United States Patent 11,078,247 (RNA ENCODING A THERAPEUTIC PROTEIN) - sequence listing, part 34

SEQ ID NO: 57930 - RNA, 1968 nt, Artificial Sequence
  derived and/or modified sequence opt3 from KATNB1__Homo_sapiens__NP_005877
auggccacccccguggucacaaagacugcuuggaaacugcaggagaucguugcacacgccagcaacguguccucucucguacuuggcaaggcgucagggagacuguuggcuacgggaggugacgauugcagggugaauuuauggaguauuaacaaaccuaauuguauaaugagccugaccggccauacauccccagucgaaucugugcggcuaaacacuccggaggaacucaucguugccgggucgcaaucaggaagcauucgcgugugggaccuggaggcagccaagauccuucgaacccugaugggccacaaagcuaauauuugcaguuuggauuuccaucccuacggugaauuugucgcauccgggucucaggacacaaacaucaagcucugggauauacguagaaagggauguguguucagguaucggggccacagccaggccguacgcugccugagauuuuccccugacggcaaauggcuggcuucagccgcggaugaccauaccguuaagcucugggauuuaacugcagggaaaaugaugagugaguucccaggacacacaggucccgugaaugucguggaguuucacccuaacgaauaccugcuugccagcgggucuuccgacaggaccauccgguucugggauuuggagaaguuucagguggucucauguauugaaggcgagccaggacccguucgcagcgugcuguucaauccugacggcugcugucuauauagugguugccaagauucucuccgaguauacgggugggagccagaaagauguuuugacgugguccuggugaacuggggaaaaguugcugaccuugccaucugcaaugaucagcugauuggcguggcauucucccagagcaacgucucgucuuaugugguagacuugacgaggguuacucggaccggcacaguggcucgugauccgguccaggaccaucgcccccucgcccaaccucugccaaaucccuccgcgccuuuaagaaggaucuacgagcggccaucaacuaccuguaguaagccccagcgagugaagcagaacagcgaauccgagcgcagaucuccgagcucagaagaugacagggaugagcgggagagucgcgccgaaauacagaaugcagaggacuauaacgaaauuuuucaaccuaaaaacuccaucagcagaacacccccaaggcguucugagccuuuccccgcuccacccgaagaugacgccgcuaccgccaaggaggcagccaaaccuucaccagcuauggauguccaguuuccggugcccaaucuggagguucucccucggccacccgugguagcgaguacgccugcaccaaaggccgaacccgcuauuaucccggccacucgaaacgagccuaucgggcuuaaagcaagcgacuuccugccagccgucaagauuccccagcaagcugaauugguggacgaggaugccaugucccagauaagaaaaggacacgacacaaugugcguugugcuaaccucuaggcauaagaaucuggauacuguccgcgcaguguggacaaugggugacaucaagaccucgguagauagcgcgguggcuauuaacgaccucuccguugucguggaucugcuuaauaucgugaaccagaaagccucacuguggaaguuggaccucugcacgaccguccugccucagauagaaaaauuacugcaaaguaaguacgagucuuacguucagacaggcuguacuagccuaaaacucauucugcagcgguuccuucccuugaucaccgauaugcuggcagccccaccuuccguggggguggacaucucaagagaggaaaggcuccacaagugccgccuguguuauaagcagcuuaaaagcauuucuggacugguaaaguccaaaaguggcuugagcggucgacacgggucuacauuucgggagcuccaucuguuaauggcuucccuggauuga

SEQ ID NO: 57931 - RNA, 693 nt, Artificial Sequence
  derived and/or modified sequence opt3 from KAZALD1__Homo_sapiens__XP_005270251
augcugcccccuccaagaccggccgcugcacucgcccuucccgugcuguuguuacugcuagucguucucaccccuccacccacaggcgcgaggccuagcccagggcccgacuaccugcggcgcggauggaugcgacuucuggcugagggugaaggcugcgccccuugucguccagaggaaugcgcagccccgagaggguguuuggcuggaagggugcgggaugcaugcggcuguugcugggagugugccaaccucgaaggucagcugugcgaccuggaucccuccgcucacuucuaugggcauuguggagagcaacucgagugccgcuuagacacuggcggcgaucugucuagaggggaaguaccugagccacuuugugccugcaggucacagagucccuugugcggaagcgacggucacacguacucccagaucugucggcugcaggaagcggcacgcgcccgaccugaugcuaaucuaaccguggcccauccaggccccugcgagucugggccgcaaauugucucgcacccuuaugacacauggaacgugacuggacaggauguuauauuuggcugugagguguucgcauaccccauggcuucaaucgaauggagaaaggacggucucgauauucagcugccaggggacgauccucauaucagcguccagggauggacccccgagguguga

SEQ ID NO: 57932 - RNA, 2628 nt, Artificial Sequence
  derived and/or modified sequence opt3 from KAZN__Homo_sapiens__XP_011539377
augagagccgcugacagcggcuccugggagagggugcggcagcuggcagcccaaggggaacccgcgccuucuugcggagcuggugccggcccagcacgcccgcccgggccugccgcuugugagcagugcgucgaugcagccggaccaggcgaccgaccccgugcugguguuccuagagugagggccgauggggacuguucacagccaguacuccuucgggaagaggugagucgccugcaggaagagguccacuuguuaagacaaaugaaggagaugcuggcgaaagaucuagaagagagccagggaggcaaguccucugaagugcucucggcaaccgagcugaggguucagcuugcccagaaagagcaagaacuggcucgggccaaggaggcauugcaggcuaugaaagccgaccgcaagcgacucaagggcgagaaaacagaucuggugucacagaugcagcaacuguacgcgacucucgagagcagagaagaacaguuaagggacuucauccggaacuaugagcagcaucguaaggaaagugaggaugccgucaaagcacuggcuaaggaaaaagaccuuuuggagcgcgaaaagugggagcugagaaggcaagccaaggaggcuacggaucacgccaccgcacuacggucccagcucgaccugaaagauaaucgaaugaaggaacuugaggccgaacuggcuauggcgaaacagucuuuggcaacacucacuaaggacgugcccaaacgccauagccuggccaugccuggggagaccguauuaaacggaaaucaggaauggguugugcaagcugaccugccacucacagccgcaauuagacagucccagcagacccuuuaccacucacauccgccccacccugccgauaggcaagcuguccgggugaguccaugccacagccgccagcccucugugauauccgacgccucagcagcggagggugauagaagcaguacuccuucugacaucaacuccccaaggcaucguacacacagccuguguaauggcgauucgcccgggccgguccagaagaacuugcauaauccuauuguucagucucuagaggaccuggaagaucaaaaacggaagaagaaaaaggagaaaaugggauuuggcuccaucucacgaguguucgcuagagguaagcagaggaaaagucucgaccccgggcuguuugaugacagcgauucccagugcucuccaacccgccagagccuuucacugagugaaggagaggagcaaauggaccgguugcagcagguagaacucgugagaacgacuccuaugucccacuggaaggccggcaccguccaagcauggcuggaggugguuauggccaugcccauguaugugaaggcuuguacagaaaacgucaaaagcggcaagguguuacugucucuaucagacgaggaucuccagcuggggcuuggaguaugcaguagcuugcacaggcgcaaacugcgacucgccauugaagacuaccgggaugcagaggcuggucguucccugucuaaggccgcggagcuugaccaucacuggguugccaaggcuuggcugaaugauaucggcuugucgcaguauagccaggcauuccaaaaccaucucguggacgggagaauguuaaauucccugaugaaaagggaucuggaaaagcaccuaaacgucaguaaaaaguuucaucaggugucaauacuccugggaaucgagcuuuuguaccaggucaauuucucucgcgaagcccugcaggagcggagagcuaggugugaaacucaaaacauugacccagugguuuggaccaaucagcgagugcucaaauggguacgcgauaucgaccugaaggaguaugccgauaacuuaacaaacagcggcguccacggugcagugcugguucuugagcccaccuuuaaugcggaagccauggcuacggccuuggggauuccuuccggcaaacacauccuccggagacaucuggcagaggaaaugucagcuguguuccacccagccaacagcacuggaauaagggaggcagaacguuuuggcacaccgcccgggcgcgccucuuccgucacccgggcuggaaaggaggagaauaguagcggucuaaaguacaaagcgggcagagugucucuguccauggaccucccuguaucaccagccgaucccgggaagguguucuuuaguccuccaggaagcucgguugcacccguccuggcuugcgaaggcggugugccggggagggugacuggcgccucccgaacagacgcccuugacgucccuucucggaacuugcaugaugcucugggaaccguucacaaagcaccagccggcuuacgcguggcgcccgggagccagucagcuggacucacgugucugcacgagaaucaucuuggucuguugcucaaccugcagauucuaggcccuacccuggugaguuggaagagauccucucucgggaggggaggcagcugcauccaacuggguugccccgaaggguccggcgccgcaccaaauucagagccucagagccuuauuaguaucugugacuucucugauuugacaaacuccaaagacgagcccagcggagauucgaaucagacuguauga

SEQ ID NO: 57933 - RNA, 1872 nt, Artificial Sequence
  derived and/or modified sequence opt3 from KBTBD11__Homo_sapiens__NP_055682
auggagcacgccguggcucccugcguccuguacccuggcaccgaaccaggggcagccggagagagcgaauccgagggugcggcuucuccggcccagacacccuguucacucggcgcaagucuuugcuucagcuccggggaagagucuccuccacaaucgcuggccucagcugcagagggagccgcuacuagcccucccaguuccggcgguccaagaguuguggaaaggcagugggaggccgggucugcgggagcagccagccccgaagaguuggcuuccccugaggaacgggccuguccagaggaaccggcagcucccucaccugagccacgcguaugguuagaagaccccgccaguccugaggagccaggcgaacccgcgccggugccucccggcuuuggggccgucuauggagagccagaucuggugcuagaaguuagcggucgacgucucagagcacauaaggcugugcuggccgcuaggucugacuacuuccgggcccgcgcauccagagauguccuuagggugcagggcguaucacugacggccuugcggcuccugcuggcugacgcguauagcgggcgcauggcaggaguucgaccugauaacguggccgaggucguggcuggcgccagaaggcuccaguuacccggugcagcccaacgggcuaccgacgccguggggccacagcugagucuugcaaauugcuacgaagucuugucugcggcuaaacgucagcgccugaacgagcuaagagaugccgcauauuguuuuauguccgaccacuaccucgagguucugagggaacccgccguguucggacggcuuagcggcgcugagcgagaucuguugcuccgcagaaggcugcgggccggccgcgcacauuuacuggcugccgcgcucgggccugccggagaaagagcugguucgaggccacagucuccguccggcgacgcagaugcccguggggacgcugccguauauugcuuucacgcagcggccggagaguggcgggaacuuacacgacugcccgagggcgcuccugccagagguuguggguugugcgugcuauacaauuaccuguucgucgcaggcggaguggcuccagccggccccgaugggagggcacgcccuucagaccaaguguuuuguuauaacccagccacugacaguuggagcgcuguucggccccucagacaggcgaggucccagcugcgccuucuggccuuggauggacaucucuacgcagucgguggcgagugccuguuaucuguggaacgauaugacccgcgggcugaucguugggccccuguagccccacugcccagaggggcuuucgcaguugcccacgaggcgaccacaugucacggagaaaucuacgugagcggcgguucacuauuuuauaggcuccugaaguacgacccucgccgggaugaguggcaggagugccccugcaguuccagcagagaaaggucugcugacauggucgcccuugauggguucauuuaucgauuugacuugucaggcagucgcggagaggcacaagccgcuggcccaagcgggguguccgucucucgguaccauugucuggcaaaacaguggucgccuugcguggcgccccucagacugccaggagguccgaccggccuucagccuuucaggugugccgcucuggauggggccauauacugcguuagccgugcaggaacuuggcgcuuucaacccgcccgggaaggcgaggcugguggggacgccggccagggaggcggguucgaagcauugggagcuccacucgaugugagaggcguacugauccccuucgccuuaucccugccugagaagccacccaggggugagcagggggcgccuuga

SEQ ID NO: 57934 - RNA, 1377 nt, Artificial Sequence
  derived and/or modified sequence opt3 from KBTBD13__Homo_sapiens__NP_001094832
auggccagaggcccccagacccuggugcaagucuggguugggggacaacucuuccaggcugacagggcacuucugguggagcacugcggguuuuuccggggcuuguuucgcagcgggaugcgagaaacacgugccgcggagguaagauuaggagugcuguccgcuggcgguuucagggccacucuacagguccuccggggugaucgcccugcacuggccgcugaagacgagcuucugcaggcaguggaaugugccgcuuuucuucaggccccagcgcucgcaagauuccuggagcauaaccugacgucugauaauugcgcccucuuaugugacgcugccgcagcuuuuggacugagggauguuuuccacucagccgcgcuuuuuaucugcgacggcgagcgggaauuggccgcagagcuggcucuaccggaagcccgcgcuuacguggccgcacuccgacccaguagcuaugccgcugucuccacccauacuccugcgccaggcuuccuggaggaugcaucuagaacacuuuguuaccuggacgaggaagaggaugccuggaggaccuuggcugcccucccccuggaagcaucgacauuacuggccgggguggcuacccucggaaacaaguuguauauuguagguggcguucguggggccucaaaagagguggucgaacugggauuuugcuacgacccugauggcgguacuuggcacgaguucccaagcccccaucagccucgguaugacacagcauuggcgggguuugauggacgccuauacgcuauaggcggcgaguuccagagaaccccaaucaguuccguggaaagguaugacccggccgcaggguguuggucuuucguggccgaccugccccaaccugcugccggagucccaugcgcacaggcuuguggucggcucuuuguuugccuguggcgacccgccgauacgacugcggugguagaguacgccgugcgcaccgacgcuuggcuuccugucgcagaacugagaaggccacagagcuacggccacuguaugguggcccaccgggauuccuuguauguugugcgcaaugggcccucagacgauuuccuccauugcgcuauugacugccugaacuuagccacaggacaguggacugcacugccgggccaauuugucaauaguaagggugcgcuauucaccgccgugguaagaggggauacaguuuacaccgugaacaggauguuuacgcuccuguaugcuaucgagggcggaacuuggcgucuuuugcgggaaaaagccggcuucccucgacccgggagccugcagacauuucuccugagacuuccaccuggagcacccgguccagucaccucuacuacagcugagcuguga

SEQ ID NO: 57935 - RNA, 1806 nt, Artificial Sequence
  derived and/or modified sequence opt3 from KBTBD8__Homo_sapiens__NP_115894
auggccgcuagcgcagaccuguccaagucuucacccaccccuaauggcaucccaaguagcgauccggccuccgacgcgauggaucccuuccacgcuugcucuauucucaaacagcuuaagacaauguacgacgaggggcaacugacugauauaguggucgaaguugaccauggaaaaacguuuucgugucacagaaauguguuggccgcaaucucaccuuauuucaggagcauguuuaccagugguuuaacagaguccacucagaaggaaguacggauugugggcgucgaggccgaaucuauggaucuggugcuaaacuacgcuuauaccagccgcguuauccucacagaggcaaaugugcaggcccuguucaccgcugccuccauuuuucagaucccaucaauacaagaccagugcgcgaaauacaugaucagucaucuugauccccagaacagcauuggggucuucaucuuugcagaccacuauggacaucaggagcugggcgaucgaucuaaggaauacauucguaagaaauucuugugugugacuaaggagcaagaauuucuccagcugacaaaagaccagcugaucuccauacucgauucagacgacuuaaauguagauagagaggagcacguuuaugaaagcauuaucaggugguucgagcacgaacagaacgagcgggaagugcaucugccugagauuuuugccaagugcauccgcuucccacuuauggaggacaccuuuaucgaaaagauucccccucaauucgcucaggccauagcaaaaaguugugucgagaaggguccaucuaauacgaacgggugcacucagagauugggaaugaccgcuuccgaaaugaucauuuguuucgaugccgcgcacaaacauagcggcaagaaacaaacagugccgugccuggacaucgugacuggcagggucuuuaagcuauguaaacccccuaaugaucuccgggagguugggauacuggugucgccagacaacgauauuuacaucgccggagguuaccgccccucuuccucagaaguaaguaucgaccacaaggcagagaaugauuucuggauguaugaccacagcaccaaccgauggcuuuccaaaccuucucuguugagagcuaggauuggcugcaagcucguguacuguugcgggaagauguaugccaucggaggccgggucuacgagggugaugggcguaauagccugaaaucaguggaaugcuaugacagucgcgagaacuguuggacaaccguuugcgcuaugccaguggccauggaauuucauaaugcagucgaguacaaggagaaaauuuauguguuacagggagaguucuuucuguucuacgagccccagaaggacuacuggggcuuucucacgccgaugacuguaccuagaauacagggccuugccgcuguuuauaaagauuccaucuacuauauugcggggacauguggaaaccaccaaaggauguucaccguggaagcauacgacaucgagcugaacaaguggacucggaagaaagauuuucccugcgaccagagcaucaauccauauuugaagcuaguccuguuccagaacaaacuccaucuguuugugcgagccacacaggucaccguggaagaacacguuuuccgcacgucuagaaagaacucacuuuaccaauaugaugacauugcugaucaguggaugaaaguguacgagaccccugacaggcugugggauuugggucggcauuuugaaugugccguagcaaagcucuacccccagugccugcagaaggucuuauga

SEQ ID NO: 57936 - RNA, 1146 nt, Artificial Sequence
  derived and/or modified sequence opt3 from KCMF1__Homo_sapiens__NP_064507
augagcagacacgagggcguguccugcgacgccugucugaaggggaacuucaggggacggcgcuacaaaugccucaucuguuaugauuacgaccuuugcgcuucuuguuaugaaucaggugcaaccacaacucgacauacgaccgaucaccccaugcagugcauucugacacgugucgacuuugauuuguacuauggcggggaggccuucaguguugaacaaccucagagcuuuacuuguccauacugcggaaagaugggcuauaccgagacauccuuacaggaacaugugaccucugagcacgcggagacuucgacagaaguaauauguccgaucugcgcugcccugcccgguggggacccuaaucaugugaccgaugacuucgcagcccaccuaacgcucgagcacagagcuccaagggaucuggacgaaucaagcggaguccggcaugugcgcagaauguuucaccccggcaggggccuugggggaccucgggcacgccgaaguaacaugcauuucacuuccucuagcaccgguggccuguccucaagucagagcucuuacuccccaucaaauagagaggccauggaucccauugcugaguugcucagccaacugagugggguuaggcggucugccggaggccagcugaacuccagcgguccuucggcgucucagcuccagcaauuacagaugcagcugcagcuugaacgucaacacgcacaggccgcucgccagcaauuggagacagccagaaaugcaacuaggcggaccaacacauccucagugaccacgacuaucacacagaguaccgcuacuacaaauauugccaacaccgaaagcucccagcagacgcugcaaaauucucaguuucuacucacccgacugaacgacccaaaaaugagcgagacagaacgccagucaauggagagugagagagcggauaggucccuuuucguccaggaacuguugcucagcacucuggugcgggaggaaucuucaaguagcgacgaggacgaucgcggggaaauggccgacuuuggagcaaugggcuguguagauaucaugccguuagacguugcucuggagaaucucaaccuuaaggaguccaauaaaggcaacgaacccccuccacccccucuguga

SEQ ID NO: 57937 - RNA, 1488 nt, Artificial Sequence
  derived and/or modified sequence opt3 from KCNA1__Homo_sapiens__NP_000208
augaccgugaugagcggcgagaacgucgacgaagccuccgcugcacccgggcacccucaggauggaucuuacccaagacaggccgaccaugaugaccacgagugcugugaaaggguugugaucaauauuucaggucugcgguucgagacacagcucaagacucuugcgcaguuuccgaacacgcuguugggcaaucccaaaaagcgcaugcgauauuucgauccuuuacguaacgaauacuuuuucgacagaaauaggccaaguuuugaugcuauacuguauuacuaucagagcgggggacggcuacgcagacccguaaacgugccucucgacauguucuccgaggagaucaaauuuuacgaacugggcgaggaagccauggagaaguucagggaggaugaagguuuuauuaaagaggaagaacggccacuucccgaaaaggaguaucaacgccaggucuggcuguuguucgaguacccugaaucuucggggccagcacgagugaucgccauuguuucagugauggucauccucauaagcaucgugaucuuuugccuggagacccugccggaacucaaggacgauaaagacuucacaggaacuguacauagaauugauaauaccacaguuauuuacaacaguaauaucuuuaccgaccccuucuucauaguggagacuuuauguauuaucugguuuuccuucgaacuggucgugagguuuuucgcuugcccuucuaagacagacuuuuucaaaaacauuaugaauuuuaucgauaucguggcaauuauaccauauuucaucacccuuggcacggagauugccgagcaggaaggcaaccagaagggggagcaagcuacuagcuuggccauccugcgggucauacgucuaguucgcguguuuagaauuuucaaacucuccaggcacucaaagggacugcagauccuuggucagacccugaaggcgaguaugcgggaauugggccuccugaucuuuuucuuauuuauugggguaauccuguucagcucugcaguguacuucgccgaggcugaagaggccgagucccauuuuucaagcauucccgacgcauucuggugggcugucgugaguaugacaacuguuggauauggcgauauguacccugugaccauaggugggaaaaucgucggaucucucugugccauugcgggcgugcuuacaaucgcccugccaguacccguuaucguguccaauuuuaacuauuucuaccaccgagaaaccgagggcgaggagcaggcacaauugcuacacgucagcucgccgaaucuggcuucugacuccgaucucucacgcagaaguagcuccacgaugucuaagagcgaguauauggaaauugaggaagacaugaacaacucaauagcccauuacaggcaagugaauauccggacugcuaacugcacaaccgccaaucagaacugugucaauaaaaguaagcugcuuacugauguguga

SEQ ID NO: 57938 - RNA, 1962 nt, Artificial Sequence
  derived and/or modified sequence opt3 from KCNA4__Homo_sapiens__NP_002224
auggagguggccauggucagcgcugaauccucuggcugcaacucacacaugcccuacggguaugcagcccaggcgagagcuagggagcgggaacgccuggcccauagucgagcagccgcugcagccgcuguugccgcggcaaccgccgcuguggagggaagcgguggcuccgggggaggcucucaccaucaccaucaaucgcguggugccuguacaucacacgacccucagagcaguagaggguccaggcggcgcagaaggcagcggucugaaaagaaaaaggcacacuaccgccagagcuccuucccacauugcucagaucucaugccgaguggaagcgaggagaaaauccuucgagaacugucugaggaagaggaggacgaagaggaagaggaagaggaggaagaggaaggcagauuuuauuacuccgaggaugaccacggcgaugaauguucauauacugacuuguuaccccaagaugaagggggagguggcuacagcaguguaagguauucugacugcugugagcggguggucauuaauguguccgggcugcguuucgagacgcagaugaagacccuagcucaguuuccugagacacuccugggagauccagaaaaacgcacucaguacuucgacccccuuagaaacgaguacuuuuucgauaggaaucggccuagcuuugacgccauacuguauuacuaucaaucgggcggucgauugaagcgcccaguuaacgugcccuucgauaucuuuaccgaagaggucaaguucuaccagcucggggaggaagcgcugcugaaauuuagagaggacgaaggauucgugagggaggaggaagaccgggcccucccugagaaugaauuuaagaaacagauuugguuacuguucgaguauccagaaucuuccucaccggcacgcggcaucgcuauuguaaguguucuugugaucuugauaagcaucgucauuuucugccuggagacacuacccgaguuuagagaugacagggaucucgugauggcccuguccgcuggcgggcauggaggucuucugaacgacaccucugccccucacuuggaaaauagcggccacacuaucuucaacgauccauuuuucauuguggagacagucuguaucguuugguuuucauucgaauuugugguacguugcuucgcaugucccagucaggcccucuuuuucaagaauauaaugaacauuaucgacauuguguccauccugccuuacuuuaucaccuuagggacggaucuggcucaacagcagggaggcgguaaugggcaacagcagcaggcgaugagcuucgcaauucuccggauaauccgacuugucagaguguuuaggauuuucaaacugucucgccauucaaagggcuugcaaauccuaggacacacucugcgggccaguaugagagagcucggccugcuuauauucuuucuguucauugggguuaucuuguuuagcuccgcuguguauuucgccgaagcagacgagccaaccacacauuuucagucuauccccgaugccuucuggugggcugucgugacuaugaccacaguaggauacggugacaugaagccgauuaccguuggcgggaaaaucgugggaucgcucugcgccauugcaggcguccugacgauagcguuaccugugcccgucaucgugagcaacuuuaauuacuucuaucacagggagacugaaaacgaggaacagacacagcugacccaaaaugcuguuuccuguccauaccuaccuucaaaccuccugaagaaauuucgcaguucuacuagcuccucacuuggugauaagagcgaguauuuggaaauggaggagggggugaaagaaucucugugcgccaaggaggaaaaaugccagggcaagggagacgacuccgagacagauaagaacaauuguaguaacgcaaaagccguagagaccgacgucuga

SEQ ID NO: 57939 - RNA, 1842 nt, Artificial Sequence
  derived and/or modified sequence opt3 from KCNA5__Homo_sapiens__NP_002225
auggagaucgcccuggugccccucgaaaacggcggggcuaugaccgucagaggaggugacgaggcaagggccggcugcgggcaggcgacaggaggcgaacuucaauguccuccaacugcuggucugagcgaugggccgaaggagcccgccccuaaaggacggggcgcacagcgcgacgccgauuccggcguucgaccauugcccccuuuaccagaccccggggugcguccucugccaccgcuacccgaagaacucccuagaccaaggcggcccccuccagaggaugaagaggaagagggagaccccggucugggcacgguagaggaucaggcucuugggaccgcaucucugcaccaucagcgcgugcacauuaauauaucaggauugagauucgaaacacaacucggcacucuggcccaguuuccgaacacccugcucggugacccugcuaagagguuacgguacuucgauccccugcgcaaugaguacuuuuucgaccgaaacagaccaaguuuugaugggauccuuuauuauuaccagagcggaggcagguugcggcguccugucaaugugucccuggacguuuucgccgaugaaauucgcuuuuaucagcuaggcgacgaggcgauggaaagauucagggaggacgagggguuuaucaaagaagaggaaaagccccucccacggaacgaguuccaacgacagguguggcugauuuuugaauaccccgagucuucgggaucagcacgcgccaucgcuauagucagcgugcuuguaauccugauuaguaucauuacauucugcuuggagacccucccugaauuuagagaugagagggaacuguuacggcauccaccggcaccccaccagccuccagcccccgcuccuggugccaauggcuccgggguuauggcgccacccucuggaccgacuguggccccucugcucccacgcacacuugcagaccccuucuucaucgucgagaccacgugugugauaugguuuacuuucgaacuguuggugagauuuuucgcuugcccuagcaaagccggcuuuuccaggaacauuaugaauaucauugaugucguugcuaucuuccccuauuuuaucacccuagguacagagcuggccgagcagcaaccagggggcggaggcgggggacagaacggucagcaagcaaugucacucgccauucugcgugugauacggcuuguacgaguguucagaaucuuuaagcugaguaggcauagcaagggcuugcagauucucgggaaaacucugcaggcuucuaugcgcgaauuaggacugcuaaucuucuuucucuucauaggcgucauucuguuuuccucagcgguguacuucgcagaggccgacaaucaggguacccacuucagcaguaucccugaugcuuuuuggugggccguugugacaaugaccacggucggguacggcgacaugcggcccaucacugugggaggcaagauuguagggucucuuugugcaaucgccggaguuuugacaauugcucugccagugccggucauaguguccaacuucaauuauuuuuaccacagagaaaccgaucaugaggagccugccguccucaaagaggagcaagguacucagagccagggccccgggcuggacaggggagugcagcgcaagguuucgggcucucgagguuccuucugcaaagcagggggcacacuugaaaacgcggauucagcucggcguggaaguuguccacuggagaagugcaaugugaaggccaaaagcaacguagacuugagaaggucccucuaugcacuguguuuagauaccucucgcgaaacggaccuguga

SEQ ID NO: 57940 - RNA, 1590 nt, Artificial Sequence
  derived and/or modified sequence opt3 from KCNA6__Homo_sapiens__XP_011519257
augagaagcgagaagucccugacccucgccgcucccggcgaagugagggggccugagggagaacagcaagacgccggugauuucccagaggcaggcgggggaggcgguugcuguucuucagaacggcuugucaucaacauuagugggcugcgcuuugagacacaguugcgaacuuuaagccuguucccggacacgcuacucggagaucccggccguagaguuagguuuuucgacccucugcggaaugaguacuuuuucgaucgcaacagaccauccuuugacgcgauacuuuauuacuaucagucuggcgggaggcugcggcgccccgugaauguaccuuuggauaucuuccucgaagagauucgauuuuaccagcugggagacgaagcucuggccgcauucagagaggaugaggguugccucccagaaggcggggaggacgaaaaacccuuaccuucgcaaccauuucagaggcaaguguggcugcuuuucgaguauccggaaucaagcggacccgcccggggcaucgcuauugucaguguguugguuauccugauauccaucgugaucuuuugucuagagacccucccucaguuccgugucgauggucgcgggggaaacaauggcggcgugucuagaguaagcccaguuuccagggggucacaggaggaagaggaagacgaggaugacaguuacacauuccaccauggaauuacucccggugaaaugggcaccgggggaucuagcucccugucaacacuuggcgguagcuuuuucaccgacccauuuuuccugguggagacuuugugcauugucugguuuacauucgagcuccuggugcgguuuagugcauguccuucuaagcccgccuucuuucgaaacaucaugaauauaauugauuuaguggcuaucuucccguauuuuauuacccuggggacggaacucguccagcagcaggagcaacagccugccuccggcggaggcgggcagaacggacaacaggcgaugagccuugcaauccugcgcguuaucagauuggugaggguauuccggauuuuuaaacuaucgcgccacucuaagggucugcagauacucggcaaaacucugcaggccuccaugagagaacuugggcuguugaucuucuuccucuuuauuggagugauccuguucucaagugcugucuacuuugccgaggcagacgaugacgauagcuuauuccccuccauaccagacgcuuuuuggugggccgugguuaccaugacaacugugggcuacggugauauguauccuaugaccgucgggggcaagauugugggaucucugugcgcgaucgccggcguacuaacaaucgcacuccccguuccagugauugucagcaauuucaacuacuuuuaucauagggaaaccgagcaagaggaacaggggcaguacacgcacgugacuuguggacagcccgcuccugaccugcgugccacagauaauggucuuggcaagccagacuucccggaggcuaaccgggaacgaagacccucauauuugccuaccccacauagggccuacgcagagaaacgcaugcugacugaggucuga

SEQ ID NO: 57941 - RNA, 1371 nt, Artificial Sequence
  derived and/or modified sequence opt3 from KCNA7__Homo_sapiens__NP_114092
auggagcccagaugcccuccaccguguggcugcugugaaaggcuggugcucaacgucgccgggcuucgguucgagacccgcgcucgaacacugggacguuuucccgacacuuuguuaggugauccugcaagaaggggccgguucuacgacgaugcccgcagagaauacuuuuucgacaggcaccggcccagcuuugaugcgguucuguauuauuaccaguccgggggacgccuacgaagacccgcucaugugccucucgacguauuccuggaggaaguggccuuuuauggccuuggugcagccgcucuggcaagguugcgggaggaugaggggugcccagucccaccugaacguccacucccgcgcagagccuucgcuaggcaacuguggcugcucuuugaguuccccgaaucuucacaggccgcgcggguguuagcaguugugaguguccuggugauccuuguaagcauuguuguguuuuguuuggagacgcugccugacuuccgagaugaccgcgauggaaccggccuagccgcugccgcagcugccggcccauuucccgcgccucucaauggguccucucagaugccaggaaaucccccgagacugccuuucaacgaccccuucuuugucguggagacacuuugcauauguugguucucguuugaacuguuggugaggcuccuggucugcccaucaaaggccaucuucuuuaaaaacguuaugaauuuaauugauuucguggcaauccugccuuacuuuguagcucucgguacugagcuugcccggcagcgcggcguggggcaacaggcuaugagccuggccauuuugagagucaucaggcuagugcguguuuuccggauauuuaagcugagucgacacuccaaaggacuccagauccugggccagacccuuagagcaucuaugagggaacuggguuugcucauuuucuuucuguucaucgggguggucuuauuuagcuccgccguguauuucgcugagguagaccgcguugacucacauuucacaaguauucccgagagcuuuuggugggcgguggucaccaugacuacagugggauacggcgauauggcaccagucaccgugggcgggaagaucguuggaucucugugugccauagcuggugugcuaacgauuucccuccccguaccugucaucgugucaaacuucagcuacuuuuaucaccgggaaacugagggcgaagaggccgggauguucagucauguugacaugcaaccaugcggaccgcuggaaggcaaagcaaauggugggcuuguggauggcgagguccccgaauugccuccaccccugugggccccuccaggaaagcaccucgugaccgagguauga

SEQ ID NO: 57942 - RNA, 1227 nt, Artificial Sequence
  derived and/or modified sequence opt3 from KCNAB1__Homo_sapiens__NP_003462
augcaccuguacaagcccgccugcgcugacaucccuagcccaaaacucggccuuccgaaguccucugagucagcacugaaauguagauggcauuuggccgugaccaagacacagccccaagcggcuugcaaaccugucaggccaaguggggccgcagaacagaaguauguugagaaguucuuacgggugcacggaauuagccugcaggaaacuacgcgcgccgagaccgguauggcuuaccgaaaccuaggcaaauccgggcuccguguaucuugucugggacuuggcacaugggugacuuuuggugggcagauaucggaugaagucgcagagagacugaugaccaucgccuaugagucaggagugaauuuguucgacacagcugaaguuuacgccgcgggcaaggcagaggugauucucggcagcaucauuaaaaagaaaggguggaggcggaguucccuggucaucaccacuaagcuguauuggggagguaaggccgaaacagagcgcggccucucuagaaaacauauaaucgagggguuaaagggaagccugcaaaggcuucaguuggaauacguggauguaguuuuugcuaaccggcccgacuccaauaccccuauggaggaaauugugcgcgccaugacgcacgucaucaaccagggcauggcaauguauugggguacuucacgauggagugcuauggagauuauggaagccuacagcguggcgagacaguucaauaugaucccacccgugugcgagcaagccgaguaccaucuguuucagagggaaaaagucgagguucagcuaccugaacucuaucacaagauaggggugggagcaaugaccuggucuccacuggcuuguggcauuaucuccggcaaauacgggaacggaguaccggagucaagccgggccagucuuaagugcuaucaguggcugaaagaacguauugugucugaggagggucgcaagcaacagaauaaguugaaagaucucucccccaucgcugaaagacugggcuguacauuaccucagcuggccgucgcauggugccucaggaacgagggggugagcucgguucuucugggaucuuccacuccagaacaauugaucgagaaucuaggcgccauucaggugcugcccaagaugaccucacacgucgugaacgaaauagacaauauccuccggaacaaaccuuacaguaagaaagauuaucgaagcuga

SEQ ID NO: 57943 - RNA, 1203 nt, Artificial Sequence
  derived and/or modified sequence opt3 from KCNAB2__Homo_sapiens__XP_011540622
augcugagcaugaccuacuccgagucucucagaucagugaguuccaggugccacagcgaaugggcccuucaucccguccggcagacagacacucuggaguugcaacgcuuacgagaaguucgugcugcagcccaggcgagaaacauggagucuuuccugaggaugcacggccuaucgcucgauggguguacggcucagcggaccggaaugaaguaucgcaaucuggguaaaucaggccuuagagugagcugccugggguugggaacauggguaacuuuuggcggucagaucaccgacgaaauggccgagcaacucaugacacuggcauacgauaacgggauuaaucuguucgacaccgccgagguguaugcugcaggaaaggccgaagucgugcucggcaacauaaucaaaaagaaaggcuggaggcggaguuccuuaguuauuacuacaaagaucuuuuggggagggaaggcugagaccgaacgcggucugucucgaaaacauauuaucgagggccuuaaggccagcuuggagagacugcagcuagaauacguggaugucguguucgcgaauaggccugacccaaacacgccgauggaggaaacuguacgggcaaugacccacguuauaaaucaggggauggccauguauuggggaacaucccguuggucaaguauggagaucauggaggcuuacagcguggcccgccaguuuaaccucacucccccuauuugugaacaagcagaguaucauauguuccagagagaaaaagucgaggugcagcugccagaacuuuuucacaagaucggcgugggugcuaugaccuggucuccccuggccugcgggauugucuccggaaaauacgauucaggcaucccuccauacagcagggcgaguuugaagggcuaucaguggcucaaggacaaaauacugucugaggaagggcggcgacaacaggccaaguuaaaagagcugcaggcaauugcugagcgccucggauguacacuuccccaacuggccaucgcuuggugcuugagaaaugaagguguuuccagcgugcuacugggcgccucgaacgcagaucagcucauggagaauauuggggccauccagguacugccuaaacuuucuuccucaaucauucacgaaauagacaguauccugggaaacaagccauacagcaagaaagauuauagguccuga

SEQ ID NO: 57944 - RNA, 1215 nt, Artificial Sequence
  derived and/or modified sequence opt3 from KCNAB3__Homo_sapiens__NP_004723
augcaagugagcaucgccugcaccgagcagaaccugagauccaggucuucagaagaccggcucuguggcccccgcccugggccaggagguggcaaugggggaccggcuggcggugggcacggaaaucccccuggcggcgggggaagugguccaaaggcacgagccgcgcuugucccccguccuccagcucccgccggcgcacugagagagagcacagggaggggaacuggcaugaaauaccggaacuuggguaaguccggguuacgcguuucuugccugggacuaggcacgugggugaccuucggcucgcagauuucagaugaaacagccgaggacguacucacuguggcuuaugaacauggggucaaccuguuugauaccgcagagguguacgccgcuggaaaagccgagagaacacuugguaauauacugaaaagcaagggcuggaggcggaguuccuauguuaucaccacuaagauuuucuggggagggcaggcggaaacagagcgcggcuugucucgaaagcacaucauugaaggucucagagggagccuggagaggcugcagcucggcuacguggacaucgucuuugcaaaccgguccgauccuaauuguccaauggaggaaauagugcgugccaugaccuauguaaucaaccaaggauuagcucuguacuggggcacgucacgcuggggagccgcagagauuauggaggcuuauaguauggccagacaguucaaucuuaucccgcccguuugcgaacaggcggaacaucacuuguuucagagggagaaaguggagaugcaacugccugaacuauaccauaagauuggggucgguagcgugacuugguacccacucgccuguggccugaucaccucuaaauaugacgggcgggugcccgauacaugccgagcauccauaaagggauaccaguggcuuaaagacaagguccagucagaggauggcaagaaacagcaagcuaagguuauggaccuguugccuguggcccaccagcucgguuguacuguagcucagcuggccauugcauggugcuuacgcagcgaaggggugaguucuguccugcucggcguguccagcgccgagcaacuuaucgaacaccugggagcuuugcagguucuaucgcagcugaccccacagacagugauggagauugauggccuccuggggaacaaaccccauucuaagaaauga

SEQ ID NO: 57945 - RNA, 2577 nt, Artificial Sequence
  derived and/or modified sequence opt3 from KCNB1__Homo_sapiens__XP_011527101
augcccgccggcaugaccaagcacgggagcagauccacaucuucacugccuccagagccgauggaaaucgugaggaguaaggcuugcagccggcgcguccgacucaacguuggaggucuugcacaugaggugcuguggcguacuuuggacagauuacccaggacgcggcugggcaagcuacgcgauuguaauacccacgacucccuccuggaaguaugcgaugacuacucucuugaugacaacgaguauuucuuugauagacauccuggggccuucacaucgauucugaauuuuuacaggacuggacgguugcacaugauggaagagaugugugcgcucucauucagccaggagcuggacuauuggggcauagaugaaaucuaccuggagaguugcugucaagcucgcuaucaucagaaaaaggaacagaugaacgaggagcucaaacgagaagccgagaccuuaagagaaagggagggugaagaguuugacaauacaugcugugcagagaagcggaagaaacugugggaucuuuuggaaaagccaaacuccucuguggccgcuaaaauucuggcaaucauuagcaucauguucauaguccuauccaccaucgcccucucacugaauacucuucccgagcugcagaguuuggacgaauuugggcaaagcacagauaacccucagcucgcucacguggaggccguuugcauugcgugguucaccauggaauaccuguuacguuuucugucuuccccaaagaaauggaaguucuuuaagggaccccucaaugcaaucgaccuucuggccauuuugccuuauuacgugacgaucuuccuaacugagucaaacaaaagcguccugcaguuucagaaugugcgcagaguaguucaaauauucaggauuaugcggauccuccgcauucugaaacuugcucgacacaguaccggccugcagucuuugggcuucacacucagaagguccuacaacgagcugggguuacugauccuauuucucgccaugggaaucaugauuuucagcucgcugguguuuuucgcagaaaaagacgaggaugacacuaaguuuaaaucuauaccagcuuccuucuggugggccaccaucacaaugaccacggucgguuauggcgauauuuacccgaagacucuuuuggggaaaaucgugggaggccuguguugcauagcgggugugcucgucauugcccugcccaucccuaucauuguuaauaacuuuucagaguucuauaaggagcagaagcggcaggaaaaagcaaucaagcgcagagaggcucuugagagggccaaacguaaugggaguauugugagcaugaacaugaaggacgcuuuugcccgguccauagaaaugauggauaucguaguggagaaaaacggagaaaauaugggcaagaaggacaaaguccaagauaaccaucugucuccaaauaaguggaaauggacaaagcgaaccuugagcgagacuucaaguuccaagagcuucgagacaaaagaacagggcucucccgagaaggcaagaucaaguagcuccccucagcaccucaacgugcaacagcuggaagacauguacaauaaaauggccaagacccagucucagccaauuuuaaacacgaaagagucggcugcgcaaagcaagcccaaagaagaacuggagauggaauccaucccgucaccuguugcaccccuaccaaccaggacagagggggugaucgauaugcgcaguaugucuagcauugacuccuuuauaucaugugccacugauuucccugaagcuacccgguuuagccauucuccccucacaucccugccaaguaagacuggagguagcaccgcccccgaggucggcuggagaggggcacuuggagccucuggcgguagguucguggaagcuaauccuuccccagacgccucacagcacaguagcuucuuuaucgagucgccgaaguccucuaugaaaacaaacaaucccuugaagcugcgcgcacucaaaguaaacuucauggagggggacccuagcccacuguuacccguucugggcauguaucacgauccucuucgaaaucggggaucagcggcugccgcaguggccggcuuggaaugcgcuacccuccuggacaaggccguccuaaguccagaguccucuauuuacacuacggcaagcgcuaaaacacccccgcguuccccugaaaagcauaccgccaucgcguuuaacuucgaggccggggugcaccaguauauugaugcugacacugaugacgaaggacagcugcucuacucagucgauagcaguccacccaaaucucugccugguuccaccagccccaaguuuucgacaggcaccagaucagagaagaaucauuucgagucuaguccacuuccuacuucccccaaauuuuugaggcaaaacugcaucuacagcacagaagcacugacggggaagggaccaucuggccaggagaaauguaaguuagaaaaucacauaagcccggacgugcgcguucucccuggugggggcgcccauggauccacccgggaucagucaaucuga

SEQ ID NO: 57946 - RNA, 2736 nt, Artificial Sequence
  derived and/or modified sequence opt3 from KCNB2__Homo_sapiens__NP_004761
auggccgagaaggcucccccuggccugaacagaaaaaccagcagguccacacucucucuuccaccggaacccguggacaucauucggucaaagacuugcagucgccgagucaaaauaaauguugggggacugaaccacgagguguuguggcguacguuagauagacugccuaggacccggcuagguaagcuccgcgacuguaauacacaugaaagccugcuugagguaugcgaugacuacaaccugaaugaaaacgaguauuucuuugauagacacccaggcgcauucacuuccaucuugaauuuuuacaggaccgggaaacuccauaugauggaggaaaugugugcccugucuuucggacaggagcuggacuauuggggcauugaugaaaucuaccucgagucgugcugucaagcgcgguaucaccagaagaaggagcagaugaacgaagaguuacgccgagaagcugagacaaugagagaaagggagggugaggaauuugacaauaccugcugucccgauaaacggaagaaacugugggaccuuuuggagaagccuaacucaagcguggccgcaaaaauucuggccaucgucaguauacuauucaucgugcucuccacuauugcucugucucuuaauacacugccagaauugcaggagaccgaugaauuugggcaacucaacgacaaucgucagcuggcacauguugaggccgugugcaucgcuugguucacgauggaguacuuacugcgcuuucucagcucccccaacaaguggaaguucuuuaaaggaccucuuaaugucauugaucuguuggccauccuaccauauuacgugacuauauuccugaccgaaucaaacaagaguguacuccaguuucagaacguuagaagggugguccaaauuuuccggaucaugcgcauucugcgaauccuuaaacuggcgagacacagcacaggcuugcagucucucggcuucacucugaggcgguccuacaaugaguuagggcugcuaauccucuuucuggcaaugggaauuaugauauucucaagccuuguguuuuucgccgaaaaggacgaggacgcuaccaaauuuacaaguaucccggccucuuucuggugggcaaccauuacgaugacuacaguggguuauggcgauaucuaccccaagaccuugcuggggaaaauagucggaggccucuguugcauugcugguguucuggugaucgcccuuccuaucccaauuaucguaaacaauuuuuccgaguucuauaaggagcagaagcgccaggagaaagcgauuaagagaagggaagcccuggagcgugcaaaacggaacgggagcauagugucgaugaauuugaaggacgcuuuugcccgaucuauggaacucaucgaugucgcuguggagaaagccggagaguccgcaaacacuaaggacucagccgaugacaaucaccugagucccagcagauggaagugggcuaggaaagcguuauccgaaacaucuagcaacaagucauucgagaauaaauaccaagaaguuagucagaaggauucccaugagcagcugaacaauaccuccucuucaaguccucaacaccuaagcgcacagaaacucgaaaugcuguauaacgagauuacgaagacccagccacauucccaccccaauccggacugucaggagaagccugaacgccccucugccuacgaggaagagaucgaaauggaggagguggucugcccacaagaacagcuugcuguggcccagacagagguaaucguugauaugaaaucgacuagcuccauugacucauuuaccaguugcgcaacagauuucacugaaaccgagcggucuccuuugcccccacccagcgccucccaucugcagaugaaguuuccuacagaccucccaggcaccgaagaacaccaaagagcuaggggcccgcccuuccugacuuuaucacgcgagaaagggccugccgcacgagacggaacgcuggaauaugcgccaguggauauaacagucaaccuugacgcuagcgguucucaguguggcuugcacagcccccuccagagugauaaugccaccgacagcccuaagucuucccugaaagggucaaacccacuaaagagucggagccugaaggugaacuucaaagagaaucguggaucggcaccccagacuccgccuuccaccgccagaccacuccccgucacaaccgcugauuuuucucugacuacaccucaacauaucagcacgauucuuuuggaagagacccccucacagggcgacaggccacuguuagguacugaggugagugccccuugccaggggcccuccaagggccucucuccacgcuucccgaaacagaagcuguuuccuuucagcucccgggaaagaaggucauuuacagagaucgauaccggagacgaugaagacuuccuugagcugcccggcgcacgagaagagaaacaaguugauagcaguccaaacuguuuugcugacaagcccucugaugggcgcgacccuuugcgggaggaaggauccguggguagcucgucaccacaggacacaggccacaauugcagacaggauauuuaccaugccguaucugaggucaaaaaggacaguucccaagaaggguguaagauggagaaccaccucuucgcgcccgaaauccacagcaauccuggagauacuggcuacugcccgaccagggagacgucuauguga

SEQ ID NO: 57947 - RNA, 1758 nt, Artificial Sequence
  derived and/or modified sequence opt3 from KCNC1__Homo_sapiens__NP_001106212
augggccagggggacgagagcgaaagaaucgugauuaacgucggagguaccaggcaccaaacauaccgguccacucugcgcacgcuccccggcacccgacuugccuggcuggcugagccugaugcacauucucacuucgacuaugauccacgugccgacgaauuuuucuuugauagacauccggggguuuucgcgcacauauugaauuacuauaggacaggaaaguuacauugccccgcugacguguguggcccucuguacgaggaggaacuagccuuuugggguaucgaugagacugacguagaaccaugcuguuggaugaccuaucggcagcaccgcgaugcagaggaagcccucgacucauucgggggagcuccccuggauaacagugcagacgaugccgacgcugacggcccuggcgauagcggggacggagaggaugagcuugaaaugacaaaaagacuggccuuguccgacucuccagaugguaggcccggcggguuuuggcggcgcuggcagccucgaauuugggcguuguucgaggacccauacucgucaagauaugcaagguacguggccuuugcuagccuguucuuuauccuggucaguauuaccacuuucugccucgaaacacacgagcgguuuaauccgaucgugaacaagaccgaaauagagaauguucguaacggaacucaggugcgcuacuauagagaggccgaaacggaggcauucuuaaccuacaucgaaggcgucugugugguaugguucacauuugaguuccugaugaggguuauuuucugccccaauaaaguggaauuuaucaagaacucccuuaauauuaucgauuuugucgcuauauugccuuucuaucuggaggugggucuaucugggcucagcuccaaagccgcgaaggacgugcugggauuucuucgggucguucgauucgugcgcauucugagaaucuuuaaguugacuaggcauuucguaggccuccgggugcugggccacaccuuacgcgccucaacaaacgaguuucugcuccuuauuaucuuccuggcauuggggguccuaaucuuugcuaccaugauuuacuaugccgaaagaauaggagcucaaccaaaugaucccagugccagcgagcauacgcacuucaaaaacaucccuauugguuucuggugggcagugguuacuaugacaacccugggcuacggggacauguauccacagacuuggucuggaaugcucgugggcgcccugugugcucuugcggguguccugacaaucgcaaugcccgugccgguaauaguuaauaacuuugggauguacuacuccuuggccauggcuaagcagaaacucccuaagaaaaagaagaaacacauucccaggccaccucagcugggcucacccaauuauugcaagagcguggucaacaguccacaucacucuacccaauccgauacgugucccuuagcccaggaagagauccuggaaaucaaccgugcagacagcaaacuaaauggagagguggccaaggcugcccucgcaaacgaggacugcccucauauugaucaggcgcugaccccagacgaaggccuuccguucacacggucggggacucgagagagauacggacccuguuuucuccugucuaccggugaauaugcuugcccuccaggcgggggaaugaggaaagaucucugcaaggagucccccgucaucgccaaauacaugccuacagaggcagugcgcguuacuuga

SEQ ID NO: 57948 - RNA, 1890 nt, Artificial Sequence
  derived and/or modified sequence opt3 from KCNC2__Homo_sapiens__NP_001247427
augggcaagaucgagaacaaugaaagagugauucugaacgucgggggaaccaggcacgagacauaccggagcacucucaaaacgcuucccgguacccgccuggccuuguuagcuuccucugaaccuccaggcgacugccugacaacugcaggggauaagcuacagccgucacccccuccacucagucccccuccacgagcgcccccucugagcccaggaccgggcgguuguuucgaagggggagccggcaauugcuccucucguggcgggagagcuucggaccaucccggagguggcagggaauuuuucuuugaucggcacccugggguuuucgccuaugugcuuaacuacuaucgcaccggaaaacugcauuguccagcagacguaugcggccccuuguuugaggaggaacucgccuucugggguauagaugagacagacguggaaccuuguugcuggaugaccuacagacaacacagggaugcugaggaggcacuggacaucuuugaaacuccagaucugauugggggagaccccggcgaugacgaggaucucgccgcuaagcgguuaggcaucgaagacgccgcggggcugggagguccggacggcaaaucagggcgcuggcgaagacuucagccuaggaugugggcauuguucgaggaucccuauagcagucgggccgcucguuuuauugccuucgcaucccuguuuuucauccuagucucuauaacaaccuuuugucucgaaacgcaugaggcuuucaauaucgugaagaacaagacugagccaguuauuaauggaaccagcgugguccugcaguacgaaaucgagacagacccugcccuuacuuauguggaaggcguaugcguugugugguucaccuuugaguuccugguccgcauuguguuuucccccaacaaauuggaguucaucaagaaucuccugaacauaauugauuuuguggcgaucuuaccauucuaccuggaggucggucucucagggcuuaguagcaaagccgcaaaggacguucugggcuuuuugagagugguaagguucgugcggauucuacgaaucuuuaaacugacacgccacuucgucggacucagagugcugggccacacccuuagggcuucuacgaaugaguuucuguugcucaucauuuuccuggccuuagggguucugauauuugcuacuaugaucuacuaugccgaacgggugggagcacagcccaacgauccuuccgccucagagcauacacaauucaagaauauuccaaucgguuucuggugggcugucgugaccaugacuacacuaggcuacggggacauguauccgcagaccuggagcggaaugcucguaggcgcgcugugugcacuugccgguguuuugacgauagcuaugcccgugccugucauugugaacaauuuugggauguacuauagucuggccauggcaaagcagaaacucccacgcaagcggaaaaagcacauucccccugccccacaggcuucuucccccaccuucugcaaaacagaacugaacauggccuguaacagcacucaaucggauaccugccuuggcaaggacaauaggcuguuggagcauaaccguucuguccucuccggagaugacucaacaggcagugaaccgccucugagcccacccgagcgguuaccuauccgaagauccucuacuagggauaaaaaucgcagaggggagaccugcuuucugcuaacaaccggagacuacacuugugcaagcgacgguggcaucagaaaggugcucuauaggaucuaccacgggcugcuuacggcggaaaagggaacaguugaguucucacacaccaaagauuacacuggcaaccgcuugcugcuccugaaugugcccuga

SEQ ID NO: 57949 - RNA, 2274 nt, Artificial Sequence
  derived and/or modified sequence opt3 from KCNC3__Homo_sapiens__XP_006723266
augcugagcuccgugugcgucucuucauucagaggcaggcagggggccaguaagcaacagcccgcuccuccaccgcagcccccugagagcccacccccuccaccccucccuccacagcaacagcagccggcacagcccggaccugccgcguccccagcuggucccccugccccacggggccccggggaccgccgagcagaaccguguccuggacuucccgccgcugcaaugggccgucacggugggggaggcggcgauucugggaaaaucguuauuaacgugggagguguaagacaugagaccuacaggucgacacugcggacuuugccaggcacgcgcuuagccgggcugaccgaaccugaggcugccgcgagauuugacuaugaucccggagcagacgaguucuuuuucgauaggcacccaggcguguuugccuacguccuaaauuauuaccggacagguaagcuccauugccccgcugacgugugugggccucuguucgaagaggaacuuggauuuuggggcauagaugagacugacguugaagccugcuguuggaugaccuaucgccaacaccgagaugcagaggaggcucuggacucauucgaagccccagauccggcgggcgccgcaaacgcugccaaugcugccggggcacaugacggagguuuggaugacgaggccggcgcugggggaggcggucucgacggggcgggcggagaacugaaaagacugugcuuucaggaugcaggcgggggagccgguggcccuccugggggagcuggcggugccgggggcacaugguggaggcgguggcagccacgugugugggcacucuucgaggaccccuacagcagucgcgccgcuagauaugucgccuuugcauccuuauucuuuauccugauuucuaucaccacuuucugucuugaaacacacgagggauucauucacaucagcaacaagaccgugacgcaggcguccccuauaccaggcgcucccccggagaauaucacuaacguagaaguugagaccgaacccuuuuugacauacguggagggggucugcguggugugguucacuuuugaauuucugaugaggauuaccuucuguccagauaaagucgaguuccuaaagucaagucucaauaucauugacugcguugccauccugcccuuuuaccuugaggugggacugagcgguuugucuuccaaggcagccaaagauguacucggcuuccugcgggugguccgauuugugcgcauauuaagaauuuucaagcugacaaggcauuuuguugggcuccgggugcuuggacacacccugcgcgcuucaacgaacgaguucuugcuacugaucauuuuucucgcccugggcguccuuaucuucgcaacuaugaucuauuacgcugaaagaauuggugccgacccugaugacauacuggggagcaaucauacauauuucaaaaacauccccauuggcuuuuggugggcggugguaaccaugacuacauugggauacggcgauauguauccaaagaccuggagugggaugcucguuggagcccugugugcuuuagcaggcgugcugacgaucgccaugccuguccccgugauagucaauaacuucgguauguacuauucucuagcuauggccaaacaaaagcucccaaagaaaaagaauaaacacauuccgaggccuccccagccagggucccccaacuacugcaagccugacccacccccuccgccacccccucacccacaucacggaagcggcgguaucucgcccccuccgcccaucaccccaccuucuaugggcgugacaguugcaggggcguaccccgccggaccacauacucacccuggccugcuucgugggggagcuggcgguuuggggauuaugggacugcccccacucccggccccuggcgaacccugcccacuggcacaggaggaagugaucgagauuaaucgggcugauccccgaccuaacggugacccagccgcagccgcucuugcgcaugaggacugucccgccauagaucaaccugcaauguccccggaagacaaaucaccaaucacccccggcaguagagggagguauagccgcgaucgggcuugcuuucuguugacagacuacgccccuucccccgauggaucuauuagaaaggccacuggcgcuccaccucugcccccacaggacuggaggaaaccugggccgcccagcuuccucccagauuuaaacgcaaaugccgcggcuuggaucucaccuuga

SEQ ID NO: 57950 - RNA, 1893 nt, Artificial Sequence
  derived and/or modified sequence opt3 from KCND2__Homo_sapiens__NP_036413
auggccgcuggcguggcagccuggcugcccuucgcgagagcugccgcaaucggguggaugccugucgccagcggaccaaugccggcucccccuaggcaggagcggaagcgcacccaagacgcacucauuguucuuaacguguccgguacacgauuucagacuuggcaggauacgcuggaacguuacccagacaccuuguuagguucuucagagagagauuucuuuuaucaccccgaaacacagcaauacuucuuugacagggauccugacauauuccggcauauccugaauuuuuaucgcacugggaaacuacacuacccaagacaugagugcauuagugccuaugaugaggaacucgcuuucuuuggacugauccccgagauuaucggcgacuguugcuacgaagaguauaaggauaggcggcgcgaaaacgccgagcgacuucaggacgaugcggacaccgauacagcaggcgagagcgcccugccuaccaugacugcuagacagaggguauggcgggccuucgaaaauccacacacauccaccauggcauugguguuuuacuacgucacgggguucuuuauagcugugucuguuaucgccaacguggucgagacugugccguguggaucgucacccggccauauuaaagaacucccuugcggcgagcguuaugcgguagccuucuucugucuggacaccgcaugcguuaugaucuuuacaguggaauaccugcuccgcuuagcugccgcuccaagcagauauagguucguccggagugugauguccauuaucgacguggucgccauacugcccuacuauauugggcuuguuaugacugauaaugaggacgugucuggagcauuuguaaccuugcgaguguuccgcgucuuuagaaucuucaaguuuagcaggcacucccagggucugcggauucuaggcuacacacucaaaucaugugccagugagcugggguuccuucuguuuagcuugaccauggcuaucaucauuuucgcgacggugauguuuuaugcagaaaagggaucuuccgccucaaaguucacuagcauaccugcugccuuuugguacacaaucguuaccaugacuacacucggcuacggugauauggugccaaaaaccauugcagggaagaucuucggaaguauaugcucucuguccggcgucuuagugauugcccugcccguaccgguuaucgugagcaacuucucgcgcaucuaucaccaaaaucagagagcugacaaaaggcgugcccagaagaaagcacggcucgcgcgaauuagagcugccaagucuggcuccgcaaacgccuacaugcagucaaagaggaaugggcuucugaguaaccaauugcagagcuccgaggaugaacaggcuuuugucucuaaaagcggaucaaguuucgagacgcaacaucaccaucuacugcacugucucgaaaagaccacaaaucacgaguuuguggacgagcaggucuucgaagaguccugcauggaaguggccacuguuaaccgcccuagcucucauucacccagucugagcucccagcagggugugaccucuacauguugcucgcggagacacaaaaagacuuuuaggaucccaaaugcaaacguaagcggcucccaucaagggucaauucaggagcuuaguaccauacagauccgcugcgucgaacgaacaccucugucuaauagccgguccucauugaacgcuaaaauggaggagugugugaagcucaacugcgaacagcccuauguuaccacugccauuaucagcaucccaacgcccccugugacaaccccagagggagaugaccguccggaaucucccgaguacuccggcgguaauauugucagagugagugcgcuguga

SEQ ID NO: 57951 - RNA, 390 nt, Artificial Sequence
  derived and/or modified sequence opt3 from KCNE1__Homo_sapiens__NP_001257334
augauccugagcaacaccacagccgugacucccuuccucacgaaacuuuggcaggagaccguccaacagggcgggaauauguccggacuggcuagaaggucuccucggucaagugacgguaaguuggaagcauuauacguucugauggugcuaggcuuuuucggguuuuucacacucggaauuaugcugagcuauauacgcuccaagaaacuugagcacucuaacgauccauuuaauguauacaucgaaucggacgccuggcaggagaaggauaaagcguaugugcaggcucgaguccuggaaucauaccguagcugcuaugugguugagaaccauuuggccauugagcaaccgaauacucaccuccccgaaaccaagccuaguccauga

SEQ ID NO: 57952 - RNA, 372 nt, Artificial Sequence
  derived and/or modified sequence opt3 from KCNE2__Homo_sapiens__NP_751951
augagcacccuguccaacuucacacagacucucgaggacguguuuagaaggaucuucauuacguacauggauaauuggcggcaaaacaccacagccgaacaggaggcacuucaggcuaaggucgacgccgaaaauuuuuauuacguuauacuguauuugauggugaugaucggcauguucucuuuuauuaucguagcgauuuuagugucaacugucaaaaguaagcgccgagagcacagcaacgaucccuaccaucaguauaucguggaagacuggcaagagaaauacaagucccagauacugaaucuagaggaaucuaaagcuaccauccacgagaacauuggggccgcaggauucaagaugucgccuuga

SEQ ID NO: 57953 - RNA, 312 nt, Artificial Sequence
  derived and/or modified sequence opt3 from KCNE3__Homo_sapiens__NP_005463
auggagaccacaaacggcacugaaacgugguacgagagccugcacgccgugcucaaggcucuuaaugcaacccugcauuccaacuuguuaugcagacccgggccuggacuggguccagacaaucagacagaagagaggcgggccucucuaccgggccgcgaugacaacucauauauguacauccucuucgucauguuucuguucgcgguuacuguggggagucuuauucugggauauacccgaagccguaaaguagauaagagauccgaccccuaccacguguauaucaaaaauagggucucuaugauauga

SEQ ID NO: 57954 - RNA, 666 nt, Artificial Sequence
  derived and/or modified sequence opt3 from KCNE4__Homo_sapiens__NP_542402
augcacuuccugaccaucuaccccaacugcagcuccggcguggucagagcccagucuaggacagagcaaaagaauccucucgggcuugacgaucuggggauucagaacuugggucagacuguuucauuagcuccagcaguggaagccgcgaguaugcugaaaauggagccgcuaaauagcacgcaucccggcaccgcugccuccucuucgccucucgaaucacgggcagccgggggaggcagcgguaacgggaaugaguauuuuuacauacugguagugaugaguuucuauggaaucuuucuuauuggcaucaugcugggcuacaugaaguccaaacgccgagaaaagaaaucuagcuugcuccugcuguauaaggacgaggagcgucucuggggagaagcuaugaagccauuacccgucguguccggacugagaucaguucaggugccucuuauguugaacaugcugcaagagagugucgcaccagcccuaagcuguacacucugcucuauggaaggugauuccgugucaagcgagaguucuucccccgacguacaccugacuauucaggaggaaggcgcugaugacgagcuugaagagaccagcgaaacaccucugaaugagucgucugagggguccucagaaaacauccaucagaauaguuga

SEQ ID NO: 57955 - RNA, 429 nt, Artificial Sequence
  derived and/or modified sequence opt3 from KCNE5__Homo_sapiens__NP_036414
augaacugcagcgagucccagagacugaggacccuccuuucucggcuguuguuagaacugcaccaucgcggcaaugccucagggcuaggagcugguccccgaccuaguaugggcauggggguggucccagacccguucguuggacgugaggugacaagcgcaaagggcgaugacgccuaccucuauauccugcuuauuaugauauuuuacgcgugucuggcugguggguugauccucgccuauacuagauccaggaaacugguagaagcaaaggaugagcccucucaagccugcgcugaacacgagugggcaccuggaggcgcccugacggcugacgccgaggcggcagccggcucgcaggcugaagggcggcgccagcucgccucagagggauuaccagcacuggcucagggugccgaaagaguguga

SEQ ID NO: 57956 - RNA, 1311 nt, Artificial Sequence
  derived and/or modified sequence opt3 from KCNG3__Homo_sapiens__NP_579875
augaccuucggcagaagcggggccgcuuccgugguccugaacguuggaggugcaagguacucucucucacgggagcuucugaaggacuuucccuugcgccgagugagucguuuacacggcugcagaagcgaaagggauguacuggaggugugugacgauuaugaccgggaacgcaaugaguacuucuuugauagacauuccgaagccuucggguuuauccuacucuaugucaggggacacggcaaacugcgguucgcgccucgcaugugcgagcuuucuuuuuacaacgagaugauuuauuggggucuggaaggggcucauuuggaguacuguugccagcgaagacucgacgauaggaugucggacacauauacuuucuacucagccgaugaaccaggagugcugggccgggacgaggcacguccgggcggggccgaggcugcacccagccgcagauggcuggaaaggaugcggcgaacguuugaggaaccuaccaguucccucgccgcucaaauauuagccucuguuagcguggucuucgugaucguauccaugguugugcugugugcgucaacacuuccagauuggcgcaaugcagccgcugacaacagaaguuuggaugacaggagccgguacucugccggacccggucgcgagccuuccggcauuaucgaagcaauuugcaucgggugguuuacugcugaguguauagucagauucaucgugucaaagaauaaaugcgaguuugugaagaggccacugaacauuaucgaccuacucgccauuacccccuauuacaucagcguccugaugacaguuuucaccggagaaaauagucagcuucagcgugcgggcgugacucugcggguauugcgaaugaugagaauauucugggugauuaaacucgccaggcacuuuaucggucugcagacauuagggcugacccucaagcgcuguuaucgggagauggucaugcuucugguguucauuugcguugcaauggcuaucuuuucugccuugucccaacuacuggaacauggacucgaucuggagacgagcaacaaggacuucacuucgaucccugcugccuguuggugggugauuauaucuaugaccacagucggcuacggcgauauguauccaaucacugugccggggaggauucuuggagguguaugcguuguguccggcaucguccuguuggcacuccccauaaccuuuauuuaccacucauucgugcagugcuaucacgaacugaaauuuagaagugcccgcuacagccgauccuuaucuacagaguuccugaauuga

SEQ ID NO: 57957 - RNA, 1560 nt, Artificial Sequence
  derived and/or modified sequence opt3 from KCNG4__Homo_sapiens__NP_758857
augcccaugccuagcagagacggcgggcugcacccaaggcaucaccauuacggaucccacucuccguggucacagcuccuuaguagccccauggagaccccuuccaucaagggucuguauuaccggcgcgugcgaaaagucggcgccuuggaugcuucuccaguugacuuaaagaaagaaauucugauaaacguagggggacguagauaucuacuccccuggucgacacuggauagguucccucuuucacggcugagcaaguugcgccucugcagaaguuacgaggaaaucguacaacugugugacgauuaugacgaggauucccaggaauuuuucuuugacaggucuccaagcgcauucggcgugauugucuccuuucuggccgcggguaaacucguguuacugcaggagaugugcgcucuuucauuccaggaggaauuggccuacugggggaucgaggaagcacaucuggagcgguguugccuacgcaagcuccugcgaaaacuugaggaacuggaggaauuggccaagcuccacagagaggauguucugaggcaacagcgggaaacucgucgccccgcuagucacagcucuagauggggauuauguaugaauaggcugcgggagaugguggagaacccucaguccggccucccaggcaaggucuuugcaugccuuucaauucuguucguggccacgaccgcugugagcuuguguguuaguacaaugccggaccuacgagccgaagaggaucagggggaaugcucucgcaaauguuauuacaucuuuauaguggagacuaucugcgucgcgugguucucccuggaauuuugucucagauucgugcaagcacaggacaagugccaguuuuuccagggaccccugaauauuaucgauauucuugccaucagcccuuacuaugugucgcuggcugucucugaggagccacccgaagacggugagaggccuuccggcucaaguuacuuggaaaaaguugggcucgugcugcggguauuacgcgcccugagaauacuauaugugaugaggcucgcacgucauagccugggacuucaaaccuugggccugacaguccggcgaugcaccagagaguucggucuccugcuucuguuuuuggcuguggccauuacucucuucuccccacugguuuacguggcggaaaaggagucugggagggucuuagaguuuacaagcauccccgccucauauuggugggcaauuaucaguaugaccacggugggauacggcgacaugguaccgcgcuccguuccuggccagaugguggcucugagcucuauccuaucagggauucucauaauggccuuccccgcuaccaguaucuuucacacuuucagccauuccuaucuggaacuuaagaaagagcaggaacaauugcaggcccggcugagacaccuccagaacacaggaccagcaucugagugugagcuguuagauccucacgucgccucggaacaugagcugaugaaugacgugaacgaucuuauuuuggaaggucccgcucucccaaucaugcacauguga

SEQ ID NO: 57958 - RNA, 2889 nt, Artificial Sequence
  derived and/or modified sequence opt3 from KCNH1__Homo_sapiens__NP_002229
augaccauggccggcgggagaaggggacugguggcuccccagaacacauuccucgagaauaucguccggcgcagcaacgacacuaauuuuguucuugguaacgcacaaauuguggauuggccuauaguauacuccaaugacggcuucugcaagcugucuggguaucaccgagccgaagugaugcagaaaucaaguacguguagcuuuauguacggagaguugaccgauaaggacacaaucgaaaaaguccgucagacuuucgagaacuaugaaaugaacuccuuugagauuuuaauguacaagaaaaauagaaccccagugugguucuuuguuaagaucgcgccgauuaggaaugagcaggauaaggugguccuguuccuaugcacauuuucugacaucaccgcuuucaaacaacccauagaagaugacucguguaagggcugggguaaauuugcccggcucacucgcgcacugacaucaagcagaggggugcuucagcagcuggccccuaguguacagaagggagagaacguucauaaacacuccagguuggcugaagugcuccaacugggcucugauauccugccacaguauaagcaggaggcacccaagaccccuccacauauuauccuccacuacugcgucuucaaaacgacuugggacuggauuaucuuaauacugaccuuuuauacagccauucuugugcccuacaaugugagcuucaagacucggcagaacaaugucgcuugguugguuguggauuccaucguagacgugauuuuccuggucgauaucgugcuaaacuuucauaccacauucguuggcccugccggggaggugaucucagacccaaaacucauucgcaugaauuaccugaagaccugguuugucauagaccuucugaguuguuugccguaugaugugaucaacgcguucgaaaacguagacgagggaauuagcucucucuuuuccucacugaaaguugugcgauuacugagacucgguagggucgcacggaaacuugaucacuacaucgaauauggcgccgcugugcuggucuugcuagugugcguuuucgggcuggccgcacacuggauggcuuguauaugguacagcauuggagacuaugagaucuuugaugaagacacgaaaacuauccguaauaacaguuggcucuaccaacuggccauggauauuggcacacccuaucaguucaaugguucuggguccggaaagugggagggcggcccuagcaagaacucgguguacaucucuucccuuuacuuuaccaugacuucacugacaaguguaggguucggaaauauugcgccaagcaccgacauagagaaaaucuuugccgucgcaauuaugaugaucgguuccuugcucuaugcuacgaucuucggcaacgugaccacaauuuuucagcaaauguacgccaauacuaaccgcuaucaugaaauguuaaauucuguuagagauuuccugaagcuguaccaggugcccaaagggcuaagcgagagggucauggacuauauagugucaaccuggaguaugucccggggaaucgauacagaaaagguacuccagauuugcccuaaagacaugcgagcugacaucugugugcaccugaaccgcaagguuuucaaggagcauccagccuuuagacuugcaagcgauggcugcuugagggcccuggcuauggaguuccagacuguccacugugcgcccggugaccucauuuaccacgcaggggaaucuguggauucacugugcuuuguggucaguggcagccuugagguuauccaagacgaugaagugguggccauacugggaaaaggcgacguauucggggaugucuuuuggaaggaggcuaccuuggcccaguccugcgcaaaugugcgggcccucacauauugugaccugcauguuaucaaacgcgaugcuuuacagaaggugcuggaguucuacaccgccuuuucucacucguucagcagaaaccuaauucucacuuacaaucugaggaaacguaucgucuuucggaagauuuccgacgugaagcgagaagaagaggagagaaugaaaaggaagaacgaagcaccgcuuaucuugccucccgaucauccaguucgccggcuguuccagagauuuaggcaacagaaagaggcgcgccucgcugccgaacgaggaggucgggaccuggaugacuuagacguggagaagggcaauguacugacggagcacgcaucagccaaccauagucuugucaaagccucuguggugacaguccgugaaagcccugcuacccccguuuccuuccaggcagcuucaacuagcggggugccagaucacgccaaguugcaggcgcccggaucugagugccucggcccuaagggugggggcggagacugugccaaaagaaaguccugggcuagguuuaaagaugcaugcggcaagagugaagacuggaacaaaguaagcaaggccgagucuauggaaacccugccagagcgcacaaaggcuuccggggaggccacccuaaagaagacugauucaugugacaguggaauaacaaaaagcgaucugcggcucgacaaugugggugaagcaagaucgccgcaagauaggucccccauucuggcggaggucaagcacucuuucuauccuaucccagaacagacgcuucaggccaccguguuggagguucgacaugaacugaaagaggacauuaaggcuuuaaacgccaaaaugacuaauaucgagaagcagcucagcgaaauacugcgcauccuuacaucacggagaaguucccaaucuccccaggagcuguucgaaauuagcaggccucaguccccagagucagaacgugauaucuuuggcgcaagcuga

SEQ ID NO: 57959 - RNA, 3480 nt, Artificial Sequence
  derived and/or modified sequence opt3 from KCNH2__Homo_sapiens__NP_000229
augcccgugagaaggggccacgucgccccucagaacaccuuccuggacacaaucauucggaaguuugaggggcaaagccgcaaauucauaaucgcuaaugcacgaguugaaaacugcgccgugauuuacuguaaugauggauuuugcgagcucugugguuauucccgugcggaaguaaugcagagaccaugcacuugugacuuccuucauggcccgaggacgcagcggcgcgcugccgcacagaucgcccaagcucuguugggggcagaggaaagaaagguggagauugccuuuuacaggaaagauggaucuugcuucuuaugucuggucgacgugguucccgugaagaacgaggauggcgcugucaucauguuuauacuaaauuucgaagugguaauggagaaagacaugguugguaguccugcccacgauaccaaccaucgggggccacccacaucauggcucgcgccuggacgcgcaaagacuuuucgacugaagcugccagcccuguuggcucucaccgccagagaaagcuccgugaggucuggcggcgcagggggagcuggugcccccggcgcggucgugguggacgucgaucugaccccugccgcaccaucgucagagagccuggcucucgacgagguuacagccauggauaaucacguggcuggguuaggaccggccgaagaacggcgugcacugguaggccccgguaguccuccacgcuccgcccccgggcagcuuccuucuccaagagcucauagcuugaaccccgacgcguccggaucaaguugcagccuggcaaggacucggucucgagaauccugugccucagugcgcagagcuagcagugccgaugacaucgaggcaaugagggccggcguccuaccgccucccccacggcacgcuucuacaggcgccaugcacccucuccgcuccgggcugcuuaauagcaccucggacucugaucuggugagauauaggacgauuuccaaaaucccccagauuacuuugaacuucguugaccucaagggagauccauuucuggcaucacccaccagugaccgugaaaucauagcgccuaaaauuaaggagcggacacauaaugugacugagaaagucacccagguguuaagccugggugcugauguacucccagaauacaaacuucaagccccgcgaauccacagauggacaauucugcauuauucccccuucaaggcaguuugggacugguugauccuacugcucgugaucuacaccgccgucuuuacgccuuauucugcugccuuccugcuuaaggagacugaagagggcccacccgcaacagaaugcggguacgcuugucagccucuggccguggucgauuugauuguggacauaauguucaucguugauauucucaucaacuuuaggaccacuuacgugaaugcgaacgaggagguagucagccacccaggacgcauagccgugcacuauuucaagggcugguuucugauugacaugguugcugcaauccccuucgauuuacugaucuuugguucagggagugaggagcuaauuggccuccugaaaacagcccggcuuuugagacuggugagggucgcucgcaagcucgaccgauacuccgaauauggagccgcagugcuguuccuucugaugugcaccuuugcguugaucgcccauuggcucgcuugcauuugguacgccauaggcaauauggagcagccgcacauggacagccggaucggguggcugcauaacuuaggagaucagauugguaaaccuuauaacucuucaggccuugggggaccaaguaucaaggacaaauacguaacggcacuauauuucaccuuuagcucccucacaucugugggcuucgguaauguuucgcccaacacuaauagcgaaaagaucuuuuccauuugugucaugcugauagggucacuuauguacgcuaguaucuucggcaacgugucugccauuauccaacguuuguacagcggaaccgcaagauaucacacacagaugcugagggugcgcgaguuuauucgguuccaucagaucccuaauccccucagacaaaggcuggaggaauacuuccagcacgccugguccuauacuaacggcauagauaugaaugcugucuuaaagggguuuccagagugccugcaggcggacaucugucuucacuugaaccgaucacuccugcagcauugcaaaccuuuccgcggagccaccaaggguugucuacgggcacuggcuaugaaauuuaagacaacccacgcucccccaggcgauacucucguucaugccggggaccugcuuacggccuuguacuucauuagcagaggaucuaucgaaauucugaggggcgauguggugguagcaaucuuagguaaaaaugacauauuuggggagccgcucaaccuguaugcccguccuggcaaguccaauggagauguccgcgcgcuuacauacugcgaccugcacaagauucaccgggaugacuugcucgaggugcuggauauguaucccgaguucagugaccauuuuuggagcucucuagagaucaccuucaaccugagagacacuaauaugauuccaggcucccccgggucaaccgaacucgagggaggcuuuaguaggcaacgaaaacggaagcugagcuuccgcagaaggacagauaaagacaccgaacagccuggugagguuucggcucuugggccaggacgggccggcgcaggucccuccucucgaggcagaccugggggaccguggggcgagagcccaucaagugggcccuccucuccugaaagcuccgaggaugaaggaccaggccgcucaagcagucccuugaggcuggugccuuuuucuuccccgcgucccccaggugagccucccgggggagaaccauuaauggaggacugugaaaagagcucggauacuugcaacccucucucaggcgccuucucuggugucaguaauaucuuuuccuucuggggcgacagccgggggagacaguaccaggaacugcccagguguccagcuccgacaccuucucuucugaacauaccccuaagcuccccaggacgccgacccagaggcgauguggagucacggcucgacgcacugcaaaggcaguugaaccgccuggaaacgcguuuaagugccgauauggcgaccguucuccagcugcuucagagacaaaugacucuggugccuccagcuuacagcgccguaacaacccccgggccuggaccgacaucuacuuccccauugcuccccgucucaccucugcccacccuaacgcuggacagucuuagccaggugucccaguucauggcaugcgaggaacucccaccuggcgcccccgagcugccacaggaggguccuacccggagguugucucugccggggcaauuaggagcucucacaucgcagccccugcaccgccauggcagcgauccagguucauga

SEQ ID NO: 57960 - RNA, 3252 nt, Artificial Sequence
  derived and/or modified sequence opt3 from KCNH3__Homo_sapiens__NP_036416
augcccgccaugagaggccugcucgcuccucagaacaccuuccuugacacaaucgcaacuagguuugaugggacgcacagcaauuucgugcugggaaacgcccaagucgcggguuuguuuccaguuguguacugcuccgacggcuucugugauuuaaccggguuuucucgggcugagguaaugcagcgcggaugcgccuguucauuccuguauggcccggacacaagugagcuagugcgacagcagauucguaaggcacucgaugagcauaaagaauuuaaggccgagcugauacuuuacagaaaaagcggucugcccuucuggugcuugcucgacgucaucccuauuaagaaugaaaaaggggagguggcucuguuucugguuucccacaaggauaucucugagacuaagaacaggggaggcccagaccgguggaaagaaaccggcgggggacgcagaagguauggucgggcacgcucgaagggcuucaaugccaaccgaagaaggucacgggcugugcucuaccauuuaagcgggcaucugcaaaaacagcccaagggaaaacacaaacuuaauaagggcgucuuuggugagaagccuaacuugccagaauauaagguggccgcgauucguaaaagucccuucauccugcuacacuguggggcacuccgcgccacaugggauggauuuauacugcuugcuacccuguacguagccguuacugugccuuauuccgucugcgugucuacagcaagagagccaagcgcugccaggggcccgcccuccgugugugacuuggcggucgagguucucuucauccuggauauuguguuaaauuuccggaccacguuuguaucaaagaguggccagguggucuucgccccuaaaagcaucugccugcacuacgugacuaccugguuucuccuugacguuauugcagcucugccauucgauuugcuacaugccuuuaaggugaacgucuacuucggggcucaucugcucaaaacagugcgacugcuucgccuguugagacuccugcccagguuagaccgguauucucaguacuccgccguaguucugacucuacucauggcaguguuugcccugcuugcucacugggucgcgugugugugguucuauaucggacaacgcgaaauagagucaagcgaaagugaguugccugaaauugguuggcugcaggagcucgcaagaaggcuggagaccccauacuaucuugucggccgucggcccgccgggggaaauucuuccggccagagcgacaacugcucgucuuccucagaagcuaaugguacagggcuggaguugcucggcggaccgagucugcgaagcgccuacaucaccuccuuauauuuugcacugucuagccuaacgucagugggcuucgggaacguuagugccaauacugauacagaaaagaucuuuuccauuuguaccaugcucaucggagcucugaugcacgccgugguauucgguaacgucacugcaauuauacagagaauguacgcgaggcgcuuucuuuaccacagccggacaagagacuugagggauuauauccgcauucaucgaaucccuaagccccugaaacaacggaugcucgaguacuuccaggcuaccugggccgugaacaauggcauagacacgaccgaacuguuacagucucugccagaugagcuucgugcagacauugccaugcacuugcauaaggagguucuccaacugccucuauucgaagcugccucaagagggugccugagggcacucagucuggcccuucgccccgccuuuugcacaccaggagaguauuugauccaccagggcgaugcgcugcaggccuuauacuucguguguagcgguuccauggaaguccucaaagggggcacugugcuggcuauccuuggaaagggcgaccugauugggugcgaguugccccggagagaacagguagugaaagcaaacgccgauguuaagggacucaccuauuguguccugcaaugccuacagcuggcuggucuccaugacucucuggcccuuuacccugaguuugcaccaagguucucgcgaggcuugcgcggggagcugagcuauaauuuaggagcgggcgguggguccgccgaaguggauacaucaagucucucuggcgacaacacucugaugagcacccuugaggaaaaggagacagacggagagcagggcccgaccgugucccccgcuccugccgaugaaccaucaagcccccugcuaucuccuggguguacuuccaguagcucugcagcuaaacuccuguccccacggagaacggcccccaggccgcguuugggaggccgcggucggccugggagagcaggagcccugaaggcugaggcgggcccaucagcucccccuagggcauuagaaggucuccgacugcccccaaugccuuggaauguucccccagaccuuaguccgcgggucguggauggcaucgaggacgggugcggaagcgaucagccuaaauuuucguuccgcgugggccaauccgggcccgaauguucuagcucaccaagucccggaccugaguccggccuguugacaguaccacacggucccucugaggcuagaaacaccgacacucucgauaagcugaggcaggccgucaccgaacuaagcgaacaggugcugcagaugcgggaagggcuucaaucccuccgacaggccguucagcugguguuggcuccucacagagagggaccgugcccacgcgcaucaggcgaaggucccuguccugccagcacaaguggccuguuacagccacucugcgucgacaccggggcgucuuccuacugucugcaacccccugcuggaagcgugcuuucgggcacuuggccgcaucccaggccagggccucccccacugauggccccuuggcccuggggaccaccggcaucacagucuaguccuuggccccgugccacagcuuuuuggacguccaccagcgauucugagccacccgcaagcggcgacuugugcuccgagccuucaacuccagccagucccccuccgagcgaagagggugcgcggacagggccagcugaacccguuucucaggccgaggcaaccuccacaggagaaccucccccaggcucagguggccucgcccugccuugggauccccacagucuagagauggugcugauugggugccauggaagcggcacuguacaauggacccaggaggaagggacgggagucuga

SEQ ID NO: 57961 - RNA, 3054 nt, Artificial Sequence
  derived and/or modified sequence opt3 from KCNH4__Homo_sapiens__NP_036417
augcccgugaugaagggccugcucgccccucagaacaccuuccuugacacaaucgcuacuagauuugaugggacgcacagcaauuuccuguuggcaaacgcccaaggaaccagggguuuuccaauugucuacugcuccgacggcuucugugaguuaacaggguauggacggacugaaguuaugcagaaaaccugcucuugucgcuuucuguacggcccggagacaucagaacccgcgcuacagcgacuccauaaggcucuggagggucaccaggaacaucgugccgagauaugcuucuauagaaaagaugggagugcauuuuggugucuucuggacaugaugccuaucaagaaugagaugggagaagugguauuguuccucuuuagcuucaaagauauuacccaauccggcucuccaggccuggggccccagggagguaggggcgacucgaaccacgagaauagccuggggcggcgcggagccacuuggaaguuuagaagcgcuaggcggcgcagucgaacagugcuccauagauuaaccggccacuucgguaggcgggggcagggaggcaugaaggcaaacaauaacgucuuugaaccuaaaccauccgugcccgaguacaagguugccucugugggcgggagccguugccugcuuuugcacuauuccgucucaaaagcuaucugggauggacugauucuacucgccacguucuacguggcgguaacuguuccuuauaauguguguuucaguggugacgaugacaccccaaucacaagccgccauacucuggucucugauauagcaguggagaugcuuuuuauccuggacauuaucuugaacuucagaaccacauacgugucccagucaggccaagucauuagcgccccgaggaguaucgggcuccacuaccuggcuaccugguuuuucauagauuuaauugccgcacugcccuuugaccuccuuuauaucuucaauauuacgguuacuucucuggugcauuugcuaaagacaguacggcugcuccgacugcuucgccuguugcagaaacucgaaagauacucccagugcagcgcugugguccugaccuuacugaugucgguguuugcccuacucgcgcacuggauggccuguaucugguauguuaucggaaggcgggagauggaagcaaacgacccucugcuuugggauauuggcugguugcacgagcuggguaagcgccucgaagugccauacgucaaugggucugugggcggacccuccagaaggucagcuuauauagccgcucuguacuucacucuuaguagccugacauccguaggcuuugggaacguuugcgccaauaccgacgcagagaagaucuucucuauuuguacgauguugaucggagcccucaugcaugcuguggucuuugguaacgugaccgcgauaauucagcguauguauagccggcgaucacuguaccacaguagaaugaaagauuuaaaggacuucaucaggguccaucgccugccucggccacuaaaacaaagaaugcucgaguacuuucagacaacuugggcagugaacuccggcaucgaugccaaugaacugcuuagggacuuccccgaugaguugcgcgcugacauugccaugcaccugaaccgagaaauccuccagcugccguuauucggggcagccagccggggaugccugcgugcucuuucuuugcauauuaagaccucauuuugcgccccuggcgaguaucuccugagaaggggugaugcacuacaagcgcacuacuauguuuguagugggagccuggaagugcuccgcgacaauaugguacuggcuauacuuggcaaaggagauuugaucggcgccgacauucccgagccagggcaggagccuggacugggugcagaccccaacuucgucuuaaagacauccgccgaugugaaagcucucacuuacugcggccugcagcagcuuucuucgcgggggcuggccgaaguuuugagacucuauccagaguacggagcagcuuuuagggccggccugccccgagaccuaaccuucaaucugcgccaagguagcgauacauccgggcucucacgguuuaguagaucuccuaggcugagccagccacguuccgaaucacuuggcagcuccuccgacaagaccuugccgaguaucacugaggcggaaagcggagccgagcccggcgggggaccucgcccacggagaccccuguuacucccuaaccugucuccagcuaggccccgaggcucccuugugucacugcuaggugaggaacucccgccuuucagugcacuggucagcucgccauccuugucucccagccugucacccgccuuagcugggcagggacacagugccucuccccauggcccaccucgguguucugcagcguggaagcccccacagcuccugaucccgccucuugguacguuugggcccccagaucugagcccccgcauuguggacggcauagaggauuccggaucaacagccgaagcuccuagcuucagauuuaguaggcggccagaguugccccgaccuagaucucaagccccgccaaccggcacucgccccuccccugagcucgcaagcgaagcugaggaaguaaaagagaaggugugcaggcugaaucaggaaaucucgcgucuaaaccaggagguuucacagcugucucgggagcuuagacacauuauggggcuccugcaagccagguugggaccacccggccauccugcagguagugccuggaccccggaucccccauguccucagcugcgcccuccaugcuuauccccuugugcuagccgacccccaccgucucuccaggacacaacccuggcggaaguccacugcccugccagcguggggacuauggagacaggaacggcacuucuggacuugagacccuccauccucccacccuauccuucagaaccagauccccugggcccuaguccggugccagaggcuucacccccuacccccucucuacugcggcacuccuuccagucaaggagugacacuuuucauuga

SEQ ID NO: 57962 - RNA, 2967 nt, Artificial Sequence
  derived and/or modified sequence opt3 from KCNH5__Homo_sapiens__NP_647479
augcccggcgggaagagaggacugguggccccucagaacaccuuccucgagaauaucgucaggcggagcuccgaaucuucauuucuucuggguaacgcucaaauuguugacuggccagugguauacaguaaugauggcuucugcaaauugagcggguaucaccgcgcagacgugaugcagaaguccucuacauguucguuuauguacggagaguuaacugauaaaaagacgauagaaaaaguccgacagaccuucgacaacuaugagucaaauugcuuugaagugcugcuauacaagaagaaccguacaccgguuugguucuauaugcagaucgcccccauuagaaaugagcaugagaaagugguccucuuucuguguacuuucaaggauaucacccuuuuuaaacaaccuauugaagacgauagcacaaagggcuggaccaaauucgcgaggcugacucgggcuuugacaaacagucgcuccgugcuccagcagcugaccccaaugaauaagacggagguaguucacaagcauucuagacuggccgaagugcuccaguuagguagcgacauccugccccaauacaaacaggaggcaccuaagacuccaccccacauaauccuucauuauugcgccuuuaaaaccacaugggauugggucauuuugauccugacuuucuacaccgcuauuauggugccuuacaacguguccuuuaagacaaaacagaauaacaucgcauggcuaguccucgacucaguuguggauguaauauuccugguggacauuguccuuaauuuccacaccacguuuguggggccaggaggcgagguuaucagugauccgaagcugauuaggaugaacuauuugaaaacuugguucgugaucgaccuccugagcuguuuacccuacgacaucauuaaugccuuugaaaacgucgaugagggcauaucuucccuguucucaagccucaaggugguacggcuucugcgcuuggggcgaguugcuagaaagcuagaccacuaucuggaauacggagccgcggugcucguccugcuugugugcgucuuuggucugguggcacauugguuggccuguaucugguauaguauuggcgauuacgagguuaucgacgaagugacaaacaccauacagauugauucuuggcucuaucaacuggcuuuauccaucgggacuccuuacagguacaauacaagcgccggaaucugggagggcgguccaucgaaagacucucuguauguauccucacuauacuucaccaugacgagucucaccacaauuggguuuggaaacaucgcacccacuaccgaugucgagaagauguucagcguggcuaugaugaugguuggcucccugcuuuaugccacaauuuuuggcaaugugacuaccauauuccagcagauguacgcgaacacaaaucgguaucacgaaauguugaacaauguccgugacuuucugaaacucuaccaagugccuaaggggcugucugagcgcguaauggauuauaucgugagcaccuggucaaugaguaaaggaauugacacugaaaagguucuuuccaucugcccaaaggauaugagagccgacaucuguguccaucugaacaggaaaguguucaaugagcaccccgcauuucgguuggcuagcgacgguugccuccgagcccuggcuguggaguuccagacgauucacugugccccgggcgauuuaauauaccaugcaggggagucugucgacgcccugugcuucguugugucaggaagucuagaggugauccaggaugacgaaguagucgcuauucucggcaagggugauguguuuggggacaucuucuggaaagagacaacccuggcgcacgcaugcgccaacguucgcgcucuuacuuacugugauuugcauauuaucaagagagaagcccugcucaaagugcuggacuuuuauaccgcauucgccaauagcuuuuccaggaacuuaacacugaccugcaaucuucggaagcgcauaaucuucagaaagauuucugaugucaaaaaggaggaagaggagagguugcgucagaaaaacgaagugacucucucgaucccuguugaccaccccgugcggaagcuguuucaaaaauucaagcagcagaaggagcuacgaaaucagggcagcacacaaggagauccagaaagaaaccagcugcagguagaguccaggucacuccagaacggcgcuaguauuacggggaccucugucgugacugugagccaaaucacaccuauacagaccucccuggccuacgucaaaacaucagagagccuuaagcagaauaaccgcgacgcaauggaauugaaacccaauggaggugcggaucagaagugucugaaaguuaacucuccaauucggaugaagaauggcaacgggaaaggaugguuaagacucaagaauaacaugggcgcucaugaggaaaagaaagaggacuggaauaacgugacuaaggccgaauccaugggucugcuuagugaggaccccaaaagcucugauuccgaaaauucaguaaccaagaacccucugaggaaaacggacaguugcgauagcgggaucaccaagucggacuugcgccucgauaaggcaggcgaagcccgauccccacuggagcacucuccgauucaagcugacgccaaacaccccuuuuauccuaucccagaacaggcacuacagacaacucugcaagaggugaagcaugaacucaaagaggauauacagcugcuuagcugucggaugaccgcuuuggagaagcaggucgccgaaauccugaaaauuuuaucagagaagagugugccccaggcguccucuccuaagagccaaaugccacuccagguucccccgcagaucccuugccaggacauuuucuccgugucacguccagaaagccccgagagugauaaagacgaaauccacuuuuga

SEQ ID NO: 57963 - RNA, 2985 nt, Artificial Sequence
  derived and/or modified sequence opt3 from KCNH6__Homo_sapiens__NP_110406
augcccgugagaaggggccacgucgccccucagaacaccuaccuggacacaaucauucggaaguucgaggggcaaagccgcaaauuucucauagcuaaugcacagauggaaaacugcgccaucauuuauuguaaugauggauucugcgagcuuuuugguuacucccgaguugaagugaugcagcagccauguacuugcgacuuccugacgggcccgaacacccccucuucagcgguaagucguuuggcucaagccuuacugggggcagaggaauguaagguggauauccuauauuacagaaaagacgccagcuccuuuaggugccucgucgaugugguuccugugaagaaugaggacggagcugucauuauguucauccugaacuuugaggaucuugcacagcuguuggccaaauguucuucgcggucacucagccagcgccugcugagucaguccuuccucggcucugaagguagccaugggagaccaggaggccccggcccugggacaggaagggguaaguaucggacuauaucccaaaucccacaguuuaccuuaaauuucguggaguuuaaccuggaaaagcaccgcucaaguagcacaaccgagauugagaucauugcuccccauaaaguaguugaacgaacucagaaugugacagagaaggucacccaggugcuuucuuugggcgccgacgugcugccugaauacaaacuacaagcgccaagaauccacagguggacgauacuccauuauuccccguucaaggcagucugggauuggcugauucuucuguugguuaucuacacugccguguuuacccccuacucagcugccuuccuccugagcgaccaggaugagagucggcguggggcaugcucuuauacauguuccccuuuaacuguaguggaccugauugucgauaucauguucgugguugacaucgugauuaacuuucgcaccacauacgucaauaccaacgacgaagugguaagccacccaagaaggauagcuguucacuauuucaaaggaugguuucucaucgauaugguggccgcgauucccuucgaccuucugaucuuucggacgggcucggaugagacuacaaccuugauaggucuacugaagacugcccgacuccugcgccuugucagaguggcaaggaagcuggaccgguacucugaguauggggcugccgucuuguuccuccugaugugcacauuugcuuuaauugcccauuggcuggcauguaucugguacgccaucggaaauguggaacgcccuuaucuagagcacaaaauuggcuggcucgauucccugggcguucagcuugggaagagauacaacggaucagacccagcuaguggucccagcgugcaagauaaauacguaaccgcguuguauuucacguuuuccucucugaccagcgucggcuucgggaaugugucaccgaacacaaacagugaaaagguguuuuccaucugcguuaugcucauuggaagccugauguacgcaucuauauucggcaaugucucagccaucauucagaggcuuuauagugguacugcucguuaccauacccagaugcugcgggugaaagaguuuauccgauuccaccagaucccuaaccccuugagacaaaggcucgaagaguauuuccagcacgccuggagcuacacaaaugggauugacaugaacgcaguacugaagggcuuuccagagugcuuacaggccgauauaugucugcaucuacaccgcgcucuccugcagcauugcccugccuucuccggagcaggcaaagggugucuucgggcguuggcugugaaguuuaagacuacccacgcacccccaggagacacacugguucaucucggugauguccugucuaccuuauauuucaucucgagaggcagcauugaaauccugagggacgacgugguggucgccauucuugggaaaaaugauaucuuuggagagcccguuuccuugcacgcccaaccuggcaagucaagugcugacgugcgcgcccucacuuacugcgaucugcacaaaauacagcgagcagaccuacuggaagugcucgauauguacccagcuuucgccgagucuuuuuggagcaagcuggaaguaacguucaaccuucgggacgcggccgguggguugcauuccucaccgcgucaggcucccggcagccaggaucaccaaggauuuuuccugucugacaaucaguccggcaguccucaugaguuagggccacaguuucccagcaaaggauauucucuccuggguccuggcucccagaacucaaugggggcaggaccaugugcccccggccacccggaugcugccccuccacuuaguaucagcgacgcaucgggucuguggcccgaguugcuccaagaaaugccucccagacacuccccacagucuccucaggaggaucccgacugcuggccacugaagcuagggagcaggcuggaacaacuccaggcgcagaugaaucgccuggagucacgggucaguuccgaucuuucuagaauuuugcagcuguuacaaaagccgaugccucagggccaugccagcuacauccucgaggcucccgccuccaacgaccuggcacuugugccaauugcuucagaaacaaccagccccggaccuaggcugccacagggcuuccuacccccugcccagacuccgaguuauggggaccucgaugacuguucuccaaaacaccgaaauuccagcccccgcaugccucaucuggcaguugccaccgauaagacauuggcuccaucgucagagcaagaacagcccgagggacuguggccuccguuagcgucuccccuccacccacuggaagugcagggccuuaucugcgguccuuguuuuaguucccugcccgagcauuuggggagcgucccaaaacagcucgacuuccaacggcacggaucugauccuggcuucgccgguagcuggggccacuga

SEQ ID NO: 57964 - RNA, 3591 nt, Artificial Sequence
  derived and/or modified sequence opt3 from KCNH7__Homo_sapiens__NP_150375
augcccgugagaaggggccacgucgccccucagaacaccuuccuggggacaaucauucggaaguuugagggacaaaauaaaaaguucauaaucgcuaacgcacgcguucagaauugcgccauuaucuacuguaacgacgguuuuugcgaaaugacuggcuucagccgaccagaugugaugcagaaaccguguacgugcgacuuucuccaugggcccgagaccaagcgucacgauauugcgcagaucgcucaagcccuucugggauccgaagagagaaaaguagaagugacauauuaccauaagaauggcucuacuuucauauguaacacccacaucauuccugucaagaaucaggaggguguggcaaugauguuuaucauuaacuucgaguauguuacagacaaugaaaacgccgcuaccccagagagggugaaucccaucuugccuauaaaaacugucaaccggaaguuuuucggguuuaaauucccaggauuacgcgugcugacauacagaaagcagucacuaccccaggaagauccugacguaguugugauugauaguagcaaacauuccgacgauucugucgcaaugaagcacuuuaagucgccaaccaaagagucaugcagcccgagugaggccgacgauacgaaggcucucauccaacccuccaaauguucuccucuggugaauauuagcggcccacuugaccacuccucacccaagaggcagugggaucggcuguauccugacauguugcagaguagcucucagcucucccauucacgcagccgagaaagucugugcucuaucagaagggccuccagcgugcacgacaucgagggcuucgggguccaucccaaaaacauuuuccgggaucgucacgcgucggaagacaauggacgcaacguuaaggguccauuuaaccacauaaaaucuucccugcucggcucaacgagugauagcaauuuaaacaaguacuccaccaucaauaagauuccgcaacugacacuuaacuucucugaggugaaaacugaaaagaaaaauagcucaccucccaguuccgacaagaccaucauagcaccaaaaguaaaggauagaacacauaacgugaccgagaaggucacucagguguugagccugggggccgacguucuaccugaguauaaacuccagacucccaggauuaauaaguuuacaauccugcacuacucuccauucaaagcugugugggauuggcuuauccuguugcucgucauuuacaccgccaucuuuacucccuauucagcagcuuuccuguuaaacgaccgggaagaacaaaagcgacgcgaauguggauacaguugcagcccucugaaugugguagaucucauuguugacauaauguuuaucauugauauccuuaucaacuucagaacaaccuaugugaaucagaacgaggaagucguguccgacccagccaaaauugcgauacauuacuuuaagggcugguuccugaucgacauggucgccgcaauuccguuugauuugcuaaucuucgguucugggucggacgagacgaccacacugauuggacuccugaagacugcuaggcuucugcgguuggugcgcguugccagaaaacucgauagguauagcgaguacggcgcugccgugcugauguuacugauguguaucuuugcacuaauagcccacuggcucgcuugcaucugguaugcgauuggcaauguagaacgucccuaccugaccgacaagaucggguggcuugauuccuugggacagcagauugguaaacgguacaacgacucagauaguucuagcggcccuuccaucaaggacaaauaugucacagcacuguacuucacuuucucaagccucaccucugugggguuuggaaauguuuccccaaacacaaacagugagaagauauucagcauuugcgugaugcugaucggcucucuuauguaugccuccauuuuugguaaugucucagcuaucauacaacgacuguacagugggaccgccagauaucauaugcagauguugagggugaaggaguucauccgcuuucaccagauucccaacccucuccggcagagacuggaggaauacuuccaacacgcauggacuuauacgaauggcaucgauaugaacaugguauuaaaaggauuuccagagugucugcaggccgacauuugccuacaucucaaucagacacugcuucagaacuguaaggcuuucaggggcgccagcaaagggugcuugcgcgcacuggcgaugaaguuuaaaaccacucacgcucccccgggagauacccucgugcauuguggugacguucugacagccuuauacuuccugucgcgaggcuccaucgagauacuuaaggaugacauugucguggcaaucuuggggaaaaaugacaucuuuggagaaauggugcaccucuacgccaagccuggcaagucuaacgcugauguccgggcccugaccuauugcgaccuacacaaaauucaacgugaggaucugcucgaaguucuggacauguacccagaguucagcgaucauuuucuuacuaauuuggagcugacauucaacuuaagacacgaaucagcaaaggcugaccuccugaggagucaguccaugaaugauucugagggugacaacuguaaacuucgccggagaaagcugagcuucgaauccgagggggaaaaagaaaauucaacgaacgaucccgaggacagcgccgauaccaucaggcauuaucagaguucuaagcgacacuuugaagagaagaaaucccgcagcucgucauucauuucuaguauagacgaugaacagaagccuuuguuuuccggcaucguggacagcucucccggaauuggcaaagcgagcgggcucgacuucgaggaaacugugccaacauccggacggaugcauaucgauaagagaucacacaguugcaaagacauuaccgauaugaggagcugggagcgugagaaugcccacccucaacccgaagacucuuccccaucagcucugcagcgcgcagccugggguaucagugagacagaaagcgaucuaacuuacggcgagguagaacagcggcuggaccuccugcaagagcagcuuaacagauuggagucccagaugaccacggauauacagaccauccugcaauuacuccagaagcagacaacugucgugccgccugcuuauucuaugguuaccgccgggucggaauaccagaggcccauuauccaacugaugcgaacaagccagccagaggcaucaauuaagacugaccgguccuuuagucccucuagccaguguccugaguuccuugaucuggagaaauccaagcuaaaaucaaaggagucucucagcaguggagugcaucugaacaccgcguccgaagacaauuugacgagccuguuaaaacaggauucugaccucucacuggagcuucaucugcgccaaagaaagacauauguccacccaaucaggcaccccuccuugccugacaguagccucucgaccgugggcauaguuggucugcaucggcacgugucugauccggggcuaccaggcaaguga

SEQ ID NO: 57965 - RNA, 3324 nt, Artificial Sequence
  derived and/or modified sequence opt3 from KCNH8__Homo_sapiens__NP_653234
augcccgugaugaagggccugcucgccccucagaacaccuuccuugacacaaucgcuacuagauuugaugggacgcacagcaauuucauucuggcaaacgcccaagucgcgaaaggauuuccaauaguuuacugcuccgacgguuucugugaguuggcuggcuuugccaggaccgaagugaugcagaagucuugcucauguaaauucuuauuugggguagagacaaaugaacagcugaugcuacagaucgagaagagucucgaagagaaaacugaguucaagggagaaauuauguuuuauaagaaaaacggcagcccguucuggugccugcuugauaucgugcccauuaagaaugagaaaggugacgucgugcuguuuuuggcauccuucaaggauaucaccgacacaaaaguuaagauaaccccugaagauaagaaagaggacaaggugaaagggcggucucgcgccggaacucauuuugauucggcucgacguagaucaagggcaguccucuaccacaucagcggccaucugcaacggcgcgagaagaacaaacugaagauuaauaacaauguguucguagacaaaccagccuuccccgaauauaagguuagugaugcuaagaaauccaaguuuauccucuuacacuucucuacauuuaaagccggcugggacuggcugauucuuuuggcgaccuucuacguggcagucacggugccuuauaacguguguuuuaucgggaaugaugaccugagcacuaccagauccacaacugucucagacauagccguugagauucuauucaucauugauaucauccucaacuuuaggaccacauacgugaguaagagcggacagguaauuuucgaagcucggucuauaugcauccauuaugugaccacgugguuuauuaucgaccugauagccgcacuuccauucgaucuguuguacgcuuuuaaugucacugugguuucccucgugcaccuguuaaaaacaguccgccugcuccgacuucugagauugcuacagaagcuggacagguacucacagcacagcaccauugugcucacucugcuuaugaguauguucgcccuguuggcgcauuggauggccuguaucugguauguaaucgguaagauggagcgggaagauaacucucuccugaaaugggagguuggcugguuacacgagcuggggaagcgucuagaaucccccuacuauggaaauaacacacucggcgguccuagcauucgcucggcauacaucgcugcccuguauuuuacccuuucuuccuugacgucagugggguucggaaacgucagugcuaauaccgacgccgagaaaauuuucagcauaugcacaaugcugaucggcgcacucaugcaugcccugguguuuggcaacgucacugcuauuauccaaagaauguacuccagguggucucuuuaucacacccggacaaaggaucugaaagacuucauccgagugcaccauuugccacagcagcucaagcagcgcaugcuggaauacuuucaaacuaccuggagcguuaauaacgggauugauucaaaugaguuacugaaggacuucccggaugaacuaagaagugacauaacaaugcaccucaacaaagagauccugcagcuuuccuuguuugagugugcgagcaggggaugccugcggucucucucacugcauauuaagaccaguuucugugcacccggugaauacuuacugcgccagggcgacgcccuucaagcuaucuauuuugugugcagcggguccauggagguauugaaagauucuaugguccucgccauucugggaaagggcgaccuaaucggugcaaaucugucgauaaaagaucaggugaucaagacuaacgccgacguuaaggcucucacguacugcgaucugcaguguauuauccuuaaaggguuguucgaagugcuggacuuauauccugaguacgcccacaaguuugucgaagauauucagcaugaccucacauauaaucugagagagggccacgagagcgaugugaucuccaggcuuucaaacaaaaguaugguaucucaaagcgaaccaaagggaaauggcaacauaaauaaacgucugcccuccauuguggaggacgaagaggaggaagaggaaggggaggaagaggaggcaguuucauugagcccuaucugcacccggggaucuuccagucgaaacaagaaagucgguagcaauaaggcguaccucggccugucucuaaagcagcuggcuuccgggacugugccauuccacucacccauuagagugaguaggagcaacucgccgaaaaccaagcaggaaaucgauccucccaaccauaauaaacgcaaggagaaaaaccucaagcugcagcuuuccacauugaauaacgccggaccaccugaccugucuccccggauagucgauggcaucgaagacgguaauagcucagaggaaagucaaaccuuugacuucggguccgagagaauuaggucugagccacgcaucagcccucccuuaggcgauccagaaauuggagcagccguucucuuuaucaaggcugaggaaacuaaacagcagauaaacaagcugaacuccgaggugacaacgcuuacccaggaagugucacaacugggcaaagacaugcgaaauguaauucagcuacucgagaauguccugagcccgcagcagcccagucgguucuguucuuugcacuccacuagcgugugcccuucgcgugagucacugcaaacaagaaccucuuggagugcccaucagccauguuuacaccuccagacagggggagcagcuuauacucaagcccagcugugcuccagcaacaucaccucugauaucuggagcguugaccccuccucaguggguaguagcccucagaggacgggcgcgcacgaacagaauccagccgauucugagcuuuaccauucccccucacuggacuacaguccgagccacuaucaagucgugcaggaagggcauuugcaguuccuccgcuguauuuccccucacucugauucgacccugacaccacuacagagcaucucagcuacucuguccaguucuguuugcagcuccucagagaccucucuucaucucgugcugcccagccggagugaggaaggauccuuuagccaaggcacaguaucuucauucuccuuggagaaccugccugguaguuggaaucaggaagggauggcaagcgccucgacuaagcccuuagagaaccucccacuggaagucgugaccucuacggcugaggugaaagacaauaaggccauuaacgucuga

SEQ ID NO: 57966 - RNA, 684 nt, Artificial Sequence
  derived and/or modified sequence opt3 from KCNIP1__Homo_sapiens__NP_001030009
augggcgccgugauggggaccuucagcucccugcagacaaagcaaagaaggcccucuaaagacaucgcuuggugguacuaucaguaccagcgggauaagauugaggacgaacucgagaugacuauggucugccaccgcccugaaggacuugagcagcuggaagcacaaacgaacuuuaccaaacgagaguugcagguuuuauaucgugguuucaagaaugaguguccaucaggcgugguaaacgaagauacauuuaaacagauauacgcccaguucuuuccgcauggggacgcgaguacuuaugcucacuaccuguucaaugccuuugauaccacacaaaccggaagcgugaaguucgaggacuuugucacugcacuauccauccuccugagaggcacagugcaugaaaaacuuagguggaccuucaaccuguaugauauuaauaaggacgguuacaucaacaaggaggagaugauggauauuguuaaagccaucuacgacaugauggggaaguauacguaccccguguugaaagaagauacuccucggcagcacgucgacguguuuuuccagaagauggauaagaauaaagacggaauaguaacccucgacgaguuucuggaaucuugccaggaggaugacaacaucaugcgcucgcugcaacucuuccagaauguuauguga

SEQ ID NO: 57967 - RNA, 858 nt, Artificial Sequence
  derived and/or modified sequence opt3 from KCNIP2__Homo_sapiens__NP_055406
augagaggccaggggaggaaggagagccuguccgacucucgggaucucgacggaucauacgaucaacuuaccggucaucccccuggcccaacuaaaaaggcccugaaacagcgcuucuugaaguuacugccgugcugugggccccaggcucuaccuagugugagcgaaaucggacgagucuuucguuuccucggcgacuccucucugccaucggcacuugccgcgcccgcuucacugagaccucacaggccacgguugcucgaucccgacagcguugaugacgaguuugaacugaguacagugugccaccgcccugagggucuggaacagcuccaagagcagacgaaauucaccagaaaggaguuacagguacuguauaggggguuuaagaacgaauguccauccggaauugugaaugaggaaaacuucaaacagauauacucucaauuuuucccgcagggcgauagcuccacauaugccacuuuucuuuucaaugcauuugacaccaaccaugauggcucagucaguuucgaggacuuuguggccggguugagcguuauccugcggggaacaguggaugaccgccuaaauugggcuuucaaccucuacgaccugaauaaggaugguugcauuaccaaagaggaaaugcuugacaucaugaagucuauuuaugauaugaugggcaaauacacuuaucccgcacugcgagaggaagccccuagagagcacgucgaauccuucuuucagaagauggacaggaacaaggauggggugguaacaaucgaggaguucauagaaucaugucagaaagacgagaauaucaugcggagcaugcaauuguuugauaacguuauuuga

SEQ ID NO: 57968 - RNA, 693 nt, Artificial Sequence
  derived and/or modified sequence opt3 from KCNIP3__Homo_sapiens__NP_001030086
augggcauccaggggauggagcugugcgccauggcuguggucguucuccuuuucauugcagugcugaagcaauuuggaauauuggaacccaucagcauggaggacuccucugauucagaauuagagcugaguaccguaagacaccagccugaaggucuagaccagcuccaggcccaaacaaaauucacuaagaaagagcugcagagccuuuacaggggcuuuaagaacgaguguccaacggggcugguggaugaagacaccuucaaauugauuuaugcgcaguuuuucccgcagggagaugcuacaacuuacgcccauuuucucuucaaugcauuugacgccgauggcaacggugcuauccacuucgaggacuuugucguggggcuguccauucugcuccggggaaccguucaugaaaaguuaaagugggcauucaaucuguaugauaucaacaaagacggcuacauaacaaaggaggagaugcuugccaucaugaaaucuauuuaugauaugaugggccgccacaccuaccccaucuugcgagaagacgcuccugccgagcauguggaaagauuuuucgagaagauggaucguaaucaagacggggucgugacuauugaagaguuccuggaggcgugccagaaagacgaaaacaucaugucgucaaugcagcuauuugagaauguaauauga

SEQ ID NO: 57969 - RNA, 678 nt, Artificial Sequence
  derived and/or modified sequence opt3 from KCNIP4__Homo_sapiens__NP_001030175
augagcggcugcagaaagagguguaaacgggagauccugaaguucgcccaguaccuccuucgccuguugaccggguccuuacacacagacucuguggaagaugagcuggaaauggcuacuguccgacaucgucccgaggcacuagaacuccuggaggcccaaucaaaauuuacgaagaaagagcuucagauucuguauagaggauucaagaacgaaugcccuagugguguugugaaugaggaaaccuuuaaggagauauacagccaguucuuuccacagggcgacuccacaacuuaugcgcacuucuuguuuaacgcuuucgauaccgaccauaauggggccguaucuuuugaggauuucaucaaaggacucucgauucugcugaggggcacagugcaagaaaagcucaacugggcauuuaauuuauacgacaucaacaaagaugguuauauuaccaaggaggaaaugcuggacaucaugaaagccauauacgauaugauggggaaguguacuuauccgguccuuaaggaggacgcuccccggcagcacguggaaacauucuuucagaaaauggauaagaauaaagacggaguugugaccaucgaugaguucauugagucaugccagaaggacgaaaacaucaugcgcagcaugcaauuguucgagaaugucauuuga

SEQ ID NO: 57970 - RNA, 1140 nt, Artificial Sequence
  derived and/or modified sequence opt3 from KCNJ10__Homo_sapiens__NP_002232
augaccagcguggccaaggucuacuauucccagacaacucaaacggagucuagaccccugaugggcccugggaucaggcggcgccgaguucucaccaaagacggacguucaaacgugagaauggaacacauugcugauaagagguuccuuuaccugaaagacuuguggacaacuuuuauagauaugcaguggcgguauaaguuacugcuauucagugcaaccuuugccgguacaugguuccucuuuggcguagugugguaccuggucgcgguggcucauggggaccuucuggaguuggauccaccggccaaucacacccccugcguugugcagguccauacucucacaggagcauuccuguuuagccuggaaucccagaccacgaucggcuaugguuuccgcuacauuucugaggaauguccucucgccaucguguuacugauugcucaacuuguauugacuaccauccuggagauauuuaucacagggacuuuccuagcaaaaauugccagaccaaagaagagggcugagaccauccgguuuucgcagcacgccguuguggcgucacauaacggaaaacccugccucaugauucgcgucgcaaauaugcgaaagagccugcuuaucggcugucaggugacaggcaaacuguugcagacccaccaaacgaaggaaggggagaacauaagacucaaucaggugaacgucacuuuccagguugacacagccagugauuccccuuuucugauuuuaccacugaccuucuaucacgugguagacgaaacuucuccccucaaagaucuuccucugaggagcggagagggugacuucgaguuggugcuaauccuguccggcacagucgaaucaaccagugcuacgugccaggugcggaccagcuaccucccagaggaaauucuguggggguacgaguuuacaccggccaucucucuuuccgcaucaggaaaguauaucgcugauuucagccuguuugaccaaguugugaaggucgccagucccucuggcuugcgugauuccacugugcgcuacggugacccugaaaaacucaagcuggaggagagcuuaagagaacaggcggagaaagaagggucggcccugucuguaaggauuuccaauguuuga

SEQ ID NO: 57971 - RNA, 1173 nt, Artificial Sequence
  derived and/or modified sequence opt3 from KCNJ11__Homo_sapiens__NP_000516
augcugagcagaaagggcaucauucccgaggaauacgugcucaccaggcuugccgaggacccugcuaaaccacgguaucgcgcacgacagcguagagccagguucgucuccaagaaagggaacugcaauguugcgcacaagaacauacgggaacaaggacgcuuucugcaggauguguucacaacuuugguagacuuaaaauggccgcauacgcugcuaaucuuuaccaugucuuuccucuguucauggcugcuuuuugcuauggccugguggcugauugcauucgcccacggugauuuggcucccagugagggcacagcagaaccuugcgugacuagcauccauuccuuuucuucggccuuccucuuuucaauugagguccaggugaccaucggguucggaggcagaaugguuacagaggaauguccacuggcuauacugauccucauugugcagaauaucgucgguuuaaugauuaacgccaucaugcuggggugcauauuuaugaagaccgcgcaagcacacaggcgggccgagacucuuauuuucagcaagcaugcugugaucgccuugcgccacggacgacuguguuuuaugcuaagaguaggcgaccucaggaaaaguaugauuaucuccgcaacaauccacaugcagguugugcggaagaccacgucucccgaaggcgaggucgugccucugcaucagguggauauuccaauggagaauggggucggagguaacagcauauuccuuguugcuccccugaucauuuaccacgugaucgacgccaauuccccuuuguaugaucucgcgccaucagaccugcaucaccaccaggauuuagaaauaauuguaauccuggagggcguggucgaaacuaccgggaucacaacucaagcccguaccaguuaccucgcagacgagauucuuuggggacagcgcuucgugccgaucguugcugaagaggauggcagauauagcguggacuacucuaaauuugguaacacagucaaggugcccaccccucugugcacggccaggcaguuggaugaggaccauucccuacuggaagcucucacucuggccucagcacgggggccacuucgaaaacgcagcguacccauggccaaggcuaagccuaaauucaguauuucuccagacucccugagcuga

SEQ ID NO: 57972 - RNA, 1302 nt, Artificial Sequence
  derived and/or modified sequence opt3 from KCNJ12__Homo_sapiens__NP_066292
augaccgccgcuagcagagcaaaccccuacuccaucgugucuucagaggaagacggccugcaccucgucacaaugaguggggccaauggauucgguaacggcaagguucauacuaggcggcgcugccgaaaucguuuugugaaaaagaacgggcaguguaauauugaguucgcgaacauggaugagaaaagccaaagauaucuugcugacauguuuacgaccugcguagauauaagguggcgguacaugcuguugaucuucuccuuagccuuucuggcaucuuggcuacucuucggaauuaucuuuugggugauugccgucgcucacggcgaccuggaaccugcagaaggucgcgggagaacaccaugugugaugcagguucauggauucauggccgcuuuucuuuucucgaucgagacucagaccacaauaggcuauggccugaggugcgugaccgaggaauguccggucgccguguuuaugguaguugcgcagucaaucguggggugcauuaucgauagcuucaugauuggagcaaucauggccaagauggcucggcccaaaaagcgcgcccaaacuuugcucuuuagucacaaugcagucguggcucugcgagacgguaagcugugucucauguggagagugggcaacuuaaggaaaucccauauagucgaggcccacguucgggcgcagcugauuaagccucgugugacagaagagggggaguacaucccacuugaucagauugacaucgauguaggauucgacaaaggcuuggaucgcaucuuccuggugucucccauuaccauacuacacgaaaucgacgaggccagcccucucuuugguauuuccagacaggaucuggaaacggacgacuucgagaucgucgugauacuugaagggaugguugaggcaacugcuaugaccacacaagccaggucaaguuaucuggcuaaugagauuuuguggggacaucgguuugaaccaguccucuucgaggaaaagaaccaguacaaaaucgauuauagccacuuucauaagacuuacgaggugcccucuaccccucgaugcuccgccaaggaccugguggaaaauaaauucuuacugccaucagcaaacagcuuuuguuacgagaaugagcucgccuuccuuagucgcgaugaagaggacgaagcugauggcgaccaggauggcagaucuagggacgggcuguccccgcaggcgcggcacgauuuugaccgcuugcaagcaggagguggcguacuagagcagagacccuauaggcgugaaagcgagaucuga

SEQ ID NO: 57973 - RNA, 285 nt, Artificial Sequence
  derived and/or modified sequence opt3 from KCNJ13__Homo_sapiens__NP_001165887
auggacagcuccaacugcaaggugaucgcuccccugcucucucagagauacaggcggauggucaccaaagauggccacucaacacuucaaauggacggggcccagcgcggacuggcauauuugcgagaugccugggguauuuuaauggacaugcguuggagauggaugaugcugguuuucagugcgagcuuugugguacauuggcuaguguucgcuguccucugguguuuuugcggcgaggauuguccugccaagaaauccucuuucuuuaauucgcuguacuga

SEQ ID NO: 57974 - RNA, 1311 nt, Artificial Sequence
  derived and/or modified sequence opt3 from KCNJ14__Homo_sapiens__NP_037480
augggccuggccagagcucucaggcggcuuagcggggcacuggacuccggagauucucgcgccggugacgaggaagaggcgggccccggguugugccgaaacggaugggcuccugccccagugcagucaccggucggccguagaaggggucgguucguuaagaaagaugggcacuguaaugugcgcuuuguaaacuuaggaggccaaggcgcaagauaccugagugaccuauucaccacaugcguggaugucagguggcgguggaugugucuccuguuuagcugcuccuuccuugccucuuggcuguuguuugggcucgcuuucuggcugaucgcaucgcugcauggagaccucgccgcucccccuccacccgccccuuguuuuucacacguggcgagcuucuuagcagccuuucuguucgcucuugaaacucagacgaguauugguuauggcguucgcuccgugaccgaggaaugcccagccgcagucgcugccgugguauugcaguguauagcggggugcguucuggaugccuuuguggucggagcagugauggcuaagauggccaaacccaagaaacgaaaugagacucuaguguucucugagaacgcugucguugcccucagagaccauaggcugugucuuauguggcgggugggcaaucugcgucgcagccacuugguagaagcacaugugagagcccagcuccugcaaccuagggucacaccagagggugaauacaucccguuagaucaccaggacguggauguuggguuugacggaggcaccgaucggauuuuccuggugucccccaucacaauuguccacgagaucgacucagcuaguccucucuaugagcuuggccgagcggaacuggcacgcgccgacuucgaguuggugguaauacuagaagggaugguugaggcuaccgccaugacuacacagugcagaagcucuuaccugccaggagaacuccuguggggucauagguuugagcccgugcuuuuccagcggggcucccaauaugaggucgauuaccgccacuuucauagaaccuaugaagugccugggacgccagucuguucagcaaaggagcuggacgaaagggccgagcaggcuagccacaguuugaagucuuccuuccccggaagccucacugccuuuugcuacgaaaacgagcuggcauuaucgugcugucaggaggaagaugaggacgaugaaaccgaggaaggcaaugguguggagacagaggacggggcggcuucuccgcguguucugacuccuacccuagcccucacacugcccccauga

SEQ ID NO: 57975 - RNA, 1128 nt, Artificial Sequence
  derived and/or modified sequence opt3 from KCNJ15__Homo_sapiens__XP_011527863
auggacgccauccacauuggcaugagcuccacuccccuggugaagcauacagcuggggcaggacucaaagccaacagaccuagggucaugucuaagucaggucacaguaauguucggauagauaaaguggacggcaucuaccuucuguauuugcaggauuuauggacuacgguaauugacaugaaguggcgcuacaaacugacccuauucgcggcuacauuugugaugacuugguuccucuuuggggucaucuauuacgccauugcauucauccauggagaucuggagccaggcgaaccgauaagcaaccacacccccugcaucaugaagguggacucccuuacaggugccuuucuguucucuuuggagucgcaaaccacuauuggguauggaguucgaucaaucacagaagaguguccucaugcuauuuuucuccugguggcacagcuggucaucaccacgcucauagaaauuuucaucacuggcaccuuuuuagccaagauugcucgucccaaaaagagagccgagacaaucaaauucagccacugcgcggugaucacuaagcagaauggcaaacugugucuuguaauucagguugcaaacaugaggaagaguuugcugauacaaugccagcuauccgggaagcuccugcagacccacgugacaaaagagggagaacggauccuucugaaucaggccaccgucaaguuucauguggauucuagcuccgagucaccauucuugauucucccuaugacguuuuaccacgugcuggacgaaaccaguccauuacgcgaucugacaccccaaaaccucaaagagaaggaguucgaacuugucguucuguugaaugcuaccguggagagcacuucugccguaugucaguccagaacaucauauaucccugaagagauauacugggguuucgaauuugugccagucgugagccuaaguaaaaacggcaaguacguugcagacuucucucaguuugagcagauuaggaaauccccggauugcaccuucuauugugcugacagcgagaagcaacagcuggaagagaaguaccggcaggaagaucaacgcgagcgagaacucagaacgcugcuucugcagcagucgaauguguga

SEQ ID NO: 57976 - RNA, 1362 nt, Artificial Sequence
  derived and/or modified sequence opt3 from KCNJ16__Homo_sapiens__NP_001278551
augcugaagauggugcucaccgagaaccccaaucaggaaaucgccacaagccuugaguuccuguuguuacaaaacuccccuggcucucugagagcucagcagaggaugucauacuaugggaguagcuaccacauuauaaaugcagacgccaaauauccaggauacccgcccgaacauaucauugcggagaagcggcgcgcucgacguagacuacuccacaaagaugguuccugcaacgucuauuuuaagcauaucuucggcgaaugggggucuuacguuguggacauuuuuacuacgcugguagauaccaaauggaggcacauguucgugaucuuuucgcuuucauauauacugagcugguugaucuucggaagugucuuuuggcucauugccuuccaucacggcgaccugcugaaugauccugacaucacaccauguguggauaacguucacuccuuuacuggugcauuccucuuuucuuuagagacccagacaaccauuggguacggauaccggugcgugacugaggaauguagcgucgccgugcugaugguaauccuucaauccauauugucaugcauuaucaauacauucauuaucggcgcugcacuggccaagauggcuaccgcccgcaagagagcgcagacgaucagguuuaguuauuucgcacuaauuggcaugcgggacgggaaacucugucugauguggcgcauaggagauuuccgacccaaccauguuguggaggguacugucagagcccagcuucugagguacaccgaagacagcgagggccggaugacaauggcuuuuaaggauuugaaacucgugaaugaccagaucauucuggugacuccugucaccaucguucacgagauagaucaugaaucuccauuauaugcccuggaccguaaggcaguggcuaaagacaacuucgagauucucguaacauuuaucuacaccggggauuccacgggaacuucacaccaaagccgcaguucuuaugugcccagagaaauccuuuggggccacagguucaaugacguccuggaggugaagcggaaguacuauaaaguuaacugcuugcaguuugaagguuccguggaggucuacgccccuuucuguagcgcgaagcagcuagauuggaaagaccagcaacugcauauugagaaggccccaccggugcgagaaucgugcacaucugauaccaaagcacgcagaagguccuuuucagcuguagccaucguuaguagcugugagaaucccgaagagacuacaaccuccgcuacgcacgaauaccgggagaccccuuaucagaaggcccuccugacacuuaaccgcauuucuguggagagccagauguga

SEQ ID NO: 57977 - RNA, 1302 nt, Artificial Sequence
  derived and/or modified sequence opt3 from KCNJ18__Homo_sapiens__NP_001181887
augaccgccgcuagcagagcaaaccccuacuccaucgugucucuggaggaagacggccuccaccuugucaccaugucaggggccaauggauucgguaacggcaagguucauacuaggcggcgcugccgaaaucguuuugugaaaaagaacgggcaguguaauauugcguucgcuaacauggaugagaaaagucaaagauaucuggccgacauguuuacgaccugcguagauauaagguggcgguacauguuguuaaucuucagccuggcauuucuagccuccuggcuccuguucggagugaucuuuugggucauugcuguggcacacggcgaccuugaaccugccgagggucaugggcgcacaccauguguuaugcaagugcacggauucauggcugccuuucuguucucuauugaaacucagaccacaaucggcuauggcuugagaugcgucaccgaggagugucucguggcgguauuuaugguuguggcacagucgauagucgggugcaucauugauucauucaugaucggagccauuauggcuaagauggccaggccgaaaaagcgggcacagacucugcuguuuagccauaaugcugugguggcccuccgcgacgguaaguuaugucugauguggcgagucggcaaccuuagaaaaagucacaucguugaagcgcacgugagggcccaguugauaaagccccggguaacagaggaaggggaguacauuccucuggaucagaucgacauugaugugggauucgacaaaggccuagaucguaucuuccucgucuccccaaucaccauucugcaugagauagacgaagcaucuccccuuuuugguaucagccgccaggaucuggagacggacgacuucgaaauugugguuaucuuggaggggaugguggaagcuacugccaugaccacacaagcuagauccucauaucucgccaaugagauacuguggggacacagguuugagccugucuuauucgaagagaagaaccaguacaaaauugauuauagucauuuucacaagacuuacgaagugccaagcacaccccggugcucugcaaaggaccugguagagaauaaauuccuccuuccuuccgccaacucauuuuguuacgaaaaugagcuggcuuucuugagccgagaugaggaagacgaggcggauggcgaccaggauggccgcaguagagacgggcuaucuccacaggcaaggcacgauuuugaccggcugcaagccggagguggcguucucgaacagcgcccguauagaaggggguccgagaucuga

SEQ ID NO: 57978 - RNA, 1176 nt, Artificial Sequence
  derived and/or modified sequence opt3 from KCNJ1__Homo_sapiens__NP_000211
augaacgccagcuccagaaauguguucgacacccugaucaggguccucacagagucuauguuuaagcaccuucggaaauggguugugacucgcuucuuuggccauucacgacagcgugcuagacugguaaguaaggaugggaggugcaacauugaguucggaaauguggaagcacaaagccgguuuauauucuuugucgacaucuggacgaccguguuggauuuaaaauggcgcuacaagaugacaauuuucaucacugccuuucuggguuccugguucuuuuucggccuacucugguaugcgguugcuuacauucacaaagaccugcccgaauuucauccuucugccaaccacaccccauguguggagaauaucaacgggcuuacaucggcauuccuguucucauuggaaacccaggucacuauaggauauggcuuuagaugcgugacagagcagugugccaccgcuaucuuccuccugauuuuucagagcauccuggguguaauuaucaauaguuucaugugcggggcaauacucgccaagauuuccaggccgaagaaacgggcuaagacgaucacuuuuucuaaaaacgccguuauuagcaagcgcggaggcaaauuaugucugcuuauccgaguggcgaauuugagaaagucccugcuaaucggcucacauauuuacgggaagcuccugaaaaccacagucacucccgagggagaaaccauaauccuugaucaaauuaacaucaauuucgugguggacgcagguaacgagaaucuguuuuucauaaguccuuugacaauuuaucacgucaucgaucacaacagcccauuuuuccauauggccgcugaaacccuccugcagcaggacuuugaguuaguuguguuccuggauggcacgguagagucuacuuccgccacaugccaggugaggaccucauacguccccgaagaggugcucuggggguaucgguuugcaccuaucguuagcaagacuaaagaaggaaaguaccguguggacuuccacaauuucaguaaaacagucgagguggaaaccccacauugugcuaugugccuuuacaacgagaaggauguacgcgccagaaugaaaaggggcuaugacaaccccaauuuuauucugucugagguuaacgaaacggaugacaccaagauguga

SEQ ID NO: 57979 - RNA, 1284 nt, Artificial Sequence
  derived and/or modified sequence opt3 from KCNJ2__Homo_sapiens__XP_011523081
augggcagcgugagaaccaacagguacuccaucgucucuucagaggaagacgggaugaagcuggccacaauggcuguugcaaauggauucgguaacggcaaaaguaaggugcacacucggcagcaaugccgcagccgauuuguuaaaaaggaugggcauuguaaugugcaguucauuaacgucggagagaaaggccagcguuaucucgccgacauauuuacgaccugcguggauaucagauggagguggaugcuuguuauuuucugucuggcguuuguguuguccugguuauucuuugguugcgucuucuggcugaucgcucuacuccacggggaccuggaugccucuaaggaaggaaaggcaugugugucggagguaaauucauuuacagccgcuuuccuuuuuagcauugaaacucagaccacaaucggcuacggcuuccggugcguuaccgacgagugucccauagcaguguuuauggucguguuccaaaguaucguggggugcauuaucgaugccuucauuaucggagcugucauggccaaaauggcgaagccuaaaaagcgcaacgagacucugguauuuucccauaaugcagugauagccaugagagacgguaaauugugucucauguggaggguaggcaaccugcggaagucucaccugguggaagcucauguccgcgcccagcucuuaaagagccgaauuacauccgagggggaauauaucccacuggaucagauugacaucaaugugggauucgauucaggcaucgacagaauuuuucuuguuaguccgauaaccaucgugcacgagauugaugaggacagccccuuguacgaccugucuaaacaggauaucgacaacgcagauuucgaaauagucgugauucuagaggguaugguagaagcuacggccaugacuacccaaugcagguccucauaucucgcgaaugagauccugugggggcaccgguacgaaccuguucuuuuugaggagaagcauuauuacaaaguggacuacagccguuuccacaagacauaugaagucccaaacacuccccuguguagugcccgcgauuuggcagagaaaaaguacauccucucuaaugcuaacuccuuuugcuaugaaaaugagguggcccugaccagcaaagaagaggacgauucggagaacggagucccugaaucuacauccaccgacacgccacccgauauugacuuacauaaccaggcuucagugccucuggagccaagaccgcucaggcgggaaagugagaucuga

SEQ ID NO: 57980 - RNA, 708 nt, Artificial Sequence
  derived and/or modified sequence opt3 from KCNJ3__Homo_sapiens__NP_001247437
augagcgcccugagaaggaaguucggcgacgauuaccagguggucaccacauccucuucagggaguggacuccaaccccaggguccuggccaggacccacagcaacagcuuguuccgaaaaagaaacggcagcgcuuuguggauaagaacgggcgaugcaauguacagcacggaaaccugggcagcgagacuucccguuauuugucugacuuauucacgacccugguggaucuaaaauggagauggaaucucuuuaucuucauucugacauacacugucgcuuggcuuuuuauggcaucgauguggugggugauagccuauaccaggggugaccugaacaaggcgcauguugggaauuacacacccuguguggcuaacgucuauaauuucccuucagccuuuuuguucuuuaucgaaaccgaggcaacuauuggauacggcuaucgguacaucacagauaagugcccagaaggcauuauccucuuccuguuucaaagcauacuggggaguaucguggacgccuuccucauuggauguauguuuaucaaaaugucccagcccaagaaacgcgcugagaccuuaauguucucugaacacgcaguaauuagcaugagagaugguaagcugacgcuuauguucaggguuggcaacuugcgcaauucccauauggugucagcccagauccggugcaaacugcuaaagggguga

SEQ ID NO: 57981 - RNA, 1338 nt, Artificial Sequence
  derived and/or modified sequence opt3 from KCNJ4__Homo_sapiens__NP_690607
augcacggccauagcagaaacgggcaggcccacgugcccaggcggaagcgccgaaaucguuucgucaaaaagaacggacaaugcaauguuuacuuugcuaaccuguccaauaaaucucagagauauauggcagacaucuucaccacauguguggauacuagguggcgguacaugcucaugauauuuucagccgcguuccuuguaaguuggcuguuuuucgguuuguuauuuuggugcauugcuuucuuucauggcgaccuggaggccagcccuggggugccagcagccggaggcccggcugccggugggggaggcgcagcucccgucgccccuaagccauguaucaugcacgugaacggcuuccuaggggcguuucucuucuccguugaaacgcagaccacaauuggauaugguuuucgcugcgugacugaggaauguccccuggcagucaucgccgugguaguucagucuauugugggcugcgucaucgauucguucaugauagggaccaucauggcuaaaauggccagaccuaagaagagggcacaaacacuucuguucucacaucacgcugugauuagcgugcgggacggaaaauugugucucauguggcgcgucggcaaucugcgaaagagucacaucguugaggcccaugugagagcgcagcugauuaaaccauacaugacccaggaaggugaguaucuccccuuagaucagagggaccugaacguaggguacgauaucggacuugaccggauauuuuugguguccccuauuaucauuguccacgagaucgaugaagacucuccacuguauggcaugggcaaggaggaacuagagagcgaggauuucgaaaucgugguuauucucgaggggaugguggaagccacugcaaugacaacccaagcucguuccucauaccuggccagugagauacuuuggggacaucgcuuugaaccggucguguucgaggagaaaagccacuacaagguagacuauucuagauuucacaagacguacgaaguugcugguacucccugcuguuccgccagggagcugcaggaaucaaaaaucaccguguugccugcaccacccccuccacccagcgccuucugcuaugagaaugaacucgcucugaugagucaggaggaggaagagauggaagaggaagcggcagccgcugccgcagucgccgcuggcuuagggcuggaggccggaucuaaggaggaagcaggcauuauccggaugcucgaguuugguucccaucuugaucuggaacgaaugcaggcgagcuugccgcuagacaacauaucguaccgcagagagucugcuauuuga

SEQ ID NO: 57982 - RNA, 1260 nt, Artificial Sequence
  derived and/or modified sequence opt3 from KCNJ5__Homo_sapiens__XP_011541112
auggccggcgacagcagaaacgcuaugaaucaggauauggagaucggggugacccccugggacccuaagaaaauuccaaagcaagcaagggauuacgucccgauagccacagaccggacucgccugcucgcggaagguaaaaagccccgacagcguuauauggagaaauccggaaagugcaacguucaccauggcaaugugcaggaaacguacagauaucuuucugaucuguucaccacauugguagacuuaaaguggagguuuaaccugcuaguguucacuauggucuacaccgugacauggcucuuuuucggguuuaucugguggcugauugcuuauauccggggagaucuugaccacguuggcgaucaggaguggauuccuuguguggaaaaucugucagguuucgucagugccuuuuuguucagcaucgagaccgagacuacaauaggguacggauuucgcgugaucaccgaaaaaugcccagagggcauuauccuccugcugguacaagcaauucucggcuccaucguuaacgccuucauggugggguguauguuugucaagauaucucagcccaaaaagagagcugaaacguuaauguucucgaauaacgcagugauuucaaugagggacgagaaacugugccuuauguuucgggugggagauuugcgcaauagccauaucgucgaggccaguauucgagcuaagcugaucaaguccagacagacuaaagaaggugaguucaucccucuaaaccagaccgacauuaauguuggcuucgauacaggggacgacaggcucuuucuggugucuccacuuauaaucagccacgaaauuaaccaaaagucccccuucugggagaugucacaggcccagcugcaucaggaagaguuugagguaguggucaucuuggaaggaaugguggaggcgacuggcaugaccugucaagcacggaguagcuauauggauacagaaguucucuggggucaccguuucaccccugugcugacguuagagaaaggguuuuacgaagucgacuacaauacuuuccacgauacauaugagaccaacacuccaucuugcugugccaaggagcuggcugaaaugaaacgcgagggaagacuccuucaguaccugccgucacccccuuugcuaggcggcugcgccgaagcagggcuggacgcugaggccgaacagaaugaggaggaugaaccaaagggacucgguggcuccagggaggcgcgggggagcguguga

SEQ ID NO: 57983 - RNA, 1272 nt, Artificial Sequence
  derived and/or modified sequence opt3 from KCNJ6__Homo_sapiens__NP_002231
auggccaagcugaccgagagcaugacaaacgugcucgaaggcgacuccauggaucaggacgucgagucucccguugcuauccaccaaccuaaacuuccaaagcaggcaagagaugaccugccgaggcauauuucacgggaucgcacuaaacgaaagauacagcguuacgugagaaaagacgggaagugcaauguacaccauggaaacgugagggaaacguaucgguacuugaccgauaucuucacaacuuuagucgaccugaaguggcgcuuuaaucuacucauuuucgugaugguuuauaccgugacauggcuguuuuucgguaugaucugguggcuuauugccuacaucagaggcgauauggaccacauagaggaucccaguuggaccccuugugucacuaaccugaauggguuugugagcgcguucuuguuuuccaucgaaacagagaccacgauuggauauggcuacaggguaaucacugacaaaugcccagaggguauuauccuccugcugauacagucuguucucgggucgauugugaacgcuuucauggucggauguauguuugugaagaucucacaacccaaaaagcgggccgaaaccuuaguguucagcacacaugcagucauuaguaugcgcgauggcaaacugugccuuauguuucgaguuggcgacuugagaaauucccacaucguggaggccucuaucagggcuaagcugauuaagagcaaacagacuuccgaaggggaguucauaccucuaaaccagaccgacaucaauguaggauauuacacaggugaugaccggcucuuucuggugucaccacuuauuaucagucacgagauaaaccagcaaagccccuucugggaaauuucuaaggcacagcugccuaaagaggaauuggagaucgucgugauccucgaaggcaugguugaggccaccgggaugacgugucaggcucguuccucauacauuacuagcgagauccuguggggauaucgcuucacaccaguguuaacccuggaagauggcuuuuacgaggucgacuauaauaguuuccaugaaacuuacgagacaucuaccccgucccucagcgccaaggaacuugcggagcuggcaucgagagccgaguugccccuaucuugguccgugucaaguaaacugaaccagcacgcugaacucgagacggaagaggaagagaagaaucuggaggaacaaaccgagaggaacggugauguagccaaucuugaaaacgagagcaaaguuuga

SEQ ID NO: 57984 - RNA, 1275 nt, Artificial Sequence
  derived and/or modified sequence opt3 from KCNJ8__Homo_sapiens__XP_005253415
augcuggccagaaagagcaucauucccgaggaauacgugcucgcuaggauagcagccgagaaccuucggaaaccucgcauccgagaccgucugccaaaggcgagauucauugcuaaauccggcgccugcaauuuggcacacaagaacaucagggaacaggggcgguuuuuacaagauauuuucacuacacuggucgaccuaaaauggcgccauacucucguuaucuuuacgaugucuuuccuguguucauggcuucuguuugccauaauguggugguugguggcuuucgcacacggagauaucuaugccuacauggagaagagugguauggaaaagagcggccucgaguccaccguaugcgugacaaaugucagaucuuuuacuucggcuuuccuguuuucaauugaggugcagguuaccaucggguucggaggcaggaugaugacagaagaguguccgcuggccauuaccgugcucaucuuacagaacauagucggucugauuaucaaugcggugaugcuugggugcauuuuuaugaaaacugcacaggcccaucggcgcgcugaaacauugaucuucagccgacacgccguaaucgcaguuagaaacggaaagcuguguuuuauguucagggugggcgaccuacggaaaaguaugauuauauccgcuucuguccguauccaaguggugaagaaaaccacgacucccgagggcgaggucguuccuauucaucagcucgauaucccaguggacaaucccauagaaagcaacaauauuuuccugguagccccucuuaucaucugccacgugauugauaagcgcuccccacuguaugacaucucagcgaccgauuuggccaaccaggaccucgaggucauugugauacuggaagggguuguggagacaacuggaaucaccacacaggcaagaaccaguuacauugcugaagagauccaauggggucacagguuugucagcaucgugacggaggaagagggcguauauucuguugauuacuccaaguucgggaauacugugaaagucgccgcuccccgguguucagcccgagaauuagacgagaagccuagcauucugauacagacacuccagaaaagugaacuuucucaucagaacucccugcgcaagagaaauagcaugaggcggaacaauucgaugcgcagaaacaacucuaucaggcguaauaacuccucauugauggugccaaaaguccaauuuaugaccccggagggaaaucagaacaccagugagagcuga

SEQ ID NO: 57985 - RNA, 1371 nt, Artificial Sequence
  derived and/or modified sequence opt3 from KCNJ9__Homo_sapiens__XP_006711368
augagaagcaggcuggaggaacucaaguuccuugagggccgguggcgcaaccaggugcuggacuuggaaaucgagcccuuacaagauccucgacguagacugggggcccagaggcgggcugcaggagguuccucuucaggcccacgcagaaccccgggggccaggagugcgcggcccgacgcugccgcaauggcccaggaaaaugcugcauuuagcccuggacaggaggagccaccccgccgaagaggcaggcaacgguacgucgaaaaagauggucguugcaacguucagcaggggaaugugcgcgagacauauagauaccuaacugaccucuucacgacccugguagaucuucaguggaggcuguccuugcucuuuuucgugcuggccuaugcucugacauggcucuuuuucggagccauuuggugguuaauagcguacggccggggcgaccuggaacaccuugaggauacugcauggaccccuugugucaacaauuugaacggguuuguggccgcuuuccuguuuucuaucgagacagaaaccacuauuggauauggucaucgaguuaucacagaccaaugcccagagggcauugugcuacuccugcuucaggccauccuggggucgauggucaaugcauucauggugggauguauguuuguaaagauaucacagcccaacaaacgcgcugccaccuugguuuucagcagucacgcgguggucucccucagagauggcaggcugugcuuaauguuucgggugggugaccugcgcucuagccauaucguggaagccuccauuagagcaaagcucaucaggucacgucagacgcuugagggggaguucauuccucugcaccaaacugauuugagugucggauucgacaccggcgaugaccggcuauuucugguuagcccacucgugaucucucaugaaauagacgcugccuccccguucugggaggcuucaagacgagcccuggaaagggaugacuuugagauuguagugauccuugaaggcauggucgaggcaacagggaugacuugucaggcccgcagcaguuaccugguggaugaaguuuuguggggacaccgguucaccucugugcucacacuggaggacgguuuuuaugaggucgauuacgcuuccuuccacgaaaccuuugaggugcccacgccuagcugcucggcgagagaauuagcagaggccgcugccaggcuggacgcacaucuauacuggucuauuccaucccgccucgaugaaaaaguagaggaggaaggcgccggggagggagcuggcggugaagccggggcagacaaggagcagaauggcugucugcccccuccagagucagaaaguaagguuuga

SEQ ID NO: 57986 - RNA, 1617 nt, Artificial Sequence
  derived and/or modified sequence opt3 from KCNK10__Homo_sapiens__NP_066984
auguucuuucuguacaccgacuucuuucucagccuuguggccguccccgcugcagccccuguuugccagccaaaguccgcgacaaacggccaaccgcccgcuccugccccaacucccacgccuagacugucuaucucaaguagggcaaccgugguagcccggauggaggggacaagccagggagguuugcagacugugaugaaauggaagaccgucguggcuauuuucguuguggucgugguauauuuaguuacaggcgggcugguguuucgcgcacuagaacagccauucgaguccucucagaaaaauaccauagcccucgaaaaggcugaguuucugcgagaucacgucugugugucgccccaagaacuugagacucugauccagcaugccuuggacgcggauaacgcaggagugucaccuauuggcaauagcaguaacaauuccucucacugggaccucgguagcgccuucuuuuucgcugggacagucaucaccacgauuggauacggcaacaucgccccauccacugagggcgggaaaauauuuugcauccuguaugcaauuuucggaaucccgcuguuugguuuccucuuagcuggcauuggggaucagcugggaaccaucuucggcaagucaauagcccguguugaaaagguguuuaggaaaaagcaaguaagucagacaaaaauuagagugaucagcacuauucuuuucaucuuggcggguuguaucgucuuugugaccauucccgccguuauauucaaguacaucgagggguggacagcacuggaaucuauuuauuuuguggucgugacccuaacgacuguaggauucggcgacuuuguugcuggcgggaaugccggaaucaacuaccgggagugguauaaaccucucgugugguucuggauacuggucggucuugcuuacuuugccgcagugcuguccaugauuggcgauugguugcgcguccucucaaagaagacaaaagaggaagugggggagaucaaggcccaugcugcggaauggaaagcaaauguuaccgccgaguucagagaaacuaggcggcgccugagcguggagauccacgacaaguuacagcgagcugccacaauuagaaguauggagaggcggcgucugggacucgaucagcgcgcacauucucuugacaugcuguccccagagaaaagaagcguauuugccgcuuuggauaccggcagguucaaggccucgucucaagaauccaucaacaaucggcccaacaaucuacgacugaaagguccugaacagcucaacaagcacgggcagggcgcaucagaggacaauauuauaaacaaguuuggaaguacgagccgccugaccaaaagaaagaacaaagaucuuaagaaaacacugccagaagacguccaaaagaucuacaagacuuucaggaauuauuccuuggacgaggagaaaaaggaagaggaaaccgagaaaaugugcaacucugauaauagcucaacagcgaugcucacugacuguauucagcagcacgcugaacuggagaacggcaugauccccaccgauacaaaggaccgggagccggaaaauaacaguuuacuggaggaucgcaauuga

SEQ ID NO: 57987 - RNA, 1293 nt, Artificial Sequence
  derived and/or modified sequence opt3 from KCNK12__Homo_sapiens__NP_071338
augagcuccagaucucccaggccuccaccgcggcgcucacgacguagacugcccaggccuaguugcuguugcuguugcugucggcgcagccaccucaacgaggacaccggcagauucgugcuucuggccgcuuugaucggguuauaccuggucgcaggagccacaguguuuuccgcgcuagaaucuccaggugaggcugaagccagggcacgguggggcgccacucuccgcaauuucucggcugcacaugggguugccgagcccgaacugcgagcuuuucuuagacacuaugaggccgcgcuggcagccggaguaagggcugaugccuugcggccucguugggacuucccaggcgcauuuuacuucguggguacggucgugucaaccauuggguuuggaaugacaacucccgcuaccguuggcggcaaggccuuccucauagcguaugggcuguuuggaugcgccgguacaauccuguucuuuaaccucuucuuagagcgcauuaucagccugcuugcauuuauuaugagagcuuguagggaacggcaguugcgacgcaguggccugcuaccugccaccuucagaaggggguccgcucucucugaggccgauagccuggcaggauggaaaccauccguguaccauguccuucugaucuugggccucuucgccgugcuguuaucaugcugugcuagugcgauguauacuagcguagaagguugggacuacguugauucucuguauuuuugcuucgugacauuuuccaccauaggguucggagaccucgucucaagccaacacgcagccuaccggaaucagggccuuuaccgccugggcaacuuuuuguucauccuacuggggguguguugcauuuauagucucuuuaaugugaucucuauucugaucaagcagguccuuaacuggaugcugagaaaauuguccuguaggugcugcgcucguuguugcccggcccccggagcaccucucgcccggcgaaaugcuauaacgccagguagcagacugaggcgccgguuagccgcacugggcgcggaucccgcugccagagacucggaugcagaggggaggcgccuaucuggagagcucauuuccaugcgagaccugacugccucaaacaagguuagucuugcuuugcugcagaaacaacucagcgaaaccgccaauggcuacccucgguccguguguguaaacacacgucagaaugguuucucugggggcgugggagcacugggcaucaugaacaauagacuugcugagacuagcgccucaagguga

SEQ ID NO: 57988 - RNA, 969 nt, Artificial Sequence
  derived and/or modified sequence opt3 from KCNK16__Homo_sapiens__NP_001128577
augcccagcgccggccugugcuccuguuggggagggagagugcucccucuucuguuggcuuacgucugcuauuuacugcuaggugcaaccaucuuccagcuccuggagaggcaagccgaagcgcagucucgggaccaguuucagcuugagaagcugcgcuucuuggaaaacuacacaugucucgaucaaugggcuauggagcaguuuguucaggugauuauggaagccuggguaaaaggcgugaauccaaaggggaacucaacuaauccgaguaacugggacuucggaagcuccuuuuucuuugcaggcacggucgugaccacaauagguuaugggaaucuggcccccucuacugaggcuggacagguuuucugcguguuuuacgcacugcucggcaucccuuuaaacgucauuuuccugaaucaccuuggcaccggguugcgagcccaucuggcugccaucgagcguugggaagauagaccaaggcggucgcaagugcuacagguacucggacuggcgcuuuuucugacauuggguacccucguuauucugaucuuucccccuaugguguucucacacgucgagggcuggagcuucagugaaggguucuauuuugcauucauaacuuuauccacaaucggauuuggcgacuacguggugggucauccacugaacuucauuacccccucugggcuccuuccuagccaggagccauuucagacgccgcacggaaaacccgagucccaacagaucccuggcucauuccagaaggucaguagcaugaauguuuggccacugucuggcaugcauucccccggguuggccuuuccucuaccagauuguaacauucccgaccaagaacgcuucagaccgcugcacccuggagcuuggaaauuuuggccccucccacugccuucaagcaauaguaagugggcccccauguggcuugguucuuccgcacagguguga

SEQ ID NO: 57989 - RNA, 816 nt, Artificial Sequence
  derived and/or modified sequence opt3 from KCNK17__Homo_sapiens__NP_001128583
auguacagacccagggcccgggcugcaccugagggccgcgugcgagggugcgccgucccaagcaccguucugcuccuucuggcguauuuggcuuacuuagcccugggaacagguguguucuggacucuagaaggccgugcagcccaggacuccucuagaucauuucaaagggauaagugggagcuccugcagaacuucacgugucuugaccggccggcucuggauaguuugauccgcgacguagugcaggcauauaaaaauggggccagccuccuguccaacaccacaucuaugggaagaugggaacuggucggcucguuuuucuuuucagugagcacuauuaccacaauagguuacgggaaucucagucccaacaccauggcugccagguuauucugcaucuuuuucgcgcugguugggauuccucuuaauuuggugguccugaaccggcuaggccaccucaugcagcaaggcgugaaucauugggcaucccgccugggaggaacuuggcaggauccagacaaggcccgauggcuugcugguucuggcgcccuguugagcgggcuccuguuauuucugcuccuucccccucuguuguucucccacauggagggauggucauauacagaaggcuuuuacuucgcauuuaucacccuaaguacgguagguuucggggauuauguuauugcuagcugucugaucucugacacuagaaaaccaaacagggauuggcagacccucgagcggacauccaagucaagcggaggccugcuuaaauaccguuuccuggccggccaugggggaagucacuuguga

SEQ ID NO: 57990 - RNA, 1155 nt, Artificial Sequence
  derived and/or modified sequence opt3 from KCNK18__Homo_sapiens__NP_862823
auggaggugagcggccacccccaggccagaaggugcuguccugaagcucuggggaaacucuucccaggacuuugcuuucuguguuucuuggucaccuacgcauuaguuggugccgugguauuuuccgcgaucgaggacggccaagugcuggucgcugccgaugacggggaauuugagaaguuucuagaagaacucugccggauucugaacuguucugagacagugguugaagaucgcaagcaggaccuucagggacaucugcagaaagugaagccgcaaugguucaaucgaacuacgcacuggucauuuuugaguagccucuucuuuugcuguaccgucuucuccacagugggcuaugguuacauauaucccguaacucgucuggggaaauaccugugcaugcucuaugcauuauuuggaaucccucugauguuccuuguuuugaccgauacaggcgacauucuggccaccauccuaucuacuucguacaacagauuuaggaaguucccauucuuuacacggccccuccugucaaagugguguccuaaaagccuuuucaagaaaaagccagaucccaaaccugcugacgaggcagugccacagauuaucauaagugccgaggagcugccgggccccaaguuggggaccugcccuucccgcccaucuuguagcauggagcucuuugaaagaucccaugcucuggagaagcagaauacguuacagcugcccccucaagccauggaaaggucaaacaguugcccagagcucguccuuggacggcugagcuauucuaucauuuccaauuuggaugaagugggucaacagguggagcgccuagacaucccccugccgauuaucgcgcucauagucuucgcauacauuucaugcgccgcugccauccugccuuuuugggagacucagcuugauuucgaaaacgcauuuuacuucuguuuuguuacccugacaacuauuggcuucggggacaccguguuggagcaccccaauuucuuccucuuuuucagcaucuauaucauuguaggaauggaaauaguguucaucgcuuuuaaacugguccagaaccgauuaauugauaucuacaagaaugugaugcuguucuuugccaaaggcaaguucuaucaucuaguuaaaaaguga

SEQ ID NO: 57991 - RNA, 1011 nt, Artificial Sequence
  derived and/or modified sequence opt3 from KCNK1__Homo_sapiens__NP_002236
augcugcagagccucgccggcuccucuugcgugagacuugucgagaggcaccggucagcuugguguuucggguuucugguuuugggauacuuacuguaucuaguguucggugcaguaguguuuaguagcgucgaacuccccuacgaggaccugcuucgccaagaacugcgaaaguugaaacguagauuccucgaggaacaugagugccuguccgagcagcagcuggaacaguuucucggcaggguguuagaggccucuaacuaugggguuucggugcugucaaaugcgagcggaaacuggaauugggauuucaccagugcuuuguuuuucgccuccacaguccuuucuacuacgggcuacggucacaccgugccucugagcgacgggggaaaggcauuuuguaucauuuauuccguaauaggcaucccauucacacuacucuuucugacugccguugugcaacggauuaccguccaugugacacgcagaccggugcuuuacuuccacaucagguggggcuuuucaaaacaggucguugcuauugugcaugcaguacuguugggguucgugaccgucaguugcuucuuuuucauccccgccgcuguguuuagcguucucgaagaugacuggaacuuccuggagucuuuuuauuucuguuuuauauccuuaucaacuaucggacugggugauuacgugccuggcgagggguacaaucagaaguuccgggaacucuauaaaauuggaaucacaugcuaccuucuguugggccuaauugccaugcuggucgugcucgagaccuuuugugaacugcacgagcuuaagaaguuccgcaaaauguuuuauguaaagaaagacaaggaugaagaccagguucacaucauagagcaugaucaacugagcuucaguucuauuacggaccaggcggcagguaugaaagaggaucagaagcagaacgaaccauuuguggccacucaauccagcgcuugcgucgacgggcccgccaaucacuga

SEQ ID NO: 57992 - RNA, 1269 nt, Artificial Sequence
  derived and/or modified sequence opt3 from KCNK2__Homo_sapiens__NP_001017424
augaugaaccccagagccaagagggacuucuaccuggcugcaccugaucuccuugacccaaaaagcgccgcgcaaaauuccaagccgcggcugucuuuuucaaccaaacccaccguguuggcuagucgcgucgagagcgauacuacgaucaacguuaugaaguggaaaaccguguccacaauuuucuuaguagugguccuguaucuaauaaucggcgccacuguguuuaaggcacucgaacagccucacgagauuucucagcgaaccacaaucguuauucagaagcagaccuucaucucgcaacauucaugcgugaauagcacugaacuggacgagcuuauacagcagaucgucgccgcuauuaacgcagggaucauuccacugggaaauacaaguaaccagaucucccacugggauuuggguucuagcuuuuucuuugccggcaccgugauaacgacuauuggguucggaaauaucucaccccguaccgaaggcgguaaaaucuuuuguauuaucuacgcucuccuggggauuccucuguucggauuucucuuagccggcguaggcgaccaacuggggacaauauucggaaaggguaucgcgaaaguugaggauacuuuuauuaaguggaacgugucacagaccaaaaucagaauaauuaguacaaucaucuucauucuuuucggcugcgucuuguuuguggcacugccagccaucauuuucaagcauauagagggguggagcgcucuagacgccaucuauuuuguggucauuacccucacgacuaucggauucggcgauuacguugcuggugggucugacaucgaauaucuggauuuuuacaagcccgugguaugguucuggauucuugugggacuggcauauuuugccgcggucuuguccaugauaggcgacuggcucagggugaucuccaaaaagacaaaagaggaaguuggcgaguuccgggcccacgcagcugaguggaccgccaaugugacugcugaauuuaaggagacacgcagaaggcugagcgucgaaauuuacgauaaauuccagcgggccaccaguaucaagcgcaaauuaucugcagagcuggccgggaaccauaaucaggaacucacgccuugucgaagaacccuuuccgugaaccaccugacaagcgagagggacguauugccaccgcuacugaagacugagucgauuuaccucaauggacugacaccccacugcgcuggugaagagaucgcgguuauagaaaacaucaaguga

SEQ ID NO: 57993 - RNA, 1185 nt, Artificial Sequence
  derived and/or modified sequence opt3 from KCNK3__Homo_sapiens__NP_002237
augaagagacagaacgugaggacccuggcccucaucgucugcacauucacuuaccuucugguuggcgcugcaguguuugacgccuuggagagcgaacccgaguuaauugaacggcaacgccuggagcuacgacagcaggaacuccgugcgagauauaaucugucccaagggggauacgaggagcuugaaaggguagugcugcgguugaaaccucacaaggcugguguccaguggcgcuucgccggcucuuuuuauuucgcaauaacggugaucaccacaauuggguacggacaugccgcuccaucaacugauggcgguaaaguguuuuguauguucuaugcacuccuggggaucccgcugacccucguuauguuucagaguuuaggagagagaauuaacacacuggucagguaccuuuugcaccgggccaagaaaggccugggcaugcgccgagcugacgugagcauggccaauaugguacuaaucggguucuuuuccugcauaucuacccucuguaucggagcggcagccuucucgcauuaugaacacuggacauuuuuccaggcuuacuacuauugcuuuauuacucugaccacgaucgguuucggcgauuacguugcccuucagaaggaccaagcacugcagacucagccccaguauguggcuuucucauuugucuacauuuugaccgggcucacagugaucggagccuuccugaacuuagugguccugagauuuaugacuaugaaugcggaggaugagaagagggacgccgaacaucgggcacuccuuacccguaacggccaagcuggugggggaggcggcgggggaagcgcccacacaaccgauacggcuaguuccacugccgcagccgguggcgggggauuccgcaauguuuaugcugaggugcugcacuuucagucuauguguagcugcuugugguacaaauccagagaaaagcuacaguauucaauaccuaugauuaucccaagggaccugaguacaagcgauaccuguguagagcaaucucauuccucacccggcggugggggccgguacagcgacacuccuagucgacgcugccucuguucuggagcgccaagauccgcaauuagcucggugucuacaggccugcacucccuuucaaccuucagggggcugaugaaacggcgcaguagcgucuga

SEQ ID NO: 57994 - RNA, 1500 nt, Artificial Sequence
  derived and/or modified sequence opt3 from KCNK5__Homo_sapiens__NP_003731
augguggacagaggcccccugcucaccagcgccaucauuuucuaccuugcuauaggggcagccaucuuugagguccuggaggaaccucacuggaaggaagcgaaaaagaacuauuacacacagaaauugcauuuacugaaggaguucccaugccuaggacaagaaggucucgauaaaauucuggagguuguguccgacgcugccggccaggggguagcaaucacuggaaaucagacguuuaacaauuggaacuggccgaaugccaugauuuucgcugcaaccgugaucacaacuauaggcuaugguaacgucgcccccaagaccccugcugggagguuguuuuguguguucuacggacuguuuggcguuccauugugccucacauggaucucugcccugggcaaguucuuugggggacgggcgaaacgccugggucaguuccucaccaagcgaggcgugucauuacguaaagcacaaauuacuuguacagucaucuuuauuguguggggaguacugguucaccuugugauacccccuuucgucuuuauggugaccgagggguggaauuauaucgaaggcuuguacuauaguuucauuacgaucagcacuauugguuucggggauuuuguggccggagucaacccauccgcuaauuaccaugcccuguacagauauuucguugagcuauggaucuaccucggccuggcauggcuuucucuguuugugaacuggaagguaucgauguucguggaaguccacaaagcuaucaagaagaggcggcgcagaaggaaagagucauuugagagcaguccccauucccggaaggcccuucaggugaaaggcucuaccgcgagcaaggacguuaauauuuucuccuuucucaguaaaaaggaagagacauauaacgaucugauaaaacagaucgggaagaaggccaugaaaacuucaggagguggcgaaaccgggccuggaccaggcuuagguccgcaagggggcggacugcccgcacucccuccaagccuugugccccuggucguguacucuaagaaucgcguaccuacauuggaggaaguuucccagacccuacgaucaaaaggccacgugagcagaaguccagacgaggaggcugucgccagggcucccgaagauucuuccccggccccugagguguucaugaaccagcuggaccggauuagcgaagagugcgaacccugggaugcacaggacuaucacccacucaucuuucaggaugccucgauaacguucgucaauacugaggcugggcugucugacgaggaaacauccaagucaagucuugaggauaaccuggcgggagaagagagcccucaacagggugcagaagccaaagcucccuugaacaugggcgaguuuccauccucuagcgagucaaccuucacaaguacugaauccgagcucagcgugcccuacgaacagcugaugaaugaguauaacaaggccaauucuccuaaggggaccuga

SEQ ID NO: 57995 - RNA, 942 nt, Artificial Sequence
  derived and/or modified sequence opt3 from KCNK6__Homo_sapiens__NP_004814
augagaaggggcgcccugcucgcuggggcacuugccgcguacgcugccuaucugguguugggagcauuacuggucgcccggcuagaggguccccacgaagcucgccuccgagcagagcuggaaacccuucgugcccagcuguugcaaagaagcccuugcguugcugccccagcgcucgacgcauucguggagaggguacuggccgcuggccggcuggggcgcgugguccucgccaacgcauccggaucugcuaaugccucagauccggcgugggacuuugccagugcauuauucuuugcuagcacacugaucacuacggugggcuacgguuauaccacaccccuuacugaugccgggaaggcuuucuccauugccuuugcauugcugggaguuccuaccacaaugcuacuccugaccgccucugcucagagacuuucgcuguugcucacucaugugccacugucaugguuaagcaugagguggggcugggacccccggcgcgcggcauguuggcaccuggucgcccuccuuggcgugguaguuacagugugcuuccuggucccugcugugauauuugcccauuuggaagaggcauggaguuuccuagaugccuuuuacuucuguuuuaucucccugucuaccauugggcucggagacuaugugccaggugaggcucccggccagccuuaccgagcccuguauaaaguccuuguuacgguguaccuguucuuggggcucguagcaauggugcuggucuuacagacuuuuagacacgugagcgaucugcauggacuaaccgaacucauccugcuuccaccgcccugcccugcguccuucaacgcugacgaggaugacaggguugauauuuugggcccacaacccgaaucacaccagcagcugagugccagcucucacacagacuacgcauccaucccucgguga

SEQ ID NO: 57996 - RNA, 1125 nt, Artificial Sequence
  derived and/or modified sequence opt3 from KCNK9__Homo_sapiens__XP_011515404
augaagagacagaacgugaggacccugagccucaucgucugcacauucacuuaccuucugguuggcgccgccguguuugacgcauuggaguccgaucacgaaaugcgggaggaagagaaauuaaaggccgaagagauucgcauaaaagggaaguauaauaucucuucagaggacuaccgacaacuggagcuaguaauucuccagagugaaccccaucgugcgggagugcaguggaaauucgcugguagcuuuuauuucgccaucacggucauuaccacaaucggcuacgggcacgcagccccuggaacugaugcuggcaaggcauuuuguauguucuaugccgugcuggguauaccacuuacccugguuauguuucaguccuugggggaaagaaugaacacauucgugagguaccuccugaagcggaucaaaaagugcuguggaaugcgcaauaccgacgucucuauggagaacauggugacuguaggcuuuuucucgugcaugggcacacuguguauuggggcugccgcguuuucacaaugcgaggaauggagcuucuuucaugcauauuacuacuguuucaucacccucacgacuauuggauucggugauuauguugccuuacagaccaaaggcgcucugcagaagaaaccgcuuuacguggccuuuaguuucauguauaucuuggucgggcugacagugauaggagcauuucuaaaucucgugguccugagauuccuuacuaugaacuccgaggacgaaaggcgggaugcugaggaacgcgccucucuggcgggcaaucgaaacagcaugguuauucacauccccgaggagccuagaccauccaggccccgguacaaggccgacgugccugauuugcagucaguaugcaguuguaccugcuaucguagccaagacuacggugggcgcucuguggcaccacagaauagcuuuucagcuaagcucgcuccccauuauuuccacagcauuaguuacaaaaucgaagagaucucuccuuccacacugaagaacagcuuauuuccaucgccgauuucuuccauaucacccggacugcacaguuucaccgaucaucagagacucaugaaaaggcggaaguccgucuga

SEQ ID NO: 57997 - RNA, 3711 nt, Artificial Sequence
  derived and/or modified sequence opt3 from KCNMA1__Homo_sapiens__NP_001154824
auggccaacggcgggggagguggcgggggaagcuccggcggugggggaggcggcgggggaucuucacugagaaugaguagcaauauccacgcuaaccaucucucccuugacgcaucuucgucaagcaguuccucuagcuccucaaguucuucuuccucaagcaguucuuccagcucgucugugcacgagcccaagauggaugcccugauuauaccugucaccauggaaguuccaugcgacuccaggggucagcggauguggugggcguucuuggcuucaaguauggugacauuuuucggcggguuauuuaucauucugcuauggcgcacucucaaauaccuguggacgguauguugccauuguggaggcaagaccaaagaggcccaaaagaucaauaacgguagcucccaggcagaugggacacuuaaaccgguggacgaaaaggaggaagccgucgcugcagaggugggauggaugacuucuguuaaggauugggccggcgugaugauuagcgcucagacccugacaggccgagucuuggugguacucguuuucgcccugucaaucggggcgcuggugauauauuuuaucgacaguuccaaucccauugagagcugccagaacuucuacaaagauuuuacccuccaaaucgacauggcauucaaugucuuuuucuuacuguauuuuggacuucguuucauugccgcuaacgauaaguugugguuuuggcuggaagugaauagcguggucgacuucuucacuguuccuccaguguuuguaucaguguaccuaaacagaaguuggcucggucugagguuccuucgggcccugcgcuugauccaguuuagcgagauacuccaguuccugaauauuuuaaaaacauccaacucuaucaagcuggucaaucuccuuucgauuuuuaucagcaccuggcugacggcagcuggcuucauccacuugguggaaaacuccggggaucccugggagaauuuucagaacaaccaagcccuaacuuauugggaguguguuuaccugcucauggugaccaugucaacagucggauauggcgacguguacgcgaaaacuacccuggguagacuuuucaugguauuuuucauucugggcggguuggccauguuugcaaguuacguuccugaaauaaucgagcucauuggaaauaggaagaaguauggcgggucuuacagcgcuguguccggacggaaacauaucgucgugugcggucacauaacacuggaaucagucagcaacuucuuaaaggauuuucugcacaaagaccgcgacgaugugaauguugagauuguguuccuacauaacaucucuccaaaucucgaacuggaggcccuuuucaagcgacacuuuacccagguagaguucuaucagggcuccgucuugaacccccaugaccuggcuagagugaaaaucgaaagugccgaugcaugucucauucuggccaauaaguacugcgcugacccugaugcggaggacgcaagcaacaucaugaggguuauuucuaucaaaaauuaucacccaaagauacggauuaucacgcagaugcuucaauaccacaacaaggcccaucuguugaauaucccguccuggaacuggaaagaaggggaugacgcuauuugucucgccgagcugaaguuaggauuuauagcacagucaugccuggcccagggccuaaguacuaugcucgcuaaucuguucagcaugcguucguuuaucaaaauugaagaggauacauggcaaaaguauuaccuugaggguguguccaacgaaauguacaccgaguauuugucuagcgccuucgucgggcugucauuucccacugugugugaacucugcuucguaaaacugaaguuacugaugaucgcaauugaguacaagagugcgaaucgcgaauccagaauccuuauaaacccuggcaaccacuugaaaauccaggagggaacacucggcuuuuucauugcuucugacgccaaggaggugaaaagggcauuuuucuauugcaaggccugucaugaugacaucaccgacccaaaacggauuaagaagugcggguguaaacgacccaagaugagcaucuacaaacgcaugagaagggcuugcuguuuugauugcggacgguccgaacgcgacuguucaugcaugagcgguagaguuaggggcaaugucgauacgcuggagcgugccuucccucuaaguucuguguccgugaacgacuguagcaccucguuccgggcauuugaagaugagcagccaucaacacugucucccaagaaaaagcagcgaaaugggggaaugagaaacaguccgaauacuuccccuaagcucaugaggcacgacccccugcuuauaccaggcaacgaucaaauugacaauauggauagcaacgucaaaaaguaugacucuaccgguauguuccauuggugcgcuccuaaagagaucgaaaagguuauuuugacacgcagcgaggccgcgaugacugugcuguccgggcacgugguagucuguaucuuuggcgaugugucaagugccuuaauaggacuccggaaucugguuaugccccuuagagcuagcaacuuccacuaccaugaacugaaacacaucguguuugucggcucuauugaguauuugaagagggaaugggagacccuccauaauuucccaaaaguguccauccugcccgggacaccucuaucacgcgcagaccugcgagccguuaacauuaaucucugcgauaugugcgugauccugagugcuaaccagaauaacauagacgacaccagccuucaggauaaggaguguauuuuggccucccugaacaucaagucuaugcaguuugacgauucgaucggaguauuacaagcaaauagccagggcuucacuccaccggguauggaccggucaucccccgauaacaguccuguccacgggaugcuccgucagccaucuauuacgacaggagugaauauccccauuauaaccgaacuggugaacgacacuaauguccaguuucuugaucaagacgaugacgaugacccugauaccgagcuguaccuaacacagccauucgcgugcggcaccgccuuugcuguuagcgugcucgacucccugaugucagccacuuacuucaacgacaauaucuugacacugauuagaacguuaguaaccgguggcgcaacucccgaacucgaggcucugaucgccgaagagaacgcacuucgcgggggauauucuacaccgcagacccuggccaauagggaucgguguagaguggcucaguuggcgcuccuggacggcccuuucgccgaucuaggggacggaggcugcuacggugaucuguuuuguaaagcacuuaagacauauaacaugcucugcuucgggauuuacaggcugcgagacgcucacuugagcacuccaagucaauguaccaaacgcuaugucaucacgaaucccccuuacgaguuugaacuggugcccaccgauuuaauauucugccucaugcaguuugaccauaacgccggacagucccgggccagccugucucacucaucccauaguagccaaucgucuuccaagaaaagcucaaguguucacucuaucccauccacagcuaauagacagaacaggccuaagagccgugagucacgcgauaagcagaaauaugugcaggaggaacggcuuuga

SEQ ID NO: 57998 - RNA, 576 nt, Artificial Sequence
  derived and/or modified sequence opt3 from KCNMB1__Homo_sapiens__NP_004128
auggugaagaaacuggucauggcccagaagagaggcgagaccagggcucucugccuugggguuacaauggugguaugugcagugaucacuuacuauauucuggucacgaccguguugcccuuauaccagaaaagcguuuggacacaggaauccaagugccaccugauagagacuaacauccgggaccaggaagaguugaaaggaaagaaggugccucaguauccaugucucugggucaaugugucugccgcgggucgcugggcuguacuguaccauaccgaagauacacgagaccaaaaccagcagugcucauauauuccgggcaguguugauaauuaccagaccgcccgugcagacguggagaaagucagagccaaguuccaagagcaacagguguuuuauuguuucagcgcucccagggggaacgaaacuuccgugcuuuuucagcggcuguacggaccucaagcacuacucuucucucuguuuuggccaacauuccugcucaccggcgguuuacugaucauugccauggucaaaucgaaucaguaccuuucaaucuuggcugcccagaaguga

SEQ ID NO: 57999 - RNA, 708 nt, Artificial Sequence
  derived and/or modified sequence opt3 from KCNMB2__Homo_sapiens__NP_001265840
auguucaucuggaccagcggcagaacauccucuucauacaggcacgacgagaagcggaacauuuaucagaaaauacgcgaucaugaccugcucgauaagcgaaaaacugugacggcccuuaaggcuggggaagaccgugcaauccuguugggauuagccaugauggucugcaguauuaugauguacuuucugcuagguaucacccuccugagaagcuauaugcaauccguuuggacagaggaaucucaguguacucuucugaaugcgucgauuaccgagacauucaacugcucauuuagcuguggccccgauugcuggaaauugagucaguacccuugucuccagguguauguaaaucugaccuccucuggggaaaagcugcucuuauaccacacugaggagacaaucaagauaaaccaaaaaugcagcuauaucccaaaguguggcaaaaauuucgaagaguccaugucacuggugaacgucgugauggaaaauuuuaggaaguaccagcauuucaguugcuacagcgacccggagggaaaccagaaaucuguuauucuuaccaaguuguauuccucaaaugugcuguuucacagccuauucuggcccacguguaugauggcugguggggucgccaucguggcaaugguaaagcucacucaguaccugagucuucugugcgagcggauucaacgcaucaacagauga

SEQ ID NO: 58000 - RNA, 522 nt, Artificial Sequence
  derived and/or modified sequence opt3 from KCNMB3__Homo_sapiens__NP_001157149
augcagcccuucagcaucccugugcaaauuacccugcagggcuccagaaggcggcaggggcgcacagccuuuccagcuucuggaaagaaacgagagacugacuacucagauggugacccgcucgauguccacaagcgucuucccaguagcgcaggcgaagacagagccguuaugcugggguucgcgaugaugggauuuuccguguugauguucuuuuuacugggcacgaccauacuaaaaccuuucaugcucucuauccagagggaggaaucgacaugcacugcuauucauaccgauaucauggacgauuggcuggacugugccuuuacaugcgguguacacugucaugggcaaggaaaguauccaugccuucagguguucgucaaccugucacaccccggccagaaagcauugcuccauuacaaugaggaagccgugcagauuaacccuaagcgggauguuaccgacugucgcgugaaggagaaacaaacucugacagucagcgaugagcacaagcaguga

SEQ ID NO: 58001 - RNA, 633 nt, Artificial Sequence
  derived and/or modified sequence opt3 from KCNMB4__Homo_sapiens__NP_055320
auggccaagcugagaguggcuuacgaguauaccgaagcagaggacaaaagcaucaggcucggccuuuuccugauuauauccggggucguuucuuuguuuaucuucggauuuugcugguuaucacccgcccugcaggaucuacaagcgacagaagcuaacuguacugugcucaguguacagcagauuggugagguguucgaaugcacguuuaccuguggcgccgacugccgggggacaagccaguacccuuguguccaaguguauguuaauaacuccgagucuaauucgcgcgcacugcuucacucagaugagcaucagcuguugacuaacccaaagugcagcuacaucccgcccuguaaacgagaaaaucagaagaaccucgagagugugaugaauuggcagcaauauuggaaagacgaaauuggaucccagccuuuuaccugcuacuucaaccagcaccagcguccagaugacguccugcugcauagaacacacgaugagaucgugcucuuacauuguuuccuguggccccuuguaaccuuuguugugggcgucuugauaguggugcugacuaucugcgccaagucucuagcugucaaggcagaggccaugaaaaagaggaaauucagcuga

SEQ ID NO: 58002 - RNA, 1632 nt, Artificial Sequence
  derived and/or modified sequence opt3 from KCNN1__Homo_sapiens__NP_002239
augaacagccacuccuacaauggcucuguggggagaccccugggaucagguccuggcgcccucgggagggacccaccggaucccgaggcuggacauccuccacagcccccucacaguccaggccuucaagucguuguggcaaagagcgaacccgcccggccuuccccagguucuccgcgcgggcagccccaggaccaggaugacgaugaggacgaugaagaggacgaagcgggacgacaacgugcuucgggcaaaccuucaaacguaggccauagacuggggcacaggcgggccuuguucgagaagcgcaaaagauuaagcgauuaugcacugaucuuuggaauguucgguauuguggucauggugaccgagacagaacuaaguuggggcguuuacacuaaggagucccucuauucuuuugcccugaaaugccuuauaagccuguccacggcuaucuugcucgggcuggugguccuguaccaugcaagggaaauucaacucuucaugguggacaauggagccgaugacuggcggaucgcuaugaccugugagcgcguauuuuuaauuucacuggagcuugccguuugcgcgauccacccagugcccggccacuaucgauucacauggacugcaagauuggccuuuaccuacgcuccuagugucgccgaagcagauguggacgugcugcuaagcauaccaauguuccucaggcuguaucuucugggucgggucauguugcuccauucuaagaucuuuacagacgcuuccucacguagcauuggggcccugaacaagaucaccuucaauacucgcuuuguuaugaaaacauuaaugaccauuugucccggaacggugcugcucguauucaguaucucuuccuggauaauugcggccuggacugugagagucugcgagagguaccacgauaagcaggaagugaccagcaacuuucuuggcgcaauguggcugaucucgauuacauucuugucuaucggcuacggggacaugguuccgcauacuuauuguggaaaaggugugugccuacugaccggcaucaugggggcuggauguacagcccucgucguggcuguaguugcccggaagcuggagcuuaccaaagcagaaaagcacgugcacaauuucaugauggauacgcagcugacuaagcgagucaaaaacgccgcugcgaauguguugcgcgagacauggcucauuuacaagcauaccagacuggucaaaaagccugaccaggcaagggugcggaaacaccagcgcaaguuuuuacaggccauacaucaggcucaaaaacugagauccguuaagaucgagcagggcaagcuaaacgaucaggccaauacucucacagaccuggcaaaaacccaaacggugauguaugaucuuguaucagaauugcacgcccagcaugaggaacuggaggcuaggcucgccacccuggaaagucgucuugacgcacugggugcgagcuugcaggcucuccccgggcugauugcccaggcaauccggccaccucccccacccuuaccuccacgaccgggccccggaccucaagaucaggccgcuagauccucuccauguagguggacacccgucgccccuagcgacugcggcuga

SEQ ID NO: 58003 - RNA, 1740 nt, Artificial Sequence
  derived and/or modified sequence opt3 from KCNN2__Homo_sapiens__NP_067627
augagcuccugcagauacaacggcggggugaugaggccccugucuaaucucucagccagucggcgcaaccuucacgagauggacagcgaagcucagccucugcaaccaccggcauccgucggagguggcgggggagccucuucgcccucagcggcugccgcagccgcugcagccguuagcaguuccgcuccugagaucgugguaucuaagccagaacauaauaacagcaauaacuuggccuuauauggcaccggugggggaggcuccacaggcgggggagguggcgggggaggcucaggucacgggaguagcucuggaacuaaauccucaaagaaaaagaaucagaacauuggcuacaaacugggccaucgacgugcgcuauucgagaagagaaagaggcucagcgauuaugcacugauauuugggauguucggaaucguggucauggugauugaaacggagcuuaguuggggugccuacgacaaggcuucucuguauuccuuggcccucaaaugucugaucagccugucgaccauuauccucuuaggccugauaaucguuuaccacgcacgggagauucagcuuuuuaugguggauaauggggcugacgauuggcgcaucgccaugacauaugaaagaauuuucuuuaucugcuuggagauacuggucugugcgauucaucccaucccuggaaacuacacuuucaccuggacagccaggcuagcauuuucuuacgcuccauccaccacuacagccgacguggauauuauccucucaauccccauguuccugcggcuuuaucugauugcucgcguaauguugcuccacaguaaacuguuuaccgacgccagcucccgaucuauaggcgcauuaaauaagaucaacuucaauacgagauuuguuaugaaaacucugaugaccauuugcccugguacagugcuccuugucuucagcaucucacuguggauaauugccgcuuggacugugagggcgugugaacgguaccacgaucagcaagacgugaccaguaacuuuuugggggcaauguggcuaaucuccaucacauuccugagcauuggcuauggagauauggucccaaauaccuacugcggcaaggggguuugucuccugacgggaaucaugggugccggcugcacugcucuugugguagccguggucgcacguaagcuggaguugacaaaagccgagaagcaugugcacaacuucaugauggacacccagcucacuaaacgcguuaagaacgcugccgcaaaugugcugagagaaacaugguuaauuuauaaaaacaccaagcuggucaaaaagauagaucaugcgaaggugaggaaacaccagcggaaguuucuacaggcuauccaccaacuccgaucuguaaaaauggagcagcgcaagcugaaugaccaggccaacacgcuuguugacuuggcaaaaacccagaauauuauguacgauaugaucucagaccugaacgaaagaagugaggauuucgaaaagaggaucgugacacucgagacuaagcuggagacccuuauugggagcauacaugcccugccgggauugaucucccaaacaauucggcagcagcaacgcgacuuuaucgaagcucagauggagucuuaugauaaacacgucacuuacaaugccgaaagaucgaggagcuccucacgucggcgaagaaguucuagcaccgcacccccuacauccucagagagcucuuga

SEQ ID NO: 58004 - RNA, 2196 nt, Artificial Sequence
  derived and/or modified sequence opt3 from KCNN3__Homo_sapiens__NP_002240
auggacaccagcggccacuuccaugauuccggggugggagaccuggaugaggaccccaagugcccuuguccaucuucaggugaugaacagcaacagcagcagcaacagcagcagcaacagcagccgcccccuccagcucccccugccgcaccacagcaaccccucggcccuagucuucagccacagccgccccaacugcagcagcagcaacagcagcagcaacagcagcagcaacagcagccuccacaccccuugagccaguuagcccaacugcagucccagccuguccauccagggcuacuccacucuucgcccacagcguuuagagcuccgccuucaagcaacaguacugccauccugcaucccuccucuaggcaaggaagccagcuuaaucugaacgaccacuugcucggccacuccccaucaaguacggcaaccagcgguccugggggaggcucucggcaucgccaggccucaccccugguucaccgacgugauuccaauccauucacagagauugcuaugagcaguugcaaauacucuggcggggugaugaagccccuguccagacucagcgcaucgaggcggaacuuaauagaagccgagacugaaggacagccucugcaauuguuuucuccauccaauccgcccgagaucguaauuucaagucgcgaggacaaccaugcucaccagacccuucugcaccauccuaaugccacacacaaccaucagcacgcggguaccacugcaagcuccacaaccuucccaaaagccaauaagaggaaaaaccagaauaucggcuauaagcuagggcauagacgggcucucuuugaaaagcgcaaacgacugucugauuacgcccuuauuuucggaauguuuggcaucguggucauggugauagagacggaacugagcugggguuuguauucaaaggacaguauguucucccucgcacugaaauguuuaaucagccugucuacuauuauccuccuugggcugauuaucgcuuaccacaccagagagguucaauuguuugugauagauaacggagccgacgauuggaggauugcgaugacauaugagcggauccuauacauuucacuggaaaugcucgucugcgccauccaccccaucccuggcgaguauaaguucuuuuggacugcacgucuggcuuucaguuacaccccaagccgcgccgaagcugacguggacauuauacuuuccauccccauguuucugagauuguaccucauugccaggguaaugcuguuacauucuaaacuguucacagaugcaucgagccgguccaucggcgcccuaaauaagauaaacuucaauacccgauuuguuaugaagacgcucaugacuauuuguccggggacagugcugcuugucuucucaaucaguuuguggaucauugcugcguggaccgugcgcgugugcgagagauaucacgaccagcaggaugucacuucuaacuuucugggagcaauguggcucaucagcauuacauuccuguccauagguuacggcgacaugguuccucauaccuauugugggaaaggagugugccuucugacgggcaucaugggugccggguguaccgcuuugguaguggccgucguggcaaggaagcucgaacugacaaaagccgagaagcacguucacaacuuuaugauggauacucaguuaaccaaacggauuaagaaugcugccgcaaacgugcugcgcgagacauggcuaaucuacaaacauacuaagcuccugaagaaaaucgaccacgcgaaggucagaaaacaucaaaggaaguuccuucaggcuauucaccaguugcguucagugaaaauggaacaacggaagcugagcgaucaggccaauacccucguagaccugucuaagaugcagaacguuauguaugauuuaauaacagagcugaaugaccgauccgaagaucuugagaaacagaucggcaguuuggaaagcaagcucgagcaucugaccgcaucuuuuaacucccuaccacugcucauugccgacacucugagacaacagcagcagcaacuuuugucagcuaucauugaggccaggggagugagugucgcagugggcacgacacacacccccaucagcgacucgccuauaggggucuccucuacuagcuuccccaccccauacacaucaaguuccucuugcuga

SEQ ID NO: 58005 - RNA, 1284 nt, Artificial Sequence
  derived and/or modified sequence opt3 from KCNN4__Homo_sapiens__NP_002241
augggcggggaccuggugcucggacuuggugcccugagaaggcggaagcgcuuguuagagcaggaaaagagccuggcuggcugggcauugguccucgccgggaccggaaucggccugaugguucuucacgcggagaugcugugguucggugggugcuccugggcuuuguaccucuuucuggugaaguguacaauuucuauaucaacuuuccugcucuuaugccugaucguagccuuucaugcaaaagaagugcaacuuuucaugacggauaacggauugcgagacuggcgugucgcccugaccggcagacaggcugcacagauugugcuagagcucguuguguguggccugcaccccgccccugucagggggccaccgugcgugcaggaucuuggagcuccccugacaaguccucaaccauggcccgguuuucuaggccagggggaagcccuccugagcuuagcgaugcugcuccggcuuuaucugguaccucgcgcaguuuugcuaagauccggagugcugcucaaugccucuuacaggucgaucggcgcucugaaccagguccgguuccgccauugguuuguggccaaacuuuauaugaauacucacccaggucgacuguugcucgggcugaccuuaggacuguggcuaacaaccgcaugggugcucucagucgcugagagacaggccguuaacgcgacuggccaucugagcgacacacuuugguugauucccaucaccuuccugacgauaggcuacggggaugugguaccuggaacuaugugggguaaaaucgugugucucugcaccggcgucauggggguguguugcacagcccugcuuguugcaguggucgcuaggaagcuggaguuuaauaaggccgaaaaacacgugcacaacuucaugauggacauucaauauacuaaggagaugaaagaaagugcugcccggguauugcaggaggcauggauguuuuacaagcauacccgucgcaaagagucccacgccgcuagaaggcaucagcggaagcuccuggcggcaaucaaugccuuccgacagguucgcuuaaagcacagaaaacugagggaacaagugaacucuauggucgauauuagcaagaugcacaugauccuauaugaccuccagcagaaucuguccucaagucaucgggcucuugagaaacaaauagauacauuggccggaaagcuggacgcacucaccgaacuguuaagcacggcccugggcccacgccagcuuccggagcccucucagcaguccaaauga

SEQ ID NO: 58006 - RNA, 2031 nt, Artificial Sequence
  derived and/or modified sequence opt3 from KCNQ1__Homo_sapiens__NP_000209
auggccgcugcaagcucucccccuagagccgagaggaagcgguggggcugggggcgccugccaggagcgcgacgugguuccgcuggccucgccaaaaagugcccguucucacuugaacuggcagaagggggacccgccggcggugcuuuguacgcaccuaucgccccaggggcucccggaccugccccacccgcgaguccugcagccccagcugccccgcccguggcaagcgacuuaggcccuagaccacccgucucccuggauccuaggguuucuauuuauucgacccggcgcccagugcuagcuagaacacacguacagggcaggguguacaacuuucucgagcggcccacuggguggaaauguuucgucuaucauuuugccguguuccugauaguucuugugugccugaucuuuucagucuugagcacgauugagcaauacgcggcccucgcaaccggaacacuguucuggauggaaaucgugcugguaguguuuuucgguacugaguauguuguccgccucuggagugcuggcugucgauccaaguacgugggguuauggggaagacugagguuugcccggaaaccgauuucuaucauagaccuuaucguggucguugcuagcauggugguauugugcgugggcuccaagggucaggucuucgccaccucagcaauucgugggauccgcuuucugcagauucuaagaaugcuccacguggauaggcagggaggcacauggcggcugcuuggcaguguuguguucauccaucgacaagagcugauaaccacuuuguauauuggguuucucggacugaucuucagcucuuacuucgucuacuuagccgaaaaggacgcugugaaugaguccggucgcguagaauuuggcucauaugcggaugcacugugguggggaguugugacagucaccacgauuggguacggcgacaaagugccucagacuugggucgguaagaccaucgccagcuguuucaguguguuugcuaucucuuucuuugcccuccccgcagggauucuuggcuccggauucgcccugaaaguucagcagaagcaaagacagaaacacuuuaacaggcagauaccagcugccgcgagcuugauccagacagcauggcggugcuaugcugccgagaauccugauucgucuacuuggaagauuuacauccgcaaggcacccagaucccauacccuacugucaccaagucccaaaccuaagaaaagcgugguagucaagaaaaagaaauucaagcucgacaaggauaacggcgugacaccaggggagaaaaugcugaccguuccgcacauaacgugugaucccccugaagagaggcgucuugaccacuuuuccguggacggauaugauucuagcguccggaagucaccaacucuguuggaagugaguaugccccauuucaugcgaacaaauuccuuugccgaggaccucgaccuggaaggugagaccuuacugacuccuauuacacacaucagccaacuaagagagcaucacagggcuaccaucaaaguaauucgccggaugcaguacuucguggccaagaaaaaguuucagcaagcaagaaagccauaugauguuagggacgucaucgaacaguacucucagggccaccucaaccugauggugcgcauuaaagagcuucagcgacgguuggaucaaucaauagggaagcccagucuguucaucagcguguccgaaaaaucuaaggaccguggaucgaauacgauuggcgcuagacucaacagggucgaggauaaaguuacccagcuggaccagcgccuugcccugaucacagauauguugcaucagcuccugagcuuacacgguggguccacuccgggcucaggaggcccuccacgggaagggggagcgcauaucacccaacccugcgguaguggcgggucuguggacccugagcuguuccuacccagcaauacacucccaacuuacgagcagcugaccgugccuagaaggggacccgaugaaggcuccuga

SEQ ID NO: 58007 - RNA, 2535 nt, Artificial Sequence
  derived and/or modified sequence opt3 from KCNQ2__Homo_sapiens__NP_004509
auggugcagaagucuagaaacggcggggucuaccccggaccuuccggugagaaaaagcugaaaguuggcuucguggggcucgacccaggagccccggauucuaccagggacggcgcacuucugaucgcugguucagaagcccccaagcgggggaguauuuugagcaaaccucgcgcgggaggcgcuggcgccgggaagccacccaagcgaaaugcauuuuaucguaaauuacaaaacuuccuguacaauguacuagagagaccuaggggaugggccuuuauauaucacgcuuacguguuccuccuggucuuuuccugccuugugcugucuguuuucucgacaaucaaggaauaugagaaaucaagcgaaggugcauuguacauucucgagaucgugacuauugucguguuuggcguagaguauuucguucggaucugggccgcuggguguugcugucgcuacagaggauggaggggccggcugaaguuugcccgcaaaccauucugcgugauagauaucaugguccugauugcgaguaucgcagugcucgccgcugguucccaggggaacguguuugccacgucugcauuacgaagccugagauuccuucagauuuugaggaugauccggauggaccgucgcggaggcaccuggaagcugcuaggcuccgucguuuacgcucauucaaaggaacucgugacagccugguauauaggguuucugugucuuauucuggcgaguuucuugguauaccucgccgagaaaggagaaaaugaucacuucgacacuuaugcagaugcucuguggugggguuuaaucacccugacaaccauuggcuacggggacaaguauccccagacuuggaacggaagacuccuugccgcuacauuuacccugaucggcgugagcuucuuugccuugccugcagguauccuagggucuggcuucgcccugaaaguccaagagcagcauaggcagaagcacuuugagaaacggcgaaauccagcugcgggacucauucaguccgcauggcgcuucuacgccacgaaccugucaagaacugaucuucauagcaccuggcaauauuacgaaaggacagugacuguuccgauguaccggcugauacccccuuugaaucagcucgagcuguuacgcaaccugaagaguaaaucuggccuagcuuuuagaaaggacccacccccugaaccaucccccagccagaaggugucgcucaaagauagggucuucucuuccccgcgugggguggccgcaaagggaaaagguucaccucaggcccaaaccguacggcgaagucccagcgcugaccagucccuggaggauucuccaagcaagguuccuaaaucauggaguuuuggcgacagauccagggcccgccaggcauuccggaucaagggggcggcuagcagacaaaauucugaagaggccucacuucccggagaggacauuguggaugacaagaguugcccaugugaauuugucacagaggauuugacccccggccugaaagugagcaucagggcagucugcgugaugcgcuuccucguuuccaagcgaaaauuuaaggaaucucugcggccuuaugacgugauggauguaauagagcaguacucggccggucaccuugacaugcugagccguauuaaauccuugcagucaagagucgaucagaucguggggaggggcccagcuaucacggacaaggaucgcacuaagggaccggccgaagcagagcuccccgaggacccuaguaugaugggccggcuggggaaaguugaaaagcaaguguuaucuauggagaaaaagcuggauuuccuagucaacauuuauaugcagagaaugggaaucccacccacagaaaccgaggcuuacuucggugccaaagaaccugagccagcgcccccguaucacagcccugaggacuccagggaacauguggaccgacacggcuguauuguaaagauagugcgcucaagcagcuccacugggcagaagaauuuuagugccccacccgcugcaccucccguucagugcccaccuagcacaucuuggcaaccccagucccauccacggcagggacacggcaccucaccggucggugaucacgggagucucgugagaaucccucccccacccgcccaugagaggagccugucggcuuacggcggaggcaaccgugccuccauggaguuccuucgccaggaggacacgccugggugucggccacccgagggaaauuugagagauucugacaccagcauuucaaucccuaguguggaucacgaagaacuggaaagguccuuuucuggcuucagcaucucccaaucaaaagagaaccucgacgcacugaacagcugcuaugcggccgucgcuccgugcgccaagguucgaccauacauugcagaaggugagagugauacagacucugauuuauguacucccugcgggccuccaccccgguccgcuaccggagagggcccuuuuggugacgugggcugggccgggccgcgcaaauga

SEQ ID NO: 58008 - RNA, 2259 nt, Artificial Sequence
  derived and/or modified sequence opt3 from KCNQ3__Homo_sapiens__NP_001191753
augaagcccgccgagcacgcuaccauguuccugaucgugcucggcugccuuauucuggcagucuugacaacuuuuaaagaauacgagacgguuagcggggacugguuacugcuacucgaaaccuucgccauauuuaucuucggagcggaguuugcucugagaauuugggccgcagguuguugcuguagguauaagggcuggcgggggcgccuuaaauucgcccgaaagccucugugcauguuggauaucuuugugcucauugcuuccguaccaguggucgcagugggaaaccagggcaauguucuggccacaucucugcguucacucagauucuuacaaauccugaggaugcuucggauggaccgcagaggugggacuuggaaauugcugggaagugcuauaugugcccauagcaaggaacuaaucaccgcgugguacauuggcuuucucacacugauccuuuccucuuuccugguguauuuggucgagaaggaugugccggagguagacgcacagggcgaagagaugaaagaagaguuugagaccuacgccgaugcucucuggugggggcugauuacuuuagccacaaucggauauggugacaagacccccaaaacgugggaaggcaggcugauagcagcuacuuucucgcucauugggguuucauuuuucgcccuuccugcgggaauccugggcagcgguuuggcccuaaaggugcaggagcagcaccggcaaaaacauuucgaaaagcgccgaaagccagcagcugagcugauucaggccgcuuggagauacuaugccaccaaccccaauaggaucgaucucgucgcaacauggcgguuuuacgaaagugugguguccuucccauuuuuccguaaagagcagcuggaggccgcuucuagccagaaacuugggcuguuggaccgcgucagacucuccaacccuaggggaucaaauacuaagggcaagcuguuuacccccuuaaacguugaugcgaucgaagagaguccuagcaaagaaccaaagccggugggccugaauaacaaagagcgguuccgaacagcauuucgcaugaaggccuacgcuuucuggcaaucuuccgaagacgccgggaccggagaucccauggcagaggacagagguuauggcaaugauuuuccuauugaggacaugauaccaacgcuaaaggccgcuaucagggccguacggauucuccaguuccgccuguacaaaaagaaauuuaaggaaacucuuagacccuaugacgugaaagaugucaucgagcaguacucagcagggcacuuggacaugcugagcaggauaaaguaucuccagacacguauugauaugaucuucaccccuggaccacccaguacuccgaagcauaaaaagucucaaaaaggcuccgcguuuacauucccuagccagcagucgccccggaacgaaccauacguggcucgaccuucuaccuccgagaucgaagaccaaucaaugauggguaaguucguuaaaguggagagacagguccaggauauggggaagaagcuggacuuucuuguggauaugcacaugcagcacauggagaggcugcaaguacagguuacggaauauuaccccaccaaaggcacaaguagcccagccgaggcagaaaagaaagaggacaaucgcuacuccgauuugaagacuauuaucugcaacuauucugagaccggacccccugaaccaccguacagcuuccaucaggugacaauugacaaagucucacccuauggcuuuuucgcccacgauccugugaaucucccaagagggggacccaguuccgguaagguccaggcuacuccuccaagcucugccaccacauacguggagcggcccaccguucugccgauauuaacucugcuagacucaagggugaguugucauagccaagcagaccuccagggcccuuauuccgaucgcaucucuccacgacagcggcguucgauuacgagagacagcgauacaccccugucccuuaugucaguaaaccacgaagaguuggaaaggaguccuucuggguuuagcaucucccaggaccgcgaugacuacgucuucggacccaauggcgguucaagcuggaugcgggagaagagauaucuggcugagggggaaaccgauacugacaccgauccauuuacaccuucuggcuccaugccccucaguagcaccggagacggcaucucugauuccguguggacuccaucaaacaaaccgauuuga

SEQ ID NO: 58009 - RNA, 2772 nt, Artificial Sequence
  derived and/or modified sequence opt3 from KCNQ5__Homo_sapiens__NP_001153602
augcccagacaccaugccggcggggaggaaggaggugcugcaggccugugggucaagagcggggccgcggcugccgcagccggaggcgguaggcucggguccggaaugaaagacguggagucuggccggggccgcguucuucugaacucagcugcagcccgaggggauggauuguuacugcuagguacccgugcugccacacucggcgggggaggcggugggcugagagaaaguaggcggggaaagcagggcgcgcgcaugagccuucugggcaaaccuuuguccuacacuucuucgcaaucaugcagaaggaaugugaaguaucggcgcguacagaacuaccucuauaaugugcuggagcgaccaagagggugggcauucaucuaccacgccuuugucuuccugcucguguuuggauguuuaauucugagcguuuucaguacgauaccggaacauaccaaacuugcuuccucuugcuugcugauccuagaguuugugaugauugucguguucggucucgaguuuaucauuaggaucuggagcgccggcuguugcugucgguaucguggguggcagggacgccugagauucgcaaggaagcccuuuugcguaauagacacaaucguucuuauugcuuccaucgccguggucucagcgaagacucagggcaacauuuucgccaccagugcacugcggagcuugcgauuucuccaaauccugcgcauggugagaauggauaggcggggugggacauggaaauuacugggcucuguggucuacgcucacuccaaggaacucauaaccgccugguauauuggauuccuuguucugaucuuuagcagcuucuugguguaccuaguagagaaagacgcuaauaaggaguucaguacuuacgccgaugcacugugguggggcacaauuacccucacgacuaucggguauggagacaaaaccccucugacauggcuuggucgccuguugucugccggcuuugcucuccuggggaucuccuucuuugcguuaccagcaggcauucugggaagcgguuucgcccuaaaggugcaggaacagcauagacagaagcacuuugagaaaaggcguaaccccgcugccaaucucauacaaugugucuggcggucguacgcagccgaugaaaagucuguguccaucgcuacuuggaaaccucaccugaaggcccuucauaccugcucaccaacaaaccagaaauugaguuucaaggagcgaguuagaauggcaagccccagggggcaguccauuaaaucucgccaggcgagcgugggcgaccggagaucaccuaguaccgauaucacggcugaaggauccccaacuaagguccaaaagagcuggucuuuuaaugacaggacacgcuuccgaccgucacugcggcucaaaaguagccagcccaagccugugauagaugccgacaccgcacugggcacugaugacguauaugacgagaaagggugucagugcgauguuuccguggaagaccuuacaccaccccugaagaccgucauucgugccaucagaaucaugaaauuucacguggcuaagaggaaguucaaagagacguugcgcccuuacgaugucaaggacgugauugagcaauauucugccggacaucucgauaugcugugucggaucaaaucguuacagaccagaguugaccagauucuggguaagggccagauaacaagcgauaaaaaguccagggaaaagaucacugcagagcacgaaaccacagacgaucuaucaaugcucgggcgagugguaaaagucgagaagcaagugcagaguauugaaucuaaacuggacugccuuuuggauaucuaccagcagguucugcgcaagggaagcgcuuccgcccucgcgcuggccucauuucaaaucccacccuucgagugcgagcagacuagcgacuaucagucuccgguggacuccaaagauuuaaguggcagcgcucagaacucugguugucugucccggucaaccagugcaaauauuagcagagggcuucaauuuauauugacaccuaacgaguucucggcccagaccuucuacgcucucucccccacuaugcacucucaggccacgcaggucccaaucagccaaucagacggcagugcaguggcggccacaaauaccauugcuaaccagaucaauacugccccuaagcccgcagcuccaaccacacugcagauucccccuccacuaccggccaucaagcaucugcccaggccugaaacccuccacccaaaccccgcaggacugcaagaauccauaucugauguaacuacaugccuuguggccagcaaagagaacguucaggucgcucaguccaauuugacgaaggaccguucaaugcgcaaaucauuugauaugggcggggaaacccuguuaaguguguguccuauggugccaaaggaccucggaaaaucucuguccguccagaaccuuauccggagcacugaggagcugaauauucaauugucgggcucagaaucuagugguuccagagggagccaggauuucuaccccaaguggagggagucuaaacucuuuaucacagacgaagagguuggaccggaggaaaccgagacagauacuuucgacgcggccccucagccagcacgagaagcugccuuugccagcgauucccugcggaccggccgcucaagaaguagccagucuauuugcaaggcuggugaguccacggacgcacuaucacugccccaugugaagcucaaauga

SEQ ID NO: 58010 - RNA, 819 nt, Artificial Sequence
  derived and/or modified sequence opt3 from KCNRG__Homo_sapiens__NP_775876
augagcucccaggagcuggugacccucaacgucggcgggaagaucuucacaacuagauuuucuacgauuaaacaauuccccgccucaaggcuugcucggaugcuggacggacgcgaucaggaauuuaagaugguugguggccagauauucguggaccgagauggggacuuguuuaguuucaucuuagauuuucugcguacccaccagcuacuccugccuacagaguucagcgacuaccuuagacugcaaagggaagcauuguuuuaugagcuccggucccugguagaucugcucaauccauacuuacugcagccgcgccccgcccuuguggaaguccauuucuugucuagaaacacucaggcguuuuucaggguguuuggaucgugcucaaaaaccauugagaugcugacaggccggaucaccguuuucacugagcagccuagcgcuccaacauggaaugguaacuucuuucccccucaaaugacccuacucccacugcccccucagcgcccaaguuaucacgaccuuguguuccaguguggguccgauucuacgacugacaaucagaccggaguccgauacgugagcauuaagccggauaacagaaaacuggccaauggcacaaacguauugggccuccugaucgacacuuuacugaaggaaggguuucaucucguuuccaccaggacagugucaagugaggauaagaccgaaugcuauagcuucgagcggauaaaaucucccgagguccuuaucacgaaugaaacuccuaagccagagacaauuaucauucccgaacaaucccagaucaaaaaguga

SEQ ID NO: 58011 - RNA, 1581 nt, Artificial Sequence
  derived and/or modified sequence opt3 from KCNS1__Homo_sapiens__XP_005260466
augcugaugcuccuugugagaggcacccacuacgagaaccugaggagcaaggucguuuugcccacaccuuuagggggacgguccacugaaacguucgugucugaguuuccagguccggacaccggcauccgcuggcgacguucagaugaagcccugagaguaaaugucgggggagugaggcggcagcuaagugcucgcgcacucgccagauuccccggcacaaggcugggucggcuucaagcggcugccagcgaggaacaggcacgccgacugugcgacgauuaugacgaggccgcuagagaguuuuacuucgauaggcauccuggguuuuucuugucccuccugcacuuuuaucggacuggacaucugcacgugcucgacgaauuauguguuuucgcauuuggccaggaggccgauuacuggggccugggggaaaacgcucuugccgcgugcugucgugcacgcuauuuggagagaaggcugacccagccacaugccugggacgaggauucugacacacccucgucaguggauccuugcccagacgaaauuagcgauguccaacgggagcuagcucgauacggagccgcacgcugugguagacucaggcggcgccuguggcuuaccauggaaaaucccggcuauagucugccuuccaaauuguucucuugcgugagcauauccguaguucucgcuucaaucgccgcgauguguauucacagucugccagaguaccaggccagagaagcagcugccgcuguggccgcagucgccgcugggaggagcccggagggagugcgugacgaccccguguuacggcgacuggaguacuuuugcaucgcgugguucucuuuugaagucuccucaagacuccuucuggcaccuagcacuaggaacuucuucugucacccauugaaucuaauugauaucguuagugugcugcccuuuuaucucacacugcuugccggcguagcucugggugaccaagggggaaaggaguucggccauuugggcaaagugguccagguguuucgccucaugcggauauucagaguucugaaguuagccaggcacucuaccgggcugcgcucccuaggagcaacgcucaaacauagcuaccgagaaguggguauccugcuuuuguaucuggccgucggcgugucgguauuuucugggguugcuuacacugccgagaaggaagaggaugugggauucaacaccauuccugcaugcuggugguggggcacagucuccaugacuaccguggguuauggggacgucgugccaguuacaguggcgggcaagcucgcugccucaggauguauccugggcgggauucuuguagucgcacugcccaucaccauaauuuuuaauaaauucagucacuuuuaccggcgucagaaggccuuggaggcugccgugagaaacagcaaucaccaggaguucgaagaucuccuguccucuaucgacggaguuagcgaagcaucauuagagacgaguagggaaacuucccaggagggucagagcgcugaucuggagucucaagccccgucagaaccuccccauccacagauguauuga

SEQ ID NO: 58012 - RNA, 1476 nt, Artificial Sequence
  derived and/or modified sequence opt3 from KCNS3__Homo_sapiens__XP_011531127
augguguucggcgaguuuuuccacagacccgggcaggacgaggagcuggucaaccucaauguuggagguuuuaagcaaagcguggaucaguccacccuucugagguucccucauacacgguugggcaaauuacugacuugccacucugaagaggccauccuagaacucugugacgauuacucaguagcugacaaggaguauuacuuugaucgcaacccaagucuguuccgauaugugcuuaauuuuuacuauacggggaaacugcaugucauggaggaauugugcguguucagcuuuugucaggagauugaauacuggggaauaaacgaacucuucaucgacuccugcuguucuaaucguuaucaggagagaaaggaagagaaccacgaaaaagauugggaccaaaagucgcaugauguuucaaccgacagcaguuuugaggaauccucucuguucgagaaggagcuggaaaaauuugauacacucagguucggccaguuacggaagaaaauuuggauccgcauggagaauccggcauacugccugagcgccaaacuuauugcgaucuccucauugagugugguccuggcuagcauaguggccauguguguacacucuauguccgaauuucagaacgaggacggugaaguugaugaccccgugcuagagggggucgagaucgcaugcauugccugguuuacuggagaacucgcugugagacuggcagccgcuccuugucagaagaaguucuggaagaauccacuuaacaucauugacuuugugucaaucauacccuucuacgccacccuggcggucgauacaaaagaggaagagagcgaagacauugagaauaugggcaagguugugcaaaucuugaggcucaugcggauuuuucgcauccugaaauuagcacgacacaguguaggccugagaucucucggggccacccuuaggcauuccuaucacgaggugggacuguugcuacuguuccucagcgucgguaucucgauuuucucugugcugauauacuccguugaaaaggaugaccauacuucaagucuuacaagcaucccuauuugcugguggugggcuaccaucuccaugacgacugugggcuauggggauacccacccagucacacuggccggaaaauugauagcaucuacuuguauuaucugcggcauccucgugguagcucugcccauuaccaucauuuucaacaaguuuagcaaauacuaucagaagcagaaggacauagauguugaccagugcucagaggaugccccugaaaaaugucacgaguuaccauacuucaauauccgggacauuuaugcgcaacguaugcauacauuuaucaccagucuguccagcguggguaucgucgugucugauccggacucaacggacgccaguagcauugaggauaacgaagacauaugcaauacuacaucccuagagaacuguaccgcaaaguga

SEQ ID NO: 58013 - RNA, 3708 nt, Artificial Sequence
  derived and/or modified sequence opt3 from KCNT1__Homo_sapiens__NP_065873
augccccugccugacggcgccagaaccccagggggagugugcagggaggcucgggguggcggguacacaaaccgcacuuucgaauuugaugacggacagugugcaccgcgacgucccugcgccggcgauggugcgcuccuugacacggcuggguucaagaugagcgaucuggacuccgaggucuugccuuuaccacccagauauagguuucgggaucugcuacucggagacccuucuuuccaaaaugaugaccgcguucagguggaauuuuacguaaacgagaauaccuucaaagaaagacugaagcuguuuuucaucaaaaaccagaggucaagucuucggauucgcuuguuuaauuucagccucaagcugcugacaugucucuuauauauagugcgaguccugcuugaugacccagccuugggcaucggcugcugggggugucccaaacagaacuacuccuuuaaugauucuucgucagagauuaacugggcaccuauccuguggguggagagaaagaugacucuaugggccauucaaguuaucguggcuauaaucagcuuccucgaaaccaugcugcuuauuuaucugaguuacaagggaaauaucugggagcagauuuuuagggucuccuucguguuggaaaugaucaacacacucccauucauaauuaccaucuuuuggccgccccugcggaauuuauucauuccuguauuucugaacugcuggcucgcaaaacacgcccuugagaauaugaucaacgacuuccaucgugcuauccugcgcacucagucugccauguuuaaucagguuuugauucuauucuguacacugcucugccugguguuuaccgguacguguggcauacaacaccuugagagagcgggggaaaaccugagcuugcucacuuccuucuauuuuugcaucgucaccuucucaacagugggauacggcgacgugacuccaaagauuuggcccagucagcuguuagucguuaucaugauauguguggcacugguagugcuaccucuccaguuugaggaacuggucuaccuuuggauggagaggcagaaaagcggugggaacuauucucggcaucgagcccaaaccgaaaagcacgugguuuugugcguguccucacugaaaauugaucuccugauggacuuccuuaaugaguuuuacgcucauccacgccugcaggauuauuacgucgugaucuugugccccacagagauggacguacagguuagaagggugcuccaaaucccgcuguggagccagcgggucauuuauuuacagggaagugcccugaaggaucaggaccuaaugcgcgcaaagauggauaacggcgaggcuuguuucauccucucuuccagaaaugaaguggacaggaccgccgcggaucaccaaacgauucugcgugccugggcagucaaagacuucgcuccuaacugcccccuuuacgugcagauauugaagccagaaaauaaauuucacguuaaguucgccgaucaugugguaugugaggaagagugcaaauaugcuaugcuggcccucaacuguaucugcccugcaacuagcacacugauuaccuuacugguccacacuucgcggggccaggaggggcaggaaucucccgagcaauggcagcgaauguacggaagauguuccgguaaugaaguguaccauaucaggaugggcgacucaaaguuuuuccgcgaguaugaagggaaaaguuuuacauacgccgcuuuccacgcgcacaagaaguauggaguuugccuuaucggcuugaaacgggaggacaacaagagcauucuccugaauccaggucccagacauauacuagcagccuccgauaccuguuuuuacaucaacauuacgaaagaggaaaauucugcuuucaucuuuaagcaggaggaaaagaggaagaagcgcgccuucagcgggcagggccugcacgagggaccugcacgacucccagugcauucaauuaucgccaguaugggcaccgucgcuauggaccugcaagggacagagcaccggccgacucaguccggagguggcgggggaggcagcaaacuugccuugcccaccgaaaacgguucugggucacguagaccuaguauagcaccagugcuggaguuagcggauagcuccgcucuccugcccugcgaccuucugucugaucagucggaagacgagguaacaccuagcgaugacgaaggcuuguccgugguugaguaugucaagggauacccacccaauucaccguauaucggcaguucuccuacucucugucaucugcuaccagugaaagcccccuuuugcugccugaggcucgauaagggguguaaacacaacagcuacgaggacgcaaaggccuacggauucaagaauaaacugauuaucguguccgcugaaaccgccgguaacggccuuuauaacuuuauugucccuuugcgcgcauacuaucggucaagaaaggagcugaaucccaucguuuuacuccuggauaacaaaccagaccaccauuuccuugaagcuauaugcuguuucccuaugguguacuauauggaggggagcguggauaaucuggacucucuacuccagugcggaauuaucuacgccgacaaccugguagucguggauaaggaauccacaaugagugcggaggaggacuauauggccgaugcuaaaaccauuguuaaugugcaaacuauguuuagguuguuccccagccugucuaucacgacagaauuaacccacccauccaacaugcgauuuaugcaguuccgcgcaaaggacucauacagucucgcccugagcaaacuugagaaacgggaaagagagaauggcucgaaccuggcuuuuauguucagguugccguuugccgcaggucgugucuucuccauaucuaugcucgauacucugcuauaccagagcuuugugaaggacuauaugaucaccauuacacgccugcuucucgggcuggauaccacuccuggcucaggauacuugugugcgaugaaaaucacagaaggcgaccuguggauucggacguaugggagauuauuccaaaagcucugcaguuccucugccgagauccccauaggaauuuacaggaccgagagccauguguuuuccacuucagaaccacacgaucugcgagcucagagccagaucaguguuaauguagaggacugugaagauacacgggaggucaaaggccccugggguucucgcgccgggaccggaggcuccagccaggguagacacacaggcgggggagacccugcagagcauccacuucugaggcggaagucguugcaaugggcucgaagacucucacgcaaagcccccaagcaggcaggcagggccgcugcggccgaauggaucucucagcagcgucugagucuauaucggagauccgagaggcaagaacugagcgagcuugugaagaaccgcaugaaacaccucgggcugccuacuaccggauacgaugaaaugaaugaccaucagaacacguugucuuauguguuaauuaauccgccacccgacacccgacuggagccuagcgauaucgucuaccucauuagauccgacccacuggcacacguugcuucaaguagccagucucggaaguccucaugcagucauaaacuuagcuccuguaaccccgagacaagggaugaaacucagcuguga

SEQ ID NO: 58014 - RNA, 3336 nt, Artificial Sequence
  derived and/or modified sequence opt3 from KCNT2__Homo_sapiens__NP_001274748
augguggaccuggagagcgaaguucccccucucccaccgagauacagguuccgggaucuucuguugggcgaccagggguggcaaaacgaugaccgcguccagguggaguuuuauaugaaugaaaacaccuucaaggagcgauuaaaacuguuuuucaucaagaaucagcguuccucucuaagaauuaggcucuuuaacuucucacugaaacuucugaguugcuugcucuacauaauccggguacugcuggaaaaucccagccagggaaacgaguggucccacaucuuuugggugaaucgcucucucccuuuauggggucugcaagucucgguggcccuuauuucauuguucgagacaauucugcuaggcuaucucagcuacaaggggaacaucugggaacagauacugagaaucccauuuauucuugagaucauuaaugcuguucccuucaucauaaguaucuuuuggccuucccugaggaacuuguucgugccagucuuucucaauuguuggcuggcaaaacaugccuuagaaaacaugauuaaugaucugcaccgggcgauucagcgcacucagucugcuauguucaaccaagugcucauccuuaucagcacgcuguugugccuaauuuucaccuguauaugcggaauccagcaucuggagcgaauuggcaagaagcucaaucuguuugacucccuuuauuucuguaucguaacauuuucaacuguugguuucggggaugugacccccgagacauggaguagcaaacuguuugucguggccaugauaugcguggcauuggucguucucccuauucaguucgaacagcuggccuacuuauggauggagagacaaaagucuggaggcaacuauuccaggcaccgggcucagaccgaaaaacaugugguacugugugugucaagccuaaagaucgaccuccugauggauuuucuuaacgaguucuacgcacacccacguuugcaggacuacuaugucgugauccugugcccgacugaaauggauguucaagugcgcagaguccuccagauucccauguggagucagagggugaucuaccugcagggcucugcccuuaaagaccaagaucuguugcgggcuaagauggacgacgccgaggcguguuuuauucucuccagccgaugcgagguagaucgcacaucgucugaccaccagaccauacugagagcaugggccguuaaggauuucgcuccuaauuguccauuauaugugcagauccugaaacccgaaaacaaguuucauauuaaauucgccgaccacgucgugugcgaggaagaguuuaaguacgcaaugcuagcucucaauugcaucuguccugccacguccacucugaucacccuuuugguccauacaucaagggggcaggaaggacaacagaguccagagcaguggcagaaaauguauggucggugcagcggcaacgagguguaccacauuguucuggaagaguccacuuucuucgcggaauaugaggggaagucuuuuaccuacgccagcuuccacgcacauaaaaaguuuggagugugucucauaggcguacgcagagaagauaauaagaacauccuguuaaaucccgguccgagguacauuaugaacucaacagacaucugcuucuauauuaauaucaccaaagaggagaacagugcuuuuaagaaucaagaucagcagcguaaauccaacgucagccggucuuucuaccacgggccuucacgacugcccgugcauaguauaaucgccagcaugggaacgguugcuauugaccuucaggauacuuccuguagaucugccucgggcccaacauugagccucccuaccgaaggcuccaaggagaucaggcgccccucaauugcaccagugcuggaagucgccgacacaaguucuauccaaacuugcgaucuacugagcgaccaguccgaggacgagaccacgcccgaugaagagaugucaagcaaucucgaauaugcuaaaggguacccuccauauucuccguacauaggauccagucccaccuuuugucaucugcuucacgagaaggugccuuucugcuguuugcggcuggacaagagcugccagcacaacuauuacgaagaugcgaaagcauacgguuuuaagaauaaauuaauuaucguagccgcugagacagccggcaacgggcucuauaacuucauugugccacugagagcauacuauaggcccaagaaagagcuuaauccuaucguucuguugcucgacaacccacuggaugaccuacugcgcuguggagucacuuuugccgcuaauauggugguggucgauaaggaaucuaccauguccgccgaggaagacuacauggcagaugcgaagacaauaguuaacgugcaaacucucuuccgacuguuuucaagucuuagcaucauuaccgaguugacacaccccgcuaauaugcgguucaugcaguuccgugccaaagacugcuauucgcuggcauuauccaagcucgagaaaaaggaaagagagaggggcucuaaccuggccuuuauguuccgccuuccguuugcugccggucggguguucagcaucucaaugcuggauacccuacucuaccagaguuuuguaaaagacuauaugauuuccaucacuagacuguugcugggguuagauacgacaccuggcucuggauuccucugcagcaugaagauaaccgcagacgaccuguggauuaggacuuacgcucgacuuuaccagaagcuguguuccucaaccggcgaugucccaaucgggaucuaucgcacagaaagccaaaaauugaccacaagugagucucagauuuccaucagcguggaagagugggaagacacuaaggauucgaaagagcagggacaucaccggucaaaucauagaaacucuacgaguuccgaccagagcgaucacccccuccugaggcguaagucuaugcaaugggcccgccggcuaagcagaaaagguccuaagcacuccggcaaaaccgcggagaagauuacucagcagaggcugaaucuuuaccgacggucagaacgccaggagcucgccgaacugguuaagaacagaaugaaacauuuggggcugaguacagugggauaugacgagaugaaugaucaccaaagcaccuuaucuuacauacucaucaaccccuccccagacacaaggauugagcugaaugaugucguguaucuuauccggccugacccccuggcuuacuugccaaacucagaaccgagucgaagaaauagcauuugcaacguuacuggccaggauucccgcgaggaaacccagcucuga

SEQ ID NO: 58015 - RNA, 3450 nt, Artificial Sequence
  derived and/or modified sequence opt3 from KCNU1__Homo_sapiens__NP_001027006
auguuccagaccaagcugagaaacgagacaugggaagaccuccccaaaaugagcugcacuacggagauccaagccgcuuuuauucuuuccucuuucgugaccuuuuucucaggccugauaaucuuguuaauuuuuaggcugaucuggcggagugucaagaaauggcagauuaucaaggggacaggaauaauccuagaacucuucacuagcgguaccauugcacgcucccacguucgaucucugcauuuucagggccaguuccgugaucacaucgagaugcuucugucggcccaaacauuuguggggcagguauuggugauucucgucuucgugcugucaaucggaagccugauaauuuacuuuaucaauagugcggacccuguuggcuccuguucuagcuaugaagauaaaaccauuccaaucgaccucguguucaacgcuuucuucuccuucuacuuugguuuaagauucauggccgcagaugacaagaucaaguuuuggcuggagaugaacucaauugucgauauauucacuaucccgcccacauuuauuaguuauuaccuuaaaagcaauugguuggggcugagguuccuacgggcccuccgccugcuugagcugccucagaucuugcagauacucagagcuauuaagaccucuaauuccgugaaauuuucaaagcuguuaagcaucauccugaguacgugguucacugcagccggauuuauucaucucguagaaaacucuggcgacccauggcuuaaaggccgaaauucccaaaacaucagcuauuucgagucgauuuaccugguuauggcuaccacaucuacugugggguuuggagaugucguggccaagaccuccuugggucggacauucauaauguuuuucacccuaggcucacugauccucuucgcgaauuauauucccgaaaugguggagcuguuugcaaacaagcgcaaauacacgaguagcuacgaggcccuuaaggggaaaaaguucaucgucguuugcggaaauaucacuguggacuccguaacagcuuuucugcgaaacuucuugagagauaaaucuggcgaaauuaauaccgagauaguguuucucggugaaacuccuccaagccuggaguuagaaacaaucuucaaguguuaucuggccuacaccacguuuauuucagggagugcaaugaaaugggaggaccuaaggcgggucgcuguggaguccgccgaagcgugccucaucauugccaacccccuguguagcgauucucacgcagaggacaucucaaauauaaugcguguucuuaguaucaagaacuaugacagcaccacacgcauuaucauucagaucuugcagucccauaacaagguguaccugccuaaaauaccaucuuggaauugggauacuggagacaacauuaucugcuucgcugaacucaagcugggcuuuauugcccagggcugucuugucccggggcugugcaccuucuugacaucgcucuuuguggagcaaaauaaaaagguaaugcccaaacagacuuggaagaagcacuuccugaacagcaugaaaaauaagaucuuaacccagagacuguccgaugacuuugcuggaaugucauucccugaaguugccaggcuauguuuccucaaaaugcaucugcuuuugauagcaaucgaguauaagagucuguuuacagaugguuucugcggccucauucugaacccacccccucaagugcggaucaggaaaaauaccuuaggguuuuucauugccgagacuccaaaggacguccgcagagcucuguuuuacuguucugugugccacgaugacgucuucauccccgaacuuauaacgaacugcggauguaagagcaggucccggcagcacauuacagugccgucaguuaaacgcaugaagaaaugcuugaagggcaucagcucuagaaucuccggucaggauaguccucccagggugagcgcgucuaccuccucaauuaguaauuuuacuacccguacacuccagcaugacguagagcaagauagcgaccagcuggacucguccgggauguuccacugguguaaaccaaccucucuagauaaggucacucugaagcggacaggcaaaagcaaguauaaauuucgaaaccacaucguggcaugcguuuucggagacgcccauucagcuccuaugggccucagaaauuuugugaugccccugagggccaguaacuacacgcgcaaggaacuuaaagauauugucuucauaggguccuuggacuaccugcagcgggaguggagauucuuauggaauuuuccacagaucuauauucuccccggaugugcacuguacucuggugaucuucacgccgcuaacaucgaacaaugcagcaugugugccgugcuguccccuccaccgcagcccucaagcaaucagaccuugguagacacugaggcaauuauggcgacacucaccaucggcagucugcagauagauucuuccagcgacccuucgccaucagugucugaggaaacacccggguauacuaacggacauaacgagaagaguaauugcaggaaaguuccuauccuaaccgaacugaagaacccauccaauauucacuucaucgagcaacucggcggucuggaggggagccuucaggaaacgaacuugcaucugucuaccgcuuuuagcacaggcacugucuucuccggaucauuuuuagauagucuccuggccaccgcauucuacaauuaucacgugcuugagcugcuacagaugcucgugacaggcggggucagcucucagcuggaacaacacuuggacaaggauaaaguuuacggaguggccgacuccuguacuucacuguuaaguggucgcaaccgaugcaagcucggccugcuuagccugcaugagaccauuuuguccgaugugaauccccggaacacguuugggcagcucuuuuguggaucucuggaccuauuuggcauccugugcguaggucuuuaucguauaauugacgaagaggagcucaauccggaaaacaaaagauucgucaucacaaggccugcuaaugaguuuaagcuguugccaucggaucugguguucugcgccauccccuuuagcaccgcauguuacaaacgcaacgaagaguucucauuacagaaguccuacgaaauuguuaauaaggcuagucaaacuacagagacccacucugacacuaacugcccucccaccauagauagcgugacagagacgcucuauuccccagucuacucauaucagccucggaccaauucucugagcuuccccaaacagaucgccuggaaccagaguagaacuaacuccauuaucagcucucaaauuccacuuggggacaaugcgaaggaaaacgagaggaaaacaucagaugaaguguacgacgaggauccguuugccuauuccgaaccucuguga

SEQ ID NO: 58016 - RNA, 1503 nt, Artificial Sequence
  derived and/or modified sequence opt3 from KCNV1__Homo_sapiens__NP_055194
augcccagcuccggcagagcccugcucgacucuccucuugauucagggagucugaccagcuuggacuccucuguguucugcucggagggagaaggugagccauuagcucugggcgauuguuuuacagucaacguugggggaucaagguucgugcuaagccagcaagcacucaguugcuuuccgcacacucggcugggcaaacuugccguaguggucgcguccuaccgccgacccggugcucuggccgcagugccuucuccauuggaacucugugacgaugccaaucccguugacaacgaguauuucuuugaucguagcucccaggcuuucagauacgugcugcauuauuacaggacggggcggcugcacgucauggaacagcucugcgcauuaucauuucugcaggagauccaauauuggggaauugacgagcuuaguauagauagcuguugccgcgacagauacuucaggcggaaggaauugucugagacccuggauuuuaagaaagacacagaagaucaggagucccagcaugagucagaacaggacuucagccaaggcccuuguccaacugugcgccagaagcuauggaauauccucgagaaacccggcaguucuaccgccgcucgaauuuuugggguaaucuccauuaucuucguuguggucagcauaaucaacauggcccugaugucggcggaacuuucuuggcuggacuugcagcuccuggagauuuuagaauaugugugcaucuccugguuuacaggagaguucgugcugagauuccucugugucagggaucggugccguuuucuucgcaagguuccuaauauuaucgaccuguuggcaauacuaccauucuacauuacccugcucguggagucacugagugguagccagacuacacaagaacuugagaacguaggcagaaucgugcagguccugagguugcuccgggcccugcgaauguuaaagcuggggcgccacuccaccggacuaagaucucucggcaugacgauuacucaguguuacgaagaggugggucugcuuuugcuguuucucagcguugggaucucaaucuucaguaccguggaauauuuugcugagcaauccauuccggauacaacuuucaccagcguccccugcgccugguggugggcaacaaccucuaugacgacugugggauacggcgacauaaggccugauacaaccacuggcaaaaucguagcuuuuaugugcauucugucagggauccuuguucuggccuugccaauagcgauuaucaaugaccgguucagugccuguuauuuuacacucaagcugaaagaggcagcugugcgccagagagaagccuuaaagaaacugaccaagaacaucgcuacggauagcuacauuuccgucaaucuaagggacguguaugcccguucuaucauggagaugcuccggcugaagggacgagaaagagcaucgaccaggagcuccgguggcgaugacuucugguuuuga

SEQ ID NO: 58017 - RNA, 1638 nt, Artificial Sequence
  derived and/or modified sequence opt3 from KCNV2__Homo_sapiens__NP_598004
augcugaagcagagcgagagaaggcgguccuggucuuaccgccccuggaacaccacagaaaaugagggcucacaacaccgacguaguaucugcagccucggggccagauccggaucucaggcuucgauucaugguuggacugaaggcaacuauaauuacuauauagaggaagacgaggauggggaggaagaggaccaguggaaagaugaccuugcagaagaggaucagcaagccggagaggugacgaccgcgaagccugaaggcccaucagacccgcccgcucuguugagcacauuaaacgucaauguuggugggcacaguuaccagcuggauuauugugagcuagccggauucccuaaaacuaggcucggccggcuggcaaccuccacaucucgcagcagacagcuuucccugugcgacgauuacgaagaacagaccgacgaauacuuuuucgauagggacccagccguguuucaauugguauauaacuucuaccucucaggcgugcugcugguccucgauggguuauguccccggcgcuuucuggaggagcuuggauauuggggugugcgauugaaguacacuccuagaugcuguaggaucugcuucgaggagcggcgugacgaacugagugagcgccuaaaaauucagcaugaacucagagcucaggcacagguugaggaggccgaggaacuguuuagggacaugcgguucuauggcccacaacgacgcagacuuuggaaucugauggaaaagcccuuuagcucuguggcugccaaggcgaucggggucgcauccucaacauucguguugguaagcguuguggcccucgcucugaacaccgucgaggaaaugcagcagcacaguggacaaggcgagggugggccugauuuaaggccaauucuggagcauguggaaaugcucuguaugggauuuuucacgcuugaguaccuguugcggcuagccucuacuccggaccugcgcagauuugcaagguccgcucucaaucugguggaucuugucgccauccugcccuuguaucuccagcuguuacuggaaugcuucaccggcgagggccaccagcgugggcagacaguuggaagcguggguaaaguaggccaagugcuacgggucaugcgacucaugagaauauucaggauccugaaacuugcgcgccacucgacuggguugcgggccuuuggauucacccugagacaguguuaccaacaggugggcugccuccugcuuuuuauugcaauggguaucuucacauuuucugcugccguuuauuccguggagcaugacgucccuucaaccaacuucacgacuauuccacacaguugguggugggcugccgugagcaucuccacaguaggguacggcgauauguaccccgaaacccaucugggaagguuuuucgcauuuuuguguauagccuucggcauuauccucaaugggaugccuauuucuauccuguauaacaaauuuagcgacuacuauucaaaguuaaaggcuuacgaguauacuacaauccgccgagaacggggagagguuaauuucaugcagcgugcgagaaagaagauugcagaaugccugcuagguaguaacccacagcucacccccaggcaggagaauuga

SEQ ID NO: 58018 - RNA, 942 nt, Artificial Sequence
  derived and/or modified sequence opt3 from KCTD10__Homo_sapiens__NP_114160
auggaggaaaugagcggcgaguccguggucucuucagccguucccgcugcagccaccagaacaacgaguuucaaggggacuagcccuuccucuaaauacgugaagcugaacguaggaggugcgcucuauuacaccacaaugcagacucuuaccaaacaagacacaaugcugaaggcuauguuuucgggcaggauggaaguguugaccgauucagagggguggaucuuaauugaccggugcggaaaacacuucggcacuauacugaauuaucuacgcgauggugccgucccacucccggaaagccgacgugagaucgaggaacugcuugcagaggccaaguacuaucuggugcagggguugguugaagagugucaggcugcacuccagaacaaggacacauacgagcccuuuugcaaagugccugucauuaccaguuccaaggaggaacaaaaacugaucgccacgucuaauaagccagcugugaaacugcucuauaacagaagcaauaacaaguacuccuacacuucaaauagugaugacaacauguuaaagaauauugaacuguucgauaaacuuagcuugagguuuaacggacggguacuguucaucaaggacguuauaggcgaugagaucuguugcuggucuuuuuauggccaggggcgcaaaauugccgaaguguguugcaccuccaucgucuacgcgacagagaagaaacagacuaagguggaguuccccgaagcaagaauuuaugaggaaacccuaaauauccuccuguacgaggcccaggacggaagggguccugauaacgcccuucuggaagcuacaggcggggcagcuggacggucacaucacuuggacgaggaugaggaacgcgagcgaauagaaagagugaggcggauucauaucaaacguccagacgaccgcgcccaccuccaucaauga

SEQ ID NO: 58019 - RNA, 699 nt, Artificial Sequence
  derived and/or modified sequence opt3 from KCTD11__Homo_sapiens__NP_001002914
augcugggcgccauguucagagcugggacccccaugccuccaaaccucaauagccagggagguggccacuacuuuaucgacagggaugggaaggcauuccggcauauucuuaacuuucugcgcuugggacgauuagaccugccgcguggcuauggugagacagcccuacucagagcggaagcugauuucuaccaaauaaggccccugcuugacgcccugcgggaguuggaagcaucccaggggacuccugccccaacggcugcacuccugcacgccgauguggacgucucuccccgccugguucauuuuucagcuagaaggggaccucaccauuaugagcucaguagcgugcagguagauaccuuccgggccaauuuauuuugcacagacuccgaaugucugggcgcgcuucgcgcacgauucggcguggccucuggggauagagcugagggaucgccacacuuucacuuggagugggcccccaggccugucgaacugccagagguggaauacggucggcuaggccuccagccgcuguggacugggggacccggcgagcgucgcgagguuguggguaccccuucauuccuugaagagguccugagaguggcauuggaacauggguuuaggcucgacagcguauucccagaucccgaggaccuguuaaacagucggucccugcgauuuguucgccacuga

SEQ ID NO: 58020 - RNA, 978 nt, Artificial Sequence
  derived and/or modified sequence opt3 from KCTD12__Homo_sapiens__NP_612453
auggcccuggcugacagcaccagaggccuccccaaugggggagguggcgggggaggcuccgguucuucaaguagcuccgcagagccuccacuuuucccggauaucguggaacugaaugucgggggacagguuuacgugacaaggcggugcacuguagugucuguccccgacucguuguuauggcgcauguuuacgcaacagcagccucaggagcuggcccgagauucaaagggccguuucuuucuagacagagauggcuuccucuuuagguauauucuggacuaccuucgggaucugcaauuggugcucccagacuauuuccccgaacgcagcagacugcagagggaggcggaauacuuugagcugccugagcucguucggcgcuuaggggcuccacagcagcccggaccugguccaccgcccagucgaagaggcgugcacaaagaagggucccugggagaugagcuuuugccucugggcuauucugaaccagagcaacaggagggugccagcgcaggggcccccuccccuacccuagaacucgcuucaaggaguccaagcggaggcgcagccggcccccugcuuacaccgucucagucccuggacgggucacggcguagcggauacauaacuaucgguuaucgcggcaguuacaccauugggagagaugcucaggccgacgcgaaguucaggcgggucgcacgaaucacaguguguggaaaaaccucuuuggccaaggagguauuuggcgauacucucaacgaaucccgcgacccugacagacccccagagagguacacaagccgguauuaccugaaauucaacuuuuuagaacaggcuuucgauaagcugucggagucugguuuucauaugguugccugcuccucaaccgggacgugugcauucgcuaguagcacugaccaauccgaggauaagauuuggaccucuuauacagaauacguguucugccgcgaguga

SEQ ID NO: 58021 - RNA, 990 nt, Artificial Sequence
  derived and/or modified sequence opt3 from KCTD13__Homo_sapiens__NP_849194
augagcgccgaggcuuccggccccgcagccgcggcugccccuucucuggaagcaccaaagccgucagggcucgagcccggaccugccgcuuacggucuuaaaccacugacccccaacaguaaguaugugaaauugaaugucggcgggagcuuacacuacacaacucugagaacgcuaaccggacaggacacaaugcucaaggcaauguucuccggcaggguugaagugcugacugaugccgguggguggguacuuaucgaccggucuggacgccauuuuggcaccauucugaacuauuugcgagauggcucggugccucucccagagucaacacgugaacugggggagcugcucggagaggcuagauacuauuuaguccaaggucugauagaagacugccagcuugccuugcagcagaaaagggagacccugagcccccuaugucucaucccuauggugacaaguccacgggaggaacaacagcugcuugcguccacuucuaagccgguugugaagcuguugcacaaucgcagcaacaauaaauacuccuauaccucaacgagugaugacaaccuccugaagaauauugaguuauucgauaaacuggcacucagauuucauggcaggcuucuguucuugaaggacguccuaggggaugaaaucugcuguuggagcuuuuacggacagggccggaaaauugccgaggugugcuguacuucuaucguauacgcuaccgaaaagaagcagacaaaaguugaguuccccgaagcccgcauauuugaggagacucugaacauccucauuuaugaaaccccucgagguccagaccccgcacugcuugaggcuacagggggagccgcgggcgccggcggggcaggaagaggugaagaugaggaaaauagggagcaccgggugcgucgcauccaugucagaaggcacauuacccacgacgagcggccucauggccaacagaucguguucaaggauuga

SEQ ID NO: 58022 - RNA, 705 nt, Artificial Sequence
  derived and/or modified sequence opt3 from KCTD15__Homo_sapiens__NP_076981
augccccacagaaaggagaggccuagcggcuccucucugcauacccacgggucaacaggaacugccgaagguggcaacaugagucggcucagccuuacgcgcuccccagugucuccgcuggcugcacaggggauccccuugccugcccaauuaaccaaaucgaaugcgccaguccauauugacguuggaggccacauguacacaucaagccuggcuacucuaaccaaguaucccgauagucgaauaucccgucucuucaacgguacagagccuaucgugcuggacucucuuaaacagcauuacuuuauugauagagacggggaaaucuucagguauguacugagcuuuuugcggaccuccaagcuccugcugccagaugacuucaaagauuuuucacucuuauacgaggaagcccgcuauuaccagcugcagcccauggugagagagcuugagagguggcaacaggaacaggagcagcggcgccgaaguagagcaugcgacuguuuggucgugaggguuacuccugaucugggagaacggauugcccuaagcggcgagaaggcucucaucgaggaaguguucccagagacaggcgacgucaugugcaauucugugaacgcaggguggaaucaagauccgacccacguaauacguuuuccccugaacggauauugucgccuuaauuccguucaggacgugcuguga

SEQ ID NO: 58023 - RNA, 1287 nt, Artificial Sequence
  derived and/or modified sequence opt3 from KCTD16__Homo_sapiens__XP_005268550
auggcccugagcggcaacugcuccagauacuaucccagggagcaggggucugcugugccuaauucauucccagaagucguugagcucaacgugggaggucaaguauacuuuacccggcacaguacacuuaucagcauuccgcauucccuguuguggaagauguucucucccaaacgcgacacugcaaaugauuuagccaaggacucgaaaggccgauuuuucauagaucgugacggguuucuguucagauauauccuagauuaccucagggaccgccaggugguccugccugaucacuuuccagaaaagggacggcuuaaaagagaggcggaauauuuccagcugcccgacuuggugaagcuccugacgccugaugagauuaagcagucaccagacgaguuuugucauagcgauuucgaagacgcuagucaaggcuccgauaccaggaucugucccccuucuagccugcucccagccgaccggaaaugggguuuuauuacaguuggguaccgcggauccugcacuuuaggccgagagggccaggcagacgccaaguucagaagggugccgcggauccuggucugcgggcguauaucacuugcuaaagaaguguuuggagagaccuugaacgagagucgcgaucccgacagagcaccugaaagguauacaagccgguucuaccugaaguucaaacaccuagagcgagccuuugauaugcucucugaaugugguuuccauaugguagcuugcaauuccucaguuaccgccagcuuuaucaaccaguacacugacgauaagauuuggaguucuuauacagaguacguguucuaucgcgaaccauccagauggagccccucgcacugugacugcuguugcaagaauggcaaaggggauaaggagggagagucuggcaccuccuguaacgaccugucaacgaguagcugcgauucccagucugaagcgagcucaccucaagagacugucaucugcgguccagugaccaggcagacaaauauucagacucuugaccggcccaucaaaaaggggccggugcagcugauacaacagagugaaaugcgcagaaaauccgauuugcucaggacccugacaagcggaucucgugagucaaacaugaguagcaagaaaaaggcagucaaggaaaaauuauccauugaggaggaacuggagaaguguauccaggacuuucucaaaauuaagaucccugaccgguuccccgaacgaaaacacccauggcaaucugagcuucugagaaaguaccauuuguga

SEQ ID NO: 58024 - RNA, 2598 nt, Artificial Sequence
  derived and/or modified sequence opt3 from KCTD1__Homo_sapiens__NP_001136202
auggccagaaugcccggcagcggggacugcaacaccuccgcuggagguucugcaucagccgcggcugccgcagccgagaauaacggcgaaaggggagagggggaacggggcgcuggugggcgcggacgacgucacaguagaccucauuacuguagcgcaggcgaggaagaggaggaagaggaagaggaggaugaaauccaggaggugcaaauuacaggcgacgaagaggaagaggaggaugggggagguggccuggaagaggacgaagaggaagaggaggaagaggaaauggggcucgauugggacgagccacuugaaccggaggauuccgccggagaggaacuggagcccgaaccuguccacaugauaaauauggaccagucugcugccuuggagccagaggcgcccccuagguuacuggcaccacgggcccgcggcggucccccuggggauggaucggaacuagacccagauguucuccagagaccggagagggcucggcugucagaaaacacucgccuugccacgcgauaugcagugagaaucuucagggaguaccugagcgaaaaggcucagagucccgacuuugagaccauggauaaaggcgccuugugccggguacuccguuccuucuaugcggaggcccgcucuaagagcggccaacuguacuccaaaucaagucugauuagcaucagaucuucccucaauagguauuuaaacgaaccuccauacugucggacacuggaccuuacuaaggaccccgaguugcgaucagcaaaucugacccuagcugccgugauucgcaaacucgaagaacagggggcuggaccugucgugcagaagcaggccaucacaagagcagaucugaggaaacuuuauaccagcaguguguuuucuacuaacacaccauucggucuguugaauaaagugugguuugaaaccugcauguacuucuguacgcggggccgcgagaaccaaagagagcucgaagaggacuccuuugggcuggccauggaugaagacggaaggaaguucgucuacuuuaagagcuuaggccccuaucauaagucgcguucuuccucauggaguaaaaagcgggcugagagcuccgaugaagagaaucugccgcgaauguacgagacugguaccgaguucugcccuuaugcgucuuuugugaaguaccucagcaaaagaaacccccuuuguaaggcauucuuucagaggccacgcgaccacugcucagagggggauguaacaugguaugaaaauaaagccauaggcaagaaccuguugggaacucggaugcagaugcuaaguaaagcugccaagcuguccaaaaccuacacaaaucauuguaucggcgcaguuagcauugccacccucaacucuaucgcugggauuggaacgaagcuggguaguccugcaccccagggcugcuaugccgaggcgcuuaacggggcugccagacaccacucacaucacccacccacucauccuagccaccaccauaggccacaaccgcccucccugggaaauacauacaucuugccuaaggacucucaggugggcccagaugucaaaucggaggcagcccccaagcgcgcucucuacgaaagcguguucgguuccggggagauauguggcccuaccucaccaaaacgacugugcauucggcccagugaaccgguggacgccgucguugugguaucugugaagcacgauccuuuaccacugcuacccgaggcaaacggacaucguagcacuaauuccccuacaaucgucucacccgcuauugugagcccaacccaggacucuagaccuaacauguccaggccccucaucacgcgcaguccagccagcccgcugaauaaccaaggcaucccuacccccgcgcagcuuacaaaaucuaaugccccaguucacauugacguugggggacauauguauacuuccucauuggcuacccugacaaaguaccccgaaagucggauagguagacucuucgauggcacugagccuaucguccuggacagccuuaagcagcacuauuuuauugauagggacgggcagauguuccgauacauccugaacuuuuugcgcaccucgaaacuccugauaccagaugacuucaaggauuauacauuacuguacgaggaagcaaaauauuuucaacuacagcccaugcuccuggagauggaacgguggaagcaggacagagagaccggaagguucucccguccuugcgaaugucuugugguacgcguugccccggauuugggcgagcggauuacucugucuggugacaaaagccucaucgaggaaguguuuccagagaucggggaugucaugugcaauucagugaacgcuggcuggaaucacgacaguacgcaugucauuagauucccccugaacggauacugucacuuaaauuccgugcagguucuggaaaggcuucaacagcgaggcuuugagaucguggggucuugcggaggcgguguagauagcucccaguucucagaauacgucuugcggcgcgagcucagaaggacaccucgggugccaagcguuauucgaauaaagcaggagccccuggacuga

SEQ ID NO: 58025 - RNA, 990 nt, Artificial Sequence
  derived and/or modified sequence opt3 from KCTD21__Homo_sapiens__XP_005273982
auggaguucgcccuggacgcucccagcugcgaggaaccuagagaaaacuaccaguccaggaaggcagcccaccggccacgcaccgcgacaccgcucggcugggcucccacucuucgaccuccacguaaagccgcacuggccgcuagagggggaagggguugucgggcacgcgccggcggguuguuacccgcuacgcaaucuccugccaugucagauccaaucacccugaaugugggaggcaagcuauauacaacaagucucgcgacccugacuagcuuucccgacuccaugcuuggugcaauguucucugggaaaaugccuaccaagagagauucgcagggaaacugcuuuauugacagggauggcaaagucuuccgguacauacugaauuuucuucgcacuucacaucucgaccugccagaggauuuccaggaaaugggccugcuccgaagagaggccgacuuuuaucagguucaaccguuaaucgaggcucugcaggaaaaggagguggaacuuagcaaggccgagaaaaacgcaauguugaauauuacacugaaccagaggguacagaccgugcacuucacgguccgggaggcuccccaaaucuacagucuauccucuagcuccauggaaguguuuaaugccaacauuuucucaaccaguugucucuuucugaaguugcuggggagcaaauuguucuauugcucuaauggaaaccucuccucaaucacuagccaucugcaggauccuaaucacuuaacacuggacuggguugcgaacguggagggucucccagaagaggaauacacuaagcagaaucuuaaacgucugugggucgugcccgccaacaagcagauaaauaguuuucaaguauucguugaggagguguugaagaucgcacuaucugauggcuucuguauugacuccagccauccucacgcucuggauuuuaugaacaacaaaaucauucgccucaucagauauagguga

SEQ ID NO: 58026 - RNA, 792 nt, Artificial Sequence
  derived and/or modified sequence opt3 from KCTD2__Homo_sapiens__NP_056168
auggccgagcugcagcucgaccccgcuauggcaggccuugggggagguggcgggagcggagugggcgauggugggggaccugucagaggcccaccgucccccaggccugccggcccaacaccccgggggcacggacgcccugcggcugccguugcacaaccacuggaacccgguccuggcccaccggagcgagccgggggaggcggugcugcacguugggugagauugaacguagggggaaccuacuucgugacuacgaggcagaccuuaggccgggaacccaagucuuuucugugccgccuauguugccaggaggacccugaacucgauucagacaaagaugagacaggcgccuaucugaucgacagagauccaacuuacuucgggcccauucuuaauuaucugaggcauggaaaguugauaaucaccaaagagcucgcugaagaggguguccuggaagaggccgaguuuuacaacauugcgagucuggugcggcucguuaaggaacgcauccgagacaaugagaacagaacaagccagggcccugugaaacacgucuauaggguguuacaaugucaggaagaggaacugacccagaugguauccacuaugucugauggguggaaguucgagcagcuuauuucgaucggaucaagcuacaauuauggcaacgaggaccaagcagaauuuuugugcguugugagucgggagcugaauaacuccacaaaugguauagucaucgaaccaucugagaaggccaaaauucuacaggaacgugggagccgcauguga

SEQ ID NO: 58027 - RNA, 2448 nt, Artificial Sequence
  derived and/or modified sequence opt3 from KCTD3__Homo_sapiens__NP_057205
auggccggcgggcacugcgggagcuuccccgcugcagccgcggguuccggcgagaucgugcagcugaacgucgggggaaccagauuuucuacaucaaggcaaacucucauguggauuccugacaguuucuuuagcucccuucugucuggccggauaucgacguugcgcgaugaaaccggugcuaucuucauugaccgagauccagccgcauuugccccgaucuuaaauuuccugcguacaaaggagcuagaccucagagggguuucaauuaacgugcugaggcaugaagcugaguuuuacggaaucacuccccuuguacggcgccuguugcucugugaagaacuggagagaagcaguugcggcuccgugcuguuccacggcuaucucccuccacccgggauaccuucuaggaaaaucaauaacaccguccggagcgcagauucccgcaauggauuaaacucaacagaaggugaggcccgaggcaaugggacccagccagugcugaguggaacuggcgaagagacaguuagacuugguuuucccguggacccuaggaaggucuugauuguggcugggcaucacaacuggaucguagccgcguacgcacauuucgccguuuguuaucggauuaaagagagcucuggauggcaacagguguuuaccuccccauaccuggauuggacgaucgaacgugucgcucuaaaugccaagguggugggcggcccgcacggggacaaagauaagauggucgcaguugcuucagagagcaguauaauucucuggucugugcaggacggagguuccggcagcgaaaucgggguauucucgcugggagugcccgucgaugcccuuuucuucauuggcaaccagcugguggcgacuucucacaccgguaagguugggguguggaaugccgucacacagcauuggcaagugcaggacguaguuccuaucacuuccuaugauaccgcaggcucauucuugcuccugggaugcaacaauggcaguaucuacuauauugacaugcagaaauuuccauuacgcaugaaggacaacgaucugcucgugacagagcuuuaccacgaccccagcaaugaugcuauaaccgcccuguccgucuacuugacgccuaaaacuucugugagcgggaacuggaucgaaauugcuuauggaacaucaaguggugccgucagagugaucguucagcauccagagaccgugggcuccgggccccagcuauuccaaacuuuuacaguacacaggagcccggucaccaagauaaugcugucugagaaacaccucgugucaguuugugcagacaacaaucaugugcggacguggaccgucacacgauuccgcggaaugauuaguacucagccuggcagcacaccccuggccuccuuuaagauccuuucucuggaagagaccgaaucgcacgguagcuacuccucagggaacgauaucggcccauucggagagagagacgaucagcaaguguuuauucagaagguagugccuaucacuaauaaauuguucguuaggcucaguucuaccggcaagcggauuugcgaaauacaggcugucgacuguacaaccaucagcuccuuuacugugcgcgagugcgaggggucaagcagaaugggaucuaggccccgucgguaucuguucacgggucauacaaacggcuccauucagaugugggauuuaaccacugcgauggacauggugaauaaaagugaagauaaggacgucgggggaccaaccgaggaggagcugcuaaaacuccuggaccaaugugaucuuagcacaucucgaugcgcaacccccaacaucuccccugccacuucaguugugcagcacagucauuugagagaaagcaauucgucccugcagcuccagcaccacgacacaacgcaugaggcugccaccuacggcucuaugaggccauaucgcgagagcccgcugcuugcacgggccagaaggacugaaucauuucacaguuaccgcgauuuccaaacaaucaaccugaaucgaaacguggagcgggcuguacccgaaaaugguaacuuggggccuauucaggccgaggucaagggcgcaaccggagaguguaauauauccgaacguaaaucuccaggcguggagaucaagagccucagagaacuggacuccggguuagagguucauaagauugcggaaggauuuucagagagcaaaaagaggaguucugaggaugaaaacgagaauaaaaucgaauuucgcaagaaaggcgguuucgagggaggaggcuuucugggucggaagaaggugcccuaucuagcuuccagcccuucgacaucagacggcgggacugauucuccaggaaccgccagucccuccccgacgaaaaccacaccuagcccaagacacaagaaaucugacagcuccggccaggaauacucacucuga

SEQ ID NO: 58028 - RNA, 714 nt, Artificial Sequence
  derived and/or modified sequence opt3 from KCTD6__Homo_sapiens__NP_699162
auggacaacggcgauuggggguacaugaugaccgaccccgugacacugaaugucggaggucaccucuauacuacgagccuuaccacacugacuagauacccugauuccauguugggcgccauguucgggggagacuuuccaaccgcuagggauccgcagggcaacuauuucaucgaccgggauggucccuuauuucgcuacguucugaauuuccuacgaacaucugagcucacccugccucuugacuuuaaggaguucgaucuguugcguaaagaagcagacuuuuaucaaauugaaccacucauacagugccugaacgaucccaagccucuguacccaauggacacuuucgaggaagugguagagcucucaaguacaagaaaauuaagcaaguauuccaaucccguggccgucaucauuacccagcugacgaucacuaccaaagugcauucucuuuuggaggggauuucgaacuacuuuacaaaguggaauaagcacaugauggauacuagggacugucagguuucauucaccuuuggaccuugcgacuaccaucaagaagugagccugcggguccaccuaauggaguauaucacaaaacagggcuucaccauacgcaacacgagagugcaucacaugagugaaagggcgaaugagaacacuguagagcacaauuggacauuuugucggcucgcucgcaagaccgaugacuga

SEQ ID NO: 58029 - RNA, 867 nt, Artificial Sequence
  derived and/or modified sequence opt3 from KCTD7__Homo_sapiens__NP_001161433
augguggucguuaccggcagagagcccgacagcaggcggcaggauggggccauguccucuucagacgcugaagaugacuuccuggagccugcaacaccaacugccacgcaagcgggacacgcucucccgcuucugccccaggaauuuccugaggugguaccauugaacaucgguggcgcccauuucaccacacgcuuaaguacucugcgaugcuacgaagauaccaugcuagcagccauguuuagcgggcgucacuauauucccacagacuccgagggaagauacuucauagauagggacggcacccauuuuggugaugugcucaauuuccugcggucuggggaccuuccuccacgcgagagagucagggcuguguauaaggaagcacaguacuaugccaucggaccccuguuggagcagcucgaaaacaugcaaccucugaaaggcgagaagguucggcaggcuuuucugggccucaugccauacuauaaagaucacuuagagcgcauuguggaaaucgcccgacugagagcgguccagaggaaggcacgguucgccaaacuuaagguguguguauuuaaggaggaaaugccgauuacucccuacgagugcccuuugcuaaauucgcugcguuucgaacgcucagagagcgacgggcagcucuuugagcaucacugugaaguugaugugaguuucggaccaugggaggcugucgccgacguguacgaccugcuucacugccuggugacagauuuguccgcacaaggucucaccgucgaccaucaguguaucggcguuugcgauaaacaccuggugaaccauuauuacuguaagagacccauauaugaauuuaaaaucacgugguga

SEQ ID NO: 58030 - RNA, 1170 nt, Artificial Sequence
  derived and/or modified sequence opt3 from KCTD9__Homo_sapiens__NP_060104
augagaagggugacccuguuccucaacggcagccccaagaaugggaaagucguugccguguacggaacacuuuccgaccuguugucuguagcuucaaguaaguuagguaucaaagcaacuagcguguauaacggcaaagggggacugauugaugacauagcccuaauccgggaugacgauguccucuuugugugcgagggcgaaccuuucauugacccacagacggauuccaagccgcccgagggucugcuuggguuucacaccgacuggcugacauugaauguuggaggccgcuacuucacuaccacacgaucuacccucgugaacaaggaaccugauucgaugcuggcgcauauguuuaaggacaaaggcgucugggggaauaagcaagaucaccguggagcuuuccugaucgacagaucaccagaguauuuugaacccauucucaacuacuuaaggcauggucagcugaucgugaaugauggcauaaaccuuuuggggguacuggaggaggcccgguucuuuggaaucgacagccuaauugaacaccucgagguugcaaucaaaaauagucagccuccagaagaccauucccccauuucucgcaaggaguucgugagauuucugcuugccacuccuacaaaaagcgagcugaggugucagggcuugaacuucuccggugcugaucucucacggcuggacuuacgcuauaucaauuuuaagauggcaaaccugagucgaugcaaucucgcccacgcuaaccuuuguugcgccaaucuggaaagagcggauuugagcgggucuguccuagacugugcaaaccugcaaggagugaagaugcucugcuccaacgccgagggcgcuucacugaaacuuuguaauuucgaagauccaagcggccugaaggccaacuuggagggggcaaaucucaaaggaguggacauggaagguagucagaugaccggcauaaaccugagggucgcuacguuaaagaaugccaaacugaagaacugcaaucuacguggggcgacucucgccggaaccgaucuggagaacugugaccuuucuggcugcgauuugcaggaggcaaaucugcgggguuccaacguuaaaggggcuauuuucgaagagaugcucacaccgcugcacaugagccagucggugcgcuga

SEQ ID NO: 58031 - RNA, 1509 nt, Artificial Sequence
  derived and/or modified sequence opt3 from KDELC1__Homo_sapiens__NP_076994
auguucggcacccugcuccuuuacugcuuuuuccuggccacagugcccgcuuuggcagagacugggggagaaagacaguuaagcccugagaaguccgaaaucugggguccaggccugaaagccgacgucguucuaccggcgagguauuuuuacauucaagcuguggauacgucugggaacaaguucaccucaagucccggagagaaaguauuucaggugaaggucagcgccccugaggaacaguucacacgggugggcguucaggugcucgaccgcaaagaugguuccuuuauaguccgauaucguauguacgcaucuuauaagaaucugaagguggagaucaaauuccaagggcagcacguagccaagucgccauacauucuuaaaggacccguuuaucaugaaaacugugacugcccucugcaggauucagcugcaugguugagagagaugaauuguccagaaacuaucgcccagauucaaagggaccucgcucacuuucccgccguggauccugagaagaucgcggucgagauaccaaaacgguucggccagcgccagagccugugccauuacacccugaaggacaacaagguguacaucaaaacacacggcgaacaugugggguuuagaauuuucauggaugcaauccucuuaagucugaccaggaaggucaaaaugccggacguugagcuuuuugugaauuugggagauuggccccuggaaaagaaaaaguccaacucuaauauucacccuaucuucagcuggugugguuccacugacucaaaagauauaguaaugccaacauaugaccuaaccgacagugugcucgagacgaugggccgggucagccuggauaugaugucugugcaggccaacacugggcccccuugggaauccaaaaauucaaccgcuguuuggcgcggacgagacagcagaaaggagaggcuugagcuggugaaguugagucggaagcacccagaacucauugaugccgcauucacaaacuuuuucuuuuucaaacaugacgagaaucuguacggccccaucgucaagcacauuucuuucuucgacuuuuucaaacauaaguaucaaaucaacaucgaugguacuguggcugccuaccguuuaccguaucugcucguaggggauuccguugugcuuaagcaggacagcauuuacuaugaacacuuuuacaaugagcugcagccuuggaaacacuacauacccgucaagucgaacuugucugaucuacuggaaaaacucaagugggcgaaagaccaugaugaggaggccaagaagaucgcaaaagcuggacaagaauuugcccgcaauaaccugaugggcgacgacaucuuuugcuauuacuucaagcuguuucaggaguaugcuaaccuucagguguccgaaccacagauuagagagggcaugaaaagggucgaaccucaaaccgaggaugacuuguuccccuguacaugccaccggaagaaaaccaaggaugagcucuga

SEQ ID NO: 58032 - RNA, 639 nt, Artificial Sequence
  derived and/or modified sequence opt3 from KDELR1__Homo_sapiens__NP_006792
augaaccuguucagauuucucggcgaccuuagccaccuguuggccaucauuuuacugcuacucaagauauggaaauccaggucuugcgcugggaucucaggaaagagucaggugcuguucgcagucguuuuuaccgcccgguaccuugaucuguucacaaauuauauuagcuuguacaacacuuguaugaaagugguauauaucgcgugcuccuuuacgaccguguggcucauuuacucuaaguucaaagcuacauaugacgguaaucaugauacuuuucgcgucgaguuccuggugguucccaccgccauccuggcauuucucgugaaccacgacuucacaccuuuagaaauacuguggaccuuuucgaucuaccuugagucagucgccauuuugccacaacuguucauggugagcaagacuggcgaagcugagacaaucaccagucauuaucuauuugcacucgggguauaccgaacgcuguaccuuuucaauuggauuuggcguuaucacuucgaaggauuuuucgaucugaucgccauaguugcuggcuuggugcagacuguccucuacugugacuuuuucuaucuguacauuaccaagguguuaaaagguaagaaacugucccucccggccuga

SEQ ID NO: 58033 - RNA, 2172 nt, Artificial Sequence
  derived and/or modified sequence opt3 from KDM2A__Homo_sapiens__NP_001243334
augugcagcggcagauuccagaacauccaagugaaucccgacuuuccuagggggcggauuuccaacucuuuccgccgaaccucaaguacagagaauaagacuaaaacgcugggaaagcuccaccaggaaccacgucagcuucagagcgaugguaaaagaaagauacuguuggaggaauuagccaacuccgacccgaaacuggcucuaaccggcguccccaucguucaauggccuaagagggauaagcucaaauuuccaacacggcccaaggugcgcguaccuacuauuccaaucaccaaaccccauacaaugaagccugcaccaagacugaccccggugaggcccgccgcggcuucuccuauugucucgggggcccggcgccgaagagugaggugucggaaaugcaaggcauguguucagggagagugcggcgugugucacuacugccgugacaugaagaaauucggugggccaggacgcaugaagcagucauguguccuuagacagugccuggcccccagguugccucauagcgugacuuguagucucugcggcgaaguagaucaaaaugaggagacacaggacuuugagaaaaagcugauggaguguugcaucugcaacgaaauaguucacccaggcugucugcagauggauggggagggacucuuaaaugaggaacugcccaacugcugggaguguccgaaaugcuaucaggaagacuccucugagaaggcucaaaaacggaagauggaagagagcgaugaggaagcagugcaggccaagguccuucgaccuuugcgcuccugugacgagccccugaccccaccuccccauucaccaacgaguaugcuacagcucauccacgaucccgugagcccuagagguauggugacuaggucuuccccaggcgcugggccgucagaccaccauagcgccagucgggaugaacgcuucaaaagaaggcaacugcuucgucugcaggcgaccgagcggacaaugguccgagaaaaggagaauaaccccucugggaaaaaggaguuguccgaaguugagaaagcaaagauuagaggcagcuaccucacugugacccugcagaggccuacaaaggaauuacacgguaccucgaucguaccaaaacugcaggccauuacggcuucuuccgccaaucuccgccauucaccccgggugcuuguccaacacugcccugcaagaacuccacagaggggagacgaggaaggacugggcggcgaggaggaagaggaagaggaggaagaggaagaggacgauagugcugaagaagggggagccgcgcgcuugaacggucgaggcagcugggcccaggacggggaugaguccuggaugcagcgggaaguguggaugucuguuuuucguuaucuaagcagaagggagcugugugaaugcaugcgcguguguaagacaugguacaaauggugcugugacaagcggcucuggaccaaaaucgaucugucaagaugcaaggcaauagucccccaagcucuuaguggaauuaucaagaggcagccggugucccuggacuugagcuggacuaauauuucuaaaaagcagcucacauggcugguaaaccgauuaccuggccugaaagaucuacuccuggccgguugcucauggagugcuguuagcgcccuuuccaccucuucguguccauugcugcgcacgcucgaccugcggugggcaguggggaucaaggauccccagaucagagaccuucugaccccucccgccgauaaaccaggccaagacaauaggagcaaguugcguaacaugacagacuuccgccucgcuggacuggauauuacugacgcgaccuuacggcugauaaucagacacaugccucuacucuccaggcuggaucuuucacauugcagucacuugacagaccagucuagcaaccugcucacugcagucggcuccucaacccgauauagccugacagaguuaaauauggccggguguaacaagcugaccgaucagacucuuauuuacuugcggcgcaucgcuaaugugacgcucauagaccugagaggaugcaaacagauuacaaggaaggccugugaacauuuuaucucugaucuauccaucaacagucuguauugccucagcgacgagaaacugauucaaaagaucucuuga

SEQ ID NO: 58034 - RNA, 3798 nt, Artificial Sequence
  derived and/or modified sequence opt3 from KDM2B__Homo_sapiens__NP_001005366
auggaggccgaaaaggacagcggcagaaggcugcggcccaucgaucgccagcgauacgacgagaacgaagaucucuccgacguggaggaaauugucucuguucguggguucucacuugaggagaaacugagaagucaauuguaucagggagauuuugugcacgcuauggaagguaaggacuucaauuacgaguauguacagagggaagcauuacgggugccucugauauuucgcgagaaagauggccuagggaucaagaugccagacccggauuucaccgucagagacgugaaacuccugguuggaagcaggcggcuuguggaugucauggacgugaacacacagaagggcacugagauguccaugucucaauuuguacgcuacuaugaaacgcccgaggcccagcgagauaagcuguacaauguuauuucguuggaguucucacauaccaaacucgagcaccuggugaagagaccuacagucguggaccugguggacugggucgauaacauguggccacagcaucucaaagaaaagcagacugaggcgaccaaugcuaucgccgagaugaaauaucccaagguuaagaaauacugcuuaaugagcgugaaggguuguuuuacagacuuccacauugauuuugggggaaccaguguaugguaccauguguucaggggcggcaaaaucuuuuggcugauaccuccaacucuucacaacuuggcacuguaugaagaguggguccuauccgggaagcaaucugacaucuuccucggagaucggguggaacguugccagcgcauugagcugaaacaggguuacacauuuuucauccccagcggcuggauucacgccguuuauaccccuguggacucccuugucuucgggggaaauauccugcauucauuuaacgugccaaugcaguugagaauauacgaaauugaggauaggacgcggguacaaccgaaguuccgauaucccuuuuacuaugagauguguugguacguucucgaacgcuacguguauugcgucacucagagaagucaccugacccaggaguaccaaagggaaagcauguuaaucgacgcuccucggaaaccaucuauugauggcuucuccucagacagcuggcuggagauggaagaggaggcaugugaucagcagccccaggaagaggaagagaaggacgaggaaggugaggggcgcgacagagccccuaagccacccacagauggaaguacuucuccgaccuccacaccuagcgaagaccaagaggcucucggcaaaaagcccaaagccccagcgcuuagguuucugaagcguaccuugucgaaugaaucugaggaguccgugaaaucaacgacucuagcagucgauuauccuaagacacccaccggcaguccagccacugaagugagcgcuaaguggacacaucugaccgaguucgaacucaaagggcugaaggcccuuguugagaaacuggaauccuugcccgagaacaagaaaugcgugccugagggaaucgaagacccacaggcacuccuggaggguguaaagaaugucuuaaaggaacacgcugaugacgauccgucucuggccaucacgggcgugcccguugugaccuggccuaaaaagacacccaaaaaccgggcggucgggcgacccaagggaaaacuaggcccugccagcgcagugaagcucgcugccaauagaacuaccgcuggugccaggcgccggagaacaaggugucgcaagugcgaggcaugucugcgaacugaaugcggggagugucacuuuugcaaagacaugaagaaauucggcggaccaggccggaugaagcagucaugcauuaugcgucaguguauagcccccguacuuccgcauaccgcugugugcuugguuuguggggaggcgggaaaagaagauacagucgaggaagaggaggguaaguuuaaccugaugcucauggaaugcaguaucuguaaugagauuauccacccuggcugccugaaaauaaaggaauccgaggggguggugaacgacgaacuuccaaacuguugggagugccccaaguguaaucaugcaggaaaaaccggcaagcagaaaagagguccuggguucaaguacgccagcaaccugcccggcucuuugcucaaagagcaaaagaugaauagggauaacaaggaaggacaggagccagcuaaacgccggucagaaugcgaggaagccccuagaaggcgaagugacgagcacagcaagaaagucccaccagauggccuguuacgccggaaguccgacgacguucaucugaggaaaaagagaaaguaugagaaaccgcaggaacuaucugggcguaagcgccucaaaccuggaaaggaggauaaacuguuucggaagaagagaaggucguggaaaaaugcagaagaccgaauggcccuugcuaacaagcccuugcggcgcuucaaacaagagccagaagaugagcugcccgaggccccuccaaagacuagagaaagcgaccacuccaggucaaguucucccacggcagguccuagcacagagggcgcggaagggccggaggagaaaaagaaagugaagaugcggcgaaagagacgccucccaaauaaagaacuguccagggaguuaucaaaggaacugaaccacgagauucagcguaccgaaaauagccuugcuaacgagaaucagcagcccaucaaaucugagccugaauccgagggagaagaaccaaagcggcccccuggcaucugugaaagaccgcauagguuuaguaaagguuugaacgggacuccccgcgagcuccgacaccaacugggcccaagccuaagaucuccuccccgggugauuuccaggccaccucccucaguaaguccaccgaagugcauccagauggagcgccaugucauucguccucccccaauaucgcccccuccagauagccugccccucgacgauggagccgcacacgugaugcacagagaaguuuggauggccguguucuccuaccugucucaucaggaccuuugcgucuguaugcgggugugcaggaccuggaaucgcugguguugcgauaagcgauuguggacaagaaucgaccugaaccacuguaaaagcauuaccccuuuaaugcucucaggcaucauccggaggcaaccgguuagucuggaucuuuccuggacuaauauuucuaagaaacagcugagcugguugauaaaccgccucccagggcugagagaccuagugcuguccggaugcucauggaucgcuguaagcgcccucuguaguucuuccugcccccugcuuaggacauuggauguccaguggguggagggccugaaggacgcacagaugcgggacuuacucagcccucccacggauaaccguccaggucaaauggacaaucgcucgaaacugcgaaacauuguggaacuuagacuggcugggcuagauaucaccgacgccucacucaggcugauuauccggcauaugccuuugcugucuaaguuacaccucaguuauuguaaucaugucacugaucaguccauaaaccugcuuacagcgguuggaaccacaacucgcgacagccugaccgagaucaauuugucugauugcaacaaggugacggaccagugucucagcuucuuuaaaagaugcggcaauauuugccacaucgaucugagguacuguaagcagguaaccaaagaagguugcgagcaauucauugccgagauguccucauuucagggccggaguuguagcacaacucgacuaggggacgaauga

SEQ ID NO: 58035 - RNA, 3966 nt, Artificial Sequence
  derived and/or modified sequence opt3 from KDM3A__Homo_sapiens__NP_060903
auggugcugacccucggcgagagcuggcccguccuuguugggagaagguuccuguccuugucugccgcugacggaucagaugguagucacgacagcugggauguggaacggguagcagaguggccuugguuauccggcacaauccgcgccgugucucauacugacgucacgaagaaagaucugaaggugugcguugaauuugacggggagucguggcgaaaacguagauggauugaaguguacucacuacucaggcgggcguuccuggucgagcacaaccuugugcuggcugagcgcaagagcccagaaauaagugagagaaucguacaguggccggccauuaccuauaaacccuugcucgauaaggcaggacugggcuccaucacaucuguuagguuucugggugaccaacagcggguguuccucagcaaggauuuacugaaaccuauucaggacgucaauucccuucgcuugucacugacugauaaccagaucgugaguaaggaauuucaagcccuaauagugaaacaucucgacgagagccaccuacuuaagggggauaaaaaucuggucggaucugagguuaagaucuacuccuuggacccaucaacccagugguucagcgcuacagugauuaacggcaaucccgcaaguaagacccuccagguaaacugugaagagaucccugcccugaaaauuguggacccaucuuuaauccaugucgaagugguucacgauaaucuggugacuugcggcaacuccgcucgaauaggggccgucaagagaaaaagcucggagaauaacggaacacucgugucuaagcaggcgaaauccuguucagaagcaagucccagcaugugcccuguacaauccguuccaaccacgguguuuaaggagauucuucuggguuguacugccgcuaccccgcccucuaaagacccuaggcagcagagcacaccacaggccgcaaauucacccccuaacuugggcgcuaagaucccacaagggugccacaagcagagucuacccgaggaaauuuccagcugucugaauacuaaaucugaggcccuccggaccaagccggaugucugcaaagcgggacugcuuucaaagaguagccagaucggcacaggugaccugaaaaucuugaccgaaccuaagggguccuguacgcaacccaagacuaacacagaucaggagaaucgucucgaaucugugccacaggcccugaccggauuaccuaaagagugccugcccacuaaggcaucgagcaaagcugagcuagaaauugccaacccacccgagcuccagaagcaucuggaacacgcuccuuccccaucagacgucaguaacgccccggaggugaaagcaggcguuaauucugauagccccaacaauuguuccggcaagaagguggaaccuucagcccuugcuugccgcagccaaaacuugaaagagucuuccguaaaggucgacaaugagaguugcuguagcagaucuaacaauaaaauacagaacgcgccauccaggaagucagugcugacagaucccgcaaaacucaagaagcugcagcagaguggggaagccuucguucaagacgauagcugcgugaauaucgucgcucagcuuccuaaaugucgggagugccgacuggacucguugcgcaaggacaaagaacagcagaaggauuccccaguguuuuguagauucuuucauuucaggcggcuccaauuuaacaaacacggaguacugcgcguggaggguuucuuaacccccaauaaguaugacaacgaggccauuggccuguggcuaccgcucacgaaaaauguugucgggaucgaucuggacaccgcaaaguacauacuugccaacauuggagaucacuucugccagauggugaucucugaaaaggaggcuaugagcacaaucgaaccucauagacagguggccuggaaaagggcagucaagggcguucgugagaugugugacgugugcgauacuaccauuuuuaauuugcacuggguguguccacggugcgguuucgggguaugugucgacugcuaucgaaugaaaagaaagaacugccagcaaggcgcggcuuacaaaacauuuucauggcugaagugugugaagagucagauccaugaacccgagaaccucaugccuacucagauuauacccggaaaagcccuguaugauguuggcgacaucgugcacuccgucagggcaaagugggggauuaaagccaauugcccauguucuaaccgccaauucaaguuauuuagcaaaccugcuuccaaggaggaucugaagcagaccucacuugccggagaaaaacccacauugggugcagugcuccagcagaauccaagcguucuggagccggcugccgugggcggggaagcggccaguaagccugcuggaucuaugaaacccgcaugcccagccuccaccagcccccuaaacuggcuggcugaccucacuucgggcaauguaaacaaggagaauaaagaaaagcaaccuacgaugccaauccugaagaacgagaucaaaugucuucccccuuugccgccacugucaaagucuaguacagucuuacauaccuucaauuccacuauucucacccccgugagcaacaauaacucugguuuucugcggaaucuucugaacagcuccacagggaaaaccgagaauggcuugaagaacacuccuaaaauacucgaugacaucuucgccucacuggugcagaacaagacaacgagugaccuaagcaaaagaccacagggacugaccauuaagcccucuauccucggcuuugauacuccucacuacuggcugugcgacaauaggcuuuugugucugcaggauccgaacaauaaguccaacuggaaugucuuccgcgaaugcuggaaacaagggcagcccguuauggugucaggaguacaccauaaguuaaacagugagcucuggaaaccagaauccuuucgaaaggaguucggugaacaggagguggaccuggucaauugucggacaaacgagauuaucaccggcgcaacagugggggauuuuugggacggauucgaagauguuccuaaucgucuuaaaaacgagaaggaacccauggugcugaagcuaaaagacuggccaccuggcgaggauuucagagacaugaugcccagcagguuugaugaccucauggcgaauauaccacugccggaguacacucgccgggaugguaaguugaaccuggccucuagauuaccuaauuauuucgucaggcccgaccucgggccaaaaauguacaacgcuuauggccugaucacccccgaagaccgaaaguacggaacgaccaaucuucaccuggaugugucggacgccgcaaacguuaugguguaugucggcauuccuaaagggcagugcgagcaagaagaggaaguauugaagacaauccaggauggagacagcgaugagcucacuauuaagcgcuuuaucgagggcaaagaaaagccaggugcucuguggcauauauacgccgcaaaagacaccgagaagauucgggaguuccugaaaaaggugucagaagaacaggggcaagagaaccccgccgaucacgacccuauccacgaucaguccugguaucuggacagaagucuuaggaagcgucuccaucaggaguacggaguucagggcugggcuauugugcaauuucugggugaugucguguucaucccggcgggcgccccacaccagguacauaauuuguacucuuguauaaaaguggcagaagacuuugucagccccgagcacguuaagcauugcuucuggcugacacaggaauuucgcuauuuaucccagacucacaccaaccacgaggacaaacuccaagugaagaaugugaucuaccaugcugucaaagaugccguggccaugcugaaggcuucagaaucuagcuucgggaagccuuga

SEQ ID NO: 58036 - RNA, 5286 nt, Artificial Sequence
  derived and/or modified sequence opt3 from KDM3B__Homo_sapiens__NP_057688
auggccgacgcugcagccagccccgugggcaagagacugcuccuucuguucgcggauaccgcugccuccgcaucugccucagcuccugcagccgcugccgcgaguggggacccaggaccggcauugaggacacgggccuggcgcgcugguacuguccgagccaugagcggcgcaguuccccaggauuuagcuaucuuuguggaguucgacgggugcaacuggaaacaacacuccuggguaaaggugcaugccgaagaggucauugugcugcuacucgaaggaucucugguuugggcgccucgugaggauccagugcuucugcagggcauaagagucucgaucgcccaguggcccgcauugacguuuaccccucucguggacaaacugggucuggggucaguaguuccaguggaauaccucuuagauagggagcugcgguuccuuagcgacgcuaauggauugcaccuguuucagaugggcacagauagucaaaaccagauucuacucgagcaugccgcucugcgcgaaacugucaaugcccuuaucuccgaccagaagcugcaggagauuuucucuagaggccccuauagcgugcaagggcacagggugaaaaucuaccagccugaaggagaggaggguugguuguauggcgucguuucccaucaggauucaauaacccggcucauggaagugaguguaacagagagcggggaaaucaagucuguggacccacgccugauucacgucauguuaauggauaacuccaccccgcagucagagggaggcacucugaaggcagugaaaagcaguaaggguaaaaagaaacgagaaucuaucgaggggaaggacggaagaaggcggaaguccgccagcgacucgggcugugaucccgcuucuaaaaagcucaaaggcgaccguggggagguugauuccaauggaucagacgguggcgaagcgagucgcgggccuuggaagggaggcaacgcaagcggugagccagggcuugaucaaagagccaaacagcccccuuccacauuugugccacagauuaauaggaacauccgguucgcuaccuacacgaaggaaaauggccgaacucuggucgugcaagacgagcccguaggaggcgauaccccggccucuuuuacaccuuauagcacugcaaccgggcagacacccuuggccccagaaguuggaggugcugagaacaaagaggccggcaagacccuagaacagguggggcagggaauagucgcaucagcggcuguggucacgacugccaguuccacaccuaauaccgugcgcauuagcgacacuggccuggcagccgguacaguucccgagaagcaaaaagggucuagaucacaggcuaguggcgaaaacagcaggaauuccauccucgccucuucgggauucggcgcaccacugcccagcuccucacagccucuuaccuuugggaguggacggucucagagcaacggugugcuggcuacggagaauaagccauugggcuucuccuuugggugcucaagcgcccaagaagcgcagaaagauaccgaccucucuaagaaccuguucuuccaguguaugucccagacauuaccgacuaguaacuacuuuaccacaguaagcgagucucuggccgaugacuccucaagucgcgacagcuucaaacaaucgcuagagucccucucuagcggacugugcaagggcagaucaguccuugguacugauaccaagcccgggaguaaagcuggcuccucuguggacaggaagguuccugcagaaagcaugccaacauugacccccgccuuuccucguucccugcucaaugcucggacuccagagaaccacgaaaaucuguuccuucagcccccgaaacugucacgagaggagccuagcaacccauuuuuggccuucguggaaaaggucgagcauagucccuuuucuuccuucgcaagccaggcgucgggaucaucuaguuccgccacgacagugaccagcaaaguagcuccuucuuggcccgaaagccacuccucagccgauagugcaagccucgcuaagaagaaaccacuguuuauuacuaccgacucuuccaaguuagugucaggcguucuggggagugcccuaacaagcggaggcccuucccucucugcaauggguaaugggagaucgagcucacccaccuccagucugacucagccaaucgagaugccgacacuuucuagcuccccuacggaagagaggcccaccgucggaccaggccaacaggauaaccccuugcugaaaacuuucucaaauguguuuggucgccauucuggcggguuccucagcaguccugccgacuuuucccaggagaacaaggcuccauucgaagcggugaaacgguucagccuggaugagagaucuuuagccuguaggcaagacucagauuccaguacaaauagcgaccugucggaucuuucugacuccgaagagcaguugcaggcaaagaccggacucaagggcauccccgaacaccugauggggaaacuaggaccuaacggcgagcgcagcgcugagcugcuccuggguaagucaaaagggaagcaggccccgaaaggacgaccacggacagccccccuuaaggucggccaaaguguuuugaaagaugugucuaaggugaagaaacugaagcaguccggugaaccuuuuuuacaggacggcagcugcauuaauguagcuccacaccuccauaaaugucgugagugcagacuggaaagguaucgcaaguucaaagagcaggaacaagacgauucaacugucgcaugucgguuuuuccacuuuagaaggcuuauauucacccgaaagggggugcugcgcguugagggauuuuugaguccccagcagagcgacccugaugccaugaaccucuggaucccguccucuagccuggcggagggcauugaccuagaaacguccaaguacauccuggcuaaugugggggaucaguucugccaacucgucaugucagagaaagaagccaugaugaugguggagccccaucagaagguugcauggaaacgggccgugagaggaguaagggagaugugugacgucugcgaaaccacacuguuuaacauacacugggugugccguaaguguggcuucggugugugccuugauuguuaccgcuugcggaaaucuagaccaaggagugagacugaagagaugggggacgaagaggucuuuucguggcugaagugcgcuaagggacagagccaugagccugaaaauuuaaugcccacccaaauuaucccaggcacagcacucuauaacaucggugauaugguucacgccgcgcgaggcaaaugggggauuaaggcuaacuguccuugcaucucccggcagaauaaaucugugcugcgccccgccguaacuaacggaaugucacagcuuccaagcauuaauccguccgcaaguucuggcaacgagaccacguucagcgggggaggcgguccugcccccgugacaaccccagaacccgaccacgucccuaaggcugauucaacugacauaagauccgaggaaccacugaaaacagauaguagcgccucuaauuccaacucagagcuaaaggcaaucaggcccccuuguccggacaccgcuccacccagcucggcccuccauuggcuggcggacuuggccacucagaaggcaaaagaggaaaccaaggaggcugggucucugcggaguguguuaaauaaagaaucccacagcccuuuuggacucgauucauucaacuccacagccaagguuucuccccugacgccaaaacuuuucaauagccuguugcucggcccuaccgcuaguaacaauaagacugagggcuccagccugcgagaccuacugcauucugggcccggaaaacuuccacaaacaccucucgauaccgguauuccguuucccccaguguucucaacaaguuccgcaggcgucaagagcaaggccucucugccuaacuuuuuggaccacaucaucgccucggugguugaaaauaaaaagacuucagaugcuagcaaaagagcgugcaaccugaccgacacgcagaaggaggugaaagagauggucaugggguuaaauguacucgauccccacacaucccauaguuggcugugugacggacgccuucugugcuugcacgauccaucuaacaagaacaauuggaagauuuucagggaauguuggaaacagggccagccugugcucguuagcggugugcauaagaaacugaaguccgagcuauggaaacccgaagcauuuucacaagaguucggggaccaggaugucgaccuggugaacugccguaauugcgccauaaucagugacguaaaggugcgggauuuuugggacggauucgagauuaucuguaagagacuuaggucugaagauggccagccgaugguccucaaacugaaggacuggccaccuggcgaggauuuucgcgacaugaugcccacccgauucgaagauuugauggagaacuuaccacugcccgaauacacuaaaagagacgggcggcucaaucuggcuagcaggcuuccuuccuauuuuguucgcccggaucugggacccaagauguacaacgccuaugguuugauuaccgcagaggaccguagagugggcacaacuaaucuacaccuggaugugucagacgccgucaacgugaugguuuacguagggaucccaauaggagagggcgcucaugaugaagaggugcucaaaaccaucgacgaaggugacgcggaugaggucacaaagcagcggauucacgacgggaaggaaaaaccuggagcccuguggcacaucuaugcagcuaaggaugccgagaaaauuagggagcuuuuacgcaaggugggcgaagagcaaggccaggaaaaucccccugaccaugauccaauccacgaccagagcugguaccuggaucagacgcuccgaaaaagauuguacgaggaauaugggguucaaggaugggcaauagugcaguuccugggugacgccgucuucauucccgcuggcgccccucaucaggugcacaaccucuacucuugcaucaagguagcggaggauuuugucuccccagagcaugugaagcacuguuuccggcugacccaagaauuuaggcaccuuaguaauacucauacaaaccacgaggacaaacugcagguuaagaauauuaucuaucaugcagugaaagaugccgucgggaccuugaaggcucacgaaagcaaacuagcccgcucguga

SEQ ID NO: 58037 - RNA, 3291 nt, Artificial Sequence
  derived and/or modified sequence opt3 from KDM4B__Homo_sapiens__NP_055830
augggcagcgaggaccacggggcccagaaccccuccugcaagaucaugaccuucagaccuacaauggaagaguuuaaagauuucaauaaguacguggcuuauauugaaucucaaggagcacauagggccggucuggcgaaaauaaucccaccgaaggaguggaaaccccggcagacuuacgacgauauugacgaugucguuaucccugcuccaauucaacaggugguaacgggccaaucagggcucuuuacccaguauaacauccagaagaaggccaugacagugggagaauaccgccgacuugcaaauagugagaaauauuguacuccccgucaccaggacuucgaugaccuggagagaaaguacuggaaaaacuugaccuuugucagcccuauauauggcgccgauaucuccgguucuuuauacgacgaugacguggcucaauggaauauugggucgcugaggacaauccuagauaugguugaacgggagugcggaaccauuaucgaaggcgugaacacuccauaccucuauuucggcauguggaagacaaccuuugcauggcauacggaggacauggaccuguacucaauaaauuaucuucacuucggggagcccaaaagcugguacgccauuccuccagaacauggaaagcgccuggagagauuggcuaucggauuuuucccgggcaguucccaggggugugaugccuuucucaggcacaagaugacucugauuucucccaucauccugaaaaaguaugguauuccuuucagccggauaacccaggaagcgggcgaguuuaugaucacauucccauacgguuaucacgcaggguucaaccauggauuuaauugcgccgaauccacuaacuucgcuacccuccgcuggauugacuacggcaaagucgccacacaguguaccugccgaaaggauauggugaaaaucucaauggacguauuuguuagaauauuacaacccgagagguacgagcuguggaagcagggcaaagaucuuacgguguuggaccacacucggccuacagcacugaccaguccagaacuaagcucuugguccgcuucacgugccagccucaaggcgaagcugcuucgcagaagucauaggaaacggucucagcccaagaaaccgaagccugaggaucccaaauucccaggggaaggaacugccggugcagcucuguuggaggaagccggcggguccgucaaggaggaggcuggaccugaaguggaccccgaggaagaggaagaggagccacaaccccucccucacggccgagaagccgagggugcagaagaggaugggcgcggcaagcugagaccaacaaaagccaagagcgagaggaaaaagaaaucguuuggauuacugccgccccagcucccuccacccccugcucacuucccaucugaagaggcgcuuuggcugcccuccccguuggaaccuccagugcuaggccccgggccugcagccauggaggaaucaccccugccagcuccucucaaugucguucccccagaggugccgagugaggaacuggaggccaagccucggcccauuaucccaaugcuuuauguagugccccgcccuggaaaggcagccuuuaaccaggaacaugucagcugucagcaggcuuucgagcacuuugcccagaaagguccaaccuggaaggaacccguguccccuauggagcugacgggcccggaggacggggcagcgucuagcggagcuggcagaauggaaaccaaagccagggccggugaggggcaggccccaucaacauucaguaaguugaaaauggaaaucaagaagucccgucggcauccccucggccgaccuccaacuagaagcccccugucuguugugaaacaggaggcuucaagugaugaagaggccagcccuuuuuccggagaggaagacgucucugacccggaugcauuaaggccccugcuaucgcuccaauggaagaaucgcgcugccagcuuccaggcggagcggaaauuuaacgccgcugcagccagaaccgaaccauacugcgcuauuuguacacuguucuauccuuacugccaggcccuucagacugagaaggaggcacccaucgcguccuugggcgaaggguguccagccacccugccuucaaaaaguaggcaaaagacacgcccccucauuccagagaugugcuucaccucuggaggugaaaauacugagccgcugccugcuaacagcuauauaggcgacgaugggacgucaccccuuaucgccugcggaaaauguugccugcaagugcacgcauccuguuacggcauucgaccagaauugguaaacgaggguuggacaugcagccggugugcugcccaugcauggaccgccgagugcugucucugcaaucugcgugggggcgcuuuacagaugacuaccgacagaagguggauccacguuaucugugcgauugccgugcccgaagcacgcuuucugaacgucauagagcggcacccuguggauaucucugcuauuccagaacagagauggaagcuaaagugcgucuauuguaggaaacgaaugaagaaaguguccggagccugcauccagugcaguuacgagcauuguagcacaucuuuccacguuaccugcgcccaugcugcaggcgugcucauggaacccgacgauuggccuuacguagucuccauuacuugucugaagcacaaaucagggggacacgccgugcagcuuuugcgcgcgguuagucugggccagguggucaucacaaagaaucggaacggucucuauuacagaugcagggugauaggggcugccagccaaacguguuaugagguaaauuuugacgauggaucguacuccgacaaccuguauccggagucuaucaccagccgugauugcgugcaguuaggcccacccucagaaggugagcugguugaacuucgcuggacugacggcaauuuguacaaggcaaaauucauuaguuccgucacaucucauaucuaucagguggaguuugaagaugggagccagcucaccgugaagcggggagacauuuucacacuggaggaggaacuaccuaaaagagucaggucccgacugucacucagcacuggcgcaccccaagagccagcuuuuaguggggaagaggcaaaggccgcgaaacggccucgcguuggaacgccccuggcuaccgaggacucuggcagaucccaggauuacguggccuucguggaaagccuuuugcagguacaggguaggccaggggcaccuuuuuga

SEQ ID NO: 58038 - RNA, 2442 nt, Artificial Sequence
  derived and/or modified sequence opt3 from KDM4C__Homo_sapiens__NP_001140167
auggagguggccgaagucgagagcccccugaacccuuccugcaagaucaugaccuucagaccaucuauggaagaguuuagggaguucaauaaauaccucgcuuauauggagucaaagggcgcacaccgggccgggcuugcgaaaguuauuccgcccaaggaguggaaaccucgccaguguuacgacgauauagacaaccuguugaucccagcucccauucaacagauggugacaggacagagugguuuauuuacucaguauaauauccaaaagaaggccaugacgguaaaagaguuccgacagcuggcaaacagcggcaaguacugcaccccucguuaucuagauuacgaggaccucgaaagaaaauauuggaagaaucugacauuuguggccccaauuuacggggcugauaucaacggauccauauacgacgagggcgucgaugaguggaauaucgcaaggcuuaacacugugcuggacguuguggaagaggaaugugguauuucuaucgagggggucaauacccccuauuuguacuucggaauguggaaaacaaccuuugccuggcauacugaagauauggaccucuauucgauuaacuaccugcacuucggcgagccuaagucaugguaugcuaucccaccggagcauggcaagcggcuggaacgccucgcccagggguuuuuccccagcaguucccagggaugcgaugcguuuuuaagacacaaaaugacacugauaucuccuagcgugcuuaagaaauacgguauuccauucgacaagaucacccaagaggcaggcgaauuuaugauuacguuccccuauggguaccaugccggauucaaucacggcuuuaacugugcugaguccacuaauuucgccaccguaagguggaucgauuacgguaaaguugcaaaguugugcacaugucggaaagacauggugaagaucucaauggacauuuuuguccgcaaguuccagccugaucgauaucagcuguggaaacaggggaaggacauauacacuaucgaucacaccaaaccaacacccgcuaguaccccggaagugaaggccuggcuacaaagaaggcggaaagugcguaaggcgagccgcucuuuucagugcgccagauccacgucaaagaggccuaaagcagacgaggaggaagaggucagcgaugaaguugacggagcugaggugcccaacccagauaguguaacugacgaucucaaggugucugaaaaauccgaggccgcugucaagcugcggaauacagaggccagcucggaagaggaaucuuccgcaucacgaaugcaaguggagcagaaccuuagugaccauauuaaacugagcggcaacuccuguuugucuaccagcguuacugaggauaucaagacagaagacgacaaggccuaugcuuaccgcucagugccuaguauauccagcgaggcggaugacucuauuccccucucaaguggcuaugaaaaaccagaaaagagcgaucccuccgaacugucuuggccuaaaucgccagagagcugcuccucagucgcagagaguaaugggguguuaaccgaaggagaggaaucugacguagagagccacgguaacggccuggaaccgggggagauccccgccguuccuuccggagagagaaauucauucaaggugccaagcaucgcugaaggcgagaacaaaacgucuaaguccuggaggcauccccucagucggccuccagcccgcagccccaugacccuugucaagcagcaggcaccgucugaugaagaacugccugaaguguuguccauugaggaggaagucgaggaaacagagucaugggccaaaccacuaauccaccuguggcagacuaagagucccaauuuugcugccgagcaagaauacaacgcaaccguggcgagaaugaaaccucacugugcuauuugcacacuccugaugcccuaucauaagccagacagcucgaaugaggaaaacgaugccaggugggagacuaaacuugacgaaguugugaccuccgaggguaagacaaaaccucugauacccgagaugugcuucaucuacucugaagagaauauugaauacagcccaccgaacgcauuuuuggaggaagaugggaccucacuccugaucaguugugccaagugcuguguacguguccacgcuuccugcuauggcaucccuucucaugagauuugugacggaugguuaugcgcccgguguaagcgaaaugcauggacugcugagugcugucugugcaaccuaagaggcggggcccucaaacagacgaagaauaacaaaugggcgcacgugaugugugccguugcugugcccgaagucagguucacaaaugugccagagcgcacccagauagauguaggacggaucccccugcagagacuuaaguuggguaggcugggcauuuga

SEQ ID NO: 58039 - RNA, 5073 nt, Artificial Sequence
  derived and/or modified sequence opt3 from KDM5A__Homo_sapiens__NP_001036068
auggccggcguggggcccggagguuacgcugcagaguucgucccuccaccggaaugccccguuuuugagccuagcugggaagaguucaccgacccacuguccuuuaucggccguauuaggccccucgccgaaaagacagggauauguaaaauccggccuccaaaggauuggcagcccccuuucgcgugcgaggugaaaucuuuucgcuucacuccacgaguacagcgucuuaacgagcuggaagcuaugacgagagugagguuggacuuuuuagaucagcuggccaaguucugggagcuacagggaucaacccucaaaauuccggucguggaacggaagauccuggaccuuuaugcacugaguaagauuguugccagcaaaggcgguuuugagauggugacaaaggagaaaaagugguccaaagucgggucucgcuugggauaccuccccggcaagggcacugggucgcugcugaagucacacuaugaaagaauccucuacccuuaugaguuauuccagagcggagugagucugauggguguacaaaugccaaaucuugauuugaaagaaaagguugagcccgaagugcuguccaccgacacacagaccucuccugagccaggcacuaggaugaacauacuacccaaacggacacgccgagucaagacccagagcgaguccggggaugugucaagaaauacggaacucaaaaagcugcagaucuuuggagcuggcccgaaaguggucggucuugcaauggggacuaaggacaaggaggaugaaguuaccaggcggcguaaagugacaaaccgcagugacgccuucaauaugcaaaugagacagaggaagggaacucugagcguaaacuuuguggauuuguacgucuguauguucugcggccggggcaauaacgaggacaaacuccuguuaugugaugggugcgacgacucuuaucacaccuucugucugauuccuccccucccagaugugccuaagggagacuggcgaugccccaaauguguugcugaagagugcuccaagccacgcgaggccuuugguuucgaacaggcggugagagaguacacacuucagucauuuggcgaaauggcagauaauuucaagagcgacuacuuuaacaugcccguccacauggugccuaccgagcugguagaaaaagaguucuggagguugguuaguucuaucgaggaagaugugauugucgaguauggggccgacaucuccagcaaggauuuuggaucgggcuucccagugaaagacggucggcgcaagauacuaccggaagaggaggaauacgcucugucuggguggaaucucaacaauaugcccguccuggagcaauccgugcuugcccacauuaacguugauaucucaggcaugaaagugccuuggcuguauguaggaauguguuuuaguagcuucugcuggcacauugaagaccauugguccuacucuaucaauuauuugcacuggggcgagccaaagacgugguacgggguccccagccacgcagcugaacagcucgaggaggugaugagagaacuggccccugaguuauuugaaucacagccagaucugcuacaucaacucguuacuaucaugaaccccaacgugcugauggagcacggagucccgguguauaggacaaaucagugcgcgggugaguucguagugaccuuuccucgugccuaccauaguggcuucaaccagggguacaauuucgcagaggcuguuaacuuuuguacugccgacuggcuuccaauuggacggcagugcgucaaucacuaucgaagauugaggcgccacuguguguucucccaugaggaacugauauuuaagauggcugccgaccccgagugccucgaugugggccuggcagccauggucuguaaagaacuuacacugaugaccgaggaagagacgcgguugagagagagcguugugcaaaugggugugcucaugucugaagaggaaguauucgagcuggucccugacgaugagaggcagugcucagcuugucgcaccacaugcuuuuuaagugcgcugacuuguagcugcaaccccgaaagauuagugugucucuaccacccaaccgaccugugcccuugccccaugcagaagaaaugucuucgguaucguuacccauuggaggaucugccgucccuccuguaugggguuaaggugagagcacagucuuacgacacaugggucucgagggugacugaagccuuaagcgcuaauuucaaccauaaaaaggaucugaucgagcuucgcguuauguuggaagacgccgaggaucggaaguauccugagaaugaccucuuuagaaaacugagggaugcagugaaggaagccgagaccugcgcuuccguagcccaacuacugcucagcaagaagcagaaacaccgacagagucccgacucuggccgcacacggaccaagcugacugucgaagaacuuaaagcauucgugcagcaauuguuuagccugccaugugugauuucccaggcgagacaggucaagaacuuacucgaugacguugaagaguuccaugagagggcucaggaagccaugauggacgagacgcccgauucaagcaagcugcaaaugcuuaucgacaugggaucuucccuguacguggaauugccugagcucccacgucugaaacaggaacuacagcaagcacgcuggcuggaugagguacggcucacacugagugacccccaacaggugacccuugaugucaugaagaaauugauagacagcggcguggggcuggccccucaccacgcuguugagaaggccauggcagaauuacaggagcuccugacugugucugaaagaugggaggagaaagcuaaggucugccuucaagccaggccgcgacauuccguggcgucacuggaaaguauuguuaaugaggccaagaacaucccagcuuuucuacccaaugugcucagccugaaagaagcauugcagaaggcccgggaguggaccgcuaaagucgaagccauccagucgggauccaacuacgcauaucuggagcaguuagagucucucagcgcgaagggucgcccuauuccaguaagacuggaagcccuuccccaaguggagucacagguugcugccgcaagggcuuggcgggaacgaacaggcagaaccuuccugaaaaagaauaguucccacacuuugcuccaggugcugucuccucgcacagauaucggggucuacggaagcggcaagaacaggcguaaaaaggugaaagagcuaauugaaaaggagaaagagaaggaccuggaucuugaaccgcucuccgaccuggaggaagguuuggaggaaacgcgggauaccgccaugguaguggcagucuuuaaggagagagagcagaaagaaauagaggccaugcauucacugagggcugcgaacuuagccaagaugacuaugguugaccgcaucgaagaggugaaauucuguauuugccgaaagacagcaagcggguucaugcuccaaugugagcugugcaaagauugguuucacaauaguugugugccccuuccaaagucuuccagccagaaaaagggcucgucauggcaggcuaaggaagucaaauuccugugcccuuuguguaugagaucucggaggccccgccucgagaccauccugagucuacuggugucccuucaaaagcucccaguucgucugccugaaggagaggccuugcagugcuuaacagaaagagccaugagcuggcaggaccgggcuaggcaggcacuggccacugacgagcucucuagcgcgcuggcuaaacuuuccguacugucacaacgcaugguggagcaggccgcacgagaaaagaccgagaaaaucauuagugccgaauugcagaaggcugcagccaaccccgaucuacagggccaucugccaucauuucaacagucugcguucaauagagucguguccucaguuaguagcuccccgcggcagacgauggacuaugaugacgaggaaaccgauucugacgaggauauaagggagacauacggguaugacaugaaggauacugcuucggugaaaagcucauccagucucgaaccuaaccuguuuugcgacgaggaaauccccauuaagucugaggaagucgugacccauauguggacagcccccagcuucugugcagagcacgccuacuccucagcuucuaaaagcugcagucagggauccagcacuccccgcaagcaaccuagaaaaucuccacuuguacccaggucauuagagccuccgguccuggaacucuccccaggcgccaaggcacaguuggaggaacugaugauggugggugaucuccuggagguuagucuugacgagacccagcauaucuggcggauucugcaggcuacgcauccaccuagcgaagacagauuuuugcauaucauggaggaugacucgauggaagagaagccccuaaaagugaaggggaaagauucuuccgaaaagaaacgcaagcgaaagcuggagaaagucgagcaacucuucggagaaggcaagcagaaaagcaaggagcugaaaaagauggacaagccaaggaaaaagaaacuaaaacuuggugccgauaaaucaaaggaacugaauaaacucgcgaagaaguuggccaaagaggaggaacgaaagaaaaagaaagagaaggcagcugccgcuaagguggaacugguuaaagagaguacagaaaagaaacgggagaagaaagugcucgacauaccuucuaaguaugauugguccggcgcagaagagagcgacgaugagaacgccgucugugccgcucagaauugccaacgccccuguaaggacaaaguggauuggguacagugcgacgggggaugugaugaaugguuucaccaggugugcguuggcgucucaccagagauggcggaaaacgaggacuacaucuguauuaauugcgcaaagaaacaggggccugugaguccgggacccgccccaccucccagcuucaucauguccuacaagcugccaauggaggaccuuaaagaaaccucuuga

SEQ ID NO: 58040 - RNA, 4635 nt, Artificial Sequence
  derived and/or modified sequence opt3 from KDM5B__Homo_sapiens__NP_006609
auggaggccgcuaccacacugcaccccggcccuagaccagcacucccgcuugggggacccgguccucugggcgaguucuugccacccccugaaugcccaguguuugaacccagcugggaggaguucgccgacccuuuugcguucauccauaagauuaggccaauagcugaacagacugggaucuguaaaguccggccgcccccugauuggcaaccacccuuugccugcgacguugauaaguuacacuucacgccucgcauucagcgacugaacgagcuagaagcacagacccgugugaaacucaauuuucuggaccagaucgccaaguacugggagcuucaaggauccacacugaaaauuccacauguagaaagaaagaucuuggaucucuuccagcugaacaagcugguggcugaggagggcgguuuugcagucguguguaaagacaggaaguggacuaaaauagccaccaagaugggguucgcucccggaaaagccguuggcucucacauccggggccauuaugaacgcauucucaauccguacaacuuauuucugucaggggauagucuuagaugcuugcagaagccuaaucugacaaccgacacuaaggauaaagaguauaagccccacgacaucccacagaggcaaagcgugcagccuuccgaaacaugucccccagcgcggcgcgcaaaacgaaugagagccgaggcuaugaacauuaagaucgaacccgaggagaccacggaagccaggacucacaaucuacggcgucgcaugggaugcccuaccccaaaaugugagaacgaaaaggagaugaaaucuucgauaaagcaggaaccgauugagagaaaggauuacaucgucgagaaugaaaaagagaagcccaaaucaaggagcaagaaagcaacaaacgcuguggaccucuauguaugccugcuuugugguaguggcaaugaugaagaccggcuguugcucugcgacgggugugaugacuccuaccauacuuucugccugauuccuccauuacacgauguucccaagggagacuggcgaugcccuaagugucuggcccaggagugcucuaaaccacaagaagcguuuggcuucgagcaggccgcacgcgauuauacccucagaacauucggugagauggcugacgccuuuaagagcgauuacuucaacaugcccgugcauauggucccgaccgaacuuguggagaaagaauuuuggaggcugguguccacgaucgaggaggacgucacuguugaauacggggcugauaucgccucaaaggaguucggaaguggcuuuccugugcgggacggcaaaauuaaguugagcccagaagaggaagaguaucuagauucuggguggaaucugaacaauaugcccguaauggagcaguccgugcucgcacacauaacagccgacaucuguggaaugaagcugccuuggcuuuacgucgguaugugcuucagcucauuuuguuggcacauugaagaccauuggaguuauucuaucaacuaccugcacuggggcgagcccaaaaccugguauggggugccaggauacgcugcggaacaauuggagaacguuaugaagaaacucgcaccugaacuguucgugucccagcccgauuuacugcaucagcuagucacuauaaugaauccaaacacacucaugacccacgaggugccgguauaucgcacgaaucagugcgccggcgaguuuguuauuaccuucccuagagcuuaccauagcgguuuuaaccaaggguucaauuuugccgaagcagugaacuucuguacagucgacuggcugccccuuggcaggcagugcguggagcacuaccguuugcugcaccgguauugugucuucucgcaugaugaaaugaucugcaagauggccucuaaagcugacgugcucgauguugugguagccuccacuguccagaaggacauggcaaucaugauugaggaugaaaaggcgcugcgagagaccgugagaaaacuuggaguuaucgacucagagaggauggauuuugaacuguugccagacgaugagcgccagugugugaagugcaaaacaacuugcuucaugagugcuauuagcuguuccugcaagcccggccuccuggucuguuuacaccaugugaaagaacugugcucuuguccuccauacaaguauaaacuacgguacagauauacccucgacgaucuguaccccaugaugaaugcccuuaaguugagggcagagagcuauaacgagugggcccugaauguaaacgaagcucucgaggccaagauaaauaaaaagaaaucacuggugaguuuuaaggcauuaaucgaagaguccgaaaugaaaaaguucccugacaacgaccugcuucgccacuugcgacucguuacacaagaugcugagaagugcgccagcgucgcgcagcagcugcuaaaugggaaacggcagacccguuacagaucuggagguggcaagucacaaaaccagcugacugugaaugagcucaggcaguuugugacgcagcuguacgcccuuccgugugucuugagucaaacaccacuguuaaaagaccuccugaaccgcguugaagauuuccagcagcacagccaaaaacuucuguccgaggaaacccccucugcugcagaguugcaggaccuccuggaugugucguuugaguucgacguggaacuaccucagcuggccgagaugcggauuagacucgaacaggcuagguggcuggaggaaguacaacaggccugccuugauccaagcuccuugacucuggacgauaugcgacgcuuaaucgaccucggggucggacuggcacccuauucagcgguggagaaggccauggcucggcuucaggaacugcuaaccguuagugagcauugggaugacaaggccaagucucuccugaaagcaagaccuaggcacagcuugaacucccuggcuacagccgugaaggagaucgaagagauuccggcauacuuacccaauggcgccgcucucaaagauucaguccagcgugcgcgcgacuggcugcaagacguggaaggucuucaggccgggggccggguuccagugcuggauaccuugauagagcucguaacuagaggaaggagcaucccuguccaucugaacucucuaccccgacuggagacacuuguggcagaagugcaggcuuggaaggagugugccgucaauacguuucucaccgaaaacuccccauauagucuguuggagguucugugcccucggugugacauuggcuuacucgggcugaaacgcaagcagagaaaacuuaaggaaccccugccaaauggaaagaaaaagagcacuaaauuggagucucucuccgaucuggagagggcccuaacagaaucaaaggagaccgcuagugcaauggccacacugggugaagcgcggcuucgagagauggaagcucuccaaagccugagauuggccaacgagggcaaauuacugucgccgcuccaggacguggauaucaagauuugccugugccagaaggccccugcagcucccaugauccaaugugagcuuugccgcgacgcauuccacacuuccuguguagccgugccaucuauaagccaggggcugaggaucugguugugcccccauugucgucggucagaaaaaccuccacuagagaagauucugccccuccuggcgagucuucagagaaucaggguccgcuuaccugaaggagaugcucugcgauacaugauugagagaaccgugaauuggcagcaccgggcccaacagcucuuguccucuggcaaccugaaauuuguucaggacaggguggguagcgggcuccuguauucccgcuggcaggcaucagccggccaagucagcgauacgaauaaggugagucagccgccaggaaccacaucuuucucccuucccgacgauugggacaaccguacuagcuaccugcacucgccuuuuucaaccggcagaucuugcauccccuugcaugggguuaguccagaagugaaugagcuacugauggaggcucagcucuuacaggucucccugccugaaauacaagagcuuuaucagacacugcucgccaaacccagcccagcacagcagacugaccggucuagcccuguaaggccguccucagaaaagaacgauuguugccgcggaaagcgagacggcauuaauaguuuggagagaaaacugaagcggaggcucgagcgcgaaggucugagcucugagagaugggaaagggugaaaaagaugcggacccccaaaaagaagaaaaucaaacuuucccacccaaaggauaugaacaauuucaagcuagagcgugaacgcucauacgagcugguucgaagugcugagacgcauagcuugccuuccgacacaucuuacucggaacaagaggauagcgaagacgaggaugccauuugucccgcggugucaugcuuacagccagaaggggacgaggucgauugggugcagugugacggauccugcaaccaaugguuccaccagguaugcgugggcgucaguccugagauggccgaaaaagaggauuauaucuguguuagaugcaccgugaaggacgcacccucuaggaaguga

SEQ ID NO: 58041 - RNA, 4140 nt, Artificial Sequence
  derived and/or modified sequence opt3 from KDM5C__Homo_sapiens__NP_001140174
auggagcccggcagcgacgauuuccugccuccaccggaaugccccguguuugagccuuccugggccgaguucagagacccacucggguacaucgcuaagauuaggcccauagcagagaaaucuggaaucuguaagauucggccuccagccaucgucguugaagaggguggcuaugaggcgauuugcaaagaucgccgaugggcucguguggcccagagacuuaacuaucccccugggaagaauaucggaucacuguugaggagucacuacgaacggauaguauacccauaugagauguaccaaagcggcgcaaacuuagugcaguguaauacccgcccguuugacaacgaagagaaagauaaggaguauaagccccauuccaucccucugagacagucuguccagccaucgaaauucaauucauacgguaggcgggccaagcgccuacaacccgacccugaaccaacagaggaagauauugagaaaaaccccgaacucaagaaacugcagaucuacggggcuggaccgaagaugaugggccuuggccugauggcaaaggacaaaacuuugcgaaagaaagauaaggaggggccugagugucccccaacggugguugugaaagaggaacucggaggugacgucaagguggaaagcaccaguccuaaaacauuucuggaguccaaggaggaacugucucacagccccgagccaugcacuaagaugaccaugagacucaggcggaaucauuccaacgcccaguucauugaaucauauguaugccguauguguagucgcggcgaugaggacgauaaauuacugcuuugcgacgggugugacgauaauuaccacaucuuuugcuugcugcccccucuaccagaaauaccgaagggaguuuggagaugucccaaaugcgugauggcugagugcaagaggccuccagaagccuucggcuuugagcaggcgacacgggaguauacccuccaaucauucggugaaauggcagacucuuuuaaagccgauuacuucaacaugcccguccauauggugccuacugagcugguggaaaaggaguuuuggcgacuugucaauuccauugaggaagacguuacaguggaguauggggcugauauccacucaaaggaguucggaagcggcuucccaguaagugacucuaaacgccaccugacccccgaagaagaggaguacgccacguccggcuggaacuugaaugugaugccgguccucgaacagagcgugcugugucauauuaacgcagauaucucggggaugaagguuccuugguuauaugugggaauggucuuuucugcuuucugcuggcacaucgaggaccauugguccuacucaauuaauuaccugcacuggggugaaccaaaaacuugguauggcgugcccagucucgccgcggagcaccuugaagagguaaugaagaaacugaccccugaguuguuugauagccagcccgaccuacugcaucagcucguuacacugaugaacccaaacacucuuaugucccacggggugccugucgugagaaccaaucaaugugccggagaguucgucauaacauuucccagggcauaccauucuggcuucaaccaggguuauaauuuugcugaagccgugaacuucugcaccgcugauuggcugccagccgggcggcaguguaucgaacacuaccgcagauugaggcguuauugcguuuuuagccaugaggaacucauuuguaagauggcagccugcccggagaagcuggacuuaaaucuggcugcggcagugcacaaagagauguucaucaugguacaagaggaacggcgacuaagaaaggcccuccuggaaaaaggcauaacggaggcugagagggaagccuuugagcuuuugccugacgaugaacgccaguguauuaagugcaaaacuacauguuuccugucagcacucgccugcuacgacugccccgauggacuggucugucuuagucacaucaacgaccugugcaaguguuccagcucucggcaguauuugagauacagguacacccucgaugagcugccagcuauguuacauaagcugaaagugcgcgccgaaucauuugacacuugggcaaauaagguucgaguggcgcuagaggucgaggauggccggaaacguagucucgaggaacugagagcucuugaaagcgaggccagggaacgccgguuccccaacuccgaguugcugcagcaacucaagaauugccugucugaggcagaagccugugugucgagagcuuuagggcugguaagcggacaggaggccgguccucacaggguggcaggccuucagaugacauugaccgaacuccgagcuuuccuggaccagaugaacaaucuaccaugcgccaugcaucaaaucggggauguuaaaggaguccuggaacagguggaagcguaucaggccgaggcucgcgaggcacucgccucccugcccucaaguccuggccuuuugcagucucuguuagaacgggguagacaacucgggguggaggucccggaagcucagcagcugcagaggcaaguugagcaggcccguuggcuugacgaggugaagcgcacgcuggcaccaagcgcgcggagaggcaccuuggccgugaugaggggacuccugguagcuggcgccuccgucgcacccagcccugcuguggauaaagcccaggcagaacuacaagagcugcucacaauugccgaacgaugggaggaaaaggcucaccugugucuugaggcgcggcagaagcacccacccgccacuuuggaggcaaucauucgcgaagcugagaacauaccuguucaucugccgaauauccaggccuuaaaagaagcccucgcuaaggcaagagccuggauugcggacguggaugagauccagaacggggaccacuaccccugccuggacgaucuugaaggacuggucgcuguggguagggaccuaccaguuggccucgaggagcugcggcaauuggaauuacagguguuaaccgcccauagcuggcgagagaaagcaucuaagacauuucucaaaaagaacuccuguuauacucugcuugaaguacugugcccuugugccgaugcugggagugacagcaccaagagaucucgcuggauggagaaagaauugggacucuacaaguccgauacagagcugcuaggccugucagcacaggaccuuagggaucccgguagugucaucguggccuucaaagagggggaacagaaggagaaagaaggcauucuccaacugcgucggaccaauagcgcgaagccaucgccuuuggcuuccucuagcacugccucaaguacgacauccauaugcgugugcggacagguccuggcaggcgccggggcuuuacagugugaccucugccaggauugguuucacggaagauguguuucugugcccaggcugcuuagcuccccacgcccgaacccuaccucaagcccccuguuggccuggugggagugggacacuaaguuccucugcccacuguguaugcgaaguagacggcccaggcuagagaccauccuggcacuucucguagcucugcaacgcuugccugugcguuuaccagaaggcgaggcccugcagugccucacagaaagagcgauuucuuggcagggucgggccaggcaagcacuggcuuccgaggaugucaccgcccuucuggggcgcuuggcugaacuacgacagagacugcaggcagagccccggccugaggaaccgccaaauuaucccgccgccccugcuagcgacccccucagggagggaucgggcaaagauaugccaaaggugcagggucugcuugaaaacggcgacucaguuacuucuccugagaaaguggcgcccgaagaggggagugacuuagagcugcucuccagcuugcugccacaacucacaggaccuguccuggaacuuccggaggcaacgcgcgcuccccuggaagaguugaugauggaaggcgaucuacuggaggugacccucgacgagaaucauucuaucccagaaagccuggauuuuuguauucugacuccuagauacugcuccgaccuuucaaguugggggcccgccccaggaguuuucccucccugguga

SEQ ID NO: 58042 - RNA, 4713 nt, Artificial Sequence
  derived and/or modified sequence opt3 from KDM5D__Homo_sapiens__NP_001140177
auggagcccggcugcgacgaguuccugccuccaccggagugucccguguuugaaccuagcugggccgaguuccaggauccacucggguacaucgcuaagauuagacccauagcagaaaaauccggaaucugcaagauuaggccuccagccgacuggcaacccccuuuugcggucgagguugauaacuuccgguuuaccccacgcgugcagcgacuuaaugagcuggaagcucagacacguguaaaauugaacuauuuagaccagaucgccaaguucugggagauucaagguucuucacugaaaaucccgaauguggaaagaaagauacuagaucucuacagucugagcaagaucgucauugaggagggcggguaugaagcaaucuguaaagacaggcggugggcccgcguggcucagagacuucacuacccaccuggaaagaacauuggcucccuguugaggucucauuaugagcggaucauauacccauaugaaauguuucagucgggugcaaaucacguucagugcaacacucaucccuucgauaaugaggugaaagacaaggaauacaaaccucacucaauuccacuccgccaaagcguccagcccaguaaguuuuccucuuacagcagacgagccaagaggcugcagccggauccugagcccacggaggaagacaucgagaaacauccagaacugaagaaacuccagauuuaugggccuggacccaagaugaugggcuuaggccugauggcuaaagauaaggacaaaaccgugcacaagaagguaacauguccacccacuguuaccgugaaagaugagcaauccgggggagguaacgucucaaguacacuuuugaagcagcaccugagccuagaaccuugcaccaaaacuacaaugcagcuccggaagaaucauucuuccgcccaauucaucgacucauacaucugucaggugugcagccguggcgacgaggaugacaaacuguuauuuugugaugggugcgacgauaacuaucacauuuucugucuguugccaccgcuccccgagauaccucgcggaaucuggagaugcccaaagugcauucuggcggaauguaagcagcccccugaggcauuuggcuucgaacaggccacccaagaguacaguuuacagucuuucggugaaauggcugacuccuuuaaaagcgauuauuucaauaugccagugcauaugguccccacggagcugguugagaaggaauuuuggaggcucgugucgucuaucgaggaagacguaacuguggaguacggggccgauauacacuccaaagaguucggaucaggcuuuccggucaguaacagcaagcagaaucuuuccccugaagagaaacggcagucucugaccguguugacacgacuaauuagcucauucugggcacaagcuguucugccacccuggccucccaaggugcucggccugcaggaauaugccaccaguggguggaaccuuaaugucaugccagugcuggaccaguccguauugugccacaucaacgcggauaucagcggaaugaagguuccuuggcucuacguggguauggucuuuucugccuucuguuggcauauugaggaccacuggucauacaguaucaacuaucugcauuggggcgaacccaaaaccugguacggggugccaagccuugcagcugagcaccuggaggaagucaugaagaugcuaacaccggagcucuuugacucccagccugaucugcuucaucaauuggugacccugaugaaucccaacacgcucaugucucacggaguuccagugguacgcacuaaucagugcgccggcgaguucgucauuacauuucccagagcuuaucacucggguuucaaccagggguacaauuuugccgaagcagugaacuucuguaccgccgacuggcugccugcuggcaggcagugcauagaacauuaucggcgccuuagaagguacuguguuuucagccacgaggagcugaucugcaaaauggcggcauuuccagaaacuuuggaucucaaucuggccguggcuguccauaaggagauguucauuauggugcaagaggaacgucgguuacgaaaagcccugcuagaaaagggaguaacagaggcagagagagaagccuuugagcuccugcccgacgaugaaaggcaguguaucaagugcaaaaccacguguuuccuuuccgcuuuggccugcuaugacugcccugauggccuggugugucucucacacaucaacgaccugugcaaguguaguucuagccgccaguacuuacgguacagauauacccuggaugagcuuccgacaauguugcacaaacucaagauuagggcagaguccuuugacacuugggcgaauaaaguucgcgucgcucuggaaguggaggaugggcgaaagcggucauucgaggaacuacgugcccuggaaagcgaggcaagagagaggcgcuuuccaaacucugaacuccugcaacggcuuaaaaauugcuuguccgagguggaagccuguauagcucagguccugggauuaguuaguggucagguggccagaauggacacuccccagcucacacugacugagcuuagggugcuguuggaacaaaugggcagccucccuugcgcaaugcaucagaucggggauguaaaggacguccuggaacagguggaggcuuaccaggccgaagcgcgagaggcccuagcuacccugccaucuucccccggacuccugcgcucacuuuuggaacggggccaacagcuggguguugaggugccugaagcacaccaguuacagcaacaggucgagcaggcccaauggcucgacgaggugaagcaggcucuggccccgagugcacauagagggagccuuguuauuaugcagggccugcuagugaugggagcgaaaaucgccucgucccccucuguagauaaggcuagggccgaacuccaggagcuguugacaauugcagaacguugggaggagaaagcucacuucugucuggaagcccgccaaaagcaucccccugcaaccuuagaggccaucauacgggaaacugagaacauccccguccaccucccaaauauucaggcucugaaagaagcgcuuacgaaggcccaggcauggaucgcugacguggaugagauucagaacggcgaccacuauccuugccuggaugacuuggaggggcucguggccgucggaagagaucugcccguuggucuagaggaacugaggcaacuugaacuccaggugcugacagcccauagcuggcgagagaaggcuucaaaaaccuuuuugaagaaaaauaguuguuacacucuguuagaaguacucugcccaugugcagacgccggcuccgauucuaccaagcggagccgcuggauggagaaagcgcuggggcuuuaucagugcgacacagagcuguugggacucuccgcucaggaucugagagacccgggcucagugaucgucgccuucaaggaaggugagcaaaaggaaaaagaggggauacuacagcugaggcggaccaacagcgcaaagccuaguccccuugccccaucucucauggcuuccagccccacuucgauuugcguguguggccagguuccugcaggagugggcguccugcagugcgauuugugucaagacugguuucacgggcagugcgugucaguuccacauuuacugacaucucccaaaccuagucucacguccagcccgcugcuugccuggugggaaugggacaccaaguuccuguguccauugugcaugcgaucuagacgccccaggcuagagacuauccuggcgcuccugguggcccuucagcguuuaccuguccggcugcccgagggagaagcucuccaauguuugacagagagagcaauuggcuggcaggauagggcccgcaaagcucuggccagcgaagacguaaccgcacuccugcgacagcuugcugagcugagacagcaauugcaggccaagccacggccugaggaagcguccguguacacaucagccacugcaugcgaucccaucagggaggguagugggaacaauauaagcaagguucagggacuacuggaaaacggcgacucugugaccuccccagagaauauggcuccugguaaaggcucagaucucgaauuacugaguagccuucugccgcagcucacggggcccgucuuggagcugccagaggccauccgcgcuccucucgaggaacugaugauggaaggagaccuucuagaggugacccuggaugaaaaccacuccauuuggcaauuguuacaggcaggccagcccccagaccuggaucguaucagaacacuccuggagcuugagaaguuugaacaucaggggucucggacuaggucgcgcgcccuggagcgaagacggaggcgccaaaaaguagaccagggaagaaauguggaaaaccucguccagcaagaguugcagagcaagagggcccggucauccggcauuaugagucagguuggucgugaagaggagcacuaucaggaaaaagcugaucgcgagaauauguuccugaccccuucuacagaccacagccccuuccuaaaggggaaccaaaauucccugcagcauaaagacucaggaucuagcgcggcauguccgagucucaugccacuucugcaguuauccuacagcgaugaacagcaauuguga

SEQ ID NO: 58043 - RNA, 4362 nt, Artificial Sequence
  derived and/or modified sequence opt3 from KDM6A__Homo_sapiens__NP_001278344
augaagaguugcggcgugucccuggccaccgcugcagccgcggcugccgcauucggggacgaggagaaaaagauggccgcuggaaaagcaucuggugagucagaagaggccagucccagccucacagcugaagagagagaggcccuuggcgggcuggauuccagguuguuuggauucguccgguuucacgaagacggcgcgcgcacuaaggcauuacuggguaaagccguucgauguuacgagucucuaauccucaaggcugaagggaagguggagucggauuucuuuugccagcugggacauuucaaccuucuguuggaggacuauccuaaagcccucucagcauaccaacguuauuacagccugcagagugauuauuggaagaaugcugccuuucuguacggccucggcuuaguauauuuccacuacaacgcguuucagugggccauuaaagcauuccaggaagugcuguacgucgacccauccuuuuguagagcuaaggagauacaucuuagguuggggcugauguucaaagugaauacggauuaugaaucuagccuaaagcacuuucaacucgcccugguugacugcaacccguguacccuuuccaaugcugagauccaguuccauauugcccaccuguacgaaacacagcggaaguaucacucagcaaaagaggccuacgagcaguugcuccaaacugaaaaccugagugcucaggugaaggcgaccgucuuacagcagcugggauggaugcaucacacaguggaucuccuuggugacaaagcaaccaaggagagcuaugccauccaauaccugcagaaaucuuuggaagcugaucccaauuccggccagucaugguauuuccuagggcgcugcuacagcaguauuggaaagguacaagacgccuuuaucucuuacagacaguccauagauaaaagcgaggcaucggccgacacuugguguucuaucggcguucuguaucagcagcaaaaccagccuauggacgcucuccaggccuacauuugcgcagugcagcuggaucauggucacgcggcugccuggauggaccuugggacacuguaugaauccuguaaucaaccacaggaugcaaucaagugcuacuugaacgccaccaggucaaagaguuguagcaauacguccgcucucgccgcacggauuaaauaucugcaggcucaguuaugcaaccugccccaaggaucucuacagaauaagacuaaacuccugccuagcaucgaggaggccuggucacuuccaauacccgcggaauugaccagucgccagggcgccaugaacacagcucagcaagcaugcaagccucaccauccaaauacugagccgguccugggccucucccagacccccauuagccagcaaucucugccucuucacaugaucccaucaagucagguggacgaucugagcucccccgccaaacgaaagagaacaucuucgccuaccaagaacacgagcgacaacugguccgggggacaugcugugucacacccacccguccagcagcaagcccauaguugguguuugacuccgcagaaacuccagcaccuggaacaguuaagggcaaaucggaacaaucugaacccugcgcaaaagcuaaugcucgagcagcuggaaucucaguucguucuuaugcagcaacaccagaugcgucccacagguguggcccagguacgcagcaccggcauuccaaaugggccuacugcugauuccucauugcccacaaacagcgugucuggacaacagccacagcuggcccucaccagaguccccuccgugagucagccuggcguuaggccagcaugcccgggucaaccccuggcuaaugggccuuuuagcgccggccaugugccauguucuacgucccggaccuuaggaucaacagacacuauccugaucggcaacaaucacauuaccgggaguggaagcaacgguaauguccccuaccuucagcgaaacgcauugacacucccucauaaucgcacuaaccugaccucguccgccgaggagccauggaaaaaucagcuaucuaacagcacacagggccugcacaaggggcaaucaagucacuccgcuggacccaacggcgaaagaccgcucucuagcaccgguccuucccagcaucugcaggcggccgggucaggcauacagaaucaaaacggacacccaacucuucccagcaauagugugacgcagggcgcagcuuugaaccaucugucuucccacacagccaccagcgggggacagcaggguaucacuuuaaccaaagagucgaagccuucaggcaauauucucacaguacccgaaaccucuaggcauacuggggagacaccaaacaguacggccuccguugagggacugccuaaucacgugcaccaaaugaccgcugaugcagucugcagccccucucauggcgacagcaaguccccaggucuucugucaagugauaacccgcaguugagcgcccuccugauggggaaagcgaauaacaaugugggcacuggaacaugugacaaggucaacaauauccacccugcugugcauaccaaaacagacaacucuguugccuccucacccaguagcgcaauauccacugccaccccaucucccaagucgacggaacagaccacaacuaauagcgugaccucacuaaacuccccucacaguggccugcauacaauuaacggggagggaauggaagagucucaaagcccaaugaaaacugaucuccugcuuguaaaucacaagcccuccccucagaucaucccgucaaugucugucagcauuuauccaaguuccgcugaaguguugaaggcaugccggaaccugggcaaaaaugguuuaagcaacucuucaauccuccuggacaagugucccccuccaagacccccuuccaguccguaucccccacuuccuaaagauaagcugaaucccccaaccccuagcauuuaccuagagaacaaacgcgacgccuucuuucccccacuccaccaguucugcacgaauccgaacaauccuguuacagugauaagggggcuggcgggagcuuugaagcuggauuuaggccucuuuucgaccaaaacucuggucgaggccaacaaugaacauaugguggagguacguacacagcuucugcaacccgcagacgaaaacugggauccaaccgguacuaagaagaucuggcacugugagucuaaucggucccauaccacaauugccaaauacgcucaguaccaggccagcucauuccaggaaaguuugcgagaggagaacgaaaagagaucucaccacaaagaccauuccgauagcgagucaacgaguagcgacaauuccggcaggcgccggaaggggcccuuuaaaaccaucaaguucggaacuaacaucgaucucucugacgauaagaaauggaagcugcaacuacacgaacugacaaaacuuccugcauuugugagaguugucagcgcuggcaaccuccugucccauguggggcacaccauuuugggaaugaauacagugcagcuguauaugaaggucccaggcucaaggacucccggucaucaggagaacaauaacuucugcucuguuaauauaaacaucgggccuggagacugugaaugguuuguggugccggagggcuacugggguguauuaaaugacuucugcgagaaaaacaaucucaacuuccugaugggcaguugguggccaaaucuugaagaucuguaugaggccaacguccccguguaccgcuuuauucagcgaccuggggacuugguuuggaucaaugcgggaaccgugcacuggguccaagccauuggcuggugcaacaauaucgcauggaacguggggccccucacggcuugucaguauaagcuggccguugaacgguacgaguggaauaagcuacagucggugaaaagcauaguaccaaugguccaccuguccuggaacauggcucguaacaucaaggugucugauccuaaacuuuucgagaugauuaaguacugccuccugagaacauugaaacaaugucagaccuuaagggaagcacugaucgccgccggaaaggagauuaucuggcauggccgcacuaaggaagaacccgcucacuauugcucaauaugugaaguggaggucuuugaccuccuguucguuaccaaugagagcaacucccggaaaacauacauugugcauugccaggauugugcgagaaagacuagcgguaaucuugaaaacuuuguagugcuggagcaguauaaaauggaagacuugaugcaagucuacgaucaguucacccuagcaccaccucugccgucugccagcucauga

SEQ ID NO: 58044 - RNA, 5049 nt, Artificial Sequence
  derived and/or modified sequence opt3 from KDM6B__Homo_sapiens__NP_001073893
augcacagagccguggauccaccuggcgcuagggcagcccgggaggcguucgcucucgggggacugagcugcgccggugcaugguccucuuguccaccgcaucccccuccacgcucagccuggcuucccggcgggcgaugcagugcuagcaucggacagccuccacugcccgcaccuuugccaccgucccacggaucuucgucaggucaucccagcaagccuuacuaugccccaggggcucccaccccucguccauuacacggaaaacuggaaagucugcauggcuguguccaagcccuccugagagagcccgcgcagccgggccuuugggaacagcuggggcaguuguacgaguccgaacacgacucugaggaggcaacaaggugcuaucacagcgcccuccgguacggagguuccuuugcugaacugggcccucgcauugggagacugcaacaggcccagcucuggaacuuccauacuggaucaugucagcacagggcaaagguuuuacccccacuggagcaaguguggaaccuuuugcaucuggaacacaaacggaacuauggcgcuaagcgcggugggccucccguaaaacgagccgcggagccacccgugguccagccugugccaccggccgcacuaaguggacccagcggcgaggaaggccucucuccugggggaaagagaaggcgggguugcaauuccgagcagacgggccugccacccgggcuuccucugccacccccgccuuugccacccccucccccaccucccccaccgccucccccaccccucccuggacuggcuaccucaccacccuuucaguuaaccaagccuggccuguggagcacucuccacggugacgccugggggccggaacguaaaggcagugcuccacccgagcgccaagaacagagacauucucuuccucacccauaccccuauccugccccggcauacaccgcccaucccccaggacacaggcugguuccugcugcgcccccaggcccugggccccggccaccgggagcagagucccaugguuguuugccugccacacgacccccaggcagcgaucuacgcgagucgagagugcagaggucucggauggacuccucagucagucccgcugccaccacugcaugcgugccuuacgccccaagcagacccccugggcugccgggaacaaccacguccucuagcucaaguuccagcucuaacacuggccucagagguguagaaccaaaucccgggauaccuggcgcugaucacuaucaaacccccgcccuggagguuucacaccauggaaggcuuggcccaagugcacacagcucccguaagccuuuccugggggcgcccgcugccacaccacauuugucucucccuccgggacccucgagcccaccucccccaccuuguccccggcuguuacgaccgccaccucccccagcauggcugaaaggucccgccugcagagcugccagggaagacggcgagauccuagaagaacucuuuuucgggacugagggaccuccgcgccccgcaccaccuccccugccucaccgggaaggcuuucuugguccacccgcuuccagauucucaguggggacccaggauagucacacaccuccaacacccccgacgccuacuacaucuagcuccaacucaaauagcggcucucauuccaguagcccagccggacccgucucuuuuccuccacccccguacuuggcgagguccauugacccucugccccgcccaccuucacccgcccagaacccacaggaucccccucucgugccacugacccuugcucugccgcccgcaccuccaaguagcugucaccaaaauacuucgggcuccuuccgacggcccgagucuccucguccaagagugagcuuucccaagacaccugaagucgggccgggaccacccccuggccccuugucaaaagccccacagccuguucccccaggugugggggagcucccggcuaggggaccucgccuguucgacuuucccccaacccccuuagaagaucaguucgaggagccugccgaguucaagauccugccagacggccuagcaaacauuaugaagaugcucgaugagaguauccggaaagaagaggagcagcaacagcaugaagcggguguagcaccccagccuccgcugaaggagccauuugcuucccuucagucucccuucccuacggacaccgccccaacaacuaccgcacccgcuguggccgucacaacuaccacaaccacuacgacaaccacuaccgcaacacaagaagaggagaaaaagccucccccagccuugccgccucccccaccucuggcuaaauuucccccaccuagccagccccagccgccaccucccccacccccuuccccggcgucacuccuaaagagcuuagccagugugcuggagggccagaaauauugcuacagagggaccggagcagcuguuucuacuaggccaggcccccuuccuacaacgcaauauucccccgggccaccuagcggagccaccgccuugcccccaacuucggcugcaccuucagcccagggcucuccgcagcccagugcguccagcucuagccaauucuccacaucaggugggccaugggcucgagagcgccgggccggagaagaaccugugcccggcccaaugaccccuacacagcccccgccaccucucagucugcccccagcaagaagcgaaucugagguccuagaagagauauccagggccugcgagacucugguggaacguguaggucgcucagcuaccgaccccgcagauccuguugacacggccgagcccgcggauaguggcaccgaacggcuccugcccccugcucaggccaaggaggaagcagggggaguggccgcugucagcggcuccuguaagagaaggcagaaagagcaccaaaaggagcaucgacggcaccgcagagccugcaaagacucuguggggaggcggccgcgagaaggccgcgccaaggcuaaagccaagguccccaaggagaaaucgcgcagggugcuuggcaauuuggaucugcagagcgaagagauccagggucgugagaagucacggccagacuuagggggagcguccaaagccaagccucccacagcaccagcuccucccagugccccggcuccuucugcacagccaacucccccuagcgccuccguuccaggcaaaaaggccagagaagaggcucccgguccuccaggcgugucaagggcggauaugcucaagcugcgcucucuuagcgaagggcccccgaaagagcugaagauucgauugaucaaaguagaaaguggagacaaggagaccuuuauugcauccgaggucgaagagagacggcucaggauggccgaucugacaaucagccacugugcugccgacgugguucgcgcaucucguaacgccaaagugaagggcaaguucagagaaucauaccuauccccugcucaaagugucaaacccaagauaaauacugaggaaaaacugccacgggagaagcucaaucccccuaccccaagcauuuaucuggagucgaaaagggaugcguuuucucccgugcuuuugcaguucugcacggacccucgcaauccaaucacaguaauucgagggcuggccggauccuuaagacucaaccugggccuuuuuagcaccaagacucugguggaagcaucaggugagcauacaguugaaguccggacccaggugcagcaaccgagugacgagaacugggaucuaacugggaccaggcagaucuggcccugugaaucuucccgcagccacacaacgaucgcuaaauacgcccaguaccaagcaucaaguuuccaggagagccuccaggaggaaaaggaguccgaagacgaggagucugaggaaccugauagcaccacuggaacaccacccuccucagccccugacccaaagaaucaucacauuauaaaauuuggcaccaacaucgaucugucugacgcuaagagauggaaaccccaguugcaagaacuguuaaagcucccggccuucaugagggugacaaguacuggcaauaugcugucgcaugucgggcacaccauucuuggaaugaacacgguucagcuguauaugaaagugccugguagccggacaccaggccaccaggagaauaacaauuuuugcuccgugaacaucaauauagggcccggagauugugaaugguucgcgguacaugagcacuacugggagaccauuucugcauucugcgaccgucauggcgucgauuauuugacugguucaugguggccuauccucgacgaucuguacgccagcaacauccccguguaucgcuuuguucagcgaccaggggaccuaguguggauuaaugcuggaaccguccacugggugcaagccacaggcugguguaacaauaucgcuuggaacguuggcccgcugacugcauaccaguaucagcuugcccucgaaagauacgaguggaaugaagugaagaacguaaaguccauugucccuaugauacacgugaguuggaacguggcuaggaccgucaaaaucucugaucccgaccuguucaagaugauuaaauuuugcuugcugcagagcaugaagcauugucaaguucagcgggagucauuagugcgcgccgggaaaaagaucgcauaccagggaagaguaaaggacgaaccagcguauuacugcaaugagugcgauguggaggucuucaacauccucuuugugacauccgaaaaugguaguaggaacacguaucugguucacugugagggcugcgcccggcgaagaagcgcugggcuucagggaguggucgugcuggaacaauaccgcaccgaggaauuggcccaggcauaugacgcuuucacucucguuagggcccggcgugcaagaggccagaggcgccgggcccugggucaagcugcggggacaggauuuggcucucccgccgcaccuuucccagagcccccuccagcuuuuuccccgcaggcccccgccucaaccagccgauga

SEQ ID NO: 58045 - RNA, 4071 nt, Artificial Sequence
  derived and/or modified sequence opt3 from KDR__Homo_sapiens__NP_002244
augcagagcaaggugcugcucgccgucgcucuuuggcugugcguugagaccagagcagccuccgugggcuugcccucuguaucauuagaccugccuaggcuaaguauccaaaaagauauucucacaauaaaggcgaacacuacgcugcagaucaccugucgggggcagcgcgaccuugauuggcuguggccaaauaaccagagcggauccgaacaacgaguggaggucacagaaugcucugacgguuuguucuguaaaacucucaccauuccgaaggugaucggcaaugauacaggggcuuacaaaugcuuuuaucgugagaccgaccuggccucgguuauuuacguguauguccaggauuacagaucacccuucaucgcaagcgugagugaccagcacggaguaguuuauauaacugaaaacaagaauaagacaguggucaucccuugucugggcuccauuucuaaccucaaugugagcuuaugcgccagguacccagagaaacgguuugugcccgaugguaaccgcaucuccugggacucaaagaaaggguucaccauuccuaguuauaugaucagcuacgcuggaauggucuuuugugaggcaaagauaaaugaugaaucuuaccaguccauuauguauaucguugugguagugggcuacagaauuuaugacgucgugcugucaccaagccauggcaucgagcuuaguguuggggaaaaauuggugcugaacugcacggccaggacugagcuaaaugucggaaucgauuucaacugggaguaccccucuuccaagcaccaacauaagaaacucgugaaucgggaccugaagacccagagcgguucggaaaugaaaaaguuucuuucuacacugacuauugacggcguaacccgcuccgaucagggguuguauacaugugcugccucaaguggacucaugaccaaaaagaacagcacguucguucgagugcacgagaaaccuuuugucgcguucggcuccgguauggaaucucugguggaggcaacugucggggaaagagugaggauaccagccaaguacuuaggauauccgcccccugagaucaagugguacaaaaauggcauuccacuggagagcaaccauacaaucaaggcuggccacguucucaccauaauggaagugucagagcgggacacugggaacuacacaguaauucuuaccaaucccaucaguaaagaaaagcagucccacgucgugagccugguuguguaugucccuccacaaaucggagagaaaucuuugauuucacccguggauaguuaccaguaugguacgacccagacacuaacuugcaccguauacgccaucccgccuccccaucacauucauugguauuggcaacuggaagaggagugugcaaacgaaccaagccaggcuguguccguuacaaauccuuaccccugcgaggaauggcguucugucgaggacuuucagggcgggaacaagauagaagugaauaagaaccaguucgcccucaucgagggcaaaaauaagacugugucgacccuggucauucaagcggccaacguuagcgcacuuuauaaaugcgaggcugugaauaaggugggacgcggugaaagaguaaucuccuuucacgucacaagggggccagagaucacccugcagcccgauaugcagccuacugaacaggagucagugaguuugugguguacggccgaccggucuacauucgagaaccucaccugguacaaacugggcccacaaccguuacccauucacguuggagaacugccuacuccagugugcaagaaucuagauacccucuggaagcugaacgcuacaauguucagcaauuccaccaacgacauacuuaucauggaguugaaaaaugccucacugcaggaucagggcgacuacgucugucucgcacaggaucgaaagacuaaaaagcgccauugcgugguuagacaacugacagugcuugaaaggguagcccccacgauuaccgggaaccuggagaaccagacuacaagcaucggagaaucuauugaggucuccuguaccgcuagugguaauccuccaccccagaucaugugguuuaaagacaacgagacauugguggaagacagcggcauagugcucaaggaugggaaucggaaccugacuauccgcagagucaggaaggaggacgaaggauuauauaccugccaggcguguucuguucugggcugcgcaaaaguggaggccuucuuuauuaucgaaggugcucaagagaagacgaaucuagagauuaucauacucguagggaccgccgugauugcaauguucuuuuggcugcuuuuggucaucauucugcguacagugaaacgggccaacggcggagaacucaagacuggcuaccuguccaucguuauggauccggacgaguuaccucuggaugaacacugugagcgacuuccauaugacgcuucaaaaugggaauuucccagagauagguugaagcucgggaaaccucugggacgcggugccuuuggccaggugauagaggcagacgcguucgggaucgauaagaccgcuacaugccggacugucgccgugaagaugcuaaaagagggagcaacccauagugaacacagagcccugaugagcgagcucaagauucugauccauauuggccaccaccuuaauguugugaacuugcugggugcuuguacgaaacccgggggcccauuaauggucaucguagaauuuugcaaguucggaaaucucucgacauaccugagguccaaacgcaacgaguuugugccuuauaagaccaagggcgcccgauuccggcaggggaaagacuacguuggagcaauacccguggaucuuaagcguagacuggacucuauuacuagcucacaaaguuccgcuucuagcggcuuugucgaggaaaaauccuugucagauguggaggaagaggaagccccagaggaccucuauaaggacuuccugacacuagagcaucugaucugcuacagcuuccagguagcgaaagguauggaauuucucgccaguaggaaguguauccaccgcgaucuggcugcacggaauauucuuuugucugagaagaacguggucaaaaucugcgacuucgggcuggccagagauauuuacaaggacccggauuauguuaggaaaggagacgcucgauuaccucucaaguggauggcccccgaaaccauauuugaucgcguguacacuauccaguccgacguguggagcuucggcguccugcuuugggagauuuucucgcugggugcaucaccauaucccggcgugaaaaucgaugaagaguucugucggagacuaaaggaggggaccaggaugcgugcgccugacuacacaacgccagaaauguaucagaccaugcucgauugcuggcauggagagcccucucaacgcccuacuuuuagugaacugguugagcacuugggcaaucuguuacaggccaacgcucagcaggacgggaaggauuacauuguacucccgaucuccgaaacacugagcauggaggaggacucuggacuuagccugccaaccucccccgugucauguauggaagaggaagaggucugcgacccuaaauuccacuaugauaauacagccggcauaagucaauacuugcagaacagcaagcggaaaucuagaccaguguccguuaagacuuuugaggacaucccccucgaggaaccugaagugaaagucauuccggaugacaaccagaccgauucagguauggugcuggcaagugaggaacuaaagacgcuggaggacaggacaaaacuuagccccuccuucgggggaaugguaccaucuaagucgcgagagagcgucgcuucagaaggcuccaaucagaccagugguuaccaaucuggcuaucauagcgaugacacugauaccacaguguacuccucagaggaagccgagcuccugaaguugaucgaaauugggguucagacuggaucuaccgcacagauccugcaaccugacagcggcacaacguuaaguuccccacccguguga

SEQ ID NO: 58046 - RNA, 999 nt, Artificial Sequence
  derived and/or modified sequence opt3 from KDSR__Homo_sapiens__NP_002026
augcugcuccuugccgcugcauuccugguggccuuugucuuguuacuguacaugguuagcccccuaaucuccccuaagccacucgcgcugccgggcgcucacgugguagugaccgggggaucuucagguauuggcaaaugcauagccaucgaguguuauaagcagggggcauucauuacacuugucgccagaaacgaagacaaacuguugcaagcuaagaaagagaucgaaaugcauaguauuaaugauaaacaggugguucucugcaucagcguggacgucucccaggauuacaaccagguggagaauguaauaaagcaagcacaggaaaagcugggacccguugacaugcuggugaacugugccggcauggcugucucugguaaguuugaggaucucgaggugucgacuuucgaaagguuaaugucaaucaauuaucuggggagcguguacccuagucgggccgucauuacgaccaugaaagagcgccgaguuggacguaucguguuuguauccucucaggcgggccagcuuggcuuguucggguuuacagcauauagcgccuccaaguucgcuauuagaggacuggccgaagcacuacaaauggaggugaaaccauacaacgucuauaucacuguggcuuaucccccugacaccgauacaccagguuuugccgaggaaaauaggaccaagccccucgagacucggcugauaucagaaacaaccaguguuugcaagccugaacagguggcgaaacagauugucaaggacgccauccagggcaacuucaauagcucucuuggguccgauggauacaugcugucagcauugacguguggcauggcuccagugacuagcauuaccgagggucuccaacagguaguuacaauggggcuguuucgcacuaucgccuuauucuaccugggaaguuuugacucuaucgugagaaggugcaugaugcagcgggagaaauccgagaacgcugauaagaccgccuga

SEQ ID NO: 58047 - RNA, 1875 nt, Artificial Sequence
  derived and/or modified sequence opt3 from KEAP1__Homo_sapiens__NP_036421
augcagcccgacccuagaccaagcggcgccggggcuugcuguagguuccugccgcuccaaucccagugccccgagggagcaggggaugccgugauguacgcgucuaccgaauguaaggcugaggucacaccuucacagcacggcaaccggacuuuuaguuauacgcuugaagaccauaccaaacaggccuucgggaucaugaaugagcugcgcuugagccaacaguuaugcgauguuacacuacaggugaaguaccaggacgcaccagccgcucaauuuauggcacacaaaguagugcuggccuccucuucgcccgucuucaaggcuauguuuacuaacggacuccgagaacagggcauggaggugguuucaauugaggguauacauccuaaagugauggaacgucugaucgaguucgccuauaccgcgagcauuaguaugggggaaaaguguguccuucacgugaugaauggagcaguaauguaccagaucgauuccguugugagagccugcucugacuuucugguccagcaauuggauccaagcaacgcuauuggcaucgccaauuucgcagagcagauaggcuguguggagcuccaucagagggcucgggaauauaucuacaugcacuuuggggagguggccaagcaagaagaguucuuuaaccugucccacugccagcuggucacacucauuucacgcgacgauuuaaauguuagaugugaaagugagguguuccaugcgugcaucaacuggguaaaauaugacugugagcagaggcgguuuuacgugcaggcccugcuucgcgcaguccgaugccacagcuugacccccaauuuccugcaaaugcagcuacagaagugcgaaauucuccagucugauuccagauguaaagacuaccuggugaagaucuucgaggaacuuacucugcauaaaccuacacaaguuaugccaugcagggcuccgaaggugggacgguugauauauaccgccgguggcuacuuucgucagucacucagcuaucuggaggcuuacaaccccagugaugggacgugguuacgccuggccgaccuccaggucccuagaucuggacuugcaggcugugugguaggugggcuguuguaugccguuggaggcaggaauaacuccccagacggcaauacugauagcucggcucuagacugcuacaaccccaugaccaaucaguggucuccuugugcgccaauguccgugccccggaaccgaauuggggucggagugaucgauggucacauuuaugcagucggcgggucacacggaugcauccaucacaacaguguggaacgcuacgagccggagagagacgaauggcaucugguugccccuaugcucacaaggcggaucggcguggguguagcuguccugaaucgccuucuguacgccguggguggcuucgauggaacuaacagauugaauagcgcagaguguuauuaccccgaaaggaacgaguggcguaugauuaccgccaugaauacaauacgguccggcgcugggguuugcgugcuccacaacuguaucuaugccgcaggagguuacgacggccaagaucaguuaaauucugucgaacgauaugacguggagaccgagacguggacuuuuguagcgccaaugaagcauagaaggagcgcucuggggauuacagugcaccagggacgcaucuacguucugggcgguuaugaugggcacaccuuccuagacucagucgaaugcuacgauccugacacugacacauggagugaggugacccggaugacguccggcagaagcggagugggcgucgccguuaccauggaacccuguaggaaacagauagaucaacagaacugcacaugcuga

SEQ ID NO: 58048 - RNA, 2199 nt, Artificial Sequence
  derived and/or modified sequence opt3 from KEL__Homo_sapiens__NP_000411
auggagggcggggaccagagcgaagaggaacccagagagaggucccaagccggagguaugggcacccuguggucucaggaaucaacaccugaggagcggcucccaguggaagggagucgcccgugggcugucgcacgacguguucuuacugccauccugauuuugggauuacugcuaugcuucagcgugcuccuguuuuacaacuuccagaauuguggccccagaccuugcgagacguccguaugucuugaucugagggaccacuauuuggcgucugguaacaccucgguggcuccaugcacagacuuuuucucauuugccugugggcgggcaaaggaaacuaauaacagcuuccaggagcucgccaccaaaaauaagaaccgccugagaaggauacuggagguccaaaauaguuggcaucccggauccggcgaagagaaggcuuuucaguucuacaacucuugcauggauacacucgcaaucgaagccgcuggcaccgggccuuuacgccaggugauugaggaacugggagguuggcggaucagcggcaaguggacuucccuuaauuuuaaccgaacauugagacugcuaaugucacaguaugggcacuucccauuuuucagggccuaccucggaccccauccugcgaguccacacaccccgguuauucaaaucgaucagcccgaguuugacgugccucugaaacaggaucaggagcaaaagauauaugcacagaucuuccgggaauaccuuacguaucugaaucaguugggcacucuccuggguggggacccaagcaagguccaagagcauucuuccuuaucaauuagcaucaccagucgucuguuccaguuucuccgcccccuugaacagagaagggcccagggaaaacuguuccaaauggugacaauugaucaguugaaggagauggcuccugccaucgacuggcuaucuugucugcaggcaacuuuuaccccaaugucccucagccccucgcagucucugguaguucacgauguggaauaccuuaaaaacaugucccaacuggucgaggagauguugcucaagcagcgggacuuccugcagucacacaugauauuaggccugguggugacacuaaguccggcucucgauagccaguuucaagaagcccgacgcaaacugucccagaaacuuagagaguugaccgaacagccucccaugccagcgaggccucgguggaugaagugcgucgaggaaacgggcacuuucuuugagcccacacuggccgcacucuucguucgcgaggcuuuugggccaucuaccagaagcgccgcuaugaaacuguucacugccauuagggacgcacuuaucacacgucugcggaauuugcccuggaugaacgaagagacccagaauauggcccaagacaagguggcucagcuccagguagaaaugggagcgucagagugggcacugaaaccugaguuagcccgacaagaauacaacgauauucagcuggguaguuccuuucuacagagcgugcucucuugugucagaucacugagggcucgcaucgugcagaguuuccuucaaccacauccgcagcaccgguggaagguuagccccugggacgugaacgccuauuacuccgucucugaucaugugguaguuuuuccugcaggcuugcugcagccacccuucuuccacccuggguauccaagagccgugaauuuuggagcugccggcucgaucauggcacacgagcuccugcauauuuucuaccaguuacugcuucccggugggugcuuggcgugugacaaccacgcucuccaagaagcccaucugugccuaaaaaggcacuaugcagccuuuccgcugccuagccgcacguccuucaaugauucacucaccuuucuggagaacgcugccgacgucggcggacuugcaauagcuuugcaggccuacaguaagcgacuguuacggcaucacggcgaaacagugcucccaucucuggaucuuagcccccagcagaucuucuuucguuccuaugcgcaagucaugugcagaaaaccuucaccccaggacagccacgauacucauucuccaccucaccugagggugcaugggcccuuguccaguaccccagccuucgcucgcuacuuucggugugcaagaggagcccuccugaauccgagcucuaggugccagcuaugguga

SEQ ID NO: 58049 - RNA, 1059 nt, Artificial Sequence
  derived and/or modified sequence opt3 from KERA__Homo_sapiens__XP_011536083
auggccggcaccaucugcuucauuaugugggugcuguuuauaacagacacugucuggagcagauccguuaggcaaguguacgagguacacgauucugacgauuggacgauccaugacuucgaaugucccauggagugcuuuuguccuccaucauucccgaccgcucucuauugcgaaaaccgggggcuuaaggagauucccgcaaucccuagucgcauuugguaccuguauuugcagaauaacuuaaucgaaacaauaccagagaaacccuuugagaaugccacucagcugcgauggaucaaccuaaauaagaacaaaauuaccaauuacggaaucgaaaagggugcgcucagccagcugaaaaagcugcuuuucuuguuucucgaggauaacgaacuggaggaggugccuuccccacugccccguucucucgaacaguuacaacuggcuagaaauaaggucucgaggauuccucagggcacauucucaaaccuugagaauuugacccugcuagaccuccagaacaauaaacugguggauaacgccuuucagcgggacacuuucaaggggcuuaaaaaucugaugcaauugaacauggcaaagaacgcccuccgcaauaugccaccgagacugcccgcuaacacaaugcaguuauuucuggauaauaacagcaucgaaggaauaccugagaauuauuucaacguuauuccaaaaguggcauuucucaggcuuaaucacaacaagcugagugacgaaggcuugcccucccgggguuucgaugucucuagcauccuagaccugcagcucucccauaaucagcugaccaaggugccucgcauuucagcccaccuucaacaucugcacuuggaucacaacaaaaucaagaguguaaauguuagcgugaucuguccaucucccuccaugcucccggcugagcgagacucauucagcuacgggccucaucugagauauuuaaggcuggacggaaacgagauuaaacccccaauaccuauggcccuaaugacgugcuuucggcuccugcaggcggucaucauuuga

SEQ ID NO: 58050 - RNA, 654 nt, Artificial Sequence
  derived and/or modified sequence opt3 from KHDC3L__Homo_sapiens__NP_001017361
auggacgcccccagaagguucccuacccuggugcagcucaugcaaccaaaggcuaugccggucgagguucuuggccaucugcccaaacgguuuagcugguuccacuccgaauuuuugaagaacccuaaagugguacgcuuagagguguggcuggucgaaaagaucuucgggcgaggaggugagcguauuccacacgugcagggcaugucucagauacuaauccauguuaauagacucgaucccaacggggaagcagagauucugguguuuggaaggccuucauaccaggaggacacaaucaaaaugauuaugaaucuugccgauuaucaccggcaacugcaggcgaagggcagugguaaggcuuuggcccaggacgucgcaacucagaaagccgaaacgcaacgcagcuccaucgaggugagagaagcugggacccagaggucuguagagguucgggaggcaggaacacagcgcucgguggaaguccaggaggugggcacucaaggcucaccaguggaaguccaggaggccgggacccagcaaagccuccaggcugccaacaagaguggaacacagcgaucccccgaagcggcaucuaaagccguuacccagagauucagggaggaugcucgggacccugugacucgucuguga

SEQ ID NO: 58051 - RNA, 1050 nt, Artificial Sequence
  derived and/or modified sequence opt3 from KHDRBS2__Homo_sapiens__NP_689901
auggaggaagagaaguaccugcccgaacucauggccgagaaagacagccuugauccuuccuucgugcacgcuucuagacuguuggcagaagagaucgagaaguuucagggcucagacgggaaaaaggaagaugaggagaaaaaguauuuagacgucaucaguaacaagaauauaaaacugagcgagaggguucuaaucccagugaagcaauacccgaaauucaacuuuguaggaaagcuccuggguccccggggcaauucccuuaaacgccugcaggaggaaaccggggccaagaugucuauuuugggaaagggcucgaugcgagauaaagcgaaggaggaagaacuccguaaaucaggugaagcuaaguaugcccaucugagcgacgagcugcacgugcucaucgaggucuucgcaccuccaggggaagccuacaguagaaugucccaugcuuuagaggaaauuaaaaaguuucuggugcccgauuauaacgacgagaucaggcaggaacagcuucgggaguugucuuaccugaauggaagcgaggauuccggccgcggcagagggauaaggggacgggguauccgcauugcaccuacagccccaucacgaggcagagggggagcuauucccccuccaccgcccccuggcagggguguucuaacuccacgggggaguacggugacccguggagcccuccccgucccuccaguggcgcgcggcguacccacaccgagagcaaggggcgccccuacuguucccggguaucgggcuccaccucccccagcccacgaagcauacgaggaauacggauaugacgaugguuacggcggggaguaugacgaucaaaccuacgaaacauaugacaacagcuacgcuacccagacucagucugugcccgaguauuacgacuacggacauggcgucuccgaggaugccuaugacucauacgcgccugaagagugggccacaacccgaagcagucugaaagcaccaccgcagcgcucugcuagagguggguauagggaacaccccuacggccgguauuga

SEQ ID NO: 58052 - RNA, 1041 nt, Artificial Sequence
  derived and/or modified sequence opt3 from KHDRBS3__Homo_sapiens__NP_006549
auggaggaaaaguaccugcccgagcucauggccgaaaaagacagccuugauccuuccuucacccacgcucugagauuggugaaccaggagaucgaaaaguuucaaaaaggcgaggggaaggacgaggaaaaauauauugaugucguuauaaauaagaacaugaaguuaggacagaaagugcugaucccaguaaagcaguucccgaaauuuaauuucguggguaagcuacucggccccagggggaacucucugaaacggcuucaggaggaaacacugacuaagaugucaauuuugggaaagggcaguaugcgcgacaaagcaaaggaggaggaacuccgaaaaagcggugaggccaaguacuuucaucugaaugaugaccugcacguccucaucgaaguguucgcgccuccagcugaggccuaugcacguauggggcaugccuuagaagagauuaaaaaguuucugauccccgauuacaacgacgagauaagacaagcucagcuucaggaauugacguaucugaauggaggcuccgagaacgcagauguuccuguggucaggggcaaaccaacccuacggacacgcggggugcccgccccugcuaucacuagaggaagggguggcguaaccgcccggccaguugggguggucgugccgcgcggaacacccaccccucgaggcgugcucucuacuagagguccagucucgagggggcggggacugcuuacaccccgugcgcgcggcguuccuccaaccggcuacagacccccgccucccccaccuacgcaggaaacuuauggggaguacgacuacgaugacggauaugguaccgcauacgaugaacaaucauaugacagcuacgacaauaguuauuccacacccgcccagucuggcgcugauuacuaugacuacgggcacggacugagcgaggagacuuacgauuccuauggccaggaagaguggaccaacucaaggcauaaggccccaagugcacggacagcuaaggguguguaccgagaccagcccuaugggcgcuacuga

SEQ ID NO: 58053 - RNA, 897 nt, Artificial Sequence
  derived and/or modified sequence opt3 from KHK__Homo_sapiens__NP_000212
auggaggaaaagcagauccugugcgugggccucgucguucuugacgugauuagccugguagauaaauaccccaaggaggacuccgaaauaagauguuugucucaaagguggcagcggggaggaaacgccucaaauaguugcaccguguuaagccugcuaggugcuccuugugcauucaugggcuccauggccccagggcacgucgcggauuuugugcucgacgaucugcgccgauauucuguugaccuucguuacacaguguuccagacuacgggaucggucccgaucgcuaccgugauuaucaacgaggccucaggcagcagaacaauucuguauuacgauaggaguuugcccgacguauccgcaacugauuuugaaaaaguugaccucacccaguucaaguggauccauauagagggucggaaugccucugagcaagugaaaaugcugcagcgcaucgaugcucacaacacaagacagccuccagaacagaagauuagggucagcguggagguggaaaagccccgggaggagcuguuucaacucuucggguauggagacgucguuuuuguguccaaagauguagcaaagcauuuaggcuuccagucagccgaagaggcucugcgcggccuuuacgggcgagugagaaaaggagccgucuuggugugcgcgugggcagaagagggugccgacgcucugggcccugacgggaagcuacuccacagugaugccuuuccacccccuaggguuguggacacccugggagcaggcgauacuuucaaugcuagcgucaucuuuucucuuucccagggucggucagugcaggaagcccugcguuucgggugucaaguagcggggaaaaagugcggcuugcagggcuuugacgggauuguuuga

SEQ ID NO: 58054 - RNA, 2136 nt, Artificial Sequence
  derived and/or modified sequence opt3 from KHSRP__Homo_sapiens__NP_003676
augagcgacuacuccaccggcgggcccccuccaggaccgcccccuccagccgguggcgggggaggcgcugguggggcaggaggcggacccccuccagggcccccuggagccggugauagaggcgggggaggcccaggugggggaggcccgggcgggggaucugcggguggccccucacagccuccagggggaggcggucccgggaucaggaaggacgcuuucgccgaugcagugcaacgggcccgccagauugcugcaaaaauaggcggagacgccgcuacaacugucaacaauaguacgccugauuuuggcuucgggggacagaagcgacagcuggaggacggugaucaaccagaaagcaaaaagcucgccucccagggcgacucuaucucgucacagcuugggcccauucacccgccuccccguaccagcaugacagaggaauauagaguuccagauggaauggugggccugaucauugguaggggcggggagcagaucaacaaaauacaacaggacaguggaugcaagguacagaucuccccugauucuggcggguugcccgaacggagcguguccuuaacuggagcgccagagucaguccagaaggcaaaaaugaugcuggacgauauugugagucgcgguagaggcgggcccccuggacaauuucaugacaaugccaacggcggucagaaugggaccguucaggagaucaugauuccagcuggcaaggccggccuagugaucggcaaagggggagaaacaauaaagcaacuccaggagagggcaggcgucaaaaugauucugauccaggacgguagccagaacaccaauguggauaagccgcuucggauuaucggggaccccuacaagguacaacaggcuugugaaaugguuauggauauccugcgcgagcgagaccagggaggcuucggugauagaaacgaguauggcucuaggauugggggaggcauagacgugccugucccacggcacuccguggggguggucaucggacguucaggcgaaaugauuaaaaagauccagaaugaugccgguguucgcauacaauuuaaacaggacgaugggacuggacccgagaagauugcgcauaucaugggcccuccagacagaugcgaacacgccgcaaggaucauuaacgauuugcuccagagccugcggaguggucccccgggcccuccagggggacccggcaugccucccgggggacgaggccgcgguagagggcagggaaauuggggcccaccugguggcgagaugacauucucuauccccacccauaaaugugggcuggugauuggaaggggcggggaaaacguaaaggcuauaaaucaacagacgggagccuuuguggagaucucccggcagcucccaccgaacggcgacccuaauuucaaauuauuuauuauccgcgguagcccccagcaaaucgaccacgcuaagcagcugauugaggaaaagauagaggggccacuuugccccgucggaccuggcccaggcgggcccggaccugccgguccgaugggcccauucaaccccgggccuuuuaaccagggaccacccggcgcaccuccgcacgccggugggcccccaccucaucaauaucccccacagggauggggcaauacuuacccucaguggcagcccccagcuccgcacgauccuucgaaagcggcagccgcugccgcagaccccaacgccgcuugggccgcauacuauucucauuacuaccaacagccacccggcccugugccagggcccgcgccugcuccggccgcaccacccgcccagggagaaccuccccagccaccucccaccggucaauccgauuauacaaaggcuugggaggaauacuauaaaaagaucggccagcagccacagcaaccuggggccccgccccagcaggacuacacuaaagcaugggaggaguauuacaagaagcaagcucagguugccaccggaggcgguccaggggcgccucccggaucacagccagauuauagugccgcuugggcagaauacuacagacagcaagccgcuuauuacggccagacaccuggccccgggggaccgcagccaccucccacccagcaaggucagcagcaggcccaauga

SEQ ID NO: 58055 - RNA, 1947 nt, Artificial Sequence
  derived and/or modified sequence opt3 from KIAA0020__Homo_sapiens__NP_055693
auggaggugaagggcaaaaagcaguucaccgggaaaagcacaaagacugcccaagaaaagaacagauuucacaaaaauuccgacucuggaucaaguaagacguuccccaccaggaaagucgcuaaggaggguggcccuaaaguuacaagccggaacuuugaaaaguccaucacuaaacuggggaagaagggagugaaacaguucaagaauaaacagcagggcgauaagucuccgaaaaacaaguuucaaccagcaaauaaauucaacaagaagcgcaaauuucagcccgacggucgaucggaugagucagccgcgaagaaaccuaagugggacgauuucaaaaagaagaaaaaggaacucaaacagagccgucagcuuagugacaagaccaauuacgauauuguagugagagcuaaacaaaugugggagauacugaggcggaaggacugcgauaaggagaaacgcgucaaguugauguccgacuuacagaaacugauccaggggaagauuaaaacaaucgccuuugcacaugauucuaccagagugauucaguguuauauccaauacggaaacgaagaacagaggaagcaggccuucgaagaacuacgggacgaucucguugagcugagcaaggcuaaauauucccgcaauauagugaagaaauuucuuauguacggcucaaagccacaaaucgcagaaauuauccgaaguuucaaaggccacgucagaaagaugcugaggcaugccgaggcuagcgccauuguggaauaugcguacaacgacaaagcaaucuuggagcagcggaauaugcucacugaggagcuguaugggaacacauuucagcuguacaagucugccgaccaccguacccucgauaagguauuagagguucagcccgaaaaacuggagcuuauaauggacgaaaugaagcaaauuuugacgccuauggcucagaaagaggccgugaucaagcauucccugguccacaaaguguuccuagauuucuuuacuuacgcaccacccaagcuccgcucagaaaugauugaggcuaucagagaggccguggucuaucuggcgcacacccaugacggagccaggguugcaaugcacugccuuuggcaugguacaccuaaggaucggaaagugaucguaaagacuaugaaaaccuacguggaaaaggucgcuaauggccaguauagccaccugguguugcucgccgcuuucgacuguauugaugacacaaaacugguuaagcagauaaucauuagugagaucauaucuuccuuaccaagcauugugaacgauaaguacgggcgaaaaguccugcucuaucuucugucgccgcgcgaccccgcccacaccgugagagaaaucaucgagguauugcaaaagggagauggcaaugcacauucuaaaaaggacacggaaguuaggcggcgcgagcuacuggaguccauuaguccugcccuccugucauaccuucaggaacacgcucaggaggugguccuggacaaaagcgcgugcguguuggucuccgauauccucgguucugcaacuggggacgugcagccaacaaugaacgccauugcuagccuggccgcaaccggauuacaucccggcggcaaggauggggaacugcacauagccgagcauccugcuggacaccuaguucucaaguggcugaucgagcaagacaaaaagaugaaagaaaacgguagagagggcuguuuugccaagacucuuguggaacacguagggaugaaaaauuugaagucaugggcaagugucaacaggggagcgauuauccuguccagccuccugcagucuugcgaucuugagguggcuaauaaaguuaaggccgcacugaagucauugaucccaacacucgagaaaaccaagaguacgagcaaaggcauugagauacuguuagagaagcuguccaccuga

SEQ ID NO: 58056 - RNA, 300 nt, Artificial Sequence
  derived and/or modified sequence opt3 from KIAA0040__Homo_sapiens__NP_055471
auggagagaaucagcgccuucuuuuccucuauuugggacaccauacugacaaagcaccaggaaggcaucuacaacacuauuugccucggggugcuucugggauugcccuuacuggucaucauuacgcuacucuucaucuguugccauuguugcuggucaccuccagguaagaggggccaacagccggagaagaauaaaaagaaaaagaagaaaaagaaaaagaaagaugaagaggaccuguggauaagugcucagcccaaacuucugcagauggaaaagcggccuagcuugccaguuuga

SEQ ID NO: 58057 - RNA, 6708 nt, Artificial Sequence
  derived and/or modified sequence opt3 from KIAA0100__Homo_sapiens__NP_055495
augccccuguucuuuagcgcccuccuugugcuguuguuagucgcucuguccgcacuauuccucggacgauggcugguugugaggcuugccaccaaguggugccagcggaagcugcaagcggaauugaagaucgggucuuuucgcuucuuuuggauucagaacguaucacucaaguuccagcagcaccaacagacuguggaaauagacaaucuguggaucaguagcaagcugcucucccacgacuuaccucacuacgucgcucuguguuuuggagaagugagaauuagaacugaccuucagaaaguuucugauuugucggccccauucucacagagcgccgguguggaccaaaaggaacugaguuuuuccccgucucuacucaagaucuucugccagcuguuuagcauucaugucgaugccaucaacauaauggugcuuaaaguagacacguccgagucacuguggcacauccagauuaguagaagcagguucuugcucgauucugacggcaagcggcugaucugugaaguuuccuuaugcaaaauuaauucaaaggugcugaaaagcgggcagcucgaggauaccugucuugucgagcugaguuuggcucuagaccugugccucaaggugggaaucucuucccgccaucugacagcaauaacuguggaugucuggacccuucacgccgaacugcacgagggcuuguuucaaagccagcuccugugucagggucccucguuagcuucuaagccuguuccaugcuccgaagugacagagaaccugguagagcccacccuaccugggcuauuccugcuucaacaguugccagaccaggugaaagucaagauggaaaauacuucagugguucugaguaugaacagccagaaaagacaucucacauggacccugaaacuucugcaauucuuguaucacagggaugaggaccagcucccccugcgguccuuuacggccaauucugacauggcgcagaugagcacugaauuacugcuagaggauggacuccugcuuucacagagucgccaacgaauuguguguuugaacucccugaaagcaagcguccaggugaccacaaucgaccucucugccucacugguauuaaauacuugcauuauccauuacagacaccaggaguucagucacuggcugcaucuuuuggcucucgagacccagggcagcuccucuccuguucugaagcaaaggaaaaagcggacauuuccacagauccuagccccgauuauauucucgaccagcaucuccaacgugaauauuucaauccagcugggcgauacgcccccuuuugcacucggguucaacaguauaucucuggacuaucagcaccuucguccacaaagcauucaucagcgcggagucuugacuguggaucaccuguguuggagagucgguuccgacucacauauccagagggcuccccacccuccaaauaugcacguguggggcgaggccuuaguucucgauagcuuuacacugcaagggucuuacaaccagccccuuggacuguccaguacccagagcgacacuuuguuccucgauugcacaauccggggccuacagguggaagcgucugauaccugcgcccaaugucuaucccguauucugucacucauggguccgcagaguggaaagagcgcaguaucgcgccauuccucuuuuggagagagcgucucacugcuuuggaaaguggauuugaagguugaagacaugaaucuguucacguuaagugcucucgugggcgccuccgaggucagacuggacacccuuacaauccugggcucugcugaaacuagcaccguggggauucagggccugguacucgcccuggugaaauccguuacagagaagaugcagccuugcuguaaagcacccgauauaccaacuccugucuugucacugagcauguuaaguaucaccuaucacucuuccauuaggagccucgaggugcaaugcggugccggccugacacuucuguggucgcccccagaccauauguacuuguaucagcacgugcucgcuacccugcagugucgggaucuacugcgcgcgacugucuuucccgaaacgguuccuucacuugcacucgagacaucugggaccacaagcgaacuggaggggcgagcaccagaaccguugcccccuaagaggcuguuaaaccucacccuggagguguccacagcuaaacuuaccgccuucguggcagaggacaaauuuaucacucuggccgcugaaagcguaucuuugagccgucacggcgguucccuccaggccuacugcccagagcuggcagcgggguucgauggcaacucaaucuucaauuuuaaggaagucgaggugcaacuacugcccgagcuugaagagaugauucuccaucggaacccuuucccagcucugcagacauugcgaaauagaguuugguuacugaguuuuggaagcgugucugucgaguuccccuaccaguaugacuuuuccaggacgcucgaugaggccgugggcguucaaaaauggcugaaggggcuucaccagggaacccgcgcaugggccucaccgaguccugugccacugcccccugacuugcuacugaaaguagaacauuucagcugggucuuucucgaugacguguucgaggugaagcugcacgauaacuacgagcuuaugaaggacgaauccaaagagucugcuaagcgguuacagcugcucgaugccaaagucgcagcuuugagaaagcagcauggugaacugcuccccgccaggaaaauagaggaacuguaugcgucgcuugagcgcaagaauaucgagauuuacauccaacgaagccggcgucuguauggcaacacuccaaugagaagggccuugcuaacauggucacuggcugggcucgaauuaguugcacuggccgacgcuuccuuucacggaccugagcacgugguagaacaggugcaggagcuugaccccggcaguccauucccgccugaaggucuggaucucgucauucaguggugucgcauguugaagugcaaugugaaaucuuuucugguucggaucagagacuaccccagguaucucuucgagauacgagauuggcgccugauggggcggcuugugggcaccgagcaaagcggacagccauguuccagaaggcgucagauccuacaucugggcuugcccugggggaacgucgccguggaacgcaauaugccuccauuaaaguuuuaccacgacuuccauucagagauuuuccaguacacaguuguguggggacccugcugggauccugcauggacucugaucggucaaugugucgaccuccugaccaaaccgucugcggauccaagucccccucuuccauggugggacaagagucggcugcucuuucacggcgauuggcauauggacauugaacaggccaacuugcaccagcuggcuacggaggaucccuauaauaccacagagaacaugcacugggaauggucccaucucagcuuccacuggaaaccugggcaguuuguauucaagggagaccuggauaucaaugugagaacugccucuaaauacgacgacugcugcuuucuccaucuuccggaucuguguaugaccuuagacuugcaauggcugugccacggcaacccccacgaucaucacucaguuacacucagggcaccagaguuccugccugaagugccccuuggucagcugcaugacuccuaucgagcuuuucggagugagaaucucaacuugagcauaaagauggaucugacucgccacucggggaccauuucucagccaagaaucuuacuauacuccagcacgcugagguggaugcaaaacuucugggccacauggaccucagucacucggccuauuugucgaggcaagcucuuuaauaaccuuaaacccaguaagaaaaagcugggacagcauuauaaacaguugucuuacacagcacuguucccacagcuccaagugcacuauugggccuccuuugcucagcagagaggcauccagauagaaugcagccaagggcacguauucacccgcggaacucagaggcugaucccgcaggcgggcaccgugaugcgucggcuuauuucagacuggagugucacacagaugguuagcgaucucucccaagugacggugcaucugauggccucuccuaccgaggagaaugcagaccacuguuuggauccccuggucacuaagacacauuuacuaagccuguccucacucaccuaccagagacacucuaacaggacagcugaagaggaacuuagugcccgcgacggugauccaacuuuccacacccaucagcugcacuugguggaccugcgaaucucguggacgacaaccaauagagacauugccuuugggcucuacgauggauauaagaaagcugcaguucugaagcggaaccuuagcacugaggccuuaaaaggccugaagaucgacccccaaaugccugcgaaaaagccaaagagggguguacccaccuccgcuucugccccuccgcgcgugaauacaccaucauucagcggccagcccgauaaaggguccaguggaggcgcauacaugcuccagaaguugauagaagagacugaccguuuugucguguucaccgaggaagagucugggaugagcgaucagcugugcggaauugccgcuugucaaacagacgauaucuauaacagaaauugccuaaucgaacugguuaacugucagauggugcuccggggcgcagagacggaagguugcgucauugugucagccgcgaaagcucagcuucugcagugucaacaucacccugccugguacggggacaccuugaagcagaaaacuuccuggacaugccugcucgauggaaugcaguauuuugcaaccacugagaguagccccacagagcaggacggcaggcaacugugguuagaaguaaagaauaucgaggaacaucgccagcgaucucuugauuccguccaggagcugauggagucaggucaggccgugggcgggaugguuaccacgacuaccgacuggaaccaaccagcugaagcccagcaggcacaacaggugcagagaauuauaagccggugcaauuguaggauguacuauaucucguacucucacgauauugacccugagcucgcuacacagaucaagcccccagaaguccuagagaaccaagaaaaagaggaccuguugaagaaacaggagggagccguggauaccuucacucugauucaccaugaacucgagaucaguacaaauccugcgcaguacgccaugauacuugacaucguuaacaaccuguugcugcacguggaaccgaagcgcaaagagcauuccgaaaagaaacagagagucagguuucaacucgagauuagcucaaaucccgaggaacagcgguccucuaucuuacaucugcaggaggcagugcgucagcacguagcucaaauucgccagcuugaaaagcagauguauagcaucaugaagagucugcaagaugacuccaaaaacgagaaucuacucgaucugaaccagaaguugcagcugcagcucaaucaagaaaaagccaaccuucagcuggagagcgaggaauuaaauauacugauucgaugcuucaaggacuuucaguugcagagagcuaacaaaauggagcucaggaagcaacaggaagaugugucuguuguccggcgcaccgaguucuacuuugcacaggccagauggaggcugacagaggaagacggccagcuagggaucgccgagcuugaacugcaacgguuccucuauucaaaggugaauaaaagugaugacacugcugagcaucuguuggaacugggaugguuuaccaugaacaaucuccuuccaaacgcgguguacaaggucguacugcgaccucaguccagcugucagucuggcagacaauuagcacugcgcuuguucucgaaagugaggcccccaguuggugggaucucagugaaggagcacuucgaggucaaugugguuccucucacgauucagcugacacaucaguuuuuccaccggaugaugggauuuuucuuucccggccguagcguggaagaugacgaggucggugaugaagaggacaaauccaagcuagugaccacuggcauaccgguagugaagccaagacagcuuaucgccaccgacgaugcuguuccucuggggcccggaaaaggcgucgcccaagggcucacaaggaguucuggagugcgccggagcuuccgaaaguccccagaacaucccguggacgauauugacaaaaugaaggagagagcagccaugaacaauucauuuaucuauauuaaaaucccucaggucccgcugugcguuaguuacaagggcgagaagaacucuguggauuggggugacuugaacuuaguacugcccugucucgaauaucacaauaacacuuggaccuggcuugauuucgcuauggcggugaaaagggacagccgcaaggcccuggucgcacaggugauaaaagagaagcuacggcugaaauccgcuacggggucagaaguuagaggaaagcucgagacaaagagcgauuugaauaugcagcaacaggaagaggaggaaaaagcccgucugcuuaucggccugucugugggcgacaagaacccagggaaaaaguccauuuuuggaaggcggaaauga

SEQ ID NO: 58058 - RNA, 198 nt, Artificial Sequence
  derived and/or modified sequence opt3 from KIAA0101__Homo_sapiens__NP_001025160
auggugagaaccaaggccgacagcguccccggcacauacaggaaaguuguggcugcacgggccccucgcaagguacugggguccucuacuucagcgacgaacaguaccagcguguccucucgaaaagagcacguccucugcaaucuuaucacacagaugaugaagaaaaaccguacuuucucguuuauuuucgaauga

SEQ ID NO: 58059 - RNA, 3480 nt, Artificial Sequence
  derived and/or modified sequence opt3 from KIAA0196__Homo_sapiens__NP_055661
augcuggacuuccucgccgagaacaaucuuugcggccaagcuauccugagaauugugagcugugggaacgcaauaaucgccgaauuguuaaggcuguccgaguuuauucccgcggucuuccggcuaaaggaucgcgcugaccaacagaaauacggagauaucauuuuugacuucucuuauuuuaaggguccugaacucugggagucaaaacuggaugccaagccagaacuucaggaccuggaugaggaguuccgagaaaauaacaucgagauaguuacccguuuuuacuuggcauuccagagugugcacaaauauaucguagaccucaauagauaccuggaugaccugaacgaaggcguguauauucaacagacacucgagacugucuuacugaaugaggaugggaagcagcuuuugugcgaagcccuguaccuauauggagugaugcuccugguuaucgaccagaagauugagggcgaagugagggagcggaugcuugucagcuacuaccgcuauuccgcugcaagaucuucggccgauucaaacauggacgacaucuguaaacuguugaggagcacggguuacaguucccaaccgggggcuaagcggcccucuaauuauccugaaagcuacuuucagcgcgugccaauaaacgaguccuucauuucaaugguaaucggacgacucagaagugaugacauuuauaaucagguuagcgccuacccccugccugagcauaggucuaccgcguuagcaaaccaggccgcuaugcuguaugugauccucuacuuugaaccauccauccuucacacacaucaagccaaaaugcgggagauugucgauaaguacuuccccgacaauugggugauaucaaucuauaugggcauuacugugaaccuggucgaugcaugggaaccuuacaaagcugccaagaccgcguugaauaacacacuagaccugagcaacguucgugagcaggccagucgcuaugcaaccgugucugaaagaguacacgcucaggugcaacaguuucucaaggagggcuaccugagggaggaaaugguccuugauaauaucccaaaacuguugaacugccuccgggacuguaauguggccauacgauggcugauguuacauacugcugauuccgccugcgacccgaacaauaagcgccugagacagauuaaagaucagauccuaacagacagcagguauaacccccggauccucuuccaacugcuuuuggacaccgcacaguucgaguuuauucugaaggaaauguucaaacagaugcucucggagaagcagacgaaaugggaacacuacaagaaggaggggucugagcgcaugacugaacuggccgauguuuucuccggagugaaaccucuuaccagagucgagaagaaugaaaaccugcaggcuugguucagggagaucucaaaacaaauuuugagucucaauuaugacgauagcacagcggcaggucguaagacugugcagcugauacaggccuuagaggaaguacaagaguuucaccagcuggaauccaaccuacagguuugucaguuccucgcugacacccggaaauuucugcaucaaaugauccgaacaauuaauaucaaggaggaagugcuuaucaccaugcagauugucggcgauuugucuuucgccuggcagcugauagacagcuuuacgucaaucaugcaagagaguauuagagugaacccauccauggucacuaagcucagggcaacauuccugaaauuagccagcgcucuggaucuucccuugcuccgcaucaaucaggccaacucuccugaccugcuaucagugagucaguacuacagcggggagcugguuuccuaugugcggaagguacuccagauuaucccagaaucuauguuuaccucgcugcuuaaaauaaucaaguugcaaacucacgauauuaucgagguccccacaagacuggacaaagauaaguuaagggacuacgcacagcucggaccgcgcuaugaaguggcgaagcugacccaugcuauuagcaucuucacggagggcauacuuaugaugaaaaccacacugguugguauuaucaagguggauccuaaacaguugcucgaagacgggauucgaaaggagcuggucaaacggguggccuuugcacuacaccguggacugaucuucaaucccagagccaagccauccgagcucaugccuaagcugaaagaacuuggcgcuacuauggacggcuuccacaggucauuugaguacauacaggauuauguaaacaucuacggguugaagauuuggcaagaagaggugagucgcaucauuaacuauaauguugaacaggagugcaacaauuuccugcggaccaaaauccaggacuggcagucuauguaccaaagcacacauauacccauuccaaaguuuacucccgucgaugaguccgugaccuucaucggaagauuauguagggaaauccuccgaauuacagacccuaaaaugaccugccacaucgaucagcugaacacuugguacgacaugaagacgcaucaggaggugacaucaagccgccuguuuucugaaauucaaaccacucuugguaccuucggccuaaaugggcucgaucggcuguuguguuuuaugauagucaaagagcugcagaacuucuuauccauguuucagaagaucauucucagagacaggacaguucaggauacccugaagacucuuaugaaugccgugaguccacugaaaagcaucguggcaaacucuaauaagauuuauuucuccgcuaucgccaaaacacaaaagauauggacggcguacuuggaggccaucaugaaaguaggacagaugcagauucuccgucagcaaaucgcuaacgaacugaauuauucaugccgcuuugacaguaagcaccuagcagccgcucuggagaaccuuaauaaggcccuccuggcagauauugaagcgcauuaccaggacccgagcuugcccuauccuaaagaggauaacacccuguuauacgaaaucacugccuaucucgaggcugccggcauacacaauccacugaacaagauuuacaucacaaccaaacggcuucccuacuucccuaucgucaacuuucuguucuugauugcacagcucccaaagcugcaguauaauaaaaaccuagguauggugugcagaaagcccacagacccgguugacuggccuccacuggugcuugggcuccugacuuuguuaaagcaauuccacucgagguacaccgagcaguuucuggcucucauaggccaguucaucuguuccacggucgaacagugcaccucucagaaaauucccgagaucccugccgaugugguuggagcacugcuuuuucuggaagacuaugugcgauacacaaaguugccccggcgcguagccgaggcucaugucccaaauuucauuuuugaugaauuuagaacugugcuauga

SEQ ID NO: 58060 - RNA, 2784 nt, Artificial Sequence
  derived and/or modified sequence opt3 from KIAA0226__Homo_sapiens__NP_001139114
augcagagcauccuguaccacggccucauuagagaccaagccugcaggcggcagaccgauuauuggcaguucgugaaggacauacgcuggcuuucuccccauuccgcucugcacgucgagaaauuuaucucaguucaugaaaacgaucagaguagcgcagacggggccuccgagcgagcgguggcugaauugugguuacaacacucucugcaguaccauugucuaucggcccagcuccguccucugcuuggagauagacaguauauuaggaaguucuacacagacgcagccuuucuguugucagaugcucacguaacugcaaugcuccaaugccuggaggccguggaacagaauaacccacggcugcucgcucagaucgacgccagcauguucgcgcgcaaacacgagaguccguuacuggucacgaagucccagucucuuaccgcauugcccagcuccacauauacuccuccaaauucauacgcccaacauaguuauuuugguagcuucucuucccugcaccagucagugcccaacaauggcagcgagagaaggaguaccucuuuuccucuauccgggccaccccggaaaccucaggaaagccgcggacauguuucgccagcugaggaucaaacaauucaggccccgcccgugucugucuccgcacucgcucgagacucaccucugaccccaaacgaaaugaguagcuccacucuuacaucucccaucgaggccagcugggugucaagucagaaugauuccccuggcgacgcgagcgaggguccagaauaccuggccauagggaacuuggaucccagaggaaggaccgcaucuugucagucacacaguagcaaugcugaguccucuucgagcaaccucuucuccucaaguucuagccaaaagccggacuccgccgcuucaagccugggcgaccaggaaggcgggggagagucucaguuauccaguguacugcggcguagcucuuuuuccgaaggucagacgcucacuguuaccucaggcgccaagaaaagucacauccgcagccauucggauacauccauugcaucuagaggggccccuggaggccccaggaauaucacuauuaucguggaggacccaauagcugagagcugcaacgauaaggcgaaacuucgggguccucugcccuacucagggcaaaguuccgaagucucuaccccaagcuccuuguauauggaguacgaaggaggccgauaucuauguucaggcgaggggauguuccgcagacccagcgaaggacagagucugauuucuuaccucuccgagcaggacuuugguagcugcgcagaucuggagaaggaaaaugcccacuucucgaucucagagucucuuauugcugccaucgaacugaugaaauguaacaugaugagucagugcuuggaggaagaggagguggaagaggaagacuccgauagggagauccaagagcucaagcagaagauucggcugcgcagacagcagauaaggaccaaaaauuuacugccuauguaucaagaagcagagcauggcagcuuucgugugacaucuagcuccucacaguucaguagccgggacucugcccagcuauccgauucagggagugcugacgaagucgaugaguucgaaauccaagacgccgacauucgaagaaacacggcaagcuccucuaagucguuuguuagcucacaguccuucagucacuguuuucuccauucuacuagcgcggaggcuguggccaugggacugcuuaaacaguucgagggcaugcaguugccagcagccuccgaacuggaguggcucguaccggaacacgaugcuccccaaaagcugcuuccuaucccagacucacugcccauaucuccugaugacggucagcacgccgauauuuacaaauugaggauccgcgugcgggggaaccucgagugggcaccacccagaccgcagaucauuuuuaauguccauccugcuccaacaaggaagaucgccguggcgaaacagaacuaucgcugcgccggcuguggcauucgaaccgaccccgauuacauaaagcggcugcguuacugcgaauauuuaggaaaguacuucugccaauguugccacgagaaugcucagauggcaaucccuagcagaguucugaggaaaugggacuuuaguaaguauuacguguccaacuucagcaaagaucuacucauuaagaucuggaaugacccccuguuuaacguccaggauaucaauucugcccuuuaucgcaaagugaaguugcugaaccagguacggcuccugagaguucaauuaugucauaugaagaauauguucaaaacuugcaggcuggcuaaggagcuuuuggacucauuugauacagugccagggcaccucaccgaagaccugcaccuauacucccugaacgaccucacggccacccgaaaaggagagcuggguccucgccuugcagaauugacacgggcgggcgccacucaugucgagagauguaugcugugccaggcuaagggguucauuugugaauuuugccagaaugaggaugacauaaucuuccccuucgaguuacacaaauguaggaccugcgaagaguguaaggccugcuaucauaaggcaugcuuuaaaaguggaagcuguccacguugcgaacgccuccaagcucggagagaggcccuggcaaggcagucgcuugagucuuaccuguccgauuacgaagaggaaccggccgaggcuuuggcgcucgaagccgcagugcuggaggcuacauga

SEQ ID NO: 58061 - RNA, 1908 nt, Artificial Sequence
  derived and/or modified sequence opt3 from KIAA0226L__Homo_sapiens__NP_001273691
auggugagccaguccaccgucagacaagacucucccguugagccuugggaaggcaucucagaucacagugggauuauagacggaagcccaaggcugcucaacacagaucauccgcccugccagcuugacauccggcugaugcgccacaaggccguguggauuaauccucaggauguacagcaacagccacaggacuugcagucccaagugcccgcugcagguaacucuggcacucauuucgucacggaugccgcgucgccuucagggccaagccccaguuguuuaggagacucccuggcugagaccacacuaucugaagauacuaccgacagcgugggcuccgccucaccucacgguaguagcgagaaaucuuccucauuuagccucaguucuacagaaguucauauggugcgaccaggguacucccaccgugucagccugccgaccucgcccggaauccuugcaacuucuccuuauccagagacagauuccgccuucuuugagcccucacaccugaccagugcugcagacgaaggcgccgugcagguaagcagaaggacgauuuccucuaauagcuucucaccugagguuuuuguguugccagucgauguggaaaaggagaacgcucauuucuacguggccgacaugaucauaagugcgauggagaaaaugaagugcaauauccucucccagcagcaaacugaaagcuggucuaaagaggucucaggccugcuggggagugaccagcccgauagcgaaaugaccuuugacacaaacauuaagcaggaguccggaucuucgacuagcuccuauucagguuacgaaggcugugcaguucuccaagugaguccgguaaccgagacacggaccuaucacgaugugaaggagaucugcaaaugugacgucgaugaauuugugauuuuagagcugggggacuuuaaugauaucacggaaacuugcucuuguagcugcuccucaagcaagucuguuacauacgagccugacuucaacuccgccgaacuuuuggcuaaagagcuguaucgcguguuucagaaguguuggauacuaagugucgugaauagccagcucgccggaucucuguccgcagcuggcucaauuguaguuaacgaggaaugcgugagaaaagauuucgagaguagcaugaaugucgugcaggaaaucaaguuuaagucgaggauucgggguaccgaggacugggcgcccccacgcuuccaaaucaucuucaacauucauccuccccuuaaacgagaucuggucguggccgcccagaauuucuucugugcagggugcggaacuccaguugaacccaaguuugugaaaagauugagguacugcgaguaccucggcaaguauuucugugacugcugucacuccuacgcugagucuugcauaccugcccggauccugaugaugugggacuuuaaaaaguauuacguaagcaacuucucaaaacaguuacuggauaguauuuggcaccagccaaucuuuaaucuccuuuccauaggccaaucucuguaugcuaaggccaaggaauuggaccgugucaaagagauucaggaacagcuauuccauaucaagaaacugcucaagacaugucgcuuugcaaacagcugcgugaaagagagagcccuguucguuaacuuugcuaggauccggcuuuccucaagccacuuccgacagcaacauguggaggauguccagcgcgcggggcuggcauuuaccaauagugccucuuccccgcccagcgcuccuggagugagagguucgcagaggggcgaaaacuucuggaagguauggccauugcagcaacacgacgcccccgaguacugugaaaaggauugcucaacgugucucaugauuaccccuaucugcguguauuacugguga

SEQ ID NO: 58062 - RNA, 4188 nt, Artificial Sequence
  derived and/or modified sequence opt3 from KIAA0232__Homo_sapiens__NP_001094060
auguaccccaucugcaccguggucguugacggccugccuagcgaguccucuucaaguagcuauccagggccgguguccguaucugaaaugucgcuccuucacgcccugggacccgugcagacaugguugggucaagaguuagaaaaguguggcauugaugcuaugauauacacuagauauguccugucacuacuccugcaugacagcuacgauuaugaccuucaggagcaggaaaacgauaucuuccuggggugggagaaaggagcauacaagaaauggggcaagaguaaaaagaagugcuccgacuugacgcucgaggaaaugaaaaagcaggccgcggugcaaugucugaggucugcuagcgaugaguccucagguauugaaacccugguugaggagcucugcagucgguuaaaagaccugcagagcaagcaggaagagaaaauccacaagaaacuugaagggucuccuuccccagaggccgaauugucacccccugcaaaggaucagguggagauguauuacgaggccuuuccaccccugagcgaaaagccugucugucuacaagagauuaugacaguguggaauaaaaguaagguaugcucuuacuccagcucgucuuccucaaguacugcuccaccggcaagcaccgacacauccucucccaaagauuguaacagcgaaucagagguuaccaaggaacgcaguuccgaggugccuacuacaguccaugagaaaacccagagcaagucuaagaaugaaaaagagaacaaguucucaaauggaacgaucgaagagaaaccagcccucuauaagaaacagauacgacacaagcccgaaggcaagauccguccuagaaguuggagcuccggcagcucggaggcugggagcuccucaaguggaaaccagggugagcugaaagccucuaugaaguacgugaaagugaggcauaaggcgcgggaaauucgcaauaaaaagggcagaaacgggcaaagcaggcuuucccugaagcacggagagaaagcagaacggaauauccacacuggcucaucuucuuccaguagcucugguuccgucaagcaguugugcaaacgcgggaagcgaccacucaaagagauuggaagaaaggaccccggcucaaccgagggcaaggaucuguauauggaaaacaggaaagacacagaguacaaggaggaaccguuaugguauacugaaccuaucgccgaguacuuuguuccccugagucggaaaagcaagcucgagaccacauaucguaaucgccaggacaccucggaucuuacguccgaagcuguggaggaacugucugagagcguacauggguuguguauaucaaacaauaaccuacacaaaacuuaccuggccgcaggaacauucauugacggucauuuuguggaaaugccagcugucaucaaugaggauauugaccucaccggcacuucucugugcucccuuccugaggauaacaaguaccuggacgauauccacuugucugaacucacacacuucuaugagguggacaucgaucaaagcaugcuggaccccggggccuccgaaaccaugcagggagagucaagaauuuuaaacaugauaaggcagaaaagcaaggaaaauacggauuuugaggcggaguguugcaucguucuggacggcauggaacuacagggugagcgggccauuuggaccgacaguacaucuuccgugggggcagaaggccucuuccugcaagaucuuggaaacuuggcucaguuuugggagugcuguagcucgucaucuggcgacgccgauggggagaguuucggaggugacuccccaguccgacugagccccauccucgauucuacugugcugaauagccaucuucuggcuggcaaccaggaauuguuuuccgacauaaaugaggggucaggaauuaacaguugcuucagcguauuugaaguucaguguucuaauuccgugcucccuuucucauucgagacccugaacuuaggcaaugaaaacacagauaguagcgccaauaugcuggguaagacucaaucccgccuacucaucuggaccaaaaacucugcauuugaggagaaugaacacugcucgaaccugagcacaagaaccuguucaccauggucccauagugaggaaacuaggucugacaaugagacgcuuaacauccaguucgaagagagcacacaguuuaacgccgaggauauuaauuacgucgugccgcgggucuccucaaacuauguggacgaagaguugcuggauuuccuccaggacgaaaccugccaacagaauagucgcacucugggggagauccccaccuuaguuuuuaagaaaacaagcaagcuggaaaguguguguggcauucagcuugagcagaaaaccgagaacaagaauuucgaaacuacacaaguaugcaacgaguccccucacggagauggcuacagcucuggggucauaaaggacaucuggacgaaaauggcugacaccaauucaguggcgacuguugaaauugagagaacagaugcagaguuguuuuccgccgacgugaacaauuauuguugcugucucgaugcugaagccgagcuggaaacccuacaggagccagacaaggcagucaggcguagugaauaccaucugugggagggacagaaagagagccucgaaaagcgggccuucgcuucgucugagcuguccaacguggaugguggcgacuauacaacucccagcaaaccuugggauguagcccaagacaaggaaaauaccuuuauccuugggggaguguacggcgaguugaagacguucaacucagauggugaaugggcaguugucccacccagucacaccaaagggucucuguuacagugcgcggcuuccgacguggugacaaucgccggcacugaugucuuuaugaccccgggaaauagcuucgcaccuggccaccgacagcucuggaagccauuuguuucauucgagcagaacgaccaacccaaaaguggggagaauggacugaacaagggcuucagcuuuauuuuccaugaagaucuucugggugccugcgggaacuuucagguggaggacccuggauuggaauacuccuucucuagcuuugaccucuccaaucccuucucacaggugcugcacguagaguguucuuuugaaccagagggcauagcuaguuucucgccuagcuuuaaacccaaguccauccuaugcucugauucagacagcgaggucuuccauccaagaauuugugguguggauaggacacaguaucgcgccauccggauuuccccgagaacucacuuuaggccuaucagugcaucugaacugagccccggcgggggaucagaguccgaguucgaaagugagaaggacgaagcuaacauaccaauccccagccaaguugauauuuuugaggacccucaggccgaucucaaaccacuggaagaggacgcggaaaaggagggccacuacuaugggaaaucugagcuugaauccggaaaguucuugccccgccugaaaaagucaggcauggagaaaagcgcccagaccucguuagauucucaggaagagaguacggguauccucuccguggggaagcaaaaucagugccuggaauguagcaugaacgagucacuugagauugaccuggaauccucugaggcuaauugcaagaucauggcacagugugaagaggaaauaaacaauuucugcggauguaaagccggcugccaauuuccugcuuacgaggauaacccggucagcaguggucagcuagaggaguucccagugcucaauacagacauucagggcaugaaccgaucccaggaaaagcaaaccuggugggaaaaagcccuguauagccccuuguuuccugcaucugagugugaggaaugcuacacuaaugcgaagggggagucaggacuggaagaguauccagacgccaaagaaacacccaguaacgaggagcgguuacucgauuucaaucguguuuccagcguguacgaagcuagaugcaccggcgagagggacucuggggccaagucggauggauuucgcggcaagauguguucaagcgcauccaguacuucugaagagaccgguagcgaagggggaggcgaguggguagguccuuccgaggaggaacuguucucacggacacaucuuuga

SEQ ID NO: 58063 - RNA, 3192 nt, Artificial Sequence
  derived and/or modified sequence opt3 from KIAA0319__Homo_sapiens__NP_001161846
augaccagacugggcuggcccagcccuugcugugccaggaagcagugcuccgaggggcggacauacucuaacgcugugaucucaccaaaucucgaaacuacgcgcauuaugcgagucagucacaccuucccgguuguggacuguacagcagccugcugugaucuuagcuccugcgaccuggcguggugguuugagggacguuguuauuugguaucuugcccccauaaagaaaacugugagccuaagaaaauggguccaauaagaucguacuuaacuuucgugcugaggcccguccaacggccugcucagcuacucgauuauggcgacaugaugcugaaucgcgggucaccaagcggaaucuggggcgauagucccgaagacauuagaaaggaucuuaccuuucuggguaaagacuggggguuggaggagauguccgaauacucugaugacuauagggagcucgaaaaggaucugcugcagccuagcggaaagcaggagccacggggcuccgccgaguacacagacuggggccucuuaccggggucagaaggagcauucaacaguagcgugggugauucucccgccguuccugcugagacccaacaggacccagaacugcacuaucuuaaugaguccgcaucaacucccgccccuaaauugccagaacgcagcgugcugcuaccccucccgacaaccccuaguucuggcgagguccuggagaaggaaaaagcuagucagcuucaggagcaaagcucgaacucuuccgggaaggaagugcugaugcccucacauaguuugcccccugccagccucgagcuguccucuguaacgguugagaaaagccccguguuaacugucaccccaggaucaacagaacacaguauccccacuccuccaaccuccgcggcaccgagcgagucuacacccucagaacugccuauuaguccaaccacggccccacgaacugugaaggagcucacagugagcgcuggcgacaaucuuaucauaacccugccugauaacgaagucgaguugaaggccuuuguugcaccagcucccccgguggaaacuacauacaauuacgaguggaaccuaaucucccauccuaccgacuaucagggugagauuaaacaggggcacaagcagacgcugaaucucucucaacugucgguaggacuuuacguguucaaagucaccgugagcuccgaaaacgccuuuggcgagggcuucguuaaugugacagucaagccagcgagaagggugaaccugcccccuguagccguugugucaccccaguugcaggaacucacucugccauuaaccagugcacugaucgaugggucucaaagcacagacgauacugagauugucuccuaucacugggaggaaaucaauggaccuuuuauagaggagaaaaccucaguggacagccccguccuacggcucucuaaccuggauccagguaacuacuccuuccgucuuacagugaccgacagugauggcgcuacuaauagcacgacagccgcuuugauuguuaacaaugccguggacuauccgccuguagcaaacgccgggcccaaucauaccaucacucugccacagaacucuauuacccucaauggaaaccaguccucagaugaccaccagaucguccuguacgaauggagucuuggccccgguagcgaagggaagcaugugguuaugcaaggcgugcagacaccuuaucugcacuugucggcuaugcaggagggagacuacaccuuucagcucaaagucacugauuccucucgccaacagagcacagcggugguaacggugaucguucagccagagaauaacagacccccugucgcaguggccggcccggacaaggaacugauuuucccaguggagucagcuaccuuagaugggaguuccucuagcgacgaucacggaauagucuuuuaccauugggaacacguuaggggucccuccgccguggagauggaaaauaucgacaaggcaauugccacugugacaggccugcagguagggaccuaucauuuccggcuaacagucaaagaucaacagggacucucaagcacuuccacccugacgguggcuguuaagaaagagaacaauucuccuccacgagcccgcgcaggcgguagacacgugcuugucuugcccaacaauuccaucacccuggacgggagcaggucgacagaugaccagcggauagugucauaccucuggauucgcgauggccagucuccugcggcuggagacguuaucgauggcagugaccauuccguggcccugcaauuaacuaaccugguagagggggucuauaccuuccaccuuagagugacagacagccagggagcaucugauacugacaccgccacgguggaaguccagccggauccccguaagagcgguuugguugagcucacacugcaagugggcguagggcagcuaaccgaacagaggaaagacacucuggugcggcagcucgcuguccugcuuaacguguuggauuccgacaucaagguucaaaagauucgagcccacucagaucugaguacagugaucgucuuuuacgugcagagcagaccaccuuucaaaguuuuaaaggcagcugagguggccaggaaucuccauaugcgccugucuaaagaaaaggcggacuuucuucuguucaaagucuugcggguagauaccgccggaugccuccugaaguguuccggccacggucauugcgacccccuaacuaagagaugcauuuguucacaccuguggauggagaaccucauacagagguauaucugggauggggagaguaauugcgaauggagcaucuuuuacgugaccguucuggcuuucacacuuauuguguugacgggcggauuuaccuggcuguguaucugcuguugcaaacgccagaagcgaacuaaaauucggaagaaaacaaaguauaccauauuagacaacauggaugagcaagaacguauggagcucagaccaaaguacggcaucaaacacagguccacagagcauaauucuucgcugauggucagcgaaucagaguucgacuccgaccaggauacuauuuuuagucgcgaaaagauggagcgggggaacccuaaagugucuaugaauggaagcaucagaaacggcgcauccuucucauacuguucuaaggacagguga

SEQ ID NO: 58064 - RNA, 2547 nt, Artificial Sequence
  derived and/or modified sequence opt3 from KIAA0319L__Homo_sapiens__XP_011540484
auggagaagagacugggcgugaaacccaacccugccagcuggauccucuccggguacuauuggcagaccucugcuaaguggcuuaggucacuguacuuguucuauacaugcuuuuguuucagugucuuauggcugagcacugacgcauccgaaucucggugccaacagggaaaaacgcaguuugguguuggccuacgcucagggggagagaaucaccucuggcugcuugaaggcaccccaucgcugcagagcuguugggccgcgugcugucaagauagugcuugccauguguucuggugguuggaggguauguguauucaggccgacugcucccgaccgcagucuugucgugcauuuagaacacacagcuccaacucaaugcucguauuccugaagaaauuucagacugccgaugaccugggguuccuccccgaagaugacgugccucauuuacugggacuuggcuggaauugggcuaguuggaggcaaagcccaccccgggcagccuugcgcccugcugucucuuccucagaucagcagagccugauaagaaagcuacagaagaggggcaguccaucugacgugguuacccccaucgugacacaacacuccaaagucaacgauagcaaugagcucgggggacugaccacuucggguucugccgaggugcauaaggcgauuacaaucuccucaccucuuaccacggaccugacugcagaauugaguggcgggcccaaaaacguaagcguucagccggagauuuccgaaggacucgccaccacacccucuacucagcaagugaaaagcucagagaaaacccagaucgcugucccucagccaguggcccccaguuacuccuaugcaacaccuaccccacaggcuagcuuucaaucuacgucagcccccuacccggugauaaaggagcuggucguuagugcgggcgaaagcgugcagaucacuuuaccuaagaaugagguacagcugaacgccuaugugcuccaggaacccccaaaaggugagacauacaccuacgauuggcaacuuauuacucacccucgggacuauuccggggaaauggagggaaagcacucucagauccugaaauugucgaagcuaacacccggccuguacgaguucaaagucauuguggaaggccagaaugcacauggggagggauauguuaacgugaccgucaagccagaaccccgcaaaaaucgaccuccaaucgcuauagugagcccgcaguuucaagagauuucccuccccacgaccucaacaguaaucgaugguagucagucuacugacgacgauaagauuguucaguaccacugggaagaacugaagggcccucuuagagaggagaaaaucagcgaggacaccgccauccugaaguuguccaaacucgugccagggaacuauacauucucacugacugucguggauagcgacggagcuaccaauucuacaaccgccaacuuaacugucaauaaggcaguggauuacccaccuguugccaacgcuggcccaaaccaggugauuacgcugccccaaaauuccauaacacuauuugguaaccagaguaccgacgaucaugggaucacuagcuaugaauggucucucuccccgucaaguaaaggcaagguagucgagaugcagggagugaggaccccuacacugcaacuuagcgcgaugcaggaaggcgacuacaccuaccaguugacuguuacagauacgauugggcagcaagcaaccgcccaggugacugucaucgugcagccagagaauaacaagcccccucaggcugacgccggacccgauaaagagcugacacucccaguagacucgaccacacuggacgguuccaagucuagcgaugaccaaaagauaauuucauaucuuugggaaaagacucagggcccugauggggugcagcuggagaaugcaaacaguuccguugccaccgucacgggacuccaggugggcaccuacguguucacauugacugucaaagacgaacggaaucugcaaucucagagcuccguuaacgugaucgugaaggaggagaucaauaagcccccaauugcuaaaaucaccgguaacguagucauuacauuaccgacuucaaccgccgaacuggaugggagcaagaguucugacgauaaaggcauaguguccuaucuauggacgcgugacgagggaagcccugcagcgggcgaaguucucaaucacucggaucaccaucccauccuguuccuuucaaacuugguggaggggacauacaccuuucaccugaaggucacugacgcuaaaggagaaucugauacagaccgcaccacuguggagguuaagccagaucccagaaagaauaaccucguggagauuauccuggacaucaauguaagucaguuaaccgaaaggcugaaagguauguucauucggcaaauaggcguccuuuugggggugcucgacuccgauaucauugugcagaagauccagccuuauacagagcagcgaaaaauuagcucugucgaagccagccugaaguga

SEQ ID NO: 58065 - RNA, 3213 nt, Artificial Sequence
  derived and/or modified sequence opt3 from KIAA0355__Homo_sapiens__NP_055501
auguacugcuguagcgcccaggacuccaagauggauuauaaaagaagguuccugcucggcgggucuaagcaaaaagugcagcagcaccagcaauaccccaugccugagcuuggacgggcucugucagcaccauuggccaguaccgcgacaacugcuccguuagguagccugacggccgcaggcuccugccaucacgccaugccccauaccacaccuaucgcugacauucagcaggggauaucuaaguaucuagaugcacucaacgucuuuugucgcgccucgacuuuccugaccgaccuauuuucaacaguuuuccgaaauagccacuacaguaaagcugccacccagcugaaggaugugcaagaacauguaauggaggcggcaucccguuugacuucugccaucaagccagaaauugcuaaaaugcucauggagcugagcgccggagcagcuaacuuuacagaccagaaggaguucucccugcaggauaucgaagugcucggcagaugcuuuuuaaccgucgugcagguucacuuccaauuucugacgcacgcccuucagaaagugcagcccgucgcgcauucauguuucgccgaggugauuguaccugaaaagaaaaauagugguagcgggggaggcuugucuggcauggggcacacuccagagguugaagaggcagugagguccuggcggggagcugccgaggcuaccucacgccugagagaaagggguugcgacggcugucuagccgggaucgagguccaacagcucuuuugcagccagagugcagccauacccgaacaucagcugaaggagcuuaacaucaagauugauucugcucugcaagcguauaaaaucgcauuggaaucccucggacacugugaguacgccaugaaggcuggcuuccaccugaauccuaaagccauugaggcaaguuuacaggguugcuguucggaagccgaggcucagcagacagggcggcgccaaacuccaccgcagcccaugcagugcgaacugccuaccgugccagugcagaucggaucucauuuucucaagggcgucuccuucaacgagucagccgcagacaaucuuaaacugaagacacacaccauguugcaacuaaugaaagaagcgggcugcuauaacgggauaacgagucgagaugacuuccccguuacugaggugcugaaucagguauguccuagcacauggagaggagcuugcaagaccgccgugcagcuccuguuuggucaggcaggccuugucgugguugauacugcccaaauugagaacaaggaggcuuacgccccacagaucucccuggaagggucuaggauugugguccaggugcccagcacaugguguuugaaagaagacccggcaaccaugucacuccugcaacggaguuuagacccugagaagacgcugggacuuguagauguucucuacaccgcugugcuggaccuuaaucguuggcgcgccggcagagaacaggcguugcccugcauccagauccagcugcaaagggagauuugugauuucgguaaccaggccgaccucccauccgggaauggcaacaaaagcucuggaggccugcagaagacauuuucaaaacuuacuagccgguucaccaagaaggcuagcugcacauccucuucgagcuccacuaauuauucaauacagaacaccccuaguaaaaacaucuuuauugcaggguguucugaggaaaaggccaaaaugcccggaaauaucgauacacgacugcaaagcauauugaacauugguaauuucccacgcaccacugaccccucccagucagcucagaacagcucuaauacggucgccaacggcuuucucauggagagaagggaaaauuuccugcauggggaugacggaaaggaugagaaaggcaugaacuuaccuacagaccaggagaugcaagaagugaucgauuuucuguccgguuucaauauggggcagagucaccagggcagcccccuagucacccggcauaacucugcagcgacugccauggugaccgagcaaaaggcuggagccaugcagccgcagcagcccucccucccuguuccacccccuccacgcgcaccccaagcuggcgcccacacaccgcugaccccucagccagggcuugcaccccagcagcaaucaccuaagcagcagcagccccaagugcaguacuaucagcacuugcugcagccaaucggaccucaacagcccccaccgcagccuagagcccccgguaaauggguacauggcaguagccaacagccagcucaggcggucggggccggacucucgccccugggccaguggccugguauuuccgacuuaucuagcgaccuguacucacuuggguuggugaguuccuauauggauaauguuaugucugaagugcucggccaaaagccacagggacccaggaacaauacuuggccuaaccgugaccagagcgauggcgucuuugggaugcugggagagauccuaccguucgacccagcagugggcuccgaucccgaauuugcucgguacguagccggugugucacaggccaugcaacagaaacgacaggcucagcacgggagaaggccuggaaauccacgcggcaacuggcccccuauggacgaugcacaucggacauggccguuccccgaguucuuuacggagggugacggccugcacgggggauggagcggcgcccaaggggauagugcgucuuccagcgacgaaaccucgucagcuaacggagauucucucuucaguauguuuuccggcccagaccugguugccgcagucaagcagagaaggaaacacagcucuggugagcaggauacuagcacacuuccuuccccaccauugcugaccacaguggaagacgugaaucaagacaacaagacuaagaccuggccucccaaagccccauggcagcauccgucaccuuuacccaguacgcucccaagccccucugcuccucuguaugcagucaccuccccagggucacaguggaaugauacaaugcagaugcuucaaagucccguuugggccgcgacuaacgacugcagcgcugccgcauucuccuacgugcagaccccuccgcagccacccccucccccagcccacaaggcugccccuaaaggauuuaaggcauuccccggcaaaggugagcgccgaccagcuuaccugccucaguauuga

SEQ ID NO: 58066 - RNA, 1704 nt, Artificial Sequence
  derived and/or modified sequence opt3 from KIAA0391__Homo_sapiens__NP_001243607
augaccuucuaccuguuuggcaucagaucauuccccaagcucuggaaauccccuuaucuugggcugggaccaggucacucuuacgugucauuguuuuuagccgacaggugcggcauucggaaccagcaacgccuguucagucuaaagacaaugagcccgcagaauacuaaagcuacgaaccucauagcaaaggcccgauaucugcguaaagaugagggguccaauaagcaggucuacucuguuccccacuuuuuccuugcgggagcugccaaggaaagaucgcagaugaacucacaaaccgaggaccaugcacuggccccugugaggaauacaauccaguugccaacucagccccucaacagcgaagagugggauaaacugaaggaagaccugaaagagaauaccggcaagacaaguuuugaguccuggauuaucucucagauggcugguugucauagcuccauugauguagcaaaaucacucuuagccuggguggcugccaagaacaaugggaucgucaguuaugaccugcuugugaaguacuuguaucugugcguuuuccacaugcaaaccagcgaagugauagaugucuuugagaucaugaaagcgcgguacaagacucuagaaccucgcggauacucucuccugauuagaggccuuauccauuccgacagguggcgggaggcacuguugcuccuggaggauauuaaaaaggugaucacaccaagcaaaaagaacuauaaugacuguauacagggcgccuuacugcaccaggauguaaacaccgcuuggaaucucuaccaggaacuucuggggcacgacauuguucccauguuggagacgcuaaaagccuucuuugauuucggaaaggacaucaaggacgauaacuauagcaauaaacugcucgacauucugaguuaccuucgcaacaaccaacuguauccuggugaaucuuuugcacauuccaucaagacuugguucgagagcggccagugcucgggguguggaaaaaccaucgaaucuauucaguuguccccagaggaguacgaaugccucaagggcaaaauaaugcgagaugugaucgacgguggggaucaauauagaaagacaacuccgcaggagcugaagagguucgaaaauuuuauuaaaucacggcccccuuucgacgucgugaucgauggauuaaacguggcuaagauguuuccaaaaguccgugagagucagcugcuacucaauguugugagccagcuggccaagcgcaaccuuagauugcugguacucggcaggaaacacaugcugcggcgauccucucaauggagccgcgacgaaauggaggaggugcagaagcaggcgucauguuucuuugccgaugacauaagugaagaugaccccuuccuucuguacgcaaccuugcauuccggcaaucacugcagauuuauuacaagggaccucaugcgggaucacaaggcuugucugccugacgccaaaacccagcgcuuauucuuuaaguggcaacaggggcaucagcuggcuaucgucaacagauucccaggaagcaaacuaacguuucagaggauccucucuuacgauacugugguucaaacaaccggugacucauggcacauucccuaugaugaggaccugguggaacguugcaguugugaggucccgacuaaguggcuuugcuugcaucagaaaacauga

SEQ ID NO: 58067 - RNA, 4935 nt, Artificial Sequence
  derived and/or modified sequence opt3 from KIAA0586__Homo_sapiens__NP_001231118
auguucuggugcggcaccuguuuugugacaaacaauaugaaggggagcgaggucucccuggaaaagaagaaaaagaucaaaaugcccguuaagagacucagggaggugguaucucagaaccacggagaccaucuugugcuguugaaggaugaauuaccuugcgucccaccggcccugucagcuaauaaacggcuacccguggguacuggcacgagucucaacgggaccagccgcggauccucugaccugacaucggcacgaaauuguuaccaaccucuucuggagaacccaaugguuucagaaagcgauuucaguaaggacguggccguccagguguugccccucgauaaaauugaggagaauaacaagcagaaagcgaaugacauauuuaucucccaguauacuaugggccaaaaggaugcucugcguaccguacugaagcagaacguuucucucugcuuaacagguuggagcgaccacuccggggugauuaccacucauuguucacuguaccuuuugagacugaugaggaguagccaccuaucucucccuuccucaugggauuaucgggcccagagcaugccagucuucaaagaagugaaggugcaucugcuugaggacgcaggaaucgaaaaagaugccgucacacaggagacccgcauuagucccucuggcaucgacuccgcuacgacuguugcagccgcuaccgccgcggcaauagccacagcugccccucugaucaaggugcaaagcgauuuggaggcaaaaguaaauucggugacugaacuccugucuaaguuacaggagaccgacaaacaucugcagagagucacagaacagcaaaccuccauucagaggaagcaggagaagcuccacugccacgaccacgaaaaacaaaugaacguguuuauggagcagcauauccggcaccuugagaagcugcagcagcaacagauugauauccagacgcacuucauaucagcugccuugaaaacuuccagcuuucagccaguuuccaugccgucuagccgcgcgguggaaaaguacucagucaaacccgagcauccuaaucuaggcaguuguaacccaucccuguauaauacauucgccagcaagcaagcaccccucaaggaaguggaggacaccucuuuugauaaacagaagucaccucuggaaacuccagcuccccgaagauucgccccgguaccuguuaguagggacgaugagcuuagcaaacgggagaaccuguuggaagagaaggaaaacauggagguguccugccaccgugggaauguccgccuccuggaacagauuuuaaacaauaacgacucucugacaagaaaaucggagagcuccaauaccacgucacuaaccaggaguaagaucggauggacacccgagaagacuaaccgguuuccaucuugugaggaacucgaaaccacaaaagugacuaugcaaaagagcgaugacguccugcaugaucuuggucaaaaagagaaggagaccaauuccauggugcagccuaaagaaucauugagcaugcugaagcuccccgaccugccacagaacucuguuaaacuucagacaaccaauacuacgcgauccgugcugaaagaugcugagaagauuuugcgcggcguacaaaacaauaaaaagguccucgaagagaaccuggaagccaucaucagagcaaaagacggggccgcuauguacaguuuaauuaaugcgcugagcacaaacagggagaugucugagaagauacggauccgcaaaaccguggacgaauggauuaagacuaucuccgcagagauacaggaugaacuaucaagaaccgacuaugagcagaagagguucgaucagaaaaaucagcguacaaagaaaggacagaacaugaccaaggacauucggacuaacacacaggauaaaacgguuaauaagagugugaucccccgaaagcacagccaaaaacagaucgaggaacauuuuagaaaccucccuaugaggggcaugccagccucgucccugcagaaggagcgcaaagaaggucuuuugaaggcuaccacugucauucaggacgaggauuacaugcugcaaguguacgggaaaccgguauaucagggacaccggucuacacucaagaagggccccuaccugagauucaauagcccuucaccaaaaaguaggccccagcgcccuaaggugaucgaacgaguuaaaggcaccaaggucaaauccauucggacacagacugacuucuaugccaccaagccaaagaaaauggauucuaagaugaaacacagcgugcccguguuaccgcauggggaccaacaguaccuguuuuccccuucacgugagaugccaacguucagcggaacccuugaaggucacuugauacccauggcaauccuccugggccagacacaaaguaacucugauacuaugccucccgccggggucauuguuuccaagccacauccugugaccgugacaacuagcauucccccaucgucaagaaaaguagagaccggagucaagaaaccgaauaucgcuaucguggagaugaagucugaaaagaaagacccuccccagcuaacgguucaggugcugccaagugucgauauagacuccaucagcaacucuagcgccgacgugcucaguccccugucaaguccuaaggaggcaagccuuccacccguucagacauggauuaaaaccccugaaaucaugaagguggaugaggaggaaguaaaauuuccgggcacuaauuucgacgagauuaucgaugucauacaagaagaggaaaagugcgacgagaucccagauucugagcccauuuuggaauuuaacagguccgugaaggcggacucaacaaaauauaaugguccuccauuucccccuguggcuaguaccuuccagccgacugccgauauccuggacaaggucauugagcgcaaagaaaccuuagagaacagccucauccaguggguugaacaggagauaaugucccggauuaucucugggcuguuccccgugcaacagcagauugcaccaucgaucagcguaucaguguccgagacaagugaaccucuuacgucugauauagucgagggcaccagcuccggagcccugcaguuguuuguggacgcuggcguucccgucaauucaaacgugaucaagcacuucgugaaugaagcccucgcagagacuauugcuguuaugcugggggauagagaagccaaaaagcaaggaccaguggcgacaggugucucuggcgacgccagcaccaacgagacauaccuaccugcuaggguauguacuccccugccaaccccgcagccuacgcccccaugcagucccuccagcccugcaaaggagugcgugcucguuaaaacaccagauucuucacccugugacuccgaccacgauauggccuuuccugugaaggaaaucugcgcugagaaaggggacgauaugccggccauuaugcuggucaauaccccaacugugacccccacaacuaccccucccccagcagcggccguauucacaccuacgcuuagugacaucagcauagauaaguugaaagugucgucucccgaacugccaaagccuuggggagacggcgauuuaccgcucgaggaggaaaaccccaacuccccacaggaggaacugcauccucgagcuauugucaugagcguugccaaggacgaggaacccgagucaauggauuuuccagcacagccucccccgccagagccugugcccuucaugccauuccccgcugguaccaaagccccuaguccgucucaaaugcccggguccgacagcucaacucuugaaaguacacugagcgugaccgucacugagacagaaacccuagauaagccaaucuccgagggcgaaauccucuuuucuuguggacagaaacuggcaccuaagauuuuggaggacaucggccuguauuuaacgaaucucaacgacagccuguccucaacucuucacgaugccguggagauggaagacgaucccccuucugaggggcagguuauucgcaugagucauaaaaaguuccacgcugacgcgauacugucguuugccaagcaaaaucaggaaagcgcaguaucccagcaggcuguguaccauucugaggauuuggaaaacucagucggagagcucagcgagggucaacggccacagcugaccgccgccgcugaaaauauccuaaugggccacucccuguacaugcagcccccugugacaaacacccagagucuugaccaacagugcgauccaaaaccccucucuagacaguucgacacuguuagcgggucaauuuaugaggauuccugugcaagucacggaccgaugagccugggcgaauuggagcuggagccuaauucuaaguuagugcucccaacaacccugcuuacagcccaggaaaacgacgucaaucugcccguggcggcugaggauuuuucccaauaccaguugaaacagaaccaagacguaaagcaggucgaacauaaaccuucacagagcuaucucagggugcguaauaagucggauaucgccccaucucagcaacagguuagucccggugacauggaccgcacucagauugagcugaacccguaccuaaccugcguguucuccgggcugggcguccacgugaaaaagguuagcuguaucggaaaacuuggccucuggcgguuugugauacagaucauuucauccccuagaugggaaucuagcgcaacgcugagguucacagaugcccccugccaagacgucagugaugcugcaguguccgagccacgaggguuguuaagcguaucugagucacagcauaaugccggaggccacgguguguuugggggacgguaucugcucaacggcaagcgccagccugcgcagugucugugccauugguucuga

SEQ ID NO: 58068 - RNA, 3828 nt, Artificial Sequence
  derived and/or modified sequence opt3 from KIAA0825__Homo_sapiens__NP_001139150
auggacugggaugacgaguacagccacaacuccuucgaucugcauugccuccuuaauucuuuucccggcgaccuggaguucgaacagaucuuuucagauauugacgaaaagauagagcaaaacgccgcuaguaucaaacacuguauuaaggaaauccagagcgagauuaauaaacagugcccuggggugcaguugcaaaccacaacugauuguuucgagugguuaacgaacuauaauuacuccaccucugaaucgucauuuaucagccauggagaccugauaaaguucuuuaaaacacuacaggaucuccugaagaacgagcagaaucaggaagagaugacucuugaccuguugugggaucucaguugccacuccucugucagcuucccauccacccugucagguacaaguuuucauuuccugagcagaaccucucuccacuccguugaggacaacucaagcauggaugugaagaguaugugggacgacaucagguuacaucugcggcgcuuucuuguaucuaaauugcaaucccacaaugaaauuaacaauagccagcagaagauccugcucaaaaagcagugucuacaacagcugcuuuuccuguauccggagucggaagugauuaucaaauaccagaacauacaaaauaaguugcucgcaaaccuguuauggaauugcuuucccucuuauaaccgagauuccaaccuggacgucauugcccacggcuaccagucaacuaugcucaaacuuuauagugugaucaaagaggauuucaauacacugugugaaauuuuggcgccuagcuccaugguuaaguucaucaaagagaccuaccuagacacggugacugaggaaauggcuaaguuucuggagaacuucugcgaacuccaguuucgugagaaugccgucagagugguaaaaaccucuaagagcucaaguaaacauaggggagcaguucacgcccuggugacaacugaauguccacagaaggggcggaacuucucccuuccccuggauaaggucgaguuuuugagccaacucaucaaaucuuucaugaagcuggagaaaggcgugcaggaauuauuugacgagauucugcuaucacucaagauaacccgcgauacaagugguauccuggagaaaagcgacagagaaguggucauggaaaagccuagggcuaaugagaccaacauuccauccgagcagucucuucccgggaaggaagcaacguugcuggauuucggauggcggucggccuuuaaagagguuagccucccuauggcucacugcgugguaacugccaucgaaggcuucuccacaaagauacugcagcaagagcagaaugagcgcucaagugcggugucuuacgcaaugaaccuugucaaugugcagcagguuuggcaagacagccauauguuuccagaagaggaacagccgaaaaagauuggcaaauucuguuccgauaucauggagaagcuggacaccauguugccccucgcccuggcuugccgagacgauucauuucaggaaaucagagccaacuuaguggaggcaugcuguaaggucgcuacugccgugcugcagaggcuacaagagcgggcgaaagaaguaccuagcaaggccccacucaaaaaucugcacacauaucuuucuaccgcaguuuacguguuccagcauuucaagcguuaugacaacuugaugaaagagaugacgaagaagcccauuuuucugguccucgugcagcgcuaccaagaguucaucaauacccugcaguuucaggucacaaacuauugcgugagaguuugugcuacuuccauuuuacaggaugccgaaagucaccauugggacgauuacaaagcauucuaugaaggggagaggugcagcuuuucuauacaaauguggcacuacuucuguuggucccugcacuacgaccuuuggaccaucuugccuccaaagcucgcccaggagauucugguggaaguacuagagaaaucacugagucuccuggcaagccgguaugcccgagcucaucccucgcgcaagagaacaccgcagcuuagguuggaugucacuaccauccugaucugcacagaaaauauguuaugguccguguguaccucuguucagaaacuccugaacccucaccaacauacugacgauaagauuuuuaaaauacacacgcacugcaacaaucuuuucacaacccuggugaucuugacuagcccccucaccgagcuguacaagacauuucagcauggacuagacgaaucagcgagugauucccugaagucuuucuuuaaacagccacucuauugggucagcuguauuucccacuucuacccuucacugcuucggacccccagcgcugguggcuugaaggccgaggggcagcugaaauuacuccugagucaaccacgcugcaacuggaaucuucugcuagagacucuccugcaucacgacggauugcuguuaagaauccuccugaagucuuccaaacaggugagcgauacagaaaacaaucuuaaccagggccccucgcugauggaggcuauuuuuaagaucuuguaucauuguucauucucuccucaaacguucgccaauguauuugugaguuacauggaagaggagcagcucugggacuuccuguauaacauaccaguuuccacuugcgucgaauacgagcuagaagugaucaggugccugcgucuugcacucaccgacgccauuaaggauacagugcagcagaucgucagcguuaugucuagccggcgaaauugugagaccaaccugaauaaacacauugugccggacugcuugcuggaauccaugcccaaggaguggaacuacucaccuaaagagacaaauagaaaggaaaguuguaagagcuuuacuagguuaaccgcucaagccgugucuaucguaauauccaagcucccaacggucauugcaugccugcccccuccagugaaguauuucuuuuuccuuucagagcgcaaaaugaguaagaaauuuguugaacugaagaaagcggguuugcucguguggaaccugaucgucauuaucugucggauauucgaggaugggaauaccguggaacuacugacaggagcuagccuugacagaugguccaaggagaagcucggccugaucugcauguguuugaaaucuauuaugggcgaucagacuucgauccacaaccagaugauucagaagguuauccaaagcauagagcagcagaaacccaacuggauugaaaggcaguuacugaaggcccgcaaacucucaaccgagugcgcauuuaugacaaucgaaaaguccacugcccugcaagagggggacguggcucuugaacugaccgagcagaaaaucaauacgaugguauuggaucuaugucauaagccgggaggucgagaguaccugcggcagauuuaucacaucaugcagcucaacgaagaguaccugaaggaacaacuuuucaguaugaacucuagcgaggagaaaccuuuaccaauucguccccugaagacaacccucagauccauagaagaccagccuucagccuuuaaucccuuccaugucuauaaagcauucucugagaauauguuggaucaggugagcaucacuaaguggaacuggaauugggcuaaacugcucccaaacuaccugaggcuugacaagaugacauuuagugugcuguugaagaaucgcugggaaaugaaaaaggaugagacccuagaagaggaggaaaaagccauucuggagcaccucaagcaaaucugcacuccucagaacuccagcgcgucugacaauauugaggaacaguga

SEQ ID NO: 58069 - RNA, 1845 nt, Artificial Sequence
  derived and/or modified sequence opt3 from KIAA0907__Homo_sapiens__NP_055764
augagcgccggcuccgcuacccaccccggggcaggagguagaaggucuaagugggaccagccugccccagcgccgcuccuguuccuucccccugcugccccaggcggggaggugacaucaaguggaggcagccccggugggacuacggcagccccuuccggagcucuggaugcagccgcugccgucgcggcaaaaaucaacgccauguugauggcuaagggcaaauuaaagccaacccaaaaugccucugaaaaacugcaggcacccggcaaggggcuaacaucgaacaagucaaaagacgaucucguuguggcugagguagaaauuaaugacgugccucugacuugccggaaccuucugacccgcggacagacacaggaugagauaagccgauugaguggugccgcggucuccacccguggcagauuuaugacuacagaagagaaggccaaaguggggccaggagacaggccgcucuaccugcauguucaaggccagacccgggagcugguggaucgcgcagucaauagaaucaaggaaauuaucacgaacggugugguaaaagcugccacugggaccucucccacauucaauggagcuacuguuaccguguaucaccagccugccccaauugcacagcucagccccgccgucucccaaaagccuccauuucagucaggcaugcauuacgugcaggacaaguuauucgugggccuggagcacgcuguccccacauuuaacguuaaagaaaagguggaggggccgggauguaguuaucuucagcauauccaaauagagaccggugcgaaaguauucuugaggggcaaggggagcggaugcaucgaaccugcaucuggccgggaggccuuugaacccauguacauuuauaucucccacccaaaaccugagggucuggcugccgcaaagaaacuaugugaaaaucuccugcagacggugcacgccgaguacucacgcuucgucaaccagauuaauacugcugugccccuuccaggguauacacaacccagcgccaucaguucuguuccuccacagccgcccuacuacccuuccaacggcuaucagagcggauacccaguggucccuccuccacagcaacccgugcagccgccuuauggcguaccaucgauaguucccccugcagugucucuggcgcccggggucuugccagcucucccuaccggagugcccccagucccgacucaguacccuauuacacaggugcaacccccagccuccaccggucagucacccaugggcgggccuuuuaucccagcagcccccguuaagacggcucugccugccggaccgcagccacagccccaaccucagccacccuuaccuagucagccgcaggcacaaaagcgaagauucaccgaggaacugcccgaugagagggaaagcggccuccuugguuaucagcaugggccaauucacaugacaaaucugggcacuggauuuuccucucagaacgagaucgaaggcgcugggagcaaaccugccucaaguuccggaaaggagcgggagcgugaccgccaauugaugcccccacccgcguuccccgugaccgguaucaaaacagaaagcgaugagagaaauggcucugggacucuaaccggaucacaugacuacccagccaagaaaaugaagacaaccgaaaagggcuuuggucugguagcuuaugcagccgauaguagcgacgaggaagaggagcacgggggccacaaaaacgcuuccucuuucccgcagggauggucgcucggcuaccaguacccuagcucccagcccagggccaagcaacagaugccauucuggauggcacccuga

SEQ ID NO: 58070 - RNA, 4833 nt, Artificial Sequence
  derived and/or modified sequence opt3 from KIAA0922__Homo_sapiens__NP_001124479
auggccggccugagaaggccccagccugggugcuacugucggaccgcugcagccgugaaccuccuucugggagucuuccaaguuuuguuaccaugcugucgcccggguggcgcgcaggggcaggcuaucgagccccugccuaaugugguagaacuauggcaggccgaggaaggagagcuccugcuuccaacacaaggcgacagcgaagagggucuggaggaacccucccaggagcagucuuuuucagauaaguuguucagugggaaaggacuccacuuucagccuagcgugcuggacuucggcauucaauuucugggccauccagucgcaaagauacuccacgccuauaaccccucccgagauucugaagugguuguuaauucggucuucgcugcagccgggcauuuucacgugccuccaguaccgugccguguuauccccgcuaugggaaaaacuucauucagaauuaucuuuuuaccuacggaggaggguagcauugaaaguucccuguucaucaacaccucuagcuacggcgugcuuuccuaucaugucucagggauaggaacaaggcggaucaguacugagggcagcgccaagcaguugccaaaugcguacuuucugcuacccaaagugcagucuauucagcucucccaaaugcaggcagaaaccacaaacaccucacugcuucaggugcaacuggaguguagcuugcacaauaaggucugccagcagcucaaggguuguuaucuggaaagugacgauguuuuacgccugcagaugucuaucauggugacuauggagaacuucuccaaagaguuugaagagaauacacaacaccuccuugaccaucugagcauuguauacguggccaccgaugaaucggagacgucugacgauuccgcugucaacauguauaucuugcacucagggaauagucuaauauggauucaggacaucagacauuucagccagagggaugcccugucccuccaguucgaaccugugcugcuuccaacuucuaccacaaacuuuacuaagauugcuagcuuuaccugcaaagcagccacaucaugugacaguggaaucaucgaggauguuaagaaaaccacgcacacucccacacugaaggcgugcuuguuuuccagcguggcccaaggcuacuuccggauggacucuucagcaacccaguuucacauugagacucaugaaaauacaaguggccucuggagcauaugguaccgcaaccacuucgaccgauccgucgugcugaaugauguauuuuuaucuaaggagaccaaacauaugcugaagauccuaaacuucacggggccgcucuuucugccucccggauguuggaacauuuucucgcuuaaauuggcuguuaaggacaucgccauaaaucuguuuaccaacguguuccucacaacuaauauuggugcuaucuuugccaucccacugcagauuuauagcgcaccuaccaaagaaggcucccuuggguucgaggucaucgcccacugcggaaugcauuacuucaugggcaagucaaaagcugguaaccccaauuggaacgggagucugucuuuggaucagagcacauggaauguggacuccgaacucgcgaacaagcuguaugagagauggaagaaauacaagaauggcgaugucugcaaaaggaacguguuaggaacuacccgguuugcacaccugaagaaaucaaaggagagcgaaucuuucguuuucuuccuaccacgucucauugccgagcccggccugaugcuuaauuuuuccgcuacagccuugcgcaguagaaugauaaaguauuucgugguacaaaacccuagcucuuggccagucucccugcagcuccugccguuaucacuguaccccaaaccugaagcacuugugcacuugcuccauaggugguuugggaccgacaugcagaugaucaauuucacuacgggagaguuucagcugacagaggccuguccauaucuagguacccacagugaagagagccgguucggcauucugcaucuccaucugcaaccccuugaaaugaagcgaguugggguggucuuuacuccugcugauuacggaaaagugaccucguugauccugauccgcaacaauuuaacaguaauugacaugauaggcguggaggguuucggggccagagaacuccugaagguuggcggaaggcuuccaggcgcagggggaucccugcgguuuaaaguccccgagucuaccuugauggauugccgcagacagcucaaggacagcaagcagauccugucaauuacuaaaaacuucaagguggagaacaucgguccgcuaccuauuacagugaguucccugaaaaucaauggcuacaacugucaaggguauggauucgaaguccucgauugccaccaguuuucucuggacccaaauacgagcagggacauauccaucguuuucacccccgauuuuacuucaagcugggugauucgugaccuuaguuuggugacagcggcugaucuggaguuccgguuuaccuuaaacguaacacucccucaccaucugcuuccccugugugccgacgucgugccaggcccuucuugggaagaguccuucuggcgacuaacuguguuuuucgugagccucucgcuguugggugucauccugauugcauuucagcaggcccaauacaucuuaauggaguucaugaagaccagacagaggcagaaugcuucaucuaguucccagcaaaacaaugggcccauggaugugauaagcccacacucuuauaaaagcaacugcaagaauuuucucgacacguacggcccguccgauaagggacgcggcaaaaacugucugccuguuaauaccccacagucacggauucagaacgccgcaaagagaaguccagcuacauaugggcacagccagaaaaagcauaaaugcucuguguacuauuccaagcacaaaacuucaaccgccgcggccaguagcacauccacuaccacggaagagaagcaaacaucuccccuuggaucgagccugccugcugcaaaggaagacaucuguaccgaugccaugagggagaauuggauuucauugcgcuacgcuuccggcaucaacguaaaucuccagaaaaaccugacucuaccaaagaaccugcuuaauaaagaagagaacacacucaagaauaccauagucuucaguaaccccucuagcgaaugcuccaugaaagaggguauccagacuuguauguucccuaaggagaccgacauuaagacaucagaaaauacggccgaguuuaaagaacgagagcugugcccguugaagaccucuaaaaagcugccagagaaccacuuaccccggaauagcccucaauaccaucagccagaucuccccgaaaucagucguaaaaacaaugggaacaaucaacaggugccugugaagaacgaggucgaccacugcgaaaaucugaagaaaguugauacuaagccguccagcgagaaaaagauucauaaaacaucuagagaagacauguucucagagaagcaggacauccccuuuguggagcaggaagauccauauaggaagaaaaagcugcaggagaaacgcgaaggaaaccuucagaauuugaacugguccaagagucggaccuguaggaaaaacaagaaaagaggcguagcaccugugagccgacccccagagcaaucggaccucaagcuggucugcucugauuucgaacgcuccgagcuaagcucagacauaaaugugcggaguugguguauucaggagucuacaagagaaguuugcaaggcggaugccgagaucgcuuccagccugccugccgcacagagggaagcugaggguuacuaucagaaacccgaaaagaaauguguggacaaguuuugcucagauaguagcuccgacuguggcucuagcuccgggucaguccgugccucucgcggaaguuggggcucguggagcuccacuucuucaagcgauggggacaaaaagccaaugguggaugcacaacacuuccuuccggccggagacuccguuagucagaacgauuuuccuucugaggcucccaucagccucaaucugucacauaacauuugcaauccaaugaccgugaacuccuugccccaguacgcggagccuaguugucccagcuuacccgccggcccuacgggugucgaagaggacaaggggcuguauucuccgggagaccucuggccaacacccccuguaugcgugaccuccucacugaauuguacucuugaaaacggcguucccugcgugauccaggagagcgcaccaguccacaauucguucauugauuggucugcuaccugcgagggucaauuuaguuccgccuacuguccucuggaauugaacgacuauaaugccuuccccgaggaaaacaugaauuacgcuaacggcuuuccaugcccugcagaugugcagacagacuucauagaucacaauagccagucaacuuggaacaccccgcccaauaugccagccgcgugggggcaugcuuccuuuaucucuagcccucccuaccuaacaaguacgcggucccugagcccaaugucuggacucuucggcucaauuugggccccucaaagugacguauaugagaacuguugccccaucaacccgaccacugaacacuccacacauauggagaaucaggcaguggucuguaaagaguacuauccaggguucaacccuuuuagagccuacaugaaucuggauauuuggaccacuacagcuaacaggaaugcaaacuucccccuuagccgagacucuucguauugcggaaauguuuga

SEQ ID NO: 58071 - RNA, 2751 nt, Artificial Sequence
  derived and/or modified sequence opt3 from KIAA1024__Homo_sapiens__NP_056021
auggagaccagccaggaaacaucccuguuccucgugaagauccuugaggaacuggacucuaaacaaaacacugucucauaccaggauuugugcaagaguuuaugugccagauuugaccugagccagcuagcuaaacucagguccguucuguucuauacggcaugccuugaucccaauuuuccugccacccuguucaaggacaaaaugaaguguacagugaacaaucagcaaucuaagaaaauuaugguagcggcugauauagugacuaucuuuaacuugauucagaugaauggcggggccgcaaaggagaaacucccaaccggacggcagaagguccgcaaaaaggaagccucguucgagucaugccgaagcgacacagagaucuguaacgcugcagaaugcgagccgcugaauugugaacugagugagcguuccuuuucuagagguuaccccauuaggcagagcuccaagugccggaaaauggauuguaaggacugcccucaauucgugccagccucagagcccaacuuucucuuaggcguuaguaaagaagugaagaaucgcgcugccagccuggauagacuucaggcguuggcaccuuauucugucaccuccccacagcccugugagaugcagaggacuuacuucccuaugaacaucgaaaaugagucaauaagcgaccaagauagucugccaaucaaccagucuauuaaagaaacauuuaucuccaaugaggagccguucgugguacagagcugcguucaaaagcggaacauuuuuaaagaagacuuccacaaucuaauggccgugucgcccucucucgucgggccuaucuccaaggcugagaacgaacaucgcgagccacagucacgaaaggaaccccacaaaccuccauucuuuaaccauaguuucgagaugcccuauaauagccaguaccugaacccgguguauuccccugugcccgauaagagaagggccaaacacgagucucuugacgaccugcaggcaagcaccuacuuuggaccaacgccugucaugggcacucaagaagcucggcguugcuuggguaagcccaauaaacagaccccauggcccgccaagucauggagucucaacacagaggaaguuccugauuucgagcgcuccuuuuucaauagaaacccaagcgaagagaagcugcauuacccgaaugcgucuucacagacucccaacuuuccugccccagagaggcggcccaccuauuuagugccuaaagaccagcaaccaauacugcccauugcauacgcugccaagcagaaugggcucaaaaguaaggaaaucagcuccccgguagaucuugagaaacacgaaccugugaagaaguucaaagacaagucuauuaacuguacaucgggacagcugagcuccgauaccucaagugucggcacgcagacugagcacguguuggagcccaaaaagugccgagaccuauguacaucuggccaagggaaauauagcgaucgccauaccaugaagcacuccgacgaugacucagaaaucguuagcgaugacaucucugacauuuuuagauuccuggaugacauguccauaaguggaagcacuggugugauccagucuuccugcuacaauucaacaggcagucucagccagcugcauaagucggauugugacuccucuccagagcacaaccuuaccaaaauugcuaauggggucccuaacagcaagggagauaaaggcaauaggcccgaaaacacgcaccauucagaggaagaacugaagaccagugugugcaaauugguacuccggaucggugagauagaacgcaagcuggaguccuuaucugggguuagagacgaaauuagccaggugcugggaaaacuaaacaagcucgaucaaaagaugcagcagccagagaaagucuccgugcaaaucgaccugaauagccuuacaagcgaaggcccuagugaugacucugccucccccaggauguuucacgcacauagcggcucgcacgggccaaaguuggagaacaauccggauugguguugcucagacgccucuggaaguaacuccgagagccugcgugucaaagcucucaagaaaucucuguucacucggccuagcucccgaucacuuaccgaagagaauagugcgacagaaagcaagaucgcaucuauuuccaacucacccagagauuggaggacuaucaccuauacaaaucgcgugggucugaacgaggaagagauuaaggacaccggcccaggggacaauaaagauuggcaucggaagaguaaagaggccgacagacaguacgauauacccccucagcacagguugccaaagcagcccaaagacggauuucucguugaacaaguguucagcccucacccguauccagcuucccugaaggcccauaugaagucuaaccccuuauacacugauaugcgccugacggagcuagcagaaguaaaacgaggccagccuucguggacaaucgaggaguacgcccggaaugcuggugacaaggggaaacucaccgcccuggaucuucagacucaggaaucauugaacccaaauaaccuggaguauuggauggaagacauuuacacccccggcuaugauucacuccugaagcguaaagaggcagaguucagaagggcgaaggucuguaagaucgcugccuuaaucgcagccgcugccugcacagugauucugguuauaguggucccuaucuguaccaugaaauccuga

SEQ ID NO: 58072 - RNA, 3522 nt, Artificial Sequence
  derived and/or modified sequence opt3 from KIAA1033__Homo_sapiens__NP_056090
auggccguggagacccugagccccgacugggaguucgauagagucgacgauggcucccagaagauccacgcugaaguucaacucaaaaacuacgggaaguuucuugaagaguauacaucucagcugaggcggauugaagacgcauuggaugacucaauaggagaugugugggacuucaauuuagauccuaucgcccugaaacuacucccauacgagcagaguagccugcuugagcugauuaagacugaaaacaaaguauugaauaaggugaucacggucuaugcggcucucugcugugagauuaagaaacugaaguacgaagccgagaccaaauuuuauaacggucuucucuucuacggcgagggggcaacagacgccuccaugguggaaggagauugccagauccaaaugggccgcuuuauaucuuucuuacaggagcugucguguuuuguuacucgaugcuaugaaguggucaugaaugugguacaucagcuugcugcauuguacaucucaaacaagauugccccgaaaaucauugagaccacagguguucacuuccagaccauguacgaacaucugggggagcuacucacugugcugcuuacacuggacgagaucauagauaaucacauuaccuugaaggaccauuggacgauguauaagcgucuccugaaaagcguccaccacaaccccaguaaguuuggaauccaagaagagaaauuaaagccuuucgaaaaauuucugcucaagcuggagggccagcuguuggacggcaugauuuuccaggcuuguaucgaacagcaauuugauucccuaaaugggggagugucugugagcaaaaacuccacuuucgccgaggaguucgcgcauucaaucagaaguauuuuugcaaaugucgaagccaagcugggugagccaagcgaaauagaccagagggauaaguacguuggcaucugcggacucuucgugcugcacuuucagauuuuccggaccaucgacaaaaaguuuuauaaaucucuucuggauauauguaagaaaguacccgcuauuacauugacugccaacaucaucugguucccugacaauuuucucauucaaaagaucccagcagcugccaagcuguuagaucgcaaaucccugcaggcgauuaagauacauagagacaccuuccuacagcagaaagcccaaucacucacaaaggaugugcagagcuacuaugucuuugugaguucuuggaugaugaaaauggaguccauccugagcaaggaacagaggauggacaaguucgcagaggaucuuaccaaccggugcaauguuuuuauucagggauucuuguacgcuuauucgaucucuacgaucauuaaaacuacaaugaaccuguacauguccaugcaaaagcccaugaccaaaacuucagugaaggcccucugucgccuggucgagcuucugaaagcuauagaacacauguuuuaccgaagaaguauggugguagccgacagcguuucccacaucacacagcauuugcagcaccaggcacuccauucuauuagcguggccaagaagagggucaucucagacaaaaaguauagugagcaacggcuggauguguuauccgcucugguccuagcggaaaacacccucaauggcccuagcacgaaacagcgucgccugauugugucucuugcauugucaguugguacccagaugaagacauucaaagacgaggagcuguucccacuccaggugguaaugaagaaacuggauuuaaucagugaacugagagagaggguccaaacucagugcgacuguugcuuucuuuacuggcaccgggccguguucccgauauauuuggaugacguuuacgaaaacgcuguggaugccgcacgacuccauuauauguuuagcgcccugcgcgacugcguccccgcuaugaugcacgccagacaccuagaguccuacgaaauccugcucgauuguuaugacaaggagauuauggagauccugaaugaacaucuuuuggauaagcugugcaaagagauugaaaaggacuuaaggcucucugugcacacccaucugaaacuugaugaccggaacccuuucaagguagggaugaaagaccuggcauuguuuuucucgcucaauccaauccgcuuuuucaacagauuuauagauauuagggcguacgugacacacuaccuggacaagacuuucuauaaucuaaccacaguugcucugcacgauugggccaccuacagcgagaugcguaaccucgcaacucagcgguauggacuggucaugacggaagcccaucuucccucccaaacauuggagcagggccuggacguguuagagaucaugcgaaauauucacaucuuugugucaagauaccucuauaaccugaauaaccagauauucaucgaaaggaccaguaauaacaagcaucuuaauacuauuaacauccgccacauugcuaacucuauccggacccauggcacagggauaaugaauaccacugucaacuuuacauaccaguuccugaaaaagaaauucuauauuuuuagccaauucauguacgaugagcacaucaaguccagacuaaucaaagacauuagguuuuuccgcgaaaucaaggaucagaaugaccacaaguacccuuuugaucgagccgagaaauucaaccgggggauucguaagcucgguguuacgccagaaggccagucauaucuggaccaguuuagacaauugauaagccagaucgggaaugcaaugggauacgugaggaugauucgcucuggcggucugcauuguuccaguaacgcuauccgguucgugcccgauuuagaggacauuguaaauuuugaggaacucgucaaagaggaagggcuggccgaggagacccuuaaggcggccagacaccuggauagcguguugucugaccauacuaggaacuccgcugaaggcacagaguauuucaaaaugcucguugacguguuugcaccggaguuccgacgcccuaagaauauccaucugcggaacuucuacauaaucgugcccccacuaacccugaauuuugucgaacacucaauuaguugcaaggaaaaacuuaacaagaaaaauaagaucggagccgcuuucacagaugacggcuuugccauggggguugcauauauucucaaacuguuggaucaguacagagaguucgacagccugcacugguuucagucggugagggagaaguauuuaaaagaaauccgugcgguagccaagcaacagaacguccaguccgcuucucaagaugagaagcuccugcagacuaugaaucuuacccagaaacgccuggacguguacuugcaggaguucgaacuccuguacuuuagccuaucaagugcccggauauucuuuagagcagauaagacggcugccgaagagaaccaagagaaaaaggaaaaagaggaagagaccaagacauccaacggagaccugucugauagcacuguguccgcagacccugucguuaaguga

SEQ ID NO: 58073 - RNA, 15018 nt, Artificial Sequence
  derived and/or modified sequence opt3 from KIAA1109__Homo_sapiens__XP_005263344
auggaccagagaaagaacgaaagcaucgugcccuccauuacccaacuggaagauuuccucacagaacacaauucuaacguaguuuggcuucugguggccacuaucuugucaugcggcuggaucauuuacuuaacguauuacaauaguaggaacguagggcugauccucacccucgugcugaaucggcuuuauaaacauggcuacauucacaucgguagcuuuuccuucucuguccugucgggcaaggugaugguucgcgaaaucuauuacaucacagaggacaugucaauucgaauccaggauggguuuauuaucuuccguugguggaaaauguauaacccuaagcagaaacagcaugacccaaaggcugaaacuagauuguacauaaccgugaaugauuuugaguuccacgucuacaacaggagcgaccucuauggacggcugcaagagcuguuuggccucgaaccgacaauuauacccccuaagaaagaugacgauaagacccgcgagauugguagaacuaggacacagaguaaaaucgaacgggugaagguaaaaaccgagucccaggacccaacgucuagcuggcgcuccuuaauccccguuauuaaggugaaugucucaacugggcgacuggcauucggaaaccauuaccagccucaaacccuuuguauaaauuuugaugacgccuucuugacauauacuaccaagccacccaguagccaccuggaucaguuuaugcacaucgugaaaggcaagcucgagaacgugagagucaugcucguuccuucuccaagguacgugggccugcagaaugacgaaccgccccggcuuaugggggagggauucguagugaugcaguccaacgacgucgauauuuauuacuauauggacgaaccuggucuggugccagaggaaacagaggagaauaucgaaggcgagaugucaagcgaagauugcaaauugcaagaccuacccccuuguugggggcuggauauaguuugcggaaagggcaccgacuuuaacuacgguccaugggcggaucgucagcgcgacuguuuauggaaauucuucuuucccccggauuaccaggugcugaaggucagugagauugcucaaccugggagacccaggcagauccucgccuucgaacuucggaugaacaucauugcagacgccacgaucgaucuguuguuuacuaaaaaucgagagacaaacgcugugcauguaaauguuggagcaggcucuuauuuggagauuaacauaccaaugaccguggaagagaauggcuacacuccugccaucaaggggcagcugcuccacgucgacgcuacaaccuccaugcaguaucgcacgcugcuugaagccgagaugcuggcguuccauauuaacgcaagcuaccccagaaucuggaauaugccacaaaccuggcagugcgaauuggagguguauaaggccacauaccacuuuaucuucgcucagaaaaacuuuuucacugaccucauucaggauuggucgucugacucacccccugauauauuuagcuucgucccauauaccuggaauuuuaagaucauguuccaccaauuugagaugauuugggccgcaaaccagcauaauuggaucgacuguaguacaaaacagcaggaaaacguguaccuggcugccugcggagagacuuuaaauauugauuucagccugccguucaccgacuuuguucccgcgacauguaacaccaaguucucccuaaggggugaagauguggaccuccaccuguuucuuccugauugccauccaucuaaauacagcuuguucaugcugguaaagaauugucaccccaacaagaugauccaugacacuggcauaccugccgagugccaaucagggcagaaaacggucaagccaaaauggcggaacgugacacaggagaagaguggauggguugaaugcuggaccgugcccuccgucaugcucacuaucgauuauaccuggcacccgauuuacccucagaaagcagacgagcaacugaagcagagccuuucugaaauggaggaaacaaugcugucaguguugcgcccaagucagaagaccagcgauagaguaguguccucucccucgacuagcuccaggccucccaucgacccaucagagcucccucccgacaaacugcacguugagauggaauuaaguccagauucucaaauuacacuguauggcccgcuacucaaugcuuuucuguguaucaaggagaacuacuucggugaagacgauauguauauggacuuugaggaagucauaagcuccccugugcuuucauugagcacgucuuccaguagcggguggaccgccgugggcauggagaaugauaaaaaggagaacgaaggaucugcuaaauccauucauccccuggcccuccguccaugggacaucacuguccugguuaauuuauacaaggugcacggccggcugcccgugcaugggacaaccgauggaccugagugcccaacagcauuccuugaacgauuguguuuugagaugaagaaagguuucagagaaacuaugcuccagcugauucuaucaccccugaacguauuugucagugacaauuaucagcagaggccuccgguggaugagguucuccgcgagggccacaucaaccugagcgggcuucaauugcgggcccacgcuauguucucggcggaaggacugccauuaggcuccgacucucucgaguacgcauggcugauagaugugcaggccgguagccuuaccgcuaaggucacggcaccccagcuggcaugcuugcucgaaugggggcagaccuuuguguuccauguuguguguagagaguacgagcuggaaaggccuaaaucaguaaucauuugccaacacggcaucgaccgccgauucugugagaguaagcuauccugcauuccaggacccuguccuacaucugaugaccugaaauauacuaugauccggcucgccgucgacggcgcugauauauacauuguggaacaugggugcgccaccaauaucaagaugggagcaauccguguggcgaacuguaaucugcacaaccagagcgucggugagggcauuuccgcugccauccaggacuuucagguuagacaauauauugaacagcuuaauaacugcaggauaggguugcagccggcagugcugcgccgggccuacugguuagaggcuggaucagccaaucucggccugaucacaguagauauugcacuugcugccgaccaucacagcaaacacgaggcgcaaagacauuuccuggaaacucacgaugccaggaccaagcgacuaugguuucucuggcccgacgauauccugaagaacaaacgcugccggaacaagugugguugccuagggggcuguagauucuuuggaggcacggugacagggcuggacuucuuuaaauuagaggaacucaccccaaguucuuccagcgcuuucucgucaacuucugcagagagugauauguauuacggacagucccugcuucagccuggcgaauggauuaucacaaaggagauacccaaaaucauugacgguaaugucaacgggaugaagaggaaggagugggaaaauaaaagcgugggaaucgagguugaacguaagacccagcaucugucuuugcaagugccacuccgcagccacuccucaaguuccucuuccgaggaaaacucaaguagcuccgccgcucagccucugcuagccggcgagaaagagucucccucgagcgucgcagaugaccaucuggugcagaaggaauuucuucacgguacuaaacgggacgauggccaggcgucaauuccaaccgagaucuccgggaauaguccgguuucuccuaacacacaagacaagagcgugggacagagcccccucagaucaccacugaagaggcaggccucugucugcagcacgcgauugggcaguaccaaaucccugacugcugccuucuauggggauaagcagcccguaacagugggaguucaauuuagcucugacgugucacgguccgaugaaaaugucuuagacaguccuaaacagcgcagguccuucggcucguucccauacacccccucugcagauuccaacagcuuucaccaguacaggucaauggacaguucuauguccauggcugauagcgaggccuauuucucagcagccgaggaauuugagccuauaaguagcgacgaagguccggggacauacccaggacggaagaaaaagaagaaacagacucaacagauugauuauucccgaggcucuaucuaccauagcguggaggguccccucaccggccacggggaauccauccaggacucaagaacgcugccuuucaagacacaucccucucaagcuaguuuuguaucggcgcuuggaggcgaggaugacgugauugagcaccuguauauagucgaaggggagaaaaccguugaaagcgagcagaucacuccacagcagccugugaugaauuguuaccaaaccuauuugacacaguuccaggugauuaacugguccgucaagcaccccacuaauaaacgcaccucuaagucaagccuccauaggccacuggaccuagauacaccuacguccgaagagaguucuagcucauuugagcagcuguccgugccgaccuucaaaguuaucaagcaaggacuuacugccaacagucuccuggaccguggcaugcaguugagcgguucuacauccaauacccccuacacuccauuagaaaagaaacuggcagauaacacagacgaugagacccucacggaagaguggacucuggaccagccuguaucacagacccggacaaccgcuauuguggaagucaaggggacuguggauaucguucuuacaccccugguggccgaggccuuggacagauacauagaggcuaugguccacugcgcaagcaccaggcauccagccgcgaucguggaugaccuacacgcuaaaguacugcgcgaagccguccaaaauucgaagacaacuuuuucugagaaccucaguuccaaacaggauauucgaggaaccaagacggaacagagcacaaucggcaccacuaaccaaggucaggcacagaccaaucugacaaugaagcaggacaacgugacuauuaaaggccuucaaaccaauguuucaaucccuaaggugaacuuaugucugcuccaggccuccgucgaggagucucccacgacagcuccgagcagaagugugacccauguuuccuugguggcacugugcuucgaucggauagccacucaggucaggaugaaucgcggggugguagaagagacaagcaacaaugcggaaccaggacguaccucuaacuuugacagauaugugcacgcuacuaaaaugcagccucaaucaaguggcucccuccggagcaaugccggggcagagaagggaaaagaaauugccgcuaagcugaacauccacaggguucauggccagcuucgcggucuggacacaaccgauaucgggacgugugccauuacugcaauccccuucgagaagucuaaagucuuguuuacccuagaggaacuggacgaguucacauucguggaugaaaccgaccagcaggcugugccagaugucacacgaauaggacccucgcaagagaaguggggcuggauuauguuugaaugcggccucgagaauuuaacuaucaaagggggaagacagucaggugccguacuguacaacagcuucggcauuauggggaaggcguccgacaccgagcggggaggcgugcuuacgaguaauaacucuagcgauuccccuacagguucaggguauaauacugacguuagugaugacaaccugccgugugauaggaccucucccagcuccgaccucaauggaaacucagugagcgacgaacaggaugagggcgucgaaucugacgauuugaaaaaggaccugccacucaugccucccccuccagauuccugcaguaugaagcugacaaucaaagagauaugguuuagcuucgccgcacccaccaacgugcgcucgcacacucaugcuuuuuccagacagcuuaaucuacugucuaccgccaccccugcuguuggcgcaugguuggugccaauugaccaauuaaagucaagccugaacaaacucgaaacggaggggacucugaggaucugcgccgucaugggauguaucaugaccgaggcccuugaaaauaagagugugcacuucccccugcgguccaaauacaaccgucucacaaagguagcucgcuuuuugcaggagaauccgucuugccugcuauguaacauucugcaccauuaucuccaccaggcgaauuacagcaucauugaugacgcaaccaugucagauggucuuccugcccuggugacuuuaaagaaaggcuugguugcucuggcccgacaauggaugaaguucauagucgugacaccagcauuuaaaggggugucccuccauagacccgcccagccucugaagccacagaucgcuauggaccacgaacaugaggauggacuuggccuggacaacggugggggacuccagagugauaccagcgcggacggcgccgaguucgaauuugacgcagcuacggucucugagcacacuauguugcuggaaggcacagccaauaggcccccgccugggucauccggacccguuaccggugcagagauuaugcggaaauuaagcaagacccacacucauucugauagugcccuaaaaaucaagggcauccacccauaucauucgcuguccuacacaagcggggacaccgcuacagauucaccugugcacguaggacgcgccggcaugcccgugaaggacucuccaagaaaagaaagccuccuuuccuaccugacugguaguuuccccucauugcacaaccugcucgaggggacgccucaaaggucuagcgcggcagucaaguccaguagccugacccggacaggaaauacuguggccaccgauaugcuuuccgagcauccacuccugucugaaccgucaagcguuucguuuuauaacuggauguccaaugcugugggcaaccgaggcagugucuugcaggagucucccguaacaaaaagcgggcacaauucacugccuaccggaguggccccaaacuuacccacuauuccuuccgcuucugacuucaacacgguucuaaguagcgaucagaauacccuggacgguacacauucccagcacucaacuagccaagaugacguggcaggcgucgaagaggccaaccagggguucccagcugugcagcucgccgaugcacaggucguguuuaagccccuucugucucauaccggaauacaaagucaggacacaaugccuuucugcuacagaauguauuuuggcgaacacuuguccuucagcgguacccuggacugucuccgcgcggauaucguugacucagauacugccaaagagaggaaggggaagcgggcucguagacagggacacgugaaucugccgccacuugaguuuaaacccgccuuaaugcugggcacauucucuauuuccgcaguagugauggaaaagucggucugcacgccucaaaacagcaccagugcucucucuuuucaugacuuguccaaaagguacuauaauacuuuccacuguaacuuuacaaucagcugccagucaauuagucagcauguugauauggcccuggugcgccuaauccaccaguucuccaccaugauagacgauaucaaggcaacccaaacagacauuaaacugagccgguacacugccggcucugcuucacccacgccaaccuuuaagacacgaaagcauagagauuucaggagcuccgacuuuucucgcaguucgcgggggagccucaauggagguaacagagucaauaacgcgaaaaauaagcguacuaacaaugagaacaauaaaaaggaauccaggaacaaaaacucacuuggccggucugagcgccgaaccagcaaggugaguagaaagggguccaaagauguaguggaccacaugacaauccacauggaugacucagacucuauuaccguuagcgaacaguccgagccuagugccgaguguuggcagaauauguauaagcuguugaacuucuacagccugaucucugaucccacuggaauacucgaaaaaucauccgagacguucggcccagccggugugaggagcccgacagaaccuaccugcaaggucguguuugagaaugagcaggacaacaguucucugacuaaaacccaacggaagcgcuccuuagucacaucggaaccccagcaugugacucuuauuguuuucgggaucggcaugguaaauagaacccaccuggaggcugauauuggaggccucacaauggaaagcgagcuaaaaaggauccaugggucauuuacgcugaaggaaaagaugaaagacguguugcaccagaagaugaccgagacuugugccacagcccacauaggaggugucaacaucgugcugcucgagggcauuaccccaaauauccagcuugaagauuuccccacuuccccuacaucuaccgcaaaacaagaguuucugacgguugugaagugcaguauugcuaaaagccaggccuuguacucagcgcagcgagggcugaagaccaacaaugcugccgucuucaaggugggagcaaucuccauaaacauuccacaacaucccgccacacuccacagcaugaugguacggucuagucaucaguuauccaaacagaucagcgaccugauccgucagccuucaacugcuccgcaaccagugaaggaagauauugcaacaccccuuccuucugagaaaacaccaacuucgguuaaucagacccccgucgaaacaaacgaguuuccucagcugcccgagggccuagaaaagaaaccaaucgugcucaaguucagcgccaugcuggacgguauagcgauuggggcugccuugcugccgucccucaaggcagaguauaaaaugggcagaaugcgcagucacggaaugaccggcgcccagacuagguuuacguucgaacuuccuaaucaucggcugagauuuacaucuaaggugucagcuaccgauaugagcacuauacccccauccgccaguuuaaaccugccucccgucaccaugucugggaaauacauuauggaggaacacgacagcuauuccgaucaaguuuggucaaucgacgaguugccaagcaagcagggauacuaucuccaggguaauuaccugcgcugcguggcagagguaggcucuuucgaacacaaccuaacaacggaucuucugaaccaucucguguuuguccagaaaguguucaugaaggagguuaaugaagugauacaaaaggucuccgggggagagcagccuaucccccuguggaacgagcacgacggcaccgcugacggugauaaaccgaagauuuugcuguauagucucaaucuucaguucaaagggauccaggugacugccacaaccccaucaaugagggcgguacgauuugaaacuggccugauugaguuagaacugagcaaccgguugcaaacaaaggccucgccuggauccucuaguuaccucaaacuguucggcaagugucagguugaccuaaaucuugcacuggggcagaucgugaaacaucaagucuacgaggaagcuggaagcgauuuucaccagguggccuauuucaagaccagaauuggccucaggaacgcacugcgcgaggagaucucagguuccucugaccgugaagcuguguugauaacauuaaaucggcccauugucuacgcccagccaguugccuuugauagagcggugcuguucuggcucaacuauaaggcugcauacgacaauuggaacgagcagaggauggcccuucacaaagauauccauauggcuacuaaggaaguaguggacaugcugcccgggauccaacagaccagcgcccaggcauuuggaacgcuauuccugcagcucaccgucaaugauuugggcauuugccugccuauaacaaacacugcccaaaguaaucacaccggugaccuugauacaggcuccgcucuggugcucacuaucgagagcaccuuaauuacggcguguucuucagaaucccugguuagcaaagggcauuuuaagaacuucugcauccgcuuugccgacggauucgagacaaguugggacgauuggaaaccggagauucacggcgacuuggugaugaaugcaugugucgugccagaugggaccuaugaaguaugcucucgaacuacaggacaggcugccgcagagucauccagcgccggcaccuggacucugaacguucucuggaagaugugugguaucgacgugcauauggaucccaacauagggaagcggcuuaaugcucugggaaacacccuaacaacgcugaccggcgaagaggacaucgaugacauugccgaucucaauucggucaacaucgcggacuugucugaugaagacgagguggauacuaugaguccuacaauucacaccgaggcaacugacuacagaaggcaggccgcuuccgccagccagcccggugaacugcgcggcagaaaaaucaugaagcggauaguugacauuagggagcuuaaugaacaagcaaaagugaucgaugaccugaagaaauuaggggcuucagagggaacaaucaaccaggagauucagcguuaucaacagcucgaaucugucgccgugaaugauauacgacgcgacguaagaaagaagcugcggaggagcuccaugcgcgcugccaguuugaaagauaaguggggccugucauacaaaccaagcuacuccagaucuaagaguaucagcgcauccgggcggccuccccucaaaaggauggagcgagcgucaucucgugugggagaaaccgaggaacuuccagagauuagagucgacgccgcuucgccuggcccgcgcguuacguuuaacauccaggauacauuccccgaggaaaccgagcuggaccuacugagcgugacuauugaagguccaucccacuauaguucuaauagcgaggggucaugcuccgucuucagcucuccuaagacccccggaggcuuuaguccaggcaucccuuuccagacagaagaggggcggagggaugacucccucucaagcacuucugaggauucggaaaaggacgagaaagaugaagaccaugagagagaacgcuuuuacauauaucggaagcccucccacaccaguaggaaaaaggccacaggauucgcagcugugcaucaauuguuuacggagcgauggccgacuaccccaguaaacagaagccugucagguacagccaccgagcggaauaucgacuucgaauuagauauuaggguggagaucgacucuggcaaauguguucuucacccuacuacacugcuccaggaacaugaugacauuucccugcgccguagcuacgauagaaguucacgauccuuggaccaggauagccccucuaagaagaaaaaguuucagaccaacuaugcaaguacgacucaccugaugaccgggaaaaaggugccaagcucccuccaaacaaaacccucugaccuugagaccacugucuucuacaucccuggaguggauguuaagcugcacuauaauucaaaaacacuaaagaccgagagccccaacgccuccaggggcucgucucugccacggacauuaaguaaggaaagcaaacucuacgguaugaaggacucagcgacuuccccuccgucucccccacugccuagcaccguccaguccaaaacgaauacauugcuucccccacagccucccccgauuccugcugccaaggggaaaggaaguggcggcgugaagaccgcaaagcuguacgccuggguggcucuccagucacugccagaggaaaugguaauaagccccugcuugcuggauuuucuagagaaagcccucgaaacuaucccuauuaccccagucgagcgcaacuauacagcagugucuucccaagacgaggacauggggcauuucgaaauccccgauccuauggaggaaaguacuacgagccuuguuucaucuuccaccucggcuuacagcaguuuuccaguggacgucgugguuuaugugagaguacagcccucccagaucaaguucucuugucugccggucucaaggguggagugcauguuaaaacugccuagccucgaucugguguuuuccucuaaccggggagaauuggagacacuugguaccacuuaccccgccgagacacugagcccaggcgggaaugcgacccagaguggaacuaagacaucagcuuccaaaaccggcauucccgguagcucugggcucggaaguccucugggccgcuccagacacagcucaucgcaaucugaccuaacgagcuccaguucaucuagcuccggcuugaguuucacugccugcaugagcgauuucucucuguauguuuuucauccauacggggcaggaaagcagaagaccgccgucuccggucucacacccggcucagggggacuuggcaacguggacgaagaaccuaccagcguaacuggucgaaaagauucgcuguccauaaauuuagaguucgugaaggucucucugaguaggauccggcguucagggggagcuagcuuuuucgagucccagucugugagcaaaagugcaucaaagauggacacaacccucauuaacaucuccgccguuugugauauuggcagcgcgucuuuuaaauaugacaugcgcagacuguccgaaaucuuggccuucccaagggcuugguaccggagaaguauagcacgccgacuuuuucugggcgaucaaacgaucaaucucccgacaagcgggcccggaacuccugacucaauugagggugugucucagcaccuguccccagagagcucgaggaaggccuacugcaagaccugggaacagcccagucagucugcuucauucacacacaugccucaauccccaaacgucuuuaaugagcauaugaccaacagcacuaugucucccggcacgguggggcagagccuaaaauccccggccaguauccggucaagaagcguuuccgauucuagugugccucgucgcgacucauuaagcaagaccuccacaccauucaauaaaucuaacaaggcagcuucgcagcagggaacucccugggaaacccugguagucuuugccauuaauuugaaacaacucaacgugcagaugaauaugagcaacguuaugggcaauacaaccuggacuacauccggucugaagagucaggggaggcuuucagugggaucuaaccgggacagagagaucagcauguccgucggccugggccgaagucagcucgauucuaaagggggagugguagguggcaccauagacgugaacgcgcuggagauggucgcccacauuagcgaacauccuaaucaacagcccucacacaagauccagauuacgaugggguccacugaggcaaggguugauuauaugggaagcucuaucuugaugggcauauucucaaacgcugaccuuaagcugcaagaugaauggaaagugaaucuauacaacacacucgacaguuccaucaccgauaagagcgagauuuucgugcauggugaccugaaaugggauaucuuucaggucaugauuucgcgcucuacuaccccagacuuaaucaagauagggaugaaacugcaggaguucuuuacacagcaauucgauaccuccaagcgggccuugagcacguggggaccggugccuuaucuacccccaaagacaaugacuucaaaucuggagaaaaguucucaggagcagcuucuggacgcagcccaccacagacauuggcccggcguucucaagguaguguccggcugucacauuagcuuguuucagaucccucugccagaagaugggaugcaauucggagguucaaugagucuucauggcaaccacaugacccuggcuugcuuucacgggcccaauuucagguccaaaagcugggccuuauuucaucuagaggaaccuaacaucgcguucuggacagaggcucagaagauuugggaagacggaucuucggaccacagcacuuacaucguccagacccucgauuuucaucugggccacaauacaauggugaccaaaccauguggugcacuggaguccccgauggccacuauaacgaagauuacccgccgucggcaugagaaucccccucacgggguugcuucagugaaggaaugguucaauuaugucacagccacuagaaacgaggaauugaaucuccugcgaaacguggacgcaaauaacaccgagaacucuacaaccgucaagaacaguagccuucuguccggcuuuaggggaggaucuucauacaaccacgaaacugagacaaucuucgccuuaccacgcaugcagcucgauuucaagagcauucaugugcaagagccccaggaaccuagucugcaggacgcuuccuugaaaccaaaggucgagugcucuguugugacggaauuuaccgaucacaucugugucacuauggacgcggagcuuauaauguuccugcaugaucuagugagcgccuaucucaaagagaaggaaaaggcaaucuuucccccucggauucuguccacaagaccggggcaaaaaucacccaucauuauccacgacgauaauaguagcgacaaggauagggaggacucuauuaccuacaccacuguugacuggcgcgauuucaugugcaacacauggcaccuggaaccaacguugagacucaucuccuggaccggacggaaaauagacccuguggguguagauuacauccugcagaaacuuggcuuucaucacgcccgaacaacuauucccaaauggcugcagagaggggugauggacccauuagauaagguccucucggugcugaucaaaaagcuaggaaccgcuuugcaggacgagaaggagaaaaagggcaaagauaaggaggagcauuga

SEQ ID NO: 58074 - RNA, 1368 nt, Artificial Sequence
  derived and/or modified sequence opt3 from KIAA1147__Homo_sapiens__NP_001073861
augguggagcagggcgacgccgcuccccugcucagaugggcagaagggccugccgucagccuuccacaagcgccgcagccccaggcuggagguuggggcaggggagggggcgguggggcccggccugcagccgagccaccccgccgacgugaaccugaggaaccagcugcacccgagguucuguugcagccuggaagauuagagcugggcgauguggaagaggaccaaguaguggccgucuuugugguuaccuuugauccaagguccggcaacaugguggaauggugccuaccgcaggacaucgaucucgagggggucgaguucaagucuauggcuucaggaagucacaaaauucagagcgacuuuauauacuuccggaagggucccuuuuucggccuggccuguuuugcgaauaugccuguggaauccgagcuugaacgcggggcaagaaugaaaucuguaggaauccugucgccaucauauacauugcucuacagguauaugcauuuccuggagaaccagguucggcaccaacuggaaaugcccggccauuacagccaccucgccgcuuuuuaugaggauaagaaagguguguuacaugccgggccuggacgcggcaguucccugccacccgucuacuggcuuccgucuauucaccgauauauguacccugagaugaagaucacucaccccgcaggcugcaugagccaguucauuaaguuuuucggggaacagaucuugauacuguggaaauuugcucuacucagaaagaggauccugauuuucuccccaccucccgugggaguggucuguuaccggguuuauugcuguugcugucuugccaaugugucacugccagguaucggcgggacgauucccgagaguaaaccuuucuuuuacguaaacguggcggacaucgagagcuuggaagucgaagugucuuauguugccugcaccacagagaagauauucgaggaaaaacgugagcucuacgauguguaugucgacaaucagaacgugaagacucaucacgaucaucugcaaccauuacugaagauuaauuccgcagaccgcgaaaaauacagaaggcucaacgagcagcggcagaugcuucuguauucacaagaaguagaggaggauuacaauccgugugaagaggacuuguuuguucuauucuuucuggaacagaacaaucgaaucuuccagacccuccuggaggugagcgcuagucaggacaagacacuuaccgccgagcacgcucgcggaaugggccuggauccccaaggugacagaucuuucuugcucgaucuguuagaagccuacgggauugacgucaugcuggugaucgauaacccuugcuguccauga

SEQ ID NO: 58075 - RNA, 2145 nt, Artificial Sequence
  derived and/or modified sequence opt3 from KIAA1161__Homo_sapiens__NP_065753
augcugcagaacccccaagaaaagagccaggccuacccuagaaggcggcgcccaggcugcuaugcuuaccgacagaauccggaggcaaucgccgcggcugccauguauaccuuccuccccgacaacuuuuccccugcaaaaccaaagcccucuaaagaucuuaagccucuguuggggucagccguguuaggacugcuacucguccuggcugcaguuguggccugguguuacuauaguguaagccuucguaaagcugagagacugagggccgaauugcucgaccugaaggcggguggcuucuccauucggaaucagaagggggagcaaguguuucgccuggcauucagaucuggagcccucgauuuagacucgugcucaagggauggcgcucugcuugguuguagcuugacagccgacgggcugccacuacacuuuuucauacagacuguccggcccaaagauacggugaugugcuaccgcguucgaugggaagaggcagcuccuggacgggccguggagcaugcgauguuucucggcgacgccgcagcucacugguauggcggggccgaaaugaggacccagcauuggccaauccggcuggauggacagcaagagccgcagcccuucgucacaagugacguguacuccucugaugcugccuuugguggcauucuugaacguuacuggcugagcucccgcgcagccgcuaucaagguaaacgacucaguuccuuuccacuugggguggaauaguacugagagaagccucaggcugcaggcgcgguaucaugauaccccauacaaacccccugcaggacgagccgcugccccagaguuaucuuaucgcgugugugucggcuccgacgugacaucaauucacaaguacauggugagaagguauuuuaacaaacccagccgggucccggcaccugaagccuuccgcgaccccaucuggaguaccugggcucuguacgguagagccguugaucaggacaaggugcucagguuugcacaacagauacgucuucaccauuucaauucuucccaccuggagaucgaugacauguauacuccagcguacggggauuucgacuuugaugaaguaaaguucccuaacgcuagcgacauguuucggcgauugagagaugccggauucagggugacacuauggguccaucccuuugugaauuacaacucgucucgcuucggcgagggcguugaacgggagcuguuugugagagagccaaccgggaggcuccccgcacugguccgcugguggaauggaauuggugccgugcuugacuucacgcacccuaaagcucgagauugguuucagggccaccugagacguuugagauccagguauucaguagccaguuucaaguuugacgcaggggaaguuagcuaccucccacgcgacuucuccacuuaucggccgcugcccgauccuucuguguggagcagaagguacaccgagauggcuuuaccauuuuucucacuggccgaaguccgagugggauaucaaagucagaacaucuccugcuucuuucgccuagucgaccgggauagcguguggggcuacgaccucggucugagaucucuuauucccgcgguuuugacagugucaaugcugggguauccuuucauccucccagauaugguaggcggaaaugccgucccccagaggacugcuggcggggacgugccggagcgugaacuguacauacgcuggcuugagguugcagccuuuaugccugcuaugcaguucaguauuccacccuggcgguacgaugccgagguggucgcaaucgcgcaaaaauuugccgcucugagagccagcuugguggcaccucuccuguuagaacuggcuggagagguaaccgacacaggugaucccauugugaggccacuaugguggaucgccccuggcgacgaaaccgcacaucgaaucgauucccaguuccucauuggggacacgcugcuuguugcccccgucuuggagccaggaaagcaggaacgggauguguaucugccggcuggcaaauggcgcucuuacaagggugagcucuuugacaaaacuccugugcuguuaacagacuaucccgucgaucuggacgagauagcguacuucaccugggccucguga

SEQ ID NO: 58076 - RNA, 3702 nt, Artificial Sequence
  derived and/or modified sequence opt3 from KIAA1211__Homo_sapiens__NP_065773
augggaaccagagccuucagccacgacuccaucuuuauucccgaugggggagcugagucugaacagacagugcaagcaaugucacaggacaacauacuggguaaggucaaaacucuccagcagcaacuuggcaagaauaucaaauucgggcagaggaguccuaacgccauuccaaugaauaaggcgaacagcggagaggcuucccuggaagaggauuuguuuuuaacgucuccgauggaaaucguuacccagcaggacauugugcugucggaugccgagaauaaaucaagcgacacacccaguucccuaucuccucucaaccugccaggcgcagguagcgagauggaagagaagguagcccccgugaagccuucccggccaaaacgccauuucucaagugcugggacuaucgaaagcgucaaucuugaugcaauaccccuggccaucgcucgauuggacaacucugccgcgaagcacaaacucgcagugaagccuaaaaagcaacguguuuccaagaaacauagaaggcuggcccaggauccacagcacgagcagggaggccuggagucacggccgugccucgaccaaaauggccaucccggggaagauaagccuaccuggcacgaggaagaaccaaaccccuuagacagcgaagaggagcgcagaaggcaggaagauuacuggcgggagcuggaagcuaaauguaagcgccagaaagccgaggcagcugaaaagcgaagacuugaggagcaaagguugcaggcccuggaacggcgucuaugggaggaaaaucgcagacaggagcuccuggaagaggagggagaaggucaggagccuccacuugaagcggagagggcaccccgggaggaacaacagcgaagucuggaggccccgggcugggaagacgcugagcgcagagaaagggaggagcgggaacgcuuggaggccgaagaggaaagaaggcgucuccaggcucaggcccaagcagaggagcggcgaagacuggaagaggacgccagguuagaagaacgccggagacaggaagaggaggaagggaggugcgcugaggaacugaaacgccaggaggaggaagaggcggaaggaugggaggaacucgagcagcaagaggcagaagugcagggcccucccgaggcccuugaagagacaggugaagggcgacggggagcugaggaggaagaucugggcgaggaagaggaagagggccaggcccacuuggaggacuggcgugggcagcuaucugaacugcucaacgauuuugaggaaagacuggaggaccaagagaggcuuaagccagaaggacagcgcgagcauuccgaggagccugguauuugugaggagcagaaucccgaggcagaacggagaagggagcaacagggccgaagcggggauuuccagggagccgaccgcccaggccccgaagagaagcgggaagagggugauaccgagccucuguugaaacaggaagggccagucgaggcugcccaaccgcccguggaaagaaaggaggcagcggcucucgaacagggcaggaaaguagaggagcugcguuggcaggaaguugacgagcgccagacuaugccucggccauauacauuucaagugucgucuggaggcaagcagaucuuauuccccaaagucaaccuguccccugugaccccagccaaggauacggggcuaacugcagcuccccaggaaccgaaggccccuaaagccucaccagugcagcacgcacuccccaguagccuguccgucccucauaccgcuauucuuguuacaggagcccaauugugcggucccgcggugaaucugucucagaucaaggacacugccuguaaaagccuccugggccuugaggagaagaaacacgcugaagcaccagccggggagaacccucccagaggaccaggcgaugcuagggccgguucagggaaggcaaagccgcgacaggaaaguccuuccagcgcgucugcccuggcugagugggccucaauacggagucgcauuuugaaaaacgcagaaagcgaccccagauccucugagagggaccaacuccggccaggcgaugagucgacaccccgaggaagaugcgacagccgcggcaaucagaggaagaccccuccaguaaacgcuaaauuuuccaucaugcccgccuggcagaaguucucagaugggggaaccgaaacgaguaaacagucuacugaggcagaaagcauucguaagcggccuaugcuggguccguccgaggaaacagccccacaacccccuccagcuggcgugagagaguuagggaagggacccgagaaaucagaaaugcacagggagccugcggacaccacugaaggcuguaaguuugccaaagaucugccgagcuuccuaguccccucucucccauacccuccccagaaggugguugcacauacagaguuuaccacguccagugacagcgaaaccgcuaaugguaucgccaaaccagauccugugaugcccgggggcgaggagaaggccucuccauucggaaucaaacugcgccgaacaaacuauucccuuagauucaauugcgaccagcaggcugaacaaaagaagaaaaagcggcacucaaguacuggcgauagcgcagacgccgggccgccugcggcuggaucggccaggggcgagaaagaaauggagggugucgcauugaagcaugggcccucccugccacaggagcgcaaacaggcccccucuacccguagagauagcgcugaaccuucaaguucccggucugugccaguagcacaccccggaccuccgccagccagcucccagacacccgcgccugagcaugacaaggcugccaacaagaugccccucgcacaaaaaccagcccuggcuccuaagcccacuucacagaccccuccagccagcccguuaaguaaacugucuaggcccuaccuuguugaauugcucucccgccgagcaggcagaccagauccugagcccagcgaaccaucgaaggaggaccaggagucaucugaccggaggccucccaguccgccagguccugaggaacgcaaaggccagaagagagaugaagaggaagaggcuacagagaggaagcccgccuccccaccccugccugcgacccaacaggaaaaaccgagccagacucccgaggccgggcggaaggaaaaaccaaugcuacaaucucgucacagccuggacggauccaagcucacggagaaaguggaaacagcacagccucuguggauuacccuugcuuugcagaagcagaagggcuuucgcgagcaacaggccacucgagaggaaagaaaacaggcuagggaggcaaagcaggccgaaaaacugucaaaggagaaugucagugugagcguccaacccgggucuuccucagugagucgggccggcagcuuacacaaauccaccgcucucccugaggaaaagcgcccagagacagcgguuucuagacuggaaaggcgggagcagcuuaaaaaggcaaacacccugcccacuucggugacaguagaaauaagcgauucagccccuccagcucccuuggucaaggaggugacgaaacgauucuccaccccggacgccgcaccuguuaguacugagccagccuggcucgcucuggcgaagagaaaagccaaggcauggucugauuguccccagaucauuaaauga

SEQ ID NO: 58077 - RNA, 2973 nt, Artificial Sequence
  derived and/or modified sequence opt3 from KIAA1211L__Homo_sapiens__XP_005263981
augagagagcuggaagcccacagcacccucaggcggauggcugcauucuaccagugcauccgccccgacccuuccgagcuugauaugauuucuacacgagugauggacauaaagcugcgugaagccgcggagggcuugggggaagauucaacuggcaaaaagaaaaguaaguuuaaaacguucaagaaguuuuucgguaaaaagaaaagaaaggagagcccauccucuaccggcucgucaacauggaaacaaagccagacuaggaacgaggucaucgcuauugaaagugggccgguuggauaugacuccgaggaugaauuagaggagucucggggcacccuggguagccgcgcccuaucccaugacucaaucuuuauucccgaaagugggcaggaugcaacaagaccugugaggguauucagccaggagaaugugugugaccggaucaaggcccuccaacugaagauacagugcaacgucaaaaugggaccacccccuccacccggcggccuuccugcuaagcgcggggaagaugcaggaaugucuuccgaggacgauggucugccacgaucaccgcccgaaaugagcuugcuccacgacgugggcccugggaccacuaucaaaguuaguguggucucuccagaucauguguccgacagcacaguaucggccagaauuucugacaauucccuggcucccguugccgauuuuucauacccugcggagaguagcuccugucuggacaacucugcagccaagcacaaacuccaggugaagccaaggaaucagcggagcucaaaaaugcgucgcuuaaguuccagagcucaaagcgagucucugucagaucuuaccugcacgcccgaagaggaagagaacgaagagaagccguugcuggaggucaguccugaagagaggcccagcuccggacagcaggacguggccccagaucggggcccugaacccgguccacccgcaccucuaccaccgcccgggggagcucgagcccgcagagcgaggcuccagcauucuucggcccugacugcaagcguggaggaaggaggcgucccuggggaggacccauccucacggcccgcuaccccugagcuugccgaaccagagagugcucccacacugcgcguugaaccgccuucuccacccgagggaccucccaauccagguccugauggcgggaagcaagacggagaggcacccccagccggcccgugugccccugcuacugauaaagcggaagaggugguaugcgcacccgaagacguggccagcccauuccccaccgcuaucccugagggugauacaaccccacccgaaacggacccugccgcaacuuccgaggccccgucagcuagagacgggccagagaggagcguccccaaggaagccgagccuacaccacccguguugccugaugaagagaaaggcccgcccggaccagcaccugaacccgagcgugaggcggaaaccgagccagaacggggcgcugggacugagccugaacgaauuggaacagagcccucuaccgccccagcaccguccccucccgccccaaagaguugucucaaacacagacccgcugccgcaagcgaggguccugcugccucuccaccccuggcggccgcugaauccccuccgguugagccaggccccgggucauuagacgcagaagccgcugccccugagaggcccaaggcagagcgcgcggaagccccuccagcuggagccgagcgggcagcucccgaaagaaaggccgagaggggcggugcagaacugcgcggggccaaaaaguuuagugugagcucgugccgagcucggccacguccuggcgucuccagaccgcucgagagggcgucuggacgccuuccccuggcccggagcggcccaguguggagaucagaggcagcuuuggaugaccuacaggggcugccugaaccccagcacgccaaaccaggaccuaggaagcucgccgagcgagguccccaagauaguggcgaccgcgcugcauccccggccgggccacggaaaucuccucaggaagcggcugccgcacccggaacgagagagccaugucccgccgcucaggaaccugcaccgagcgaggauaggaaccccuucccaguaaagcugcguuccaccucacuuagccugaaguaucgcgacggcgccagucaggagguuaaaggugugaagcgguacucugcggaagucagauuggagaggucccucacagugcugccuaaagaagagaagugccccuuagggacugcuccugcccugcgaggcacccgggcaccaagcgaucaaggaaaaggcaaggccagacccccugaaccacuaucgucaaagcccccgcucccucgcaaaccacugcuucagucuuuuacauugccccaucagccugcuccacccgacgccgggccgggagagagggagccucggaaggaaccccgaacugcagagaaaagaccacugcgcaggggcgcugaaaagagucucccucccgccgcgaccgguccaggggccgauggacagcccgcaccuccauggaucacagucacccgucaaaaacggagaggcacucuggaccagccgcccaaucaggaggauaagccuggugcuaggacgcuuaaauccgagccaggcaagcaggccaaggugcccgaacgcgggcaagagccuguuaaacaggcugacuucgugcgaagcaagucuuuucugauaacaccaguaaaacccgcagucgacagaaagcagggagccaaauugaacuucaaggaaggccuccagcgggggauuagccugucccaccaaaauuuagcccagucagcugugaugauggagaaggaacugcaucagcuaaaaagggcgaguuaugcaagcaccgaucaaccuucuuggauggagcucgcccgcaagaaaucccaggcuuggucagacaugccgcagaucauuaaguga

SEQ ID NO: 58078 - RNA, 3795 nt, Artificial Sequence
  derived and/or modified sequence opt3 from KIAA1217__Homo_sapiens__NP_001091970
augcagaccagcgagauggacagaaagagggaagccuuccuggagcaccucaaacaaaaguacccccaucacgcuuccgcaaucaugggccaucaggaacggcuucgcgaucagacacgaucuccuaaacugucacacaguccacagccgcccagcuugggggacccuguggagcauuuauccgaaacuucugccgauucgcuggaggcgaugucagagggagacgcuccaacgcccuuuagccgugguaguagaaccagggccucccuaccugucguucggucuacaaaccaaacuaaggaacgcagccucggcgugcuguaucuucaguacggggaugagaccaaacagcugagaaugccaaaugaaauuacauccgcagacaccauaagggccuuguucguaucagcuuuuccccagcaacucacuaugaagaugcuggagaguccuagcguggcaaucuauauuaaggaugagucucggaacgucuacuaugaacugaaugacgugcgcaacauccaggaucgaucccucuuaaaaguuuacaauaaggacccagcccacgcuuucaaccacacaccgaaaaccaugaauggagauaugagaaugcagagggagcugguguaugcccggggcgacggucccggggcgccucguccaggaucaacggcacaucccccucacgccauuccaaacagucccccgagcacuccugucccccauucuaugccaccuucccccagccgcaucccauacggcggcaccagaucgauggugguacccgggaaugcuacaauaccuagggaucggaucucuucccuuccaguuucacgaccgauuagucccagcccuuccgccaucuuggaacgcagagacgugaagccagacgaggauaugucugguaaaaacauugcaauguacaggaaugaaggauuuuaugcugaccccuaccuguaucacgagggccggaugagcaucgccucaagucacgggggacauccucuagaugucccagaccacauaauugcguaccaucgcacugccaucagauccgcaagcgcuuauugcaaccccucuaugcaggccgagaugcacauggaacaaucacucuacaggcagaagagucguaaguauccggauagccaucugccuacccuuggcuccaaaacaccacccgcuucuccucaccgggugucggaccugcgaaugauugauaugcacgcccauuacaaugcacacggucccccacauaccaugcagccugacagagccagccccuccaggcaagcauucaagaaagagccagggacguugguguacaucgaaaagccgcgcucagcggcaggacucaguucucuggucgauuuaggcccuccccugauggagaaacagguuuuugccuauagcacugcuacaaucccaaaggaccgggaaaccagagagaggaugcaggccauggagaaacagauugcaucccucacuggccuugugcaaucagcccuguucaaggggcccauaacaagcuacucuaaggaugcuuccagugagaaaaugaugaagaccacggccaaccgcaaucacaccgacagcgcaggaacaccucacguaucugguggcaaaauguuguccgcgcuagaaucaacugugccacccagucagccuccgccagucgggaccagcgcuauccauaugucgcugcucgaaaugcgacgguccguggccgagcugcgucuucagcugcagcaaaugagacaguugcagcuccagaaccaagaacuguuaagggcaaugaugaagaaagccgagcuggagauuucuggaaagguuauggaaacaaugaagcgccuagaggaccccgugcagcggcagagaguccucguggaacaggagaggcaaaaauaucugcacgaggaagagaagaucguaaagaaacuuugugaauuggaggauuuuguugaagaccugaaaaaggauagcacugcugccucacgacucgugacccugaaggacgucgaggauggcgcauuccuucugcgccaggugggugaggcugucgccacauugaaaggggaauuuccuacccuccagaacaagaugcgggcgauacugagaauugagguggaagccguuagguucuuaaaagaggaaccacauaagcuggacagucuacucaaacgugugcgcuccaugacugauguacugacgaugcuucggagacacgucacagacggcuugcugaagggaaccgaugcugcacaagccgcucaguacauggccauggagaaggcaacugcggccgaggugcucaaaucucaggaagaggcugcccauaccagcggccagcccuuucacuccacaggggcaccuggagacgcuaagucagaaguugugccgcugagcgguaugauggucaggcacgcccaaaguucucccgugguaauccagccaucccagcauagcguggcauuacugaauccugcccagaaccuuccccacguugcuucgucaccagcggucccucaagaggccaccucuacuuugcagaugagucaggcaccccaguccccacaaaucccgaugaauggcagcgcuaugcagucucucuucauugaagagauccauagcguguccgccaaaaaccgagccgugucaauugagaaggcugagaaaaagugggaagaaaaacggcagaaucuggaucacuauaacgggaaggaguucgagaagcuacuggaagaggcacaagccaauauaaugaaaaguaucccuaaccucgaaaugcccccagcgacaggaccccugccucgcggcgacgcuccagucgauaagguugagcuuagcgaagacucucccaauuccgagcaggacuuggagaaacugggugggaagucaccuccgccacccccucccccaccuagaaggaguuacuuacccggcagcggacucacgaccacucgguccggcgaugugguguauacagggcgaaaagaaaacauuaccgccaaggcaucuucggaggacgccggaccaagcccucagacaagagcuacuaaguacccggcagaggaacccgccucagcguggaccccauccccucccccaguaacgaccaguucuagcaaagaugaagaggaggaagaggaagagggugacaagaucauggcugaacugcagggcuccucaggggccccucaaacaucucgcaugcccgucccgaugagcgcuaaaaauaggccaggaacucuugauaagccuggcaaacagaguaagcugcaggacccccgucaguaccggcaagccaacgguuccgcuaagaaaagcgggggcgauuuuaagccaaccucucccucauugccugccuccaaaaucccggcacucagucccagcucgggaaagucuuccagccugccaucaaguucuggcgacuccagcaaucuaccuaaucccccugcuacaaaaccaucaauugccaguaacccccugagcccucagacugggccacccgcgcauuccgccucucucauaccgagcguguccaacggaucacugaaguuccagucucuuacccacacgggcaagggucaccauuugaguuuuucgccucagagccaaaacgggagagcaccacccccucuguccuucucuucaagcccacccuccccggcuaguucuguuagcuuaaaucagggagccaaaggcacaaggaccauccacacuccuucacucacauccuauaaggcucagaacgguaguagcucuaaagcaacccccuccacugccaaggagaccucauga

SEQ ID NO: 58079 - RNA, 1866 nt, Artificial Sequence
  derived and/or modified sequence opt3 from KIAA1279__Homo_sapiens__NP_056449
auggccaacgugcccugggcugaggucugcgaaaaguuccaggcagcccuggcgcucagcagaguugagcuucacaaaaauccugaaaaggagccauacaaauccaaguauucugcuagggcccuguuggaagaggugaaagcauuacugggcccggcccccgaggacgaagaugagcggccugaagcugaggacgggccaggagcuggugaucaugcccuaggccuccccgcugagguaguggaaccugaggggccagucgcccaacgcgcggugcgacuggcaguuaucgaauuucaccuuggagugaaccauauugacaccgaggaacugucagccggcgaggagcacuuggucaagugucuccgucugcugagaagguaccggcucagucaugauugcaucagcuuauguauacaggcucagaauaaccuggguauucuuugguccgaacgcgaggaaaucgagacagcccaggcauauuuggaaucuucggaggcucuguacaaucaauauaugaaggagguggggucacccccucuagacccaacugaaagauuccucccggaggaagagaaacugacggaacaggagaggagcaagcgguuugagaaaguauacacccacaaccuuuauuaccuggcccagguuuaccagcacuuggaaauguucgagaaggcggcccauuauugccacaguacacucaaacgccaacuggaacauaaugcauaccaccccauugagugggcuaucaacgccgcuacuuuaucccaguuuuauauaaauaagcuguguuucauggaggcccgacacugccucucugcagccaacgugaucuuuggacagaccggcaagauuagcgcuacagaagauaccccugaggcggaaggcgaggucccagaacuuuaccaucagagaaaaggggagaucgcaagguguuggauuaaguauugccugacuuugaugcaaaaugcccagcuauccaugcaggacaacaucggagagcuggaucucgacaaacaaucagaacugcgggcacuucguaagaaagagcuggaugaagaggaaaguauacgcaagaaagccgugcaguucgguacaggcgaguugugugacgcaauuagcgccguggaggaaaaggucucuuaccucagaccccuggauuuugaggaagcuagggaguuauuccugcuagggcagcacuauguuuuugaagccaaggaguucuuucagaucgacggauacgugaccgaccauauugagguagugcaagaucacuccgcacucuucaaaguccuggcguucuuugaaacggacauggagcggcgaugcaagaugcauaaacgcagaaucgcuaugcuugaaccuuugacuguggaucugaauccacaguacuaucuccugguuaacaggcagauccaguucgagauugcccacgcauacuaugacaugauggaucuuaagguggccauagcugaccggcugcgcgaucccgacucacacaucgucaaaaagauuaauaacuugaacaagagcgcccucaaauacuaucaacuguuuuuagauagucugagagacccgaauaagguguucccugagcauaucggcgaagauguacuaaggcccgcaaugcucgcuaaauuucguguugcccggcuguacgguaagauaauuaccgcggacccuaaaaaggagcuugaaaacuuggccacaucucuggagcacuauaaguucaucguggacuacugugaaaaacauccagaggcugcacaggagaucgaagucgagcucgaacuguccaaggagauggugagcuuacugcccacuaaaauggaacgauuuagaaccaagauggcccuuacauga

SEQ ID NO: 58080 - RNA, 3015 nt, Artificial Sequence
  derived and/or modified sequence opt3 from KIAA1324__Homo_sapiens__XP_011540127
auggccgagcccggccacagccaucaccuguccgcuagagugagggggcggaccgaacgccgaaucccucgucucuggagacuucuguugugggcaggaacagccuuccaggucacucaagguacgggcccagaguuacaugcgugcaaggaaucugaguaccacuaugaauacaccgcuugugacucaacagggaguagguggcggguugccgugccgcauacucccggacugugcaccagccuaccugauccaauuaaaggcacagaguguuccuuuucuugcaacgccggugaguuccucgacaugaaggaucagucguguaaacccugcgcagaagggcgcuauucacugggaaccggcauaagauuugacgagugggaugaacuuccucacggcuucgcuagccugagugcaaauauggaguuggacgauuccgccgcugagucuacugggaacuguacaagcuccaaguggguaccaaggggagacuacaucgccucaaauaccgaugaaugcacggcgacucucauguaugcagugaaccugaaacagagugguaccgucaauuuugaguacuauuaccccgacagcucuauuaucuucgaauuuuucgugcagaacgaucaaugucagccuaaugccgacgauucccgguggaugaagacaacugagaagggcugggaauuucacucaguugagcugaaccgcgggaauaacgugcucuacuggcgaaccacagcuuucagcgucuggaccaaagugccaaagccgguauuaguuagaaauauugccaucacgggaguggcauauaccagugagugcuuucccuguaaaccuggcacauacgcugacaagcaggguucuuccuucugcaaacugugcccagccaacagcuauucgaauaagggggaaaccucuugucaucagugcgaccccgauaaguacuccgagaaaggaucaaguagcuguaacgucaggccugcgugcacugacaaggauuauuuuuacacacacaccgccugugacgcaaauggcgaaacgcaacuuauguauaaaugggcuaagccaaaaauaugcuccgaggauuuggaaggcgccgugaagcugcccgcuucuggggugaaaacccauuguccgccuugcaaccccggauucuucaagacaaacaauagcacuugucagccaugcccuuacgguucauacaguaacggcuccgacuguacccggugccccgccgggacagagccagcagucggauuugaguauaagugguggaauacucuacccaccaacauggaaacaaccguucucagcggcaucaauuucgaguacaaagguaugacugggugggaaguggccggcgaucacauuuauacggcugcgggagcaucugacaacgauuuuaugauccugacacuuguagugccuggcuuccguccaccgcagucagucauggccgacaccgagaauaaggaaguggcucgcauuacuuuuguuuucgagacccugugcagugugaacugugaguuguacuuuauggucggggugaauagcagaacaaacacccccguagaaacuuggaaaggauccaaggguaaacagucuuauacauacaucauagaggaaaauacgaccacuucguucacaugggccuuucaaaggaccacauuccacgaggcaagccggaaguauacuaacgauguugccaagauuuacuccaucaaugugaccaacgucaugaauggcguggcuucauacugccgaccuugugcccucgaggcaagugacgucgggucuagcugcacguccuguccagcgggauauuacauugaccgcgauucaggcacuugccauagcugucccacaaacacuauccugaaagcucaccagccuuauggugugcaggccugcguuccaugugggcccggcaccaagaacaauaaaauccauucuuuaugcuacaacgacuguacauuuuccagaaauacuccgaccaggacguucaacuauaauuuuagugcacuggccaacacagugacccucgcuggaggcccuagcuucacuucuaaggggcuuaaauacuuccaccauuuuacacuguccuugugcggaaaucaaggucggaagaugucaguaugcaccgauaacgucacugaccuacgcauuccagaaggcgagaguggguucagcaagucgauaaccgccuaugugugucaggcaguuaucauucccccugaagugacaggauacaaagcuggcgucuccucucagcccgugagccuggccgauagacucaucgguguaacgaccgacaugacucuggaugggauaacaucaccagcggagcuuuuucaccuggaaaguuugggcauuccugacgugaucuucuuuuacagguccaaugauguuacccagucuugcagcuccggacguucaacaacuauccggguccgauguagcccccaaaagaccgugccaggcagucuccuguuaccggggacgugcucugacggaacaugugauggcugcaacuuccacuuucugugggaguccgccgcugcauguccucuaugcagcguggccgacuaucaugcuauugucucgucauguguugccgguauccagaaaaccacuuacguguggagagagcccaagcucugcucugggggaauuagucugccagaacagagggugaccauauguaaaacaaucgauuucuggcuuaagguaggcauuuccgcagguacuugcaccgcgaucuugcugacaguccucacgugcuauuuuuggaagaaaaaucagaagcuggaguacaaauauagcaaacuugugaugaacgccacccugaaggacugugacuugcccgcugccgauucuugcgcaaucauggaaggcgaggacguugaagaugaccucauuuucacuagcaagaaaucccuguuugggaagauaaagucauucacaaguaaacaaccugcuccagugaccaucagcuuaucugaggauuccuga

SEQ ID NO: 58081 - RNA, 3090 nt, Artificial Sequence
  derived and/or modified sequence opt3 from KIAA1324L__Homo_sapiens__NP_001136221
augcuguucagagccaggggccccgugcgggggcgcggauggggucgaccugcugaggcaccacguagaggcaggagcccgcccugguccccugccuggaucugcuguugggcgcucgcugggugccaggccgcaugggccggagaccuuccaucuucaaguagccggccccugccuccaugucaagaaaaggauuaccacuuugaguauaccgaaugcgacuccucuggcucgcgcuggagagucgcuauucccaacucagcaguugauuguagcgguuugccugacccagugagggggaaagagugcacauucaguugugccuccggagaauacuuagagaugaagaaucagguaugcucuaaauguggcgagggcacuuauagccugggguccggaauaaaguuugaugaaugggacgagcuaccggcugguuucucaaacaucgccacguuuauggauaccguggucggccccagugacagccggccugaugggugcaauaacucuuccuggauuccacgcggaaauuacaucgaaucaaaccgagacgauuguacagugagccucauuuaugcgguucaucugaaaaagaguggcuacguguucuuugaguaucaguacgucgacaauaacaucuucuuugaguucuuuauacagaaugaucaaugccaggaaauggacacuaccacagacaagugggugaaacuuaccgauaacggugagugggggucucacuccguaaugcucaagagcggaacuaauaucuuguacuggagaacaaccggcauucucaugggcucgaaagcaguuaagcccgugcuggucaaaaacaucacgauugaagggguggccuauacuucugagugcuucccuuguaagccaggaaccuuuuccaauaagcccgguucauucaacugccagguguguccgaggaauacauacagugaaaaaggcgcuaaggagugcauccgguguaaagacgauagccaguucuccgaggaagggucuagcgagugcacugaacguccucccuguaccacaaaggacuauuuucaaauacauaccccaugcgaugaggaaggaaaaacgcagauuauguacaaguggaucgagccuaaaauuugucgcgaggaccugacugaugccaucagacugcccccaucaggcgaaaagaaggacugucccccuugcaacccagguuucuauaacaaugggaguuccagcugccacccgugucccccuggcacauuuucugauggaaccaaagagugcaggccaugccccgcaggcacugaaccugcuuuaggguucgaguacaagugguggaacguccugccaggaaauaugaaaacaucauguuuuaacguugguaauaguaagugcgacggcaugaacgggugggaaguggccggagaucauauccagagcggcgcggguggguccgacaaugacuaucuuauuuugaaccugcacauacccggcuucaaaccgccuaccucuaugacgggagccaccggcucggagcuagggcggaucacauuuguauucgagacucucuguagcgcagauugcgugcuguacuuuauggucgacauuaaucgaaaguccaccaacgugguugaaucauggggagguacaaaggagaaacaggcuuacacucacaucauauucaagaaugccaccuuuacauucaccugggcuuuucaacgcacuaaccagggccaggauaauagaagguucauuaacgacauggugaaaaucuauaguaucacggccacaaaugcagucgaugggguggccucuagcugucgggcuugcgcgcuuggauccgaacaaucaggcagcucuuguguaccaugucccccuggucauuacauugagaaggagaccaaccagugcaaagaaugucccccagacacuuaucuguccauccaccagguuuacgggaaggaggcaugcauuccuugcggccccggaaguaagaacaaucaggaucauagcgugugcuauucugacuguuucuuuuaccacgaaaaagagaaccaauccuugcacuaugauuucucaaaucucaguagcgucggcucgcugaugaacgggccauccuuuaccucuaagggaacaaaauacuuccacuuuuucaauaucagcuuaugcggccaugaagguaagaaaauggcccuguguaccaacaauauaacugacuuuacagugaaggagauugucgcugggucagaugacuacacgaaccucgugggagccuucguuugccagaguaccaucaucccguccgagucuaagggcuuucgcgcagcccuuagcucccagucaauuauacuggcugauacuuucaucggugugacaguagaaaccacauugaaaaauauuaacaucaaggaggacauguuuccuguccccacuagccagauuccagacgugcauuucuuuuauaaaaguucuaccgccacgaccuccuguaucaauggcagaagcacagcaguuaagaugaggugcaaccccacuaaaucgggggcgggagugauaucagucccuucuaaguguccagcugggaccugcgauggcuguacauucuacuuccuaugggaaagugccgaggcaugcccccugugcacugaacacgacuuucaugagaucgagggagccuguaaacguggcuuccaagaaacccucuauguguggaaugagccuaaguggugcauuaaggguaucucccugccggaaaagaaacuugcuacgugugagacaguagauuuuuggcugaaagugggggccggaguuggcgcauucaccgcugucuugcucguggcccugacuugcuacuuuuggaagaaaaaccagaaguuagaauauaaguacagcaaacuggugaugacaaccaauucuaaggagugugagcuaccagcggccgacagcugcgcuauuauggaaggugaggauaacgaagaggaggucguuuauuccaacaaacagucacuccugggcaaacuuaagaguuuggcaacuaaggaaaaggaggaccacuucgaaagcgugcagcugaaaaccucucggucccccaauaucuga

SEQ ID NO: 58082 - RNA, 3354 nt, Artificial Sequence
  derived and/or modified sequence opt3 from KIAA1377__Homo_sapiens__NP_065853
augcuggccggcagacccgggaccaggagcgcugugggagagcucgguacagaauccucugacaaccuugaucgggcaccucugggcccacgcgagucagggggacaccaucgaccgggcaguuacuuggacaugaagauccacuuagagaaaaaucuggaggaggaacgucagauucuacuccaacagcagaagauaugcagaaacagggcccggaaauauuucgucgagagcaaucgcagaaagaaagcguuugaagagaagaggaaggaacaggaggagaaagaacaucaaauccgggagcagauucugcagcagcgcaagcaaaaauucgaagagguuacugaaaaguuucagcgagcucacgugccccuuucccagagaaggaaagccguaucucggaagccugugccaccccuggaggaggcauugaagcagauccaagaaucgaaccucaaaucagaggucaaucugccuuucagccgucgcccaacgauuaacuggagagccaucgauagugcucugcccuccgcacucucuaagaaugaccauaaacaccagaagcaguuacugagcaaaauaaacugugaaaaggagaugaaugaaaacaugagggccacccuugcuacauccaaaaauguguuucaauugaagcuggaggagacucagaagcuacucgaagaucagcaccugucaaaccuucagaaauucugcgacgagguuaaucaaaucaccaacagugaaacacugagcucuauugauuccuuggaggccaccgaacaugaggagaucuaccucacucugaauaaggaacacucaacaagcauucagcggaacaccaucaguuuaaaaccugcgaacaugcagucuacgaaucuguccuguuuugacgaggauaagcucgcauucagcaaaacucagcauauaaacaauuggcuuaccaaccuggacgccucgaauacacaaaacgugacugcuuuuucugauauuuuguccaagucaaauguccuaccaaguugggaauauuucaacagcaaggagcagaauccgagcccccugaacgguaccguggagcgagccacaaauaccgcaaacaauucuguaccuuuuguuagcucaccacccauguucgugcucgacaaaaagugcgagaaaacgagugaaacuuccacaaugcgcaccacugauagcacaucuggggcuuuuaagagagaaaggccucuggucaccgagucaccaacguucaaauucaguaagagccaguccaccucugacucgcuuacacaggaaguggccacuuuucccgaccaagagaaguacagcgagcugaaccaggaaaauggaaccacauccaucccgacuucaugugugccugucgcgacccccuugguucucccaaguaacauucagucugcccggccuagcgcuaaaaacuccauccacaucaaggagauugaugcagugcagugcucagacaaacuggaugaauuaaaggacggcaaagaggaagagauaaaguauuucaauuguaacaaggaggaacugccccuauuuagcgauucuuuccaagacgccuacaucccacacaaucccgauuccaaagacgagaagcagaaacucgcugaaacaaguagccugucuaacguaaccuccaauuaugauuuugugggccagcauaagaaaaugaaguacaacauucacgagcgcaauggggucagauuccuuaaaucaaucuugaagaaggaaaguaaauacgagcauggauaucugaaggcccucauaauuaaccaauccuuuaaauucgguaaucagaaggcagccgcuaucagggacucgaucgagcugacuaaagaaaagggcgcggagauuccuaagacgaucaaaaagcugcguugguuugaugaaacauccaacauugagaauaacgcagaaaauucucacagccuuaaaaacaagaccgggacuacccagcagcauucacaacaguuccacauacagaguggagccggcuccaauaucauuucugugagcacaugcgcuguuaacuccgccgacaccaaaaagucacgggaagacagcaucagugagaacgugacuacauugggugggucuggagcagaucacaugccacucaauuguuuuaucccguccggcuacaacuucgccaagcaugcuuggcccgccagcaaaaaggaagagucgaaaauuccuguccacgacgauucaaagacgaaacagggcaagccacaacgagggagagcaaagauaaucaggaaacccggaucugcgaaggugcagagugguuuuauuugcaccaaucgcaaaggcgcuguaauccagccucaguccgccagcaagguuaacauuuucacucaagcacaggggaaacugaucauaccaugucccccgccucagucuacaagcaauauccgguccggaaagaacauucaagugucacagugccagccagucacccccgaaaauccucagaacaucauuacacauaauaguuucaacagcaaacacguguuacccacugagcacucucugaaucaauggaaccaggaguccucaaguccacuaagcaaugccugcuccgaccucgucaccgugaucccuucucugcccucguauuguagcucagaaugccagacguuugcuaagauaaaccauuccaauggcacccaggccguugcaagacaagaugcuacacuuuacuguacucagaggaguccagugugcgaggaaucuuauccgagcguaaccuugcgcacagccgaggaagaguccgucccucuguggaagcgaggucccaacgugcuccaccagaacaaacgggcgacugggucaaccguuaugcguagaaagaggauugccgagacgaaacgccggaauauccuggaacagaagagacaaaacccaggcucugugggacagaaauacagcgagcagauuaauaacuucggccagagugucuuacuguccagcucugaacccaagcaaacaaccagggggacuucauauaucgaggaaguguccgacaguacaagcgaguuucuuauggcugagaauuugguaaaggcaucggugccugaagaugagauacucaccguucugaacucuaaacagauccagaaguccaaucuaccacugaacaaaacucaacaguucaauauuuguacccucagcgccgaggaacagaagauccuggagucacuuaacgacuugagugaacgacugcauuacauucaggagucuaucugcaaaaaucccuccauaaagaacacauuacaaauuaucccucuccuggaaaagcgcgaggaucggacgagcucauguagagacaaaagguga

SEQ ID NO: 58083 - RNA, 1572 nt, Artificial Sequence
  derived and/or modified sequence opt3 from KIAA1456__Homo_sapiens__XP_005273641
augaagauccaguucaaaaaggagugccaaaacagaaaaggccuguguuuucuccagaggcuuacccaggaaguguaccacgagaaggaccggacaauuagcuuccauuccuauaaauuuucuuucacucugcacauagaaaaggucaugcgcucaaauugccauaguuuggagguugaaacggccgugauccacaaggauaaacgaauggaccaugaggcugcacaguuagagaagcaacacguacacaacguguacgaaagcaccgcccccuauuuuuccgaucugcagucuaaagcguggccucgugucagacaguuccuacaggagcaaaagccagggucgcucauugcugacaucggaugugguacaggcaaauaccugaagguuaauucacaggugcauacuguggggugcgauuauuguggaccgcuugucgaaauugccaggaaccggggcugcgaggcaauggugugugacaaucugaacuugcccuuucgcgaugaggguuucgacgccaucauaagcaucgggguaauucaccauuuuaguaccaagcagagaaggauccgggcuauuaaagaaauggcacgcguucucgugccuggaggccagcugaugaucuacgucugggccauggagcaaaagaaucgacacuucgaaaaacaggaugugcuggugccauggaacagagcucucugcucccaguuauuuucugagagcucccaaucaggcaggaagcggcaguguggguaucccgaacguggacacccuuaccauccacccugcagugaguguagcugcucugucugcuucaaagagcagugugguuccaagcgcucacacagcguuggcuacgaaccugccauggcgagaacaugcuuugcaaauauaaguaaagagggggaagaggaauauggauucuacucuacccugggcaaguccuucaggagcugguuuuucucgcggucucuugacgaguccacuuugcgaaagcagauugagcgcgugagaccacugaaaaacacagaaguaugggccucaaguaccgugacgguccaaccgagcaggcauuccucucuagauuuugaccaccaggagcccuucagcacuaagggucagucacucgaugaagagguguuuguugaaaguuccagcgggaaacaucuggaguggcuucgggcuccuggaacccugaagcacuugaauggcgaccaccagggcgagaugcgcagaaacgggggagguaauuuccucgacucuacaaacacuggcgugaauugugucgaugccgggaacaucgaagacgauaacccaucagcaaguaaaauucugaggcguaucagcgcuguggacuccaccgauuuuaaucccgacgauacaaugucuguagaggacccucaaaccgauguuuuagacucgacggccuucaugcgguauuaccauguguuucgagaaggagagcugugcagccuccuuaaggagaacgucuccgaacugagaaucuugucaaguggcaaugaucacgguaacugguguauuauagcggagaagaaaagggggugcgacuga

SEQ ID NO: 58084 - RNA, 4080 nt, Artificial Sequence
  derived and/or modified sequence opt3 from KIAA1462__Homo_sapiens__XP_011517910
auguacagcguggaggaccugcucaucucccacggcuauaaacuuucuagagaucccccugccucaagggaagacaacccaaaagggcggcaggcugcacgcaccggaacacgagccggucaaggccugcagaaugggcaugaggauggaccggcggcuuuggcccaccguaagacgagugcaggcaaaggucaugucagcgacuccgaaucuagaaggucgacuccccgggggcacggagagccucagucaaccagcgccagucgcacauccgaagcuggcuucugcaaccagccacccucugcauggagcucccauccuccaacuggcaaugaucaagccuacagaaggcgggggcgccaggaggcucgaucacagaagcccagagagcacgaaaacuuagaggccaggggaauggcgcaggcacacagucugccuguucaugugcgggaagguccaugggagguaggcgggcguagcgagcacgugaugaaaaagccggucugggaagaggaacuacgcaugucuggacccgccaaguggcaaaaugugucccucgagucauggaaccagccuagaaaacugggcaggcagaugagcgacggugauggggaacggcuuuuucaggaccuguauccauucauucaaggagagcauguuuugaauagucagaacaagggcaaaucucgaucccucccccgcgugcugagcccugagucgcugucuuguaccgaaauaccaaucccccucaaugagagacacuccccgaagaugccucccuacccaccuacaugcgcucccaacuuagauucaaccaggaauagugaaaagagcggcuguuccgccccauuuccccggccuaaguucgggcgcccacugaagccgcccucuuauagcucacaccagcaaaguagaggaggugcagacuccagcgauucucaggacucacagcagauggaugcuuacgucccuaggcaugagcuuugcuugagugacccaggccuggaacccccuguguauguaccacccccgagcuaccguuccccuccacaaaacauucccaauccuuaccuagaggacacuguucccaucaacgugugugggggacacucucagcagcagucgccaacagagaaagccggcgcgagcggucaaccucccuccgggccaccgggcaccggaaaugaauauggcgucucaccucggcucccccaggggcugccagcccauccccgaccugugacggcauacgauggauuugugcaguauauuccauucgacgaucccagacuuaggcacuuuaagcuggcucagccucaagguuucugcgaggacaucaaauuggaugacaagaguuacaacucuagcccggucacugcccaggaaccagcucauggcgggaugcagcccgauggagccauauggaacccucagucccucaucccacccucaggcgacgagcgcggucugguuuuagcagauagcucuccucgguggcugugggggcaaccgcccggcgacggagaaaauuccggccucccaaaccagagagauagguguguggcccgcgggcaguggccugacguacgaggaagucaacacggucacaccggccgucaggugagcucucccuauucccagggggagucaacaugcgagacucagaccaaacuuaagaaauuucaaacaggaacccggacgaagaagaguagcaaaaagaaaaugaaugaaacuauuuucugucuggucucgaucccagugaaguccgagucucauuugccugacagagauauggacaacaaugaucuaaaacccagcgcugaccagaagaacggcucagauaagaguccagcgcugcaggaacagucccuccugucuaugagcuccacagaccuugagcugcaagcauugaccgguucaaugggcgggaggacugaguuucagaaacaggaucucggagaaccggaggaagaccgccagacaaaugaucugagcuucauucacuuaaccaagcaucgggagcugaaacacaguggcucuuggccugggcacagauacagggaccaacagacgcagaccuccuuuagcgaagaaccccaaucgucacagcuacucccaggagccaagcugggcggucccucucgagcugcccuuaguccuaaaugcuccgauccagcagccagcgaggcucagacacauacugccuuccccaccggggaccacaagcagcgcccuucugcacggaacuugaagggacauagaagccuguccccgucaaguaauagcgcguucucuaggacaucccucucaguugaucaagcuccaacucccaaagccggccguagucagccuuguguggacguccacggucugggcgcacaucccgggccaaagcgcgaagugguaaaaggagagccuaccggccccugcaacagcaagcagcuuuuugggcaguuccuguugaaaccaguuucccggagaccuugggaccucaucucucaacuggaaucguuuaauaaggaguuacaggaagaggaggaaagcucauccaguucuagcuccucaucuagcaguuccgaggaaagcgaggccgaaccgcagcaggagaacagggcucacugccgacaagaggaugugggauuccggggcaauucucccgaaaugcgcgucgagccacagccuagaaugugggugcccgaaucaccagucuguagguccggucgaggggagaguaagagcgagucguggucugaggagcugcagccuggacacccccgggccuggccgccauccccuggcagauuucgcguggaagaggguggcggggcacccuucugcagcgcugacggaucaacaagugccgagaaaaggcaucuagagguuucuaacggcauggaugagcucgcgggguccccauuucccgugacccguaugagcucacggaguagcgacgccaagccucugccggcuuccuaucccgcagaaccaagagagccucaggaaucucccaaaauaacuagcgccuucuccucaguaaagccuucugaggcugucccaaggaaauuugauaguggaggcgaacgcggugccgggcuucccuugucgcugagcaauaagaaccgaggacucuccgcaccugaccugagaucugugggcuuaacgccaggucaagagcagggcgcgucagagcuggaagggagccuuggagaggccuccacaauugaaauucccccgggcgagaguuugcaggcucgggccgcaaggauccucgggaucgaaguugcuguggagucucugcuaccuggaauccgccgugccggccaaaaccagccagcagagcccgaugccagcgcuuguaccccugaaucaccacaggaggaacugcucuccagacccgcgccggccgacgucccucgggugaguacugaugcauucuacgguaggcgcaaaugcggguggaccaagagcccccuguuuguaggagaccgagauucugcuagacgggccccacaggccuucgagcacuccgacguggauggcguugucacaucaaccgacccugugcccgagccagaacccagcccucuugagucgaaguuuuucgaacaaaaagacguggagacuaagccaccguucaggucuacauuguuucauuucgucgaacgcacgcccaguguugcuggcuccgagaaaagacugaggagcccuucaaaggugauugaguccuuacaggaaaaacucgcaucuccaccccggcgugccgauccugaccgccugaugcgaaugaaggaggugagcaguguauccagaaugaggguccuuagcuuucggaaugcggauucucaggaagacgcugaggaacugaaggccaccacucgcgggcaggcaggauugccagguggccucgugucacccgggaguggagauagagcccaaaggcugggccacucccuaagcguuucuaaagacucgauaucacgggaggagaaggaacauccugcugcacagaaagaaaagagcauggaucaggacuucugguguccggauuccuacgacccaagucgaguggaaagagucuga

SEQ ID NO: 58085 - RNA, 3651 nt, Artificial Sequence
  derived and/or modified sequence opt3 from KIAA1468__Homo_sapiens__NP_065905
auggccgcuauggcacccggcgggagcggauccgguggcggggugaacccuuuccugucugacucagaugaggacgaugacgaagucgccgcgaccgaggaaagaagggcuguucuccggcuuggagccggcaguggucuggauccagggagcgcaggauccuugucuccgcaggaccccguggccuuaggcucgucagcucgcccuggccugccaggggaggcaagcgccgcugccguagcgcuaggagguacaggcgaaacucccgcacgacucaguaucgaugccauugcugcccaacugcuucgugaccaguaccuguugacggcacucgagcugcacaccgagcugcucgaauccgggagagaguuaccuaggcugcgggauuauuuuucuaauccaggaaacuucgaacgccagagcggcacacccccugguaugggggcuccaggagugccgggcgccgcgggcgucgggggagccgguggcagagagcccuccacugcaucagggggaggccagcuuaauagggcugguaguauaagcaccuuggacucucuggauuuugcccgguacuccgacgaugggaaccgcgagacagacgaaaagguggcuguucuagaguucgaacuccgaaaagccaaggagaccauccaagcacugagagccaaucuuacuaaagcugcggaacaugaggugccucugcaggagaggaagaacuauaaaucaagcccagaaauucaggagcccaucaagccuuuggaaaagcgggcacucaauuuucuggucaacgaguucuuacugaaaaauaacuacaagcucacaaguauuaccuuuucugacgaaaaugaugaccaggauuucgagcuuugggacgaugugggccugaacaucccaaaacccccggacuugcuacaacuguaucgugauuuuggaaaucaccagguaacgggcaaggaccucguugauguggccuccggggucgaggaagacgagcuggaagcucuuacuccuauaaucagcaaccugcccccaaccuuggagacaccucagcccgccgaaaauucgaugcucgugcagaaacuggaggauaagauuucuuuacugaacuccgagaaguggucacuaauggaacaaauccgcagacucaaaagugagauggacuuccugaagaacgaacauuuugcaauuccagccgugugcgacagcguccagcccccucuugaucaguugccacacaaagacuccgaggauucuggacaacauccggacguuaauagcucagauaaggguaaaaacacugacauccaccugaguauauccgaugaggcugacagcaccauucccaaggaaaauucuccuaacucauucccaaggcgggagcgagaaggcaugcccccuaguagccucuccucuaaaaagacagugcacuuugauaagccaaaucgcaaacugucgcccgccuuccaucaggcacuucugagcuucuguagaauguccgcggacucaagguugggguacgagguaagucggaucgcugauucugaaaagagcgugaugcucaugcugggacgcugcuuaccgcacauugucccuaacgugcugcuagccaaaagagaggagcucaucccacugauccuuuguaccgcaugcuugcaucccgaaccuaaggagagggaccagcugcuccacauucuguuuaauuuaauaaaacgucccgaugacgaacagcggcaaaugauccugacgggcuguguugccuucgcucgacacguggguccaacuagagucgaggccgaacuuuugccucagugcugggagcagauuaaccauaaguaucccgagaggcgccuccugguggcagaauccuguggggcucuagccccauaccugccgaaggagauccggucaagccucguacugucuaugcuucagcaaauguugauggaagacaaagcggaucugguuagagaggccgugauaaaguccuuaggcauuaucaugggauacaucgacgauccugacaaauaucaccagggcuuugaacuccugcuuagugcucugggggaucccagcgagagggucgugucugcaacacaucaggucuucuugccagccuacgcugccuggaccacugagcucggaaaucugcagucccaccuaauucugacacuccugaacaagaucgaaaaacuuuugcgcgagggugaacauggccuggacgagcacaaguuacacauguaucucucagcacugcaaagucuuauucccagccuguuugcgcuagugcuccagaaugccccuuucucguccaaggcuaaacugcauggggagguuccacagauagaagugacccgauuuccccggccuaugucuccguugcaggauguaagcacgaucauuggaucacgugagcaacuggccgucuuacuccagcuguacgacuaucagcuugaacaagagggcaccacagguugggaaagucuguugugggugguuaaccagcuccugccacagcuaaucgagaucguggggaagauuaaugucacuuccaccgcaugcgugcacgaguucucuagauuuuucuggaggcugugucgcacauuuggcaaaauauucacuaacaccaagguaaaaccccaguuucaagaaauccuucggcucagcgaggaaaauauugauuccucagcuggaaacggcgugcugacaaaggccaccguuccuaucuacgcaacuggggucuugacgugcuauauucaggaggaagacagaaagcuguuagugggauuccucgaggaugugaugacacugcuuagccugagucaugccccauuggacucucucaaggcuuccuucgucgagcugggcgcgaaccccgccuaccacgaacuacugcuuaccguucucugguacgguguggugcacacuagcgcacugguaagguguaccgcugcccgaauguuugaguugacauuacgcgggaugucggaagcccuggucgauaaacggguggcuccugcacucguuacccugucaucugacccggaguucagugugagaaucgccacuauacccgcguuuggaacaaucauggaaacggucauucagagggagcuucuggagcgugugaaaaugcaguuggcuuccuuccuagaagacccacaauaucaggaucagcauagccugcacaccgagaucauuaagacuuuuggccgcguugguccuaaugccgaaccccgguucagagacgaguuugugaucccacaucuccacaaacuggcacuuguaaacaauuuacagauagucgauucuaagaggcuggacauugccacacaucucuucgaggcuuacagcgcauuguccugcugcuuuaucucagaagaucugauggugaaccacuuccucccuggccugcgaugucuucggaccgacauggagcaccugagucccgaacaugaggugauuuugagcucuaugaucaaagaaugcgagcaaaaggucgagaauaagacaguucaggaaccacagggguccaugucaauagccgcgagucuagugagcgaggauacuaaaaccaaguuucugaacaaaaugggacaacucacgaccuccggcgcuauguuagccaauguauuccagcgcaagaaauga

SEQ ID NO: 58086 - RNA, 2718 nt, Artificial Sequence
  derived and/or modified sequence opt3 from KIAA1524__Homo_sapiens__NP_065941
auggacagcaccgccugccugaagucccuccuucugacagugucucaguacaaagcugucaagucagaggcaaacgccacucaauuguuaagacaccuggaaguuaucaguggccagaaacuaacgaggcuauucaccagcaaucagauucugacauccgagugucuuucuugccugguggaauugcucgaggaucccaacauaucggcgucacugauccugagcauuaucgggcucuuaagucagcuggcuguagacauugaaacucgggauugucuucaaaauaccuauaaccuuaauuccgugcuggccggagucgugugccgcucuagccauacagacuccguuuuucuacaguguauccagcuccugcagaaguugaccuacaacgugaaaauauucuauucaggugcaaauaucgaugagcugauuacuuuucuuaucgaccacauucaaaguagcgaggaugaacucaagaugccuugccugggcuuacuggccaaccucugucgacauaaucuuucuguccagacacacaucaagacccuguccaacgugaaaucauucuaccguacguugauaacucuacuggcucauagcagucucaccguaguuguguuugcacugucuauucuuuccagccugacauugaaugaggaagucggggagaaacucuuccacgccagaaacauccaccagacuuuucagcugauuuucaauaucuuaaucaacggagacggcacccugacaaggaaauauucgguggaucuacucauggaccugcuuaagaauccaaaaauugcugauuacuugacccgguaugagcauuuuucuuccugccugcaccaagugcucggucugcuuaacgggaaggacccggauucaaguagcaagguccuggaauugcuccuggccuucuguuccguuacgcaguuacgccauaugcugacucagaugauguuugagcaaucucccccuggaagcgcgacacuaggcucacacaccaaaugccucgaaccaacuguggcacugcuuagaugguugagucagccccuggacggcuccgagaacuguagcguacucgcccuggaauuauucaaggagauauuugaggacgugaucgaugcugccaauuguucuucagcagacagguucgucacacugcuuuugccuaccauucucgaucagcugcaguucacggaacaaaaccuagacgaggcucugacccggaaaaagugcgaacgcaucgccaaagcgauagaggugcuccugacacuuugcggggaugacacuuugaagaugcacauugccaaaauccugaccacaguuaagugcacuaccuuaaucgaacagcaguuuacauacggaaagauugaucucgguuucggcaccaaaguggcagacagugagcuguguaaguuggcugccgaugucauccugaaaacuuuggaccucauuaauaagcugaaaccacucgugcccgggauggagguuagcuuuuacaagauacugcaggauccucgacucaucacgccacuggcuuucgcccuuacauccgacaacagagaacaaguacagucuggauugaggauucuguuagaggcagccccgcuccccgacuuuccugcucuggugcuuggcgaaucgaucgcggcaaauaacgccuaucggcagcaggagaccgaacauaucccacguaagaugcccuggcaaagcuccaaucacucauucccuaccaguauuaaaugccugacuccacaucuaaaggaugguguccccgggcucaacauagaggagcugaucgaaaaauugcagucuggaaugguggucaaggaccagauuugugaugugcgcaucagcgacauuauggauguuuacgagaugaaacuguccacauuagcuucaaaggaaagcagacuccaggaccugcuugagaccaaggcccuggcauuggcccaagcugauaggcucaucgcccagcaccggugccagcgaacucaagcagagacagaagcgcgcacgcuggcuucuaugcuaagagagguggaaaggaaaaaugaggaacuguccguacuucucaaggcccagcaggucgagagugagcgggcacagagcgacauagaacaucuguuucaacacaaccgcaaauuggagucuguggccgaggaacacgaaauccugaccaaguccuauauggaguuacuccagagaaaugagucaacugaaaagaagaacaaggaucugcagauuacaugugacagucuuaauaaacagaucgagaccguuaagaaacugaacgagagcuugaaggaacaaaaugaaaaaucgauugcucagcucaucgagaaggaggaacagaggaaagaggugcagaaccaacuggucgaucgugaacauaagcuagccaaccugcaccagaagacaaaagugcaggaggagaagauaaaaacucuucaaaaggaacgggaggacaaagaagagaccauugauauccuccgaaaggaacuguccagaacggagcagauuaggaaggaguugucuaucaaagcaagcucauuagaaguacagaaggcucagcuggagggccgccucgaagagaaagaaagucuggugaaacuucaacaggaggagcugaauaagcauucccacaugauagccaugauccacucuuugagcggcgggaagauuaacccggaaaccguuaaucuauccaucuga

SEQ ID NO: 58087 - RNA, 5853 nt, Artificial Sequence
  derived and/or modified sequence opt3 from KIAA1549__Homo_sapiens__NP_001158137
augccaggcgccagaaggcggcgccgaggggcugcuauggagggaaagccucgugccgguguggcgcuggcuccaggcccgagcgggagaaggcccuccgcccggugcgcacgcagaaggcggccuggacuccuucugccaggcuugugguuacugcuacucgcccgccccgcuucuugugcaccugacgaacugucaccagagcaacacaaccuuagccuguacagcauggaauugguccucaaaaaguccaccggucauucugccgcucaaguugcccugacagagacugcgcccgggucgcagcacucaagcccucugcaugugacggcaccaccgagugccaccacauucgauacugcauuuuucaaucagggaaaacagaccaaguccacagccgaccccucuaucuuuguagcaaccuaugugagcgucacuuccaaagaaguggcuguuaacgaugacgagauggauaauuuccucccugacacacacuggaccacgccacgaauggugucacccauucaauacauaacugucaguccuccaggcuuacccagagaggcccuggaaccgaugcuuaccccuagcuugcccauggugucucugcaggaugaggaaguaacauccggcuggcagaacacuaccaggcagccagcggccuaugcagagucagcuagccauuuucacacauuccggagugccuuucguaccucugaggggaucguuccuacgcccggacgcaaucuagugcucuacccaacugacgcuuauucccaccugagcucgagaacacuucccgaaauugucgccucucugaccgaggguguggaaacuacauuguuccucuccucaaggagucugaugccucaaccauuaggcgaugggaucaccauuccgcugcccagccucggagaggugucccagccuccagaagaggucugggcaacgucugccgaccgguacaccgauguuacaacugugcuuagccagucacuggaggaaaccaucaguccccgaacauauccuacuguaaccgcuucccaugcggcauuggccuuuagccgcacacacucuccacuacugucaacuccccucgcuuucgccaguagcgcauccccgaccgacgugucuucgaacccuuuucugccaagcgauuccucaaagacgagugagcuucauucuaauagcgcccugcccggcccugucgacaacacacacauauugucccccgugucaaguuucagaccauacaccuggugcgcugccuguacuguuccuucuccccagcaagugcucgcaaccucccugauggaaaaggacgucgguaguggggauggagcggagacauuaugcaugaccgugcuggaagagagcucuaucucccuaaugucaaguguaguugcugacuuuagcgaguucgaagaggauccacagguguucaauacucucuuuccgucgaggccuauugucccccuguccucucggagcauggaaaucucagagacaagugugggcauuuccgccgaagucgacaugucuagcgugacgaccacucagguuccacccgcacacggccgccuuuccgugccugccucauuggauccaacagcugggagccugaguguagccgagacccaagucacacccucuuccgugacuaccgcauucuuuagcguuaucacgucgauacuccuggacucaucuuucagugugauugcuaacaaaaauaccccuucccuugccgucagagauccgagcguguuuacaccauacucucugguacccagcguggaguccucauuguucagugaccaggaaaggagcucuuuuuccgagcauaagccucguggagcgcucgauuucgccagcucauuuuucagcacuccaccccuggaauuauccgguucuaucucgagcccuucagaggcuccggcaucccugagucuaaugcccucugaccucagcccauuuaccucccagucauucucuccucugguugagacauuuacucuuuucgauagcagugacuugcaguccagccaacugucucuccccucauccaccaaccuggaguucagucaguuacagccaagcucggagcugccucuuaauacgauuauguugcuccccucucgguccgaagucagcccauggucaaguuuuccgucugacucccuggaguucguggaagccagcacagugucacuaaccgauagugaggcucacuuuacuagcgccuucaucgagacaaccuccuaucuggaaucuagccucaucucccaugagucagcagucacugcgcugguuccucccggcucugaaaguuuugacauucuuaccgccgggauacaggcuacaucgccauugacgaccgugcacacuacacccauccugaccgagagcuccuuauucucuacacucacuccuccagaugaccaaauuucagcccuggauggacaugugagcguacuugcauccuuuaguaaagcuauccccaccggcacgguccugauaacagacgccuacuugccuucugguagcucauucguguccgaagcaaccccguuuccacuccccacugagcugaccguuguggggccuagucuaacacccacugaggucccacugaacaccagcacagaagugucuacgaccuccacuggcgccgcuacaggaggcccucucgauucaacccugaugggggacgcggccagccagucgcccccagagucuagugcagcuccuccgcuucccuccuugcgaccaguuacugccuucacacuggaagccaccguggauacgccuacuuuagcuaccgcaaagcccccauauguaugugacauuacagucccugaugccuaccucaucaccacugugcuggcgagaagggcugugcaggaguauaucauuacagccaucaaagaaguccuucgcauucacuuuaaucgggcaguugagcugaagguguacgagcuauucaccgacuuuacauuccucguaacuagcggacccuucguguauaccgccauaucagucaucaacgugcugauuaacuccaaguugguuagagaucagacgccgcugaucuuaucugugaaacccagcuuucucgucccugaaaguagguuccaagugcagacaguucugcaguuugugcccccauccgucgacaccgguuucugcaauuuuacucagcgcaucgagaagggccuuaugaccgcucuguucgaaguacgaaaacaccaucaagggacauacaacuugacugugcagauucucaauauaaccaucaguucuucacggguuacgccccguagaggaccugugaacauuaucuuugcagucaagaguacacagggcuuccugaaugguuccgaggugagcgagcuacugaggaaccuuucuguaguggaauuuucguucuaccucggguauccgguccugcaaauugccgagcccuuucaguacccacaguugaaucugucacaguuacucaaaagcuccuggguucgcaccgugcugcuuggcgugauggaaaagcaacugcagaacgaggucuuccaggcggaaauggagcggaaauuggcucagcuccugagugaggugucuacuagaaggcgaauguggcgccgggccacaguugcagccggaaauagcguagugcaagucgugaacguuuccagacuagaaggcgacgauaauccugugcagcugaucuauuucgucgaggaccaggauggggaaaggcuuucagcugugaagaguucugaccucauaaacaagauggaucugcagcgugccgcaaucauuuugggauaccgcauccaagguguaauugcucagcccgucgaccgggugaaaagaccuagcccagagucccagucaaauaacuuauggguuaucgugggcgucgugauacccguucugguggucauggugauuguagugauccucuauuggaagcuguguaggaccgauaaacuugacuuucaaccugauacuguugccaauauucagcagcgacagaagcugcaaaucccaagcgucaaaggguucgacuuugcgaagcagcacuugggacagcauaacaaggaugacauacuaaucauucacgaacccgccccgcugccuggcccacucaaagaucacacaacccccucugagaacggugacgugccuuccccaaagaguaaaauccccagcaagaaugugcggcaucgcgggagagucucgccguccgacgcagauucuacgguaucagaggaaagcagugagagggacgcuggcgauaaaacuccuggagccgugaacgacggccggucccaccgagcuccccagucugggccaccucugcccagcucaggaaaugaacaacauuccagugcaagcauuuucgagcacguugauagaaucucucgcccacccgaagccucaaggcgugugccuuccaagauacagcuuauugccaugcagccaaucccggcucccccuguccagcggccaagccccgcggacagaguggcagagucuaacaagaucaauaaagagauucaaaccgccuuaaggcauaagagugaaaucgagcaccaccgcaacaaaauucgacugagagcuaagcggaggggccauuacgaauuuccuguuguggaugaccucucguccggugauacaaaagagcgccaccgugucuauagacgggcccagaugcagauagacaagaucuuggauccaaccgcaagcgugcccucaguauucauugagccuaggaagucuagccgcaucaaacgauccccgaagccaagacggaaacaucaggugaaugggugccccgccgacgcugaaaaggacaggcugauuacaacugauagugacggaaccuaccgcagaccucccggcguucacaacucagcguacaucgguuguccaucugauccugaccuccccgccgauguccaaacgccaagcuccguggagcugggcagguauccggcacuuccuuuucccgcuagucaguacauaccaccccagccuagcaucgaagaggcccggcaaacaaugcauucccuguuggacgaugcauucgcccuaguggcuccaucuucacagcccgccagcacugcgggggucggaccuggcguuccgccagggcugcccgcaaauucgaccccuucccaggaagaacgucgcgccacacaguggggaaguuuuuauucuccagcucaaaccgccaacaaucccugcagccgauacgaggacuauggcaugacuccucccaccgguccacucccgagaccuggguucggacccggcuuacugcagucaacagaacuugugccaccugauccccagcagccacaggcuuccgcagaggccccuuuugcugccagggguauuuacucugaagagaugcccaguguagcacggccgcgcccagugggcgggacgacuggaagccagauccagcaccugacccaggucggcauugcguccagaaucggggcccaaccuguggaaauacccccaucaaggggaagccaguauggcggucccggguggccuucuuacggagaggacgaggcuggccggcgagaagccacacacaugcucggucaucaggaguacaguuccagcccguuguuccaaguuccaagaaccucaggccgcgaacccucugcaccuuccgggaaccugccccacaggggacuccagggcccagggcugggauauccuacuucgagcacagaggaucuucagcccggccauaguucugcuucccuaauuaaagccauccgggaggaacuguugcguuuaagccagaagcaaucaaccgugcagaauuuucacaguuga

SEQ ID NO: 58088 - RNA, 5244 nt, Artificial Sequence
  derived and/or modified sequence opt3 from KIAA1551__Homo_sapiens__XP_005253462
augaacuggaaugagaagcccaaaagcgccacccugccuccacucuacccgaagucccagcccccuuuccuucaccaaucucugaucaaccagauuacaacuacgucacagaguagcuuuuccuauccaggcucuaaucaggaagcuugcauguaccccgggaacucgaauccuauaucacaaccauuguuaaacauccagaauuauccccagcagauuagcgugagugacaugcauaacggaaccgucguugcaucccacacaucuguggagagaaucacuuacgccaauguaaacgguccuaaacaacugacccauaaucuacagaugagcuccggcgugacacagaacgucuggcucaauucaccaaugaggaacccggugcacagucauauuggggcgaccguuagccaccagacugauuucggagcuaaugugcccaacaugccugcccugcaaucucagcuuaucacauccgacaccuauucaaugcagaugcaaaugauaccaagcaacaguacgcggcugcccgucgcauaccagggcaaucaggguuugaaccagucuuuuuccgaacaacagguggauuggacucagcaguguaucagcaaggggcucaccuauccugacuaccgcccacccccgaaacuguaccgauauucgccucaaucuuuccugcccgauuccacaauucagaagcagaauuuuaucccacacacuucacuccagguaaagaacagucaauuacugaauagcguucuuaccuugccuucccgucagacaucugccgugcccagccagcaguacgcuacccaaacggacaaaagaccacccccuccaccguauaacugcagguacggaucacagccccugcagaguacucaacauauuacaaagcaccuauccauggaggucccucagagccgggaaaugcucucuucagagauccgcaccaguuuccagcagcaauggcagaauccaaacgagaaugugagcacuauaggcaacuuuacaaaucugaaagugaacaccaauuccaagcagcccuucaacucuccuauuagaucgagcgucgauggcguucagacgcuugcacaaaccaaugaagagaaaaucauggacuccuguaacccaacaucaaaccaggugcuggauacuaguguagccaaggaaaaguuggugagggacauuaaaacccucgucgagaucaagcagaaauuuucugagcuggcucggaagaucaaaauuaauaaggauuuacugauggccgcggggugcauaaaaaugacaaacacuagcuauuccgaacccgcacagaauucaaagcucagccuuaagcaaaccgccaaaauccagucuggaccgcagauuacaccugugaugccagagaacgcugaacgccaaacccccacuguuguggaguccgccgaaacgaauaagacacaguguaugcugaacagugacauccaggaggucaauugccgaagauucaaccagguggauagcguauugccuaaucccguuuacucugagaaaaggccaaugccugacuccucacaugacgugaagguccuaaccaguaaaacuagcgcaguggaaaugacccaagcuguccugaacacacagcucucguccgagaaugugaccaagguugaacagaacucucccgccgugugugagacuauaagcguaccaaagucaaugaguacagaagaguauaaauccaagauucagaaugagaacaugcugcuucuggcguugcucucucaagcccggaaaacgcagaagaccguccugaaagaugcaaaucagacuauccaggacagcaagccggauuccugcgaaaugaacccuaacacacaaaugaccgguaaucaguuaaaccugaagaauauggagacacccucaacuagcaacgugaguggccguguucuagacaauucuuuuuguuccgggcaggaaagcucgaccaaaggaaugccagcuaagucagauucuaguugcuccauggaggugcucgccacgugucugagccuuuggaaaaagcagcccucugacaccgcuaaagaaaaggagugcgauaaguugcgcacaaacacuaccgccgucggcaucagcaaaccugcaaauauucacgugaaguccccaugcucaguaguggguaacaguaauagccaaaacaaaaucucuaaucccucccagcagacagcccugucaaugguuaugcacaacuacgagaguagcgggauuaauauaacuaagggaaccgaacuccaaaucgcugucguguccccucuggugcuuucugaggucaaaacgcugucgguuaagggcauuacaccggcgguguugccagaaaccguguaccccguaaucaaagagggcagcgucuguucacuccagaaccagcuggcagagaaugccaaggcuacugccgcauuaaagguggacguuuccgggccuguggccaguacagcuaccucuacuaaaaucuucccacugacccagaaggaaaaacaaaacgagagcacaaacggaaauuccgaagucacgcccaacgugaaucaggguaagcauaacaaacuagagucagccauucacucuccuaugaaugaucagcagauaagccaagaaaguagaaacuccaccguugugagcucugacacucuccagaucgauaauauuugcucacugguagagggcgacacauccuauaacagucagaucgcaaagauuuuuagcucgcuuccguugaagauggucgagccccagaaaccaucucugccuaaucaacaggggaucggauccagggaacccgagaagcagcucgacaacaccacagaaaauaaagauuucggcuuccaaaaggacaaaccagugcaguguacugaugugagccauaagauaugcgaccagucaaagagugagccuccccuggaaucuuccuuuaacaauuuagagaccaaccgggucauccuggagaaaagcucacuugaacacgcgacggagaagaguacagcuaaugauaccuguagcuccgccgcaauucaggaagacaucuacccacaagagauugaugccucuagcaacuauacuccgcaggacccugcucgaaaugaaauccauuccgauaaagcccccguuuuguaccuccacgaccagcugucagagcuacugaaggaguucccauaugguauagaagcagugaacacccgcgaggggucuguaggccagcaaacaacuuaccagaccagugaagaucagacagcugacaaaacgucgagcgauuccaaggaccccgccgaccagauucaaaucaccauucucucuucagagcagaugaaggagaucuuuccugaacaggaugaccagccauauguggucgauaaacuggcggagccccaaaaggaagagccuauaacugaagugguuagccagugcgaccuucaggccccggcugcaggacaauccagagauagugugaucuuggacucugagaaagaugacauucacuguugcgcccugggcugguuaagcauggucuacgagggggugccacagugucagugcaacucaaucaagaauuccaguagcgaagaggaaaaacagaaggagcaauguucuccccucgauacaaacuccugcaaacagggagaaaggaccucagaccgggauguuacugugguccaguucaagagccugguaaauaacccuaagacacccccagacgguaaaucgcauuuuccugagcuucaggaugacucucgcaaggacacccccaaaacgaagcacaaaagucugccaagaacugagcaagaauugguggcuggccaguucuccagcaagugcgauaagcucaauccucugcagaaccauaaaaggaagaaacuacguuuucacgagguuaccuuccacucauccaauaagaugacagccucuuacgaacaggcaagccaagagacccggcagaaaaagcaugugacucagaacagucgaccgcugaagacaaaaaccgcguuucuccccaauaaggacgucuauaaaaagcacuccagccuggggcaaucucuuucaccagaaaaaauuaaguugaagcugaaaaguguguccuucaagcagaaaagaaaguuagaucagggaaacguacucgacauggaggugaaaaagaagaaacaugauaagcaggagcaaaaaggcagcgucggugccacauuuaagcugggggacucucuuucgaauccuaacgaaagggcuaucguuaaagagaagauggugucaaauacuaaaagcguggauaccaaggccuccaguucuaaguucagccgcauacugacgcccaaagaauaccuacagcggcagaagcacaaagaggcacucuccaacaaggcuucaaaaaagauuugugucaagaaugugccaugcgacagugagcauaugagaccuucuaaacuggccguucagguagaaagcuguggcaaguccaacgagaaacacucaagcggagugcaaacaucuaaggaauccuugaacggccugaccagucacgggaaaaauuuaaagauccaucacagccaggagucgaagacuuauaacauccucaggaaugucaaagaaaaggugggagguaaacagcccgauaagauuuggaucgacaaaaccaagcuggauaagcuuacaaacauuuccaaugaggcacaguuuucucaaaugccgccacagguuaaagaccagaagaaacuguacuugaaccgcgugggcuucaagugcacugagcgagaaucaauaagccucaccaaacuggagaguuccccucggaagcuacauaaagacaagcgucaagaaaauaagcacaaaacguuccugcccgucaaggggaacacagagaaaucuaauaugcuugaauuuaagcucuguccagauauccuguugaaaaacaccaauagcguggaggagagaaaggacguaaagccccauccuaggaaagaacaggccccgcugcaggucucaggaauuaaguccacuaaagaggauugguuaaaguucguggcuacaaaaaagcgcacccagaaggacagucaagaacgggauaacguuaauagcagacucucuaaaaggucauuuuccgcggacggcuucgagaugcugcagaaccccgugaaggauagcaaagaaauguuucagacuuauaagcagauguaccuugagaaacgaucucgcagucuggguucguccccagucaaguga

SEQ ID NO: 58089 - RNA, 1896 nt, Artificial Sequence
  derived and/or modified sequence opt3 from KIAA1598__Homo_sapiens__NP_001120683
augaacagcuccgacgaggaaaagcagcugcaacucaucaccucucuuaaagagcaggccauuggcgaauacgaggaucugagagcugaaaaucagaagacaaaagagaagugcgacaaaauaaggcaggagcgggaugaagcagugaagaaguuggaggaguuccagaaaaucucacacauggucauugaagagguuaacuuuaugcagaaucauuuagaaaucgagaagacuugucgcgaaagugccgaggcgcuggcuacgaaacuaaacaaggaaaauaaaacccucaagcgaauuagcaugcuguauauggccaaacuugggcccgacgugaucacagaggagauaaacaucgaugacgaagauuccacuaccgacacagauggagcagccgagaccugcguaucugugcagugucagaaacaaauuaaggaacugcgugaccagaucgucucggugcaggaggaaaagaagauuuuggcuaucgagcucgagaaucugaaaucaaagcugguugaagugauagaggaagucaacaaagugaagcaggagaagacuguacucaauagcgaaguuuuagagcaaagaaaagugcuggagaagugcaacagggucaguaugcuugcaguggaagaguacgaagagaugcaagugaauuuggagcuggaaaaagaucuacggaagaaagccgaguccuucgcucaggaaauguuuauugagcaaaacaagcucaagcgccagucucaucugcuucugcagagcuccaucccugaccagcaauugcucaaagcccuggaugaaaaugcgaaguuaacacagcagcuggaggaggaaaggauucagcaccaacagaaagucaaggagcucgaggaacagcuugaaaacgagacccugcacaaagagauccauaauuugaagcagcaacuagaacugcucgaggaagacaagaaagagcuggaacuuaaguaucagaacucagaggagaaagcaagaaaccugaagcacaguguugacgaauugcagaaacgggugaaucagagcgagaacucuguaccaccgcccccuccacccccuccaccccucccuccaccgcccccuaauccaauccgcucccugaugucaaugauucgaaagagaagccaccccagugguucuggcgccaagaaagaaaaggcuacgcaaccugagacuaccgaggaagugacagauuuaaaaaggcaggccgucgaggaaaugauggaccggauaaagaaaggggugcaucugcguccaguuaaccagacugcacgccccaagaccaaaccggaguccagcaagggaugugaaucggcuguggaugagcuaaagggcauccucgguacacugaauaaaucuaccuccucaagaagucuuaagagcuuggacccugagaacuccgaaacggagcuggaaaggauucuccggcgacgcaaagucacugccgaggcggauucuagcucacccacagggauccuggccaccagugaauccaagagcaugccagugcuuggaucuguaucaaguguuacuaaaacagcacugaauaagaagaccuuggaggcugaguucaacagcccuucucccccaacgcccgaaccuggcgagggcccaagaaaacucgaagggugcaccuccucgaaggugacauuucaaccgcccagcuccauaggauguaggaaaaaguacauugacggugagaaacaggccgaaccugucgugguccuggauccagugucaacucacgagccccagaccaaggaccagguugcugagaaggauccuacacaacauaaagaagacgagggcgaaauccagccagagaauaaggaggauaguaucgaaaacgugcgggagacugacucuagcaauugcuga

SEQ ID NO: 58090 - RNA, 1485 nt, Artificial Sequence
  derived and/or modified sequence opt3 from KIAA1715__Homo_sapiens__NP_001291937
augggcagaagcuggcccgggcugucccucugccaguggaggcuucugccugccuuggaggcuggaugggcaguggccgcggaaaccgguggcgggggacggccaggccgcgcugccccggcaucuuguucaugcgaguucuuauggacaaucgacgauauuuaccacugugcccaauuucugcagauaaaggacgguuggaucauuuucaguauggaagggaaaacuaagcccagcacggucgagguucuagaauccaucgauaaagagauucaggcucucgaggaauuucgagagaagaaccagcgucugcaaaaacuuugggugggaagacugaucuuguauucuucgguacucuaccuguuuaccugccugauaguguaucucugguacuuaccugacgaauuuacagcaaggcuggccaugacucuuccauucuuugcuuuccccuugaucauuuggucaauccggaccgucauuaucuuuuucuuuagcaagcgcacagagagaaauaacgaggcccuggaugaccuaaagagucagaggaaaaagauacucgaagaggugauggaaaaagagaccuauaagacugcgaaacugauucuugaacgguucgauccugacuccaagaaggcaaaagagugugagccacccucugccggcgcugccguuacagcacgcccuggccaggaaauccgacagagaaccgcugcccaaaggaaucugagcccaacgccggcgucccccaaccaggggccuccaccccaggugccugucucaccaggacccccgaaggauaguagcgccccuggugggcccccagagcggacugugaccccugcauugucuuccaauguacucccccgucaucuggggucaccagcuacaagcguucccggaaugggcuuacacccuccagguccgccccuggcccgcccuauucucccaagagaaaggggcgcucuugaccggaucguggaguaccuggucggagauggcccccagaaccgauaugccuugaucugccaacaguguuuuagucauaauggcauggcacuaaaagaagaguucgaguacauugccuuccgcugcgcuuacuguuucuuccugaacccugcgagaaagacuaggccacaggcaccccggcucccggaauuuucuuucgagaaacgccaagugguggaaggguccagcucggucggaccucugccaucugguuccguucuuucaagugacaaucaguuuaacgaggaaagccuggagcacgauguguuggacgacaauaccgagcagacagaugacaagauacccgccaccgaacagacgaaccaaguaaucgagaaggcuuccgauucugaggaaccugaggaaaaacaggagacugaaaaugaggaagccagcgugauugagacaaacucaaccguccccggcgcagacaguaucccagauccugagcucuccggggaaagccugacugccgaguga

SEQ ID NO: 58091 - RNA, 3111 nt, Artificial Sequence
  derived and/or modified sequence opt3 from KIAA1804__Homo_sapiens__NP_115811
auggcccugagaggcgcugcaggggccaccgacacacccgugagcuccgcgggaggugcuccuggcgggucugccucaaguagcuccacuucuucgggaggcucagcaagcgccggugcugggcucugggcagcccuuuacgauuaugaggcuaggggagaagacgagcugaguuugcggcgcggccaguuagucgaaguucugucccaagaugccgcggugucuggcgacgagggguggugggcaggacagguacagcgacgucuagguaucuucccagccaacuacguggcuccgugcagacccgccgcaagcccugcuccacccccuuccaggccaucaagucccguccacguggccuuugaacggcucgagcugaaggagcuuauuggcgccgggggauucggccagguuuaucgcgcgacguggcaaggucaggaaguggcagucaaagcugccagacaggauccugagcaggacgcugccgcagccgcugaaagcgugaggcgggaggcgcgccuguuugcaauguugcgacauccaaauauaaucgagcucagagggguaugucugcaacagccgcaccugugccucguuuuagaguucgccaggggaggcgcucugaaccgggcccuugcagccgcuaaugccgcacccgauccucgugcgccaggcccccgcagagcuaggcggauuccuccacauguguuggucaacugggccgugcagaucgcacgagggaugcuguaccuacacgaggaagccuuugugcccauucuccaucgcgaccugaagucuuccaauauccuucuguuggagaaaauagaacacgaugacaucuguaacaagacccucaaaauuacagauuucggacuggcuagagaguggcacaggacuaccaagaugucaacagccgguaccuaugcauggauggcuccggaggucaucaagagcaguuuauuuucuaaaggcuccgacauuuggagcuacgggguucugcucugggaacuucugacuggagaggugccuuaucggggcaucgaugguuuggccguagcguacgggguggccgucaauaagcuaacacugcccauaccaucgaccugcccugaacccuucgcuaaacucaugaaggaguguuggcagcaagacccacauauucgccccucuuuugcacugauccuugaacagcugacggccauugagggcgcugugaugacugagaugccucaggaauccuuccacucaaugcaagacgauuggaaauuggagauccagcagauguuugacgaacucagaaccaaggagaaggaacugaggagucgugaggaggaauuaacacgggccgcacugcagcaaaagagccaggaggaacuacucaagcgaagagagcagcagcuggcggagagggaaaucgauguucuugagcgcgaauugaacauucugauauuccaacucaaucaggagaaaccaaaggugaaaaagcggaaaggaaaguuuaagagauccaggcugaaacuuaaggacggccaucgcaucucucugccgagcgauuuccagcacaaaauuacuguccaggccucacccaacuuggacaagcgacggagucucaauuccagcagcucaaguccuccaagcucccccaccaugaugccucgucugagagcuauccaauuaacaucugaugaaucgaacaaaaccugggggaggaauacgguguuccgccaggaggaguuugaagacguaaagcggaacuucaagaaaaagggaugcacuugggguccaaauagcauacagaugaaagauagaacagacuguaaggagaggauucgaccccuguccgauggcaacucaccguggaguaccauccuaaucaaaaaccagaagacuaugccucucgccucucuguuuguugaccaaccagggagcugcgaagaacccaaacuuuccccugacggauuggaacaccgcaaacccaagcagauuaaacugccaucacaggcauacaucgaucucccucugggcaaggacgcucaacgggagaaucccgccgaggcagaaagcugggaggaagccgcuucugcgaacgccgcaacaguguccauugagaugaccccaacgaauaguuuaagcagaucuccgcagaggaaaaagaccgaauccgcucuguaugguuguacaguccuuuuggccucaguggcccucgggcuggaucuacgugagcugcauaaggcucaggcagccgaggaaccucuccccaaagaggaaaagaaaaagcgcgagggcauauuccagcgggcgaguaaaagcagaaggucggcuuccccacccacuucucugccuucuaccugcggagaggccucaaguccacccucccuuccuuugucuagcgcacugggcaucuuauccacaccgucauuuagcacuaagugucuccugcaaauggacagugaagauccacuugucgacucugcccccgugaccugcgauuccgagaugcugacaccugacuucugcccaaccgcucccgggagcggacgagaaccugcauugaugccgcggcucgauacugacuguucgguuucacgcaaccugcccucuaguuuucuacagcagacgugcgguaaugugccauacugugccuccagcaaacacagaccuucucaucacaggcggacaaugagcgauggcaaccccaccccaacuggggcgaccauuaucuccgcuacaggagccucagcacugccucucugccccaguccagccccgcauagccaucugccucgagagguaucucccaagaagcacuccaccguccacaucgugccacagagacgccccgcuucacuuaggagucguagcgacuugccucaagccuauccacagacugcaguuucccagcuggcucagacagccuguguggucggccggcccgguccucacccgacgcaauucuuagcggccaaagaaagaaccaagucucaugugccaucgcuccuggaugcagacguagaggggcagagcagggacuacacugugccccuuugccgcaugcgaucaaaaacauccagaccuaguauuuaugagcuggaaaaggaguuucuaucuuga

SEQ ID NO: 58092 - RNA, 2124 nt, Artificial Sequence
  derived and/or modified sequence opt3 from KIAA1841__Homo_sapiens__XP_005264663
augagcagaggcuacuccgagaacaauaacuuccugaauaacaauaaccagauggugcucgacaugauccuuuauccccugauugggauaccucaaaccaucaauugggaaacaauugccagguuggucccaggauuaacuccgaaggagugcgcuaaacgguuugaugaacugaagucuucagguaguagccccguugacaaccaguacaauucccuaauggcagccggcgagucuccuguggaaacgcucgcgaccuauaucaaaucgucacugcuugauauucacggggaguuccaggagacaccaguaggacaugacgcugugagcaagacuggccgccacaguaucgccuccacccgaaacuguucuagcgaauccgagaauugcacaacccauaacgguggggaaaugacugaggagucagaaggacccaauauggucauacacgugugugaugaggccaaaaaccugaaggaagacuuuacaugcccucgugauuugcucaucagugagaugaaguacuucgcagaauaucugagcauggacgcucagagaugggaggagguugauauuucugugcauugugacguccacaucuuuaauuggcugauuaaauacaucaagaggaacaccaaagaaaacaaggauugcgagaugccaacgcucgaacccggcaaugugauauccauuuuaaucucaagcgaguuccugaaaauggacagucuuguagaacaauguauucaguauugccacaagaacaugaaugcaaucguugccacuccuuguaacaugaauugcaucaacgcuaauuugcugacccggauugccgaucuauuuucucauaacgagguggacgaccucaaggauaaaaaggacaaauucaaguccaaacuguuuuguaagaaaauagagcgccuuuucgauccagaauaccugaauccggacagcagaucgaacgcggcaacauuguacaggugcugccucuguaagaagcuguuaacuaaagagaccgaacggcgcauccccugcauuccuggcaagaucaaugucgaucgaagagggaacauaguguauauucacaucagggacaaaacaugggaugugcaugaguaccucaauucucuguuugaggaacuuaaguccuggcgggacgucuauuggcgucuguggggaaccaucaacugguugacguguucacgcugcuaccaggccuuccuauguauugaguuuagucacugccaguaucacagcgaaacuguuguguacccaacagcugccuccucucugaauaccguagguacuggcaucuaucccuguugcaaccaaaaagugcucagauucgauccuacacagcugaccaagggguguaaggucagggaccauauggugacgcuucgggaucagggagagggcggugaccugccaagcugccccaccgcacgaauguuggacgaucuccacaaauaccgcgacguuauuguggucccguucucaaaggauacagugagugacguagggguuggacugugugaugaaaaaggcauagagugcgacguguuacuggagccuaacacucccuggggcccaaagaccggggaacuaaaugcuuuucucucccugaaaaacuggacacuucaguugaagcaacagagccuguucucugaggaagaggaauacacuaccggaucagaggucacagaggaugaagugggugacgaggaagaggucaguaagaaacagagaaagaaagaaaagccuaaaaaguuuaccaggcaacccaagaaacaggugagcuccccaugcgcccagcggaaggagaaagcgcucgagaagucugccucgcgcgauguuagccccuucgugauguccaugcagaaaaauaagugggacgcaacuagaucacugagguuuaaccaagaugcucagcgugaagacgaucagcggcgaaugacggagaucacaggccaucuuauuaaaaugagacugggggacuuggacaggguaaagaguaaggaagccaaagagaccgauaagcuccgcccucgggacggaacugucucuaaaagcaauagaaaguccggccugucaagcguguuacugaugaccguucuacucuguuga

SEQ ID NO: 58093 - RNA, 1557 nt, Artificial Sequence
  derived and/or modified sequence opt3 from KIAA1919__Homo_sapiens__NP_699200
augcugugcgccagcuuccucggccuugggcuguccguggcuaucgucggacccaccuuucaggacuuggcaacaaacguuaauagaaacauuucuucauuaaguuucauauuuguggguagggcccugggcuaccuaagcggguccguaaucggaggcuuccucguggaugucaugaauuauuuucugcuucuggguauuucuaugucggcgacuacggugggguuguaccucguuccuuucuguaagaccgcuauccugcugacagugaugaugucaauuuuuggagucagcaucggcauacucgacacuggcgggaacguguuaauccuggccauuuggggagauaaaggugcaccacacaugcaagcccuucacuucaguuuugcuuugggcgcauuccuggccccgcuacucgcuaagcuggcccuugggcccaccgcguccgcagagaaucacacagaaucugacuuucauccugcccugaaccagagcuccgaugcugacucagaggccuuguucggaguaccaaaugauaaaaaccuccugugggcauaugcuguuaucggcaccuacauguuuuuagugagugucauuuucuucugccuguuucucaagaauagcucuaaacaggaaaaggcccgggcguccgccgagacuuuccgccgagcaaaguaucacaacgcuuugcuguguuugcuauuucuguucuuuuucuuuuacgugggugccgaagugacauaugggucauacgucuucagcuuugcuaccacgcaugccggaaugaaagagagugaggcagccggccucaauucuaucuucuggggcacuuuugcugcgugccgugggcuggcaauauucuuugccaccugucuucagcccggaacaaugauuguucuguccaacaucgguagcuugacuucgucucucuuccugguguuauucgacaagaauccuauuugccuguggaucgcuaccuccguauacggcgccucaauggcaacaaccuuuccaaguggggugagcuggaucgaacaauauacgacuauucacggaaaauccgccgcuuucuuugucauaggcgccucucuaggugagauggcaauccccgcggugauugggauccuccagggcaaguacccugaucugccaguugugcuuuauacaagccuuggagcuucaauagccaccggcauucuguucccgguccucuacaaacuggcaacuagcccccuugacagacagaggaaggaagaucggaaguccgaggaccagaaagcccuguugaguucuucagggcucaacgaguaugaagaggaaaaugaggaagaggaugcugagaaguggaacgaaauggacuuugagaugaucgaaacaaacgacaccaugcgccacaguaucauugagacgagcagauccucucugaccgaaccuacagccgagguguacaaucaauauccaucgaacgcauuaguauucgagagcucccccuuuaauacuggaucagcucauguuaaacaucugccugaaaccaggacaaaggguacuaacguguga

SEQ ID NO: 58094 - RNA, 4551 nt, Artificial Sequence
  derived and/or modified sequence opt3 from KIAA2022__Homo_sapiens__NP_001008537
auggacaaccagcaagauaaggccaucguggcuagcgcaaauggcgagaacacccugauuaauggggucaaagaaaacgacuccgaggaucaggacguugccaugaagucuuucgcggcucucgaagccgcagcccccauacagccuacaccaguggcucagaaagagacucuuauguacccgagaggacuguugcccuuaccuucaaagaaaccaugcaugcaaagucccccuagcccacugggucuaaucgaagcacccgagcacgccgcuaauuccgccucuguaaacgcgauuucgcucacgucaggcaucgcaaaggggcugaauaccuggagccuuccuaacgagugugaaaaggccccauuugcuauuauggagccggccggaaugagugcacugaauggcgauugcuugaugcagcccuccaggacaugucucgguugcuucauggaaucuaaagacgcuguggauccugagccagggaucagccugaaggucggagaccugaaccgggauuaugagacuugugccguguccgacauaggcauccagugcauuaaugcgggcgaaaacaugaaauacggggagcagcucuuaucagaucaacugcuuggauuucccuugcauaagagucgcgccggugaccgacgugaaaccgagaaaccugauaucgaccuggaagacccagcacaaaagagcuauuacgaggcucuacuccuggauaaguguaauacagaggaagcccuucuggcuaacucuaaucaggacuggggcuauuucgagaccuuuauuuccgaaucaaaaaucgaguugcucgaucugugcagcaagaacgaauuaaguguuaaccuguucucugaggaggacguggauaauuacauguuugacgaugacgaauccacucucgggagcgaugucuguucgcuuaaaauaagauaugagucuuuccaggacaacgugagggauaagacaacccuguugaugcaggaagacgcccaguuuaauuucuuucccuccguauucacgacuugcccgaaacgggagucaaagaguggagcacuaaaacagagcuccgacuuuucucaauucaagguuccugaugugagcauuaucuggggcgaagaggacaagaaccuggauaaaaagaaagguaaggaggaagggcaggaggacaaaggagucgaaaagaaggauggcaaagacaauggcgagaagcccgcccucaacaaaccauguucagggaccgagguggaacagcugaagaauccuaaacagggacaccuugcuaacagucuggagacauccgguagcuucucugaugacucaaguuuuauugaaaucagcuacgaugcgaugggcgagaucaaggacugcucccgcuacauggcaagagauacuaauucugggucgagcuccucacaacagaacuauggauugagggccaagcggaaagugcgcuacagugaagacuaucucuacgaugucgacucucuggagggcgagaagguuaaugaacgaaaagagugguuacccguggguagcaaggaagaggacgaugacgaauggugcccaaagaagagaaggaagguaacccggaaagagcccccugugauuauaaaguauaucauuaucaaccguuucaaaggggagaagaauaugcuggucaaacuaggcaagguggaugcuuccgaaacaaccguuaaccucucagagaaucagcugaacaaauacgccaaacuugcaccauugaagggauuuuggcagaaaaagaaaaagcaacgcaacacgaauacugacagcauaaaaacaccguucucucagaagcaguccuuugaacccggcaguuucgaggugagcuuucugccuccagccagaaagaggaaaucuaagcucgggaaccggcaucggauucagcgcauccccuccaucgaaauuucagcuaguagcaaacaaaucucgcuguguaaugaucagagacacgccuccaaccauaaggaggacggaggucuuaaaggcacccugaagucugcaccuuugggggcgccaagcugcgcuaauggaucacaccucaacgauauuacuggccccgacagugucaaggugaaagcccaggauacagaguucaaggguccggaaaggaaaguacugaauaagauaaaauuuaaguccgaggcacgguuaaagucuaaaaagguuaaagccgcugggcaggaaagcaagccuaucgugcaaauguccccacugcuagagaaccagucaagcaaagccaaucucaagaacgaggucauucccggcaccaguaauucuucccgccugagcgaauuucacgaggcaaaagcugccaagucgucaacguuucuuccuaccacauguucuagugaaaugcccuuguccagcgcgaacgugacuaccaauaucccagucaucccuggaggcuaucugcagacacuccuggacgccucugauuuaagcaacaauacuuccauuucauacuucagucaucacagccccgagcaaaacgaagggucucugacccagacagagaaguccuuugugccacuucagccgacccaggacugcguuuugacuucaaguagcgauuccgagcuccaacagucuucgcauaacuucaaaauggaaagcucaaauuacagaaacguguggccuaauaaggcuacguccggaacacaggaguucauggcagaaguaaguagggagauagcccccacccagucuagcgaauuuggugcuucccaagucgugucaauggagaacaaucugacuccaaccacauauaaccccaucugucuaaauucuggcgggagcaacugcaauaaaguucuguacgacaguaugcaggacacccagcucccuuccgaugacagcuaucagcugugucacuucaacaauggagagauuugcuuuccauuccaacagggccccgugaacauggaugacggucgucuuuucucuuucgauucaauggccccuuuguccgucaguagcucgaauuacuguucucuguccuuaaagagcugcgaaaaagacggggaugacgauaucacugacgauuuucucgcacacuguucaccgaagcuggugauucagcaaaguaucgacgagauagcgccacuuaaggaaucuacagaccuguuggauaucuccaacuucacgcccgacaaauuucggcauagcucacucagugagaugagcccuccagauacccccucccugucuccucagauuacucgaugcgaaagcaugaagacacuaggcacccugaaaggauuccaggagggcguaccggggccccucgacuccguggagaagaucaaaugggauugcucaacacugucuagacagguucaaauggaagacggauuuacucuuaauaaccaccaguuccaguuucauauguucaacgaugaggacagugucucguugcugcagaagaauccauguuuaagcaccuucaacgauccuuccggccaaauuucuacgaauaacaaggugucaaaaagcaggaagaaauccagucccucuaagagcggugccaugaaucagucauccagucagaaaaacacccgcaaaaagagccucaaggggaauaacaagggaaucgaaaaaccaccuggcaaaaauucucgacaggugcccaaguccacaaagaaggguaaauauauggcugccauaaacggcgagaagaugcaaauugggaucggaagaggcgggucacagacuaauaccauuagcucgacaggaaaaacucuggcagagugcauccagcacggcgguccaauggcuucuaugaagaugccgagucagaaagggcuuuccggagacugggcccugggcaaggaaagcucaccugguugguccgauaugucuaugggcaccaacacgaauagccuacucgacgaugaccaaagggaguuucaggaacccaguuacauacuguccaacaucgcaagcgggauggccgacguccagcgcuucaugauggcuucuauugagccauugugggaacccauggagcaucacggagauccuaauaucuuuuauucaccagagaguaacucccugaaauuaaagacacucaagauucuggcgggcacuccccaagaaagcaaaaagaaaaucaauucugggucgcagggagccaccaagaaccaccgaucaauaaaaggcguuagcaaguccaacgguaagacagcaauuggggacccuggacgggcuaauaugccgggcuacaacgaggauagucguucuaccuucuuugacaaaaaguacagcaauauguccacucuugguaacaauggcccaacccauaaaaagcuguauagacacaaaucaaguucuaaggccuugagggaugaaaaguguaaagggaagcauauggagcgcgaacaggugcacaaagacgagagcggaacagccuccuucgagaagcuccgggauucagacuacaaccugcuaaaagcugaaacgaccuuuugggugcugcccguauucgaggaagagacuagaaucuuucagaaggauaucuga

SEQ ID NO: 58095 - RNA, 5316 nt, Artificial Sequence
  derived and/or modified sequence opt3 from KIDINS220__Homo_sapiens__NP_065789
augagcgugcugaucucccagucugucauuaacuacguugaggaagagaauauacccgcccucaaggcucuucuggaaaaaugcaaggacguggaugagagaaacgaauguggccaaaccccuuugaugaucgcagccgagcaggggaauuuagagauuguaaaagaacugaucaagaacggagcgaauugcaaccuagaggaccucgauaauuggacagcucugauuucagccaguaaagaaggucacgugcauaucgucgaggagcuucugaaguguggcgugaacuuggaacacagggacauggggggauggacugcacucaugugggccugcuauaagggccggacggauguuguggagcugcugcucagccauggugcuaauccauccgucaccggguuauacucuguguauccgauaaucugggcagccggacgcggccacgcugacauuguacaucugcuuuugcagaacggcgccaaaguuaauuguucggauaaguacgggacaacuccccuggugugggcggcacgaaaaggacaccuagaaugcgucaagcaccuccuggccaugggugcugacguggaucaggagggcgccaacucaaugaccgcacuuaucguggcugucaaagggggauauacacaaagcguuaaggaaauucugaagcguaauccuaacgugaauuugaccgacaaagauggcaacacugcccucaugaucgcgaguaaggagggucauacagagauaguacaggaccuguuagaugccgggaccuacgugaacauuccagacagauccggagacacgguccugaucggcgcagugaggggcgggcacguugaaauugugcgggcucuccuucagaaauaugccgauaucgacauccgcggacaggauaauaagacugcucuguacugggccgucgagaaagguaacgcaaccauggugagagacauuuugcaauguaaucccgauacagaaauaugcacuaaggacggcgagaccccucuaaucaaagccacaaagaugaggaacauugaaguaguugagcugcuccuggauaagggggcuaaagugucugcggucgacaagaaaggagauaccccacuucauaucgcaauacggggccgcagccgaaagcuggccgaguugcuccugagaaaucccaaagacgguagguuacuguaccggccuaacaaggcuggggaaacgccauauaauauugauuguucccaccagaagucaauccuaacucagaucuucggcgcccgucaccucaguccgacagagaccgacggagacaugcugggcuacgaucuuuauagcucugcauuggccgacauucuguccgaacccacuaugcagccuccaaucugcguggggcucuacgcucaauggggaucagguaaaagcuuucugcuuaagaaacuggaggaugaaaugaagacauucgccggccagcagauugagcccuuguuucaauucaguuggcucauagucuuucugaccuuacugcuaugugggggacucggccugcuuuucgcauuuacggugcauccuaacuuggguaucgcgguuucucuguccuuccucgcucuguuauauauuuuuuucaucgugaucuacuuugggggccgcagagagggagaaagcuggaauugggccuggguacugucgaccaggcuugcacggcacauuggcuauuuggagcuccugcuaaaacugauguucgucaacccacccgaacucccggagcagacaacuaaggcccugccugugcgauuucuuuucaccgacuacaaucgcuugucuuccguugggggagagacaucacuggcugaaaugauagccacuuuaagugaugcaugcgagagagaauucgguuuucucgcuaccaggcuguuccggguguuuaagacagaggacacccagggcaaaaagaaauggaagaaaacuugcugucuucccagcuucgucaucuuucuguucauuaucgggugcauuaucuccggaauaacguugcucgccaucuuucgcguggauccaaagcaucugacaguaaacgcggugcuaauuucuaucgccagcguugucggccuggcuuucgugcucaauuguagaaccugguggcaggugcuggacucacuuuugaacagucaaaggaagcgucugcacaaugcagccuccaaauuacauaagcucaaaagcgaagguuuuaugaagguccugaaaugcgagguugagcuuauggcucggauggccaagacuauugauucuuucacccagaaccagacacgacugguggugaucauagacgggcuagaugcaugugaacaggacaaaguacuccaaaugcuggauaccgucagaguguuguuuucaaagggcccuuucauugcgaucuuugccagugacccccacauuaucauaaaggcuaucaaccagaaucugaacagcguuuuaagggacuccaauauuaacggacacgauuacaugcgcaauaucgugcaucucccagucuuccugaacucucggggccuuucgaaugccagaaaauuccuggugacuagcgcaacaaacggggacguucccugcuccgauacgaccggaauucaggaggacgcugauaggcgcgugucacagaauaguuugggcgaaaugacuaagcucgguucuaaaacagcccugaaccgacgggacaccuaucguagaaggcaaaugcagcgcacaaucacucggcagaugagcuuugaucuaaccaagcugcuuguaacggaggacugguucuccgauauaucaccucagaccaugagaaggcuccugaauauugucagcgugacagggcgauugcugcgcgcaaaccaaaucucuuuuaauugggaccgguuagccuccuggaucaaccucacugaacaguggccauacagaaccaguuggcugauucuuuaucuggaggagacagaaggaaucccggaucagaugacuuugaaaaccauuuacgagaggauaagcaagaauauccccacgacaaaggacguggaaccucuccuggagauugauggcgacauccguaacuucgaagucuuucuaucuucccgcaccccaguucugguggcucgggacguaaaaguguuccuucccuguacugucaaccucgauccuaagcugagagagauuaucgcggacgugagggccgcacgagagcaaauaucaaucgguggcuuggcuuauccacccuuaccgcugcacgaagggccuccacgggcccccaguggauacagccagccucccucgguuugcuccucuacaagcuuuaauggcccauucgccgggggaguggucucaccucagccccauaguuccuauuacucuggcaugaccgguccacagcacccguuuuacaaccgcccuuucuuugcucccuaucucuacacuccaagauauuaccccgggggaagccaacaccugauuuccaggccuucagugaaaaccagccuuccacgggaucagaauaacggccuggagguuaucaaggaagacgcagccgaggguuugaguucucccacagauuccagccgaggcucggggccugcgccgggaccagugguccuacugaauucacucaacguagacgcugugugugagaaacugaagcagauugaaggccuugaucagucuauguuaccccaauauugcacgaccaucaagaaagccaauauaaacgggagaguucuggcacaguguaauauugacgagcucaagaaagaaaugaacaugaauuucggagauuggcauuuguuucgcaguacugugcuggagaugaggaacgccgaaucccacgucgugccugaggacccacguuuccucagcgagucuagcuccggccccgcuccucauggugaaccggcacggagagccucacacaaugagcugccccauacagaacuuaguagccagaccccauacacacugaacuucucuuuugaggaauugaauacucuagggcuggaugagggagcgccuaggcacuccaaccucucauggcagagucaaacccgccgaacgcccagcuuauccucucugaacucgcaggacagcucaaucgagaucuccaagcuuacagacaaaguacaggcugaauauagagaugccuaccgggaguacauugcacaaaugagucagcuggaaggcgguccaggcucuaccacuauaagcgggagguccucaccucacucuaccuauuacaugggacagagcaguuccggcgggagcauccauucuaaucucgagcaggaaaagggaaaggacucagagcccaaaccagaugacggccgcaaguccuucuugaugaaacguggugaugugauugacuauaguagcucgggggucucuacaaacgaugccuccccgcuggacccuaucacugaggaagaugagaagagcgaccaaucaggaaguaaacuccugcccggcaagaaaucuuccgaaagaagcucacuuuuucagaccgaucuaaagcugaagggcaguggguugcgguaccagaaauuaccaagcgacgaggaugaguccggaacagaagagucugacaauacgccccugcucaaggacgauaaagacaggaaggcugaagguaaaguugagcgcgugccuaagagcccagaacacuccgccgagcccauucgaaccuucaucaaggcaaaagaguaucugucagaugcucuucuggacaagaaagauucuagugacucgggcgugagaagcuccgaaucuucaccuaaccauagccuccacaaugaggucgccgaugacucccaguuggaaaaggcgaaccugauagagcuagaagaugacagucauucugggaaacggggaaucccgcacagccugucaggccuccaagauccaauuaucgccaggauguccauuugcagugaggacaagaagagccccucugagugcucccuuaucgcaucaagcccugaagagaauuggcccgcuugucagaaagccuacaaccugaaucgcacuccaucgacagugaccuuaaacaauaacucugcuccugcaaauagagccaaccagaauuuugaugaaauggaggguauaagggaaacuagucagguuauuuugcggcccuccagcucaccaaacccuacaaccauccaaaaugagaaccugaaguccaugacgcacaaacguucucagcgcagcaguuauacucgacucuccaaggacccgcccgagcugcaugccgcugcgagcucugaaucaaccggguucggagaggaaagagagaguauccuuuga

SEQ ID NO: 58096 - RNA, 3171 nt, Artificial Sequence
  derived and/or modified sequence opt3 from KIF11__Homo_sapiens__NP_004514
auggccagccagcccaacuccucugcuaagaaaaaggaggaaaaaggcaagaauauccaaguggucguuagaugcaggccuuucaaccuggcagagcggaaagccucagcgcacaguauuguggaaugugacccaguacgcaaggaggugagcguccgaaccgggggacucgcugauaaguccucucguaaaacauacacuuuugacaugguguucggugccucgacgaagcagauagauguuuauagaucaguggucugcccgauccuugacgaagugauuaugggcuacaauuguaccaucuuugcauaugggcagacaggaacuggcaaaaccuucacaauggagggugagaggagccccaacgaagaguacaccugggaagaggauccucuggccgggauuaucccacggacuuugcaucagauauuugagaaguuaacagacaauggaaccgaguucaguguaaaaguuucccugcuagagaucuauaacgaagaguuguuugaucugcuuaaucccucuagcgacguguccgaacgccugcaaauguucgaugacccuagaaacaagaggggcgucauuaucaagggcuuggaggagauuacggugcacaauaaagaugaaguguaccagauccucgagaagggggcugcaaaacggacuaccgccgcuacacugaugaacgccuauucaagucgcagccauucugucuuuuccguuacuauacacaugaaggaaaccacaauugacggagaggaacuggugaaaaucgguaagcucaauuuaguagaucuggcgggcucagagaacauugggcgaagcggagcaguggacaaaagagccagggaggcuggcaauaucaaccagagucuuuugacccugggucgggucaucacggcccuaguggaacguacuccacauguucccuaccgcgagucuaagcucacaaggauucugcaggacucccuugggggaagaacccggacuagcauaaucgcaacaauuucgccugcuucucugaauuuggaagagacccucuccacgcuggaauacgcccaccgagcgaagaacaucuuaaacaaaccagaggugaaucaaaagcugaccaaaaaggcccucauaaaagaguauacagaagagauugaacgccuuaagagagaucuggcagcugccagggagaagaacggcgucuacaucucagaggaaaauuuccgggugaugaguggcaaauugacuguacaggaggaacagaucguugagcuaauugaaaagaucggggcuguggaggaggaacugaaccgcgucaccgagcucuuuauggacaauaaaaacgaacuggaucagugcaagagcgaccuucaaaauaaaacacaggagcuggaaacuacccagaagcacuugcaagagacaaagcuccagcuggugaaagaggaauauauuaccuccgccuuagagucuacugaagagaagcugcaugaugcagccagcaaacuacucaacacggucgaagagacaaccaaggacgugucaggacugcacaguaaacuugauagaaagaaggcuguugaccagcauaaugcggaggcacaggauauauucgguaaaaaccucaauucccuguuuaacaauauggaagaacucaucaaggacggcagcucuaaacaaaaggccaugcuggaagugcacaaaacucuuuucgggaaccuguugucaaguagcguauccgcucucgauaccauuacaaccgucgcccugggaucuuuaacuucgaucccggagaaugugagcacacacguuucccagaucuucaacaugauucugaaggagcagucacuagcagccgaaaguaaaacggugcuccaggagcugauaaacguccuuaagaccgacuugcugucuagccucgaaaugauccugucccccacugugguaucaauuuuaaagaucaauagccaacugaaacauauuuuuaagacaucucuuaccguggcugacaaaaucgaggaucagaagaaagaauuggacggcuuccucuccauacuguguaacaaucuacacgagcugcaggagaacacaaucugcagucucguugaaagccagaagcaaugugguaaucugacugaggaucuuaagaccauuaaacagacgcauucucaggaauugugcaagcugaugaacuuauggaccgagagguuuugugcccucgaagagaaaugcgagaauauccagaagccucuguccucaguccaagaaaacauucagcagaaaaguaaggacaucgugaauaagaugacauuccacagccaaaaauuuugugcagauucggacggguucucccaggagcuucguaacuuuaaucaggaaggcacuaagcugguggaggaaucugucaaacauagcgauaaguugaacggaaaucucgagaaaauaucacaggagaccgaacaacggugcgagagucugaacacacgaacuguuuacuucuccgaacagugggugucuagccuaaaugagagagagcaggaacugcacaaccuccuggaggugguaucccagugcugugaagcgucaagcagugacauuaccgagaagucugauggcaggaaggcugcccacgaaaaacaacauaacaucuuucuugaccagaugacgauugaugaggacaaguugaucgcacagaaucuggaguuaaacgaaacaauaaaaaucgggcucaccaagcugaauugcuuccuugagcaggaucugaaacuagacauuccaacuggaacaacuccccaacgcaaguccuaucucuacccuagcacccugguccggaccgaaccaagagagcacuugcuggaccaguuaaaaaggaagcagcccgaacuccugaugaugcuuaacuguucggagaauaacaaggaggaaacaaucccggauguggacguugaggaagccgugcugggucaauauacggaggaaccuuugucacaggagcccucugucgaugcuggcguggacugcaguuccauugggggaguuccauuuuuccagcauaaaaagagccacggcaaagauaaggagaaucgcgguaucaacacccucgaacgaucuaaaguggaggaaacuacagagcaccugguaaccaagagccggcuaccucugcgugcccagauaaaucuuuga

SEQ ID NO: 58097 - RNA, 5313 nt, Artificial Sequence
  derived and/or modified sequence opt3 from KIF13A__Homo_sapiens__NP_001099036
augagcgacaccaaggugaaagucgccguucgggugaggcccaugaaccggcgcgagcuggaacucaauacaaagugcguaguggagauggaaggcaaccagacuguccuucauccuccaccguccaauacgaaacaaggggagcgaaagcccccuaaaguguucgcuuuugauuacuguuucuggucuauggacgaaucaaacaccacaaaguaugcaggccaggagguuguguuuaagugccugggugagggcaucuuggaaaaagccuuccagggguacaaugcguguauuuuugcuuauggacagacuggcagugguaagagcuucuccaugauggggcaugccgagcaauuaggacugauaccacgucugugcugugcacucuuuaaaagaaucucucuggaacagaacgagucgcagaccuucaaggucgaggugucauacauggaaauuuauaaugagaaaguaagggaucuucuggaccccaagggcagccggcagaguuugaagguucgcgaacacaaagugcucggcccuuacgucgaugggcugucccaacuggccgugacaucuuuugaggacaucgaaagccucauguccgagggaaacaagucaagaaccguggcugcaacuaauaugaacgaggaaaguagcaggucucaugccgucuucaauauuaucauaacacagaccuuauaugaucugcaguccgguaacucaggcgagaaaguuagcaaggugagucuuguagacuuggcugggucugaacggguguccaaaacgggagccgcgggcgagcgccugaaggaagguagcaauaucaacaaaucgcucacuacccucgggcuggucauuucuucccuugcagaucaggccgcuggaaagggcaagucaaaauuugugccauaccgagacaguguucugacaugguugcucaaggauaaucugggcgggaacagccaaacuuccaugaucgccaccauuucucccgcagcugacaacuacgaggagacauuaagcacccugagauaugccgauagggcgaaacggaucgugaaucacgccgucgugaacgaagacccuaaugcaaagguaauacgugagcuccgcgaagagguugaaaaacuuagagagcagcugucacaggcugaggccaugaaggcuccagaauugaaggagaaacuagaagagagugagaagcugauuaaagaacucacggugacuugggaggaaaagcugaggaaaacagaggaaaucgcccaagagcggcagcgacagcuugaguccaugggaauuagccuggaaaugucugguaucaaggucggcgacgauaagugcuacuuggugaaccucaaugcagacccggcccugaacgaguuacuggucuauuaccuaaaagaucauacccgcgugggggcugacacuucacaggauauccaacucuucggaauuggcauacagccccagcacugugaaaucgacauugcgagugauggugacguuacacugaccccuaaggagaaugcaagaagcugcgugaacgggacgcuuguauguuccaccacacaguuguggcacggcgauaggauccuguggggaaauaaccacuuuuuccggauaaaucucccaaaacgcaagagaagggacuggcugaaagauuucgaaaaggagacuggacccccugagcacgaccuugacgccgcuucugaagccucgagcgagccagauuauaacuacgaauuugcacaaauggaggucauuaugaagacccuaaauuccaacgaccccgugcagaauguugugcaggucuuggaaaaacaguaucucgaggagaagcguucagcccuggaggaacaacgguuaauguacgaacgagagcuggagcagcuaagacagcagcucaguccggauaggcaaccucagucuagcgggcccgaccgccuggcuuacuccucacagacagcccaacagaaagugacucagugggcagaagaacgggaugaacuuuucagacagagcuuggcgaagcugagggagcaacucguaaaagcuaacacccuggugcgcgaagccaacuuuuuagcagaggagaugucuaagcugacagacuaucagguuacccuucagaucccagccgcuaauuuguccgccaaccgaaaacggggagcaaucgucagugaaccugcuauucaggugcguagaaaggguaagagcacucaaguguggacgaucgagaaacucgaaaauaagcugauugauaugagggaccuauaccaggaguggaaagaaaagguccccgaggccaaacgccuguauggcaagagaggggauccauucuacgaggcgcaggaaaaccauaaucucauaggaguugccaacguguuucuggagugccuuuucugugacgugaaguugcaguaugcuguacccaucauuucucaacagggcgaagucgcagguagacugcacguggagguuaugagggugacaggggccgucccugaacgagugguugaggaugacuccucagagaauaguagcgaaucgggcuccuuagaggugguagauucuagcggagaaaucauccaccgcgucaaaaagcuaaccugccgggugaaaauuaaggaggcuacuggccugccacuuaaccugucaaauuuuguguucugccaguacaccuuuugggaccaaugugagaguacagucgccgcaccgguuguggaccccgaaguaccuuccccacagucuaaagaugcgcaguauaccgugacuuucagccauugcaaggacuacgucgugaacguuacagaggaauuuuuggaguucauauccgauggggcccucgcuaucgaaguguggggacacagaugugccgguaauggcucaagcauuugggaggucgacagucugcaugcaaagacgaggacccuacacgaucguuggaacgaggugacucgccggaucgaaauguggauuucuauccuggagcucaaugaacugggggaguacgcugccguugaacuucaucaggcaaaagacgugaacacaggaggcauauuucaauugagacagggucacuccaggcgaguccagguaaccgugaagcccguucagcacagcgggacacugccuuuaaugguggaggccauccucucggucucaauuggcugcgugacugcucggucuaccaaacugcaacgcggacuugauaguuaucagagagacgaugaggacggcgaugacauggauuccuaccaggaagaggaccugaauuguguaagggaacgguggagcgacgcgcuaaucaagcgaagagaguaucucgaugaacagauuaaaaaggugucuaacaagacggagaaaaccgaggacgaugucgaacgcgaggcccaacugguugaacagugggugggguugacagaggagaggaacgcagugcuggucccagcucccggaagcggcaucccgggugccccugccgacuggauaccacccccugggauggaaacucauauucccguguuauuccucgaucugaaugcugacgaucuuuccgcaaacgagcagcugguuggaccacacgccucaggcguaaauaguaucuugccuaaggaacaugguagccaguucuuuuaccuccccauuaucaaacacucugacgaugagguguccgcgaccgcuucaugggacaguagcguccacgauuccgugcaucugaaccguguuacaccacaaaaugaacggauauaucuaaucgugaagacuaccguccagcugucucacccggccgcaauggagcuugugcucagaaaaaggauugccgcuaacaucuacaauaagcagucguucacgcaaagccugaaacgccgaauuucauugaagaacaucuuuuauuccugcggcguaacauacgagauagucaguaauauuccuaaggcaaccgaagagaucgaagacagagagacucuggccuuacucgcggcucggucugaaaacgaggggacaagcgacggagagaccuacaucgaaaaauauacuaggggcgugcugcagguugagaauauucuuucccuggaacgcuugcgucaggccgugaccgucaaggaggcacucucaacaaaagccagacauauccggaggucucugagcacgcccaacgugcacaauguuaguuccagccgcccagaucuaucuggguucgacgaagaugacaagggauggcccgagaaccagcuggauaugucagacuacuccaguagcuaucaagauguggcuuguuacggcacccuuccucgagacucgccaagacggaauaaagaggguugcacuucugaaacaccccaugcccucaccgucuccccuuuuaaggcauucagcccgcagccacccaaguuuuucaaaccucugaugccagugaaggaggaacacaaaaagaggauugcuuuggaggcccgccccuuacugucacaggaggauagugaagaggaagagaacgaacucgaggcgauaaacagaaaacugaucucuucccagccuuauguaccgguggaguuugccgacuucagcguuuacaaugcaucacuugaaaacagggagugguuuaguagcaaggucgaucuguccaauucucggguguuggaaaaggaggugagccguucccccacaacuucaucuauuaccaguggguauuucucgcacagcgcuuccaacgccacgcuaucugacauggucguaccaucaagcgauuccagugaccaacuggcuauccagacaaaagacgcagauucuaccgaacauagcacuccuucacucgugcacgacuuucgccccuccaguaauaaggagcugaccgagguugaaaaaggacuugugaaggauaaaauuaucgucgugccauuaaaggagaacagcgcccuggccaagggcucuccuuccucacagagcauacccgagaaaaauucgaagucucucugucgaacagguaguugcuccgaguuggacgcuuguccaagcaaaaucucacagccggcgagaggcuucugcccuagggaaguuacuguggagcauaccacaaacauucuggaggaucacuccuucacggaauuuaugggggucucugagggaaaggacuucgauggccucaccgacagcagugcaggggaacuguccagccggcgcucucuucccaauaaaacuggaggcaagacagugucagauggucugcaucacccaagucaauugcacuccaagcuagagaacgaccagguaaucauucccgaggccgcuuuuugggugcugugcugucaguga

SEQ ID NO: 58098 - RNA, 4947 nt, Artificial Sequence
  derived and/or modified sequence opt3 from KIF14__Homo_sapiens__NP_055690
augagccugcacuccacccauaacagaaauaacucuggcgacauccucgauauucccucaagucagaauagcuccucucuuaacgcccugacacacucgucaagguugaaguuacaucugaaaagcgacaugagugagugcgaaaaugaugacccucuacuccgguccgcugggaaggugcgcgauauaaaccgaacuuacgucaucucugcaagccguaaaacggccgacaugccacugaccccgaaucccguuggaagacuugcgcugcaaaggcggacaacucgcaacaaggaguccucauugcucgugagugaacuggaggauaccacagaaaagaccgcugagacuagacugacacuccagaggcgggccaagaccgacagcgcagagaaguggaaaacggccgaaauugauucuguaaagaugacuuuaaauguggguggcgagaccgaaaacaauggggucuccaaagagucacgcacaaacgugcgaaucguuaauaacgcuaagaauagcuucguggcaaguucugucccucuggacgaggauccacaggugauugaaaugauggccgacaaaaaguauaaggagacuuuuuccgcucccagcagagccaacgaaaacguagcgcuuaaauacucgucuaauaggccuccaaucgcauccuugucacagaccgagguugugcggaguggacaccugacaaccaagcccacgcaaagcaaacuagauauaaagguccucggcacugguaaccuguaucaucguuccaucgggaaagaaauugccaagacaucuaauaaauucggaagccuugagaagcgcaccccuacuaaguguacaaccgagcacaaacugacgaccaagugcucauugccacagcucaaaaguccggcucccuccauccugaagaacagaaugagcaauuuacaggugaaacagaggccuaagucuucauuucuggccaacaagcaagaacggagugcagagaauacaauucucccagaagaggaaacugugguccagaacaccagcgcuggcaaagacccccuuaagguugaaaauucccaggugacaguagccgugcgaguccgcccuuucacuaaaagagagaagaucgaaaaagcgucucaggugguuuuuaugucgggcaaggagauaaccguggaacacccagacacaaagcaagucuacaacuucauuuaugaugugagcuuuugguccuucgacgagugucauccccacuacgccucacagaccacuguauaugaaaaacuggcagcuccguugcuagagagggccuuugagggguucaauacgugccuguuugcuuacggacagacagguaguggcaagucuuacaccaugaugggguucagcgaggagccuggaaucauuccccgguuuugugaagaucucuucucccaaguugcccgcaaacagacucaggaggugucauaucauaucgagaugagcuucuuugaagucuacaacgagaagauccacgaccugcuugugugcaaagaugaaaauggccagagaaagcaaccacugaggguccgugagcacccuguguauggucccuacguugaagcauugucuaugaacauuguguccaguuaugccgacauacagagcuggcucgagcuggggaauaagcagcgggcuaccgcggcaacaggaaugaacgauaaaucuucccgaucacauaguguauucaccuuagucaugacucagacaaagacggaguuuguggaaggcgaggaacacgaccauagaaucaccagcaggauuaaccugaucgaucuagccggcucggagcgcuguuccacugcucacacaaauggggaccggcucaaagaaggaguuucuauaaacaagagccugcuuaccuuggguaaagugauuucagcccugagugagcaagcaaaucagagauccgucuucaucccauacagggagucugugcucacauggcugcuuaaggaaagccugggcgggaacuccaaaacugccaugaucgcuaccauuucacccgccgcaagcaauaucgaggaaacguugaguacccuccgcuaugcgaaccaggcucgacugauuguaaauauagccaaggugaacgaggauaugaaugcaaaguuaauccgggaacugaaagccgagauugcuaagcuaaaagccgcacagcguaacucuagaaauaucgacccugagagguaccgccucugccggcaagaaaucacaucccugagaaugaaacuucaucagcaggagagggacauggcugaaaugcagcgaguuuggaaagagaaguuugagcaagccgaaaagcgcaaauugcaggagacuaaggaacugcagaaagcgggaauuauguuccaaauggauaaccaccucccaaaucuggucaacuuaaaugaggacccgcagcugagcgaaaugcuuuuguacaugauaaaggagggcaccacaacuguggguaaauauaagcccaacucgucacacgauauccagcucucuggggugcugauugccgacgaucauuguaccaucaagaacuuuggcggaacggucaguauuaucccuguuggcgaggcuaaaacauacgugaaugggaagcacauacuagaaaucaccgugcugcggcauggagacagaguaauucucgguggcgaucacuauuucagguuuaaccacccagucgaggugcagaaagggaagcgucccuccggacgcgacacuccuaucagcgaaggcccaaaagauuucgaguuugcaaagaaugaacugcuuauggcccaacggucucaguuggaggcugagauuaaggaagcccagcugaaagcaaaggaggaaaugaugcaggguauccaaauagcgaaagagauggcccagcaggaauuaagcucccagaaggcugccuacgagucaaaaauuaaggcacucgaggcugaacugagagaggaaagucaaaggaaaaagaugcaggagaucaacaaucagaaggccaaccauaaaauugaggaacuugagaaggcaaaacaacaccuggaacaggagaucuauguuaauaagaaacgauuggaaauggagacacucgccaccaagcaggcucuggaggaccauagcauacggcacgcgcgcauccuagaagcccuggagacugaaaagcagaaaauugcaaaggaggugcaaauccuccagcagaacagaaauaacagggauaaaaccuucacaguccagacgaccuggucuuccaugaagcugucaaugaugauucaagaagcuaaugccaucaguagcaaacuuaagacuuacuauguguuugggcggcaugacauauccgauaagucuucgagcgacacaucaauucgaguuagaaacuugaaacugggcaucuccaccuucuggaguuuagagaaguucgagucuaaacucgccgcuaugaaggaacuguacgagagcaauggauccaaccgcggcgaagacgcauuuugcgaucccgaggacgaaugggagccggauaucacagacgccccugugucaucucuuagcaggcgucggaguagaucccugaugaaaaauaggcgcauuagcgggugucuacacgauauccagguacacccaauuaagaaccuccauucuucacacuccaguggacugauggacaagagcucgacuauauacucuaacuccgcggagagcuucuugcccgguaucugcaaagaacugauuggcucaaguuuagacuuuuucgggcagucuuaugaugaggaacgaaccaucgcugauucccucauuaauagcuuucugaagaucuacaacggacuuuucgccauaucaaaagcacaugaggagcaggacgaagagagucaagauaaucuguuuagcuccgacagagccauccagucuuugacgauucagacagcuugcgcauucgaacagcucgucgugcugaugaagcacuggcuaagcgaucugcuuccuuguaccaacaucgcccggcucgaggacgaacugaggcaagaggugaaaaaguugggcgguuaucugcaguuauuucuccaggggugcugucuggacauuuccucaaugaucaaggaggcgcagaaaaaugcuauacaaauuguccagcaggccguuaaguacgugggccaacuugcaguacugaaaggaucuaaguugcauuuccucgaaaacggcaauaacaaagccgcuagugugcaggaggaauuuauggaugccgucugcgacggggugggacugggcaugaagauccuacuggauucgggucuugagaaagcaaaggaacuccagcacgagcuguuccgccaguguacuaagaaugagguuaccaaagaaaugaagacaaacgcuaugggguugauccguagcuuagagaauauuuuugccgaauccaaaauaaagucuuucagacggcaagugcaggaggaaaacuucgaguaucaggacuuuaaaaggauggucaaucgcgcgcccgaguuccugaagcucaagcacugccuggaaaaagccaucgagauuaucauuucagcacuuaagggaugucauagcgauaucaaccuguugcagacuugcguggaauccauacgaaaucuagcuagugacuuuuacucugauuucagcguuccaucaaccuccgugggcaguuaugagagcagagucacacacaucguacaucaagagcuggaaucucucgccaaaucccuguuauuuuguuucgagucagaagagagcccugaccuucugaagcccugggaaacguacaaccagaauaccaaagaggagcaccagcaaucgaagucuagugguauugauggcuccaagaacaaaggggugccaaagcggguuuacgaacuccacggaagcucaccggcuguguccucugaggaaugcacuccuagcaggauccagugggucuga

SEQ ID NO: 58099 - RNA, 4167 nt, Artificial Sequence
  derived and/or modified sequence opt3 from KIF15__Homo_sapiens__NP_064627
auggcccccggcugcaagaccgagcugagaagcgugacaaacgggcaguccaaucaaccuucuaacgaaggagacgcuaucaaagucuucguuaggauucggccaccggcagagcgcucagguagugccgauggcgaacagaaucucugucuuagcgugcuguccucuacuucguugcgauuacacucaaaccccgagccuaagacguuuaccuucgaccauguagcggauguggacacaacucaggaaagcgucuuugcuaccguggccaaaaguauaguugaguccugcaugucuggguacaauggaacaaucuucgcauauggccagaccgguagcgggaagacuuuuacaaugaugggaccauccgagucagauaacuucagucacaaucugcguggcgugauucccaggagcuuugaauaccuauucucucucaucgacagagagaaagaaaaggccggcgcugggaaguccuuucuguguaaaugcucauucauugagaucuauaacgagcaaauauacgaucuucuggacagcgcaagugccggauuguaucuccgggaacauaucaagaaaggugucuuugugguaggcgcuguugaacagguggucaccucugccgcggaagcauaccaggugcuguccgggggauggcgcaauagaaggguggccagcacgucgaugaaccgggagucuucccgcucacacgcugucuucacuauuaccaucgaaaguauggaaaagagcaaugagauuguuaacauccgaacaucccugcucaauuuaguggaucuggccggcucugaaagacagaaagacacucaugcagaggguaugaggcuuaaggaagcugggaacauaaaucggagcuugucaugucugggacaaguaauuaccgcccuaguggaugucggcaacggcaagcagcgucacgugugcuaucgcgacaguaaacucacauuucugcuuagagauucccuggguggaaacgcgaagaccgccaucauugcaaauguucacccugguucuagguguuucggcgagacguugagcacucucaacuucgcucagcgggccaaacugaucaagaauaaagcuguggucaacgaagacacacaggggaaugugucacaauuacaggccgagguaaagcgacugaaagagcagcucgcagaacuugccaguggacaaaccccacccgagagcuuucugacucgcgacaagaagaaaacaaacuacauggaauacuuccaggaggcuauguuguuuuucaagaaauccgaacaggagaagaaaucucuaaucgagaagguuacccagcuggaagaucucacgcugaagaaagagaaguuuauucaaucgaauaaaaugauagugaaguucagagaagaccagaucauuaggcuugagaaacugcauaaggagagccggggcggguuuuugccugaggagcaggaucgccuccuguccgaauuaagaaacgagauccagacccugagggaacaaauagagcaccauccacgugucgcgaaguaugcaauggagaaucacucacuacgggaagagaaccgaagacucaggcugcuugaaccggugaaacgcgcccaggagauggacgcucagacaauugccaaguuggaaaaagcauucagugagaucucugggauggaaaagagcgauaaaaaucagcaaggcuuuucccccaaggcccagaaggaaccuugccuguucgcuaacacugagaaacucaaggcccagcugcuucagauccaaaccgaacugaauaacucaaaacaggaguacgaagaguuuaaggaguugacacggaaaagacagcucgaacuggagagcgaauuacaaucucugcagaaggcaaaucuaaaccucgagaaccugcuugaggcgacuaaggcuuguaagaggcaggaagucucccaguugaauaagauucacgccgagacccugaaaaucauuacaaccccaacuaaggcauaucaacuccauagucgccccgugccuaaacugagcccagaaaugggaucuuucggcuccuuauacacgcagaacucaaguauacuggacaaugauauccuuaacgagcccguuccgccugaaaugaaugagcaggccuuugaggcuauuagcgaagaguugcgaacagugcaggaacaaaugucggcccuccaggcaaagcuggacgaggaggagcacaaaaaccuaaagcugcagcagcauguagauaagcucgagcaccauuccacccaaaugcaggaacuguucucuagcgagcggaucgacuggacuaaacagcaagaggagcuuuugucacagcugaaugucuuagaaaagcagcuccaggagacccaaaccaaaaacgauuuccugaagagugaggugcacgaccuucguguugugcugcacuccgcugacaaagaauugucuagcgucaagcucgaguauuccucauuuaagacaaaucaggaaaaagaguucaacaagcugagcgagagacauaugcacgugcagcuacagcuggauaaucucaggcuggaaaacgagaaacuuuuggaaaguaaggccugccugcaagacucuuacgauaauuuacaggagaucaugaaauuugaaauugaccagcucucccgcaaccugcagaauuucaagaaggagaacgagacucuuaaaagcgaucugaacaaucuaauggaacuccuggaggcggaaaaggagcggaacaauaaauugucgcugcaauuugaagaggacaaggagaacucaucuaaagaaauauuaaagguacucgaggccgugagacaggaaaaacagaaggagacagcuaagugugaacagcaaauggcaaaaguucagaagcuggaggagagucuucuggccacggaaaaagucaucuccagcuuggagaagucuagggauagcgacaaaaaggugguggcugaucucaugaaucagauucaagaacugcgaaccuccgucugcgagaagacugagacaaucgacacccuaaaacaggaacugaaggauauuaacugcaaauauaauucagcccuuguugaccgcgaggaaagucgggugcucaucaagaaacaggagguggauauacuggacuugaaggaaacacugagauuaaggauccucagcgaggacauugagcgugauaugcugugugaagaccuugcacaugcgacugagcagcugaacauguugaccgaagccucuaagaaacacuccgggcuccugcaaucagcucaggaggaacuaacgaagaaagaggcccugauccaggagcuucagcacaagcucaaucagaaaaaggaagagguagaacaaaagaaaaacgaguacaauuucaagaugcgccagcuggaacaugucauggauagugcagcugaggacccccagagcccaaaaaccccuccccacuuucaaacacauuuggccaaguuacuggagacucaggaacaggagauugaagauggacgggcauccaaaaccucucucgagcaccuggugacaaaacuuaacgaggacagagaaguuaagaaugccgagauccugaggaugaaagaacaauugcgagagauggaaaaccuacggcuggagucgcagcagcucauagagaagaauuggcugcuucagggucaauuagaugacauuaaacgccagaaggaaaacagcgaucagaaccauccagacaaucagcaacugaaaaacgagcaggaagagucaaucaaggaaagacucgcuaaauccaagauuguggaggagauguugaagaugaaagcggaucuggaagagguccagagugcccucuacaauaaggaaauggagugccugaggaugacugacgaaguggagcggacccagacgcuugagucuaaagcauuccaagaaaaggagcagcugcgaagcaaauuggaagagauguaugaggaaagagagcgcacaucccaggaaauggagaugcuaaggaagcagguugaaugucuggcugaggagaacggcaagcucguggggcaccaaaauuuacaccagaaaauccaguacguaguccgucugaagaaagaaaacgugcggcuugccgaggaaaccgagaagcugagagccgaaaauguguuucucaaagagaagaagaggucagagucuuga

SEQ ID NO: 58100 - RNA, 4179 nt, Artificial Sequence
  derived and/or modified sequence opt3 from KIF16B__Homo_sapiens__NP_001186795
auggccagcgugaaggucgcuguuagagugaggcccaugaaccggcgcgagaaagaccuggaagcaaaguucaucauucagauggagaaauccaagaccacaauaacuaaucucaaaaucccugaaggcgggacgggagauucuggucgagagcguaccaagacauuuacuuacgacuucucauuuuauagugccgauaccaagagcccagacuacguaucccaagaaaugguguucaaaacacuuggcaccgaugucgugaagucugcguuugagggguauaacgcuugcguuuucgccuacggacagacuggcucggguaaaucauauacaaugauggggaauagcggagacaguggccugauuccgagaaucugugagggcuuguuuuccaggauuaacgaaaccacgcggugggaugaggcaucuuuccgcacugaagugagcuacuuagagaucuauaaugagagagucagggaccugcuacggcgcaaguccucaaaaaccuuuaaccuccgagugagagaacaccccaaggaggggccuuacguagaagaucugaguaagcaucuuguucagaauuacggagacguggaggaacugauggaugccgguaacauaaauaggacaacugcugcaaccggcaugaacgacgucagcucucggucccacgccaucuucacaauuaaauuuacccaggcuaaguucgauucagagaugccaugcgagacggugagcaaaauccauuugguggaccucgccgggagugaacgugcggacgcaacuggagccacaggcguccgccugaaggagggugggaauauuaacaaaucucugguuacccucggaaaugugaucuccgcuuuagccgaucugagccaagacgcagcuaacacucuugccaagaaaaagcagguauuugugcccuauagagauucggucuugacauggcugcuaaaggacucucucggcggcaauuccaaaaccauaaugauugcgacgaucucgccugccgaugugaacuacggggaaacccugaguacacuuagguaugcaaaccgggcuaagaauauuaucaacaaaccaacuaucaaugaggacgccaacguuaagcugauucgagaauugcgcgcugagauagccagacucaaaacccuguuagcacagggaaaucagaucgcccugcucgauagccccacagcucuuuccauggaggaaaagcugcaacagaacgaggcgagggugcaggaauugacuaaggaguggaccaauaaauggaacgaaacacagaauauucuaaaggagcaaacccuggcacuccggaaagaggguaucggcgucgugcuggacucugaacuuccucaccugauagggauugaugacgauuugcucagcacuggaaucauccuguaccauuuaaaggagggccagacguauguaggucgcgacgacgccucaacagaacaggauauuguucugcacgggcuagaccucgagagugagcacuguaucuucgaaaacauuggcggaaccgugacucugauaccacuuuccggcagccaaugcucugucaauggggugcagaucgucgaggcuacccauuugaaccagggagccgugauucugcucgguagaacaaauauguucagguuuaaccacccgaaagaagcagccaagcugcgugagaagcggaaaucaggccuucugaguagcuucuccuugucuaugaccgaucucucaaagagccgagaaaaucuguccgcuguuauguuauacaaccccgggcuggaguuugagagacagcaaagggaggagcuagaaaaacucgagucaaagcgcaaacugaucgaagagauggaggaaaagcagaagagugacaaagccgagcuugaacggaugcagcaggagguggaaacucaaagaaaggagacagagaucguacaguugcagauuaggaaacaggaagagucucugaagcgccguagcuuccauauagaaaacaaacucaaggaucuguuagcagagaaagagaaguuugaagaggaacggcugcgugagcaacaggaaaucgagcuucagaagaaaagacaggaggaagagacguucuugaggguccaagaggaacuccagcgccugaaggaacuaaauaacaaugagaaagcggagaaguuucagauuuuccaagaacuggaccagcuccagaaagagaaggaugaacaguaugcuaagcuggagcuugaaaagaaacgguuggaggagcaagaaaaagaacaggugaugcugguugcccacuuagaggaacagcucagagagaagcaggaaaugauccaacugcuuaggcgaggagaggugcagugggucgaagaggaaaaacgcgaccuggagggcauucgggaguccuugcucagagugaaggaagcaagggccgguggggaugaggacggcgaggaacuggaaaaggcucagcuacgauuuuucgaguuuaaacgccggcagcugguaaagcucgugaaccuggagaaagaucuuguucaacagaaggacaucuugaaaaaggaaguccaggaggaacaagagauacuggaauguuuaaagugcgagcacgauaaagagucaagacuccuggaaaagcaugacgagagcgugaccgacgugacugaagucccucaggauuucgagaaaaucaagccaguugaguacaggcuucaguacaaagaacgacagcugcaauaucuacuccagaaucaucugcccacauugcuggaggaaaagcagcgggccuuugagauuuuagaccgcggaccucucucucuggauaacacccuuuaccagguggaaaaagagauggaggaaaaggaggaacaacuggcacaguaucaggcuaaugccaaccaguugcaaaagcuccaggcgacauucgaguucacugccaauaucgcuagacaggaagagaaagugaggaagaaagagaaggaaauucuggagucccgggaaaaacagcaacgagaggcacuagaaagagcccuggcucgccuugagaggcgucacagugcccuccagcggcacagcacccugggcauggagaucgaggaacagagacaaaaguuggcaucucugaacuccgggucaagggaacagaguggauuacaggcgagccucgaggccgagcaggaagcucuggagaaggaccaagaacgccuugaguacgaaauacagcagcugaaacagaagauuuaugagguagaugguguccaaaaagaccaucacggcacguuggaggggaagguggccucguccucucucccaguuagcgcagaaaaaucacaccuggugccccuaauggaugcucgaaucaaugccuacauugaggaagagguccagagacggcugcaggaccuucauagggugaucagugaaggauguuccaccucugcagauacaaugaaggacaacgagaagcuccacaauggcacuauacagcgcaaacugaaguaugaguugugccgugauuuacuguguguucucaugccggaaccugacgccgcugcgugcgccaaccauccccugcuucaacaggaucuggugcaguugagccuagacuggaaaaccgagaucccagaccugguacucccuaaugguguccaaguguccucaaaguuucagacaacucugguggauaugauuuacuuccuucacgggaacauggaagucaacguucccagcuuagcagaggugcagcugcucuuguacaccacgguaaaagugaugggcgacaguggacacgaucagugucaaucucugguccuccugaauacacauaucgcucuugugaaggaagacugcguguuuuauccaagaauccgguccaggaacauucccccuccaggcgcccaguucgauguuauaaagugccacgcccugagcgaguuucgcugugucgugguuccggagaaaaagaaugugucgaccgucgaauugguauuccuacagaaacugaagcccucaguggggucucgaaacaguccuccagagcaucuccaggaagcucccaauguucaauuauuuacuacaccucuguaccuucagggaucccagaacguggcaccagaggucuggaaacugaccuucaauagccaggacgaggcccucugguugauuucucaccugacuagacucuga

SEQ ID NO: 58101 - RNA, 3117 nt, Artificial Sequence
  derived and/or modified sequence opt3 from KIF17__Homo_sapiens__XP_011540143
auggccagcgaggcugugaaggucguugugagaugcaggcccaugaaccagcgggaacgcgagcugcgaugucaaccuguagugaccgucgacugcgcacgugcccaguguugcauccagaauccaggcgcggcugaugaaccgcccaaacaguucacauuugacggggccuaccacguggaucauguuacugagcaaauuuauaacgaaauagcauacccucucguggagggagucacggaggguuauaauggcaccaucuucgccuacgggcagacaggauccggcaagucuuuuacuaugcagggucuuccagaucccccuucacagagagggauuaucccaagggcuuucgaacacguguuugagaguguacaaugugcagaaaacaccaaauuccugguucgggccagcuauuuggagauuuacaaugaggacgugcgcgacuuacugggagcugauacaaagcagaaacuagaacucaaggagcaucccgaaaagggcgucuaugugaaaggccuguccaugcacaccgugcauucugucgcccagugcgagcacaucauggaaacuggguggaagaacagaucgguuggauacacacuuaugaauaaagacucaagcaggagucacuccauauuuaccaucucuauugagaugagcgcgguggaugagcgggguaaggaccaucugcgcgcaggcaaauugaaccucguagaucuggccggguccgaacgacagucaaagacgggagcuacuggcgagagacugaaggaagccaccaaaaucaaucucaguuuaagcgcacuggguaacgugauuucugcucuugucgacgggagguguaagcacgugccuuaccgggauuccaaauugacacgucugcuacaagacucacucggaggcaauacuaagacccugaugguugccugccuuagcccagcggacaacaauuaugaugagacacugaguaccuugcgcuacgccaacagagccaaaaauaucaggaacaagccgcggauaaacgaagaccccaaagaugcucuccugcgagaguaucaggaggaaauuaagaaguuaaaagccauccugacgcagcaaaugucuccuuccagccucucggcucugcugucucgccaggugccacccgacccuguccagguggaggaaaaguugcuaccacagcccguaauucaacaugauguugaggccgaaaaacagcugaucagagaggaguacgaagagaggcucgcacggcugaaggccgacuauaaagcugaacaggagucccgcgcgagacuugaggaagauaucacugcaaugcguaauucauacgacgugaggcugaguacauuggaggaaaaccuccggaaggagaccgaagccguccuucaggugggcgucuuauauaaggcugaggugaugagccgagccgaguucgcauccucugccgaauacccgccugcuuuucaauacgagacuguugugaaacccaagguauucagcacaaccgauacgcugccaucagacgaugucaguaaaacccagguguccagcagauuugccgaacuaccuaagguugagcccucuaaaucagaaauuagucucgggagcuccgagucuucgagccuggaggaaacauccgugucagaggcauucccaggacccgaggaaccuaguaaugucgaagugucuaugccaacugaggagagcaggucccgcuauuuucuugacgaauguuugggucaggaggcggcuggccaucugcucggggaacagaacuaccugccgcaagaggagccccaggaaguaccucuucagggacuguugggccuccaggacccauucgccgagguggaagcaaagcuggcccgguuaucaagcaccguugcuagaacagaugcaccccaagcagacgucccuaaggugccagugcagguccccgcuccgacugaucugcuagagccuucugacgccaggccagaagcggaggccgcugaugacuuucccccucgccccgagguugaucucgcauccgaaguggcccuggaggugguacgaaccgcugaaccaggugucuggcuugaggcccaggcaccuguggcguugguugcccaacccgaaccacugccggcuacagccggggugaaacgggagagugucggcauggagguggcaguucucaccgacgauccucugcccgugguagaccagcagcaggucuuagcucgucugcaacuuuuggaacaacagguggugggaggcgagcaggccaagaauaaagaucucaaggaaaaacacaagagaaggaagcgcuaugcagacgagcggagaaaacagcuggucgccgcucuacagaacagcgaugaagacucuggggacuggguucugcucaauguguacgauuccauacaggaggagguaagggcgaagucaaaacugcuugaaaagaugcagcgaaaauugcgcgccgcagagguggaaaucaaggaccugcaaagugaguuccaguuagagaaaauugauuaucucgcuacuauccggagacaggaaagggacagcaugcugcuucaacagcuguuggagcagguccagccacucauacgucgcgauugcaacuacucgaaucuggaaaagauucuacgggaguccuguugggacgaagauaacggauucuggaagaucccccacccugugaucacgaaaacaucucugccacaauuucagcucggucacagaaccaaucagcccgccaagccucugcagcaaacuauggccagcaggaccuggcgaacaaccgcuacuggcucaugcaguguuggggcaacagugaaaacgcuuccggccaccacuuccgacuugucuggaccagcgcggagcuccgcucagacacccggccgcgccucacauauuaccacaagacaccaggcaagcgccgcucauagugcaacuacccugccuucucacccacccaggccuuuaaagugcccgucccccgguccaagcgccucgucaccuucuacgagucucagcccccggccaucccugccuucuccccuugcgagcgggcuguggcuaggcccacgaggaagauggaaauccuguugccucugguga

SEQ ID NO: 58102 - RNA, 2697 nt, Artificial Sequence
  derived and/or modified sequence opt3 from KIF18A__Homo_sapiens__NP_112494
augagcgugaccgaggaagaccugugccaccauaugaaggucguugugagaguaaggcccgagaacacaaaagaaaaggccgcuggcuuccacaaagugguccaugugguugauaagcacauccucguguuugacccuaaacaggaggaagucuccuucuuucaugggaagaagacuacgaaucaaaacgugauuaaaaagcagaauaaagaucuuaaguucguauuugacgcaguuuucgaugagaccucuacacagucagagguguuugaacacacuaccaaaccaauacugcggaguuucuugaacggauacaauuguacagucuuagccuauggugcgaccggcgcugggaagacucacacaaugcugggaagcgccgacgagccgggcgugauguaccuaaccaugcuccaucuguauaagugcauggaugaaaucaaagaggagaagauuuguuccacggcagugucuuaccuugaagucuauaacgagcagauccgcgaccuguugguuaauucggguccccucgccgugcgagaagauacucaaaaagggguagugguccacggacugacccugcaucagccuaagucaagcgaggaaauucuccacuuacuggacaacggcaauaaaaaccguacacagcacccaacugauaugaaugcuaccaguuccagaucucaugcaguguuucagaucuaccuuaggcaacaggacaagacagccagcauaaaccagaauguucggaucgcuaaaauguccuugauugaucuggccggcucagagcgcgcgaguaccagcggggcaaagggaacgagauucguggaggguacuaacaucaauaggucucuacucgcccugggcaacgucauuaacgcucuugccgacuccaagcggaaaaaucagcacauccccuaucgcaacucaaagcugacacgauugcucaaagacagcuuagggggaaauugccaaaccauaaugauugcagcugugaguccuucuuccguauuuuacgaugacacuuacaacacacugaaguaugccaauagagcgaaagauaucaagagcucgcugaagucuaacguucucaaugugaacaaucauauuacccaguacgucaaaaucuguaacgaacagaaggccgagauccuucuguugaaagaaaagcuaaaagcauaugaggaacaaaaggcuuucacgaaugagaacgaccaggccaagcugaugauuuccaauccacaggagaaagaaauagagagguuucaggaaauccucaacugccuguuccaaaaucgggaggaaauucgucaggaguaccuuaagcuggagauguugcucaaagaaaacgagcugaagucauucuaucagcagcaaugucacaaacagaucgaaaugaugugcagugaggauaagguggagaaggcuaccggcaaacgcgaccauagauuagccaugcugaagacaaggcggagcuaccuagaaaaacgacgcgaggaggaacucaagcaguuugaugaaaacacuaauuggcugcacagagucgagaaagagaugggucuuuugucccagaacgggcacauacccaaggaacugaaaaaggaccuccauugucaccaucugcaccuucaaaauaaggaucugaaagcacagauuaggcacaugauggacuuggccugccuccaggagcagcaacaucggcagaccgaagcugugcugaacgcguuacugccuacacuacgcaagcaguauuguacucucaaagaggcaggacugucuaaugccgcuuucgaaagcgauuuuaaggagaucgagcaccuuguugaaagaaagaaggugguagucugggccgaccaaaccgcagagcagccaaagcagaacgacuugccgggcaucucagugcugaugacauucccccagcucggcccuguucaaccaauucccugcugcaguuccagcgggggaaccaaucuggugaaaaucccuacugaaaagaggacgcgucggaaauuaaugccaucuccccugaagggucagcauacacuuaaaucaccgccuagucagagcguccaguugaacgauucccucucuaaggagcugcaacccauuguguacaccccagaagacugucgaaaggccuuucagaauccuucgacuguaacccuaaugaaacccagcuccuucacaaccucauuucaggcuauaaguucuaacaucaauagcgauaacugccugaagaugcucugugagguggccauuccacacaauagaaggaaagagugcggccaggaagaccuggauuccacuuucacaaucugugaggacaucaagucaagcaaaugcaaacuucccgaacaagagucuuugccuaacgauaauaaggacauucugcagcgcuuagauccauccaguuuuagcacgaaacauucuaugccgguucccuccauggucccuucauacauggcaaugaccacugcggcuaagcggaaaagaaagcucacaaguagcaccucgaacuccucucugacagccgacgugaacagcggguucgcaaaaagggugcgccaggauaauucaagugagaagcaccuucaagaaaacaaaccaacuauggagcacaagcgaaauauauguaagaucaaccccuccaugguccggaaauuuggacguaauauuucuaagggcaaccugagauga

SEQ ID NO: 58103 - RNA, 5376 nt, Artificial Sequence
  derived and/or modified sequence opt3 from KIF1A__Homo_sapiens__NP_001230937
auggccggcgcuagcgugaaggucgcaguuagagugaggcccuucaacucccgggagaugucucgcgacucaaaaugcaucauucagaugagugggagcaccacaacuauaguaaauccuaagcaaccaaaagaaacgccgaaguccuuuucuuucgauuacucguauuggucacacaccagccccgaggacaucaacuacgccagucagaaacagguguaucgagauauuggagaagagaugcugcagcaugcguuugaagguuacaaugucuguaucuucgcuuauggccaaacaggggccggaaaguccuacacuaugaugggcaagcaggagaaagaccagcaggguauuaucccucaacucugcgaggaucuuuuuucucguauaaacgacaccacaaaugauaacaugagcuauuccguggaaguuucauacauggagaucuacugugaaagagugagggaccuguugaauccaaagaacaaagggaauuuacggguccgcgagcacccccugcuaggaccuuauguggaggaucucaguaagcuggcaguaaccagcuacaacgacauucaggaucuuauggacucuggcaauaaagccagaacuguugcugcaacaaacaugaaugaaaccuccucaaggagccaugccguguucaacaucauuuuuacgcagaagcggcacgaugcugagacuaauaucaccacagaaaaggucaguaaaauaucucugguggacuuggccggcuccgagcgcgcggacagcacuggggcaaagggaacccgacucaaagaaggugccaacauuaacaagucgcugacaacccugggcaaagugaucucugcucucgccgagauggauuccgggccaaauaagaacaaaaagaagaaaaagacggacuucauucccuauagagauucagucuuaacuuggcugcuuagggagaauuugggaggcaacagucggacagcaaugguugcugcccugagcccugcggacaucaauuacgaugaaacccuauccacucuccguuaugccgaccgcgcaaaacagaucagaugcaacgcugugauuaaugaggauccaaacaauaagcugauaagggaacuuaaagacgagguaacacggcugcgagauuugcucuacgcccaaggucugggggacaucaccgauacgaacaccgugccgggaggccccaaguuaacaaaugcucuggucggcaugucuccuagcucaagucucuccgcccuuagcucucgcgcagccucagugaguagccugcaugaaagaauuuuguuugcuccaggguccgaggaggcgaucgaaaggcuaaaggagacugaaaaaauaauugcagagcugaacgaaaccugggaggagaagcuccggcgcacagaagccaucagaauggagagggaagcucugcuugccgagaugggaguugcaaugcgugaggacgguggcacucuggggguguucucucccaaaaagaccccucacuuggucaaucucaacgaagacccacugaugucggaguguuuacuguauuacaucaaagauggaauuacacgggugggccgagaagacggugagagaaggcaggauaucguacuaagcgggcacuuuauuaaggaagagcauugcguuuuccgcuccgacucacggggcggaagugaggccguggucacccucgaacccugugagggcgcugauacuuacgugaaugggaagaaagucacggaaccgucuauacugagaagcggaaacaggaucauuauggguaagucccacguguuucgcuucaaccauccugagcaggcccgacaagaacgggagcguacacccugcgcagagaccccagcggaaccuguugacugggcuuucgcccagagagagcuuuuggaaaaacagggcaucgauaugaagcaggagauggaacaaaggcugcaggagcucgaggaccaguaucgccgggaaagagaggaagcaacuuaccugcuugagcagcaaaggcuggauuaugagucaaaauuggaagcccuccagaagcagauggacagccgauacuaucccgaggugaaugaagaggaagaggagccagaagaugagguacaguggaccgaacgcgagugugaacuggcuuuaugggccuuucggaaguggaaaugguaccaauucacaucucugagagaccuacucugggggaacgcaaucuuucugaaggaggcuaaugccauuuccgucgagcuuaaaaagaaagugcaguuccaguuuguuuugcugaccgauacucucuauaguccccugccuccagacuuacugccgcccgaagcggccaaggacagggagacacguccuuucccacgcacgauaguggcugucgaagugcaggaucaaaaaaacggagcaacccacuacuggacucuugagaaguugcggcagagacucgaccugaugagggaaauguacgaucgagccgcugagguacccagcucugugaucgaggacugcgauaauguugucacaggcggugacccuuuuuaugaucgguucccaugguuucgccuagugggguccucagccauuaguggcuguaacagcuacccccugcucaauaccugcaugucggaaagaauggcagcgcugacaccguccccuacuuucucuagcccagacucagaugccaccgagcccgcugaagagcagagugugggagaggaagaggaagaggaagaggaggaagaggacgaagaggaagaggaucuugaggacgaugucuuuccugaacacgccuugugcgacggcagggaccccuucuaugaucggccaccucuguuuuccuuaguugggcgagcauucguguaccucucuaaccugcuuuaucccgugccacugguacauagagucgcuaucgugagcgagaagggagaaguuaaagguuucuugcgcguggccguccaagcaauuuccgccgacgaggaagcuccggauuacggcucaggggugaggcagagcggaacggcgaagaucaguuuugacgaucagcacuucgagaaauuucagucugaguccuguccuguugugggcaugagccguucggguaccucacaagaagagcuccggauaguagaagggcagggccagggagccgacgucggccccucugcagaugaggugaauaacaauacaugcagugcugugccacccgaggggcugcuacuggacuccagcgaaaaggccgcccucgauggaccucuggacgcugcacuugaucauuugagacugggcaacacuuucaccuuuagggucacaguuuuacaggccucuagcaucuccgcggaguaugcugacauuuucugucaauuuaauuucauccaccgccaugacgaagccuuuucaacugagccacucaaaaacaccggucgagggcccccucugggauucuaccacgugcagaauauugcaguagaagugacgaagaguuuuaucgaguacauaaagagccagccgauugucuucgagguguuuggccacuaucagcaacauccauuccccccucuuugcaaagauguucugucuccacuaagacccucccggaggcacuucccucgcgugaugccgcucucaaagcccgucccagccacaaaacugaguaccuugacucguccuugucccgguccaugccauuguaaguacgaccuguuaguguauuuugaaaucugcgagcucgaagcuaacggcgauuacauuccugcaguuguggaccacagagggggaaugcccuguaugggcacauuccugcuucaccaggggauccagcggaggauaaccgucacucuguugcaugagaccggaagccacauccgcuggaaagaaguacgagagcucgugguuggcagaauucggaacacaccagagacggaugaaucccugaucgacccgaauauucuaucucugaacauccuuucgagcgguuauauacauccugcccaagaugacaggaccuuuuaccaguucgaggcggcuugggauucauccaugcacaauagucuccuguugaaccgcgugacucccuauagagaaaagauuuacaugacacugucugccuacaucgagauggaaaauugcacccagccagcagucgugacaaaggacuuuuguaugguauucuauagcagggaugccaaauuacccgcuucccggucaauccguaaccucuuugggucuggaagccugcgcgccagugaguccaaucgagugacuggcgucuacgagcuuagccugugccauguugcagacgcugguucuccuggcaugcagagaaggcggcgcagaguguuggauaccucaguggccuaugucaggggggaagagaaccucgcgggauggcggccacgauccgacagucugauucuagaccaccaaugggaacuggagaagcuuagccuccugcaggagguggaaaaaacgagacacuacuuguuacugcgcgagaagcucgaaacagcccagaggcccguuccugaggcacugucgccggcuuucucugaagauuccgagagccauggcucaaguucugccuccagcccacuuucagcugaggggcggcccaguccucuggaagcacccaaugagcgucagagagaauuggccguaaaaugccuaaggcugcucacccacacuuuuaaccgcgaguauacccauagccacgugugugucuccgccucugaaagcaagcuguccgagaugucagugacacuuuuacgggacccaucuaugaguccucugggaguugcuacucucacccccucgagcacaugcccauccuugguggagggccgauacggugcgacggaucugagaaccccucaaccguguucuaggcccgcaucaccagaaccugagcuccugcccgaagccgacagcaagaaacuuccauccccugcucgcgccacugagacagauaaggaaccccagcggcuguuggucccggacauccaggagauuagagugaguccaauaguaucuaaaaagggguaucuacauuuccuggagccucacaccagcggaugggcacguagguuugucgugguucggcgccccuacgccuacauguauaauucagauaaagacacuguggaacgauucguccucaacuuagcuacagcgcagguggaguacuccgaagaucaacaggccaugcugaagaccccaaauacguucgcaguuugcacugagcacagaggcauccuucugcaggcugccagugacaaagauaugcaugacuggcucuaugcauuuaaccccuugcuggccgguaccauuaggagcaagcucucucggcgcagauccgcucagaugaggguguga

SEQ ID NO: 58104 - RNA, 3312 nt, Artificial Sequence
  derived and/or modified sequence opt3 from KIF1C__Homo_sapiens__NP_006603
auggccggcgcuagcgugaaggucgcaguuagagugaggcccuucaacgcccgggagaccucccaggacgcgaaaugcguagugucuaugcaagggaauacaacuucaaucauuaacccuaagcagaguaaagaugcuccaaagagcuuuacguucgacuacuccuauuggucucacaccucgacagaagauccgcaguuugccucacagcaacaggucuaccgcgacauaggagaggaaaugcugcuccaugcauucgaggguuauaauguguguaucuuugccuacggccagacuggggcuggaaaaagcuauaccaugaugggccgacaggaacccggucaacaggggauuguuccucagcuuugcgaggaucuguucagucguguguccgagaaccagucugcacaauugagcuacuccgucgaagugucauauauggagaucuacugugaaagaguaagggacuuacugaauccaaagagucggggaagccuacgcguuagagagcaccccauucucggcccuuacgugcaggaucugucuaaacuugccgucacauccuaugcugacaucgccgaucugauggacugcggcaacaaggcgaggaccguggcagccacuaauaugaacgagacaucaagccggagucaugcuguguuuaccauagucuucacgcagcgcugucacgaucaauugacugggcucgacucugaaaagguuuccaaaaucagccugguggaucuggccggaucggagcgagcagacucuuccggugcuagaggcaugaggcucaaggaaggggccaauauuaacaaaucauuaaccacacugggaaagguaaucagugcgcuugccgacaugcagagcaagaaacggaaguccgauuuuauuccauaccgugacucuguguugacuuggcugcuaaaagagaaucucggcgguaacagccgcaccgcaaugaucgcugcccugucacccgcugauauaaauuaugaagagacacuuaguacccugagauacgccgacaggacgaagcagauucggugcaacgcaaucauuaaugaggauccuaacgcccgauugauccgcgaacuccaggaggaagucgcuagacugagggaguuacugauggcgcaagggcucuccgcaagcgcccuugaaggacugaaaacugaggagggcucugugcggggcgcuuugccagccguuucaaguccgcccgcaccugugagcccauccucucccacaacccauaacggggaacuagagccuucguucagcccaaauacugaaucccagaucggacccgaggaagccauggagcgccugcaggagacagaaaagauuauagcugagcucaacgaaaccugggaggagaaacugagaaagacggaagcccuuaggauggagcgugaagcacuguuggcggagaugggugucgcugugcgggaagacggcgggaccguaggaguguuuucaccgaagaaaacaccucaccucguuaaucugaacgaggaucccuuaaugagugagugucugcuauaucacaucaaggacggcgucacucgagugggucaggucgauauggacauuaaacucaccgggcaauucaucagagaacagcauugccuguuuaggucuauaccacagccugauggcgaggugguugugacacuugaacccugugagggagccgaaacuuacguaaauggcaaguuggucaccgagccacuggugcucaaaagcgggaaccgcauuguuaugggaaagaaucacguguuccgguucaaccaucccgagcaggcaagacuggaaagggagcgcggugucccuccaccgcccggcccuccauccgaacccguggacuggaauuuugcccaaaaggagcuucuggaacagcaggggaucgacaucaaauuggagauggagaagcgacuccaggaucuggaaaaccaauaucggaaagagaaggaagaggcugacuuacugcuagagcagcagcgucucuacgccgauucagacagcggagaugacucugauaaaagauccugcgaagagaguuggaggcugauuagcucucuucgcgaacaauugccuccaacaaccguacagacuaucgugaagcgguguggccugcccuccucagguaagagaagggcaccgcgacgcguuuaccagauuccucagcggagaaggcuccaagggaaagacccacguugggcuacgauggccgaucugaagaugcaggcggucaaagagauaugcuaugaaguggccuuagcugacuuccgccacggccgggcagagaucgaggcccuggcugcccuuaagaugagagaauugugcaggacauacggaaaacccgauggcccuggggacgcauggcgagcgguggcccgggaugucugggacaccguuggagaggaagaggguggcggggcuggaaguggcggugggagcgaagagggcgcccgcggagcagagguggaagaccucagagcucacauugauaagcugacuggcauccuacaggaggugaagcugcaaaauucguccaaagacagggaacuccaggcccugcgggaucgaaugcuuagaauggagcgcguaauccccuuggcacaggaccaugaagaugagaacgaggaagggggagaggucccaugggccccucccgaaggcucugaggcugcggaggaagccgcaccaagcgacaggaugccgucagcucguccucccaguccaccccuguccucuugggagcgggugagcagauuaauggaagaggauccugccuuuaggcgcggucgacucagauggcugaagcaggaacagcuucggcugcaaggguugcagggauccggcgguaggggcgggggacuccgccguccacccgccagauucguuccuccgcacgacuguaaacugcgguuuccauucaagucaaauccccagcauagggagagcuggccuggcauggggaguggagaggcuccaaccccucuacaacccccggaagaggugacaccccacccagcaaccccugcccgccgacccccaucuccuagacggucccaucaccccaggcgcaacagccuggauggcggugggagaucgaggggagcgggcucagcucagccagaaccgcagcacuuucagccuaaaaagcauaauucuuauccccaaccaccccagccuuacccagcccagcggcccccugguccgcguuauccacccuacacuacaccuccccgcaugcgaagacagaggagugcaccagaccucaaagaguccggcgccgcugucuga

SEQ ID NO: 58105 - RNA, 2673 nt, Artificial Sequence
  derived and/or modified sequence opt3 from KIF20A__Homo_sapiens__NP_005724
augagccagggcauccugucucccccugccgggcuccuuuccgacgaugacguggucguuucaccaauguucgagaguaccgcugcagaucugggaagcgugguaagaaagaacuuguuauccgacugcucuguggucucgacaucacuggaagauaaacaacaggugccgagcgaggacaguauggaaaagguuaaaguguaccuaaggguccggccccuccugccuuccgagcuugaacgccaggaggaucaggguugugugcgaauugagaauguagaaacucugguuuugcaagccccaaaggacucuuuugcgcucaaaagcaacgagcguggcauagggcaggcuacgcacagauucaccuuuucccagaucuucggacccgaagugggccaggccucauuuuucaaucugacagucaaggagauggugaaggaugugcugaaaggucaaaacuggcucauuuauacuuacggggucaccaauaguggaaagacacauaccauccagggcacuauuaaagacggcgggaucuuaccuaggagccuggcacuuauauuuaacucuuugcagggacagcugcacccaacacccgaucuaaagccucuccuguccaaugagguuaucuggcuugacucaaaacaaauucggcaggaagagaugaagaagcugagcuugcucaacgguggccugcaggaagaggaauuaaguaccucucugaaacgcuccguguauaucgagagcagaauugggacgucgacuucuuucgauuccggaaucgccggccucucaaguauaagccaaugcaccuccucuagccagcuugacgagacaucacauaggugggcucagccagacacugcaccgcugcccguaccugccaauauucgguuuaguaucuggauuuccuucuuugaaaucuacaacgaguugcuauaugaucugcucgaaccacccagccagcaacgcaagcgacagacccugagacuuugugaggaccagaaugguaacccuuacgugaaagaucugaauuggauccacguccaggacgcugaagaggccuggaaguugcucaaaguggggaggaagaaccaaucuuucgcgucaacacaucugaaucagaacaguagccggucccacucuauauuuucgauucguaucuuacaucugcagggagagggcgauauuguuccaaaaaucagcgaacuaucccucugcgaccuggcaggcucagagcgcuguaaggaucagaagaguggggaaagacuuaaagaggccggaaacauaaauaccucuuugcacacgcuggguaggugcauugcugcccuccggcaaaaccagcagaaucgaagcaagcagaaccuggugcccuuccgcgacuccaaacuuacuagagucuuccaaggcuuuuucacagggaggggacggucauguaugaucgugaauguaaacccgugcgcaagcaccuaugaugaaacucugcacguugcuaaguuuucugccaucgcgucccaguuggugcaugccccucccaugcagcucggcuucccaagucugcacagcuuuauuaaagagcacucuuuacaagucuccccuucacuggagaagggugcaaaggcugacacagggcuagaugacgacaucgaaaaugaggccgauauuaguauguacggcaaagaagaacuccuucagguggucgaggcuaugaagacccuguugcugaaagaacgccaggagaagcuccagcuggaaaugcauuuaagagacgagauauguaacgaaaugguggagcaaaugcagcagagggagcaguggugcagcgaacaccuggauacgcaaaaagagcuuuuggaagagauguacgaagagaagcucaauauccugaaggagucgcuaaccuccuucuaucaggaagagauucaggaacgugacgagaaaaucgaggagcuggaggcccuccugcaggaagcacggcaacagucuguugcccaucagcaaagcggaucagagcuugcuuugcgaagaagucagaggcuggcggcauccgccucuacacagcaguuacaagaagugaaggcuaaacuccagcaguguaaggccgagcugaacagcacuaccgaggaacuucacaaauaccagaagaugcuggagcccccacccuccgcaaagccuuuuacaaucgauguagacaaaaaguuggaagagggccagaaaaauauucgccuccugcggacugaacuacaaaagcugggggagucacuccagagcgccgagagagcuugcugccauaguaccggagccgguaaacugaggcaggcacuuacaaccugugaugacauauugaucaagcaagaucagacucuggcggaauuacagaacaauaugguccucgugaaacuggaccuucgcaagaaggcugccugcauugcagagcaguaucacacgguucugaaacuacaaggccaggugucugccaagaaacgacucgggacaaaccaggaaaaucaacagccaaaccagcagccgcccggaaagaaaccuuuccugcggaacuugcugccacguacccccacuugucaauccagcaccgauugcucgccuuacgcuagaaucuuaaggucacgccggucuccacuccugaagaguggccccuuugguaagaaauauuga

SEQ ID NO: 58106 - RNA, 5463 nt, Artificial Sequence
  derived and/or modified sequence opt3 from KIF20B__Homo_sapiens__NP_001271188
auggagagcaacuucaaucaggaaggcgugcccagaccuuccuacgucuuuucugccgacccaaucgcuaggccgucagagauuaacuucgaugggauaaagcuggaccucagucacgaauuuagccuuguugcacccaauaccgaggccaacuccuucgaaucuaaagauuaucugcaagugugcuugcggauccgcccuuuuacacagucggagaaggaguuagaaucagagggauguguacauauucuggacagccagacugugguccuaaaagaaccacagugcauccucggucgacugagugagaaguccucuggccaaauggcgcagaaauucagcuuuuccaagguguucgggcccgcuacgacccagaaggaguuuuuccagggauguauuaugcaaccuguuaaagaucuucugaagggccagucacguuugaucuuuacauacggucucacuaauagugggaaaaccuauacauuccagggaaccgaagagaacauaggcauccugccaagaacucugaaugugcucuuugacagcuuacaggaaaggcuguacacaaagaugaaccuuaaaccccaccggucucgcgaguauuugagacuguccucagaacaagagaaggaggaaauugccagcaagagugcacuacucaggcagaucaaagaggucaccgugcauaaugauucugacgauacgcuguacggcucccuuacuaacagccugaauauuucggaauucgaggaaucuaucaaggacuaugagcaggccaacuugaauauggcuaacuccauaaaauucucaguauggguuaguuuuuucgagauuuacaaugaauacaucuaugaucucuuugugccugucagcuccaaguuccaaaaacggaagaugcugcgcuuaucucaggacgugaaaggguacagcuuuauuaaggaucugcaguggauccaggugucagacaguaaggaggcauaucgacuccuuaaacugggaaucaagcaccaauccgucgccuucaccaaauugaacaacgcuagcucuagaucacauaguauuuuuacaguuaagauacuacagaucgaagacagcgagauguccagggugauucggguaucugaacugucgcucugcgaucuggccgguagcgagcguacuaugaaaacccagaaugagggcgaacgccuuagagagacagggaacaucaauaccucccuguugacgcucggaaaguguauaaacgugcugaagaauucagaaaaaaguaaguuccagcaacacgucccauuuagggagucuaaauuaacucacuacuuccagagcuuuuucaacggcaaggguaaaauuugcaugaucgugaauaucucccaguguuaucuggcguacgacgagacacuaaacguucucaaguuuucagcaauugcccagaaggugugcgucccggauacccugaauagcucucaagaaaaacuuuucgggcccgugaaguccagucaggacguaagcuuggauucuaacuccaauucaaaaauccugaacguuaagcgggcuacuauuaguugggagaauagccucgaagaccugauggaggaugaagaccuuguggaggagcuggaaaacgccgaggaaacacagaaugucgagaccaaauugcucgaugaagaccuggauaagacguuagaggagaacaaggcauucauaucgcaugaagagaaacgaaagcugcuagaccucaucgaagaccugaaaaagaaacuuauuaacgagaagaaagaaaaguugacccuggaguuuaagauccgcgaggaagugacacaggaguucacucaauauugggcucagagagaagccgauuuuaaagagacccuccugcaggagagggaaaucuuagaggaaaaugcggagcggcgccuggccauuuucaaggaccuugucggaaaaugugauacaagagaagaggcagcuaaggacauaugcgccacuaaaguggagaccgaagagacacacaacuacguuggcuuugaagauaucauugacuccuugcaagauaauguggcugacaucaagaagcaggccgagauugcacaucucuacaucgccucucugccugauccacaggaagcuaccgcgugucuagagcugaaauucaaccagauaaaggcagagcucgccaaaacuaagggcgaacugaucaaaacgaaggaggaacuuaagaaaagggagaaugaaagcgacucauugauucaagagcuggagacaaguaacaagaaaaucauuacccagaaucagcguaucaaggaauuaauaaacauuaucgaucagaaagaggacacuauuaaugaauuucaaaaccucaagucccacauggagaauaccuucaagugcaacgauaaagcugacacaucuagccugaucauaaauaacaagcuuaucugcaaugagaccguagaaguccccaaagacuccaagucaaaaauuuguagcgagcggaagcgagugaacgaaaacgagcugcagcaggaugaaccuccagccaaaaaggggaguauccacguuucuuccgcaauuacugaggaccagaagaaaagcgaggaagugagacccaauaucgccgagauagaagauauuagggucuugcaagagaacaaugaaggacuccgcgcuuuucugcuaacaaucgagaacgagcugaagaaugaaaaagaggaaaaggccgagcucaacaaacagaucgugcauuuccagcaagaacugucgcuuucagagaagaagaauuugacgcugucuaaagagguacagcagauucagaguaacuaugacaucgcaauugcggaauuacacgugcaaaaguccaaaaaucaggagcaggaagagaagauaaugaaacucagcaacgagaucgaaaccgcuacucggucuauuacaaauaacguuagccagaucaagcugaugcauaccaagauugaugagcuuagaacacuggacuccgucucacaaaucaguaauauagaucuacucaaccugagggacuugagcaaugguucugaagaggauaaccugccgaacacucaguuagaccuccugggcaaugauuaccuuguguccaaacaggugaaggaauaucgcauccaggagccuaaccgagagaauucauuucacaguagcauugaagccaucugggaggaaugcaaagagauugucaaggcauccucuaaaaagucgcaucaaaucgaagagcuggagcagcagauagaaaaguugcaggccgagguuaaaggguacaaggacgaaaacaaucggcucaaagagaaggaacacaaaaaccaagaugaccugcuaaaggagaaggagacccugauucagcagcuuaaagaagagcuccaagaaaagaaugugacgcuggacgugcagauccagcacguagucgagggaaaacgugcuuugagcgagcugacccagggcgugacauguuauaaggccaaaaucaaggaauuagagacuauucucgaaacccaaaaaguugagugcucacauuccgcaaagcuggaacaggauauacuugagaaggagaguaucauucugaaauuggaaagaaaccucaaggaguuccaggaacaccugcaggacucugugaaaaauacaaaggaucuaaacgucaaagagcugaagcuuaaggaagagaucacucaacucaccaauaaccugcaggacaugaaacauuuguuacagcugaaggaggaagaggaagagacgaauaggcaggaaacagagaaacucaaggaggaacugagcgcuuccucagcccgcacccaaaaccuuaaagcggaucugcagcggaaggaggaagacuacgccgauuugaaggagaaacuaacugacgcuaagaaacagauuaagcaagugcagaaagagguuucugugaugagagaugaagacaagcugcucaggaucaagauaaaugagcuggaaaaaaagaaaaaccaguguagccaggagcuugauaugaagcaacgaacaauccagcaguuaaaagaacagcugaauaaccaaaagguagaggaggcaauucagcaguaugaacgcgccugcaaagaccucaacgucaaggagaagaucauugaagacaugcggaugaccuuggaggaacaggagcaaacucagguggagcaggaucaggugcuggaagcuaaacucgaggaagucgagagacuggccaccgaacuugagaaguggaaagagaaguguaaugaccuggaaacaaaaaacaaucaaaggaguaacaaggagcacgaaaauaacacggauguuuuggguaagcuaaccaaucugcaggacgagcuccaggaguccgaacaaaaauacaacgcagaucguaagaaaugguuagaggaaaagaugaugcugaucacucaggcgaaagaggccgaaaauauacgcaacaaggagaugaagaaauacgcugaggaccgggaaagauuuuucaagcagcagaaugagauggaaauucuuacagcccaacugaccgagaaagauagcgaccuccagaaguggagggaagagcgagaucaguugguggcagcucuggagauccagcucaaagcccugaucucuucaaacguacaaaaggacaaugaaauugagcagcuuaagcggaucauauccgaaacaaguaaaauugagacucagaucauggauauuaagcccaaacgcaucagcucggcagacccagauaagcuacagaccgaaccucugucuacguccuucgagauaagcagaaacaaaauugaggacgggucaguggucuuggacaguugcgaagugucuacagagaaugaucaauccaccagguuucccaagccagaauuagagauccaguucacuccccugcagccuaacaaaauggccguuaagcacccaggcuguaccacaccggugacugucaagauccccaaagcucggaagcgaaaaagcaacgagauggaagaggaccucgugaagugcgaaaauaaaaagaacgcgaccccuagaacaaaucugaaguuuccaauuucagaugaccgcaacaguagcguuaaaaaggagcaaaaaguggccaucaggcccuccucuaagaaaacguauagccuucguucccaggcaucaauuauaggagucaaucuggcuaccaagaagaaagaaggcacucuccagaaguucggggauuuuuugcagcauucuccuaguauccugcaaucgaaagccaagaaaauuaucgagacaaugagcuccucuaagcuaucaaacguagaggccagcaaggaaaaugugucccagccaaaacgggcuaagagaaaacuguacaccagugagaucucuagccccauugacauaucaggacagguuauccucauggaucagaagaugaaagaauccgaccaccaaauuaucaagaggcgccuucgaacuaagacagcaaaauga

SEQ ID NO: 58107 - RNA, 4914 nt, Artificial Sequence
  derived and/or modified sequence opt3 from KIF21A__Homo_sapiens__NP_001166934
augcugggcgcccccgacgagagcuccgugagagucgcuguuaggauccggccucagcucgcaaaggaaaagauugaggggugccacauauguaccucugugacaccaggagaaccgcaaguauuccuugguaaggauaaagccuuuacuuucgacuacguguuugauaucgacucacagcaggagcagauuuauauccaaugcauugaaaagcugaucgagggcuguuucgagggguacaacgcgacggucuuugcuuauggacagaccggcgccgguaaaacauacacuauggggaccggauucgaugugaauauaguugaagaggaauugggcaucauuagucgcgcagugaagcauuuauuuaagagcaucgaggagaaaaagcacauugccaucaaaaacggccugcccgcuccugacuucaaggucaaugcacaguuucuagaacucuauaacgaggaagugcuggaucuuuucgacacaacccgagauauagacgccaaauccaagaagucuaauauucguauccaugaggauucgacugggggaauuuacacaguagguguuaccacgagaacugugaacaccgaaucagagaugaugcagugccugaaauugggcgcucucagcaggacaacugccaguacccaaaugaauguccaguccucucggagccacgcgaucuuuacaauccaugugugucagacccgcgugugcccacagauugacgcagauaacgccacggacaauaagauaaucuccgagucagcucaaaugaacgaguucgaaacucugacagccaaauuucacuucgucgaccuggcagggagugaaagacucaagaggaccggagcuacuggcgagcgggccaaagaagguauuagcaucaauuguggguuacuggcgcuuggaaacguuauaucugccuugggcgauaaguccaaacgcgcaacacacgugcccuaucgagacucaaagcugaccagacuacuccaggauagccugggcgggaauagucagacgauuaugaucgcuugcguaucuccuuccgacagggauuucauggagacccuuaacacacugaaguacgccaaucgggcucguaacaucaaaaacaaggugauggucaaucaagaccgcgccagccagcagauuaacgcauugagaucggagaucacuaggcuccagauggaacugauggaguacaaaaccggaaagcggauuauagaugaagaggguguggaaucuaucaaugacauguuucaugagaacgccauguuacaaacagagaauaacaaucugcgaguucgcauuaaagcuaugcaggaaacuguggaugcgcucagauccaggaucacccagcuugucucagaccaggcaaaccacgugcuggcccgggcuggcgaggggaaugaagagaucaguaacaugauucauagcuauauaaaggagaucgaagauuugcgcgccaagcuacuggaguccgaagcaguaaaugagaaccucaggaaaaaucugacaagagccaccgcucgugccccauacuucucuggaagcucaacuuuuagucccacgauucuuuccagcgacaaggaaacaaucgagauuaucgaccuggcgaaaaaggauuuggagaaacucaagcggaaggaaaaacgaaagaaaaagucuguugcaggcaaagaggacaacaccgauacugaccaagaaaagaaggaggaaaaaggugugucagagagagagaauaacgaacuggaggucgaagagagucaggaagugagcgaucacgaggacgaggaagaggaagaggaggaagaggaagaugacauagaugggggcgaguccucugacgaaucggauagcgaguccgacgagaaggcuaacuaucaggccgauuuagcaaauaucaccugugaaauugccaucaaacagaagcugauugacgagcuagaaaacucacagaaaaggcuccaaacacugaagaaacaguacgaggaaaaacuuaugauguugcagcacaagauccgcgacacccaacuggagcgggaucagguccuccagaaucugggaaguguggagucuuauagcgaagagaaagcuaagaaaguuagauccgaauacgagaagaaacuucaagccaugaacaaggaacugcagagguugcaggcagcucagaaggagcaugcccgccuccugaaaaaucaaucacaguaugagaagcaguugaaaaagcugcagcaagacgugauggaaaugaaaaagacuaagguacgacuaaugaaacagaugaaggaggaacaggagaaagcgcggcucacagagagccguagaaacagggaaauagcccagcugaagaaagaucaacgcaagcgggaccaccagcuuagauugcuggaggcucagaagaggaaucaagaagucgugcuccgacgcaaaacggaggaaguuaccgcacugcggagacaggugaggccuaugucugauaaggucgccggcaaagugacucguaaguuauccaguagcgacgcuccagcccaggauacagggucuuccgcagcggccguagagaccgacgcuucacgcacaggagcccagcagaaaaugcggauuccgguggcaagaguucaagcucugcccacuccugccaccaacgguaauaggaagaaauaccagcgaaagggccuuacggggcgggucuucaucaguaagaccgcacgcaugaaauggcaguugcucgagagaagggugacagauauuaucaugcaaaagaugacuauaagcaacauggaagccgacaugaaucggcugcuaaaacagcgagaggaacugaccaagagacgcgagaaacucucgaagaggcgugaaaagaucgugaaagagaacggagagggcgauaagaaugucgcuaacauuaaugaagagauggaaucccugacagcgaacaucgacuacauuaacgauucuaucagcgacugccaggccaauauaaugcagauggaggaagcaaaagaggagggugaaacucuugacguuaccgcugugauuaacgccuguacguugacagaggcccgguaucuguuagaucauuuucucucaauggggaucaauaagggccugcaagcugcacagaaagaagcccagaucaaggugcuugagggaagacugaagcagaccgagauuacaagugcgacucaaaaccaguuacucuuccacaugcugaaagaaaaggcugagcuaaauccagaacuggacgcccuccugggccaugcacuucaggagaacguagaagauuccaccgacgaggaugcccccuugaacucuccugggagcgagggauccacucugucaagcgacuuaaugaaacucugcggugaagucaagcccaaaaauaaggcuaggcgccgaaccacaacgcaaauggagcugcuuuacgcagauaguucugaacuggccuccgacaccagcacuggcgaugcgucgcuaccagggccgcucacaccuguggcugagggacaggaaaucggcaugaauaccgagacaucagguacuucugccagagagaaggaacugagucccccaccuggguugcccuccaaaauuggcagcauaucucggcagagcucccugucagagaagaaaaucccagaacccaguccuguuaccaggcgcaaggcauaugagaaagccgaaaagagcaaggcuaaagagcagaagcacucugacuccggaacgucagaggccaguuuaagcccaccguccucucccccuucgcguccaagaaacgaacucaauguguuuaaccggcugacagucagccaaggcaauaccucagugcagcaggauaaagggauuaucaaccccuucccugcauccaagggaauuagggcuuuuccacuucagugcauccacauagccgagggccauacuaaagcgguucuguguguggacaguaccgacgaucucuuguucacagguucuaaggaccgcacuugcaaaguauggaaucuggucaccgggcaagaaaucaugagccuaggaggccaccccaacaacgugguguccgucaaguacuguaauuauacaucacugguuuuuacggugucuaccagcuacauuaagguaugggauauccgagacagugccaaaugcauuagaacucuuacauccagcggucaggugacccucggcgaugcauguucugcuucaacuucccggacagucgccaucccgaguggggagaaccagauaaaucagauugcucugaacccuaccggaacguucuuguaugcagccagcggcaaugccgugaggaugugggaccugaagcgcuuucaaucgacugggaaauuaaccggacaucucggcccaguuaugugccugacaguggaucagaucucuuccggucaggaccuuaucauuaccgggagcaaggaucacuacauaaaaauguucgacgucacugagggagcucugggcacagugucacccacccacaacuucgaaccuccccauuacgaugguaucgaggcguugacaauucaaggcgacaaucucuuuagugggucuagagauaacggaaucaagaagugggaccugacucagaaagaccuacugcagcagguuccaaaugcacacaaggauugggugugugcccuuggcgucguaccugaccaucccgugcuccuguccgggugcaggggaggcauuuugaaaguuuggaacauggauaccuucaugccagugggugaaaugaaggggcacgacagcccgaucaaugcuauaugugucaacucaacgcauaucuuuacagccgcagaugaccggaccgugcguauuuggaaagcccgcaauuuacaagauggacagaucagugacacuggcgaucugggugaggacauugcuagcaacuga

SEQ ID NO: 58108 - RNA, 4914 nt, Artificial Sequence
  derived and/or modified sequence opt3 from KIF21B__Homo_sapiens__NP_001239029
auggccggccagggggacugcugugugaaggucgcuguuagaaucaggccccaacugagcaaagagaagauugaaggaugccacauauguaccuccgugacaccuggugagccacagguacuccuuggcaaagauaaggcauucacuuacgacuuuguguucgaucuggacacguggcaggaacagaucuauucuaccugcgucucaaaauugauugagggguguuuugaaggauacaacgccacaguguuagcguauggccaaacuggugcugggaagaccuacacaaugggaaccggcuucgauauggccacaagugaggaggaacagggcaucauuccgcgggcaaucgcccaucuguuugggggaauagcugagcgcaagcgacgugcacaggaacaggguguugccggccccgaguucaaagugagcgcucaauuucuagagcucuauaaugaagagauccuggaccuuuucgauuccacuagagacccugauaccaggcaccggcgcucuaacauuaagauccaugaagacgccaaugggggaauuuacacgacuggcgucaccucgagacugauccacucacaggaggaauugauacagugccucaaacagggugcgcugagcaggacaacugcaaguacccaaaugaacgugcaguccucucggagccaugccauuuuuacaauccaccugugucagaugcgcaugugcacccaaccagaucucguaaaugaggcuguuacgggguuacccgacggaacuccuccauccucagaguaugaaacacugaccgccaaguuccacuuuguggaucuugcaggcagugagcgauugaaaagaacuggcgcuacaggggaaagggccaaggagggaauuagcaucaacuguggucugcuagcgcucggcaaugucaucucugcccugggggaccaguccaagaaaguggugcauguccccuaccgggacucaaaacuuacccgucuguugcaggauagccucggaggcaacagucagacgauuaugauagcaugcguuucuccuuccgaccgcgauuucauggaaacccugaauacauuaaaauacgcuaacagagccaggaauaucaagaacaaagugguagugaaucaagacaagacuagccagcagauuucggcucugcgggccgagaucgcacgacuccagauggagcuuauggaauauaaagccgguaagcgcgucauaggggaggauggcgcugaaggauacucugaccuguuuagagagaacgcgauguugcaaaaggaaaauggcgcacuaaggcugcgggugaaagccaugcaggaggcuauugaugccaucaacaaccgcguuacccagcucaugucccaggaggcaaaucugcuucuggccaaggcuggggacggaaacgaagccaucggugcauugauucaaaauuauaucagagagauugaggaacucaggacaaaacuguuagagucagaagcgaugaacgagagucugcgucggagccuaucccgagcuucugccagaagcccauacucacucggcgcaaguccggccgcucccgccuucgggggauccccugcaagcucuauggaagaugcuucagaggugauaaggcgcgccaagcaggaccuggaacggcuuaaaaagaaggaggucagacagaggcgcaaaaguccagagaaggaagcguucaaaaagcgagccaaauugcagcaagagaauagcgaagagacugaugaaaacgaggcugaggaagaggaagaggaacgggacgaguccggcugugaggaagaggaaggucgugaggacgaggaugaagacucugggucggaggaaagccugguggauuccgacucagaucccgaggaaaaggagguaaauuuucaggcagaccucgccgaucugaccugcgagaucgaaauuaagcagaaacuuaucgacgagcuggaaaacagucaaagaagguugcagacacucaagcaccaguaugaggaaaaacugaucuuacugcagaauaagauucgcgauacccaacuagagcgggacagaguucuccagaaccugucuacuauggagugcuacacggaagagaaagcuaauaagauaaaggccgauuaugaaaaacgacuucgagagaugaaccgcgacuugcagaagcugcaggcagcgcaaaaagaacaugcccggcuccugaagaaucagagcagauacgagagggaguuaaagaagcugcaggcugaaguggccgagaugaaaaaggcaaaggucgcucuuaugaaacagaugcgugaggaacaacagcgccggagauugguggagacaaagaggaaccgagaaaucgcccagcucaaaaaggagcaacggcgccaggaguuccagauuagagcacuggaaucccagaaaaggcaacaggaaaugguccuacggcgaaagacccaggaggugucagcccugagacgccucgcuaagccuaugagcgagaggguugcgggccgugccggacugaaaccacccaugcuugauucuggcgcagaaguguccgcuaguacuaccagcucugaggccgaauccggggcccggucaguaaguagcaucgucagacaguggaauaggaagauuaaccacuuuuugggagaccacccggcuccuacagugaacgguacccgccccgcaaggaaaaaguuccagaaaaagggcgccucgcaauccuuuucuaaggcggcuagacugaaauggcagagcuuagagcggaggaucauagacaucguuaugcagcgcaugacuauugugaaucucgaagccgauauggagcgucugaucaagaaaagagaggaacuuuuccuguugcaagaggcacuccggaggaagcgcgaacgacugcaggccgagucaccagaagaggagaaagggcuacaggaacuggcugaggaaauugagguccucgcagccaacaucgacuacauaaaugauggaauuacagacugucaggcgacgaucgugcaacuggaggaaaccaaggaggaacuugauaguacugacacauccguagugauuucuagcugcuccuuggcugaggccagacuguuacucgauaacuuucugaaggcaucaaucgacaaaggccuucagguugcccagaaggaagcucaaauacggcugcuagaggguaggcuccgccagaccgauauggccgggagcagucagaaucaucuguugcuggacgcauuaagagagaaagcugaagcccacccugagcuccaggcgcugaucuauaacguccaacaggaaaauggcuacgccucuacagaugaggaaauuuccgaguucagcgagggaucguuuucacagucuuucacuaugaagggcaguaccucccaugacgauuuuaaauucaagagcgaacccaaacuuucugcacagaugaaggcugugagcgccgagugucuggggccacccuuggacaucuccacgaagaacauuaccaaaucacucgcuagucugguggaaaucaaggaggacggagucggcuuuagcguuagggauccuuauuaccgggaccgugugucucgcacagugucccuaccaacucgagguucaaccuucccgagacaaaguagggcaacagaaacuagcccccugacccggcgcaaauccuaugauagagggcagccuauaaggucuacggacguaggauucacaccacccucgagcccuccaacccggccccgaaaugauagaaacgucuuuucacgccuuacuuccaaucagagucagggcucugcccucgacaagagcgaugacuccgauucaucucugagcgagguguugagggguauuaucaguccgguuggcggggccaaaggagcucggacagcgccucugcaaugcguguccauggcagagggccacaccaagccaaucuuaugucucgacgccacugaugaacugcuuuucaccgggagcaaggaccguucuugcaaaauguggaaccuggucacaggacaggagauugcugccuugaagggccaucccaauaacgugguuucaaucaaauacuguucccacaguggucucguguuuagcguaucgacgucuuauauuaaggucugggacauaagagauuccgcaaaaugcaucaggacccugacuagcucaggacaggugauuaguggggacgccugugcugcgacaucuacccgcgccaucacauccgcacaaggcgaacaccagauuaaucagaucgcucuaagcccuucagguacuaugcuguacgccgcaaguggcaacgccgugcggauaugggagcuuagccgauuccagcccgucgggaagcucaccggacauaucggcccaguuaugugccugacggugacacaaaccgcuucccagcacgauuugguagugacugggucuaaggaccauuacgucaaaauguuugaguuaggagaaugugugaccggcacaauugguccuacucacaacuucgagcccccacacuaugaugggaucgaaugccuggccauucagggagacauccucuuuagcggcuccagagauaaugguauaaagaaaugggaccuggaucagcaagagcuuauucagcagaucccgaacgcgcauaaggacuggguuugcgcacuggccuucaucccuggcaggcccauguugcuaucagcuugucgcgccggggugauuaaagucuggaauguggauaacuuuaccccaauaggagaaaucaagggccacgacucucccauuaaugcuaucugcacaaacgcaaagcauauuuucacggccaguucggauugucggguuaaacuguggaauuacgugccugggcucaccccaugccugcccagacguguccuugcuaucaagggaagggccacuacauuaccuuga

SEQ ID NO: 58109 - RNA, 1794 nt, Artificial Sequence
  derived and/or modified sequence opt3 from KIF22__Homo_sapiens__NP_001243199
auggacagcugcucccuggagaucgccaacuggagaaaucaccaggaaacccucaaguaccaauucgaugcuuuuuauggcgagaggucuacacagcaggacauuuacgcagggucagugcagcccauacuucggcaucuguuggaaggacaaaacgccagugucuuagcguaugguccuacuggcgcugggaaaacgcacaccaugcugggaagcccagagcagccgggcguuaucccccgcgcccuaauggaucuccugcagcuuacacgagaagagggugcagaggggcguccuugggcccuguccgugacuaugucuuacuuggaaauuuaucaggagaagguacucgaccugcuggauccagcuucgggagaccucgugaucagagaagauuguaggggcaauauuuuaauccccggccugucacaaaaaccuauaagcaguuucgcagacuuugagcggcauuuccuuccagccucccgcaacagaaccgucggggcuacaagguugaaucagcggucuagccgcucccacgccgugcugcuaguuaagguggaucagcgagagagacucgcgcccuuuaggcagcgggaaggaaaacuguaccuuaucgaccuggcagguucagaggauaaccgucgcaccggcaauaagggguugagacucaaggaaaguggagccauuaacacuagccuguucgucuuaggcaaagugguagacgcucugaaucaaggucucccuaggguuccauaucgggauucuaaacuuacacgacuguugcaggacucccuagggggaucagcccauagcauccugauugcaaacaucgcuccggagcgcagauuuuaccucgacaccgugagugcccugaauuucgcggccaggucuaaggaagucauaaaccggcccuuuacgaaugagucccuucagccucacgcacugggcccagugaaguugagccaaaaagagcuccuggggcccccugaagcuaagcgcgccagaggcccagaggaagaggaaauuggaucgcccgagccgauggcugccccugcaucugccucccagaaguuaucaccccugcagaaacuaaguagcauggauccagcuaugcucgagaggcugcuuuccuuggaccgucugcucgcgucucaggguagccaaggcgcaccucugcuuucaacucccaagcgggaacgaauggugcugaugaaaaccgucgaggaaaaggauuuggagaucgaaagacucaaaacaaagcagaaagagcuggaggccaagauguuagcucagaaggccgaagagaaagaaaaccacugcccaacuaugcugaggccccuaagucaucgcaccguuacaggggcaaagccucucaaaaaggccgugguaaugccacugcagcuuauucaagagcaggcugccuccccgaaugcagagauccacaucuugaaaaacaagggacggaagagaaaacuggaaagccucgacgcgcuggagcccgaagagaaggcugaagauuguugggaguuacagauuucuccugagcugcuugcccauggcaggcagaaaauauuggaccuccugaacgaagguucagcacgcgaucuacgaagucugcaacggaucgggccaaagaaagcccagcucauugugggcuggcgugagcugcacggacccuucagccaggucgaagaccuugagagaguggaaggcaucaccgggaagcagauggaguccuuuuugaaggcuaauauacugggauuagccgcaggucaaaggugcggcgcuucuuga

SEQ ID NO: 58110 - RNA, 2571 nt, Artificial Sequence
  derived and/or modified sequence opt3 from KIF23__Homo_sapiens__NP_004847
augaaaagcgccagagcuaaaacccccaggaagccuacagugaaaaagggcucccagacuaaccugaaagacccagucgggguuuacugccgggugcgcccgcucggauuccccgaucaagaguguugcaucgaaguaauuaauaacacgaccgugcagcuucacacaccugaggguuaucgacugaaucguaacggcgacuacaaggaaacucaguauucuuuuaagcaggucuucgggacccauacaacccaaaaagaguuguuugaugugguugcaaauccauuagugaacgaccugauacacggaaagaauggccuacucuucacuuacggugucacagggucaggaaaaacccauacgaugacuggcagucccggcgaagggggacugcuuccuagaugucuggauaugaucuuuaacagcauugguuccuuccaggccaagagguauguguuuaaaucuaaugaccggaacucgauggauauccagugcgagguagacgcguugcucgagcgccagaagagagaagcuaugccaaaucccaagaccucaagcaguaaaaggcaaguugauccugaguucgccgacaugauuacagugcaggaauuuuguaaggcagaggaggucgaugaagacuccguguacggcguguucgucucuuauaucgagauauacaacaauuacaucuaugaucugcuggaagagguuccauuugacccgauuaaacccaagccuccacagagcaaacucuuacgggaagacaagaaccacaauauguacguggccgggugcacugagguagaggugaaauccaccgaagaggcuuucgaagucuuuuggcgcggacagaagaagcgaagaaucgcaaacacacaucugaacagggagucaagucggagccacucuguguucaauauuaaacuuguucaagcccccuuggaugcugacggcgauaacgugcugcaggaaaaggagcagaucaccauaucccaacuaucacucgucgaccuggccgguagcgagcguacgaaucgcacuagagcggaagggaacaggcuucgggaggcaggaaauauuaaccagagucugaugacauugcgaaccuguauggaugugcuccgcgaaaaucagauguauggcacuaacaaaaugguaccuuacagagacucuaagcugacacacuuauucaaaaauuauuuugauggcgaggggaagguuaggaugaucgugugcgucaacccaaaggccgaagacuacgaggagaaucuccaggugaugcgguucgcugaagucacccaagagguggaaguugcccgccccguggauaaagcaauuuguggacugacgccggguagaagguaucguaaccagccucggggccccguagggaaugagccacuugucaccgacgugguucugcaguccuuuccucccuugccaagcugcgagauccuagauaucaacgacgaacagacacugccccgacucauugaggcucuggaaaagagacauaaucuuaggcaaaugaugauagacgaguucaacaaacagucgaacgccuuuaaggcgcuguugcaggaguucgauaaugccgugcucucuaaagaaaaccacaugcagggaaagcugaaugagaaggaaaagaugaucuccggccaaaaguuagagauugaacgccuggagaaaaagaacaaaacucuagaauacaagaucgagauacucgagaagaccacaacuauuuacgaagaggacaaacggaaucugcagcaggaacuugagacccagaaccaaaaguugcagagacaguuuucagauaaaaggcgccuggaagcacgacuccaagguauggucacagagaccacuaugaagugggagaaagaaugugagcggcguguggcugccaagcagcuggaaaugcagaauaaacuuuggguaaaggacgagaagcugaaacaguugaaggcuaucgugacggagccuaaaacagaaaagccagagagaccgaguagggaacgcgaucgggagaaaguuacccaaagaagcgucucccccucuccugugccacuccuguuccagcccgaccagaacgccccuccaaucagguuacgacaucgccggagcagaucagcaggggauagguggguggaccacaagcccgccaguaauaugcagacugaaaccgucaugcaaccgcacguuccucaugcuauuacaguguccguggcgaacgagaaggcacuggccaaaugcgagaaguauaugcuaacccaccaggaacucgcuagcgauggcgagaucgaaacuaaacugauuaagggagacauauacaaaacacguggcgggggacagucuguacaguuuacggauaucgagacccuuaagcaagaaucaccaaaugguagucgcaagcggagaagcuccacugucgcccccgcacagccugacggcgccgagucugaguggacagauguggaaaccaggugcucgguugcuguggagaugcgagccgggagccaguugggacccggcuaucaacaucacgcacagccaaaacggaagaaaccuuga

SEQ ID NO: 58111 - RNA, 4107 nt, Artificial Sequence
  derived and/or modified sequence opt3 from KIF24__Homo_sapiens__NP_919289
auggccagcuggcuguacgagugccucugugaagcugagcuugcacaguauuacucccacuucaccgcccugggcuugcaaaagaucgacgaauuagcgaaaauuacaaugaaggauuauucuaaacugggggugcaugacaugaacgauagaaagaggcuauuucagcucauaaaaaucauuaagaucaugcaggaggaagacaaggcugucucaauucccgagcggcaucugcagacuuccagccuucgcaucaaaucccaagagcugcgaucuggaccucguagacaguugaauuucgauucgccagccgacaacaaggauaggaaugcaucaaacgacgguuuugaaaugugcagccucagugauuucuccgccaaugagcagaaaucuacguaccugaagguucuggaacacaugcucccggacgauagccaguaucacaccaaaacaggcauauuaaacgcuacugcaggggacuccuacgugcaaaccgagaucucaacaagucuguuuagccccaauuaucuuucugccauuuugggagauugugacaucccuauuauccagcggauaucccauguaucaggcuacaacuacgguauuccacacagcugcauccgccagaauaccagugagaagcagaaccccuggacugaaauggagaagauuagagugugugucaggaaacggccucuggggaugcgcgaagugcgaagaggagagaucaauaucauuacaguugaagacaaggagacccuacucgugcacgagaaaaaggaagcugucgaucugacgcaauauauacuucagcauguguucuacuuugacgagguauucggcgaagccugcacuaaccaggauguuuauaugaaaaccacacacccacugauccaacauauuuuuaauggcgggaacgcgacuuguuucgcauacggacagaccggugccggcaagacauauaccaugaucgggacgcacgagaaucccggauuguacgcucucgccgcaaaagacauauuuaggcagcuggaagugucucagccucggaagcacuuauucgucuggauuuccuuuuaugagaucuacugcggccaacuguacgaucuccuuaaccgucgcaagagacuguucgcuagggaggacagcaaacauauggugcagaucguggguuugcaggaacuacaggucgauucgguugagcugcuccuggaagugauucuuaaggggucuaaagagcgguccacuggagccacaggcguaaacgcggacucaagucgaagccacgccgugauccaaauucagauaaaggauuccgcaaaacgcaccuucggcagaaucucuuuuauugaccuggcugggagcgaaagggccgcugaugcccgggacucagaccgccagacuaagauggagggagcagagaucaaucagaguuugcucgcccugaaggaauguaucagagcuuuagaucaagagcauacacacaccccauucaggcaguccaaacugacgcagguccuaaaggacagcuuuauugguaacgcgaaaaccugcaugauagcaaauaucucuccgucacauguggccacagaacacacucucaacacccugcguuaugcugaucggguuaaggagcuuaaaaagggcauuaaguguugcacaagugugacuagccgaaauagaaccuccgggaacucuucgcccaaaaggauccagagcuccccuggagccuugucagaggacaagugcaguccgaaaaaggucaaacugggcuuccaacagucucucacaguggcagcccccgguagcacccgcgggaagguacacccucugacuucccauccacccaauauuccguuuacgucagcuccuaagguuagcggcaaacggggaggcucuagagggucccccagucaggaaugggugauccacgccagcccagucaagggaacagugaggucuggucaugucgcgaaaaagaaaccugaggaauccgcaccccuuuguucagagaagaaccgcaugggcaauaaaaccgugcuggggugggaaagucgagcuagcggaccaggcgaggguuugguucgggggaagcucucgacuaagugcaaaaaggugcaaaccguacagcccguccagaaacagcuggugucccguguugaguuaucuuucggcaacgcccaccacagagcagaauacagccaagauucacagaggggaaccccugcccgcccagcuagugaggccuggacaaauauaccgccccaucagaaggaacgggaggaacaccugagauuuuaucaucagcaauuccagcagccuccacuacuccagcaaaaacugaaguaccagccccuuaagagguccuugcgacaguaucgcccuccagagggccaacugacuaacgagacacccccgcucuuucacucuuacagcgaaaaucaugacggggcacagguggaggaacuggaugacuccgauuucucagaggacagcuuuagucacaucucuucccagcgggcuacgaaacagagaaacaccuuagaaaauagcgaggauucguucuuucugcaccaaacuuggggacaggguccugagaagcaggucgccgaaaggcagcaaucacuuuucucuaguccacguacaggcgacaaaaaggauuugaccaaauccuggguggacagccgcgaccccauuaaccaucggagagcggcccucgaucacucuuguagcccuuccaaggggcccguagacuggucaagggagaacaguacaagcucuggaccauccccucgagauucacuggcugaaaagcccuauugcagucagguggacuucaucuaccggcaggagcgcggcggugggagcuccuuugaucuaagaaaagacgcaucucagucggagguuagcggcgaaaaugagggaaaccugccaucaccggaagaggauggcuucacuauuucccucagucaugucgccgugccugggucucccgaccaaagggauaccgugacgaccccacugcgggaagucagcgcugacggacccauccagguuacauccacugugaagaauggccacgccgugccuggugaggauccacgagggcagcuuggaacccaugcagaguacgcgucaggcuugaugucuccccugacaaugagcuuacucgaaaacccugacaaugaggguaguccgccauccgaacagcugguacaagauggcgccacucacagccuugucgcugagucuaccgggggacccgugguuucacacacggugccuuccggcgaccaggaagccgcacugccagucaguagcgcuacaagacauuuguggcucucgucuagucccccugacaacaaaccagggggagaucugcccgcccuaagcccaucaccuauacgccagcaccccgcagacaagcugccaaguagggaggccgaucucggcgaggcuugucaaucucgugaaaccgugcuguuuucccaugagcacauggguagcgaacaguaugacgcggaugccgaggaaacugggcuugacggaucauggggcuucccugguaaacccuuuacaaccauucacaugggcguuccacauagugggccgacuuugaccccucggacaggaagcuccgauguggcagaccagcugugggcucaggagagaaagcaccccacgagguuaggcuggcaagaguucgggcucucuaccgauccaaucaagcugcccugcaauagcgaaaacguaacuuggcuuaaaccucgcccaauuucccgaugucuggccagacccucaucuccucuagucccgaguugcucgccaaagacagccggaacccuccggcagcccacacuggagcaggcucagcaaguggugaucagggcacaucaggaacaguuggacgagauggccgagcugggcuuuaaagaagagacuuuaaugagccagcucgcguccaaugauuucgaagacuuugucacccaacuggacgagauaaugguucuuaagucuaaauguauccagucacugcgcagccaguugcaacucuaccugacgugccacgguccuacagcugcccccgaagggaccgugccauccuga

SEQ ID NO: 58112 - RNA, 999 nt, Artificial Sequence
  derived and/or modified sequence opt3 from KIF25__Homo_sapiens__NP_005346
augaccuggacaagcggccagcugcaaagagagaagcaggccaggcccggguccggagcugugcucgcauucccugacgauaaagaccuucgggucuacgguccagccgaaucucagucagcgguuuuuggcgaugugugcccgcuguugacaaguuuacuggacggguauaacguaugugugauggcuuacggacagacgggcagcgguaaguccuauaccaugcuagggcgccacucugaugacggacccguccucccucuggauccacaaucggaccuuggcaucauuccccgaguggccgaggaacuguuccguuugauacucgagaauacaucaagaagcccuaaaguugaagugaguaucgucgagguguacaacaaugauauuuuugaccugcuggcaaaggauuccaucgccgcuguaucuggcguuaaaagggagguggucacugcaaaggacgggcggaccgaaguggcccucuuagcuagcgaggccgugggauccgcgucaaagcugauggaacuuguccaugguggcuugcagcugcgcgcaaaacacccaacucuaguucaugccgauaguagcagaucucaccucauuaucaccgugacucugacaaccgcuuccugcucagacagcacggccgaccaggcauguagugcuacucuucccagggagcagaccgaggccgggcgggcgggacgcucuagacgagccucccaaggcgcacuggcuccucaguugguaccagguaacccggccgggcaugcugaacaggugcaggccaggcuccaacuggucgauagcgcaggaucggagugcgugggcggcgacgccaaguuacugguuauacucuguaucucucccucccagcggcaccuugcucagacacugcaaggguugggauucgguauucgugcgcgccaggugcagagaggcccugcaaggaaaaagccacccucaagucagacugaagggaaacggcgaccugauuga

SEQ ID NO: 58113 - RNA, 5649 nt, Artificial Sequence
  derived and/or modified sequence opt3 from KIF26A__Homo_sapiens__NP_056471
auggugggcagaggggucccccugugcgccgcucagccugcaguugccgaaggggguccagcgagggagccgcccccucuccuugaggugagcccacggaagcgccugcccgcuggcccugaccaagauccaugugggucccgacccgccccugaaggagcaggcgccgguccagagcaggggcacucugcuggaggcggcggguggugccgucauugucacaccaaauugguagaauuaaagagacaggcauggaaacuggugucaggaccggguacaacucucagggaccccugccucagugcccugcuucuggauaaguugccugcuccaggcgcccuccccgcgugucggccugaggcagagcgcagaugcgacgucugugccacgcaucugcagcaacugaccagggaagcuaugcaccucuuacaggccccagcaagccaugaggaucuggacgcuccccacgggggaccgucccuugccccucccucuacaacuaccucgucacgggauacaccaggcccugcgggucccgccgggcgccagccaggacgagcaggccccgacagaaccaaaggcuuggcuuggagcccugggccaagugugcagguuuccguggccccggcuggacuggguggcgcccuaucuacugucacaauccaagcacagcagugccucgaagggauguggagcguguccaggguaaacucauuccugcccccugccugucuugcugaggcggcaguugccgcuguggccgucgcagauaccgugcgggagugcccacccguggccggaccugacggccugaguaaggcuuggggucgugggggcgucuguacgagcgccuugguuacuccaacccccggaucugugggcggguccacaggaccgucagcagcggcuagcuuuuucauucgcgccaugcagaagcucagucuggcaucuaaaagaaagaaaccucacccacccccucccccagccacuagggguaccuccacauacccuaccgauuuuagcggcguauuacaacuguggcccccaccggcuccucccugccuccuucgggccgcaucgaagacgaaagacaauccagggucuauaggaaaggugaaggucaugcugcgaaucuggcccgcucagggcgcccagcgcuccgcggaagccaugucauucuugaaaguggauccuagaaagaaacaaguuauucuauaugacccagcugcaggucccccugggagugccggcccgaggcgggcugccacugcagcggugccaaagauguuugccuucgacgcugucuuuccccaggauagcgagcaggccgaagugugcuccggaacaguagcagacguucugcagucuguggucagcggcgcugauggguguaucuucucauuuggacauaugagucucgguaaauccuacaccaugauuggcaaggacagcucuccucaaucacuggggaucgugccaugcgccauaaguuggcuuuuccgccugaucgaggaaagaagggagcguacuggaacacgguuuagcguccgaguguccgcaguugagguguguggcagagaucagucuuugagggaccuccuggccgaaguagcucccgguucguuacaggauacccagagcccuggggucuaucugcgcgaggacccggugugcggcgcgcaacuacagaaccaguccgaacuccgggcccccacggcagagaaagcugccuucuaccuggaugccgcucuugcagccagaucaaccaguagggcgggauguggcgaagacgcucgccgaucuagccacauguuguuuacacugcauguuuaucaguaccggauggagaagugcgggcguggaggcauguccggugggagaucaaggcuccaccugauugaucuuggaagcugugaggccgcagccggccgcgcuggugaagcagccggcgggccacugugcuugucucucuccgcgcugggaagugugaucuuagcucuggucaauggcgccaagcacgugccuuaucgggaccauagacuaacuaugcuccugagggagagccuugcaaccgccgggugucgaacaacuaugauugcucacguaucugacgcccccgcacaacaugcugaaaccuuguccacagugcagcuggccgcgcgcauccaccggcucagaaggaaaaaggccaaauacgcaucaaguagcucgggaggcgaguccucuugcgaagagggucgugcucgccggccaccucaucugagacccuuccacccaaggaccguugccuuagauccggaccgaacuccucccugucugccaggggaucccgacuacagcucaaguuccgagcagucuugcgauacggucauauaugugggaccuggcggugcugcacuuagcgaccgggaauugacagauaacgagggcccacccgacuucgugccuauuaucccggcccucucccgccacagaccaucaaaggggcccagggaugccgaccauuuucggugcagcaccuucgcugaacugcaggagcgacuagaguguauggauggaaaugaaggcccuagugggggacccggcgguacugacggggcgcaagcaucuccagccagaggaggccgcaaaccuucgcccccagaggcugccagcccuaggaaggcagucgguaccccgauggccgcuagcacaccccguggcucaucugggccagauacccaccagggaacuccugaacccugcaaggcgauuguuuggggcgaccagcgggaggacaguuccgccuggccagaacugcucgugccugagaaagcagcugugagcgggggaagaaggccccugccgucuccagccccucccccaccccaacuuuuggaggcaugucgcgccccugaggaaccgggcggugggggaacagauggcguagcucgaacgcccccagucggcaugagcggacagguggccggauccccuaugcugcccggugcgaccugcccuagauuagcagccggcucacgguguccagaaagggggcuccugacuacaaccguuacacuucagcgccccguggagcugaacggagaagacgaguuggucuuuacugugguugaggaacucagucugggcgcucuagccggugcugggcguccuaccagccuggcaucuuucgauuccgacugcucacucagagcccuggcuaguggaagccggccaguguccaucaucucuucgauuaaugaugaguuugacgccuacacgagccaggcacccgaaggcggcccgcuugagggggcggccugggcuggaucaucccaugguaguucuauaagcuccugguugucagaaguaucugucuguaccgccgauagcagggacccuacaccacaaccccgcuucaguccugauucccuggcaggcuuagacccagggggacccccggcucucgauggcagccugggugacgggucuucaggauuucuuggcccugaucgacccgacuccccaggcccuacuugggggcccugcccaggagagguggccgcaguggcccccaguagaccuggucgggagccacaggcuggcccgucgaggugggcgucggccgcacagaccauccacucuucccugccccgcaagccuagaacagcuagcgccacuaccagggucgggugugcccggcuaggacagucaccacccggccgugguggacucuucgaagacccuuggcuguugcgcguuggagagugcgauacgcaagcagcuagugccggccgagcgccaucucccacacugggcuccccuagauuaccggaagcucaggugaugcucgccugugcacagaggguaguggacgggugcgaggucgccgcucgggcagcccgcagaccagaggcgguggcuaggauucccccucugcggcgaggagccaccacucuugguguuacaacccccgcagugagcuggggcgaugccccaacugaagucguggcuugcucagggagucugaaagccagcccuaccuccaagaaaggauuggcacccaaggcuggcuuucucccaagaccgucuggugccgcgccucccgccccacccacacgcaagagcucccuggagcagaggucaucuccugcaagugcuccaccccacgccguuaacccugcacgggugggggcugccgccguccuacguggagaagaggaaccgagaccaucgagcagggcggaccauuccguaccccgcgcuacgucuucacugaaagcacgggccagcaagguggaggcugcccaccgacuugcaggccaugccucccucgagagauaugaaggccuggcucacaguucuagcaaagggagggaggcgccuggacgcccaccccgggccguuccuaaguugggugugcccccaucauccccgacccauggcccugcacccgcuuguagaaguggggccgcaaaagccgucggagcuccaaagccucccgugggcggugggaagggccguggacugguagccggcgggagcagggcguuaggaccaucugugaaacucuccacugcaucagucacaggucggagcccuggcgggcccguugccggaccgcgcgcugccccacgagcaggcccuucggugggugcuaaggccgggagaggcaccgugaugggaacaaaacaagcucugagggccgcacacucucggguccacgaacuuagugcguccggcgcccccgggcgcggagguagcucauggggcuccgcugauucugacagcgggcaugauaguggagugaauguuggcgaggaaagaccacccacugguccugcccugccguccccauacagcaagguaaccgcacccaggcgaccucagcgguauucuucagggcacggcagugacaacuccagcguguugucuggagagcuacccccagcuaugggccguacggcccuguuccaucacagcggcgggucaagcggguacgagucccuaagacgcgauagugaagcaacagguucugccagcuccgcgccugacucaaugagugagucuggggcugccagccccggagcaaggacccggucccugaaaucaccaaagaaaagagccacuggccuucagcgcaggcgacucaucccugcuccgcugcccgauaccacagccuugggucggaagccauccuuaccuggccaaugggucgaccugcccccaccucucgcagggucucugaaggaacccuuugagauaaaaguguaugaaauugacgauguugagagacuucagaggccgcgcccaacuccucgugaggcucccacccagggacuggccugcguguccacacgguugagacuagcggaaaggcgccagcaacgacugcgggagguccaggcuaagcauaaacaccucugugaggaacuggccgagacgcagggcagacuuauguuagaaccagggagguggcuggagcaguucgaaguggaccccgagcucgaaccugagagugcagaguacuuggccgcucuggaacgcgcaaccgccgcgcucgagcaaugcguaaaucuguguaaggcccacgucaugauggugacuugcuuugauaucagcguugcugcaucggccgcuauccccggaccacaggaaguggacgucuga

SEQ ID NO: 58114 - RNA, 6327 nt, Artificial Sequence
  derived and/or modified sequence opt3 from KIF26B__Homo_sapiens__NP_060482
augaacuccguggccggcaauaaagagaggcuggcugucuccaccagggggaaaaaguacggcguuaacgaagugugcucucccacuaaaccugccgccccauucucaccggagaguugguaucggaaggcguacgaagagagucgcgcugguucccgacccacuccugaaggcgccgggucugcucucggaucgucaggcacgccaagccccgguagugggaccuccucuccuagcuccuuuacaggaucaccaggccccgccaguccuggcaucgggacuagcucuccaggaucccuugguggcucaccgggguucggaaccggcagccccgguagugggucuggaggcggcuccagcccugggucggaccguggaguguggugugagaauugcaacgcuagacugguggaguugaaaaggcaagcauuacggcugcuucucccaggucccuuuccuggcaaggauccagccuucucugcugucauucacgacaagcugcaagugcccaauacaauacgcaaagccuggaacgauagagacaauaggugugauaucugcgcgacccaucuuaaccagcugaagcaggaagcaauucagaugguuuugacucucgagcaagccgcuggguccgaacacuaugacgccucaccguguaguccucccccacugagcaauaucccuacacuggugggaucccggcaugucggcggucuccagcagccccgcgauugggcauuugugccagcucccugcgccaccucuaacuacacgggguucgcgaauaaacacggcagcaagccuucaaguuuaggaguauccaacggcgccgagaaaaagagcgggucuccaacucaucaggcaaagguuucacugcaaauggcuaccaguccgagcaauggaaacauucuuaauuccguggccauccaggcucaccaguauuuggacgguacauggucucugucgcgaacuaacggcgucacccuguaccccuaucagauaagccaacucaugacagaguccucaagagaagggcugaccgaggccgugcuuaacagguacaaugcagauaaaccuagugccuguucugugccagcuagccagggauccugcgucgcgucagaaacgagcacuggcacaucuguugcagccuccuuuuucgcucgggccgcacagaagcugaacuugaguagcaaaaagaaaaagcaccgucccucuaccuccucagccgcugagccuccacucuuugccacaaguuucagcgguauccugcaaacaucgcccccgccugcaccacccuguuuacugcgcgcggugaauaaaguaaaggacaccccugggcucggcaaggugaaagucaugcuuagaauuugcuccacgcuggcuagggauaccucugaaagcagcucauuuuugaagguggacccccggaaaaagcagaucacacuauacgauccacugacuuguggaggccagaacgccuuccagaaacgagggaaucaaguuccucccaagauguuugcauucgacgccguguucccacaggacgcuucccaggccgaggucugcgcaggaaccguggcugagguaauucagucuguugugaacggugccgauggcugcgucuuuuguuucgggcaugcgaagcucggaaaaagcuauacaaugaucggcaaggacgauuccaugcaaaaucuggguauaauuccgugcgccaucucauggcuuuuuaaacugauuaacgaacgcaaggagaaaacuggggcuagauucagcgugagggucagugcaguggaaguuuggggcaaggaggaaaauuugcgggaccuccugucugagguggccaccggauccuuacaggauggccagagcccugggguauaccugugugaggaccccaucugcggaacacagcuacaaaaccagucggaacuccgcgcuccaaccgccgagaaggcagcguuuuuccuggaugccgcuaucgccucaagaaggucucaccagcaggacugugaugaagacgaucaucguaauagucacgucuuuuucacucuucacauuuaucaauaccggauggagaaauccggcaagggugggaugagcggaggccgaucuagauugcaucugauagaccucgguagcugcgugaaagcacuguccaagaacagggaaggcgggucaggacuuugucugaguuugagcgcucucggcaauguuauccuggccuuagugaacgggucuaaacacauucccuauaaggaguccaagcuggcaaugcuacuccgcgagucacugggaaauaugaacugccggacgacaaugaucgcccauauaagugcugcggucggcagcuacgccgaaacccuuuccacuauucagaucgcaucuagaguguugaggaugaaaaagaaaaagaccaaauauacaucgagcucauccgguggggagaguucuugugaagagggacgcaugcgacggccuacccagcugcguccauuucacacuagagcuacaguagaccccgauuucccuaucgcccaucucagcuccgacccggauuacucaucuagcagugagcaauccugcgacacggugauuuacaucggcccaaacgguaccgcccugagcgauaaggaauuaacugacaaugagggacccccugauuuuguuccaauuguccccgcucugcagaaaacaagaggggacucucgcccugcagaagccggagaggcggcugccggcaagucagaacgggauugucuuaagugcaacaccuucgcagaguugcaggagagacucgacugcauagauggguccgaggaaccgaguagcuuucccuucgaggaacugccagcccaguucggaccugaacaggcuucgaggggcccccgacuaucucaggcagccggugcguccccacugagcgagucagacaaagaggauaaugggagugaaggacagcucacaaaccgcgagggcccugaacugcccgcuucuaagaugcagcggucccacagcccagugccggccgcagccccugcucacucacccaguccagccagccccagauccgugccugguucuagcucccaacauucagcaucuccacuuguccagagucccucguugcagagcuccagggagucucuaaauucauguggcuuuguugaagggaaaccucguccgaugggaagcccacgcuuaggcaucgcuucccucaguaagacuucugaguauaaacccccuagcucacccucccagcggugcaagguguacacccaaaagggggugcugccaaguccugcaccccuuccaccuagcucuaaagacuccggaguagcgucaagagagagccuguugcagccggaagucaggacgcccccagugggcaugucgccucagguucucaagaaaucuaugagugccgguuccgagggguuccccgaaaccccaguggacgaugagcaacaggcagcuacaccuagcgagucaaagaaagaaauucuguccacuaccauggucacagugcagcagccccuagagcugaacggagaagacgagcucguuuuuacucugguggaggaacuuaccaucucuggcguauuggauagcggccgaccgacgaguaucauuuccuucaauagcgacuguucugcccgggcucuggcaucagggagucgcccagucuccauaaucagcucuauuucggaggauuuagaaugcuauucaagcacagccccuguguccgaggugaguaucacccaauuucucccccugccaaagaugucucuugacgaaaaggcccaggaugcuggaagcagaagguccucaauuaguucuuggcugagcgagauguccgcggguucagaaggcgagcagagcugucacucuuucaucgcacagacuugcuuugggcauggagaggccauggcugaacccgucgccuccgaguucguuaguagccuacaaaacacagcagugguaugucgggaaaaaccuaaggccucgccggacaaucuccugauauuguccgagaugggcgaugacucuuuuaacaaagcugcgcccaucaaggguugcaaaauuucaaccgugagcaaggccauggucacuaucaguaauaccgcaaaccuguccucuugugaaggguacauuccaaugaagacaaauaucacgguguauccuugcauagcuaugagcccccgaaacauucaggagccugaggccccaaccgcaacucccaaagccggaccuacauuagcucagucaagagaauccaaggagaauagugccaaaaaggaaaugaaauucgaggauccauggcucaagcgcgaggaagagguuaaaaaggaaaccgcgcaccccaacgaggaaggcaugaugaggugugagacagcaacuggcccgagcaacgccgagacccgugcugaacaggagcaagacgggaagccuucuccaggagaucggcugucauccagcucuggugaagugagugccucgcccgucacggacaauuuuagaagggugguugacggcugcgagauggcacuuccugggcuggcaacacaguccccagugcaccccaacaaaagcgucaagucaucuagcuugccgcgcgccuuccagaaggcuucccgacaggaggaaccugauagucucucauacuauugcgccgcagagaccaauggaguaggcgcggccucugguacucccccaagcaaggcuacccuggaagggaaaguggccuccccuaagcauuguguucuagcaagacccaagggaacaccaccccugccuccagugcggaaaaguagccuugaccaaaagaacagggcuuccccgcagcacucugccucaggcagcggcacuucgagcccccucaaucagccugcagccuuuccagcugggcugcccgaugagccuaguggaaaaaccaaggacgcgucuagcucauccaaauuguucucugccaagcuggaacaauuagcaagucgcagcaacucccucggucgugcuacagucucacauuacgagugccugagccuugaaagagccgagucucugaguuccgugagcucacgguugcacgccggcaaggaugggacgaugccaagggcaggacgcucucucggccgauccgcugguaccucgcccccuagcaguggggccucuccgaaagcgggacaguccaagaucagcgcuguaucaagacugcuacuggccaguccacgggcaaggggccccuccgccagcacuacaaaaacccuuucuuucucaacuaagagccucccucaggcugugggccagggguccucuagucccccaggagguaaacauacaccuuggucgacccaaagccugucccgcaauagaucaucuggcuuggcaagcaaguuaccccugagggccgucagugggcggauuuccgagcuccugcagggaggcgcgggugcucgugggcuucagcugcgcgccggaccagaagcagaggcccgaggcggcgcuuuggccgaagacgagccggcagcugcccaccuacugccuucacccuacucuaagaucacgccacccagaaggccucaccgguguagcuccgggcauggaagugauaacagcucuguucucucaggugagcugccacccgcgaugggcaaaacugcccuauuuuaucacuccgggggaagcaguggcuacgaaucugugaugcgcgacuccgaggcaaccgguucggcuagcucagcccaggauuccacaucugaaaauaguagcucaguagggggcagaugcagguccuuaaagaccccuaaaaagcggagcaacccgggaucucaacgaagacgccugauaccagcacucaguuuggacacuuccagccccgucaggaaaccuccaaauucaacaggcgugcgguggguugaugggccccugcguucuucgccuagaggacucggugagcccuucgaaaucaagguauaugagauugacgacguggagaggcugcagcgccggcgaggcggggcuagcaaggaagccauguguuuuaacgccaaacuuaagauccuggagcauagacagcagaggauugcggaaguccgcgcuaaauacgagugguugaugaaggaacuagaggcaaccaaacaauaucugaugcucgauccaaauaagugguuauccgaguucgaccuggaacaggugugggagcuugauagucuggaauaccucgaggccuuggaaugcguuacagagcggcuggagucuagagugaacuuuuguaaagcucaccucaugaugaucacuugcuucgacauaaccucacguaggcgguga

SEQ ID NO: 58115 - RNA, 2235 nt, Artificial Sequence
  derived and/or modified sequence opt3 from KIF2A__Homo_sapiens__NP_001091981
auggccaccgcuaacuucggcaagauccagauugggauauacguggagaucaaaagaagcgacggaaggauucaccaagcaauggucacaucccugaaugaagauaacgagucuguuacuguggaauggaucgagaauggugacacgaagggcaaagaaauugaucucgagucaaucuuuagucuuaaccccgaccugguaccugaugaggaaauagagccaagcccggaaacacccccuccacccgccuccucugcgaaggugaauaaaaucgucaagaaccggcgcaccguggcuucgauuaagaaugacccuccaucacgagauaaccguguuguggggagcgccagagcaaggcccagucaguucccugagcaguccucuagcgcccagcaaaauggauccgucucagacaucaguccagugcaggcugccaaaaaggaguuuggcccgcccagccggcgcaaaucuaacugcguaaaggaaguugagaaauugcaggaaaagagagagaagaggcgguuacagcaacaggaacugcgcgagaaacgagcacaggauguggacgcuacuaauccuaacuaugagauuauguguaugaucagagauuucagggguucccuagacuaccggccacucaccacagccgaucccauagacgaacaucguauuugcgucugugugcgcaagagaccucugaauaaaaaggagacccagaugaaagaccuugaugugaucacuauuccaucaaaggacgucguuauggugcacgaacccaaacaaaagguagaucugacaagguauuuggagaaccagaccuuucgguucgacuacgcguuugaugacagcgcaccgaaugaaaugguguaucgauucacggcccgcccucucgucgagacuaucuuugagagagggauggcuaccugcuucgccuacggacagacaggcaguggcaagacucauaccaugggaggggauuuuucugguaaaaaccaagacuguuccaagggcaucuaugcacuggcugccagggauguguuccugaugcucaaaaagcccaacuacaaaaaguuagaacugcagguuuacgcgacauuuuucgagauuuauagcgggaagguguucgaccuuuugaaucggaaaaccaagcugcgcguccuagaagauggaaaacaacaggugcagguaguuggccuccaggagagagaagugaagugcgucgaggacgugcugaaacuuauagacaucgguaacucguguaggacgucugggcagacuuccgccaaugcacacucaagucguagccaugcugucuuucagauuauccugcggcgaaagggaaaguugcacggcaaauucucccucauagaucuggccggcaacgagagaggggcugacacaucuagcgccgauaggcaaacccgcuuagaaggagcagagauuaauaagucacugcucgcccuuaaagaaugcauccgggcucuggguagaaacaagccacacacuccuuuuagggcgaguaaauugacacaggugcuacgcgacuccuucaucggcgagaauagccgaaccuguaugauugcaacgaucucucccgggauggccucaugcgagaacacccugaauacacuccgguacgcuaaccguguuaaggaauuuggaauuaguccaagcgauauacccuucucccagggcucugguucgagaccugaccugagcccauccuaugaguacgaugacuuuucaccgagugugacuaggguaaaggaacuuaccgucgaucccacagccgcaggggacgugcgcccuaucaugcaucacccacccaaucagauugaugaccuggagacucaauggggcguuggaucuagcccucagcgggaugacuugaaacuccugugugaacagaacgaggaggaaguguccccacaguuauucaccuuucaugaggccgucucacaaaugguggaaauggaggaacagguaguggaggaccacagagcuguuuuccaggagagcaucagguggcuggaagaugagaaggcccuacucgaaaugacagaggaagucgacuaugauguggacucuuacgcaacccaacuggaggcgauccuugagcagaaaauugauauauugacugaacugcgagacaaggugaaauccuuucgcgcugcccuccaggaggaggaacaggcaaguaagcaaaucaaucccaaacggccgagagcccuguga

SEQ ID NO: 58116 - RNA, 2022 nt, Artificial Sequence
  derived and/or modified sequence opt3 from KIF2B__Homo_sapiens__NP_115948
auggccagccaguucugccugcccgaguccccuugucucucuccacuuaagccgcugaaaccccacuuuggcgacauccaagaagggauuuacguggcuauacagagaucagauaagaggauccauuuggcagucguuaccgagauuaaccgggaaaauuauugggugacaguagaguggguggaaaaagccgucaagaaaggaaagaagaucgacuuagagacuauucugcuacucaacccugcgcuggauagugcugagcacccaaugcccccuccaccccuuagcccucuggccuuggcaccauccucugccauccgcgaccagcgaacggcuaccaaauggguggcaaugauaccgcagaagaaucaaacagccucgggugauucacucgacguucgugugcccagcaaaccuugccugaugaagcagaaaaagaguccaugucugugggaaauccagaagcuccaggagcaaagagaaaagaggcggcgcuuacagcaggagauuagagcuaggcgggcccuggaugucaacacucgcaaucccaacuacgagaucaugcauaugauugaagaguaucgaagacaccuugacuccucuaagaucagcguguuggaaccuccacaggagcauaggauaugcguauguguucggaaacguccccugaaucaacgcgaaaccacacuaaaggaucucgacauuaucaccgugccguccgauaacgucgugauggugcacgagucaaaacagaaggucgaccugacuagauaccuucagaaucaaacauucugcuuugaucacgcguucgacgacaaagcaaguaacgagcugguuuaucaguuuaccgcccagccuuugguggaaagcauuuucaggaagggcauggcuacguguuuugccuacgggcagacuggaucuggcaagaccuauacaauggguggggauuucuccggaacugcacaagacugcucaaaaggcaucuacgcucucguagcccaggauguguuucuguuacugcggaauagcaccuacgagaagcucgaccuuaaagucuauggcacauucuuugaaaucuacgggggaaagguguaugaucuguugaacuggaaaaagaagcuacagguucuggaggacgguaaucagcaaauucagguggucggccuccaggaaaaagagguguguugcguagaggaaguucugaaccuuguggagauagggaauaguugucgaaccucucgccagacgcccgucaacgcgcauuccagcagaucgcacgccguguuccaaaucauucugaagucuggaaggaucaugcauggcaaauuuuccuuggucgaucucgcagguaacgaacgcggggcugacacuacaaaggccucacggaaaagacagcuggagggagcugaaauaaauaagaguuuacuggcccuaaaggagugcauucucgcacugggccagaacaaaccacacaccccuuucagggccagcaaacuuacuuuggugcugcgugauuccuucaucggccaaaauucuagcacaugcaugaucgcuaccauuucacccgggaugacgaguugugagaacacccucaauacacugcgguacgcgaaccgaguuaaaaagcugaauguggacguaagaccauaucacaggggacauuaccccaucggucacgaagcaccucgcaugcuuaaaucccauauuggcaacagcgagaugucuuugcagcgggaugaauuuauaaagaucccauauguccagucagaggagcagaaggaaauugaggaaguggagacucucccgacccuguuagggaaagacacaacuaucaguggaaagggcagcucccaauggcuggaaaauauccaggagagagccggugggguucaccaugacauugauuucugcauagcuaggucucuaucgauccucgagcagaaaauugacgcccugaccgaaauccagaagaaacuuaaguugcugcucgcagaucugcacgugaaaagcaaggucgaguga

SEQ ID NO: 58117 - RNA, 2055 nt, Artificial Sequence
  derived and/or modified sequence opt3 from KIF2C__Homo_sapiens__NP_001284584
auggccauggacagcucccugcaggcuagacucuuccccggccuugcaaucaagauucaaaggucuaacgggcugauacacucagccaaugugcggaccgucaacuuggagaaaaguugcguuagcguggaaugggcggagggaggugcuacaaagggcaaagaaaucgauuuugacgauguagccgcaauuaauccugaguuacugcagcuacucccacugcauccgaaggacaaccuuccccugcaggaaaaugugacuauccagaaacaaaagcgccgauccgucaacucuaagauuccugccccaaaagagucguugcguucaagaagcacgaggaugaguaccguguccgagcuccggaucacagcucaggaaaaugauauggagguugaacugcccgcagccgcuaacucucgcaagcaguucagcgugccucugagaaggaaauccugucucgucaaggagguggagaaaaugaagaauaagcgggaagagaaaaaggcccagaacucagaaaugcgcaugaaacgagcgcaagaguacgacaguagcuuuccaaauugggaguucgcaagaaugauaaaggaguuuagggccacuuuagagugccacccccugaccaugacagauccuaucgaagaacaucggauuuguguaugcguucguaaacgcccacuuaacaagcaggaauuggcuaaaaaggagaucgacgugauuucuaucccguccaagugucugcuacucguccacgaacccaaacugaagguggaucuuaccaaauaucuggagaaucaggccuucugcuuugacuucgcauuugaugagacugcuucaaacgaaguggucuacagauucacagccaggccuuugguucagaccauauuugaagggggaaaggcgacguguuucgccuauggccaaacugguagcgggaaaacccauacaaugggaggcgaccucaguggcaaggcacagaaugcuucuaaggggauuuacgccauggcuucccgggauguguuucugcuuaaaaaccagccaugcuaucgaaagcugggacucgaaguauacgugacuuucuucgagaucuauaacgguaaacuuuuugaccuguugaauaagaaagccaagcuacgcguccuggaagacggcaagcaacaggugcagguuguggggcuccaggagcaccuggucaacagcgcagaugacgugauuaaaaugaucgauaugggaucggccuguagaaccucuggccaaacauucgcuaauuccaacucaaguaggagccacgcgugcuuucagaucauucuucgggcaaagggucgcaugcaugggaaauucucccugguagacuuggccggaaaugagagaggcgcugauaccucuagcgccgacaggcagacgcguauggaaggcgcagagauaaacaagucacuccuggccuuaaaagaauguauccgggcucuggggcagaauaaggcccacacucccuuucgagagaguaagcuaacacaaguucucagagauuccuucauuggagagaacagcaggaccugcaugaucgcaacuauaucuccugguauuucaaguugcgaauacacacugaauacccuucgcuacgcggaccgggugaaagaguugagcccacauuccggccccucuggggaacagcugauccagauggagacggaagagauggaggcuuguucgaacggagcccucaucccgggcaaucugagcaaggaagaggaagaguuauccucacagaugaguucuuuuaacgaagcaaugacccaaauuagagagcuggaggaaaaagccauggaggaauugaaggagaucauucagcaggguccugauuggcucgaacugagcgagaugacagagcagcccgacuaugauuuagaaacuuucgucaauaaagcugaguccgcccuggcacaacaggcuaagcacuuuucagcccuaagggacgugauaaaagcgcuccgccuggccaugcagcuugaggagcaagcuagccgacagaucucuuccaagaagcggccacaguga

SEQ ID NO: 58118 - RNA, 2181 nt, Artificial Sequence
  derived and/or modified sequence opt3 from KIF3A__Homo_sapiens__NP_001287720
augcccaucaacaagagcgagaaaccugaauccugcgacaaugugaaggucguugugagauguaggccacugaacgagcgggaaaaaucuaugugcuacaagcaggccguaucaguggaugagaugcgcggcaccauuacaguccacaaaacugacaguagcaaugaaccgcccaagacguucaccuuugauacaguguucgggccugaguccaagcaacucgacguuuauaaccuuacugcucgaccaauaaucgauucugugcuggagggauacaaugguaccauuuuugcauauggccagacagggaccggaaaaacuuucacaauggaaggcguccgugccauccccgaguugagagguauuaucccuaacucguuugcgcauauauucgggcacaucgcuaaggccgaaggagacaccagguuuuuagugcggguaucauaccuggagauuuauaaugaggaaguucgcgaucuacucggcaaagaccagacgcagagacuggaggugaaggaaaggccagaugucggcguguacaucaaagaccuuagcgcauauguggucaacaaugccgaugacauggaucggauuaugacucuggggcauaagaaccgcaguguuggagcuaccaauaugaacgagcacuccucucgaagccaugcaaucuucacaauaacuauugaauguuccgagaaggguaucgacggcaauaugcacgugagaauggggaaauugcaccucguagaccuggccggaucagagaggcaagcuaagaccggcgccacaggucagcggcugaaagaagcgaccaagauuaaccucaguuuaagcacgcuggggaaugugaucucugcacuugucgauggaaaauccacucaugugcccuaccguaacucaaaguugacacgccugcuacaggacagccucggcggcaacaguaaaaccaugaugugcgccaauaucgggccugcugauuacaacuaugacgagacuauuucuacacugagauacgccaauagggcaaagaacauaaagaauaaagcucggaucaacgaagauccaaaggacgcccuucugcgacaguuucaaaaagagauugaagaguugaagaaaaagcucgaggaaggagaggaaaucuccgguagcgauauaucgggcucugaggaagacgaugacgaggagggggaaguuggagaggauggcgaaaagcgcaaaaagagaagggguuccucaaguagcuccucuagcgacucaaccuguagugugauugagaaaccgcuggacaaguucuuacccaaucaggcggggaaaaagaaggucuccccugauaaaaugaucgagaugcaggccaagaucgacgaggaacggaaagcacuggaaacgaagcucgauauggaggaagaggagcgcaacaaagcuagagccgaacuugagaagagggaaaaggaccuguugaaagcucagcaagagcaccagagccuacuggaaaagcucucugcccuggagaaaaaggugauuguaggcggaguugaucuucuggcaaaagccgaggaacaggagaaguugcucgaagagucaaauauggaacuggaggagcgucggaaacgagcugaacaauuaagaagggagcuggaagagaaggagcaggaacgccuagacaucgaggaaaaguauaccagucuccaggaggaagcgcagggcaaaacaaagaaacugaagaaaguguggacuaugcuuauggcagccaagagcgagauggcugauuugcaacaggagcaucagcgggaaauugaggggcugcucgaaaacauaagacagcuguccagggagcuucgccugcaaauguugaucauugacaauuuuaucccacgagauuaccaggaaaugaucgagaacuauguccacuggaaugaggacauuggagaauggcagcucaagugcguggccuacaccgguaacaauaugcggaaacagacacccgucccugauaagaaagagaaggacccauucgaaguggaucugucucacguuuauuuagcauacacugaggaaucgcugcgucaaagccuaaugaaacucgagagacccaggaccuccaagggcaaggcccgcccgaaaacagggcggagaaagaggucagcuaaaccugagaccgugauagacagucugcuucaguga

SEQ ID NO: 58119 - RNA, 2244 nt, Artificial Sequence
  derived and/or modified sequence opt3 from KIF3B__Homo_sapiens__NP_004789
augagcaagcugaaauccucugagucagugagagucguugugaggugccggcccaugaacggcaaggaaaaagccgcuaguuacgacaagguaguggaugucgacgugaaacucgggcagguuagcgugaagaauccuaagggaaccgcacacgagaugccaaaaacauucacuuuugaugccgucuaugacuggaacgcgaagcaauucgaacuuuacgaugagacguuucgcccgcugguggacuccguauugcaggguuucaauggcaccaucuuugcuuaugggcagacaggaacuggcaaaaccuacacaauggaagguauucgaggggaucccgagaagcguggaguuauaccuaacucuuucgaccauaucuuuacccacauuucgagaucacagaaucaacaguauuuagugagggccagcuaccuggagaucuaucaggaagagauucgggaucuacucaguaaagaccagacuaagcgccuggaacuuaaggagagaccagauacaggcgucuacgugaaagaccuguccucuuucgugaccaagagcgucaaagagaucgaacauguuaugaacgugggcaaucaaaacagguccguaggggcaacgaauaugaacgagcacucaagucggagccaugccauauuugugaucacuauugaauguucugaggucggauuggauggugaaaaucacauccgcgugggcaagcucaaccugguugaccuggcuggguccgagcgacaggcaaaaaccggagcccagggcgagagacucaaggaagcuacaaaaauuaauuuaucacugagcgcccuugguaacgugaucagugcguuggucgacgggaagucuacucacauacccuacagggauuccaagcugacccggcuacuccaggacagccugggaggcaaugcaaaaacagugaugguagccaacguuggcccugcuucguauaacguggaggaaacccuuacgacucugcguuacgccaaucgcgcaaagaacauuaaaaauaagccaagagucaacgaggaucccaaagacgcuuugcucagggaguuccaagaggagaucgcccggcugaaggcgcaguuagaaaagcgaucuauugggcgcagaaaaaggcgggagaagcgcagagaaggagguggcuccgggggaggcggugaggaagaggaggaagagggggaagagggcgaggaagagggagaugacaaagaugacuauuggagggaacagcaagagaagcuggaaaucgagaaacgugccaucguggaggaucauucacucgucgcagaagagaagaugcggcuucugaaggaaaaagagaagaaaauggaagacuugcgaagagagaaggaugcugccgagaugcuaggcgcuaaaauuaaggccauggaaaguaagcugcucgugggagggaaaaauauaguugaccacacaaacgagcagcagaagauccuggaacagaaaaggcaagagauugcagaacagaagcgccgggagagagagauccagcagcaaauggaaagcagggacgaggaaacccuugagcugaaagagacuuacuccucuuugcagcaggaaguggauauaaagaccaaaaagcucaagaaacuguuuagcaaguuacaggccguaaaagcugagauucaugaccugcaagaagaacacaucaaggaacgccaggagcuagagcagacacagaaugaacucacgcgagagcugaaacuuaagcacuugaucauugaaaacuucaucccucuggaggaaaagucaaaaauuaugaaucgggcguuuuucgaugaggaggaagaccauuggaagcuccacccaauaacccgucuggagaaccaacagaugaugaaaagaccggucagugcaguggguuauaagaggccccuuucccagcaugcccgcaugagcaugaugauccggccugaagcuagauacagggccgagaauauuguucuguuggaacucgauaugccaucucgaacaacucgcgacuaugagggccccgcaaucgccccuaaagugcaagcugcccuggaugcagcguuacaggacgaggaugaaauccaggucgacgcuucaaguuucgagagcaccgccaacaagaaguccaaagcacggccaaagucugggagaaaaucgggaagcuccucaaguucuagcggcacacccgccucccagcuguacccgcaaucaaggggucuagugccuaaguga

SEQ ID NO: 58120 - RNA, 2382 nt, Artificial Sequence
  derived and/or modified sequence opt3 from KIF3C__Homo_sapiens__NP_002245
auggccagcaagaccaaggcuuccgaggcacugaagguggucgccagaugcaggccccucucucggaaagaagaggcggcuggccacgaacagauccuuacaauggacguuaagcuggggcaagugacuuugcgcaacccucgagccgcaccaggagaguuaccgaaaacguucaccuuugaugccguauacgacgcuucaaguaagcaggcagaucuguaugacgaaacagugcguccccuaauugauagcguccuccaggguuucaauggcacuguguuugccuacgggcagaccggaacaggcaagaccuauacuaugcaagguacauggguugagccugagcugagaggggugauaccaaacgcuuucgaacauaucuuuacccacauuuccaggucucagaaucagcaguaccuuguccgggccucguaucuggagaucuaccaagaagagauucgcgacuugcucucaaaagagcccggaaagagacuggaacugaaagagaacccugaaacgggcguguauaucaaggaucucagcaguuucguaacuaaaaauguuaaggagauagaacaugugaugaacuuaggcaaucagaccagggcggucggguccacacacaugaacgaggugucuagccggucccaugcaaucuuuauuaucacuguggaguguucagaacgcggaagugacggucaggaucacauucgagucggcaagcugaaucuuguugacuuggccgggagcgagagacagaacaaagcuggaccaaauaccgccggcggugcagcuacacccucuuccgggggaggcggcgggggagguggcucagggggaggcgccgguggggaaaggccuaaggaggcgagcaaaaucaaccugagucuaucugcccucggcaaugugauagcagcucuggccggaaaccgguccacccacauuccauaccgugauagcaaacuuacgcgccuguugcaagacucgcucggcgggaaugcuaaaacuaucaugguagccacacugggaccggcaucucauuccuacgaugaaucauuaaguacccugagauucgccaacagggcuaagaacauuaaaaauaagccccgggugaacgaggacccuaaggacacucuccuucgagaguuucaggaagagaucgcgcgccugaaagcacaguuggaaaagagagguaugcuaggcaaaaggccacggcgcaagagcuccagaaggaaaaaggccgucucugcucccccuggguauccagagggacccgugaucgaagccuggguugcagaggaggaagaugacaauaacaauaaccaccguccgccucaacccauucuggagagcgcccucgaaaagaauauggagaacuaccugcaggagcagaaagaacggcuugaggaagagaaggcugccauacaggaugaccgaucacuggugagugaagagaaacaaaaguugcucgaggaaaaagagaagaugcuggaagauuuaagaagggagcagcaggcaacagaacugcuagcggcuaaguauaaagccauggaguccaagcuccugaucggcggucgcaauauuauggaccauaccaacgagcagcagaaaaugcuugaauugaagcggcaagagaucgcagaacagaaaagaagggagcgcgaaaugcagcaagagaugaugcugcgagaugaggaaacgauggagcuccgggggaccuacacaagccugcagcaggaagucgaggugaagacuaagaaacuuaagaaacuguaugccaaguugcaggcuguaaaagccgagauacaagaccagcacgaugaauacauucguguuagacaggaccucgaggaagcacaaaaugagcagaccagggaacugaaguuaaaauaucugaucaucgagaacuucauuccaccugaggaaaagaauaagaucaugaaccgccuauuucucgauugcgaggaagaacaguggaaauuccagccccuggugccagcuggcgucucuucaagucaaaugaagaaacggcccacaagcgccgugggauacaagagaccuauuucccaguacgcgagggucgccauggcuaugggcucucacccacgauaucgcgcagaaaauauaauguuucuugaguuggacgugucgccgcccgccguuuucgagauggaguucagccaugaccaggagcaggauccucgggcucugcacauggaaagacucaugaggcuggacuccuuuuuagagcguccaucaacuuccaaagugcgcaagucucggagcuggugucaaaguccccagagaccuccacccucaaccacacaugccagccuggcaucugcgucccuuaggccggccaccguagcugaucacgaauga

SEQ ID NO: 58121 - RNA, 3699 nt, Artificial Sequence
  derived and/or modified sequence opt3 from KIF4A__Homo_sapiens__XP_011529195
augaaggaggaagugaaaggcauccccgucagaguugcccugaggugccggccucucgugccaaaggagauuagcgaagggugucagaugugccuuuccuucguaccgggagagccccaaguggucguggguaccgacaaaucuuuuacauacgauuucguuuuugacccuucaacugaacaggaggagguguucaacacggcugucgcaccacugauaaagggcguguuuaaaggguauaaugccaccguauuggcguacggacagacaggcagugguaagacuuauagcaugggaggggcuuacaccgccgaacaggagaacgaacccacaguuggcgugaucccucgcgucauucaauuacuguucaaggagaucgauaaaaaguccgacuuugaguucacccuaaaagugucuuaucucgaaauuuacaaugaggaaauccuggaucuucuguguccaucgcgagagaaggcacagauaaacauccgugaagaccccaaagagggcauuaagaucgugggguugacugagaagacaguccucguugcccuggauaccgugucaugccuggaacagggaaauaacagcagaacgguagcuaguacugcaaugaacucccagucuagcaggucccacgccauuuuuaccaucucacucgagcaacggaaaaagagugacaaaaauagcucuuuccgcuccaaguuacaucugguggaucuugcugguucagaaagacagaaaaagacaaaagccgagggcgacagguugaaggaagggauaaauauuaaccggggacugcuaugucucggcaaugucaucagcgcgcugggugaugacaagaaagggggauuugugccuuaucgcgauaguaaacuuacucgacuguugcaggacucucucggcggcaacucccacacccugaugauugcaugcguuagcccagccgacucgaauuuagaggagacacugaacacccucagauacgcugauagggcccggaaaaucaagaauaaaccgaucgugaacauugacccccagacggcagaacuuaaccaucugaagcaacagguccagcaacuucaggugcuacugcuccaggcucacgggggaacucugccugguucuauaacaguagagccauccgaaaaucuucagucacugauggagaagaaccaaaguuugguugaagagaaugagaaacucagccguggccuguccgaagccgcggggcagaccgcccagauguuagagcgcaucauucugacugaacaggcaaacgagaagaugaaugcuaaacuagaggaacucagacaacaugccgcuuguaagcuggaucuucagaaauugguggagacacuggaagaccaggagcucaaggaaaacgucgagaucauaugcaaucugcagcaacuuauuacccagcugucugaugagacgguggccuguauggcagccgcuaucgacaccgcggucgaacaggaggcacagguggaaacaagccccgagacuucaaggaguuccgaugccuucaccacacaacacgcuuugcggcaggcccagaugagcaaggaacucguugagcugaacaaagcauuagcccugaaggaggcucuagcccgaaaaaugacucaaaaugacucucagcuccagccuauccaguaccaauaucaggauaacauuaaggaacuggagcuugaagugaucaauuugcagaaagagaaggaagaacugguacucgagcugcagaccgcaaagaaagacgcgaaccaagcuaaguuaucagaacgcagaaggaaacggcugcaggagcuugaaggacagauugccgauuugaagaaaaagcucaaugagcagaguaaacugcuaaagcugaaggagagcacagaacgcaccgucuccaaacucaaccaagagauaagaaugaugaagaaucagagggugcagcugaugcgucaaaugaaagaagacgcagagaaguuucggcaguggaaacagaagaaggacaaagaaguuauccagcuuaaggagcgagauagaaaaaggcaauacgaguugcugaaguuagaacgcaacuuccagaaacagucuaacgugcuccggagaaagacugaggaagccgcugccgcaaauaagaggcugaaagacgcuuugcagaagcaacgcgaggucgccgauaaacgaaaggaaacgcagucgcggggcauggaggguacagcggcccgugugaaaaacuggcuggggaaugagauugaaguaauggugagcaccgaggaagcuaagagacacuugaacgaccuccuggaggauaggaagauccuagcacaggacguugcccagcugaaagaaaagaaagaguccggcgagaauccacccccgaagcuccgccggagaacuuucucacugaccgaagucaggggacaagugagugagucugaagauagcaucacaaaacagauugagucccuugagaccgaaauggaguuucgaucagcucagauagccgacuugcagcaaaagcuguuagaugcagaaagcgaggaccgcccuaaacagcggugggaaaacaucgcgacuauucucgaggccaagugcgcucugaaguaucuuaucggcgagcuggugucuuccaaaauucaggucaguaagcuagaaagcucucucaaacaauccaagacaucaugugccgauaugcagaaaaugcuguucgaggaaagaaaucauuuugcagagaucgaaacggaguugcaggcugagcugguuaggauggaacagcaacaccaggagaagguguuauaccuccugagucagcuucagcaaagccagauggccgaaaagcagcuggaggaaucgguguccgagaaagagcagcaauugcucucuacccugaagugccaggacgaggagcuagaaaagaugcgugagguaugcgagcagaaccaacagcugcuucgcgaaaaugagauaaucaagcagaaacucacucuguugcaggucgcaagccggcaaaagcaucugcccaaggauacauuacucucaccagacaguuccuucgaauaugugccucccaaaccaaagcccucuagaguuaaagagaaguuucuggaacagagcauggacauugaggaucuuaaauacuguuccgagcacucagugaacgaacacgaggacggggauggagacgaugacgaaggugaugacgaggaauggaagccuaccaagcuggucaaagugagcaggaagaauauccagggcugcaguuguaaaggguggugcggaaacaagcaguguggcugccgaaaacaaaagucugauugugguguugacugcuguugcgauccaacaaagugucggaaucgccagcaggggaaagacuccuugggcacuguggagagaacccaggauagcgagggaucguucaagcucgaagacccgacggagguaacccccggccugucauuuuucaacccugucugcgccacaccaaauucuaaaauucuaaaggaaaugugcgacguggagcaagugcugaguaaaaagacucccccugcuccaucccccuuugaucuuccggaacucaaacaugucgcgaccgaguaucaggagaacaaggccccugggaagaaaaagaaaagggcacuggcuagcaacacaucuuucuuuagcggauguuccccaaucgaagaggaagcccacuga

SEQ ID NO: 58122 - RNA, 3705 nt, Artificial Sequence
  derived and/or modified sequence opt3 from KIF4B__Homo_sapiens__NP_001092763
augaaggaggaagugaaaggcauccccgucagaguugcccugaggugccggccucucgugccaaaggagauuagcgaagggugucagaugugccuuuccuucguaccgggagagacccaaguggucguggguacagacaaaucuuuuacuuacgauuucguuuuugaccccuguacggaacaggaggagguguucaacaaggcugucgcaccucugauaaaaggcaucuuuaagggguauaaugccaccguguuggcguacggacagacaggcucagguaagacuuauaguaugggaggggcuuacaccgccgaacaggagaacgaaccaacaguaggcauuaucccccgcguuauucaauuacuguucaaagagaucgauaagaaaagcgacuuugaguucacccuaaagguguccuaucucgaaauauacaaugaggaaauccuggaucuucugugcccuucucgagagaaagcacagauuaacauccgugaagacccaaaggagggcauuaagaucgucggguugacugagaaaacagugcucguggcccuggauaccgucucgugucuggaacagggaaauaacucaagaacgguugcuagcacugcaaugaauagucaguccucuaggagccacgccauauuuaccauuuccaucgagcaacggaagaaaucagacaagaacugcaguuuccgcagcaaacuccauuuaguggaucuggcugguucugaaagacagaagaaaacaaaggccgagggcgacaggcuuaaggaagggauuaauaucaaccggggauugcugugucuaggcaauguaaucuccgcgcucggugaugacaaaaaggggucauuugugcccuaucgcgauagcaaacugacucgacuucugcaggacaguuugggaggcaacucucacacccucaugauugcaugcgucuccccugccgacagcaaucuggaggagacauuaucgacccugagauacgcugauagggcccggaagauaaagaacaagccaaucgugaauauugacccgcauacggcagaacucaaccaccuuaagcagcaaguucagcagcugcaaguguugcuacugcaggcucauggcgggacucuccccggaucuaucaacgccgagccuuccgaaaaucugcagucacuuauggagaaaaaccagagucuggucgaagagaaugagaaguugagccguugucucuccaaagcggccggucaaacagcacagaugcuggaacgcauaauuuuaaccgaacaggugaacgaaaagcugaaugcuaaacuagaggagcucagacagcacguagccugcaagcuggaucuucaaaaguugguugaaacucuggaggaccaggaacucaaagagaacguggaaaucaucuguaaucugcagcagcuuauuacacaacugucugaugagaccgucgcuugcacggccgcagccaucgacaccgcuguggaggaagaggcgcaggucgaaacaagcccagagacuucaaggaguuccgaugcauucaccacacagcacgccuugcaucaggcucaaaugagcaaggaagugguugagcucaacaaugcccuggcauuaaaagaggcccuggugcggaagaugacucagaacgacaaucagcuacaacccauucaguuucaguaccaggauaacauaaagaaucucgaacuggagguaaucaaccuucaaaaggaaaaggaggaauugguccgagagcugcagaccgcuaaaaagaaugugaaccaggccaaacucucugagcaccgccauaagcuguuacaggaacuggagggccaaauugcagaccuuaaaaagaaauugaacgaacagucaaagcuccugaagcuaaaagagaguacagagagaaccguuagcaagcugaaucaggaaaucuggaugaugaaaaaccagagggugcaacucaugcggcagaugaaggaggaugcggaaaaauuccgccaguggaagcaaaagaaagacaaggaggucauccagcugaaagaaagagacaggaagcgucaguaugagcuuuugaaacuggagcggaauuuccagaagcaauccucuguguuacgaagaaagacugaagaggcugccgcagccaacaaaaggcucaaggaugcucugcagaaacagcgcgaaguaacggacaagcggaaagagacacagucgcacgggaaggaaggaauugccgcaagagugaggaauuggcuuggcaacgagauagagguuauggucagcaccgaagaggcuaagcgccaccugaaugauuugcucgaagaccgaaaaauccuggcccaagauguggugcagcuaaaggagaaaaaggaaucccgggagaacccuccacccaaacugcguaagugcacuuuuucacucagugagguccauggucagguucuggaaucugaggacuguauuaccaaacagaucgaaagccuugagacagagauggaauugagauccgcgcaaauugccgaucugcagcagaaguuacucgacgcugagucagaagauaggccgaagcagugcugggagaauaucgcaaccauacuggaagccaaaugugcucuuaaguaccugaucggggagcuagugagcucuaaaauucacgugacuaagcucgagaacucccugcgccaaaguaaagccagcugcgcagacaugcagaagauguuguucgaggagcagaaucauuuuucugaaaucgagacagaacugcaagcggaguuaguacggauggagcagcagcaccaggaaaagguccucuaucuggugucccaacuucaggagucacagauggccgaaaaacagcuggagaagagugcuagcgaaaaagagcaacaguugguuucgacgcuccagugucaggaugaggaacuggagaagaugagagaagugugcgagcaaaaccagcagcuacugcaagagaaugaaauuaucaaacagaaacuuauacuccugcaggucgccuccaggcagaagcauuugccuaacgacacccuguuaucucccgauagcucauucgaguacauuccaccuaaacccaagccaagucgagugaaagaaaaguuucucgagcaauccauggacaucgaagaccugaaauauuguucugagcacagcguuaaugagcacgaagauggcgacggagauggcgacuccgaugagggggacgaugaagaguggaagcccacuaaacuugugaaaguaucacgcaagaacauucagggaugcagcuguaaagguuggugcggcaacaagcagugugggugccggaaacagaagagugacugcggagucgauuguucuugcgacccuacaaaguguagaaauaggcaacagggcaaagauucccuggguaccguggaacagacacaggacagcgaggggucguucaaguuggaggauccaacugaagugaccccgggccucucauuuuucaaccccgucugcgcaacgccuaauucuaaaauccugaaggagaugugugacauggaacaaguucuaaguaaaaagaccgcuccagcccccuccccuuuugaccugccagagagcaaacauggagcaacagaauaccagcagaacaagcccccgggcaagaaaaagaaacgugcccuugcuucuaauacuagcuucuuuuccgggugcucaccuauagaggaggaagcgcacuga

SEQ ID NO: 58123 - RNA, 3099 nt, Artificial Sequence
  derived and/or modified sequence opt3 from KIF5A__Homo_sapiens__NP_004975
auggccgagaccaacaaugaaugcagcaucaaggugcuguguagauucaggccccucaaccaggcugagauucuucggggcgacaaauuuauaccuaucuuccaaggggaugacuccgucguuauuggagguaagccauacguguuugaucgcguauucccgcccaauacaacucaggaacagguguaucacgcaugcgccaugcagaucgucaaagacgugcuggcgggcuacaacgggacgauuuuugcuuauggacaaaccucuucaggcaagacacauacuauggaggguaaauugcacgauccucaguuaauggggaucauaccacgaaucgcccgugacauuuucaaucauaucuacaguauggaugaaaaccuggaguuucacauuaagguuagcuauuucgagaucuaccuagacaagauaagagaucuccuggacgugaccaaaacaaaucuuuccguccaugaagauaagaacagggugcccuuuguaaaaggauguaccgagcgguucguuucuucgccugaagagauucuggacgugaucgaugagggcaagucaaaucgccacgucgcagugacuaacaugaaugaacacagcaguagaucccauucuauuuucuugaucaacaucaaacaggagaauauggaaacagagcagaagcucagcggcaagcuguaucugguggaccucgccggguccgaaaaagucucaaagaccggagcugagggugcaguuuuagacgaggccaaaaacauuaauaagagucugagcgcucuuggcaacgugauaucugccuuggcggaagggacgaaauccuacguaccauacagggauucaaagaugacucggauccugcaagacagccuaggaggcaacugccgcaccacaauguucauuuguugcagucccucuuccuauaaugaugcagagacuaaaagcacccucauguuuggucagcgagccaagacaaucaagaacaccgcuucggugaaucuggaacuuacggccgagcaguggaaaaagaaauacgaaaaggagaaagagaagacuaaggcacagaaagaaacaauagcuaagcuggaggccgaauugucuagauggaggaacggggagaaugucccugaaaccgagcggcucgcgggagaggaagccgcacugggcgcugaguuaugugaagagacuccagugaacgacaauuccucaauuguugugcguaucgccccggaggaacgccaaaaauaugaggaagagaucagaaggcuguacaagcagcucgaugacaaagaugacgaaauuaaccagcaaagucagcuuaucgagaagcugaagcagcagauguuggaucaagaggaacuacuggucagcacacggggcgacaaugagaaagugcagcgagaacucucccaucugcagucugagaacgaugcugccaaggacgaaguaaaagagguucuucaggcacuggaggaauuggccgugaauuaugaccaaaagagccaggaggucgaagagaaaucacagcagaaccaacuccugguggaugaauuaagucagaaggucgcuaccaugcugucccuagagagcgagcuccagcgccugcaggaagugucugggcaccaaagaaagaggauugcggagguucuuaauggauugaugaaagaccugucagaauuuagugugauaguagguaacggcgagaucaagcuccccgucgagauuagcggggcaaucgaagaggaguucacgguggcccggcuguacaucuccaaaauuaagucugaaguuaaaucgguggucaagcgcugcagacagcuugaaaaucuucagguggagugucacaggaaaauggagguaaccggacgugaauugagcuccugccaacuccugauaucacagcacgaggcuaagauccggaguuuaacagaauauaugcagucuguggagcugaagaaacgacaucuagaagagagcuacgauucccucucagacgagcuggccaagcugcaggcacaagaaacuguucacgaggucgccuugaaagauaaggaaccugacacccaggaugcugacgaggugaaaaaggcccuggaacuccagauggagagccauagagaggcacaccauaggcagcuggcgcgcuuacgggaugaaauuaacgagaagcaaaagacaaucgacgaacugaaggaucuuaaccagaaauugcagcucgagcuggagaagcuacaggcugacuacgaaaaacugaagucugaggaacacgagaaguccacuaaacuccaagaacugaccuuucuuuaugagagacacgagcagaguaagcaggauuugaaaggccuggaagagacaguggccagggaauuacaaacccuccauaaucugcgcaaacuuuucguccaggacguuacuacgcgagugaaaaagagcgcagagauggaaccagaggacucuggugggauucacucccagaagcagaaaaucucauuucuggagaacaauuuggaacaacucacaaaggugcauaaacagcugguacgggauaacgccgaccuacguugugagcugcccaagcucgagaaaagacugagggcuaccgccgaacgcgucaaggcacuugaaggcgcuuugaaagaggccaaggagggagcgaugaaggauaaacggagauaccagcaggaaguggacaggauaaaggaggccguucgauauaaaaguagcggcaagcgcgggcacucggcucaaaucgcaaaaccugugcggccaggacacuaccccgccuccucuccgacuaauccuuaugguaccagaagccccgaaugcauuucauacacaaacagucuguuccagaauuaucagaacuuauaccuccaggcuaccccauccucuacuagcgauauguacuuugccaauuccugcacaucaagcggcgcaacgaguucugggggaccucuggcguccuaucaaaaggccaacauggacaauggcaacgcuaccgauaucaaugacaacaggagcgaucuucccugugguuacgaggccgaggaccaggcaaagcuguucccacuacaucaggaaacugcugccucguga

SEQ ID NO: 58124 - RNA, 2892 nt, Artificial Sequence
  derived and/or modified sequence opt3 from KIF5B__Homo_sapiens__NP_004512
auggccgaccuggcugagugcaacaucaaggugauguguagauucaggccccucaaugaaagcgaggucaaccggggcgauaaauacauugcaaaguuucagggggaagacaccguugugauagccuccaaaccuuaugcguucgaucgcguauuucaaucuucaacaagucaggaacagguguacaaugacugcgcuaagaaaaucgucaaggaugugcuugaaggauauaacgguacuauuuucgccuacggccagacgagcuccgggaagacccacacaauggagggaaaacugcaugacccagagggcauggguaucauuccgcgaaucguucaagauauauuuaauuauaucuacucuauggacgaaaacuuggaguuccacauuaaggugucguauuuugaaaucuacuuagauaaaauucgugaccugcuagaugucucaaagacuaaucucagcgugcaugaggacaaaaacagaguacccuacguuaagggguguaccgagagguucgugugcaguccugaugaagucauggacacaaucgacgagggaaaguccaaucggcacguggcagugaccaacaugaaugaacauucuagccgcucccacucaauauuucugauuaacgucaaacaggagaauacucagacagaacagaaacuuaguggcaaacuguauuugguugaucucgccggcagcgagaaggugucuaaaaccggggcugagggagcaguacuggacgaagccaagaacaucaauaaaucccugucagcucucgguaacgugauuagcgccuuagcggagggcaguacguacgucccauauagagauucuaagaugacuaggauccugcaagacucccuugggggaaacugucggaccacaaucgugauuugcuguagccccucgucuuacaaugaauccgagacuaagucaaccuugcuguucggccagcgcgcaaaaacaauaaagaacaccguuugcgugaaugucgaacuaacggccgagcaguggaaaaagaaauaugagaaggaaaaggagaaaaacaagauccuccgaaauacuauucaguggcuggaaaacgagcuuaauagauggaggaacggugaaacagugccuaucgaugagcaauuugacaaagagaaggcuaaucuggaagccuucaccguagauaaagacauaacuuugacaaacgauaagccagcaaccgcuauugggguuaucggaaauuuuacggacgccgagcggcguaagugugaagaggagaucgcgaaacucuacaagcagcuggaugacaaagacgaagagauuaaccagcaaagucaguuaguggaaaagcugaaaacccagaugcucgaucaggaggaacuucuggccagcacacgcagagaccaagauaauaugcaggcagaguugaacaggcuacaggcugagaaugacgccuccaaggaagaggucaaggaagugcugcaggcucucgaggaacuggccgucaacuaugaucaaaaaucucaggagguggaggacaagacuaaagaauacgagcuucugagcgaugaauugaaccagaagucagcaacccucgccaguaucgacgcugagcugcagaaauuaaaggaaaugacaaaucaccaaaagaagcgggcggcagagaugauggccucccugcuaaaggaucucgcugagauuggcauagccguuggcaacaaugacgugaaacagcccgaagggacuggaaugaucgaugaggaguucaccguagcacgacuguacauuagcaagaugaaaucugaggucaagacaauggugaaacgcugcaagcagcuugagucaacccagacugaaaguaacaagaaaauggaggaaaaugagaaggaauuggccgcuugucaacugagaaucagccagcaugaggccaaaaucaagucccucacggaguaucugcagaacguugaacagaaaaagaggcaacuugaggaaucuguggacgcacugucggaggaauugguccagcuccgggcgcaggagaaggugcacgagauggaaaaagagcaucugaauaagguacaaacagcuaacgaagugaaacaggccguugagcagcagauucaaagccaccgcgaaacccaccagaagcagauauccucauuaagagaugaggucgaggcaaaagccaagcugaucacugaccuacaggaccaaaaucagaagaugaugcucgaacaggagaggcugcguguggaacaugagaaacuuaaggcuaccgaucaagagaaaagucggaaguugcacgaacugacagugaugcaggaccgaagagagcaggccaggcaggaucucaaaggucuggaagagaccgucgcaaaggaauuacaaacucugcauaaccuucgcaaauuguucguucaggaccucgcuacacgggugaagaagucugccgagauugauagcgacgauacgggcggguccgcggcccagaaacagaagaucucauuucuggagaauaaccuagaacaacugaccaaagugcacaagcagcucguaagagacaaugcugaucugaggugcgagcuuccuaaauuggaaaagcgccugcgagcaacugccgagcgggucaaggcuuuagaaagcgcccucaaagaggcaaaggagaacgcgucucgugacagaaaaagguaccagcaggaaguggaucgcauuaaggaggccguucgguccaaaaauauggcuagaaggggacauagugcccaaaucgcaaagccaauacgaccgggccagcaccccgcugccagcccuacacacccaucugcaauccgcggugggggcgccuucgugcagaacucccagcccgucgcugugcggggaggcgggggaaagcaaguuuga

SEQ ID NO: 58125 - RNA, 2874 nt, Artificial Sequence
  derived and/or modified sequence opt3 from KIF5C__Homo_sapiens__NP_004513
auggccgaccccgcugagugcagcaucaaggugauguguagguucaggccucugaacgaagcagagauucuccggggcgauaaauuuauaccaaaguucaaaggggacgaaaccgucguuaucggacaggguaagccguacguguuugaucgcguacuucccccuaauacaacucaagaacagguguauaacgccugcgcgaaacagauugucaaggacgugcuggaaggcuacaaugggacgaucuucgcuuauggacagaccuccucuggcaagacacacacuauggaggguaaauugcaugauccacaauuaauggggauuaucccccgaauagcccacgacaucuuugaucauauuuacucaauggacgagaaccuggaguuccacaucaagguuaguuauuuugagauuuaccuagauaaaauccgugaccuccuggaugugagcaagaccaaucuugcaguccaugaagacaaaaacagagugccuuauguaaagggauguacagagagguucguuuccucuccagaggaagugauggaugucauagacgagggcaaggccaaucggcacguggcugugaccaacaugaaugaacacucgucacgcagccauaguauuuuucugaucaacauuaaacaggagaaugucgaaacugagaagaaauuguccggcaagcucuaccugguugaccuggcagggucugagaaagugagcaagacaggagccgaaggugcuguacucgaugaggccaaaaacaucaauaaguccuuaucagcgcugggcaacgugaucagugcacuugccgaagggaccaagacgcacguccccuacagagacagcaaaaugacuaggauuuugcaggauucucugggaggcaauugccggaccacaauagugaucuguugcuccccuucaguuuucaacgaggcugaaacuaagagcacccuaauguuuggucagcgcgccaaaacaauuaagaacaccgugagugucaaucucgagcugacggcagaggaauggaaaaagaaguaugagaaagaaaaggagaaaaacaagacucuuaaaaaugugauccaacaucuggaaauggaguugaaccgauggagaaauggggaggcuguaccagaagacgagcagauaucugccaaggaucagaagaaccucgaaccgugugacaauacacccauuaucgauaacaucgcgccuguuguggccggaauuuccaccgaggagaaagaaaaguacgacgaggaaaucagcucgcuguauaggcaguuagaugacaaagaugacgagauuaaucaacagucucagcuggcagaaaagcucaaacaacagaugcuugaccaggaugagcuguuggcuuccacucggcgugacuacgagaagauacaggaggaacuaacacgccugcaaaucgaaaacgaggccgcuaaggaugaagucaaagaggugcuccaggcccuggaggaacuugcagucaauuaugaccagaagucacaggagguggaagauaaaaccagagccaacgagcaacugacggacgaauuggcucagaagaccacaacucucaccacaacucagagggagcugagucaguuacaagagcugagcaaucaccagaaaaagcgggcgaccgaaauucuaaaccuccugcuuaaagauuugggcgagaucggcgggaucauuggaacaaaugacguuaagacccuggcagaugugaacgguguaauagaagaggaguucacuauggcccgacucuacaucuccaagaugaaaucugaagucaagagccuggugaaccgcucaaaacagcuugagagugcucagauggacuccaauagaaagaugaacgccagcgaaagggagcuggcagccugccaauugcucauuucucagcacgaagcuaaaaucaagucacugacggauuauaugcagaauauggagcaaaagcggcgccaguuagaggaaagucaggacagccuguccgaggaacuagccaaacucagagcacaggagaagaugcaugaaguuucuuuucaagauaaagagaaggagcaccugacaaggcuucaggacgcggaagagaugaaaaaggcuuuggaacagcagauggagucgcaucgugaagcccaccaaaagcagcugagccggcuccgagacgagauugaggaaaaacagaagaucauagaugagaucagagaccugaaccagaaauuacaacuggaacaggagaaacuuuccucagauuacaauaaguugaagauugaggaccaggaaagggagaugaagcucgaaaaacugcuacugcucaacgauaagcgcgagcaagcacgggaagaccugaaaggccuugaggagaccgugaguagagaauugcagacucugcauaauuuaaggaaacucuucguccaggaucugaccacacgcgugaagaagucuguagagcuugacaacgaugacgggggaggcagcgccgcucagaaacaaaagaucuccuuccuggaaaauaacuuggagcagcucaccaaggugcacaaacagcugguucgagauaaugccgaccuacggugugaacugccaaagcucgagaaacgucugagagcaacugcugagagggucaaggcccuugaaucagcguugaaagaggccaaggaaaacgcuaugcgcgaucggaagagauaccagcaagagguggacaggauuaaagaagcagugcgagccaagaauauggcucgccgggcccacagcgcacagaucgcgaaacccauaagaccuggucauuauccagccucuucccccacagcuguccacgccauuagagggggcggaggcaguagcucuaacuccacgcauuaccagaaguga

SEQ ID NO: 58126 - RNA, 2394 nt, Artificial Sequence
  derived and/or modified sequence opt3 from KIF6__Homo_sapiens__NP_001275949
auggugaagcagaccauccaaauuuucgccagagucaaacccccuguuaggaagcaccagcagggcauauacagcaucgacgaggaugaaaaacugauuccaucccucgagaucauucuuccgcgggaccuggcugauggguuugugaacaauaagcgcgaaucuuauaaauucaaguuucagcgaaucuucgaccaagaugcaaaccaggagacaguauuugaaaauauagccaagcccguggcgggaucagucuuggcugguuacaacggcacuaucuucgccuaugggcagacgggaaguggcaaaaccuuuacaauuacugguggggcagagcguuacagcgacagaggaaucauuccuaggaccuuauccuauaucuucgagcagcugcaaaaggauucuucgaaaauauacacaacccauauuucauaucuagaaaucuacaaugagugcggcuacgaccuccuggauccacggcacgaagccagcagucuugaggaccugcccaaggugacuauuuuggaggauccugaccagaacauccaucucaaaaaucugacacugcaccaggcuaccacggaagaggaagcacucaacuuacuguuucuuggcgauacuaaucgcaugaucgccgagaccccaaugaaccaggcuuccacaagaucucauuguauuuucacuauacacuugagcuccaaggaacccgggucagccaccguuaggcacgcgaagcugcaucuaguggaccucgcaggaagugagcgggucgccaaaacaggugugggcgggcaucugcuuaccgaggcuaaguauaucaaucugagcuugcacuaccucgaacaaguaauuaucgcccugucugagaaacaccgcucccacauaccuuaucgaaacucaaugaugacgagcguuuuaagagacagucugggaggcaauugcaugacuacaaugauugcaacccucucucuugaaaagaggaaccuggaugaguccaucagcacuugucgguuugcucagcguguggccuugaucaaaaaugaagcgguccuaaacgaggagauuaacccacgccuggugaucaagagacuccagaaagaaauucaagagcugaaggacgaacuugccauggugacaggugagcagaggaccgaagcacugacggaggcugaguugcuccagcuggaaaaguuaauaaccucguuccuggaggaucaggacucugauucccggcuagaagucggggccgacaugcgaaaaguucaucacugcuuucaucaccucaagaaacugcuuaaugauaagaaaaucuuggagaacaauacagugucaagugagagcaaggaccaagauugucaggaaccgcugaaggaggaagaguaccgcaaacucagagacauucugaagcagagggauaacgaaaucaauauccuuguaaacaugcugaaaaaggagaaaaagaaggcucaggaggccuugcaucucgcaggaauggaccggcgcgaguucagacaaucccagucucccccuuucaggcugggcaauccagaagaaggccagcguaugcgguuaagcucagcccccagucaggcucaagacuuuuccauucuggggaaacgaagcucucuacuccacaagaaaauaggaaugagagaggaaaugucacuggguugccaggaggcguucgagaucuuuaagagggaucacgcagacagugugacuauugaugacaacaaacagauccuuaagcagcgcuucagcgaagccaaggcuuugggcgaguccauuaaugaagcccggucuaaaaucgggauaucggagaacauggcagucccucugaugccagaucaacaggaagagaagcucagaagccagcuggaggaagagaaaaggcgcuauaagaccauguuuacacgauuaaaagcccugaagguggaaaucgagcaucuucaauugcucauggacaaagcuaagguuaagcugcagaaagaguucgaaguguggugggccgaggaagcaacuaaucuacaggucaacucccccgcgguaaauucacuggaucacaccaagccguuucuccagacaagugacucucaacaugaguggagccagcugcuuuccaacaaaucaagcggaggcugggaagugcaggaucaggguaccgggcgguucgacguuugugaugugaaugcucguaagauuuugccuucucccugcccauccccucacagucaaaaacagagcucuacuuccacgccccuggaggacucaaucccaaagagacccgucaguagcauuccuuuaacaggcgauucgcagaccgacuccgacaucauagccuuuauuaaggcaaggcagucuauccuccaaaaacagugucugggaagcaacuga

SEQ ID NO: 58127 - RNA, 4032 nt, Artificial Sequence
  derived and/or modified sequence opt3 from KIF7__Homo_sapiens__XP_005254959
augggccuggaggcccagagacuccccggggcugaagaggcaccugugagggucgcccuucggguucgcccacuguugccgaaggaauuacugcacggacaucaaagcugccuacagguggagcccggucucggccgaguaacccuggggcgugacagacacuucggauuucaugugguccuugcggaagaugcuggccaggaggccguguaccaggcauguguucaaccucuguuggaggccuucuuugaagguuucaacgcuacaguguuugcauaugggcagacuggauccggcaaaacguacaccaugggcgaggccucugucgcuucacuccuggaagacgagcaggggaucgugccaagggccauggcggaggcauucaagcugauugaugaaaaugaccucuuagauugccugguacacguuaguuaucuugagguguacaaagaagaguuucgggacuugcuggaagucggaacagccagccgcgauauacagcuaagagaggacgagagggguaacguggugcucuguggcgucaaggaaguugauguggaggggcuggacgaaguacuuucccuguuggagaugggaaaugcugcccggcauacuggcgcaacccaccucaaccaccugucuucgcgcucacauacaguguucaccgucacuuuagaacaacgagguagagcucccagcaggcugccucggccagcccccgggcagcuccuugugaguaaauuucacuucguugaucuggcgggauccgagcguguguugaagacaggcucuaccggcgagcgccuaaaggaaagcauccagauuaauuccucacugcucgcccuggggaacgucaucagugcacuuggagacccucagagaagggguagccauauuccauaucgggauucuaaaaucacgcgaauacugaaggacuccuugggcgggaaugcuaaaacugugaugaucgccugcguaucaccgagcaguucugacuuugaugagacccucaacacacugaauuacgcuucccgcgcccaaaacauuagaaauagggcaacuguuaacuggcggcccgaagccgagcgcccuccagaagagaccgcuagcggagcgagagggcccccuaggcaccguucggagacacggaucauucaccgagguagaagggcaccagggcccgccaccgcuucugccgcagccgcuaugcgcuuaggcgccgaaugugcacgguauagagcgugcacggacgcugccuacucccugcuaagggagcuccaggcagaaccgggacugccuggcgccgcugcccgcaaggugcgagauuggcuuugugcagucgagggggagcggucagcuuugaguagcgccuccggacccgacucugguaucgaaagcgcgucaguggaggaucaggccgcucaaggcgcagggggacguaaagaagacgagggcgcccagcagcugcucacucugcagaaucaagucgcuagacuugaagaggagaacagggauuuccuggccgcauuggaagacgcgauggagcaguacaagcuccagagugaucgccugcgggaacagcaagaggaaaugguggaguuaagacugaggcuagagcucguucgaccagguuggggcggcccucgccugcuuaauggauugcccccaggcuccuuugugccccggccucauacagccccacucgggggagcucacgcccauguacuggguauggucccgcccgcaugccugccuggcgacgaaguggggagcgagcagagaggagaacagguuaccaacggcagggaggcuggugccgaauuacugacugaggugaaccgucuugggucuggcucaagugcagccagcgaggaagaggaagaggaggaagaaccaccccgccggacauugcaccucagaaggaaucgaauauccaacuguucucagcgggcuggagcgcgcccuggcucgcugccagaaagaaaggggcccgagcuaugccuggaggagcucgaugccgcaauuccgggaagcagggcugucggcgguuccaaagcccgggugcaagcccgacagguaccuccagcuaccgcaucagaguggagacuggcccaggcgcagcaaaagauccgcgaacuugcuauuaauaucaggaugaaagaggaauugaucggggagcuggugcguacgggaaaggccgcacaggccuuaaaccggcagcauagucaaagaauuagggaacucgagcaggaggcugaacagguucgcgcagagcugucugaaggccagcgacaacuuagagagcuggaagguaaagaguugcaggacgccggcgagcggagcaggcuccaggaauuucgccguagagucgcggcugcccagucccaaguccaggugcugaaggagaaaaagcaggcaaccgaacggcuagugucacugagcgcccagucugagaagaggcuccaagagcuggaacgcaauguucagcuuaugcgacagcaacaggggcaguugcagagacggcugagggaggaaacagagcaaaaacgcagauuagaagcugagauguccaagaggcagcaccgggugaaagagcucgaacugaagcacgagcagcagcagaaaauacuuaagaucaagacugaagagauugccgcauuccaacguaaacgccgaaguggaagcaacggcucugugguaucccuggaacagcagcaaaagaucgaggagcagaaaaaguggcuagaccaggaaauggagaaaguccuccagcaaagaagggcucuggaagaguugggggaggaacugcauaagcgggaggccauauuagcgaagaaagaagcccucaugcaggagaagaccggacuggaaucaaaacgccuuagaaguagccaggcacugaaugaggauauugugaggguuucgucccgguuggagcaccucgaaaaggagcugucugagaaaagcggccaacuacgacaggguucagcucagagucagcaacagaucagaggggaaaucgacucccugcgccaggaaaaggauucucuucucaagcagaggcuggagauugacggaaaauugcggcaaggcagccuguuaucccccgaggaggaacguacacucuuccagcuggaugaagccaucgaggcucuugacgcagccauugaauauaagaacgaggccauaacuuguagacagagggugcugcgcgcuucagcgagcuugcucagucagugcgagaugaaucugauggcaaaacuaucuuaccuguccagcucggaaacccgggcccuucucugcaaguauuucgauaaagucgugacacugcgagaggaacaacaucagcagcaaaucgcuuuuucagaguuggaaaugcaguuagaggagcagcagagacugguuuacuggcucgaaguggcccuggagaggcaacgccuugaaauggaccggcagcugaccuugcagcagaaggagcacgagcaaaacaugcagcuacugcuccagcagucuagagaucaccugggugaaggccuugcagacagucguaggcaauaugaggcccggauucaggcuuuagaaaaagagcuggggcgcuacauguggaucaaucaggaacucaagcagaaguugggaggcguaaacgcggucgggcauucccgaggaggcgagaaaagaagccuguguucugaggguaggcaagccccugggaaugaagaugagcuccaccuggcacccgaacuucugugguugagcccacuaacugagggagcuccucggacgcgcgaagagacaagagaccuggugcaugcaccccucccauuaaccuggaagagguccucacugugcggcgaggaacaggguaguccggaggaacuucgacagcgggaggccgccgaaccucuggugggccguguccuccccguuggggaggcuggauugccauggaacuucggcccccugagcaaaccuagacgcgagcucaggcgggccucuccagggaugaucgaugugagaaagaauccccuguga

SEQ ID NO: 58128 - RNA, 2373 nt, Artificial Sequence
  derived and/or modified sequence opt3 from KIF9__Homo_sapiens__NP_001128350
augggcaccagaaagaaagugcacgccuucgucaggguuaagcccacagacgauuuugcucaugagaugauccgguacggggacgauaaacgcagcauugacauacaccugaagaaagauauccgacguggagugguaaacaaucagcaaacugacugguccuucaagcucgauggugugcuucaugacgcaucucaggaucuggucuaugaaacgguggccaaggacguugugucacaggcguuggauggcuacaacgggaccauuaugugcuauggacagacaggcgcugguaaaacuuacaccaugaugggggccacagagaauuauaagcacagaggaaucuuaccuagggcacugcaacaggucuuucggaugauugaagaacgcccaacccaugccaucacugugagaguaaguuaccuagaaauauauaacgagagccucuucgaccugcuuuccacacugccguacguuggccccucugugaccccuaugacgaucgucgagaauccacagggcguguuuauuaaaggguugucggugcaccucacuucacaggaagaggaugcuuucagccugcuguuugaaggagagaccaacaggaucauugcaagucacacaaugaauaagaacuccucucggagccauuguaucuucacuauauaccucgaggcccacucccgcaccuuaucagaagagaaauauauuacaaguaagaucaaucuggucgaccuugcugguagcgaacgauugggcaagucuggguccgagggacaaguucugaaagaagccaccuacauuaacaagucacuuagcuuucucgagcaggcgaucaucgcacugggcgaccagaaaagagaucauauucccuucaggcagugcaagcuaacgcacgcccugaaagacaguuugggugggaauuguaacauggugcucguaacuaauauauauggagaggcugcccaacuggaagagacauuaucuucccugcgguuugcaagccguaugaagcucgugaccacugaaccugcuaucaacgagaaauacgaugccgaacgcauggucaagaaucuugagaaggagcuggcguugcuaaaacaggaacuggccauucacgacucgcucacaaacagaaccuucgugacguaugauccaauggacgagauccagauagcagaaauuaacucucaaguuaggcgguaccuggagggcacccuugaugaaaucgacaucauuucccugcgacagaucaaggagguguuuaaucaguuccgcgucguguugucacagcaagagcaggaaguagagaguacacucagaaggaaauauacucugauugaucggaacgacuucgcugccauaagcgcuauccagaaggccggcuuaguugauguggacgggcaucuggucggagaacccgagggucagaauuuuggccuagggguggcaccuuucuccaccaaaccaggaaagaaggccaaaucuaagaaaacauuuaaggagccgcucagcucacuggcucgcaaagaaggcgcgaguucccccgucaacgguaaggaccuugauuacgugagcacuucuaagacccaauugguuccuucaaguaaagacggggaugugaaggacaugcugagcagagauagggagacauccucuauugaaccacuccccucggacagcccuaaagaggaacugcguccaauccggcccgauaccccgccuuccaagcccguagcauucgaggaguuuaaaaaugaacagggcucagagaucaaccgaauuuucaaggaaaauaagaguauacuuaacgagagaaggaaacgcgccucugaaacuacgcagcacaucaaugcuauuaagcgggagaucgacgucacaaaagaggcccugaacuuucaaaagagcuugagagaaaaacagggaaaguacgagaauaaaggccucaugauuaucgaugaagaggaguuccuguuaauacugaagcuaaaggaccucaaaaagcaguauagguccgaguaccaggaucugcgcgaccuucgagcagagauccaguauugccaacauuugguggaucagugucggcaccgucugcucauggaauuugacauuugguacaacgagucauucguuaucccagaagacaugcagauggcccugaaaccugggggaagcauuagacccgguauggugccagucaauaggaucgugucuuuaggcgaggaugaccaagauaaguuuucccagcugcagcagcgcguacuucccgaggggccugacaguauuagcuucuauaacgcuaaagugaagauagaacaaaagcauaauuacuugaaaaccaugaugggacuccagcaggcccaccggaaguga

SEQ ID NO: 58129 - RNA, 2145 nt, Artificial Sequence
  derived and/or modified sequence opt3 from KIFAP3__Homo_sapiens__NP_001191443
augagcaucgcccugggcaacaccuacagaaggucccucucugacucagagacagugaguguccuucaggcuagccugugcgaagagaagaaagaaaaguccucuaaacccaaggauccuccaccguucgaggggauggaaauugacgagguugcaaauauaaacgauauggacgaguauaucgaauuguuauacgaggauauucccgacaaagugcggggaucggcccugauccuacaacucgcgcgcaauccugauaaccuggaagaacuucuguugaaugagacugcucucggugcccuggcacgaguacugcgugaagacuggaagcagucaguggagcucgccacgaacauuaucuauauauuuuucuguuuuagcaguuucucccaguuucacggcuuaaucacccauuacaagauuggggcucugugcaugaauaucauugaucacgaacuuaaaagacaugaguuguggcaggaggagcugucuaagaaaaagaaagcagucgacgaggauccagaaaaccaaacacuaaggaaggacuaugagaagacuuucaaaaaguaccagggacucgugguuaaacaggaacagcugcuucggguggcccuguauuugcuccugaauuuagcugaggauacccgcacagaacugaagaugagaaacaaaaauaucguccacaugcucgugaaggcccuugacagggacaacuuugagcuguugauacuuguaguuagcuuccugaaaaagcucuccauuuuuauggagaauaagaacgauaugguggaaauggacaucgucgagaaacuggugaagaugauucccugugaacaugaggaucuucugaauaucaccuugcggcuccuguuaaaccugucauucgacacuggccuacgcaacaaaauggugcaagucggucuccugccuaagcuaacagcguugcuggggaaugauaacuacaaacagaucgcaaugugcguucucuaccacauuaguauggacgaucgauuuaagagcauguucgccuauaccgacuguauaccacagcugaugaagaugcuuuuugaaugcucugaugagagaaucgaccuggaguugauuuccuucuguaucaaucucgcugccaacaaaaggaaugugcagcugauaugcgaaggaaacggcuuaaagaugcugaugaaacgggcacuaaaguucaaagauccccuccugaugaagaugauucguaauaucucacaacacgacggcccuacgaagaaccuuuuuaucgacuacguaggggauuuggcugcccagauuagcaaugacgaggaagaggaguucgugaucgaaugucugggaacucucgcgaaccugaccauuccagauuuagacugggagcugguccuuaaagaauauaaguuggugccguaccucaaagauaagcugaaacccggugccgcagaggacgaucuaguucuggaaguggucauaaugaucggcacagugaguauggacgauucuugcgcugcccuccuggcuaaguccgggauuaucccugcccuuaucgaguugcugaaugcacagcaagaggacgaugaauuuguaugucagauuauauauguuuucuaccagaugguguuucaucaggccacucgcgacgucaucauuaaggagacccaagcuccagcguauuuaaucgaucucaugcacgacaaaaacaaugaaauuagaaaggugugcgacaacacacuggauaucauagcagaguacgacgaagagugggccaaaaagauccagagcgagaaauucagguggcauaauucgcaguggcuugaaauggucgagucucggcagauggaugaauccgagcaauaccuguauggagacgaucgaauugaacccuacauccacgagggcgacauuuuggagcgcccugaucucuuuuauaacucagacggucugaucgcuagugaaggggccauaagcccagauuucuuuaacgacuaccaccuacagaauggagaugugguuggccagcauuccuuccccggcucucuggggauggacggauuuggucagccggugggcauucucgggagaccugcaaccgccuauggauucaggcccgaugagccauacuauuacggcuacgguagcuga

SEQ ID NO: 58130 - RNA, 2022 nt, Artificial Sequence
  derived and/or modified sequence opt3 from KIFC1__Homo_sapiens__NP_002254
auggacccccagagaagcccucugcucgaggugaagggcaacaucgaacuuaaaaggccacugauuaaggccccgucccaauugcccuuaucugggucacggcugaaacgccgaccugaucagauggaggacggacuagaaccagagaagaaacguaccagaggucucggcgcuacaacuaagauaacgaccagucaccccagggucccuagccugacaacuguuccacagacccaggggcaaacaaccgcacagaagguguccaaaaagacuggaccccggugcucuacagccaucgcgaccggccuuaaaaaucagaagccuguaccagcugugccgguccagaaaucggguacgucaggggugcccccuauggccggaggcaagaagccaagcaaacgccccgcaugggaucugaagggccaauugugugaccucaacgccgaacugaaaagaugcagggagcggacucagacccuggaucaggagaaucagcaacuccaggaccaguuacgcgaugcucaacagcagguuaaggcacuggggacagaacgaacuacccuugagggacauuuggccaaagugcaggcucaagccgaacagggucagcaggagcugaagaaccuaagagcguguguccucgagcuggaagagaggcuuaguacacaagaaggccuggugcaggaguugcagaaaaagcagguagaacuccaagaggagcggcgugggcugaugucccaguuagaagagaaggaacgcagacugcagaccucugaggcagcccucagcuccucacaggcugaaguugccagucuuaggcaagagacgguggcacaggcugcccuguugacugagcgggaggagcgacuacacggacuggaaauggagcgcagaaggcuccauaaucagcugcaagaacuuaaaggcaacauucgggucuucugccgcgugagaccugugcugccaggugagcccacaccgccucccggguugcuccuguuuccaagcggaccuggcggccccucugacccacccaccagguuaucccugucacguagcgaugagcggcgagggacucuaaguggagcgccugccccaccgacaagacacgacuucucuuuugauagggucuuucccccugguuccggccaggacgaaguuuucgaggaaaucgcaaugcucgugcagagcgcucuggauggguacccaguauguauuuucgccuauggacagaccggcucggguaagacguuuaccauggaagggggccccggaggcgacccucaacuugagggguugaucccacgcgcucugcggcaucucuucucuguggcccaggaacuguccggacaggguuggacauacucauuugucgcaaguuauguggagauauacaaugaaacuguuagagaccuucuggccaccggcacaaggaaagggcagggaggcgagugcgaaauccgccgagcuggucccgggagcgaggaguugacugugaccaacgcgcgguaugucccgguguccugugaaaaggagguagaugcacuccugcacuuagcccgucaaaauagagcuguugccaggacagcacagaacgaacgcucuagccggucacacaguguguuccagcugcagauuuccggcgagcauagcucuagaggacuacaaugcggcgccccucucucacuggucgaccuugcugggagugaaagguuggauccaggacuggcccucggucccggcgagcgagagcgccugcgggaaacccaggcaaucaauagcuccuuaucuacucuggggcuugugauuauggcguugucgaacaaagagagccacgucccuuacagaaauuccaagcucacguaucugcuacagaacucacugggaggcagugcuaagaugcucauguuugugaauaucucuccccuggaagagaacguuagcgaaucccuuaacucauugagguucgccagcaaagugaaucaauguguaauagguacagcacaggccaaccguaaguga

SEQ ID NO: 58131 - RNA, 2481 nt, Artificial Sequence
  derived and/or modified sequence opt3 from KIFC3__Homo_sapiens__NP_001123572
auggugcccagcagaaggaccuggaaccugggcgccacaccuucccuccgggggcuuuggcgcgucggacgagcuccagagccggaacccgguauggcacguccugccccagcgcccgcuucuccugccgcaagaccauucccccacacuggcccugggaggcugcggacgggacgcggcaaggacaccccaguuugcggugaugaggacucaagugccagaagcgcugcaaggccggccuuggcucagugucgggccuuauccguggauugggcggggcccggaucuccucauggccuguaccuaacacuccaaguagaacaccugaaggagaagcugaucucgcaggcacaggaagugucacgccugcgaagcgaguugggcgggacugaccucgagaaacauagagaucugcugauggucgaaaaugagaggcuccggcaggaaaugcgucgcugcgaggccgaguuacaagaacugagaaccaagccagcuggacccuguccugguugcgagcacagucaggaauccgcccagcuuagggacaaauugucucagcugcaacuagagauggcagaaagcaagggcaugcucuccgagcugaaccuugaggugcagcagaagacagaucggcuggcugaaguugaguugcgacucaaagacugucuggccgaaaaggcgcaggaggaagaacgcuuaucaagaaggcugcgggauagucaugagaccauugccagccuccgcgcacaaucuccacccgugaaauaugucauaaagacuguggaaguagaguccucaaaaacaaagcaggcucuuagcgaaagucaggccagaaaucaacaccuucaggagcagguugcuaugcagaggcaaguguugaaggaaauggagcagcagcuacagucuucccaccaacugaccgcccgucuccgggcacagaucgccauguacgagagcgaacuggagcgagcucaugggcagaugcuugaagagaugcagucgcuggaggaagacaaaaacagagcgauugaggaagcauuugccagggcucaagucgagaugaaggccgugcacgaaaauuuggcaggagugcgcacgaaccuccugacuuuacagccggcccugcggacccuaacaaaugauuauaacggccucaaaagacaggucagggguuucccucugcuuuugcaggaggcucugcgcucuguuaaggccgagaucgggcaagcaauugaagagguaaauuccaacaaucaggaacuccugcgaaaauaccggcgugagcuucagcugagaaagaaaugccauaacgaauuggugaggcucaagggaaauauccgcgugauagcgcgggucagacccgugacuaaggaggacggcgagggcccagaagcuaccaacgccguuacauuugaugcagacgacgauucaaucauucaccuguuacacaaagggaagccugugaguuucgagcuggacaaagucuuuagcccccaagccucccagcaggauguguuccaggaaguacaagcucuaguuaccucuuguaucgacggauuuaaugugugcauuuucgccuauggucagacgggcgcagggaagacuuacacaauggagggaaccgcugaaaacccaggcaucaaccagagggcccuccagcugcuuuuuagcgagguccaagagaaagcgucagauugggaauauacuauaacagugagugccgcugagauuuacaaugaagucuugcgagaccugcucgguaaggagccccaggagaagcuggaaauccgcuuauguccugauggguccggccagcuguacgugccaggacuuaccgaguuccagguucaaagcguggacgauauuaacaaaguauuugaguucggccauacgaaucggaccacagaguuuacuaacuugaaugaacacucuucaagaagucaugcacuccugaucgucaccgugcgugggguugacugcagcacaggacuaaggacuaccgguaagcugaaccucguggaucuggccggcuccgagcgcgucgggaaaucuggagcugagggcucgcggcuuagagaagcccagcacaucaauaagagcuuguccgcacugggugacgugauugcggccuuaaggucacgacaggggcauguaccguuccggaacaguaaacucacauaucugcuucaagacucucugagcggcgauuccaagaccuugauggugguucaggucucacccguggagaagaauacuagcgaaacgcucuacucucugaaauucgcugagcgcgugagauccgucgaacuaggaccuggccugaggcgggccgagcucgggaguuggagcucucaggagcaccuggaaugggagccagcaugucagacaccccaaccuuccgcucgagcccacucagcaccaaguagcggaaccucguccagacccgguucuauacgcaggaaacuucagccgagcgccuga

SEQ ID NO: 58132 - RNA, 1182 nt, Artificial Sequence
  derived and/or modified sequence opt3 from KIN__Homo_sapiens__NP_036443
augggcaagagcgacuuccugacccccaaagccaucgcuaacagaauuaaguccaaagggcuccagaaacuuaggugguacugccaaaugugucagaaacagugccgggaugagaauggauuuaagugucacugcaugucugaaucacaucagcgccaacuguuguuagcaagugagaacccucagcaguucauggacuauuuuagcgaagaguuccgaaaugauuuucuggaacuacuccguagaagguucgguacaaagcgggugcacaacaauauagucuacaacgaguauaucucccaucgcgagcacauucauaugaaugccacucagugggaaacgcugaccgacuuuacaaaauggcuuggcagagaggggcuguguaagguugaugaaacuccaaaaggaugguacauccaauauauugacagggauccggagaccauccggcgccaguuggagcucgaaaagaaaaagaagcaggaccuggaugacgaggaaaagacagcgaaguucauagaggaacaggugcgaagaggccuggaggguaaagagcaagaaguacccaccuuuacugagcucucuagggaaaacgaugaggaaaaggugacauucaauuuaucgaaaggggcuugcucaagcaguggagccaccuccucuaagagcuccacgcugggcccuucagcacuuaaaacuaucggcaguagcgccucugucaagcggaaggaguccucacagagcaguacccagucuaaagagaagaaaaagaaaaaguccgcuuuggacgaaauuauggagaucgaagaggaaaagaaacguacagcacgcacugauuacuggcugcaaccagagauuaucgugaagauaauuaccaaaaagcuaggggagaaauaucacaagaagaaagccaucguuaaggaagugauugacaaauacacagcugucgugaagaugaucgacagcggagauaaacucaagcuggaccagacccaccuugagacgguaauccccgccccugguaagaggauucugguuuugaacggcggguacagaggaaaugaaggcacucucgagucgauaaacgagaaaacauuuucugcgaccaucgugauugaaacugguccacugaaggggcggcgagucgagggaauccaguaugaagauauauccaaauuagcauga

SEQ ID NO: 58133 - RNA, 1047 nt, Artificial Sequence
  derived and/or modified sequence opt3 from KIR2DL1__Homo_sapiens__NP_055033
augagccugcucguggucuccauggccugcguuggcuucuuucuucugcagggggcuuggccccacgagggagugcauagaaagccuucuuuguuagcacacccagguaggcugguaaaaucagaagagaccgugauccuacaauguuggagugacgucauguucgaacauuuucuccugcaccgggagggcauguucaacgauacacuucgccugauuggggaacaucacgacggagugagcaaggccaauuuuuccauaucucgaaugacucaggauuuggcgggcacguaccguugcuaugguucgguuacccacucaccguaccaggugagcgcucccagugacccucucgauaucgucauuaucgggcuguaugagaaaccaucccugucugcccagcucggacccacaguguuagcaggcgagaacguaacucugagcuguuccucaagaaguagcuacgacauguaucaucuuucuagggaaggcgaggcccacgaacggcgcuugccugcugggccaaagguuaauggaaccuuccaagcagauuuuccccuggguccugccacacauggcgggaccuacagaugcuucggauccuuucacgacucaccauaugaguggagcaaaaguucugauccgcuacucguguccgucacuggcaaccccagcaauucguggccuucuccaacagagcccuccucaaagaccgguaacccuaggcaucugcacauucuuaucgggacgaguguggugauaauccuguucauuuugcucuuuuuccuguuacaccggugguguagcaauaagaaaaacgcugccgucauggaccaggaauccgcgggaaaucgcacugcaaacucugaggauagcgacgaacaggauccacaggagguuaccuacacacaacugaaucauugcguguuuacucagcgaaagaucaccagacccucacagaggccgaaaacaccucccaccgacauuaucguauacacggaacucccaaacgccgagagucgguccaagguggucagcuguccuuga

SEQ ID NO: 58134 - RNA, 1047 nt, Artificial Sequence
  derived and/or modified sequence opt3 from KIR2DL2__Homo_sapiens__NP_055034
augagccugaugguggucuccauggccugcguuggcuucuuucuccuucagggggcuuggccccacgagggagugcauagaaagccuucucuguuggcacacccagguagguuaguaaaaucagaagagaccgugauccugcaauguuggagugacguccgguucgaacauuuucuacuccaccgcgagggcaaguucaaagauacacugcaucuuauuggggaacaccacgacggagugagcaaggccaacuuuuccauaggcccgaugaugcaggaucuggcggguacuuaccgaugcuaugggucuguuacgcauucgcccuaccaguugucagcuccuagcgacccacucgauaucgugauuaccggacuguaugagaaacccagucuguccgcccagccuggcccaacaguccucgcaggcgagucugugacuuuaagcuguuccucacguaguagcuacgacauguaucaccugucuagagaaggggaggcccaugaaugcagguucuccgcuggacccaagguaaaugguaccuuucaagcagauuucccucuuggcccagccacacacgggggaaccuaccgguguuuuggcucauuccgcgacagcccguaugaguggaguaacucuuccgaucccuugcugguuagcgugacugguaauccuucgaacucuuggccaucccccacagagccuucaaguaagaccgggaauccaagacaccuacauauccucauuggaacgagcgucgugaucauacuguuuauccuucuguucuuuuugcuccacagguggugcuccaacaaaaagaaugcugccgugauggaccaggaaucugcgggcaaccggacugcaaauagcgaggauucagacgaacaggauccccaggaggucaccuacacacaacugaaccauuguguuuucacucagcgcaaaauuacccgaccgagucagagaccuaagacacccccaaccgacaucauuguguacacggaauuaccuaaugccgaguccaggagcaaaguagugucuugccccuga

SEQ ID NO: 58135 - RNA, 1026 nt, Artificial Sequence
  derived and/or modified sequence opt3 from KIR2DL3__Homo_sapiens__NP_056952
augagccugaugguggucuccaugguuugcgugggcuucuuucuccuucagggggccuggccccacgagggaguacauagaaagccuucucuguuggcucacccagguccguuagugaaaucagaagagaccgucauccugcaauguuggagugacgugagguuccagcauuuucuacuccaccgggaaggcaaguucaaagauacacugcaucuuauuggggagcaccacgacggaguuagcaaggcaaacuuuuccauaggccccaugaugcaggaucuggccgguacuuaccgcugcuaugggucugugacgcauucgccuuaccaguugucagcgccaagcgacccccucgauaucgucauuaccggacuguaugaaaaaccuagucuguccgcucaaccaggccccacagugcucgccggcgagucuguaacuuuaagcuguuccucacgaaguagcuacgacauguaucaccugucucgugagggggaagcacaugagagaagguucuccgccggaccuaagguuaaugguaccuuucaggcugauuucccacuuggcccggcaacacacgggggaaccuaccggugcuuuggcucauuccgcgacagccccuaugaauggaguaacucuuccgauccuuugcuggugagcgucacugguaauccaucgaacucuuggcccuccccuacagagccaucaagugagaccgggaaucccagacaccuacaugugcucaucggaacgagcguggucauuauccuguuuauacuucuguuguucuuucuccugcacaggugguguugcaacaagaaaaaugccguugugauggaccaggaaccggcuggcaaccggacuguaaaucgcgaggauuccgacgaacaggauccucaagaggugaccuacgcccaguuaaaccauugugucuucacacagcgaaagaucacuagacccucucagaggccaaaaaccccucccacagacauuaucguguacaccgaacugccaaaugcggagcccuga

SEQ ID NO: 58136 - RNA, 1029 nt, Artificial Sequence
  derived and/or modified sequence opt3 from KIR2DL4__Homo_sapiens__NP_001074239
augagcaugucccccaccgugaucauucuggccugccucggcuucuuucuugaccagucugucugggcucacguugggggacaagauaagccuuucuguucagcauggccaagugccgugguaccgcaggguggccaugugacacugagaugccacuacaggcggggguuuaacauauucacuuuguauaaaaaggacggaguccccgugccugaguuauacaaucgcaucuuuuggaacagcuuccugauuuccccaguuacgcccgcgcaugcuggcaccuaucgaugucgugguuuucacccucauucuccaacagaauggucggcccccucaaauccucuagugaucauggucacugggcucuacgagaaaccaagccugaccgcaagaccgggacccacagugagggccggcgaaaacguaacccuuaguugcuccucucagagcuccuucgauauuuaucaccugucacgggagggcgaagcucacgaguugcgccucccugcaguuccaaguaucaaugggacuuuucaggccgacuucccccugggaccugcuacacauggugagaccuacagauguuuuggcagcuuccacgggucuccauaugaaugguccgaucccucagacccgcugccugugagcgucacgggaaaccccaguucuuccuggccaagcccuacugagcccucguuuaagaccgaugccgcggugaugaaucaagaaccagcaggccauaggacagugaaccgggaggacucugaugagcaggacccccaggaagucacuuacgcccagcucgaucacugcauauucacccaacgcaaaaucacagguccuucccagcgaucaaagagaccaaguaccgacacgagcguuuguauugaguuaccgaaugcugaacccagggcccuguccccugcacacgagcaucacucucaggcucuuauggggagcucacgggaaacuacagccuugagucagacccaacuggcguccagcaacgugccagccgcaggaaucuga

SEQ ID NO: 58137 - RNA, 1128 nt, Artificial Sequence
  derived and/or modified sequence opt3 from KIR2DL5A__Homo_sapiens__NP_065396
augagccugauggugaucuccauggccugcgucggcuucuuucuccuucagggggcuuggacccacgagggaggucaagacaagccccuguugucugcauggccuucagccguugugccaagaggcgggcauguaacauuacuguguaggagucggcuaggauucacuauuuuuagccucuacaaagaagauggcgugccgguccccgagcuguauaacaagauauucuggaaauccauccuuauggguccugugacgccagcgcacgcugggaccuaccgcugccgaggaucucauccccguucgccuauugaauggucagccccaagcaauccccugguuaucguggucacaggcuuguuuggcaagccuagucucuccgcacagccagggccgacugugagaaccggagagaacguaacacugucuuguagcuccaggucaaguuucgacauguaucaccugagccgggaaggucgcgcccaugagcccagacucccugcuguuccaucugugaauggcaccuuucaggcagauuuccccuuagggccugccacucacggaggcacauauaccugcuuugguucccugcacgacucaccauacgaguggagcgaucccagugacccgcuuuuggucucugugacggggaacuccagcucgucuuccucaaguccuacugaacccagcuccaaaaccggaauuaggcggcaucugcacauccuaauaggcacaucuguggcuaucauucucuucaucauucuguuuuucuuucuucugcauuguugcuguagcaauaagaagaacgccgcggucauggaucaggagccagcaggcgaccgcacuguuaaucgagaagauucagacgaucaagacccucaggaggugaccuacgcccaguuggaucacugcguauucacacagaccaaaaucacgagucccucccaaagaccaaagacucccccuacagacaccacuauguauauggagcucccaaacgcuaaaccgaggagccugucucccgcccacaagcaucacucacaggcauuacgggggaguagccgugaaacaaccgcucugucccagaaucgcguggccucuucgcaugucccugcggccggaauauga

SEQ ID NO: 58138 - RNA, 1128 nt, Artificial Sequence
  derived and/or modified sequence opt3 from KIR2DL5B__Homo_sapiens__NP_001018091
augagccugauggugaucuccauggccugcgucggcuucuuucuccuucagggggcuuggacccacgagggaggucaagacaagccccuguugucugcauggccuucagccguugugccaagaggcgggcauguaacauuacuguguaggagucggcuaggauucacuauuuuuagccucuacaaagaagauggcgugccgguccccgagcuguauaacaagauauucuggaaauccauccuuauggguccugugacgccagcgcacgcugggaccuaccgcugccgaggaucucauccccguucgccuauugaauggucagccccaagcaauccccugguuaucguggucacaggcuuguuuggcaagccuagucucuccgcacagccagggccgacugugagaaccggagagaacguagcccugucuuguagcuccaggucaaguuucgacauguaucaccugagccgggaaggucgcgcucaugagcccagacucccugcaguuccaucuguggauggcacauuucaggccgacuuccccuuagggccugcuacccacggaggcacuuacacaugcuuuuccucacugcacgauagcccauaugaguggagugaccccucugauccgcuuuuggucuccgugaccgguaauagcucgucuuccucaaguagcccuacggaacccuccucuaaaacugggauuaggcggcaucugcacauccuaauaggaaccagcguggccaucauucucuucaucauucuguuuuucuuucuucugcauuguugcuguucaaacaagaagaaugcggcagucauggaccagggcccagccggcgaucgcacaguuaaccgagaggacagugaugaccaagauccucaggaagugacuuacgcucaguuggaccacugcguauucacccagacaaaaaucaccucccccagccaaagaccaaaggcacccccuacggacacuacaauguauauggagcucccaaaugccaaaccgaggucucugucacccgcucacaagcaucacagucaggccuuacgggggagcucccgugagaccacugcgcugucucagaaccgcguggccucgagccaugucccugcagcuggaauauga

SEQ ID NO: 58139 - RNA, 915 nt, Artificial Sequence
  derived and/or modified sequence opt3 from KIR2DS1__Homo_sapiens__NP_055327
augagccugaccguggucuccauggccugcguuggcuucuuucuccuucagggggcuuggccccacgagggagugcauagaaagccuucucuguuggcacacccagguagguuaguaaaaucagaagagacagugauccugcaauguuggagugacgucauguucgaacauuuucuacuccaccgggagggcauguucaacgauacucugcgccuuauuggggaacaucacgacggagugagcaaggccaauuuuuccauaucucgaaugaaacaggaucuggcgggcacguaccguugcuaugguucgguuacccacucaccguaccaguugagcgcucccagugacccucucgauaucgugauuaucgggcuguaugagaagccaucccugucugcccagcccggaccuacaguccucgcaggcgagaacgugacuuuaagcuguuccucaagaaguagcuacgacauguaucaucugucuagggaaggcgaggcccacgaacggcgccuuccagcugggaccaaaguaaauggaacauuccaagcaaacuuucccuuggguccugccacccauggcgggacuuacagaugcuucggauccuuuagggauucaccauaugaguggagcaagaguucugacccgcugcuaguuuccgugacaggcaaucccagcaacucguggccuucuccaaccgagcccuccucagaaacggguaauccucggcaccuccacguccugauugggaccaguguggugaagaucccauucacuauacuucuguuuuucuugcuccaucgcugguguagcgauaaaaagaacgcugccgucauggaccaggagcccgcgggaaaucgaacaguuaacuccgaagauucugacgagcaggaucaccaggaagugagcuacgcauga

SEQ ID NO: 58140 - RNA, 1017 nt, Artificial Sequence
  derived and/or modified sequence opt3 from KIR2DS2__Homo_sapiens__NP_001278624
augagccugaugguggucuccauggccugcguuggcuucuuucuccuucagggggcuuggccccacgagggagugcauagaaagccuucucuguuggcacacccagguccguuaguaaaaucagaagagaccgugauccugcaauguuggagugacgucagguucgaacauuuucuacuccaccgggagggcaaguacaaagauacacugcaucuuauuggggaacaccacgacggagugagcaaggccaacuucuccauaggccccaugaugcaggaucuggcggguacuuaucgcugcuacgggucuguuacgcauucgccuuaucaguugucagcuccaagcgacccccucgauaucgugauuaccggacuguacgagaaaccuagucuguccgcccagccaggccccacaguccucgcaggcgagucugugacuuuaagcuguuccucacgaaguagcuaugacauguaccaccugucucgugaaggggaggcccaugaaagaagguuuuccgcuggaccuaagguaaaugguaccuuccaagcagauuuuccacuuggcccggccacacacgggggaaccuaucggugcuucggcucauuucgcgacagccccuacgaguggaguaacucuuccgauccuuugcugguuagcgugacugguaauccaucgaacucuuggcccuccccuacagagccaucaaguaagaccgggaaucccagacaccuacauguccucaucggaacgagcguggugaaaauuccguucacuauccugcuguuuuuccuuuugcacaggugguguuccaacaagaaaaaugcugccgucauggaccaggaaccugcgggcaaccggaccguuaauucugagcgcgaaauaacacgacccagcgagagaccaaagacuccucccaccgauacaucaauguacaucgaacucccaaacgcagagcccaggaguaaagugguauuuugcccucgggccccacaguccggccuggaggggauuuucuga

SEQ ID NO: 58141 - RNA, 915 nt, Artificial Sequence
  derived and/or modified sequence opt3 from KIR2DS3__Homo_sapiens__NP_036445
augagccugauggugaucuccauggccugcgucggcuucuuuuggcuccagggggcuuggccccacgagggauucagaaggaagccuucucuucuggcacauccaggucgguugguuaaaucagaagagaccgugauuuuacaauguuggagugacguaauguuugaacacuuccugcuacaucgcgagggcacauuuaacgauacucuccgacugauaggggaacacaucgacggagugagcaaggccaauuucuccauuggccguaugagacaggaucuugcggguacguacaggugcuaugggucugucccgcauucgcccuaccaguuuucagcuccuagcgacccacuggauaucgugauuaccggauuguaugagaaacccagucucuccgcccagccuggcccaacaguucuggcaggcgagucugugacucugagcuguuccucauggaguagcuacgacauguaucaccucucuaccgaaggggaggcccacgaacggcgcuucuccgcuggacccaaggucaacgguacauuucaagcagauuucccuuuaggcccagccacccaagggggaacuuacagaugcuuuggcucauuccaugacagcccguaugaguggaguaaaucuuccgauccccugcuugugagcguaacagguaauccuucgaacucuuggccaucccccaccgagccuucaaguaagacggggaauccaaggcacuugcauguucugaucggaacuagcguggucaagcuacccuuuaccauacuccuguucuuccuucugcaccggugguguuccgacaaaaagaacgcuucugugauggaucagggcccggccggcaaucgcacagugaaccgagaagacagcgaugagcaggaccaccaggaagucucauacgcguga

SEQ ID NO: 58142 - RNA, 915 nt, Artificial Sequence
  derived and/or modified sequence opt3 from KIR2DS4__Homo_sapiens__NP_036446
augagccugauggugaucauuauggccugcgucggcuucuuucuccuucagggggcuuggccccaagagggaguucacagaaagccuuccuuccuggcauugccaggucauuuagugaaaucugaagagaccguaauacugcaguguuggucagacgugauguuugaacacuuccuacuccauagggagggcaaguuuaacaauacacugcaccuuaucggggaacaucacgauggagucaguaaagccaacuucagcauuggcccgaugaugcccgugcuggcggguacuuaccggugcuauggguccguuccucacucuccauaccaguugucggcucccucagacccucucgauauggugaucauuggacuguaugagaagccaagccugagugcccagcccggcccuacgguccaagcaggcgagaaugugacccucuccuguucuagccgcuccucauacgacauguaucauuuaagucgagaaggggaggcccacgaacguagacugccagcuguaaggagcaucaacggaacauuucaggcagauuucccgcuuggucccgccacucauggcgggaccuaccggugcuuuggaucuuuccgcgacgcuccuuaugagugguccaauucaagcgauccauugcugguuagugugacaggcaaccccucuaauuccuggccuagcccaaccgagcccucgucuaaaacugguaacccgagacaccuacacguccucauagggacauccguggugaagaucccuuuuaccauucugcuuuucuuucuguugcauaggugguguucagacaagaaaaaugccgcggucauggaucaggaacccgcaggaaaccggacgguuaauagugaggacagcgaugaacaggaccaccaagagguguccuacgccuga

SEQ ID NO: 58143 - RNA, 1335 nt, Artificial Sequence
  derived and/or modified sequence opt3 from KIR3DL1__Homo_sapiens__NP_037421
augagccugaugguggucuccauggccugcguuggccucuuccuugugcagagagcugggccccacaugggaggucaagacaagccuuuucugucugcauggccaucagccguagugccgaggggcgggcaugucaccuugcggugucacuaccgccaucgauucaacaauuuuauguuauauaaagaggaucguauccacauucccauauuccauggaagaaucuuucaggaaaguuucaacaugagcccugugacaacugcgcacgcuggcaauuacacgugcagggguucccacccacauucucccaccggguggucggccccuucaaacccaguugugauuauggucacaggaaaucaccggaagcccagccugcuagcacauccuggcccacucgugaaaaguggcgagcgcguaauccugcaguguugguccgacauuauguuugaacacuucuuucuucacaaggaggggaucucuaaagauccgagcagacugguuggacagauacaugacgguguguccaaggccaacuucucaaucggccccaugauguuggcucucgcagggacuuauaggugcuacggaagugucacccacacaccuuaucaacugagcgccccaucugauccccuggacauuguggugaccggcccuuacgaaaagccaucccucucagcucagcccgguccgaaaguccaggccggggagagcguuacuuuaaguuguucuucccggagcucguaugauauguaccaucugucucgcgagggaggcgcgcacgaacgaagacuuccugcagugaggaagguaaaucggacauuucaggccgacuuccccuugggcccagcuacccaugggggaacguaccguugcuuugguuccuuccgccacucaccuuaugaguggagugaucccagcgacccacugcuaguguccgucacuggcaaccccucuagcucauggccuaguccaaccgaaccguccagcaaaucugggaaucccagacaccuccauauccugauuggaacaucagugguuaucauacuuuucauucuguugcucuuuuuccuguuacaccugugguguaguaacaagaaaaaugccgcagugauggaucaagagccugcuggcaacaggacugccaauagcgaggacuccgaugaacaggacccagaggaagucaccuacgcgcagcucgaccauugcguguuuacacagcggaagaucacccgacccucucaacgcccuaagacgccacccacugauacaauucuuuauaccgagcugccgaacgccaaaccuagaucgaagguaguuagcuguccauga

SEQ ID NO: 58144 - RNA, 1317 nt, Artificial Sequence
  derived and/or modified sequence opt3 from KIR3DL2__Homo_sapiens__NP_001229796
augagccugaccguggucuccauggccugcguuggcuucuuucuccuucagggggcuuggccccugaugggaggucaagacaagccuuucuugucugcaagaccaucaacagugguaccgaggggcgggcacguggccuuacagugucauuaccggcgcggauuuaacaauuucaugcuguauaaagaggaucgaagucacguccccaucuuucauggccguauuuuccaggagagcuuuauaauggguccugugacuccagcgcacgcugggacguacagaugcaggggaucccggccccauucucuaaccggcuggucggccccuucaaacccacucguuaucauggugacaggcaaucaccgcaagcccagccugcuugcacacccugggccacuguugaaaaguggagaaacugucauucuccaguguugguccgacgugauguucgaacacuuuuuccugcauagagaggguaucucugaagauccgagcaggcugguaggccaaauucaugacgggguuuccaaggccaacuuuucaaucggaccccucaugccuguguuagcuggcaccuaucggugcuacgguagugucccacacagccccuaucagcugucugcaccuuccgauccacuugacauagugaucacaggguuguacgagaaacccucacugagcgcccagccgggaccuaccgugcaggcuggcgagaaugucacucuaaguuguucuuccuggagcucguaugauauuuaccaccucucucgcgaaggcgaggcccaugaacgaagacugagggcgguucccaaggugaaccggacauuccaagcagacuuuccacuugggccugccacccacggagguacguaccguugcuucggcuccuuccgcgcucugcccuguguauggucaaauaguagcgauccauugcucguguccgucacugggaucugcagacaucugcacguguuaauuggaaccucuguugugaucuuucuguucauacuccuucuguuuuucuugcuauauaggugguguagcaacaagaaaaaugccgcagucauggaccaggagcccgcuggcgaucggacagugaaccgacaggacucagaugagcaggacccucaagaaguaacuuacgcccagcuggaccauugcguuuuuauucagcgcaagaucaguagaccaucccaaaggccgaaaacaccccucaccgauaccagcguguauacggagcugccuaaugcggaaccacggucuaaggucgugucauguccccgcgccccucagaguggucuugagggggucuucuga

SEQ ID NO: 58145 - RNA, 1233 nt, Artificial Sequence
  derived and/or modified sequence opt3 from KIR3DL3__Homo_sapiens__NP_703144
augagccugaugguggucuccauggccugcguuggcuucuuucuccuugaggggcccuggccucacgugggaggucaggacaagccauuccugucugcuuggccgggcaccguagugucagaagggcaacaugucacauugcaguguagaaguagguuaggauuuaacgaguucagccuguccaaagaagauggcaugcccgugccugagcuauacaaucggaucuuucgcaacucuuuccucauggguccaguuacucccgcacacgccgggacguaucgaugcuguucgucacauccucacagcccaaccggauggagugcgcccuccaauccuguggucauuauggugacaggcguacaucguaagccaucucugcuugcucacccgggcccccugguuaaaagcggggaaacugugauauugcagugcugguccgacgucagauuugagagguuccuccugcaccgggagggaaucaccgaagauccucugcgccucgugggucaguuacaugacgccggcucacaagugaacuacaguauggggccaaugacacccgcacuggccggaaccuauagauguuuuggcagcgucacucaccuuccuuacgaguugucugcuccauccgauccccuggacauuguugugguaggucuauaugggaagccgucacucagcgcacagccuggacccacagugcaggccggcgaaaaugucacccugaguuguucuuccaggagccuuuucgauaucuaccaucugucgcgggaggcugaggccggcgaauugcgccucacggcggugcugcgaguuaacgggacuuuucaggcaaauuucccauuaggaccugugacccacgguggcaacuauagaugcuuugggucuuucagggcccugccccacgcuugguccgacccaucagauccccucccugucagugugacaggaaauagccggaaccuucauguacugauuggcacuuccguugugaucauaccauucgccaucuugcuauuuuuccugcuccaccguuggugcgcaaauaaaaagaacgcugucgugauggaccaagagccggccgguaaucgcaccgucaacagagaagauucugacgagcaggauccccaggaagugacauacgcgcagcugaaucauuguguuuuuacccaaaggaagauuacgcggccuagccagcgaccaaaaacucccccuacagacaccucaguguga

SEQ ID NO: 58146 - RNA, 1902 nt, Artificial Sequence
  derived and/or modified sequence opt3 from KIRREL2__Homo_sapiens__NP_115499
augcugagaaugagggugcccgcccuccuuguccuguuguucugcuuucggggccgcgcugggccuagcccacacuucuuacagcaaccggaggaccugguugugcuacucggagaagaggcacgacugcccugugcccuuggugcguacuggggccugguacaguggaccaaguccggguuggcucucggaggccagcgugaucugccugguuggucuagauauuggaucucagggaacgccgcaaauggacagcaugaccugcacauuaggccaguggaacucgaggaugaagccaguuacgagugccaagcuacacaggcaggcuuacggagccgccccgcccagcugcauguccuugugccuccagaggcuccccagguuuugggcgggccuuccgugucucuggucgccggagugccagcgaaccuaacuuguagaucgaggggugacgcacggccgacgcccgaacuccugugguuucgcgauggcguacuucuggacggggccaccuuccaccaaacauugcucaaagagggaacuccuggcucaguugaaagcacccugacauuaaccccauuuagucaugaugacggugcuacuuucgugugccgagccagaucccaggcacugcccacagggagggauaccgcuauaacgcucucucuucaguauccuccagaggucacucugagcgccagcccccacaccgugcaggagggagaaaaggugaucuuuuugugucaagcgacagcccagccgccugucacuggcuaccggugggcaaaaggcgggucacccguucuaggagcucgugguccacgccuggaggugguagccgacgcuaguuuccucaccgaaccugugagcugcgaggucucuaaugccgugggcuccgcaaacagaucaacagcccuggauguucuuuuugggcccauucugcaggcuaagccagaacccgugagcgucgacgugggagaggaugcgaguuucucuugugcauggaggggcaauccuuugccacggguaaccuggacgcgacgcgguggggcccaaguucucggcuccggagcuacucugagauuaccgagcgugggccccgaggacgccggggacuaugucugcagggcagaagccggacugucgggucuacggggcggggcugccgaggcacgccucacagugaacgcgccuccagucgugaccgcucugcacucugcccccgcauuucuuagaggaccugccagguugcagugucugguuuucgcuuccccagcccccgaugcagugguauggucaugggacgaaggcuuucucgaggcugguagucaggggcguuuccuggucgaaacuuucccggccccugagagccggggcggacuuggcccagggcugaucuccguguugcauauuucuggaacacaggagagcgauuuuucacgaaguuucaauugcuccgcgagaaacaggcucggugaaggcggggcccaagcuagccugggacgccgggacuuacugcccaccguuagaaucguggcaggcgucgccgcugccacgaccacacuacucauggugauaacugguguagcacuguguugcuggaggcacucuaaagcgucagccaguuuuagcgagcagaagaaucuuaugcgcaucccuggguccucugauggcucgagcucccgaggacccgaagaggaagagaccggcucacgggaggaccgugggccaauugugcauacagaucacagugacuugguucuggaagaggaaggaacucucgagaccaaggauccuacaaacggcuacuauaaagucagaggugugucucccccagcuagcccggacuccagggugaccucauuccaguggaaguccccugggaucucuaaucugcccuga

SEQ ID NO: 58147 - RNA, 1803 nt, Artificial Sequence
  derived and/or modified sequence opt3 from KIRREL3__Homo_sapiens__NP_001155179
augaagcccuuccagcuggaccuccuuuuugugugcuucuuucuguucagccaagaguugggcuuacagaaaagaggguguugccugguccuaggauacauggccaaggauaaauuuaggcggaugaacgaaggucagguuuauuccuucucucagcaaccucaggaccaggugguagugucaggccagccagucacccuccugugugcuaucccggaguacgauggguuugugcuuuggauuaaggacggacuggcauugggcguuggucgcgaucucaguagcuauccccaauaccugguggucgggaaucaccuguccggagaacaucaccucaaaauauuacgagccgagcugcaggacgaugcgguguaugaaugccaggcuauccaggccgcaauucguucuagaccugccaggcuuacaguauugguuccacccgacgauccugugauccugggcggcccagucauuucgcuacgggcuggggacccccucaaccugacuugucaugcagauaaugccaagccugcugccucaaucauauggcuucgcaagggagaggugaucaacggugcgacguacagcaaaacccuguugagagacggcaagagggagaguauuguguccacacucuucaucucuccaggggaugucgaaaauggacaaagcauuguuugccgggcaacuaacaaagccaucccgggcgguaaggagaccuccgugacaauagacauucagcaucccccucugguaaauuuaucaguggaaccacagcccguccuggaggacaacgugguuaccuuucacuguagugcuaaagccaauccugcagugacucaauaucgcugggcuaagcgagggcagaucauuaaggaggccagcggagaagucuacagaacaaccguggauuacacguauuucucugagccaguauccugcgaaguuacuaacgcgcucggcucaaccaaucuuagcaggacaguggacgucuacuuuggcccccggaugacuaccgagccgcagagucuguugguggaucuagggucugacgccaucuucuccugugcauggacaggaaacccuagccugaccaucgucuggaugaaacgugguucgggcgugguucucucuaaugaaaagacgcugacucuuaaauccgugcgccaggaggaugcugggaaguauguaugcagagccgucgugcccaggguuggagcuggcgagcgggaagugacacugaccgucaacgguccaccuauuauaucaaguacucaaacacagcacgccuugcacggggagaaaggccagaucaaguguuuuauucgaagcacgcccccacccgaccgcaucgcaugguccuggaaagaaaaugugcucgagucuggaaccagcggcagauacaccguagaaacaauaucaacugaggagggggugauuaguacccugacaaucuccaacaucguuagggccgauuuccagacuauuuauaacugcaccgcuuggaauagcuucggaucugacacagaaaucauucgguuaaaggagcaagguucagaaaugaagaguggcgcggggcuggaggcagaaagcgucccuauggccgugauaaucggaguggcugucggcgccgguguugcauuucuagugcucauggccaccauuguggcuuucugcugugcccgcucccagagaucuacugggggcaggucgggaaucagcggccgugggacggagaaaaaggcacggcugcgacuuccaagaagggcguccaaacaggagugcaacgaacagggaucauga

SEQ ID NO: 58148 - RNA, 1974 nt, Artificial Sequence
  derived and/or modified sequence opt3 from KIRREL__Homo_sapiens__NP_001273278
augcugagccuccuuguguggauccugaccuuguccgacacauucucucagguucccccugaggauacuagaauugacggcgggccagucauauuacugcaagccggaacgccgcacaaccuaaccugcagggcuuuuaaugcaaagcccgccgcgacaaucauuugguuccgggaugguacucagcaggaaggcgcuguggccucaaccgagcuccugaaagacgggaagcgcgaaacaaccguaagucagcuucugaucaacccuacugauuuggacauuggacgaguguuuacaugucguagcaugaaugaggcaaucccauccggcaaagaaaccucuauagagcucgauguccaucaucccccuacggugacucugucgaucgagccacaaaccguucaggaaggugagagaguggucuucacaugccaggccacugcuaaccccgaaauucugggguacaggugggcaaagggaggcuuucucaucgaggacgcccacgagucacgguaugaaaccaauguggauuacagcuucuuuacagagccuguaaguugugaaguucacaacaaagugggcuccaccaaugucucuacguuagugaacgugcauuucgcuccacgcauugucguugacccgaagcccacuacaaccgauaucgggagcgacgugacucugacaugcguaugggugggaaauccuccacuuaccuugacguggaccaagaaagauuccaacaugguccugucaaauaguaaccagcuacuccuuaagagcgugacacaagccgacgcggguacuuauaccuguagagcaauaguucccaggauuggcguggccgagcgggaagucccucuguacgugaaugggccacccaucauuucuuccgaggcuguacaguaugccguucgcggagacggcgguaaaguggagugcuuuaucgggucaacaccgccucccgaucgaaucgcaugggcuuggaaggaaaacuuccuggaggucggaacuuuggaaagauacaccguggagaggacaaauagcggcaguggcguccucucuacccugacuauuaacaacgugauggaagccgacuuucagacgcacuauaauuguacagcguggaacuccuucgggccaggaaccgccauaauccaguuagaggagcgggaaguucugccuguggguauuaucgcaggcgcuacuauaggggccagcauucuccuuaucuuuuucuucaucgcucugguauuuuucuuguaccgucgcagaaaaggaucgaggaaggaugucacccuacggaagcuggacauuaaaguggagacaguuaaucgagaaccccucaccaugcacucugaucgcgaggacgauacugccuccgugucaacagcaacgagagucaugaaggccaucuacaguagcuuuaaagacgauguggaccugaagcaagaucuuaggugcgacaccauugacacucgggaagaguaugagaugaaagauccaacaaacggcuacuauaauguacgcgcucaugaagacagacccuccucuagggcggugcuguacgcagauuaucgugccccugguccagcucgguucgacgggcgaccgagcucaagauugagucacuccagcggcuacgcccagcucaacaccuauucuaggggacccgcaucagauuacggcccugagccaacacccccugggccagccgcucccgccggaacugacaccacgagucagcugagcuacgaaaauuaugagaaguuuaacucccauccguucccuggugcagcgggcuacccaaccuaucgcuuaggguacccccaagcuccucccucuggacuggagcggacaccauaugaagccuacgauccuauaggcaaauaugcaacugccaccagauuuucguacacaagccagcacuccgacuacggucagagguuccagcaacgcaugcagacucacguuuga

SEQ ID NO: 58149 - RNA, 417 nt, Artificial Sequence
  derived and/or modified sequence opt3 from KISS1__Homo_sapiens__XP_011507827
augaacagccugguguccuggcagcuccuucuguucuugugcgccacccacuuuggcgagcccuuagaaaaggucgcuucuguuggaaauucaagaccuacagggcaacagcuggagagucuaggucuccuggcaccaggcgaacagagccuuccguguacugagaggaaacccgccgcgacggcucggcugucccgccgagggaccucuuugucgccuccacccgaaucaagcggaaguccucagcaaccaggccucuccgcaccccauucucgucagaucccugccccacagggugccgugcugguacagagagagaaggaccugccgaacuacaauuggaacagcuucgggcucagguuuggaaaacgggaggcugcacccggcaaucacggccgcuccgccgggagaggauga

SEQ ID NO: 58150 - RNA, 1197 nt, Artificial Sequence
  derived and/or modified sequence opt3 from KISS1R__Homo_sapiens__NP_115940
augcacaccguggccacaagcggccccaacgcuuccuggggagccccugcaaaugcgucugggugcccagguuguggcgcuaacgccucagacgggccgguccccaguccuagagcaguugaugccuggcuggugccacucuucuuugcugcacuuaugcuguugggauuaguaggcaauagccuggugaucuacgucauuugcaggcauaagcccaugcggacugugacgaacuucuauauagccaaucuagcugccaccgacguuacauuucuccuguguugcgugccuuucacugcgcuucuguacccauugcccgguuggguccucggggauuuuauguguaaauucgugaacuauauccagcaaguauccguucaggcaaccugcgccacacugaccgcuaugucuguggaccgcugguacgucacuguguuuccucugcgagcccuccaccguagaacaccaagguuagcacuggcugugucgcuuucaauuugggucggaagcgccgcgguuagugccccgguguuggcacugcaucggcuaucccccggcccucgcgcuuauuguucugaggccuucccaagcagagcucucgaaagggccuuugcacuguacaaucuucuggccuuguaucuccugcccuuacuggcuaccugcgcguguuacgcagccaugcuccggcaccuuggccgcguagcugugcgaccugccccagcagauuccgcccugcaggggcaggucuuggcugagagagccggagcagugagggcgaagguuucacggcuaguggcugccgucgugcuccuguucgcagccugcuggggucccauccaacuguuucuuguacugcaggcuuugggcccggccgggaguuggcauccucguagcuacgcagcuuaugcccucaaaacgugggcgcacuguaugucuuacuccaacucagcccugaaucccuuacuguaugcuuuccuaggaagccacuuucgccaggcauucagaaggguuugcccaugcgccccucggcgaccccgcagaccaaggcggcccggcccuagugacccagcugccccgcaugcagaacuccugcgccuugguucucaccccgcgccugccagagcucagaagccaggguccagcggauuggccgcaaggggccugugugugcucggcgaggauaacgcuccccuguga

SEQ ID NO: 58151 - RNA, 2931 nt, Artificial Sequence
  derived and/or modified sequence opt3 from KIT__Homo_sapiens__NP_000213
augagaggcgccaggggagcuugggacuuccugugcgugcuccuucuguuguuacggguccagaccgggagcucccaacccucuguuucaccuggugagccaaguccgcccagcauccacccuggcaaguccgaucugauugugcgcguaggggacgaaauacgacuacucuguacagauccaggauuugugaaauggacuuucgagauccuggacgaaacgaacgagaauaagcagaacgaauggauuaccgagaaagcagaggccacaaauacuggcaaguauaccugcacaaacaaacauggucuuucuaauucgaucuacgucuuugugcgugaucccgcgaagcuguucuugguugacagaucacucuacgggaaggaagauaacgacacccuggugagguguccucugacugauccagaggucacaaauuauagccucaaaggaugccagggcaagcccuuaccuaaagaccugcgguuuauuccagauccgaaggcuggcaucaugauaaaaagugugaagcgcgccuaccacagacuuuguuugcauugcuccguagaccaggaagggaagucuguucugagcgagaaauucauccuaaaggugaggcccgcauuuaaagccgucccugugguguccgucucaaaggcuaguuaucuccugcgggagggagaagaguucaccguuacguguacuauuaaagaugugucuagcuccguauacucaaccuggaagcgcgaaaacagccaaacaaaacuucaggagaaguauaauaguuggcaccauggugacuuuaacuacgaacgacaggcaacucugaccaucucuuccgccagagugaaugacagcggcgucuucaugugcuacgcuaacaauacauuugggucggccaacgugaccacgacuuuggagguuguggauaagggauucauuaauaucuuuccaaugauaaacacaaccgucuucgugaacgacggcgagaauguagaucucauuguugaauaugaggcguuccccaaaccugaacaccagcaauggaucuacaugaacaggacuuuuacagacaagugggaggauuauccaaaaucugaaaaugaguccaacauucgguacgugucagagcugcacuuaacccgucugaaggguacggaagggggaaccuauacauuccucgucaguaauagcgacgugaacgcagccaucgcuuuuaaugucuacgugaacacuaaacccgagauccuuaccuaugaucgccugguuaauggcauguugcaguguguggccgcaggcuucccggaaccuacaauugacugguacuuuugccccgggacugagcagagauguuccgcuucuguacuaccagucgaugugcagacccugaacagcucaggaccucccuucgguaagcucguugugcaaaguuccauagacagcucugccuuuaagcauaauggcacagucgaaugcaaagcguacaacgauguggggaagaccucagccuauuucaauuuugcauucaaaggaaacaauaaggagcagauccacccacauacucuguuuacgccccuucugauuggcuucguaaucguggcugguaugaugugcauaauuguuaugaucuugacauacaaauaucuccagaagccuauguacgagguccaauggaaggugguggaagagaucaacgggaacaauuaugucuacauugacccaacccagcugccguaugaccacaaaugggaauuucccaggaaccgguuaaguuucggcaagacucugggagccggcgcuuucgggaaaguuguggaggccaccgcauacggacuaaucaagagcgaugccgcuaugacaguggcgguaaaaaugcucaagccuuccgcacaccugaccgagcgagaagcccuuaugucugaguugaagguccugucguaccucgguaaucauaugaacauugugaaucugcuuggcgcuuguacuauagggggaccaacacugguuaucacggaauauugcuguuacggcgacuugcucaacuuucugcgcagaaaaagggauagcuucauuugcuccaagcaggaggaccacgccgaagcagccuuauauaaaaaucugcuacauucaaaggagaguucuuguagcgauuccaccaacgaguacauggacaugaaacccggugugucauaugucgugccuacuaaggcugauaaacggcgcagcguuagaaucgggucuuacaucgaaagggacgugacaccagccauuauggaggaugacgaacucgcacuggaucuugaggacuugcuguccuuuaguuaucagguagcgaagggcauggcuuuccucgccagcaagaauugcauacaccgugaucuggcagcccggaacaucuuacugacccauggacgaauuacaaaaaucugugacuuuggccuugcuagagacauuaagaaugauucuaacuacgucgugaaagggaaugccagguugcccgugaaguggauggcaccggaauccaucuucaacugcgucuacacuuuugagucagacguuuggaguuauggaauauuccucugggagcuguuuagccuagguucguccccuuacccaggcaugcccguggauucuaaauucuauaagaugaucaaggaaggguuucgcaugcugagcccugagcacgcucccgccgaaauguacgacauuaugaaaaccuguugggaugcggacccacucaagcggccuacguucaaacaaaucguacagcugauugagaagcagaucucagaaaguaccaaucacauauauuccaaccuugccaacugcucucccaauagacagaaaccaguggucgaucauagcgugaggauuaacuccguuggaucaacagcuagcaguucucaaccguugcuggugcacgacgaugucuga

SEQ ID NO: 58152 - RNA, 822 nt, Artificial Sequence
  derived and/or modified sequence opt3 from KITLG__Homo_sapiens__NP_000890
augaagaaaacccagacauggauccugacuugcauuuaccuccaacuucuguuguucaaccccuuagugaagacggagggcauauguagaaauagggucaccaacaauguuaaagacgugacaaagcugguagccaaccuaccuaaagauuauaugaucacucucaaguacgugccagggauggacguccugccgagccacugcuggauuuccgaaauggugguucagcuuucugauucacugaccgacuugcucgauaaguuuaguaauaucagcgagggacuguccaacuauucuauuaucgacaaacuggugaauauagucgaugaccucguggaauguguaaaggagaacucgucaaaagauuuaaagaaaaguuucaagagccccgaaccucggcuguuuacaccagaggaguucuuucgcaucuucaaucgauccauugacgcuuuuaaggauuucguuguggcaucugaaaccagcgacugcgucguguccucaacucuuagucccgagaaagauagccgugugucugucacaaagccuuuuauguugccacccguugccgcguccucacugagaaacgacagcaguucuuccaauaggaaagcuaagaacccuccaggugacagcucgcuacauugggccgcaauggcccucccggcucuguucucucuuaucauuggcuuugcauucggggcccuguacuggaaaaagcggcagcccuccuugacccgcgcuguggaaaauauccagauaaacgaggaggauaaugaaauuucaaugcuccaagagaaagaaagagaguuucaggaaguauga

SEQ ID NO: 58153 - RNA, 3135 nt, Artificial Sequence
  derived and/or modified sequence opt3 from KLB__Homo_sapiens__NP_783864
augaagcccggcugcgccgcugggagcccuggaaacgaguggaucuucuuuuccaccgacgaaauuacaacuagauacaggaauacgaugucuaacgguggccugcagcggucagugauacucagugcacuuauccuguugcgcgccgucaccggguucagcggagauggccgagcgauuugguccaaaaauccaaacuuuacaccgguuaaugagucucaauuauuccuguaugacacuuuucccaagaacuucuuuugggguaucgggaccggagcucuacagguggaaggcucguggaaaaaggauggcaaagggccuucaauuugggaccacuucauccauacacaccucaagaauguaagcaguaccaacggauccucugauagcuacauauuucuggagaaggaccuuuccgcccuggauuucaucggugugucauuuuaucaguucaguauuagcuggccacguuuguuucccgacggcaucgucacuguggcaaaugccaaagggcuccaguacuauucuacacugcuggaugcucucguuuuaagaaacauugaaccuaucgugacccuguaccauugggaccuuccauuggcacugcaagagaaguauggaggcuggaaaaaugauacgauaauugacaucuucaacgauuacgccacuuacuguuuccagauguuuggugacagggucaaguauuggauuaccauccacaaucccuaccuaguggcuuggcauggguauggaacaggcaugcacgccccuggcgagaaagggaaccucgcggcaguauacacuguuggacacaaucugaucaaggcccauuccaagguguggcacaacuauaacacccauuuccggccacaccagaaagguuggcuuucaauuacacugggcagccacuggauagaaccgaaucgcagugagaacaccauggacaucuuuaagugccagcaaucuauggucuccguguuggggugguucgcuaaucccauucauggagauggcgacuacccugaagguaugagaaagaagcucuuuagcgugcugccaaucuucucggaggccgagaaacacgaaaugagggggacggcagacuuuuucgcuuuuucuuucggccccaacaauuuuaagccuuuaaacacuauggccaaaaugggacagaaugucucccugaaccuccgggaggcgcuuaauuggauaaagcuggaauauaacaauccacgcauuuugaucgccgagaacggcugguucacagauucacgaguuaagaccgaagauacuacagcaaucuacaugaugaaaaauuuucuaagucaggugcugcaggcuauuagacucgacgagaucaggguauucggguacaccgccuggagccugcuugauggauucgaguggcaagacgcuuauacgauucggcguggucuguuuuacguggauuucaacuccaagcagaaagaacgcaagcccaaaucuagcgcccauuauuacaagcagauaaucagagagaauggcuuuucauugaaggaaaguaccccggacguccaagggcaguucccuugugauuuuuccuggggagugacagagagcguucucaaacccgaaucuguggcaucaaguccacaguucagcgacccucaccuguaugucuggaacgccacuggcaacagguuacugcaucggguggaggguguacgacuaaagacccgccccgcucagugcacagacuuuguuaauauuaaaaagcaacucgagaugcuggcgagaaugaaagugacucacuacagguucgcacuugauugggccuccgucuugccaaccgggaaccugucugcugugaaucggcaggcccuccgcuauuacagaugugucgugucggaaggccugaaacuuggaaucagcgcaaugguuacacuguacuaucccacccacgcccauuugggccucccugagccacuguuacacgcugacggguggcugaacccguccacugccgaagcauuucaggcguacgcuggacuaugcuuccaggagcucggugaucuggugaaacuuuggaucacgauuaaugaacccaacagguugucagacauauauaaucguaguggcaacgauacauacggggccgcacauaaucugcucguagcccacgcucuggccuggcgguuauaugaccgacaauuuagaccuucucagaggggagcagucagccugucccuucacgcugauugggccgagccagcgaaccccuacgccgacucacauuggcgcgcugcagagcgguucuugcaguuugaaaucgccugguucgcugagccucucuucaagaccggcgauuauccagccgcaaugagagaauacauugcgagcaagcacaggcgcggucugucuuccagugcccuaccccgacugacugaggcugagcggcgucuccugaaagggaccguggacuuuugugcccuuaaucauuucacaaccagauuuguuaugcacgaacaguuggcaggcagcagguacgauucugaccgcgauauccaauuccugcaggacauuacucgguuauccucaccgacaagacucgcugugaucccuuggggagucaggaagcugcuucgaugggugcgccggaacuauggcgacauggauauauacaucacggccagugggauugacgaucaggcacuggaggacgauagauugaggaaauauuaccucggaaaguaucugcaggaaguacuaaaggccuaccugaucgacaaagugcguauuaagggcuauuacgcuuuuaaacucgcggaggaaaagagcaaaccacgcuucggguuuuucaccucggauuuuaaggccaaauccucuauccaauucuacaauaagguuauaagcucacgggguuuucccuucgagaacaguuccucuagaugcagccagacucaggagaauacagaauguaccgucugccuguuccuugugcaaaagaaaccuuugauuuuucugggauguugcuucuuuuccacauuagugcuccugcuuucaaucgcaauuuuccagaggcagaagcgacggaaauuuuggaaggcuaaaaaccugcagcauaucccccuaaagaagggcaaacgcgucguuagcuga

SEQ ID NO: 58154 - RNA, 1857 nt, Artificial Sequence
  derived and/or modified sequence opt3 from KLC1__Homo_sapiens__NP_001123579
auguacgacaacaugagcaccaugguguauaucaaggaggauaaacuggaaaagcucacacaggacgagauuauauccaaaacuaagcaagucauccagggccuugaagcccugaaaaaugagcacaacucuauuuugcagucauuacuggaaacgcuaaagugccucaagaaagaugacgagaguaaucugguugaggaaaagagcaacaugaucagaaaaucccuugagaugcuggaauuggggcucucugaggcucaggugaugauggcacugucgaaucaucugaacgccguagagucagaaaagcaaaaacucagggcucaggugcggcgcuuaugucaggagaaucaguggcugcgagaugaacuugcgaacacccaacagaaguugcaaaagagcgagcagagugucgcccagcuggaagaggagaaaaagcaccuagaguucaugaaucagcucaaaaaguacgacgaugacauuucccccucugaagauaaagacacagauagcacuaaggaaccucuggacgaucuuuuuccaaacgacgaggacgauccgggacaggguauccaacagcagcauuccucagcagccgcugcagcccagcaaggcggguaugaaauacccgcucgucugagaaccuugcacaaucucgugauccaguacgccagucagggaagguaugagguugcggugccucugugcaaacaggcauuagaggaccuggaaaagacaagcggccaugaucacccagacgucgccaccaugcucaacauucuugcucugguguaccgggaucaaaauaaguauaaagacgccgcaaacuugcuaaaugaugcucuggccauccgcgagaagacucucgguaaagaccaccccgcgguagccgcaacacugaacaaccuugcuguucuguacgggaagagaggaaaauacaaggaagccgagccuuuguguaagagggcucucgaaauucgggagaaagugcugggcaaggaucauccagacgucgccaaacaguuaaauaaccuggcacuacucugccagaaucagggcaaguaugaggaaguggaguacuauuaccaacgcgcccuggaaaucuaucagaccaaacuugggcccgaugacccuaacguggcuaagacgaagaauaacuuggcgucuuguuaccugaaacagggaaaguucaaacaggcagagacucucuauaaggagauacugacccgagcccacgaaagagaguuugguuccgucgacgaugaaaauaaaccaauuuggaugcaugcugaggaaagggaggagugcaagggcaagcaaaaagacgggacaucauucggagaauacggcgguugguacaaggccuguaaaguugauagcccgacugugaccacaacccuuaagaaccugggggcauuguaucggcgucagggaaaauuugaggccgcugaaacgcucgaggaagccgcaaugcgcaguagaaagcagggccuggacaauguacacaaacaaaggguggcggaggucuuaaacgaucccgagaauauggaaaagcggcgaucucgcgagucccugaacguggacguugugaaguacgaaagcggcccugaugggggagaggaagucucgaugucuguggaguggaauggugacggcacugggucccuaaaaagaucaggaaguuucagcaagcucagggcuuccauccggcgcucuagcgagaaacugguaagaaaacuuaagggcgguucaaguagggaauccgagccaaagaaccccggggccagcuuggcagaaccucuguuuguugagaaugauucuucaaguagcggccucgaggacgccacagcuaacuga

SEQ ID NO: 58155 - RNA, 1410 nt, Artificial Sequence
  derived and/or modified sequence opt3 from KLF10__Homo_sapiens__NP_001027453
auggaggaaagaauggagaugaucagcgaaaggcccaaggaguccauguacucuuggaacaagaccgccgaaaagucagacuucgaggcuguggaggcacugaugaguaugagcugcuccuggaaaucugauuuuaagaaauaugucgaaaaucggccuguuacaccagugucggaccucucagaggaagagaaccuucugccgggcacucccgauuuccacacgauuccugccuuuuguuugaccccacccuacagcccuagugacuucgagccaucccagguaucuaauuuaauggcgcccgcuccuagcacagugcauuuuaagucccugucagauacugccaagccacacauagcagccccguucaaagaagaggaaaagagucccgucagcgcuccuaaacuaccaaaggcacaagccaccucugugauccgccauacagcugacgcccagcucugcaaccaccagaccugucccaugaaagcggcauccauucugaauuaucagaacaauucauuucgacguagaacucaucuuaacguugaggccgcuaggaagaauaucccuugcgccgcagugagcccaaaccggaguaagugugaacgcaauacagucgcugauguggacgagaaagccucugcggcccuguacgauuucuccguacccagcucggagaccguuauuugcagaucucaaccggcaccugugucaccccagcagaaguccgucuuggugaguccuccagcugugagcgccgggggaguucccccaaugcccgucaucugucagauggugccucucccagcuaacaauccgguagugacgacugucgugcccuccaccccuccaucucaacccccugccguuugcccacccguggucuuuauggguacacaggugccgaaaggcgcaguaauguucguugugccucagccagucgugcagagcucaaagcccccugucgugagucccaacgggacuaggcuguccccaauagccccugcucccggauuuagcccaucugcggcaaaaguuaccccgcaaaucgacucaagucggauucgcagccacaucuguucccacccuggcugcgguaagacauauuucaaaucuucgcaucugaaggcccacacccgaacgcauacuggggaaaagcccuuuagcuguuccuggaaaggaugcgagagaagguucgcucggucagaugaacucagucgucaccgcagaacacacaccggcgagaagaaauucgccugcccaaugugugacaggcgguuuaugcgaucugaucauuuaacuaagcacgcacgcagacaucugagcgccaagaaacuucccaauuggcagauggaaguguccaaauugaacgacauugcucugccuccaacacccgccccuacccaguga

SEQ ID NO: 58156 - RNA, 1539 nt, Artificial Sequence
  derived and/or modified sequence opt3 from KLF11__Homo_sapiens__NP_003588
augcacacccccgacuucgccggcccugaugacgcuagagcaguggauaucauggacauuugcgagagcauacuggaaaggaagcggcaugauuccgagcgcucuacauguucaauccucgaacagacugacauggaggccgucgaagcgcuuguuugcaugaguagcugggggcaacgaucccagaaaggagaucuguugcguauuagaccauuaacgccggugucugacucgggugauguaaccacaacugugcacauggacgcugccacccccgagcugccuaaggauuuucauucacuaagcacacucuguaucaccccaccccagaguccugaccuggucgagccauccacuaggacacccgugucuccucagguuaccgauagcaaagcaugcacggccacugacgugcuucaauccucagcugucguggcacgggcccugaguggcggggcugaacgcggauugcucggccuggagccaguaccgagcucucccuguagagccaaggguaccuccguuauuaggcacacaggggaaagcccugcggcaugcuucccaacuauccagacccccgacugucggcugucagauagucgcgagggagaggaacagcucuuaggccauuuugagacacugcaggacacccaccuuacggauucuuugcuguccacuaaccuagugagcugccaaccuugucuccacaaaucgggcgggcugcuucugacagacaagggacagcaggccgguuggccaggcgcuguccagaccugcucucccaagaauuacgaaaacgauuugccgcgaaaaacuacaccucucauauccgugucagugcccgccccaccuguccugugucaaaugauccccguuaccgggcagaguagcauguuaccagcauuccugaagcccccuccacagcucuccgugggaacgguaagaccgauucuugcucaagccgcgcccgccccucagccaguguuugucggccccgcagugccucagggugcuguuaugcugguguugccacagggggcccuacccccgccugcuccaugcgccgcaaaugucauggccgcuggaaacaccaaacugcucccccuggcgccugcacccguguucaucacaucuagccaaaauugcguaccacagguugacuuuucaaggcggcguaacuauguguguaguuucccuggcugccgcaagacuuacuuuaaauccagccaucuuaaggcccaccugagaacccauacaggcgagaagcccuucaauuguucuugggaugggugcgacaaaaaguuugcuaggucagaugaauugagucggcaccgacgcacucacaccggagagaaaaaguucgucuguccagugugcgacagaagguuuaugcggagcgaucaucucacaaaacacgcccgcagacauaugaccacuaagaaaauuccggguuggcaggcagaggucggcaagcugaacaggaucgccuccgcugaaucuccugggucgcccuuagugagcaugccagccuccgcauga

SEQ ID NO: 58157 - RNA, 1209 nt, Artificial Sequence
  derived and/or modified sequence opt3 from KLF12__Homo_sapiens__XP_011533211
augaacauccacaugaagagaaaaaccauuaagaauauaaacacauucgagaauaggaugcugaugcucgacggcaugcccgccgugcgggucaaaacugaacuucuggagagcgaacagggguccccuaacguucauaauuacccagauauggaggcugugccguuguuacugaacaauguaaagggagaacccccugaggacucucuaucaguggaucacuuucaaacgcagaccgagccagucgaccucaguaucaacaaagcacgcacaagccccacugccguguccucuucgccuguuucaaugaccgcgagcgcuaguuccccaucuagcacauccaccucaaguucuagcuccucacgacuggccagcagucccacugugauuacaucugucuccagcgcaucgucuuccucaaccgugcuuacgccugguccacugguagccagugcuagcggcguugggggacagcaguucuugcauaucauucacccggugcccccuuccucuccaaugaaucuccaaagcaacaagcugucacauguccaccguauccccguggugguccagaguguuccugugguauauacugcagugagauccccaggcaaugucaacaauaccauagugguuccccugcucgaagaugguagggggcacggaaaggcccagauggacccgcggggcuuaagcccucgccagucuaaaucagauagugacgaugacgaucugcccaacgugacacuugacagcgucaaugagacuggcuccaccgcuuugucuaucgccagagcggugcaagaaguacauccaucgccuguuagcagggugcgggggaaccgcaugaacaaucagaaguuucccugcuccauuucaccauucaguaucgagucuacacgaagacagaggcggagcgagucccccgauucacguaaacgcaggauucacagaugugacuuugaaggaugcaacaaggucuacaccaaaagcucucaucugaaggcacaccggcgaacgcacacuggugagaagccuuauaaauguacaugggaaggcugcaccuggaaguucgcccgcuccgacgagcuaacuagacauuacaggaaacacacaggggugaagccauuuaaaugugcugauugcgaccggaguuucagccgcucugaucaucucgcccugcacagaaggcgucauaugcuugucuga

SEQ ID NO: 58158 - RNA, 867 nt, Artificial Sequence
  derived and/or modified sequence opt3 from KLF13__Homo_sapiens__NP_057079
auggccgcugcagccuacguggaccacuucgcggcugagugccuggucagcauguccucuagagccguugugcauggccccagggaagggccugagucacggccagaaggagcagccguagcugcaaccccgacacucccccgcguggaggaacgacgugaugguaaggacagugccagccuuuuugucguggcuagaauccuggccgauuugaaccagcaagcgccugcaccagcccccgcugagaggcgggagggcgccgcagcucgcaaagccagaacuccuuguagguuaccacccccugcgccagaaccgacgucccccggggccgagggagcagcugccgcuccuccaucucccgccuggucggaaccugagccagaggcaggccuggaacccgagcgggaaccggguccugccgggucaggagagcccggccuacgccagcgaguuagaaggggccggagccgugcugaccucgaaaguccacagcgcaagcacaaaugccauuaugcggggugugagaagguguacggaaaauccucucaccugaaggcacaucuuagaacccacacaggugagaggccuuucgccugcagcuggcaggauuguaauaagaaauuugcucgguccgacgaacuggcccgacacuaucgcacucauaccggcgagaagaaauucucaugccccauuugugaaaagagauuuaugaggagugaucacuugacaaaacaugcacggcgccacgccaacuuccacccagggaugcuccaaagaaggggaggcgguagccguaccgggucucuguccgacuacucacggagcgaugcuaguucucccacuauauccccugccagcucgccauga

SEQ ID NO: 58159 - RNA, 972 nt, Artificial Sequence
  derived and/or modified sequence opt3 from KLF14__Homo_sapiens__NP_619638
augagcgccgcuguggcaugccuggacuacuucgccgcggagugucucgucuccaugucugcuggcgccguugugcacagaaggcccccugauccagaaggggcaggaggugccgcuggcucagagguaggggcagccccgcccgaaagugcacuuccuggaccaggucccccuggcccagccagcgugccccagcugccucaagucccagcgccgucccccggggcaggaggcgccgcuccucauuuguuagccgcaucugugugggcugaccugcggggcucgucaggggagggaagcugggaaaacaguggugaggccccacgcgcguccucuggcuuuagcgaucccaucccuugcuccguucagaccccauguucagagcuagcccccgcaaguggggcugccgcugugugcgccccggaaucuagcuccgacgcuccugccguccccucagcuccagcggcaccuggagcccccgcugccagcggcgguuucagugggggagcacucggcgccggcccagcucccgccgcagaucaggcgccucgacguagaucugugacaccagcugccaagaggcaccaguguccguuucccgggugcacuaaagcauauuacaaguccagccaucugaaaucgcaccaacggacgcauaccggagagcgcccuuucucuugugacuggcuugauugcgacaagaaauuuacaagauccgaugaacuggccaggcacuaucggacucacaccggugagaagcgcuucucauguccauugugccccaagcaguuuagucgaagcgaccaucucacaaaacacgcuagaaggcauccuaccuaccacccagauaugauugaguaucggggccgucgcagaacucccaggauagacccgccucugacauccgaaguagagucuagcgccucagggaguggaccaggccccgcaccuuccuucaccacgugucuguga

SEQ ID NO: 58160 - RNA, 1251 nt, Artificial Sequence
  derived and/or modified sequence opt3 from KLF15__Homo_sapiens__NP_054798
augguggaccaucugcuccccgucgaugagaacuucagcuccccuaagugcccaguuggcuaccuuggggacagacuggugggaaggcgggccuaucacauguugccgucucccguaucagaagaugacagugaugcuagcuccccuuguucuugcucgucaccagacagccaggcauuauguaguugcuacgguggcgggcugggaaccgagucccaagauucuauccuagacuuucuccugagccaggccacacuuggcuccggugggggaucaggcaguagcauuggcgcgucuuccgggcccguggcuuggggaccuuggcgccgagccgcagccccagucaaaggugaacacuucugucugcccgaguuuccuuugggcgauccagacgaugugccgcgucccuuccagccuacucucgaagagauagaggaauuucuggaggaaaauauggagccagggguuaaggaggugcccgaaggaaacucaaaagaccuggaugcuugcagccagcucagugcaggcccucauaagucucacuuacauccagguuccagcgggagagagagguguucgcccccgccuggaggcgccucugcuggcggggcccaaggacccgguggcgggccaacgccugacggacccaucccaguccugcuucagauucagcccgugccuguaaaacaggaauccggcaccgguccagcgucaccggggcaagcacccgagaauguuaagguggcccaguugcuggucaacauccagggccagacauucgcucuagugccucaaguggucccaaguagcaaucucaaccugcccuccaaguuuguucggauugccccugugccaaucgcagcuaaacccguaggaucuggcccgcuugggccuggaccagccggucuguugaugggccagaaguuccccaaaaauccugcggccgaacucauaaagaugcacaaaugcacuuuucccggguguagcaagauguauaccaagucaagucaccugaaagcacauuuacgcagacacacaggagagaagccauucgcuugcaccuggccuggcugugguuggagguuuucccggagcgacgagcugucucgccaucgaagaucacacaguggggugaaacccuaccagugcccagucugcgaaaagaaauucgccaggagcgaucaccucuccaagcauaucaaagugcaccgguuuccgcguucuucgcgcagcguuagauccgugaacuga

SEQ ID NO: 58161 - RNA, 759 nt, Artificial Sequence
  derived and/or modified sequence opt3 from KLF16__Homo_sapiens__NP_114124
augagcgccgcuguggcaugcgucgacuacuucgccgcggauguucugauggcuaucuccucuggcgccgugguacacagagggaggcccggaccugagggugcaggcccagccgcugggcucgacgugcgggcagcccgccgagaagcugccucaccgggaacccccggcccuccacccccuccacccgcggcaagugguccugggccaggagccgcugccgcaccgcaucuucuggcugccagcauuuuggcggauuuacguggcggccccggggccgcaccuggaggugcuuccccagccucuucgucaagcgcugccaguucccccucuagcggcagagcaccuggggccgcuccauccgcggcagccaagucacacaggugucccuuuccggacugcgcuaaagccuauuacaagaguagccaucugaaaucucaccuacggacacauacuggagagcgcccuuucgcaugugauuggcagggcugcgacaagaaauuugccagauccgaugaacucgcuaggcaccaccggacgcauaccggugagaagcgcuucucauguccccugugcagcaagcgauuuacaagaagugaccaccuugccaaacaugcaaggcggcacccaggguuccacccugaucuguugcgucgccccggagcgagaucuacuuccccaagcgacucgcuccccuguucucuggcuggcuccccugccccaucaccggcacccaguccugccccagcuggccuguga

SEQ ID NO: 58162 - RNA, 1089 nt, Artificial Sequence
  derived and/or modified sequence opt3 from KLF1__Homo_sapiens__NP_006554
auggccaccgcugagacagcacugcccagcaucuccacucucacggcccuuggcccuuucccagacacccaggaugacuuucugaagugguggagaucugaagaggcgcaagauauggggccgggacccccugacccaacagaacccccuuugcacgugaaaucagaggaucagccaggugaagaggaggacgaugaaaggggcgcugacgccacuugggauuuagaccugcuacucaccaacuucagugggcccgagccuggaggcgcaccacagacaugcgcccuggcuccgagcgaagcauccggugcccaguaucccccuccacccgagacccuuggggcuuacgccggaggcccuggccuggucgcgggguugcucggaucugaggaucauucggguuggguucggccagcacugcgcgcccgagcucccgacgccuuugugggcccggcacuggcuccugcccccgcgccagaaccuaaggcccucgcauuacaacccguauacccagggcccggagcuggcucaagcgguggguauuucccucguacuggacugagugugccagccgcuuccggcgccccguacggccuuuugucuggguaucccgcaauguacccugccccacaguaucagggacacuuucagcuguucagaggucuacaaggccccgcuccugggccagcgacaagccccuccuuucucucaugucugggaccgggcaccgucgguacggggcuuggcggaacugcagaggauccuggcgugauugccgaaaccgcuccaaguaaaagggggcggcgcagcugggccagaaagaggcaggcagcccauacaugcgcucaccccggaugugguaaaucuuacacuaaguccucacaucugaaggcccacuugcggacccacacaggcgagaaaccuuacgcaugcaccugggaaggguguggauggcgcuucgcgcgaagcgacgagcucacgagacauuauaggaagcacacuggccagcggcccuuucguugccagcuguguccacgcgcuuucaguagaucugaccauuuagcccugcacaugaaaaggcaccucuga

SEQ ID NO: 58163 - RNA, 1068 nt, Artificial Sequence
  derived and/or modified sequence opt3 from KLF2__Homo_sapiens__NP_057354
auggcccugagcgagcccauccucccuuccuucucuaccuuugcuucaccaugcagagaaaggggccuucaggagcgguggccgcgcgcagaacccgagagugggggaacagacgaugaccugaacagcguguuggauuucauuuuauccaugggucuggacggccuaggggccgaagcggcuccugagccacccccuccacccccuccaccggccuuuuacuaucccgagccuggagcaccacccccuuacucugccccagcuggcggucucgucucggaacugcuucgacccgagcuggaugcaccguuggggccugcccuccacggacguuuccugcuggcucccccaggcagacucguuaaggccgaaccucccgaggcggacggcgggggagguuauggcugugcaccaggguuaacuaggggaccccggggccugaaacgcgagggugccccugggccagcugccucaugcaugagaggaccgggcggcaggcccccuccacccccugauacgccaccccuuagcccggacgggccugcacgguugccagcucccggaccucgcgccaguuuucccccaccuuucgguggccccggguuuggagcgccaggcccgggucugcauuacgccccucccgcaccacccgcuuucgggcuauuugaugacgccgcugccgcagccgcugcgcucggccuggcaccuccagccgcucgaggacuucugacacccccugccuccccguuggaacuccuggaggcaaagccaaaaagaggcaggcggucuuggccccguaagcgcaccgccacucacaccuguagcuaugcugggugcggaaaaacauacaccaaguccucacauuuaaaggcccaccugagaacucauacaggugaaaaaccuuaucacuguaauugggauggcugcggguggaaguucgcaaggagugacgagcucacccggcacuaccgaaaacauacgggacaccgcccauuucaaugucaucuuugcgauagagcguucagcaggucugaccaccuggcuuugcacaugaagcggcauauguga

SEQ ID NO: 58164 - RNA, 1038 nt, Artificial Sequence
  derived and/or modified sequence opt3 from KLF3__Homo_sapiens__NP_057615
augcugauguucgaccccgugccugucaagcaggaggcuauggauccaguuagcguguccuacccgucuaacuauauggaaucaaugaaacccaauaaguacggcguaaucuauaguaccccucucccagagaaauuuuuccaaacacccgaagggcuuagccacgguauucagauggagccuguggaccugacugucaacaagagauccucuccacccucggcuggaaauucaccuagcaguuugaaauuuccauccucucauaggcgggcaagcccgggcuuauccaugcccucaaguagcccuccaauaaagaaguacucucccccuuccccaggggugcagcccuucggaguuccgcugucaaugccucccgugauggccgcggcucuaagccgccacggcauccgaaguccagguauucucccugucauccagcccgugguaguucaaccagugcccuuuauguauacgucucaucugcagcagccucuuauggucucccugagcgaagagauggagaacucgucuuccucaaugcaagugccagugauugaaaguuacgagaaaccgaucagccagaagaaaauaaagaucgaacccgggauugagccucagcguaccgauuauuacccagaggaaaugucucccccuuugaugaacuccgucagcccaccccaggcccuccugcaggagaaucacccgucaguuaucgugcaaccuggaaaaagaccacugcccguagaaaguccugacacacagaggaagcggcgcauucauagaugcgauuacgacggcuguaauaagguguauacuaaauccagccaccucaaggcacacaggcggacccauacaggcgagaaacccuacaagugcaccugggaaggguguacuuggaaauucgcccgcucugaugaguuaacacgacacuuuagaaagcauaccggaaucaaaccauuccagugcccugacugugauaggucauuuagucggagcgaccaccuggcccuucaccguaagcgccauauguuggucuga

SEQ ID NO: 58165 - RNA, 1440 nt, Artificial Sequence
  derived and/or modified sequence opt3 from KLF4__Homo_sapiens__NP_004226
augagacagcccccuggcgagagcgacauggccguguccgaugcucugcucccaucuuucucaaccuuugcaagugggccggccggaagggaaaagacacuucggcaagcgggugcucccaacaaucgcuggcgagaggaacugagccacaugaaacguuugccuccagucuuacccggcagaccuuacgaccuggccgcagccacuguugcuacggaucuagaguccgggggagcaggcgccgcuugcggugggucuaaccucgccccacugcccaggcgggaaaccgaggaguucaaugaccuucuggauuuggacuuuauccucucgaacucacugacacauccuccagaaagcguggcggcaacuguaaguuccucugccagcgcuuccucaaguagcucuccguccucaagcggacccgccagugcaccuucuaccuguuccuucacauauccaauucgcgcuggcaaugaucccggcguggccccugggggaaccgguggcgggcugcucuacggaagagagagcgcgccacccccgacugccccuuuuaacuuagcagacauaaaugaugucucgcccucuggcgguuucguggcugaacugcuuaggccagaguuggacccuguuuauauucccccacagcagccccagccuccagggggaggccugaugggcaaguuugugcuaaaagccucccucucagcuccggggagugaguacggaagccccuccgucaucucugugagcaaggguucaccugauggcagucacccaguaguuguggcccccuauaacgggggaccuccacggacaugccccaaaaucaagcaagaagcagucuccagcuguacccaucugggcgccgguccgccucuuucuaaugggcaccgcccagcugcgcaugacuucccccugggccgacaguugccuucaagaacgacucccacccucggacuggaggaaguguuaaguagcagggauugccacccagcacugccucuucccccaggcuuucacccgcauccugggcccaacuacccauccuuccuucccgaccagaugcagccucaagugccaccccugcacuaucaggaguugaugccuccgggaucuuguaugccagaggaacccaagccuaaacggggucgucgcucguggccaagaaagaggacagccacucauaccugcgacuacgcuggcugugggaaaacauacaccaagagcucccaccuaaaagcccaucugcggacgcacacuggagagaagcccuaucacugcgauugggacggcugugguuggaaguuugcacgaucagaugaacucacacgccauuacagaaaacacaccgggcauaggccuuuccagugccagaagugugaccgggccuuuagucgcucugaucaccuggcucuccacaugaaaagacauuucuga

SEQ ID NO: 58166 - RNA, 1101 nt, Artificial Sequence
  derived and/or modified sequence opt3 from KLF5__Homo_sapiens__NP_001273747
auggagaaguaccugacaccccagcucccuccagugccgaucauucccgaacacaaaaaguauagaagggacagcgccuccgucguugaucaauucuuuaccgacacugagggccuuccuuacucuauaaacaugaauguguuccugccagauaucacgcauuugcggaccggguuauauaaaucacagcgccccugcguaacacacauuaagacugaaccuguggcuaucuuuagucaucagagcgagaccacagcaccacccccugccccaacccaggcgcugccggaauuuacuuccauuuucucuucgcaccaaacagcugcccccgaggucaacaauaucuucauaaaacaggagcuaccuaccccagaccuccaucugucagugcccacgcagcagggacaccuuuaccaacuguugaacacuccugaucucgacaugccaagcaguaccaaucagacagcagccauggauacucugaacguuuccaugucugcugcaauggccggucugaauacccacacaagcgcugugccccagaccgccgucaagcaguuucaaggcaugccgccuuguacguauacuaugcccucccaguuccucccacagcaagcgacauacuuuccucccucaccacccaguagcgaaccugggucuccagaccgacaggcagagauguuacagaaccugaccccgcccccuuccuaugccgcuacuaucgccucaaaacuugcaauucauaauccaaacuugcccacaacccugccugugaauagccagaacauccaaccaguacguuacaauagaaggaguaaccccgaucuagaaaagcggcgcauucacuacugcgacuauccgggauguacgaagguuuacaccaaaucuucccaucucaaggcucaccugagaacacacacuggcgagaaaccuuauaagugcaccugggaggguugugauuggagguucgcccggagcgacgaacuuacacgccauuaccgaaagcacacuggggcgaaaccauuucagugcggaguguguaauagaucguucucuagguccgaucaucuggccuugcacaugaagcggcaucagaacuga

SEQ ID NO: 58167 - RNA, 714 nt, Artificial Sequence
  derived and/or modified sequence opt3 from KLF6__Homo_sapiens__NP_001153597
auggacgugcugcccaugugcagcaucuuccaggagcuccaaauuguccacgaaaccggcuacuuuuccgcccuuccuucucuggaggaauauuggcagcagacauguuuggaguuagaaagauaccugcagucagagccaugcuauguuagugcuagcgagauaaaguucgauucccaagaagaccuauggacuaaaaucauucucgcaagggagaagaaagaagagucugagcugaagaucucgucaagcccgcccgaagauacgcuuauuaguccuuccuuuuguuacaaccuggagaccaauucuuugaacagcgacguguccucagaaaguagcgauucuuccgaggaacucucaccaacagccaaauucacuagcgaccccaucggggagguacuggugaguucuggaaagcuguccagcucggucaccucuacaccuccauccucacccgagcucagucgggaaccuagccaguuaugggguugcgugccaggcgagcugccgucccccgggaagguucgcucuggaaccagcggcaaaccuggugauaaggggaauggagacgcgucaccagauggccgacguagagugcauaggugucacuuuaacggcugccggaaagucuauacuaagaguucccaucuuaaagcucaccagcgcacacauaccgggguguuccccggauugacgacuuggccuuguaccuga

SEQ ID NO: 58168 - RNA, 693 nt, Artificial Sequence
  derived and/or modified sequence opt3 from KLF7__Homo_sapiens__NP_001257871
auggacgugcuggccagcuacuccaucuuccaggagcuccaacuuguccacgauaccggcuauuuuucugcucugcccucauuggaagagacauggcagcagacuugcuuagaacuggagagauaccuacagacggaaccuaggcggauuagugagaccuucggggaggaccucgauuguuuucugcaugcaagcccaccgcccugcauagaagaguccuuccgccgacuugacccucuguugcucccaguugaagccgcgaucugugagaagucuucggcuguggauauucugcugucacgugacaaacucuuaagcgagacaugccugagucuucaacccgccuccucuagcuuggauuccuauacugcaguaaaccaggcccagcugaaugcugugaccucacuaacaccuccaaguagccccgaacucucuagacaccuggucaagaccucccagacucuuucagcaguggacggaacaguuacccugaaauugguggccaagaaagcugcccucagcagugucaaggugaggucucugaucuccgcgcauggucgggauguaagcggcguuuuacacgaggcaaugucgucucgcgggacgacuggaaacacccaagugcaguccccuucaaaugccacaacugcuaccggcgucuuuccaggucugacaauucucccgaguaccuga

SEQ ID NO: 58169 - RNA, 1080 nt, Artificial Sequence
  derived and/or modified sequence opt3 from KLF8__Homo_sapiens__XP_005262036
augguggacauggauaagcugaucaacaaucucgagguccagcuuaacagcgaaggcggguccaugcaaguuuucaaacaggugaccgccucuguaagaaauagggaucccccugagauugaauaccggucaaacaugacaaguccaacucuguuggacgcuaauccgauggagaaccccgcauuauuuaaugacauaaagaucgaaccuccagaggagcugcuagccagcgauuucucccucccccagguggaaccugucgaccugucuuuucacaaaccaaaggcgccccuucagccugcuucgaugcugcaagccccaauucgcccgcccaaaccucagucaagcccacagacguuggugguuaguaccuccacaucugauaugagcacuuccgcaaacauccccaccgugcucacaccuggaucaguccugaccaguagccagucuacugguucccaacagauucugcaugugauccacacaauaccaucaguaagccuccccaauaagaugggcggguuaaagaccaucccgguugugguccagagucugccuaugguguauacgacucuucccgccgacggaggcccagcugcaauuaccgugccuuugaucgguggggauggcaaaaacgccggaucugucaagguugaccccacauccaugagcccacuggagauucccucggauucugaagaguccacuaucgagucaggcaguagcgcucuacagucccuccaagggcugcagcaggaaccugccgcgauggcacaaaugcagggagaggaaucucuugaccugaaacgacguagaauacaucagugcgauuucgccgguuguagcaagguguacaccaaaucaagucacuugaaggcucauaggcggauucacacaggcgagaagccauauaaaugcaccugggacggguguuccuggaaguuugcccgcagcgacgaacucacgagacacuucaggaaacauacuggaaucaagccguuucggugcacagauuguaaucgcucuuucucacgaagugaccaccugagcuuacauagaaggcggcacgauaccauguga

SEQ ID NO: 58170 - RNA, 735 nt, Artificial Sequence
  derived and/or modified sequence opt3 from KLF9__Homo_sapiens__NP_001197
augagcgccgcugcauacauggacuucguggccgcgcagugccuggucuccaucucuaacagagcugccguucccgagcacggcguggcaccugaugccgaaaggcuccggcuuccagagcgcgaaguaaccaaggagcauggggacccgggagauacauggaaagacuauuguacucuggugacgauugcuaagucauuguuagaucugaauaaauaccgacccauacaaaccccuagugucugcagcgacucccuagaaucuccagaugaggacauggguucggauucagacgugacaacugagagcggcaguucccccucucacagcccugaggaacgucaggauccaggguccgcacccucaccucucagucugcuucauccaggaguugccgcuaagggcaaacacgccagcgaaaagagacauaaguguccguauucugguugcgggaaaguguacggaaaguccucacaccugaaagcgcacuauaggguccauaccggcgagcggcccuuuccuuguacauggccagacugcuugaagaaauucagccgcagugaugagcucaccagacacuacaggacucauacaggcgaaaagcaguuucgguguccccugugcgagaagcgcuucaugcgaucugaccaccugaccaaacacgcaagaaggcauacggaauuucacccuuccaugaucaagcggagcaaaaaggcccucgcuaacgccuuauga

SEQ ID NO: 58171 - RNA, 1221 nt, Artificial Sequence
  derived and/or modified sequence opt3 from KLHDC1__Homo_sapiens__NP_751943
auggccgacagccagcuguucugcguggcugaggaaagauccggccacugugcagucguugaugggaacuuucucuacguguggggagguuauguaucuaucgaggacaaugaaguguaccuucccaacgaugagauuuggaccuaugacauagauucaggccuguggaggaugcauuugauggaaggggaguuaccugccaguaugagcggauccugcggcgcguguaucaaugguaagcuguacauuuucgggggauaugacgauaaaggcuacucuaaccggcuauauuuugucaaucuccgcacacgagacgagacuuacaucugggaaaagauuacggauuucgagggccaaccaccgacaccccgugacaaacugucgugcuggguguacaaggauagacuuaucuauuuugggggauacgguuguaggcggcacucagaacugcaggacugcuucgauguucaugacgcuagcugggaggagcagauauuuuggggcuggcacaacgacgugcauaucuucgauaccaaaacucagaccugguuucaaccugaaauuaaagggggagucccaccccagccucgcgccgcacacacaugugccguguugggcaauaaggguuauaucuucgggggaagaguacuccagaccaggaugaacgaccugcacuaccugaaucucgauacuuggacauggaguggccggauuaccaucaacggcgaguccccaaagcaucgcucuuggcacacguuaacucccauagcugacgauaagcuguuucuuugcgggggauugagcgcagacaauauuccucuguccgaugguuggauccauaacguuaccacaaauuguuggaaacagcuaacucaccucccaaagacccgaccgagacuguggcacacagccugccuuggcaaagaaaacgagauuaugguguucgggggaucaaaggacgaucuguuggcucucgacaccggccauuguaaugaucuguuaaucuuucaaacgcagcccuauagucugcucaggagcugccuugacugcaucgguaagaacucuauuaugcuggaaucccagauaucauugcuaccuccaaaacugcuccagcaaguccugaagaaaaucacuuucugggccgcggcaaaccaccgggaggagcagcgugugcagaaggaagagacagaaaauaaauaccaauggauuagcaguaacuga

SEQ ID NO: 58172 - RNA, 1221 nt, Artificial Sequence
  derived and/or modified sequence opt3 from KLHDC2__Homo_sapiens__NP_055130
auggccgacggcaacgaggaucugagagcugacgaucuccccgggccugcauucgaaagcuacgaguccauggaacuugccugcccagcggagaggucuggacacguggcugucucagacggucggcauauguuuguuuggggcggguauaagaguaaucaggugcgcggacuguacgauuucuauuugccgcgagaagaguuauggaucuacaacauggagaccggccguuggaaaaagauuaauacagaaggugacguacccccuagcauguccgggucuugugccgugugcgucgauagagugcuguaucuauuuggaggccaccauucgaggggcaacacuaauaaauucuacaugcucgacucacggagcacggaucgcguucugcaaugggagagaauagacugucaggggaucccacccaguuccaaggauaaacuuggagugugggucuauaagaacaagcugaucuuuuucgguggcuacggguacuugccugaagacaaagugcucggaaccuuugaguucgaugagacaucuuuuuggaauagcucccacccaaggggcuggaacgaccauguacacauucuggacacugaaaccuucacauggucacagcccauuaccacugguaaggcaccuaguccacgggccgcucacgcaugcgccacaguugggaaucgcggauuuguguucggcggccgauauagagaugcuaggaugaacgaccugcauuaccucaauuuagauaccugggaguggaacgaacugaucccgcaggggauaugucccgucggacggagcuggcacucucuuacgccuguguccucagaccauuuguuucuguucgguggcuucacuaccgauaaacaaccacuaagcgacgccuggacauauugcaucaguaagaaugaguggauucaguuuaaccaccccuacacugaaaaaccucgucucuggcacaccgcgugugcaucugaugagggggaggugaucgucuucggaggcugcgccaauaaccugcuuguucaucaccgcgcugcccauuccaacgaaauucugaucuuuagcgugcagccaaagucguugguaagacucucucuggaggcagugauauguuucaaggaaauguuagcuaauuccuggaacugccugcccaaacaccuccuucauucagucaaucagagguuugguaguaacaauacaagcggguccuga

SEQ ID NO: 58173 - RNA, 1053 nt, Artificial Sequence
  derived and/or modified sequence opt3 from KLHDC8A__Homo_sapiens__XP_006711492
auggaggugcccaacgucaaggacuuccaguggaaaagacuggccccucucccaagcaggcggguuuacugcucccuucuggaaaccggcgggcaaguguaugcuaucggagguugugaugacaauggcguaccgauggauugcuuugagguguacucucccgaagcagaccaguggacagccuugccucgcuuaccaacugcgcgagcuggggucgccgugacggcacugggaaagcguauuaugguuauaggcgguguggggaccaaccagcuaccccucaaagucguggagauguauaauaucgaugaaggaaaguggaaaaagagaucaaugcugagggaggccgcuaugggcauuaguguaacagcaaaggacuaccggguuuaugccgcuggcgggaugggacuugaucugcgcccucacaaccauuugcagcacuacgacaugcucaaagauaugugggugagccuggccccaaugcccacuccuagauaugcggcaaccuccuuccugagggguucuaagaucuacguccucggcgggcggcaaucgaaauacgccgugaaugcuuuugagguguucgacauugaaacacgcucauggaccaaguuuccaaacaucccguauaaacgagccuucagcaguuuugucacuuuagauaaucaucuguacucccuuggaggcuugagacaggguaggcuguaucggcagcccaaguuccuacguacaauggacguuuuugauauggagcaagggggauggcucaagauggaacgcucuuucuuucugaaaaagagaagggcagacuucguggcuggcagccuuuccggccggguaauaguggccgggggacuggguaaccagccuaccgucuuggagacggcggaggccuuucacccaggcaaaaauaagugggaaauccuccccgcaaugccuacuccacgaugugcuugcucaaguauugugguuaaaaacugucuguuagccgucgggggagugaaucagggccugagcgacgcuguggaggcccucugcguaucugauuccuga

SEQ ID NO: 58174 - RNA, 1065 nt, Artificial Sequence
  derived and/or modified sequence opt3 from KLHDC8B__Homo_sapiens__NP_775817
augagcgccggcggggguagagcuuucgcauggcaaguguuucccccuaugccaaccugcagggucuacggaacaguugcccaccaggacggccaucugcucgugcuugggggauguggccgggcgggucugccguuggauacugcugagacguuagacauggccucccacaccuggcuggcacuagcuccccucccuacagcucgcgcaggggccgcugccguagugcugggaaagcagguccuugugguuggcggcguggaugaaguccagucuccaguggcggcaguagaggccuuccugauggacgaagggcgaugggagcguagagcuacuuugccccaggccgcaaugggaguugcuaccguggaaagggaugguauggucuaugcccucggcgggaugggaccugacacagcgccacaagcccaggugcggguguacgagccccgcagagauugcuggcugucacugccuaguaugccaaccccguguuauggcgcaagcacuuuucuccaugguaacaaaaucuacgucuuagggggaaggcagggcaagcugcccguuacagcuuucgaggccuuugaccuugaagcucggaccuggacgcgccacccuuccuugccaucuagacgagccuucgcaggcugcgccauggcugaggggucgguguuuucacugggaggucuacagcaacccggcccucauaauuucuauagcaggccacacuuuguaaacacuguggaaauguucgaucucgagcacgggaguuggaccaaacugccccggucccuucguaugcgcgacaagagagcggauuuugucgugggaucucugggcggucauauuguugcaauagggggcuugggaaaucagccguguccucucggcagcguggaguccuucucacuggccaggcggcgaugggaagccuuacccgccaugccaacagcacgcugcaguuguagcucucugcaggccgggccuagacucuuugucaucggagguguggcucagggccccucccaagccguagaggcacuuugccugagggacgggguuuga

SEQ ID NO: 58175 - RNA, 1827 nt, Artificial Sequence
  derived and/or modified sequence opt3 from KLHL10__Homo_sapiens__NP_689680
auggagauggaaagcgccgcugcauccaccagauuccaccagccccauauggagaggaagaugucugccauggcgugcgaaaucuuuaacgagcugcggcucgaaggcaaacuuugugacguggucauuaagguuaauggguucgaguuuucagcucacaaaaacauacugugcaguuguagcuccuacuuccgcgccuuguuuacaucuggauggaauaacacugagaagaaaguguauaauaucccugguauuucgccagauaugaugaaguuaaucauugaauacgcauauacgcgaaccguaccgaucacacccgacaacguggagaagcugcuagccgcugcagaucaauucaauauaaugggcaucguccgugggugcugugaauuucucaaaucagagcugugccuugacaacuguauuggaaucugcaaguucacugauuacuauuacuguccugagcugagacagaaagccuauauguuuauuuugcauaauuucgaagagauggugaagguuagcgcugaauuucucgagcugagugugaccgaacugaaagacaucauagagaaggaugagcucaacgucaagcaggaagacgccguguucgaggcgauuuuaaaauggaucucccacgauccacagaauaggaagcaacauauuucuauccugcuucccaaaguacgguuggcacugaugcacgccgaauacuuuaugaacaauguuaagaugaacgacuacgugaaagauagcgaggaaugcaagccugucaucauuaaugcucuaaaagccauguaugaccucaacaugaacggcccauccaauucagauuucacaaacccccugacccgcccuagacuuccauacgcaauacuguucgcuaucgguggguggaguggaggcagcccgacuaaugccauugaggcguaugacgccagggcagaccggugggugaacgugacaugugaggaagagucuccccgcgcuuaccacggcgccgcuuauuugaagggguacgucuauaucauaggagguuuugauuccguugacuacuucaauucagugaagcgauuugauccugugaaaaagaccuggcaucagguagccccaaugcacagcagaaggugcuacgucagugugacgguucucggcaacuucauuuaugcaaugggaggguuugacggcuacgugcggcugaauacugccgaacguuaugagcccgaaaccaaccaguggacauuaaucgcuccuaugcaugagcagcgcucugaugcguccgcaacuacccuguacgguaaagucuauaucugcgggggauucaauggcaacgagugucucuuuacagccgaaguguacaauaccgagagcaaccaauggacgguaauugcuccaaugagaucgaggcggucuggcaucgggguuauugccuauggagaacacguguacgcagucgguggcuucgacggggccaaucgacuucgcuccgcugaggccuacucacccguggcaaacacuuggagaacaauaccgaccauguuuaauccuaggaguaacuucggaaucgaggucguggaugaccuguuguuuguugugggcgguuucaacggguuuacuacaaccuucaauguagaaugcuaugaugagaagacggacgaaugguacgaugcgcacgacaugagcauuuaucgguccgcucuaucuuguugcgucgugcccggccuggccaacguugaggaauacgcagcccgcagagacaauuucccaggacucgcucugagggaugaggugaaauauagcgccucaaccaguacacuuccugucuga

SEQ ID NO: 58176 - RNA, 1821 nt, Artificial Sequence
  derived and/or modified sequence opt3 from KLHL12__Homo_sapiens__NP_001289980
auggacgugaacaaguucgaggccagcgucggcuuucuggauguuaaaaaguuccucuccaccuggaaacuucagaaucccagaacacacuuugugcugucuccucauugcuucaugggaggaaucauggcuccaaaggacauuaugacuaacacgcacgcaaaaucaauauugaauaguaugaacagcuuaaggaaguccaauacccugugugauguaacacuacggguggaacaaaaggacuuuccggcccaucgcaucguccucgcggcuugcucugauuacuucugugccauguuuacuucggagcugucagaaaaagguaagcccuauguggacauucagggccuuaccgcaagcacaauggagauccuguuggauuucguuuacaccgaaacugugcacgucacaguggagaacguacaggagcuccugccugccgcuugccugcuccaguuaaaagggguuaagcaagcauguugcgaauuucuggagagucagcuugacccauccaauuguuuggggauucgagauuucgccgaaacccauaacugcguggaccugaugcaggcugccgaggucuuuucucagaaacacuuccccgagguggugcaacacgaagaguuuauccuacucagccagggcgaagucgagaagcugauaaagugugaugaaauccagguugacuccgaggagccuguguucgaagcgguaauuaauugggugaaacaugcaaagaaagagcgugaagagucacuuccaaaccuguugcaguaugucagaaugccccuccugacgccuagguacaucacugaugugauugacgccgaaccauucauccggugcaguuuacaaugucgcgaccugguugaugaggcuaagaaauuucaccucagaccggagcuuaggagccagaugcaggguccccggacccgcgcccgacugggggcaaaugaaguguugcuagucgugggaggcuucggcucucaacaguccccuauagacguaguugagaaguaugauccaaaaacacaggaauggucauuucugcccagcauuacuagaaagaggcgguacguggcuagugucucucuccaugaccguaucuaugugauugggggauacgauggucgcuccagacugagcucggucgagugccuugacuacaccgccgaugaagacggcgugugguauucuguugcgccuaugaacgugaggcgggggcuggccggagcaacaaccuugggcgauaugaucuacguauccgguggguucgacggaucacgacgccacacgaguauggagagauaugauccaaauaucgaccaguggagcaugcucggcgacaugcaaacugcuagggagggcgccgggcuggucguggcuuccggaguuauuuacugcuuagguggcuaugaugggcugaacauacuaaauucuguggaaaaguacgacccccacacaggacauuggaccaacgucacuccgauggccacaaaacggagcggcgcagggguggcccuccugaacgaucacaucuauguaguggguggcuuugacggaaccgcucaucuuucaaguguugaggcguacaauauucgcacggauuccuggaccacagucacuagcaugaccacaccuagauguuacgugggcgcaacuguguugagggggcgucuguaugccaucgcuggauacgacgguaacucucuccugucaaguauagaaugcuaugaucccauuaucgacagcugggaggucguuaccuccaugggcacacagcggugugaugccggggugugcgugcuucgagagaaguga

SEQ ID NO: 58177 - RNA, 2064 nt, Artificial Sequence
  derived and/or modified sequence opt3 from KLHL1__Homo_sapiens__NP_001273654
augagcggcuccgggagaaaggacuucgaugugaaacacauccugaggcuccgguggaagcucuuuucucaucccucaccuaguaccggagguccagccggcgggggaugccugcagcaagacggcagcgguuccuucgagcacugggggccgucucagucgcgcuuguuaaaaucacaggaacgaagcggagucaguacauuuuggaagaaacccuccucuagcuccucaaguucuagcuccccuucaagcaguucuuccagcuucaacccacugaauggcacucuacuccccguugcuacgcgucugcagcaaggcgcaccugggcagggaacccagcagccagccagaacacuguuuuacguggagucgcuugaagaggaaguagugcccgguauggauuucccuggcccacaugagaagggguugguccuccaagagcugaagguggaaccggacaacucuucccaggcgacuggagagggcuguggucacaggcugguucucucaagugugagcgauuauuuugcugccauguucaccuccgacgucugcgaagcaaaacaggaggagauuaagauggaagggauagaucccaaugccuuaugggaccuggugcaguuugcuuacacaggaugucuugaguugaaagaagauaccaucgagaaccugcuagcagccgcuugccuccugcaacuuccucagguaguugaaguguguugccauuuccugaugaaguugcuccacccaucuaauugucugggcauucgggccuuugcggacgcacagggcugcaucgaguuaaugaaagucgcccacagcuauacuauggagaacauuauggaagugauccgcaaucaagaguuccugcuccuucccgcugaggaacugcauaaguugcuagccucagaugacgugaacgucccugaugaagagacaauauuucacgcacugaugauguggguuaaguacgacaugcagaguagauguaaugaccucuccaugcugcuugcuuucaucaggcugccauugcuucccccgcagauucuggccgauuuagagaaccaugcgcuguucaaaaaugaccuagaaugccagaagcucauccuggaggccaugaaauaucaccuuuugccugaacggcgcacccugaugcaaagcccccgaacgaagccaagaaaaucuacuguggggacccucuacgcaguaggagguauggauaacaauaagggcgcuacaacuauugagaaauaugaccugaggaccaaccuuuggauccaggccgggaugaugaauggacggcgucugcaguuuggcguggcugucauagaugacaaguuguucgugauuggugggcgcgauggccucaagacacugaacaccguugaauguuacaacccuaaaacgaagacuuggacaguguuacccccaaugucaacccacagacauggacugggcgucacugugcuagaggggcccaucuacgccguaggaggucacgacggcuggaguuaucucaauacaguugagaggugggauccucagagccaacaguggaccuuuguggcauccaugucuauugcccggucgacggucgggguggcugcgcugaacggaaaacuuuacagcgucggcggucgagacggguccucaugcuugaguucuauggaauauuacgauccacauaccaauaaguggaacaugugcgcaccgauguguaaacgcagaggcggagugggcguugccacaugcgacggguuccuguaugcugugggaggucacgacgcccccgcaagcaaucauuguuccaggcuccuggauuacguagagcgguaugacccuaagacugauaccuggacaauggucgccccauuaucaaugccccgcgacgcugugggcguuugccugcuuggggauagauuguacgccgugggaggcuacgacggucagacuuaucucaacaccauggaaagcuacgauccucagacaaaugaguggacccaaauggcaucucugaacaucgggagggcgggcgcuugugucgugguaaucaagcagccauga

SEQ ID NO: 58178 - RNA, 1830 nt, Artificial Sequence
  derived and/or modified sequence opt3 from KLHL20__Homo_sapiens__NP_055273
auggagggcaagcccaugagaaggugcaccaacauccggccuggggaaacaggaauggacgugacuagccgcuguacgcugggugauccaaauaaacucccggagggcgucccccagccugcccgaaugccauacauuuccgacaagcacccccgucaaacccuugaaguuauaaaccuguugagaaaacauagggaguuaugcgaugugguacugguggucggggcuaagaaaaucuaugcacaccgggugauucuaucugccuguucaccuuacuuccgcgcgauguuuacaggagaacucgcugagaguagacagacugagguugugaucagggacauugaugaacgggccauggagcugcuuaucgacuucgcauauaccagccagauaacagucgaagagggcaaugugcagacccuguugccagccgcuugccuccugcaacuggcagagauccaggaagccuguugcgaguuucucaagcgccaguuagaucccuccaacugucuggguauucgagcuuucgccgacacucauucuugcagagaacuuuugaggaucgcggauaaguuuacacagcacaauuuccaagagguaauggaaucggaggaguuuaugcugcuaccugcaaaccagcucauugacaucauaucaagcgaugaacugaauguucggagugaggaacagguguucaacgccgucauggcuugggugaaauacuccauucaggagcgucgcccacaacuuccccaggugcugcagcaugucagauugccccuccugucuccuaaguuuuuaguugggaccgugggaagcgacccacugaucaaauccgaugaagaguguagggaccucguagacgaggccaagaauuaucuucuguugccccaagaacggccucuaaugcagggcccacgaacgcgccccagaaaaccgauuaggugcggcgaggugcuguucgcagucgggggaugguguucaggugaugcuaucaguagcguggaacgguacgacccucagacuaacgaguggcgcaugguugccucuauguccaagagaaggugcggcgugggggucucagugcucgaugaccugcuuuaugcgguaggaggccacgaugguagcaguuaccugaacucuguugaacguuacgaccccaagaccaaucagugguccagcgauguggccccaacaucgacuugccggaccucugucgggguggcagucuugggaggcuuucucuaugcugugggcgggcaagacggaguuuccugucugaauaucguggagcgauacgauccuaaagagaacaaguggacaagaguagccucaaugaguaccaggcgcuuaggugucgcuguggccguucugggcggguuccuauaugcagugggaggcagcgacgguacguccccgcucaauacugucgaacgguacaacccacaggagaacagauggcacacaauugcccccauggggaccaggcgcaaacaucugggcugcgcuguguaucaggauaugauauacgcgguaggaggccgagacgacacuacagaacuuucuagcgcagagcgguauaauccucguaccaaccaguggucaccagugguugccaugacgaguagaagguccggggucggauuggcuguggugaauggucaacugauggccgucggcggguuugauggaaccacauaccucaagacuaucgagguuuucgacccggaugcaaacaccuggcgccuguacggcgguaugaauuaucggagacuugggggcggagugggcgugauuaaaaugacacacugugaaagccauaucugguga

SEQ ID NO: 58179 - RNA, 1770 nt, Artificial Sequence
  derived and/or modified sequence opt3 from KLHL25__Homo_sapiens__NP_071925
augagcguguccguccacgagaccagaaagucuaggucaaguacaggcagcaugaacguuacucuguuccauaaagccucccaccccgacugcgugcucgcucaucuuaauacgcugcggaagcacuguauguuuaccgauguaacauugugggcaggggaccgcgccuucccuugccaucgagcgguguuagcugccucuucgcguuacuuugaagcaauguucucacacggacugagagagagcagggaugacacugucaacuuucaggauaaucuacacccagaagugcucgagcugcuucuggacuucgccuauaguucccggaucgcuauuaacgaagagaaugcagagucuuugcucgaagccggugauaugcugcaauuucaugacguucgcgaugcugccgcggaguuccuggaaaagaaccucuuuccgagcaauuguuuaggcaugaugcugcuuuccgacgcacaccagugcagaagguuguacgaguucucauggcggaugugucuggugcauuuugagaccguccgccagagugaagauuucaacagccuaucuaaagacacacuccuggaucuuauauccucagacgagcuggaaaccgaggacgaacgagugguauuugaggccaucuugcaguggguuaaacacgaucucgagcccagaaaggugcaccuuccugaauuacugaggagcguccggcucgcucugcugccaagugacugcuugcaagaggccgugucuuccgaagcacuacugauggcugaugagcguacuaagcucauuauggacgaagcccugcgcuguaaaacaagaauccuucagaaugaugggguggucaccagccccugcgcgaggccucggaaggccggacauacgcuguugauucucggcggucagacuuucaugugugacaaaaucuaucagguugaucacaaggcaaaagagauaaucccaaaggcugaccugcccucgccucgaaaggaguucucugccuccgcuauugggugcaaaguguacguaaccggaggccgcggcucagaaaacggggugaguaaggaugucuggguguaugacacaguucaugaggaauggagcaaagccgcaccaauguuaaucgccagauuuggacacgguuccgcugagcuggaaaauugucuauacguggucggcgggcauacuucucucgcgggaguguucccggcaagccccucaguaagucugaagcaaguugagaaauaugauccuggcgccaacaaguggaugaugguggcuccacuuagggacggugucuccaaugccgcaguggucagcgccaaauugaagcuguuuguguucgggggaaccucuauucaccgggacaugguuucaaaggugcagugcuacgaucccagugagaaccgcuggacaaucaaagcugaaugcccucagccauggagauacaccgccgcagcgguacucggcagccagauauuuauuaugggcggggacacggaguucacugcugccuccgcauauagguuugauugugaaacaaaucaauggacccguaucggagacaugacugccaagcggaugucuugccacgcucuggccucggguaacaaacuuuacgucgugggcggguauuucggaacacagcgauguaagacccuggauugcuacgaccccacgagcgauaccuggaacuguauuacaacuguuccguauuccuugaucccuaccgcauuugugucaacauggaaacaucuccccgcuuga

SEQ ID NO: 58180 - RNA, 1848 nt, Artificial Sequence
  derived and/or modified sequence opt3 from KLHL26__Homo_sapiens__NP_060786
auggccgagagcggcggguccucuggaggugcuggcgggggaggcgcauucggugccgggcccggaccugaaagaccaaacucaaccgcggacaagaauggcgcucugaaaugcacauuuagugccccgagccacuccacuucucuccuucagggccuggcaacguugagggcccaagggcaguuacuggaugugguccuaaccaucaaccgggaggcuuuccccgcacauaagguugugcucgccgcuuguucggacuacuuucgcgccauguucacaggagguaugcgagaagcgucacaggauguaauugagcugaaaggcgugagcgcacgugggcuuagacacauaaucgacuuugccuauagugcugaagucacucuggauuuggacugcgugcaggauguucucggagccgcaguguuccugcaaaugcugccugucguggagcucugugaggaauuuuuaaaggcugccauguccguagagaccugccugaauauuggccagauggcgacaaccuucucucuugccagcuugagggaauccguugacgcauuuacuuuccggcauuuucugcagaucgcugaggaggaagauuuccuacgccucccacuggagagacuuguguuuuuccugcagucaaacagguugcaaaguugugccgaaauugaccucuuccgggcugccguccgcuggcugcagcacgaucccgcacgaagaccuagggccagccauguguuaugccacauccgguuuccacugaugcagucuuccgagcucguggacucaguccagacacuugauauaaugguugaagacgugcugugucgucaauacuugcuagaggcuuucaauuaucagguacugcccuuucgccagcacgagaugcaaagcccuagaaccgcggugaggagugacgucccaucucucgugacguucggugggacuccguacaccgauuccgaccggagcguuucgucuaaaguguaucagcugcccgaaccuggagcacgacauuuucgcgagcuuacagaaauggaggucggcugcucccacacuuguguggccguacuggauaacuucguuuacguggcuggcgggcagcauuugcaguauagaucaggagaaggugccgucgacgcaugcuacagguacgauccacaccucaaucgguggcugcgcuuacaagccaugcaggagaguagaauccaguuucagcugaacgugcuauguggcauggucuaugcuaccgggggaaggaaucgugccggcagccucgcauccguggagcgguacugcccccgaagaaacgaaugggguuaugcgugcucucugaagaggcgcacaugggggcacgcuggcgccgcaagcggaggccggcuuuacauuucagggggauaugguaucaguguugaggacaagaaagccuugcauuguuacgauccuguggcugaccaaugggaguucaaggccccaauguccgaacccagaguacugcacgcaauggucggcgcugggggaaggauuuaugcccucggcggucgcauggaucauguggaccgaugcuuugauguucuggcgguggaauacuacgucccggagaccgaccaguggacgagcgugucuccuaugcgggccgggcagucagaggcuggcuguugccuucuggaacguaaaaucuauauaguaggaggcuacaauuggagauugaacaaugugacugggauuguucaggucuauaacacagacaccgaugagugggaaagggaccuccacuuccccgagaguuuugcaggaaucgccugugcuccagugcuguuaccucgcgccgguacucggagauga

SEQ ID NO: 58181 - RNA, 2628 nt, Artificial Sequence
  derived and/or modified sequence opt3 from KLHL29__Homo_sapiens__NP_443152
augagcagacaccauuccagguucgagcgggacuaccgcgugggcugggaucgacgugaauggucugucaacgggacccacggaacaacuucaaucugcaguguuacgagcggugccggcgggggaaccgcuuccucucugucggugagacccggccuccuuccucugccaguagugccgucaagguugcccacacccgcaacugccccagcgcccuguaccacagguagcagugaggcuauuaccuccuuagucgccucuagcgcauccgccgugacuacaaaggcuccugggauaucaaaaggagacagucagagccaaggccuggcaaccucuauccgguggggccagacgccaauuaaucaguccacucccugggauaccgacgaaccuccaucaaagcagaugcgcgagagcgauaacccggggacaggacccuggguuacuaccguggccgcugguaaucaaccuacacuaaucgcccauaguuauggcgucgcgcagccacccaccuuuucuccugcagugaacguacaggccccaguuauuggggugacgcccucccucccgccucacgucggaccccagcugccacuuaugccuggccauuacagccugccccaaccacccucgcagccuuugucuuccgugguggucaauaugccagcucaggcccucuaugcaucaccgcagccccuggcuguuaguacucugccugguguggggcaaguagccagaccaggacccacagcggugggcaacggccacauggccgggccucucuuaccacccccgccuccagcacagcccagcgcuacccugccuuccggagcccccgcuacuaaugguccaccuacaaccgacucugcccacggccuucagauguugaggacgaucggggucggaaaauacgaguucaccgaucccggccauccacgggagaugcugaaggagcuaaaccaacagcgccgagcaaaagccuuuacagaccucaagauagugguugaagguagagaguucgaagugcaccagaauguccuggcuagcugcucacuuuauuuuaaggaucugauccagaggagugugcaagacuccgggcagggcggacgggagaaauuggagcucguacugagcaacuuacaggcggauguucuggaacuccuucuggaguucguguacacuggcucuuuggucauugacucagcaaaugccaagacccuacuggaagcugccaguaaauuucaguuccauacauuuuguaaggugugcgucagcuuccucgagaaacaacugacugcauccaacugucuuggggugcuggccauggcugaagccaugcagugcucugaguuguaucacauggcaaaggcguuugcucuccagaucuucccggagguugccgcacaggaagagauucugucgaucagcaaggaugacuuuauagccuacguguccaaugacucauuaaacaccaaagcugaagaacugguauacgaaacagucauuaaguggaucaaaaaggauccugccacccguacucaauaugcagcugagcuacucgccgugguucgccugcccuucauucacccaaguuaccuuuugaauguggucgacaacgaggaacugaucaaaucuagcgaggcguguagagaucucgugaacgaagccaagagguaucauaugcugccccacgcucggcaggagaugcagacgccucgaacacgcccaagacuuuccgcaggaguagccgaagugaucguucuggucgguggcaggcagaugguggggaugacccaacggucauugguggcugucacuugcuggaauccccagaacaauaaaugguacccucucgccagccugccguucuaugaccgcgaguuuuucucuguuguguccgcaggagauaacauuuacuuaaguggcgguauggagagcggggugacccuggcggacguaugguguuauaugucucuacucgauaauuggaaccuggucuccagaaugacagugccaaggugccgucauaauucacuuguuuacgacggcaagauauacaccuugggaggccuggggguggccggaaacgucgaucacguggaacgguaugacacuaucacaaaucagugggaggcuguugccccucucccuaaggcagugcauagugcugccgcaacgguaugugguggcaaaauuuacgucuuugggggagugaacgaagccggccgagcugcgggugugcugcaaagcuaugucccacagaccaauacuuggucguucaucgagucccccaugauagauaacaaguacgccccugcaguuacauuaaauggguuuguguucauucugggcggagcuuaugccagagccaccacaaucuacgacccggagaaaggcaacaucaaggcugggcccaauaugaaccacucuaggcaguuuugcagcgcaguagugcuugacggaaaaauuuaugccacuggcgguaucgucucaagugaagggccagcguugggaaacauggaggcuuacgaaccuaccacgaauaccuggacacuccugccccacaugccaugcccuguguuccgccauggcuguguugugauuaagaaguacauacaguccgguuga

SEQ ID NO: 58182 - RNA, 1794 nt, Artificial Sequence
  derived and/or modified sequence opt3 from KLHL2__Homo_sapiens__NP_001154993
augguguggcuggaggccagaccccagauccucuucgucugcaccaagcaaggccaccagaaaccucuugacagcaaggaugacaacacagaaaaacauuguccaguuacugugaauccguggcacaugaagaaggcuuuuaaaguaaugaacgagcugaggucccagaauuuguuaugcgaugugacgauugucgcagaagacauggagauaucugcccaucgggugguucuggcggcuuguucacccuacuuccacgccauguuuaccggggaaaugagugagagccgcgcaaagcgagugcguaucaaagaggucgauggauggacacuaagaaugcucauugacuauguguacacugccgaaauccagguaaccgaggaaaacguucaagugcugcuuccugcugcaggucuguugcagcuccaggaugucaagaaaacaugcugugaguuccuggagucccagcugcauccagugaauugccucggcauuagggccuuugcugacaugcacgccuguaccgauuuacugaacaaggcgaauacuuaugcagaacaacacuucgccgacgugguccuuucugaggaauuuuugaaccuggggaucgagcagguuugcucgcuaauaucaagcgauaaacucacaaucaguuccgaagagaagguguucgaggcuguaauugccugggugaaucaugacaaggauguccggcaggaauuuauggcacgccugauggagcacgugagacuuccccuguugccuagggaauaccucguucagcggguggaggaagaggcucuggucaaaaacucuagcgccuguaaggacuauuuaaucgaggcgaugaaauaccaucugcucccaaccgaacaacgcauucuuaugaaguccgugcgaacgagacugaggacucccaugaauuugccuaaacuaaugguaguugugggaggccaggccccaaaggcaauccggucagucgagugcuaugacuucaaagaggaacguuggcaccagguggcugaacugccgagucgcagauguagggccgguauggucuacauggcugggcucguguuugccguuggaggcuucaacggcagccugcgggugcgaaccguagauucuuacgaccccgucaaggaucaauggacauccguggcaaauaugcgcgacagaaggucaacucuuggggccgcuguucugaacggauugcucuaugcgguggguggcuuugaugggagcaccggacugaguucugucgaggcauacaauauaaaguccaacgagugguuccacguggccccuaugaacacacggcgcagcucgguaggcguggguguugucgggggauuacuguaugcugugggcggcuacgacggggccucuagacagugccuauccaccguggaaugcuauaaugcaacgacuaacgaguggacauacauugccgaaaugucaaccaggcguaguggagcuggugucggcguucucaauaaccugcuuuaugccguagggggacaugauggcccauuggugcggaaaagcguggaggucuacgaccccacuacaaaugcauggcgacagguggcggauaugaacauguguagaaggaaugcugguguuugcgccgugaacgggcugcucuacgucgugggcggagacgauggcuccuguaaucuggcaucuguugaguauuacaacccuaccacggacaaguggaccgugguaagcucaugcaugaguacagggcgcuccuaugccggagucacugugaucgacaaaccacuuuga

SEQ ID NO: 58183 - RNA, 1905 nt, Artificial Sequence
  derived and/or modified sequence opt3 from KLHL31__Homo_sapiens__NP_001003760
auggcccccaagaaaaagaucgugaaaaagaacaaaggcgacauuaaugagaugaccauaaucgucgaagauagcccucugaacaagcucaaugcucuuaacgggcuguuggagggagguaauggcuuauccugcauuucuucagaacugacagacgcaaguuacgggccaaaccuacucgagggacugagcaagaugagacaggaaaauuuccuuugugaucugguuaucggcacuaaaacgaaguccuuugacgugcacaaaucuguaauggccucgugcucagaguauuucuacaacauuuugaagaaagauccgagcauccaaaggguggaccucaaugauauaaguccccugggucuggcgaccgucaucgcuuaugccuacacagggaagcucacuuuaucccuguauaccauuggaucuaucauuagcgcagccguguaccuucagauccauacauugguuaagauguguuccgacuuucugauacgggagaugucaguggaaaacugcauguaugucgugaauauugcugagaccuacagucucaaaaacgcaaaggccgcugcccagaaauucauccgcgauaauuuucuagaguucgcggaaagcgaccaguuuaugaagcugacuuucgagcaaauuaacgaacuucugaucgaugacgauuugcagcucccuucugagaucguagcauuucagauugccaugaaauggcuggaguucgaccagaagcgaguuaaauacgcugccgacuuacuguccaauauacguuuuggcacaaucucagcacaagaucucgugaacuauguccagagcgugccaagaaugaugcaggacgcugauugucacaggcuucugguggacgccaugaacuaccauuugcuacccuaucaccagaauacccugcaaagucggcgcacgagaauuaggggcgggugccggguccucguuacugugggaggucgcccuggccugaccgaaaagucucuuucccgagauauccuguacagagacccagaaaacggguggagcaaguugacagagaugcccgcgaaaucguucaaucaguguguagccgugauggauggauuucucuaugucgcaggcggugaggaccagaacgaugcuaggaaucaagccaagcaugcugugucuaacuucugccgguacgacccucguuucaauacuuggauacaccuggccuccaugaaccagaaacgcacccacuuuucauuaaguguuuucaaugggcugguguaugcagccggaggcagaaacgcugaaggcagccuagcgucccucgaguguuacgucccaucuacaaaucaguggcagccgaagacgccccuggaaguggcaaggugcugucaugccagcgcuguagccgaugggcggguucuugugaccggagguuacauugcaaacgccuauucacgaagugucugcgcuuacgacccugccuccgacagcuggcaagaguugccaaaucugucuacuccccgcggcuggcacugcgcagugacacucucagauagagucuaugugaugggagggagucagcugggcccuaggggugaacggguugacgugcuuaccguagaguguuacagcccagcgacugggcagugguccuaugcugcaccccugcaggucggcgugucuacagccggaguuucggccuugcauggccgcgcuuaccucgucgggggauggaacgagggugagaaaaaguauaagaaaugcauccaauguuuuagcccggaacugaaugaauggaccgaggaugacgaauuaccugaggccacggugggcguguccugcuguacccugucaaugcccaacaacguaacaagagagaguagggcaucuagcguguccucaguuccagucagcaucuga

SEQ ID NO: 58184 - RNA, 1752 nt, Artificial Sequence
  derived and/or modified sequence opt3 from KLHL35__Homo_sapiens__NP_001034637
augagacagggccacgcccccgaggaaagcgagccugggugcgaagcuccaugugcaggaccgugccaugcccaaagggugcugcaggcgcucaacgcuuaccggcgcuccgguacccuuacagacgucguucugcgagccggcgggcgugauuuccccugucacagagcagccuugucugcuggaucagcauauuuuaggaguuuauucgccgcuggccggccugagcgcgguccagccgugguacccguggucccuguggcgccagaagcacccgggacuagcccugccggagcugccgcagcucuggccguugugcuagacuacgucuauggcgcgggcgugagacucagggccgaggaugaggcagcugccguacuggcucuugccgaacggcuggggguugcaggauugcgcgaggccugcgugcgauuucucgaagguagacugagggcugcaaauucccuggcgcuccggcgugucgccgcugccuucucuuuagcaccacuggccgagcgcuguggcagagugcuuaggcaggcuuuugccgagguggcacggcaugcggacuucuuggaacuggcuccggaugaggucguugcccuacucgcagaccccgcccuggggguggcucgagaagaggccguauuugaagcagcuaugcgcugggugagacacgaugccccugcgaggcggggacagcuucgcagacuguuggagcaugucaggcucccacuguuagcccccgcuuacuuccuggagaagguggaagcagacgagcuccuucaagccugcggcgaaugucguccucuguugcuagaggcucgggccugcuuuauccugggucgagaagcaggggcgcucagaacgaggccacgccgguucauggaucuggccgagguuauuguggucauaggaggcugugacagaaaaggccuucugaaguugcccuuugcugaugccuaucacccggagucgcagagguggaccccucuccccucacugccaggguacacacgcagcgaguucgcagcuugcgccuuacgaaacgacguguauguaaguggaggucacaucaauucccaugauguuuggauguuuucuagccaccuccauacuuggauuaaaguggcaucccuacacaagggccgguggcgucacaaaauggccgucgugcaggggcagcuguucgcugucggaggcuucgacggucugagaaggcuucauucaguggaacgcuacgacccuuuuaguaacaccugggcggccgcagcucccuugccagaagccguuagcucugccgcuguggcauccugugccgggaagcuguucguaaucggcggagcgcggcaaggcggggucaauacagauaaggugcagugcuuugaccccaaagaggauagauggucacucaggagcccugcuccauucagucagcgaugccuggaagccguuucucuugaggacaccauuuacgugaugggaggucugauguccaagaucuuuacuuaugauccgggcacagacgucuggggagaggcagccguguugcccagcccuguagaaucguguggggugaccguuugcgauggcaaaguccacauacucggugggcgcgacgaucggggcgagucuacggacaagguguucacuuuugauccauccucaggacagguggaaguccaacccagucugcagagauguaccagcucccauggcugcguuacaaucauucagucuuuagggagguga

SEQ ID NO: 58185 - RNA, 1668 nt, Artificial Sequence
  derived and/or modified sequence opt3 from KLHL3__Homo_sapiens__NP_001244123
augggcaaggccuucaaagugaugaacgagcugagaagcaagcagcuccuuugcgacgucaugaucguugcugaagauguggagauugaagcacacaggguagugcuggccgcguguucccccuacuuuugcgcuauguucaccggggacaugucugagucaaaagccaagaaaauagaaaucaaggaugucgacggacaaacauugaguaaguuaauugauuauaucuacacugcagagauugaggugacggaagagaauguucaggugcugcuaccugccgcuagccuccugcagcuuauggacguccggcagaacuguugcgauuuucugcaaucccaguugcauccaaccaauugucucgguauccgcgcauucgccgacgugcacacaugcacugaucugcugcagcaggcuaacgccuaugcggaacaacauuuuccggagguaaugcucggcgaggaguucuuaucucugucgcuugaccagguuuguucauugauaagcagugauaaacugaccguguccucugaagaaaaggucuuugaggcagugaucagcuggauuaauuacgaaaaagagacacgacuagagcacauggccaagcucauggaacaugugcgucugccccuucugccuagagacuauuugguccagaccguugaggaagaggcucucaucaaaaacaauaacacuugcaaggauuuccugauugaagccaugaaguaccacuuacugccacucgaccagaggcuucugaucaaaaauccccggacaaagccucgcaccccaguguccuugcccaaaguaaugauaguggucgggggacaagcaccuaaggcuauuagaucaguggaguguuaugacuuugaggaagauaggugggaccagaucgccgagcuaccaagucggcgcugccgagcgggcguuguguucauggccggucacgucuacgcaguagggggauuuaacggcagccugagagugaggacgguugauguguacgacggcgucaaagaucaguggacuucuauugcuuccaugcaagaacggcguucaacccucggggccgcugugcugaaugaccuucuguaugccgucggagguuucgauggcagcacaggguuggcaaguguggaggccuacucuuauaagacuaacgaaugguuuuucguugcuccgaugaauacccgcagauccagcgugggaguaggcgucguggaggguaaacucuacgcgguugggggauaugacggcgcaucgaggcagugucugucuacaguggagcaguacaaccccgccaccaaugaauggaucuaugucgcugauauguccacgcggcgaucaggcgccggggugggaguauuaaguggucagcuguacgcaacuggcgggcaugacggaccucuagugcgcaagagcguugaggucuacgauccaggcacaaacaccuggaagcaaguggccgacaugaacaugugcagaaggaaugcuggugugugcgccgucaacgggcuccuguauguugugggcggagacgauggcuccuguaaucuugcaucuguggaauacuauaaccccguaacugacaaauggacauugcugccuaccaauaugagcacggggcggucauacgcgggagucgcugugauccacaagagucucuga

SEQ ID NO: 58186 - RNA, 1866 nt, Artificial Sequence
  derived and/or modified sequence opt3 from KLHL40__Homo_sapiens__NP_689606
auggcccugggccucgagcaggcugaggaacaaagacuuuaccagcagacccuguugcaggacggguuaaaggauaugcuggaccacggaaaauuccuagauugcguggucagggccggugaacgggaguuucccugucaucgccucguucuggcagcgugcagcccuuauuuccgagcucguuuucuugccgaaccagagagagcaggcgagcugcacuuggaagagguguccccggacguaguggcccaaguccuccauuaccuguauacaucugaaaucgcucuggaugaggcaucagugcaggaccucuucgccgcugcccacagguuucagauucccaguauauucacuaucuguguuagcuuuuuacagaagcggcugugccuuuccaacuguuuggcgguguuccgccuggggcuacuccuggauugcgcaagacuugccgucgcugccagggacuuuauuugugcacauuucacgcugguggcucgggaugccgacuuuuugggacucucugcggaugagcugaucgccauuaucucgucagacggcuuaaauguagaaaaagaggaagcaguuuucgaggcugugaugcgcugggccgguagcggggaugcugaagcccaagcagagcgacagagagcccugccuaccgucuuugagagugugaggugccggcuccuuccacgugcuuuccuggaaucccgcguggagagacaccccuuggucagggcgcagccugaacuacugcggaagguucagauggugaaagacgcacacgagggacgaauaacaacucuccgcaagaagaaaaagggcaaagacggcgccggggcuaaggaagccgauaaaggaaccucuaaggcaaaggccgaggaggacgaagaggcugaaagaauccugccagguauucuuaacgauacacugagguucggcauguuuuugcaagaccucaucuucaugauuagcgaggaaggggccguagcauacgaucccgcggcuaaugaguguuauugcgccucccugucaaaccaggugccuaaaaaucaugucaguuuagugaccaaggagaaccagguuuuuguggcaggaggccuguucuacaaugaagacaacaaagaggauccaaugagcgccuauuuucuacaauucgaccaccucgauucugaauggcuggguaugccgccccuuccuuccccacgguguuuguuugggcugggagaggcucucaauucaaucuacgucgugggcggccgcgagauaaaggacggggaaagaugccuggauagcguaaugugcuacgacaggcuuaguuucaaauggggagagucugacccccugccuuauguuguguacggucauacugucuugucccacauggaucucguguaugucauuggcgggaagggaagcgaccguaaaugucugaacaagaugugcguguacgauccaaagaaauuugaauggaaggaguuagcccccaugcagacagcacggucgcuguucggcgcuaccguucacgacggucgaaucauuguggccgcggggguaacggauacuggccuaaccucuuccgccgaagucuauucaaucacagacaauaaaugggcuccguuugaggcauucccucaggagagaaguagccucucccuggugucucuuguuggaacuuuguacgccaucggcggguuugcuacccuggaaacagagagcggagaacucgugcccaccgagcugaacgauauuuggagguauaaugaagaggagaagaaaugggaaggugucuuacgcgagauagccuacgcagcgggcgccacguuccugccagugcggcuuaacguauugugucucacuaagauguga

SEQ ID NO: 58187 - RNA, 1821 nt, Artificial Sequence
  derived and/or modified sequence opt3 from KLHL41__Homo_sapiens__NP_006054
auggacagccagagagagcuggccgaagaacucaggcuuuaccaauccacccuguugcaggauggcuuaaaggaccugcuagaugagaaaaaguucaucgacugcacacucaaagcuggggauaagucucugcccugucaccggcuuauucugucagcaugcaguccuuauuuucgcgaguacuucuugagcgaaauagacgaggccaaaaagaaggaggugguccucgauaacguugacccagcgauccuggaucugauuaucaaauaucucuacuccgcuucuauugacuuaaaugauggaaacgugcaggacaucuuugcccuggcaucgcgauuccagauaccgucaguauuuacugugugugucagcuaucuucaaaagcguuuggcccccgguaauugccuggcuauccuaagacucggccugcuucuggauuguccuagguuggcaauuagugcccgggaguucguguccgaccgcuuuguucagaucugcaaagaagaagacuucaugcagcucucuccacaggagcugauuagcgugaucuccaacgauucauuaaaugucgagaaggaagaggcuguguuugaagccguaaugaaauggguuagaacggacaaggagaacagggugaagaaucugagugaagucuucgauuguauacgguuucgccucaugaccgagaaauacuucaaggaccauguggagaaagaugacauuaucaagagcaaccccgaucuucagaaaaagauuaaagugcugaaggacgcguuugcagggaaguugccugaaccaucuaaaaaugccgcuaagacaggagccggcgaggucaacggugauguuggggacgaagaucuacugcccggauaucucaaugacaucccucgacacggcauguucgugaaagaccugauccuucugguaaacgauacugcagcuguggccuacgacccaaccgagaaugaaugcuacuugacagcgcucgccgagcaaauuccgagaaaccauuccucaauagucacccagcagaaucaaaucuaugugguuggcgggcuguacguggaugaggaaaacaaggaccagcccuuacagagcuauuucuuucaacuggauaguauugcaucugagugggucggacuaccuccacuccccuccgcuaggugucuguucggucuuggcgaaguggacgauaaaaucuacguaguugccgggaaggacuugcagacugaggcuagccuggauucggugcucugcuaugacccugucgccgcaaaguggaacgaagugaaaaagcugccaauaaaagucuacggacacaaugugauuucucauaagggcaugaucuauugucuuggugggaaaacagaugacaagaagugcaccaaccggguuuuuaucuucaaucccaaaaagggagauuggaaagaccuggccccgaugaagauuccucguuccauguuuggcguggcuguacacaaaggcaagaucgucauugcagggggagugacggaggacgguuugucagcgaguguugaggccuucgaucucacuaccaacaagugggacgugaugacagaauuuccccaggagcgcagcuccauaucucuggucagcuuagcuggcucacuguacgccaucgggggauucgcaaugauucagcuagaaaguaaagaguuugccccaacugaggugaaugauaucuggaaguacgaagacgauaaaaaggagugggcuggcaugcucaaagaaaucagauaugccuccggugcaagcugccuggcgaccaggcuuaacuuguucaagcugucuaaacucuga

SEQ ID NO: 58188 - RNA, 1518 nt, Artificial Sequence
  derived and/or modified sequence opt3 from KLHL42__Homo_sapiens__NP_065833
augagcgccgaggaaauggugcagaucagacuggaggacaggugcuaccccgucuccaagcggaaacucauugaacaaucugauuauuuccgcgcucuuuaccgaucaggcaugcgugaggcacugagucaggaagccgggggaccugagguucagcaguugagagguuuaagcgcgccaggccugaggcuagugcucgacuuuauaaacgcugggggagcccgggagggcuggcugcuugguccgcgcggggaaaagggaggcggcguagaugaggacgaagagauggaugaggugucccuguugucugaacucgucgaggcagccucguuccugcaagugaccucacugcuccaguuacugcuuagccagguuagauugaauaacugucuggaaauguauaggcuagcucagguguacgggcuccccgaccugcaagaggcaugccuucgguuuauggucgugcacuuccaugaaguacuguguaaaccucaguuucacuugcucggaaguccaccccaggccccuggugauguuucccugaagcagcgcuuacgagaggcuagaaugacaggcacuccagugcuggucgcccucggggacuuccuuggaggcccccuggcgccucauccauaucaaggugagccgcccucuauguugagguacgaagagaugacggaacggugguuuccucuagcaaauaaccugccacccgaucucgugaaugugcguggguauggaagcgccauccuggacaacuaccuuuucauugucggcggcuaccgcaucaccucccaggagauuucagcugcccacaguuauaauccuagcacaaacgaauggcugcagguugcaucuaugaaucagaaaagauccaacuuuaaguugguggcuguaaauucaaagcucuacgccaucgggggacaagcggugagcaacgucgagugcuauaauccagagcaggaugccuggaacuucguggcaccccugccgaauccuuuagcugaauuuagugccugugagugcaaagguaagauauacguuaucggcggguauacuaccagggaccggaacaugaacauucugcaguacugucccucuuccgauauguggacacuauucgaaaccugcgacgugcauauccgaaaacaacagauggucagcguggaggaaacuauuuauaucguaggaggcugucuccacgagcuggguccaaaucgcagaucgucucaguccgaggacaugcuuacaguucagucauacaacaccgugacgaggcaaugguuguaccugaaggaaaauaccaguaaaagcgggcucaaccugacuugcgcucugcacaaugauggcauauauauuaugucccgggacgucacacuuucuacuagcuuggagcaucgcguguuucucaaguacaacaucuucucagauaguugggaagccuucagaagguuuccugcauucggacacaaucuguuagucuccagccuguaucuacccaacaaggccgagaccuga

SEQ ID NO: 58189 - RNA, 2130 nt, Artificial Sequence
  derived and/or modified sequence opt3 from KLHL5__Homo_sapiens__NP_001007076
augagcggcuccagaaaggaguucgacgugaaacagauccugaagauuagguggcggugguuugggcaccaagccucuucacccaacaguaccgucgauagccagcagggagaguucuggaaucgcggucagacaggcgcuaacgggggacgaaaauuucucgacccuugcucccuucaacugccauuggcaucuauaggcuaccguagaucgucacaguuagauuuccagaauagcccgaguuggcccauggccuccacuucugaaguuccugcguuugaguucacggcugaagacugugguggggcccauuggcuggauaggccagaaguggacgauggaaccagcgaggaggaaaacgaguccgacucaaguagcugccggacaucuaauuccucacagacucuaagcaguugucacaccauggaacccugcacaucugaugaguuuuuccaagcacucaaccaugccgagcagaccuuuaagaaaauggaaaauuaucugcgccacaagcagcuuugugacguaauccugguggcuggcgauagaaggauuccugcacaucgguugguccucuccagcgugucggacuacuucgccgcuauguuuacuaacgauguucgcgaggcccgacaggaagagaucaagauggaaggcguggagccaaauucucuguggucccugauucaauaugcguacacagggagacucgaguuaaaagaagacaacaucgagugccugcuuucaaccgcauguuugcugcagcuaagucaggucguggaagccugcuguaaguuccucaugaaacaacugcaccccagcaauugccuuggaauaagguccuuugcugacgcccaggguuguacggaucugcacaagguagcacauaacuauacuauggagcacuucauggaaguuauccggaaucaggaguucguguugcucccugcuucugagauugccaaacuguuagcgagcgacgauaugaacaucccaaaugaagagaccauucugaacgcccuccuuacauggguccgucaugaccuggaacagcgcagaaaggauuugucaaagcuacuggcauacaucaggcucccgcugcuugcuccccaauuucuggccgacauggagaacaauguguuguuccgggaugacauagaaugccagaaacucauuauggaggcuaugaaguaucaccuguuaccugagcgacgcccaaugcugcagagucccagaacuaaaccuaggaaguccaccgugggcacacuauuugccgucgggggaauggauagcaccaaaggcgcaacgucuaucgaaaaguacgaccuccggacuaacauguggacaccaguugccaauaugaacggucgcagacugcaguucgggguggcuguacuugaugacaaauuguacguggucggaggcagggacggccugaagacccucaauacuguggagugcuauaaccccaagacaaaaaccuggucaguuaugccgccuaugaguacgcaccgucaugggcugggaguggcgguccuugaaggucccauguacgcagugggcgggcacgauggauggagcuaucugaauaccguagagcggugggacccacaagcccgacaguggaacuuuguugcuacaauguccacuccuagaucuaccgugggcgucgccguguugucggguaagcucuacgcagucgggggcagggauggaagcuccugucugaaaucaguggagugcuucgacccccauacaaauaaguggacuuuaugugcccagaugaguaaacgccggggcgggguuggagugaccacauggaacggucugcuauaugcuauuggcgggcacgaugccccagcaucuaaucucaccagcagacuguccgacugcguagaaagguacgaucccaagacugacauguggacggcggucgcuucaaugagcaucucucgcgaugccgugggaguuugucuuuugggcgacaagcuguaugcaguggguggguacgauggccaggccuaccucaacacagucgaggcuuaugacccucaaaccaaugaauggacucagguggccccacugugcuuaggacgagcaggcgcuuguguagugaccguuaaacuguga

SEQ ID NO: 58190 - RNA, 1866 nt, Artificial Sequence
  derived and/or modified sequence opt3 from KLHL6__Homo_sapiens__NP_569713
augcugauggccggccagagaggggcuuggaccaugggagacguggucgaaaagagccucgaagguccccuugcaccuuccacagaugagccaucucagaaaacuggcgaccugguugaaaucuugaacggggagaaggugaaauucgaugacgccggauuaucacugauucuacaaaauggccucgaaacgcugaggauggagaacgcgcuuaccgauguaauacugugcguggacauccaggaguuuaguugucaccgggucguguuggcugccgcaagcaauuacuuccgcgccauguuuugcaacgaucucaaggaaaaauaugagaagcgaauuaucauuaaggguguugacgcugaaacaaugcauacucugcuggauuacaccuauacauccaaagcacucaucaccaagcagaaugugcaacgugucuuagaggccgcuaaccuguuccaguuucuuagaaugguggacgccugugcgucuuucuugacugaggcacugaauccggaaaacugcguagggauacuaaggcucgccgauacacacucgcuggacucacuuaaaaagcagguucagagcuacaucauucaaaauuuugugcagauccugaacagugaggaguucuuggaucuccccgucgacacccugcaucacauuuuaaaauccgacgaucuguaugugacggaggaagcucagguguuugagacugucaugucuuggguucggcauaagccuagcgagcgccucugucuucugccauacguguuggaaaauguaagacuaccccugcucgacccuugguauuucguggagaccgucgaagccgauccacugaucaggcagugccccgagguguuuccucuucugcaagaagcacggauguaccacuuguccggaaacgagauaauuucagagcgcacaaagccacgaaugcacgaguuccagagugaaguuuuuaugaucauuggcggcuguacuaaagacgaaagauucguggcugaggugaccugccucgauccgcugaggcggagccguuuagaaguggccaagcugccccuaacagagcaugagcucgaaucugagaauaaaaaguggguagaguucgcguguguuacccugaaaaacgaaguguacaucuccgggggaaaggagacgcagcacgacgucuggaaauauaauucaagcaucaacaaguggauucaaauagaauaccuuaacaucggucgcuggagacauaagaugguggucuugggcgggaaaguguauguuauuggaggcuuugauggucugcagaggaucaauaacguggagacuuacgacccuuuccacaauugcuggagugaagccgcaccacuccugguacacgucucuuccuuugcugccacaagccauaagaaaaagcuguaugugauagggggaggccccaacggcaaacuugcuaccgauaagacucaguguuacgacccuucgacaaauaaguggucuuugaaagccgcaaugccaguugaggccaagugcauuaacgcuguguccuuccgggaucgaaucuaugucgucgggggagcgaugcgcgcacucuacgccuacucaccccuggaagacaguuggugcuuaguaacccagcugagccacgagagagcuuccugugguaucgccccgugcaauaacaggcuauauauuacgggcgggcgggacgagaaaaaugaagugaucgcaaccguucucuguugggauccugaggcccaaaagcugacagaagagugcguccuuccccgcggagugucucaucacggcagcgugacuauuagaaaaucauacacccauauaaggcguaucgucccaggugcuguuaguguguga

SEQ ID NO: 58191 - RNA, 1761 nt, Artificial Sequence
  derived and/or modified sequence opt3 from KLHL7__Homo_sapiens__NP_001026880
auggccgcuagcggcguggagaaguccucuaaaaagaaaaccgaaaagaaacuggcagccagagaggaagcgaagcuccuugcuggguucaugggagucaugaacaauaugaggaagcagaaaacacugugcgacguuaucuugauggugcaagagcggaagauucccgcccaccgcguaguguuagcagccgcuucacacuuuuucaaccugauguuuacuacgaauaugcuagaaaguaaaucauucgaggucgagcucaaggaugcagaaccugacauaaucgagcagcugguggaauuugccuacaccgcucgaauuuccguuaacucuaauaacgugcagucgcuucuggaugccgcgaaucaguaucaaaucgagccagucaaaaagauguguguggacuucuugaaggagcagguagaugcaucaaacugccucgguauuagcguucuggccgaaugucuggacugcccggagcucaaagcuacagccgaugacuuuauccaucagcauuucacugaaguguacaagaccgaugaguuuuuacagcuggacgucaaacgugugacacaccuuuugaaucaagauacccugacugugagagcagaagaccaggucuaugaugcugccguuagguggcuaaaguacgacgagcccaaccggcagccuuucaugguggacauacucgcgaaaguacgcuuuccacugaucaguaagaauuuccuuuccaaaacagugcaggccgagccccugauucaagauaacccugaauguuugaagauggucaucucuggcaugagauaucaucuccugagcccagaggacagggaagaguuaguggaugggacccggccccgccgaaagaaacacgacuacagaauugcacuguuuggaggcucccagccucagucaugcagguauuucaauccaaaggauuacaguuggacggacauccgguguccguucgaaaaacgucgcgaugcugccugcguguuuugggacaacguugucuacauacucggugggagccaacuuuuccccauuaagagaauggauuguuauaaugugguaaaagacucuugguacuccaagcugggaccuccaacucccagggauucauuggcugccugcgcagccgagggcaagaucuauaccagcggcgggagugagguuggaaacucugcucuauaccuguuugaauguuaugacacacggacugaguccuggcacaccaaaccuagcaugcucacacagcgaugcucgcaugguaugguggaagcgaacggccugauuuacgucugcgggggaucucuuggcaauaacguguccggucgcguccugaauagcugugagguguaugacccagcaaccgaaacguggacugaguugugccccaugaucgaggccagaaagaaccacgggcucguuuucgugaaagauaagaucuuugcuguaggaggccagaauggcuuagggggacuggacaacgucgaauacuacgauauuaaacugaaugaguggaagauggugaguccgaugccuuggaaggguguuacagugaaaugugccgcagucggcagcauaguguauguacuagccggguuccagggagugggcaggcucggucauauccuggaauacaacaccgagacugacaaguggguugcuaauuccaaaguccgggccuuucccgugacaucuugccuuauuuguguggucgauaccugcggggcaaacgaggaaacguuggagaccuga

SEQ ID NO: 58192 - RNA, 1854 nt, Artificial Sequence
  derived and/or modified sequence opt3 from KLHL9__Homo_sapiens__NP_061335
augaaggugagccugggcaacggggagaugggagucuccgcccaccuccagcccugcaaagcugguaccacaagauucuuuacuucuaauacgcauucaaguguugugcuucaaggcuucgaccagcugaggaucgaaggguuguuaugugauguaacccuggugccuggagacggcgaugagauuuuuccaguccaccgggcaaugauggccagcgcguccgacuacuucaaggcuauguuuacaggugggaugaaagaacaggaucuaaugugcauaaagcuccauggagugaacaaaguuggccugaagaagaucauugacuucaucuauacugccaaacuuucucugaauauggauaacuugcaggacacccucgaggcagccucguuucugcaaauucugccggugcucgauuucuguaaggucuuuuuaaucucaggcgugagccuggacaauugcguagaaguugggcgcauagcuaacacauacaaucuuaucgagguggauaaauaugucaacaauuucauuuugaagaacuuucccgcacugcuaaguaccggagaguuccucaaacugccuuuugaacgacuugccuucgugcuguccucuaauagcuugaagcacuguacugagcucgaacuguucaaggcugccugccguugguuaagacuggaggacccaaggauggauuacgcggcaaaacucaugaagaacauccgguuuccccuuaugacaccucaggaccugauuaauuaugugcagaccgucgacuucaugcgcacggauaacacuuguguuaauuugcuacuggaggccuccaacuaccagaugaugccauauaugcaacccgugaugcagucagacagaaccgcuaucaggagugauagcacacaucucguaacucuggguggcgugcuucggcagcagcuggucgugucuaaagaauugcgcauguacgacgagcgagcccaagaauggagaucccucgcaccuauggaugcuccaagguaccagcacgggauagccguuauuggaaacuuucuguauguggucggcggucagucaaauuacgacaccaaggggaaaacagcgguggauaccguauuccgguuugacccgcguuauaacaaguggaugcaaguugccagcuuaaaugagaaacgcacguucuuucaccugagugcacuaaagggacaucucuacgcugugggcggcagaucugccgcuggggaacuggccacugucgagugcuauaaccccaggaugaaugagugguccuacguggcaaagaugagcgaaccucacuauggacaugccgguacagucuacggcgggcuuauguacaucucgggaggcauuacccacgauacuuuccagaacgaguugauguguuuugacccagauacagacaaauggaugcagaaggcucccaugaccacggugcggggucugcacugcauguguaccguuggggacaaacucuaugugaucggcggaaaucauuuccgaggcacaucugauuacgacgauguacuguccugcgaauauuacucaccuacucuugaccaguggaccccaaucgcggcaaugcugcgcgggcaaagugaugucggaguggccguuuuugagaacaagauuuauguggucgguggcuacagcuggaauaacagaugcaugguggaaauaguacagaaauaugaccccgagaaggaugaguggcacaagguguucgacuugccggaaucccucgggggaaucagggcuuguacacugacuguuuuuccucccgaggaaaauccaggcucuccuagccgggagucacccuuaagugccccauccgaucauagcuga

SEQ ID NO: 58193 - RNA, 3039 nt, Artificial Sequence
  derived and/or modified sequence opt3 from KL__Homo_sapiens__NP_004786
augcccgccagcgcuccuccaagaaggccgcggcccccuccacccucccugucucuccuucugguguuguuaggccuugggggacgccgacuacgugcagagccuggugacggcgcccagaccugggcgagauucucaaggccacccgcuccugaagccgcagggcucuuucaaggaacauucccagauggcuuucugugggccgucgguagugcugcauaccagacugaagggggauggcagcagcacggcaagggcgccagcaucugggacacguucacccaucacccgcuugcucccccuggggauucccggaacgccucucugccauugggagcgcccucgccucuccaaccagcaacaggugacguugccucagauagcuauaauaacguguuucgcgacacugaagcucugagagagcugggcguaacccauuacagguucaguauuuccugggcccgggugcuccccaaugggucugcaggagucccgaaccgcgaaggcuuacgauauuacagaaggcugcuugagcgguugcgugagcugggugugcagccuguugugacacuauaucacugggaucucccccagcgccugcaggacgcuuacgggggaugggccaauagagcgcuugccgaucauuuuagggacuaugcagaacugugcuuccggcacuuuggcggccaagucaaauacuggauaaccaucgauaacccauacgugguagcuuggcacggguaugccacuggacgauuggcuccugguauucgcggcagccccagacucggguaccugguugcccauaauuuacugcucgcacacgccaagguguggcaucuuuauaacacauccuucaggccaacccagggaggccaggucucaaucgcucugaguagccacuggauuaauccccggcgcaugacggaccacucuaucaaagagugucagaaguccuuggauuuugugcuagguugguucgcgaaaccuguguuuauagacggggacuacccagaaucaaugaagaacaaucugagcaguauccucccggauuucacugagucugagaagaaauucauuaagggcaccgcagacuuuuucgcccugugcuuuggacccacacuuuccuuccaacuguuggauccucauaugaaauuuagacagcucgaaagcccaaaccugaggcaguuacugucguggaucgaccuagaguucaaucacccccaaauuuuuaucgucgaaaacggcugguucguuucugggacuaccaagcgugaugacgcuaaauauauguacuaucucaagaaguuuauaauggagacacugaaagccauuaagcuggauggaguggacguaaucgguuacaccgcaugguccuugauggauggcuucgaauggcaucggggguacucaauucgaagaggacuguuuuauguggacuuccucagucaggauaaaaugcugcuuccuaagagcuccgcccuguuuuaccagaaauugaucgagaagaauggcuucccaccccucccggagaaccagccucuggaagguacguucccaugugacuuugcuuggggcgucguggacaacuauauccaaguugauacuacauuaucucaguucaccgaccugaauguguaccuaugggauguccaccauagcaaaaggcucauuaagguggacgggguaguuacuaagaaacgcaagucauauugcguggauuuugccgcaauacagccccagaucgcgcugcuucaagagaugcacgucacacacuuccgguuuaguuuggacugggcucugauucucccucugggaaaccagucccaggugaaucauaccaucuuacaguacuauagauguauggccagcgaacuggucagggugaacauaacgcccguuguggcacuuuggcaaccaauggccccuaaucagggcuugccccgccuccuggcucgacagggggccugggagaacccauacaccgcacuagcuuucgccgaauacgcgcggcugugcuuucaggagcucggacaccauguaaaacuguggauuacaaugaaugagccguauacucguaacaugaccuacucugccggucacaaucuuuugaaggcucacgcacuggccuggcaugucuauaacgaaaaauucagacacgcucaaaauggcaagaucucaaucgccuuacaggcagauuggauugagccugcgugucccuuuagucagaaggacaaagaaguggccgagaggguucucgaguucgauaucggguggcuggcugagccaauuuuuggaagcggcgacuaccccugggugaugcgcgauuggcuuaaccaacggaauaacuuccuguugccuuauuuuacagaggacgaaaagaaacucauacaggguacuuucgauuuccuggcccuaucccauuacaccacaauccuggucgacucugagaaggaagacccaauuaaauauaaugauuaccucgaggugcaggagaugaccgacaucacuuggcugaacucgcccagccagguagcagugguuccuugggggcuuagaaaggucuugaacuggcugaaguuuaaauacggcgauuuaccgauguauaucauuuccaauggaauagacgauggccuccacgcugaagacgaucaacugaggguguacuauaugcagaacuacaucaaugaggcccuuaaggcacauauucuggacgggaucaaccuaugcggauauuucgccuacucauuuaaugaucgaacggcuccacgcuucggccucuaucgguacgcggccgaccaguuugaacccaaagcaaguaugaagcacuacagaaaaauuaucgauucuaacgguuucccugggccagagacacuggaaagguuuugucccgaggaguucaccgugugcacugaauguagcuuuuuccacacccguaaguccuugcuggcuuuuauagccuucuuauucuuugccucaaucauuagccucucucugaucuucuauuacuccaagaaaggacgccggaguuauaaguga

SEQ ID NO: 58194 - RNA, 831 nt, Artificial Sequence
  derived and/or modified sequence opt3 from KLK10__Homo_sapiens__NP_002767
augagagcuccccaucugcaccucagcgccgcauccggcgccagggcgcuugcuaagcuguugccuuuacugauggcccagcuaugggcagccgaggcugcacuccugccacaaaacgacacccggcuugauccggaagccuacgggucucccugcgcucgcggaucacagccuuggcaagugagucuguucaaugguuugagcuuucacugugccggcguccucguugaccaguccugggugcugacagcggcacauugcgggaacaaaccacugugggcccgaguaggagaugaccaccucuuacugcuucagggcgagcaguugcguagaacuacgaggucugugguccaucccaaguaucaccaggguucggggccuauccugccacggcgcaccgaugaacacgaccuaaugcuccugaaacuugcuagacccgugguucugggaccuagggugcgggccuugcagcucccauaccgcugugcacaaccgggcgaucagugccaggucgcuggcugggggacaacugccgcgcgaagagugaaguauaauaaaggacugaccuguucaagcauuacaauauuaagucccaaggagugcgaaguauucuacccugguguugugaccaacaauaugaucugugccggccuggacagggggcaggauccaugccaauccgacucuggaggcccccucgucugugaugagacucuucaggguauucugagcuggggaguguauccuugcggguccgcacagcauccagcuguguacacacaaaucuguaaguauaugucauggauuaacaaagucauccggaguaauuga

SEQ ID NO: 58195 - RNA, 753 nt, Artificial Sequence
  derived and/or modified sequence opt3 from KLK11__Homo_sapiens__NP_001129504
augagaauccugcagcucauucuucuggccuuggcuaccggcuuagucgggggagagacaaggauaaucaaggguuucgaaugcaaaccccacagccaaccuuggcaggcagcccuguuugagaagacucggcuacucuguggcgcgacgcugauugcuccacgcuggcuucugaccgccgcacauugcuugaaaccgcgauacaucgugcaccucgggcagcauaaccugcagaaggaagagggaugugaacaaacacguacugccaccgaguccuucccccacccuggcuuuaauaacucucugccaaauaaagaccauagaaacgauauuaugcucguuaagauggcuucacccgugaguaucacaugggcaguaaggccuuuaacccugagcucccggugcgugacugccgguacaucuugucuuauaucgggguggggaucaaccagcaguccacaguugcgccugccccacacgcuaagaugcgcuaauaucacuauuaucgagcaccagaagugugaaaacgccuauccuggcaauauuaccgacacaauggucugcgcguccgugcaggagggcgggaaagauucuugucaaggagacagcgguggcccacucguuugcaaccagucccugcaggggaucauaucauggggacaggauccgugugcaauuacuaggaagcccggcguguacaccaaagucugcaaguauguggacuggauccaagaaacaaugaaaaauaacuga

SEQ ID NO: 58196 - RNA, 765 nt, Artificial Sequence
  derived and/or modified sequence opt3 from KLK12__Homo_sapiens__NP_062544
augggccugagcaucuuccuccuucugugcguguugggguuaucccaggccgcuacccccaagauuuuuaacggaacagagugugguagaaauucucaaccuuggcaggucggccuguucgaagggacuucacuaaggugcggaggcguucucauagaccaccggugggugcugacggcagcccauuguagugguagccgcuacuggguacgacuuggggagcacucccugucucaguuggauuggaccgaacagauccgucauucgggauuuucagugacacacccaggcuaucucggcgcgagcaccagucaugagcacgaccugagacugcucagguuacggcugccgguccgcgugacuuccucuguucaaccccuuccuuugccaaacgauugcgcuacagccgggaccgaaugucacgugagcggaugggguauuacuaaucaucccagaaacccuuucccagaccugcuacagugccucaaucuguccaucgucucacacgcaacaugucauggcguguaccccgggaggauuaccaguaacaugguaugcgccggaggcguuccuggucaggaugcuugucagggggacagcggaggcccacuugugugcggcgggguccugcaaggauuggugucuugggguuccgugggcccgugugggcaggauggaauccccggcgucuauacguacauaugcaauucaacucucguuggucuggggaccagcuggaacuuuaauaguugccagccuuucuga

SEQ ID NO: 58197 - RNA, 834 nt, Artificial Sequence
  derived and/or modified sequence opt3 from KLK13__Homo_sapiens__NP_056411
auguggccccuggcccucgugaucgcuagccuuacccuggcauuguccggcggggucucucaggagucaaguaagguuuuaaacacaaauggaacuagcgguuuccugccuggcggguacacgugcuuuccacacucccaaccguggcaggccgcgcuacucgugcagggaagacugcuuuguggcgguguacuggugcaucccaaaugggucuugaccgcugcccacugccucaaggaagggcugaaaguguaucugggaaagcaugcacucggcaggguugaggccggcgaacaggugcgggaggucgugcacucuauuccucauccagaauaccgccgaucgcccacacacuuaaaccacgaccaugauauaaugcugcuugaguugcaaucaccuguacagcugacuggguauauccagacccuaccacucagccacaauaaccgucugacacccggaaccacuuguagaguuagugguuggggcacaaccacguccccucaggugaauuacccaaaaacucuucaaugcgcuaacauucagcugaggucugacgaggaaugucggcaggucuauccggggaagaucaccgauaauauguugugcgcaggaacaaaggagggcgguaaagacagcugugaaggggauuccggaggcccccucgugugcaaccgcacucuguacggcauugugucauggggagacuucccuugugggcagccagauagacccggugucuauaccaggguuagucgguacguguuauggauccgcgagacaauacgaaaguacgagacccaacagcagaaauggcugaagggcccucaauga

SEQ ID NO: 58198 - RNA, 804 nt, Artificial Sequence
  derived and/or modified sequence opt3 from KLK14__Homo_sapiens__NP_071329
augagccugagagugcucggcuccgggaccuggcccucugccccuaagauguuccuucuguugacagcuuuacagguccuggcaaucgccaugacucaaucacaggaggacgaaaacaaaauuauaggaggucacacgugcaccaggaguagccagccauggcaggcggcucuacucgccggcccgcggcgccgauuucugugugggggagcacuucuguccggccaauggguuaucacagccgcucauugcggucgucccauucuccagguggcauuggggaagcacaaucugagaaggugggaggccacucagcagguacugcgggugguccgccaagugacccauccuaacuacaauucuagaacacacgauaacgaccucauguuacugcagcuucagcagccagcuaggaucggacgggccguucgccccauugaagugacccaagcgugugcaucgccuggcacuucaugccgagucagcggcugggggacaaucaguuccccaauagccagauaucccgcuucuuugcagugugugaauaucaacauuagcccugaugagguaugccagaaagccuacccaaggaccaucacgccgggaaugguuugugcuggugugccccaaggcgggaaggacuccugccagggagauucaggcgguccucuggucugucgggggcagcuacagggacucgugaguuggggcauggaacguugcgcacugccaggcuaucccgggguguacacuaaucuuuguaaauaucgcagcuggauugaggagaccaugagagacaaguga

SEQ ID NO: 58199 - RNA, 768 nt, Artificial Sequence
  derived and/or modified sequence opt3 from KLK15__Homo_sapiens__NP_001264010
auguggcugcuccuuacccugagcuucuuguuagccuccacagcucaggacggcgauaagcugcuagagggggacgaaugcgcaccccacucucaaccuuggcaaguggcccucuacgagagaggaagguuuaacuguggugcgucacugaucaguccacauuggguccuuagcgcugcccacugccagucccgguucaugcgcguucgacugggcgaacauaauuugcguaaaagagaugggccggagcagcucaggacuacgucucgggugauuccccacccucgcuaugaagcaagaucgcauaggaacgacauaaugcugcugcggcucguacagccagcccgcuuaaauccccaggugcgaccugcuguccugccaaccagauguccccacccuggagaggcaugcgugguuucaggcuggggucuugugagccacaacgagccagggacagccggaaguccgaggucccaggucucuuugcccgauacucugcauugugcuaauaucagcauuaucuccgacaccucaugcgauaagaguuacccuggccggcuaacaaacaccauggugugugccggcgcggaagggcguggagcagagagcugcgaaggugacucuggcgggccacucguauguggaggcauucugcaggguaucguuuccuggggagaugugcccugcgacaauacuacaaaaccuggggucuauaccaaggugugucacuaccuugaguggauacgcgagacgaugaaaagaaacuga

SEQ ID NO: 58200 - RNA, 789 nt, Artificial Sequence
  derived and/or modified sequence opt3 from KLK1__Homo_sapiens__NP_002248
augugguuccuggugcucugccuugcccugagcuugggcgggaccggagcugcacccccuauccaguccagaauugucgguggcugggagugugaacaacacucucagccauggcaggccgcguuauaccauuuuucaacauuccagugcgggggaauacugguucacaggcaaugggugcuaacugcugcccauuguaucagugacaacuaucagcucuggcugggccggcacaaucuuuuugaugacgagaacacggcacaguucguacaugugagcgaauccuuuccgcaccccgguuucaauaugucucuguuggagaaccacacccgccaggccgaugaagacuacucgcaugaucucaugcugcugcgacucacagagccugcugacacuauuaccgaugcagucaaggugguugaguuaccaacagaggagcccgaaguggggucaaccugccuggccagcggauggggcaguaucgagccugagaauuuuuccuucccagacgaucuucaaugugucgacuugaaaauucugcccaacgaugaaugcaagaaagcucacgugcagaagguaacugacuuuaugcuauguguuggccaucucgaagggggaaaagauacaugcgugggugacucuggcgggccucugaugugugacggaguccuucagggcgugaccagcugggguuaugugccaugcgggacgccgaauaagcccuccgucgccguucgugugcugucauacguaaaguggaucgaagauacuauagcggagaacaguuga

SEQ ID NO: 58201 - RNA, 672 nt, Artificial Sequence
  derived and/or modified sequence opt3 from KLK2__Homo_sapiens__NP_001002231
augugggaccuggugcucagcaucgcccuuuccgucggcugcaccggggcuguuccccugauucagucuagaauagugggagguugggagugugaaaagcacucacaaccuuggcagguagcaguguacagucauggcugggcccacugcgggggagucuuggugcauccacaguggguuuuaacagcggcucacugucugaaaaagaacagccagguguggcuaggcaggcauaaucucuucgagccggaagauacuggucaacggguccccgugucccacucuuuuccucacccacuguauaacaugucgcuucugaaacaucagucauugcgccccgacgaggauagcagucacgaccucaugcugcugcgacucuccgaaccugccaagaucacggauguaguuaaaguguuagggcugccaacccaggagcccgcacuuggaacaacuugcuacgccucuggcuggggcagcauugagccugaagaguucuugcguccaagaucccugcagugugucucacuacaucuccugaguaaugacaugugcgcuagggcauauagcgaaaaggugaccgaguuuaugcuuugugccgggcuguggacaggagguaaggauaccugcggcgugucucacccguacucccaacacuuggaggggaaaggauga

SEQ ID NO: 58202 - RNA, 717 nt, Artificial Sequence
  derived and/or modified sequence opt3 from KLK3__Homo_sapiens__NP_001025218
augugggugcccgucguuuuccugacccucagcgugacauggaucggcgccgcuccucuuauucuguccagaauaguagggggaugggagugcgaaaagcacucucagccauggcaaguguuggucgcaucaaggggucgggccguguguggcgggguuuuagugcauccgcaguggguccugacugcggcucacugcauccgcaacaaaagugugauucuacucggacgacauagccuguuucaccccgaggacacgggccagguauuccagguuucccauucuuuuccucacccacuuuacgauaugucgcuguugaagaaucguuuccucagacccggugacgauucaagccacgaccugaugcugcucagguuaagugaaccugccgagcugaccgaugcagugaaagucauggaccuuccaacacaagaacccgccuuggggacuaccuguuaugcuuccggauggggcucuaucgagccugaggaauuucugacaccaaagaaacuacagugcguggaucuccaugugauuagcaacgacgucugugcacagguucacccgcagaaggugaccaaguucaugcugugcgccggccgguggacugggggaaaauccacauguucauggguaauccuuauaaccgagcugacgaugcccgcuuugccuauggugcuccaugguagucuggucccauggcgcggcgggguguga

SEQ ID NO: 58203 - RNA, 765 nt, Artificial Sequence
  derived and/or modified sequence opt3 from KLK4__Homo_sapiens__NP_004908
auggccaccgcuggcaaccccugggggugguuccugggauaccucauccuugguguggcaggcagccuggucuccgggucuugcucacagauuauaaauggagaggacuguaguccucacagccaaccauggcaggccgcguugguuauggaaaacgaguuauuuugcuccggcgugcugguacauccgcagugggugcuaucugcugcccacuguuuccaaaauucguauacaaucggucucgggcugcauucacuugaagcagaucaggagcccggaagccagauggucgaagccagucuguccgugagacacccugaguacaacaggccauugcucgcuaaugaccugaugcugauuaagcucgaugagucuguuagcgaauccgacacuauccggucaauuaguaucgcaagccagugccccacggccggcaacucuuguuuaguguccggcugggggcugcuugcuaauggacgcaugccuaccgucuugcagugcgugaacguaucaguugugagcgaggaagucuguaguaaacuguaugauccacuauaccaucccucuauguuuugcgccgguggcgggcaagaccagaaggauuccuguaauggagacagcggcgguccucucauaugcaacggguaucugcagggacuugugucguucggcaaagcgccauguggccaggugggggucccgggaguuuacacaaaucugugcaaguuuacugaguggaucgagaaaaccgugcaagcaucuuga

SEQ ID NO: 58204 - RNA, 882 nt, Artificial Sequence
  derived and/or modified sequence opt3 from KLK5__Homo_sapiens__NP_036559
auggccaccgcuagacccccuuggaugugggugcugugcgcacucaucacagcccuucuguugggcgucacugagcacguuuuagcgaacaaugacgugagcugugaucauccauccaacacgguaccgucugggucaaaucaggaccugggagcuggugccggcgaagaugcaaggagugacgauagcuccucucggauuauaaacgggucggacugcgauaugcacacccaacccuggcaggccgcucuacuccugcgcccuaaucagcuuuacuguggagcagugcugguccauccacagugguugcucacagccgcucacugccgaaagaaaguguuccguguuagacugggccauuauucacugagccccguguacgagaguggucaacagauguuucagggggucaaguccaucccucacccaggauauucucaccccggccauagcaacgaccucauguuaauuaaacugaauaggcggauccgcccuacuaaggaugugagaccaauuaacguauccucacacuguccgagugccggcaccaaaugccuuguuagcggguggggaacaaccaagucuccccaggugcauuucccuaaggucuugcaaugucugaauaucuccgugcuaucacagaaaaggugcgaagacgcguacccacggcagauagaugacacuauguuuugugccggugauaaggcaggccgcgacagcugccagggggacaguggaggccccguggucuguaacgguucucuccaagggcugguuuccuggggagauuauccuugcgcucgaccaaauagacccggcguguacacaaaccuuugcaaauucaccaaguggauccaggagacgauucaggccaauagcuga

SEQ ID NO: 58205 - RNA, 735 nt, Artificial Sequence
  derived and/or modified sequence opt3 from KLK6__Homo_sapiens__NP_001012982
augaagaaacugauggugguccucagccuuaucgccgcugcaugggccgaggaacagaacaagcugguucacggcgggcccugcgacaaaaccucccauccuuaccaagcggcuuuguauacaucuggacacuuacugugugguggcgugcuaauucauccacucuggguacugacugccgcacacugcaagaaaccgaaucuucagguguuccuggggaagcauaacuugagacagagggagucaagucaggaacaaagcuccgucgugcgggccguuauacaccccgauuacgacgcugcaucucacgaucaggacaucaugcuccugcgccuggcccgaccugcuaagcucucggaguuaauucagccacugccccuugaacgugauuguucagccaauacgaccagcugccauaucuugggauggggcaaaacagcggacggugauuuuccugacacuauucagugugcauauauccaccuggugaguagagaggagugcgaacaugccuacccagggcaaauaacccagaacaugcuaugugcuggagaugagaaguauggcaaagacuccugccagggcgauucugggggaccccucgucuguggugaccaccugaggggccuugugagcugggggaauaucccuugcggauccaaggaaaaaccaggcguauacacaaacguuugucgguauaccaauuggauucagaagacuauccaagccaaguga

SEQ ID NO: 58206 - RNA, 546 nt, Artificial Sequence
  derived and/or modified sequence opt3 from KLK7__Homo_sapiens__NP_001193982
augaacgaguacaccgugcaccugggcagcgacacacucggggauagaagggcccagcggaucaaggcuuccaaaucuuuccgccaucccggauauucaacucaaacgcacgucaaugaccuuaugcugguuaaguugaacagucaggcacgauuaagcuccauggugaaaaagguacgucugccuucuagaugcgagccaccggguaccacauguacugugucgggcugggggaccacaaccucacccgaugucacuuuuccuagcgaccuaaugugcguggauguuaaacucauuaguccacaggacuguacaaagguguacaaggaucugcuugaaaauuccaugcugugcgccggaauacccgacucuaaaaagaacgcguguaauggcgauagcggugggccuuuggucugcaggggaacccuccagggccugguguccuggggcacguucccaugugggcaacccaacgacccuggaguauauacucagguuugcaaauuuaccaaguggaucaaugauacaaugaaaaagcaucgguga

SEQ ID NO: 58207 - RNA, 783 nt, Artificial Sequence
  derived and/or modified sequence opt3 from KLK8__Homo_sapiens__NP_009127
augggcagacccaggccucgggccgcuaagaccuggauguuccugcuccuucugggaggggcaugggccggucacagccgcgcgcaggaggacaaaguguugggcgggcaugaaugccaaccacacucccagccguggcaggcugccuuauuucagggacaacagcugcuauguggcgguguccucguugggggaaacugggugcugacagcagcccauugcaagaaacccaaguacacuguacgacuuggcgaucacucucugcagaauaaagacggcccugagcaggaaaucccagugguccaaucaauuccccauccuuguuauaacaguagcgauguggaggaccacaaucacgauuugaugcuccugcagcugcgugaccaggcuucccucgggucuaagguuaagccaauaucguuagcagaucauugcacgcagcccggacaaaaauguaccgugucagguuggggcacagucacuagcccuagagaaaacuucccagacacccugaauugcgccgaggugaagaucuuuccgcagaaaaagugugaggaugcuuaccccgggcagauuacagacggaaugguaugcgccggcaguuccaaaggugcggauaccugucaaggggacucuggaggcccucuuguuugcgauggcgcauugcaggggaucacuagcuggggauccgacccaugugguaggucagacaagcccggcguguauacaaacauuugccgguaccuggauuggaucaagaaaauaaucgggaguaagggauga

SEQ ID NO: 58208 - RNA, 753 nt, Artificial Sequence
  derived and/or modified sequence opt3 from KLK9__Homo_sapiens__NP_036447
augaagcugggccuccuuugcgcccuguugagcuuacuggcugggcacggaugggcagacaccagagccaucggugcggaggaauguaggcccaacucccagccuuggcaagcuggccuauuccaucucacacggcuguuuugcggggccacucuuauuucugaucgcuggcuguugacggcagcccacugucgaaaaccauaccucugggugcgucugggagagcaucaccuguggaagugggaaggcccggagcaacucuucagagucaccgacuuuuucccccauccugguuuuaauaaagauuuaucagcuaacgaccacaaugaugacauaaugcugaucaggcuuccacggcaggcacgcuugagucccgccguucagccucugaaccuaagccagacaugcguguccccagggaugcagugucucauuucuggauggggcgcuguaucgucacccaaggcccuguucccugugacucuucagugcgcgaauaucagcauucuggaaaacaaauugugucacugggcauauccaggccauaucagugauuccaugcucugcgccgggcugugggagggagguagaggcucuugucagggggacagcggaggcccguuagucugcaaugguacccuggcuggggugguuuccggaggcgccgagcccuguucaaggccucggcgcccagcaguguacacaagugucugccacuaucucgauuggauacaagaaaucauggagaacuga

SEQ ID NO: 58209 - RNA, 1917 nt, Artificial Sequence
  derived and/or modified sequence opt3 from KLKB1__Homo_sapiens__NP_000883
augauccuguucaagcaggccaccuacuuuauuagccucuucgcuacaguguccugcggcugucuuacucaacuguaugagaacgcauuuuucagagggggagacgucgccucuauguacacgcccaaugcgcaguauugccagaugagguguaccuuucacccucggugcuuguuauucucauuucugccagcuaguagcauaaacgauauggaaaaacgcuucgguuguuuucuaaaggacuccguuacaggcacucucccgaaagugcaucgaaccggggccguaucuggacacucgcugaagcagugcggccaucaaaucucagcaugucaccgugauauuuacaaagguguggacaugagaggggucaauuucaacgugagcaagguuaguuccguggaggaaugccagaagagguguacaucuaauauccggugccaguuuuucagcuaugccacccagacuuuucauaaagcugaguaccgcaacaauugucuucugaaguauucccccggaggcacaccuaccgcaauuaaagucuugucaaacguggaaaguggcuucagccucaagccaugcgcccugucugagaucgggugccacaugaauauauuccaacaccuggcuuuuuccgauguagacguugccagagugcucacgcccgaugcguucgucuguaggacuaucugcaccuaccauccuaacuguuuauuuuucacauuuuacacuaauguguggaaaauugagucacagcggaacgugugccugcuuaagaccagcgaaaguggaacaccaucuuccagcacgccccaggagaauaccaucucggguuauucuuugcugacuuguaagcgcacacuaccugaaccaugccacuccaaaauuuacccgggcgucgacuucgggggagaggagcucaacguuaccuuugugaagggcguaaaugugugucaggaaacuugcacaaaaaugauccgaugucaauucuuuaccuauucacugcuucccgaggauugcaaggaagagaaauguaagugcuuccugagauugaguauggacgguagcccuacgaggauagcauacgggacccagggauccucuggcuauagccuccggcugugcaacacaggcgauaacucagucuguacuaccaaaacaaguacucguauugugggagggaccaauuccagcuggggugaauggccauggcagguuucuuuacaagugaagcugacagcccagcgccaucucugcggcgggucacuuaucggacaccaguggguccugaccgcugcccacuguuuugacggcuugccccuacaggauguguggagaauuuacagugguauccugaaccucagcgacaucacuaaggacacgccuuucucccaaauuaaagagauaaucauucaucagaauuauaagguaucugaggggaaccacgauaucgcacugauaaaacuucaggcuccacugaauuacacagaauuucagaagcccauuugcuugccgucgaaaggcgacaccagcacuaucuacaccaacuguuggguuacaggauggggcuucuccaaggagaagggggaaauccaaaauauucuccagaaagugaacaucccucuggucaccaaugaggaaugccagaagagguaucaggauuacaaaauuacucaacggauggugugugccggauauaaggaggguggcaaagacgcgugcaagggggauucaggaggccccuuagucuguaagcauaacgguauguggcgacugguggggauaacaaguuggggcgagggaugcgcccgcagagaacagccaggcguuuacacgaaaguggcagaguauauggacuggauccuagaaaagacccagucuagcgaugggaaagcucagaugcaauccccugccuga

SEQ ID NO: 58210 - RNA, 537 nt, Artificial Sequence
  derived and/or modified sequence opt3 from KLLN__Homo_sapiens__NP_001119521
auggacagacccggcccugggagcgccaggccaggacggaccgugcacgucugggguuaccgcguugaguggaaggugcgaaacggccguaaacugcagccguccgaaugggcugggagaggagaucucggcgguuucaagaggcgguggaaagacacacgcgcaacuguagggacgaccuuuagaaggcggucucgcgugucacuugucggagagcugaguaaguuccccuugccuagcgauuccucuggcggcaaaucgucaagcaguuuugcccgaggggcguuagcuuggugcagacaaaggaauccaaaccccuccugugccgcagccgaaacaggagcucggacuucucugccuaaggagcguugccgcgguuggagacuaggcaauuggcuccauaagcacccacaucccaacaccuguccuaggcugccagcaugcuggcuuccgcccauccugacagaacgaggggagcgggugccuaaauugguuccacuccuggccuguuaucccaagagcaaaccuaaggacuga

SEQ ID NO: 58211 - RNA, 678 nt, Artificial Sequence
  derived and/or modified sequence opt3 from KLRB1__Homo_sapiens__NP_002249
auggaccagcaagccaucuacgcugagcugaaccuccccaccgauagcggcccugaauccucuucaccaaguagccuuccgagagacgugugccaggggucccccuggcaccaguucgcacugaaguugucuugugccggaauuauauuacugguccuaguugugacaggucucucgguaucagugacuagccugauccagaaaaguuccauugagaagugcucugucgauauccaacagagcaggaauaaaacgaccgaacggccuggccuucugaacuguccaauuuauuggcagcaguugcgcgagaagugccuccuguuuucccauacagugaaucccuggaacaauucacuggcggacuguaguacuaaagaaagcucucucuuacugauccgagauaaggacgagcuuauacacacccaaaacuugauccgugauaaggcuauucuguucuggaucgggcuaaauuuuucccucucagagaaaaacuggaaguggauuaauggcagcuuccugaacaguaaugaccuugaaaucagaggagaugccaaagagaacucuugcauauccauuagccagacaucgguuuacucugaauauuguuccaccgagaucagguggauuugccagaaggagcugacuccugugcggaauaaagucuacccagacucauga

SEQ ID NO: 58212 - RNA, 648 nt, Artificial Sequence
  derived and/or modified sequence opt3 from KLRC1__Homo_sapiens__NP_998822
auggacaaccagggcgugaucuacagcgaucugaaucuucccccuaacccaaagagacaacagaggaaaccgaaggggaauaaauccucuauucucgccaccgagcaggaaauaacauaugcugagcugaacuugcagaaggcaucacaagacuuccagggaaaugauaaaacuuaccacugcaaggacuuacccagugccccugaaaagcugaucgucgguauucuaggcaucauuugucucauccugauggcgagcguugugacgauaguagugaucccaucccggcauugcgggcacugucccgaggaauggauuaccuauucuaacucgugcuacuauaucggaaaagagcgccgaacaugggaggaaucacuucuggcuuguacuagcaagaauaguuccuugcucucuauugauaacgaggaagagaugaaauuucugagcaucauauccccuucaaguuggauuggcgucuuccguaauagcucucaucacccaugggugaccaugaacggucuggccuuuaagcaugagaucaaagacuccgauaaugcagaacucaacugcgccguuuuacaggugaauagacugaagucagcucagugugggagcaguauuaucuaccacugcaagcacaaacuuuga

SEQ ID NO: 58213 - RNA, 696 nt, Artificial Sequence
  derived and/or modified sequence opt3 from KLRC2__Homo_sapiens__NP_002251
augaacaagcagagaggcaccuucagcgaggugucccuggcccaggaccccaaaaggcagcagcggaagccuaaagggaauaagucuucaaucaguggaacagaacaggagauuuuucaagucgaacucaaccuucagaauccaagccugaaccaccaggguauagauaaaaucuacgacugccagggcuuguuaccgcccccugagaagcugacugcugaaguucuagggauuaucuguauugugcucauggcaacgguacugaagaccaucgugcuuauaccauuccuggagcaaaauaacuuuucccccaauacacgcacucagaaagcccgacauugcggacacuguccugaggaauggaucaccuauucuaacucgugcuacuauauuggcaaggagcguagaacaugggaagagucauugcucgcguguaccagcaaaaauaguucccugcugucuaucgauaacgaggaagagaugaaguuccucgcuagcauuuuaccauccucauggaucggugucuuuaggaauaguagccaucaccccugggugacuauaaacgggcuggccuucaaacauaagauuaaggacucugauaaugcagaacuuaacugcgccguuuugcaagugaaucggcugaaauccgcucaguguggaucaagcaugaucuaccacugcaagcacaaacuauga

SEQ ID NO: 58214 - RNA, 477 nt, Artificial Sequence
  derived and/or modified sequence opt3 from KLRC4__Homo_sapiens__NP_038459
augaacaagcagagaggcaccuacagcgaggugucccuggcccaagaccccaaaaggcagcagcggaagcucaaagggaauaagaucucuauuucaggaacaaaacaggaaauauuccaagucgagcuuaaccugcagaaugcuaguagcgaucaccaggguaacgacaagacuuaucauugcaagggcuuguuaccuccaccggaaaaacugacggcagagguucuagggaucauuuguaucgugcucauggccaccguacugaagacaauugugcuuauccccugcauaggaguccuggaacagaauaacuuuuccuugaaucgccgaaugcaaaaagcgcgucacuguggccauugcccugaggaguggaucacuuacucuaacucguguuauuacauugguaaggaaagaaggaccugggaggaacgggugugcuggccaguucuccgcagaacacugaucuguuuccuguga

SEQ ID NO: 58215 - RNA, 651 nt, Artificial Sequence
  derived and/or modified sequence opt3 from KLRC4-KLRK1__Homo_sapiens__NP_001186734
augggcuggaucagagggaggcggagccgccacuccugggagaugucugaguuccauaacuacaaucuggaccucaagaaaucagauuuuaguacccgauggcagaagcaacguugccccguggucaaaagcaaguguagagaaaacgccuccccuuucuuuuucugcuguuuuauugcuguugcaaugggaauaagguucaucauuauggugacaaucuggucugccguauuucuuaauucgcuguucaaccaggaagugcagauuccauugacugagucauauugcgguccgugucccaaaaauuggaucugcuacaagaacaauuguuaucaguuuuucgacgaaagcaagaacugguacgagagucaagcguccugcaugucucagaaugcuagcuuacugaaagucuauuccaaggaggaucaggaccuacucaaacuggugaagucauaccacuggaugggccuuguucauauaccuacgaacgggaguuggcagugggaagauggaagcauccugucuccaaauuugcucaccauuaucgagaugcaaaaaggcgacugugcccuguaugcauccucauuuaaggguuacauugaaaacugcagcacacccaauacuuacaucuguaugcagcggaccguguga

SEQ ID NO: 58216 - RNA, 540 nt, Artificial Sequence
  derived and/or modified sequence opt3 from KLRD1__Homo_sapiens__NP_001107868
auggccguguucaagaccacacuguggagacucaucagcggcacucuugggauuauaugccuguccuugauggcuacguuaggaauccugcuaaagaacucuuuuaccaagcucucaauugagcccgcauucacaccugguccaaauaucgaacugcagaaagacagugauuguugcagcugucaagagaagugggucggcuacaggugcaacuguuauuuuauuuccucugaacagaaaacuuggaaugagucgcggcaccuuugcgccucacagaaaagcagucuguugcagcuccaaaacaccgacgaacuggauuucauguccucuagccagcaguuuuacuggaucgggcuguccuauucagaggagcauacagcguggcucugggaaaauggaagugcuuuaagccaguaccuguucccgucuuuugagaccuucaacacuaagaauuguauagccuauaaccccaauggcaacgcacuugacgaauccugcgaggauaaaaaucgcuacaucuguaagcaacaguugauuuga

SEQ ID NO: 58217 - RNA, 570 nt, Artificial Sequence
  derived and/or modified sequence opt3 from KLRG1__Homo_sapiens__NP_005801
augaccgacagcgugaucuacuccaugcuggagcuccccacagccacucaagcucaaaacgauuauggcccucagcagaagucuucaaguagcagaccauccugcucuugucuugucgcaauugcccugggguuguuaacggcgguucugcuaucggugcuccuguaccaguggauacuuugccaaggaucaaauuauagcaccugugcuaguugcccguccugucccgacagguggaugaaauacgguaaccacugcuauuacuucucuguagaagagaaggauuggaauagcucccuggaauuuuguuuggcccgggacucacaucuccuggugaucacagauaaccaggagaugagucugcuccaggucuucuuaagcgaagcauuuugcuggauuggccugcgcaauaacucuggguggcgaugggaggacggauccccucuuaauuucucacguaucagcaguaacucuuuugugcagacuuguggcgccauuaauaaaaacgguuugcaggcuuccagcugcgagguuccacugcacuggguguguaagaaagucagacuauga

SEQ ID NO: 58218 - RNA, 1230 nt, Artificial Sequence
  derived and/or modified sequence opt3 from KLRG2__Homo_sapiens__NP_940910
auggaggaaagcugggaggccgcucccggcgggcaggcaggagccgaacugccuauggagccaguggguucccucgucccgacccuugaacaaccccagguuccugcgaaggugagacagccagagggccccgagucuucaccuaguccagcuggggccguagaaaaagcagccggagcuggccuggagcccagcuccaagaaaaagccuccaucuccgaggcccgguucgccucgggugccacccuugucauuaggguacggagucugcccugaaccacccagcccgggcccugcacuggugaaacuaccccgcaacggcgaggccccaggggcugagccugcccccagugcgugggcaccaauggaacuccagguugacgugcgagucaagcccgugggagccgcugguggcuccucuacaccuagcccacguccguccacuagauuccugaagguacccguuccugagucaccagccuuuaguaggcacgcagaucccgcucaucaacuucuguugcgggccccuagccaagggggaacguggggccgcagaucuccacucgcggccgcaaggaccgaauccgguugugacgcugaggggcgggccucacccgcugaaggaagcgccggcaguccgggcucuccuacaugcugucgcugcaaagagcuggggcuggagaaggaagaugcagcccucuuaccacgagcuggacuggacggugaugagaaacuucccagagcggugacuuugaccggccugccuauguaugucaagucccuauacugggcacucgccuucauggcugugcugcuugccgugagcggggucguuaucgugguacuggcaucgagggccggagcucggugucagcagugucccccaggcuggguguugucugaggaacacugcuauuacuuuuccgccgaagcacaggcgugggaggcuucacaggccuucugcagugcauaucaugccacacucccucuguuaagccacacccaggacuuucugggucguuaccccgucucccgccauucuugggugggggcuuggagaggcccacagggauggcacuggauugaugaggccccgcucccuccccaacuucugccagaagacggcgaggauaauuuggacauaaacuguggggcacuagaagagggaacucugguugcugccaauugcagcacacccaggccuugggugugugcgaaagguacccaguga

SEQ ID NO: 58219 - RNA, 1461 nt, Artificial Sequence
  derived and/or modified sequence opt3 from KMO__Homo_sapiens__NP_003670
auggacagcuccgugauccagagaaagaaagucgccguuauuggcgggggacugguggguucucuccaggcuugcuuccuugcaaagaggaacuuucaaauagauguauacgaggcccgggaagacacccgcguggcgacauucacucgaggccguucaaucaaucuggcuuugagucacagagggaggcaggccuuaaaagcagucggacuggaggaucagauugugagccaaggcauccccaugcgggcccgcaugauucauucccuaucugguaagaaaucggcuaucccuuaugggacgaagucacaguacauacucagcguuaguagagaaaaccugaauaaggaccuucugaccgcagccgagaaauauccaaacgugaagaugcacuuuaaucauagguugcucaaauguaacccggaagagggaaugaucacaguccugggcuccgauaaggugcccaaagacguaacuugcgaucugauuguuggcugugacggggcuuacucuaccgugcggagccaccucaugaagaagccucgcuucgauuauucccagcaguacaucccacauggauauauggaguuaacaauucccccuaaaaauggugacuacgccauggaaccaaacuaccugcacaucuggccccgaaauaccuuuaugaugauagcgcuuccuaacaugaauaagucauucacuugcacauuguuuaugccauucgaggaauuugagaaacugcuaaccaguaacgaugucguggacuucuuucaaaaguauuucccggaugcaauuccccucaucggcgagaaacugcuugugcaggacuuuuuccuguugccugcccagccaaugauuagcgucaaguguucuuccuuccacuuuaaaucacauugcguucuccugggggacgcugcccacgcaaucgugcccuucuuuggacagggcaugaaugcugguuucgaagauuguuuaguauuugacgagcugauggauaaguucagcaacgaccucagucuuugccugccuguguuuucuagauugaggaucccagaugaccaugccauuuccgaucuaagcauguacaauuauauagaaaugcgggcgcacgucaacucgucuugguucaucuuucaaaagaacauggagcguuuccugcacgccauuaugcccuccacguuuaucccgcucuacacuauggugaccuucucacgcauaagauaucaugaagcaguucagagguggcacuggcagaaaaaggugauuaauaaagggcuguuuuuccuuggaagucugaucgcuaucagcuccacauacuugcucauucauuauaugucuccucggagcuuccugcgauuacgcagacccuggaacuggaucgcccacuuuaggaauacuaccuguuucccagcuaaggccgucgacucacuggagcaaauuaguaaccuaauaucccgguga

SEQ ID NO: 58220 - RNA, 11919 nt, Artificial Sequence
  derived and/or modified sequence opt3 from KMT2A__Homo_sapiens__NP_001184033
auggcccacagcugccgauggagguuccccgcucggccuggaaccacugggggagguggcgggggaggccgccgaggucuaggcggggccccacgucagagagugccggcccuacuucugcccccugggccacccgucggcgggggagguccuggcgcgccacccuccccuccagcuguugccgcagccgcugcagccgcugggucuucaggagccggcgugccggguggggcggcagccgcuagugccgcaagcuccucuucggcuucaagcaguuccucuagcuccucaagugccagcucuggacccgcguuguuaaggguaggcccuggcuuugacgccgcacugcaaguguccgcugccauagggacuaaccuacggcgcuucagagcugucuuuggagagucagguggcgggggaggcagcggugaagaugagcaguuccucggguuuggcagugacgaagaggugaggguucggucuccaacgcgcucccccagcgugaagaccucgccucgaaaaccaagaggaaggccccggucuggcuccgaucguaauucagccauucugagugacccgagcgucuucuccccucuuaacaagucugaaacaaaaagcggggauaagaucaagaagaaggacucaaaaaguaucgagaagaaacgcggaagacccccaacuuuuccuggugugaagauuaaaaucacccacggcaaggauauuuccgagcugcccaaggggaauaaagaagacagcuugaagaaaaucaagaggaccccaucugcaaccuuccagcaggccacuaaaauaaagaaacuccgggcuggaaagcugucaccccugaagaguaaauuuaagacaggcaaacuccaaaucggucgaaaggggguacagauuguucgcagaaggggccggccuccaagcaccgagcgcaucaaaacgccguccggauuacugauuaacucugaacuugagaagccccagaaggugagaaaagauaaggagggcacuccuccauugaccaaagaagacaagacagucgugaggcagucgccccgucggaucaaaccugugcgaauaauuccaagcuccaagagaacugaugcgaccaucgcaaagcaacugcuacagagggccaaaaagggggcucagaaaaagauugagaaagaagccgcacagcuccaaggacgcaaggucaagacacagguuaaaaauauccggcaguucaucaugcccgugguaucagccauuaguucuagaauaaucaagaccccgaggcgcuuuauugaggacgaagauuacgacccuccaaucaaaauagcucgacuggagagcacgcccaacucccgguucucagccccuagcugugguucuuccgagaagaguagcgcagcgucucaacacuccucacagaugaguagcgacucgucccguucuagcucacccaguguggauacuuccacagacucucaggcuagcgaagagauucagguccuuccagaagagagauccgauaccccugaagugcaucccccacugccgaucucacaaagcccugagaaugagaguaacgacaggcgcucucggagauacuccguuagcgaaaggucguuuggcucacgaacuacuaaaaaguugucuacccuccagagugccccacagcagcaaacguccagcucuccacccccuccacuguuaacacccccuccgccacugcagcccgcaagcuccaucucagaucacacaccuuggcucaugccacccacuauuccucuugccaguccguuccugcccgcuagcaccgccccaaugcaggggaaacgcaagucuaucuugcgggagccuacauucagauggacuucccuaaagcauucaaggagugaaccccaguacuuuagcuccgcaaaauaugcuaaggagggacugauucguaaaccaauauucgacaauuuucgcccucccccacucaccccggaagaugugggcuucgccucugguuuuucggcgagcgggacagccgcuucagcacggcuguucuccccucuucacaguggcaccagauuugacaugcacaagaggucuccccuguugcgagccccacgguucacucccagcgaggcucauucccgcaucuuugagucagucacgcucccuucuaacagaacaagcgccggaaccaguuccagcggcgugucuaauaggaaacggaagcgaaagguauucucaccaauuagauccgaaccccgcaguccuagccacucgaugaggacucguucugggcggcuguccagcucagaguuaaguccgcugaccccacccucuuccguuagcucaagucuaagcaucuccgugucuccucucgcaacaagcgcgcugaaccccaccuuuacuuucccaucccauucacuuacacaaucuggagaaagugccgagaaaaaucagagaccuaggaagcagacgucggcucccgccgagccauuuagcuccucuucaccuaccccguuguuccccugguucacuccaggcagccagacagaacgcggucgaaacaaagauaaggcaccugaggaacuguccaaagacagagaugcugacaagagugucgagaaggacaaaucucgggaaagggaucgcgagcgugagaaggaaaauaaaagagagagccggaaggagaaaaggaagaaggggucagagauccaauccaguagcgcccucuaccccgugggacgcgucucuaaagaaaaggugguuggcgaggacguggcaaccuccucaagcgccaaaaaggcuacaggucggaaaaagucgucuagucacgauuccggcacugacauuaccagcguaacgcugggggauaccacagcggucaaaacuaagauacuuaucaagaaaggaagaggcaaccuggagaagaccaacuuggaccucgggccaacagccccuucacuggaaaaagagaagacuuuaugccuguccacccccucuagcaguacggugaaacacuccacaagcucuauuggaucaaugcuagcacaggcugauaagcucccgaugaccgacaagagaguugccagucugcuuaaaaaggccaaagcucaguuguguaagaucgaaaaauccaagagccugaagcaaacugaucagccaaaagcacagggccaggagucugacucgucagaaacaagcgugagggguccucgcauuaagcaugucugcagaagggccgcgguggcucucgggcggaaacgugccguauuucccgaugacaugccaacccuguccgcauuacccugggaggagcgcgaaaagauccugaguucuaugggaaaugaugacaaaagcuccauagccggcucagaggacgcugaaccucuugcaccgcccaucaagccaauuaagccugugacucgaaacaaagcaccccaggagccuccaguuaagaaagguagaaggagucggcgcuguggccagugccccgggugucaggucccugaggauugcggaguguguaccaauugcuuggacaagccaaaauucggcgggagaaacaucaagaagcaguguugcaaaaugaggaagugccaaaaucuccaguggaugcccucuaaagcguaucugcagaagcaggcuaaagccgugaagaaaaaggaaaagaaaagcaagacauccgagaaaaaggauucaaaagaaagcucugucguuaagaacgugguggacuccagucaaaagccgacgccuagcgcacgggaggauccagcccccaaaaagucguccucugaaccuccaccccgaaaaccgguagaggagaagucagaagagggaaaugucagcgcuccuggccccgaaaguaaacaggccaccacuccagcauccagaaagucuagcaaacaggugucacaaccugcucuaguuauucccccacagcccccuacaaccgguccaccgcgcaaagaggugcccaagacaacuccuuccgaacccaaaaagaaacagcccccuccacccgagagugggccugagcagagcaagcaaaagaaagucgccccgaggccaucuauccccgugaagcagaaaccuaaggaaaaagagaagcccccaccuguuaacaaacaggaaaaugcgggaacccugaacauacucucaacgcuguccaauggcaacagcucuaagcagaagauucccgccgacggugugcaccggauccguguagauuuuaaagaggacugugaagcagagaaugucugggagaugggcgggcuuggaauuuugacaagugugccaaucaccccgagaguggucugcuuccugugugcuucguccggccauguugaauuuguguacugccaaguauguugcgagccuuuccacaaguuuuguuuagaagagaacgagaggccccucgaagaucagcuggagaauuggugcugucgccggugcaaauucugucaugugugcgggcgacagcaccaggccacuaagcaacuucuggaaugcaacaaauguagaaacagcuaucacccagagugcuugggacccaauuacccuaccaagccaacaaagaaaaagaaagucuggauauguacuaagugcgugagguguaaaucaugcggcucuaccacacccgguaaggggugggacgcucaguggagccaugauuuuucccucugucacgacugcgcaaagcuguucgccaaaggaaacuuuuguccucuaugcgauaaguguuacgacgacgaugacuaugaaaguaaaaugaugcagugcggcaagugcgaucgcuggguucauucaaaaugugagaaucugucuggcacggaggacgaaauguacgagauccucagcaaccugccggaauccguggccuauaccugcgucaauuguacugagcggcacccagcugaauggagacuugcguuggagaaggagcugcagauuaguuuaaagcaagugcucacagcacugcuuaacagccguaccacuucccaucugcugagguaccggcaggccgcuaaacccccugaucucaauccagaaacagaggaaucuauccccucacgcagcucgccugaggggcccgacccaccgguucugaccgaaguguccaagcaggaugaccaacagccuuuggaucuggagggagucaaacgaaagauggaccaggguaacuauacgaguguauuagaguucucugaugacauugugaaaaucauacaggccgcaauuaauagcgacggcgggcaacccgaaaucaagaaagccaacucaaugguuaaguccuuuuucaucagacagauggagaggguguucccaugguuuucugucaagaaaagucgguucugggaaccuaauaaggugagcuccaacucaggaaugcuccccaaugcuguacugccaccuagccuugaucacaacuacgcgcaguggcaggagcgcgaggaaaauucucacacugagcaacccccgcugaugaaaaagauuaucccagccccuaaacccaagggcccaggugaacccgacaguccuaccccguugcauccacccacaccucccauucucuccaccgauagaagcagggaggacucaccagaacugaacccucccccagggauagaggauaaccgacagugcgcacuaugucugacuuauggagacgauucugcuaaugacgccggccggcuucucuacaucggccagaacgaguggacacacgugaauugcgcacugugguccgccgaagucuuugaggaugacgaugggucguugaagaacguucauauggcugugauucguggaaaacagcugagaugugaguucugccaaaagccuggugccaccgugggcuguugcuuaacaagcuguacaagcaauuaccacuuuaugugcucucgcgcgaaaaacugcgucuuccucgacgauaagaaaguguauugucagaggcaccgggaccugaucaagggggagguuguaccggaaaauggauuugagguguucagacgcgucuuuguggacuucgagggcauuucccuuaggcgaaaguuucugaacgguuuggaacccgagaauauccauaugaugauagggagcaugaccaucgauugccucggcauucugaacgaccuaucagauugugaagacaaacuguucccaaucggcuaccagugcagucggguuuauugguccacgacagaugcaagaaagagguguguguauaccugcaaaauugucgagugucgcccucccgugguagaaccagacaucaauagcacugucgagcacgaugagaaccguaccauagcccauucuccuacaucauucacugaaagcuccucuaaggagagucaaaauaccgcugaaauuaucucgcccccgagcccagaccggccuccccacucccagacgucaggcucuugcuauuaccaugugaucagcaaaguuccaagaauuaggacacccaguuauuccccuacccagcgcucacccgggugucgaccacuuccuucugccggaagcccgacucccacaacccacgagauagugacugucggugauccacuccuguccaguggcuugcggagcaucgggucuagaaggcacucaacauccagcuuaaguccucagcgcucuaagcugagaauuaugucccccaugcggaccggaaacacguacucgaggaauaacgugagcucaguuuccacuaccggcacagcuaccgaccucgagucuagugcaaagguggucgaucaugugcuggguccacuuaacagcucaacaucccuggggcaaaauacuagcaccucuaguaacuugcagcguacgguagugacaguuggaaauaaaaacucccaccuagacggcagcucaucuucggaaaugaagcagagcuccgccagugaucuggucucuaaaucaagcucccucaagggcgagaaaacuaaggugcugaguucuaagagcuccgaagggucagcucauaauguggccuacccuggaauccccaaacuugcaccgcagguccacaacaccacaagccgagaguuaaauguaucuaagauugguuccuuugcggaaccuaguucagugagcuucucguccaaagaggcccugucuuuuccacaccuccauuugcgcggccaaagaaacgaccgggaccagcacaccgauaguacucagagcgcuaauucaucccccgacgaggauaccgaaguuaagacacugaaacucucugggaugagcaacaggaguuccaucauaaaugagcauaugggaaguucuucacgcgacagacggcagaagggcaaaaaguccugcaaggaaacguucaaagagaagcacagcaguaaaucuuuucuggaaccuggucaagugacuaccggggaggagggaaaccuuaagccagaguucauggaugagguccugacacccgaauauaugggccagaggccuuguaauaacgugucauccgacaaaaucggcgauaagggguugagcaugccaggaguucccaaggccccgccuaugcaaguggaggguucggcaaaagaacuacaggcuccccgaaagcguaccgucaaagugacucugacaccacucaagauggagaaugagucucaaaguaaaaacgccuuaaaggaauccagccccgcaucaccucugcagauugagucuaccagcccaacggaacccaucuccgccagugagaauccuggcgacgggccaguagcucagccgucacccaacaacacuagcugccaagauucccagucuaauaacuaccagaaucuuccugugcaggacagaaaccugaugcucccagauggacccaagccucaagaggacggcaguuuuaaacgccgguauccaaggagaagcgcgcgcgcccgguccaauauguucuuugguuugacaccccuguacgggguuaggucauauggcgaagaggacauuccguucuacucuucgagcaccggaaagaaacgaggcaagagauccgcagaagggcaggucgauggagcugacgaucucaguaccucugacgaggaugaccuguauuacuacaacuuuacucggacagugaucagcucagguggcgaagagaggcuugccucccauaaucuauuccgcgaggaagaacagugcgaucugccuaaaauaagccaguuggacgggguggaugacggaaccgaaucugauacaagugucacugccacgacccguaaguccucacaaauuccaaagagaaacggcaaagagaaugguacagaaaacuuaaagaucgaccgacccgaggaugcaggggagaaagaacacguuacuaagagcucugugggccacaaaaaugagccuaagauggacaacugucauucgguauccagggugaaaacccagggacaggacagucuggaagcucagcucagcucacuggagucuucccggcgcguccacacaagcacccccagugauaagaaucuucuggacacuuauaacacggaacucuugaagucagauuccgacaauaacaacagcgaugacugcggcaauauccugccaucugauauuauggacuuugugcucaaaaacaccccgaguaugcaagcccugggggagagcccugaguccucuucaagcgaacuccuuaaucugggagaggguuuaggcuuggauuccaacagagaaaaggacauggggcuguucgagguuuucucgcagcagcuccccacaacugagccaguggauucuagugucagcucauccaucucugcggaagaacaauuugaacugccccuugagcugccuagcgaccucuccguauugaccacaaggaguccaaccgugcccucacagaauccuagccggcuggcuguuauaucugacuccggagaaaaacgcgugacuauuacagagaagagugucgccagcucagagucugauccagcauuacuauccccgggcguggaccccacgccugaaggucauaugaccccagaucacuucauccaggggcacauggacgccgaucauauuucgagucccccuuguggcagugucgagcagggacacggcaacaaucaagaccugacuagaaacuccucuacaccagggcuccaggugcccguuucaccuaccgugccgauccagaaucagaaauacguacccaacagcaccgauuccccaggaccuucucaaauaagcaaugcugcagugcagacaacucccccacaucuuaagccugccacggaaaagcugauugucguuaaccagaauaugcagcccuuguaugugcugcaaacccucccaaacggcgucacacagaaaauccagcugacaagcucaguguccagcaccccgucuguaauggagacaaauaccagugugcuugguccuaugggaggaggccucacucugacgacagguuugaaccccucccugccaaccagccaaucauuauuucccucggcgucuaagggccuacugccuaugagccaccaucagcaccuccacuccuucccagcugccacucagaguucauuucccccuaacaucucuaauccgcccagcgggcuucugauuggaguucagccaccucccgacccacaauugcugguguccgaaaguagccagcgaaccgaucucucuacaacugucgcaaccccuuccucaggccugaaaaagaggcccaucagccggcuucagacacguaaaaacaagaaguuagccccaucguccacgccgucuaauauugcuccuagugacguggucucaaacaugacccugauaaauuucacucccagccagcucccaaaccauccuuccuugcuggaucuagggucucugaauacaagcagucaccgcaccgugcccaacaucauuaaaagaucaaaguccagcaucauguacuuugagccagccccucuccuuccccaaucuguuggaggcacugcagcuacagccgcggguaccuccacgaucagucaggacaccagccaucugacaucagggucuguauccggauuggccagcucgaguucugugcugaaugucgugucaaugcagacuaccacaacuccgaccuccagcgcaucuguuccaggccacgugacacucaccaaccccaggcuguuagguacuccugauauuggcagcauauccaaucuucugaucaaagcuagucagcaaucacucgggauucaggaccagccagucgcccuacccccuagcuccggaauguucccgcagcugggcacgucucaaacacccaguaccgcagcuaucacugccgccucaagcauuugcguguugccauccacccagacaacggggaucaccgcggcuucuccuucgggagaggcagacgaacacuaucagcugcaacauguaaaccagcuccuugccagcaagacuggcauacacuccagucagcgggaucuggacucagcuucugguccccaggugagcaauuuuacacaaaccguugaugccccaaacuccaugggguuggagcagaauaaagcacugaguucugccguccaggcuagcccuacuucacccggaggcuccccaagcucuccuucaaguggccagagauccgcgagccccucggugccggggccuacaaagccaaagcccaaaaccaagcgcuuccaacucccuuuagacaaaggaaacgguaagaaacauaaggugucucaucugcgaacauccagcucagaagcccauaucccagaucaggagacuaccagucuuacgucuggcaccgggacacccggagcagaagcugagcagcaggacacugccuccgucgagcaaagcucacagaaagaauguggccagccggcaggucaaguugccgugcugccugagguacaggugacccagaaccccgcuaaugaacaggagagugccgagccaaagacagucgaagaggaagaguccaacuuuagcucuccccuaaugcucuggcugcaacaggaacagaagaggaaagagucgauuacugagaagaaaccuaagaaaggguugguguucgaaaucagcuccgaugacggauuucagauuugcgcggagucaaucgaagaugcauggaagucucugaccgacaagguucaagaggcccggaguaaugcuagacucaaacagcuuagcuucgccggcgugaacggccugcguauguuagggauacugcacgaugcagucguguucuugauugaacagcucuccggagcuaagcacugucgcaauuacaaauuuagguuccauaagccagaggaggccaacgaacccccucugaauccacacgguucugcucgggccgagguacaucuaagaaaaucagcauuugacauguucaacuuucuugcgagcaagcaccgacagccgcccgaauauaauccuaacgaugaggaagaggaggaaguucaacugaagagugccaggcgcgcuacguccauggaccucccaaugcccaugcgguucagacaucugaaaaagacaucuaaagaggccgugggcgucuacaggagcccuauccacgggcgcggauuguuuugcaagcguaauauugacgcaggcgaaauggugaucgaguacgcugguaacgugauacgguccauccagaccgauaaaagagagaaguauuacgacucaaaggggauuggauguuauauguuccgaaucgaugacagugaagucguugaugccacuaugcacggcaaugcagccagguuuauuaaccauagcugcgagccaaauuguuacucucgcgugaucaacauagacggccagaaacacauuguaaucuucgcgaugcggaagaucuauagaggggaagaacugacauacgauuauaaauuucccauugaagacgcuuccaacaagcucccgugcaauugcggagccaaaaaguguaggaaguuccuuaacuga

SEQ ID NO: 58221 - RNA, 8148 nt, Artificial Sequence
  derived and/or modified sequence opt3 from KMT2B__Homo_sapiens__NP_055542
auggccgcugcagccggcgggggaagcugccccgguccuggcuccgcgagggggagguucccaggacggccgcgcggcgcuggugggggaggcggccgagggggacgugguaacggcgccgagcgggugagggucgcacugcggcgcgggggaggcgccaccggucccgggggagcugaaccuggcgaggacaccgcacuccuucggcuguugggcuuaaggcgggggcugcgccgauuaaggaggcucugggccggaccacggguucagcguggucgcggcagagggaggggacggggcuggggucccucucgagggugugugccugaagaggaaucaagugauggcgagagcgacgaggaagaguuucaaggauuccacuccgaugaagacguagcuccaucuucgcugcgcucagcccuuagaagccagaggggccgggcgccccgcgggagaggaaggaagcauaaaacuacgccucugccaccgccccguuuggcagauguggccccuaccccacccaagacuccugcucggaaacgaggugaggagggcacugaaagaaugguccaggcccucaccgagcugcugaggcgcgcacaggcuccacaagcaccccggaguagagcgugcgaaccguccaccccuaggcgcucucgagggcggcccccaggacguccugccggccccuguagaaggaagcagcaggcagugguuguggcugaggccgcugucaccaucccaaaacccgaaccuccaccgcccgugguaccuguuaagcaccagacugguagcuggaagugcaaagaggggccaggccccggaccuggcacaccacgcagagggggccaauccucaagagguggcagagggggccgaggccgcgguagagggggcggacuccccuuugugauuaaguucgucaguagagccaaaaaggugaaaaugggccaguuaagccuggggcuugagucuggacagggccagggucaacaugaagaguccuggcaggacgugccgcagaggcgugucgggucaggacaaggcgguagcccuuguuggaagaagcaggaacagaaauuggaugacgaggaagaggagaagaaagaagaggaagagaaggauaaagaaggcgaggagaaggaagaacgcgcaguugccgaagagaugaugccagcugcggagaaagaagaggcaaagcugcccccucccccauuaaccccucccgccccaaguccgccucccccacuacccccuccaucuacgucgcccccuccgccacugugucccccuccacccccuccggugucucccccaccucuucccagcccaccucccccaccggcucaggaggaacaggaagagagcccucccccaguagugcccgccacuuguucccggaagagagggaggccuccacugacccccucacagcgagcagagcgggaagccgcucgcgccggaccugagggcacaaguccgccaacucccaccccuagcacagcaaccgggggacccccagaagacuccccuacggucgcgcccaaaucuacuacauuuuugaagaauauaagacaguucaucaugccagugguuagcgcuaggucaagucgggugauuaaaaccccucgaagauuuauggaugaggacccgcccaagccaccuaaagucgaagugucccccguacuccgcccaccuaucacuacauccccgcccguuccacaggagccugcccccgugccaucucccccuagggcaccgacacccccaucaacgccugucccccugccugagaagcgucggaguauuuuaagagaaccaaccuucagguggacaagccugacucgcgagcuacccccuccacccccggccccuccacccccuccagcucccuccccgccucccgccccagcaaccucuucgcgaagaccucuucuguugcgggcuccccaauuuacaccaagcgaagcccaccucaagaucuacgaguccgugcugacucccccuccacucggcgcgccggaagcccccgagccugagccacccccugcugaugacucaccagcagaacccgagccuagggccgucggucgcaccaaccaucugagucuuccgcguuucgcuccagugguuacaacccccgugaaagccgaaguaucuccucacggggcacccgcgcugagcaauggaccacagacucaggcccaguugcuccaaccucugcaggcuuuacagacgcagcugcuaccccaagcccucccaccgccucagccccagcugcaaccacccccuuccccacagcagaugcccccucuugagaaggcaagaauagcuggcgucgguucauugccgcugagcggcguggaggagaagauguuuucucuccugaagcgggccaaaguucagcuuuucaagaucgaccaacagcagcagcaaaagguggcagccuccaugccacugagucccgggggacagauggaggaagucgcuggcgcggugaaacagauuagcgauagggggccuguacgcucugaggacgaauccguggaggccaagcgagagagaccaucaggacccgaaaguccuguucagggcccccggaucaaacacgucugcaggcaugcagcuguggccuugggucaagcccgcgcuauggugccagaggaugucccgagacucagcgcacugccuuuaagggaccggcaggaucuggccacagaagacaccucguccgcgucugagacugaaagcguucccucacguagucgccgagggaagguggaggcugccggaccaggcggugaguccgaaccuaccggcucugggggaacacuagcacacacccccagaaggagccucccaucccaucacggcaaaaagaugcggauggcccgcugugggcacugcagaggaugucugagggugcaggauugcggcucaugcguaaacugucuugacaagccuaaauuuggugggcccaauacuaagaaacaaugcugugucuaucggaagugcgauaaaauugaggcucgaaagauggaaagauuggccaaaaagggacgcacaaucgugaagacgcugcucccgugggacagcgaugagaguccagaagccucuccuggacccccaggccccaggagaggggcgggagcugguggcccucgugaggagguuguggcccauccggggccagaggaacaggacucccuguuacagagaaaaagcgcaaggcgcugugucaagcagcggcccucguacgacauauucgaagauucagacgauucugagccuggaggacccccagccccucgaagaaggacaccccgcgagaacgaacugccacuuccugagccggaggaacaaagucggcccagaaaaccaacuuugcagccugugcuccagcugaaggcucguaggcggcuagacaaagaugcccuggcacccgguccauucgcuuccuuuccuaauggguggacaggaaagcaaaagagccccgacggcguucaccgcgugcgaguagauuucaaagaagacugcgaucucgagaacgucuggcugaugggcgggcuuucuguguugaccagcgugccgggagguccaccuauggucugucuguuaugcgccuccaagggccuccaugagcugguguuuugccaaguuugcugugaccccuuccacccauuuugccuugaagaggcggaaagaccccugccucagcaucacgauacauggugcuguaggcggugcaaauucugucacguaugcgggcgcaagggaagaggcucaaaacauuugcucgagugugaaaggugccgacacgccuaucaucccgcaugucuggguccaaguuacccuacucgggcuacccguaagagacgccacuggauuugcagcgccugugugaggugcaagucuuguggggcuacgccgggcaaaaauugggacgucgagugguccggagauuauucacuaugcccccggugcacccagcuguacgagaagggcaacuauuguccaaucugcacaagauguuacgaagacaaugacuacgagaguaaaaugaugcagugcgcacaaugugaucacugggugcaugccaagugcgaagggcucagcgacgaggauuaugaaauucuguccggacuuccugacucuguuuuguacacuuguggucccugcgccggcgcugcgcagccacgcuggagggaggcacugucgggggccuuacagggaggccuccgacaggugcugcaaggucuucugagcucaaaagucguggggccucuacuccuguguacccagugcggacccgauggcaagcaguugcacccgggcccuugugggcugcaagcuguuucccagcgguuugaggacggacauuauaagagugugcacucuuucauggaagauauggucgguaucuuaaugagacauagcgaggaaggcgagacaccagacaggcgcgccgggggacagaugaaaggccuccugcuuaagcuguuggaguccgcauuugguugguucgaugcccacgaccccaaauacuggcgucggucaacuagacucccuaacgggguacugccaaaugcugugcuacccccuucucuggaucacguuuaugcgcaguggaggcaacaggaaccagagacccccgaaagcggacagccgccuggcgaccccagugccgcauuucagggcaaggauccagcugccuucucccaucuugaggacccccgccaaugcgcacucugccugaaauacggggacgccgauagcaaggaagcuggacgauugcuguauaucggucagaacgaguggacgcacgugaauugugccauuuggucugcggaggucuuugaagagaacgacggcucacucaaaaacgugcaugcagccguagcucgggggagacagaugaggugcgaacucugucugaagccuggagccacagugggcugcugucuuuccaguugccugagcaauuuccacuucaugugugcucgcgcaucguacugcauauuucaggaugacaagaaagucuucugucaaaagcauaccgauuugcucgacgguaaagagaucguuaacccagauggguuugacgugcugagacggguguacgucgauuucgaaggcauuaauuuuaagaggaaauuccuaacuggacuggagcccgacgccaucaacgugcuuauaggcucuauucguaucgauucccucgggacacugagcgacuugucagacugcgagggacgauuauuuccuaucgguuaucaguguagucgccuguacuggucuaccguugaugcuagacggaggugcugguaucgcugccggauucucgaauaccggccauggggcccgagggaggaacccgcccaccuggaggcagcggaagagaaucagacuaucguacacuccccugccccaagcucagagcccccugggggagaagacccaccccuugauaccgacgugcuggucccgggcgcuccugagcgacauaguccaauucaaaacuuggaucccccucuacgucccgacagcgguuccgccccaccgccugcacccagaucuuucagcggggcucgcauaaaggugccaaauuauucccccucacggaggccucugggcggaguuucuuuuggcccacuccccaguccugggucgccaagcucccugacacaccauaucccgacggugggagaucccgacuucccugccccacccagacgcucucggaggccuucaccacuugcaccccgaccuccgcccagcagaugggccuccccaccuuuaaagaccaguccccagcugcgggucccaccucccacuucugugguaacagcucucaccccaacaagcggugaauuggcgccgccuggccccgccccaucacccccuccacccgaggaucuggggccugacuuugaggauauggaagucguguccggacucagugcagcugaccuggauuucgccgccagccuucugggcacugagccguuucaggaagagauuguugcagcuggugccauggggucuucccacggcggacccggcgacucaagcgaagaggagucgucuccaaccaguagguacauccacuucccugugacggucguguccgcgcccggguuggcuccaagcgccacaccuggagcaccccgcaucgaacagcuagacggcguugaugacgguaccgauucagaggccgaagcugugcaacagccacgugggcagggaacuccgccuuccggccccggugucgugagagcaggcguacugggggccgcgggagaccgagcuaggccaccugaggaucuccccucugaaauuguggacuucguucugaaaaaccuaggcgggccaggagauggcggugccgggccucgggaggagagccuucccccggcaccaccccuggccaauggaagucagccuucccaaggccucaccgcuagcccagccgaccccacacgcacuuuugcaugguugccuggugcuccgggcgucagagugcugucucucgggcccgccccagaaccucccaagccagcgaccucaaaaauaauccuggugaacaaacuuggacaggucuucguaaaaauggccggcgagggggaaccugugcccccaccuguuaagcagcccccgcuaccuccaacaauuagucccacggcaccuaccuccuggacucugccacccggaccguuguuaggcgugcugccugucguggguguugugaggcccgcuccacccccuccacccccuccacucacacugguccuuagcucugggccggccucgcccccucggcaggcaauccgcgugaagagaguaucaaccuuuagcggacgauccccacccgcuccuccacccuauaaagccccgaggcuggaugaggacggcgaagccagugaggauacuccucaagugccaggccucgggucuggagguuucagccggguucguaugaagacacccaccguccgcggcguguuggaccuggauagaccuggggagcccgcgggagaagaguccccaggcccucuacaggaaaggucaccccugcucccacuuccggaggacggucccccucaggugccagacgggcccccugaucuguuauuggagagucaguggcaucacuacucuggagaagcuagcuccucagaggaggaaccacccagcccugacgauaaagaaaaucaagcaccgaagcggacgggcccacaucugagauuugagauuucuuccgaggacggcuucagugucgaagccgagagccucgaaggggcuuggcgcacucugaucgagaaaguucaggaagcccgaggacacgcaaggcuucggcaucugucguuuuccgguaugucuggcgccagacucuuggggauacaccacgaugcugugaucuuccuggcggagcaguuacccggagcccaacguugucagcauuacaaguuucgcuaucaccagcagggcgagggucaagaggaaccuccacuaaacccccauggggcagcuagggccgaaguauaccugcggaagugcaccuucgacauguuuaauuuccucgcaucacagcacagagugcuuccugagggagccacaugugaugaagaggaggacgaaguccagcugcgaagcaccaggcgcgcuacaaguuuggagcugcccauggccaugcgguucagacaccucaaaaagacauccaaagaagcggugggcguuuauaggucugcaauucauggccgcgggcuguuuugcaagcguaacaucgaugccggagagauggugauugaguacagcgguaucgucauacggucaguacuuaccgacaaaagagaaaaguucuaugauggcaaggggauuggauguuacauguuucgaauggacgacuucgaugugguugacgcuacaaugcacggcaaugccgcaagguuuaucaaccauuccugcgagccaaacuguuucagucgcgugauucacgucgaaggucagaaacauaucgugauauuugcucuccggagaauccugagaggggaggaauugacuuaugauuacaaguucccgauugaggacgccagcaauaaacugccuugcaacuguggagcuaagcgcugcagacgguuuuuaaauuga

SEQ ID NO: 58222 - RNA, 14736 nt, Artificial Sequence
  derived and/or modified sequence opt3 from KMT2C__Homo_sapiens__NP_733751
auguccuccgaggaagacaagucuguggagcagccccaaccuccaccgcccccuccagaagaaccaggcgccccugcuccaucacccgccgccgcggauaaaagaccuagggggcggccacgcaaggacggagcuaguccguuccagcgagcccguaaaaagcccagaagcagggguaaaaccgcagucgaagaugaggacuccauggauggccuggagacuacugaaacggagaccaucguugaaaccgagauuaaggagcagucugccgaagaggacgcugaagccgagguggauaacucgaagcagcucauaccuacucuucaacggucaguaagcgaagagagugccaauucccuggugucugucgggguggaggcuaaaaucagcgaacaguugugcgccuuuuguuacugcggagagaaguccucauuaggccagggugaccugaaacaguuccgcauuaccccaggguuuauccuacccuggagaaaccaaccuaguaauaagaaagauauugacgauaacagcaauggaaccuaugaaaagaugcagaacucugcgccaaggaagcagcggggccagcgcaaagagcgaagcccccaacagaauaucguuucaugugugagcgucaguacccagacugccucugacgaucaagccggcaagcucugggacgaacugucccuuguggggcugccggacgcuauagauauccaggccuuguucgacagcacaggaaccugcugggcucaccauagauguguagaguggucgcucgguguuugccagauggaggaaccucugcuggugaacgucgauaaagcuguggugucuggcuccacggagaggugugccuuuugcaagcaccucggggcgacuauuaaauguugcgaagagaaguguacccagauguaccauuaucccugcgccgcgggagcuggcacauuccaagacuuuucacacaucuucuuacugugcccagaacauauugaucaggccccugagcggaguaaagaggacgcuaauugugccgucugcgauagccccggugaccuuuuggaucaguuuuucuguacuaccugcgggcagcacuaccacggaaugugucuggacaucgcaguuacaccacuaaagcgugccggcuggcaaugccccgaauguaaggugugccagaacuguaaacaguccggcgaggauucuaagaugcucguaugcgacaccugugacaaaggguaucauacguuuugccugcagccugugaugaagucagucccaacuaauggauggaaaugcaagaacugucgcauaugcauugaaugugguacaagaucaaguucccaauggcaccauaauugccuuaucugugauaacugcuaccagcagcaggacaaucuguguccguucugcggcaaguguuaucaccccgaguugcaaaaagauaugcuccacugcaacauguguaagaggugggugcaucuggagugcgacaaaccuaccgaucacgaauuagacacucagcugaaggaggaauacauuugcauguacuguaaacaucucggggcugagauggaucggcuucagccaggagaagagguugagaucgcggaacugacaaccgacuauaacaaugagauggaaguggagggccccgaagaucaaauggucuuuagcgagcaggcagccaacaaggacgugaauggucaggagucuacgccugggaucguaccagaugcuguucaggugcacaccgaagaacaacagaagucacaucccagugagagcuuggacacagauucccuacugauugccgucucuucgcagcacacugugaacaccgaacucgaaaaacagauaagcaaugaggucgacuccgaggaccugaagaugucaagugaagugaaacacaucugcggcgaggaucaaauugaagacaagauggagguuacagagaacaucgaagugguaacucaucagauaaccguccagcaggagcaacuucagcuguuggaagaaccggaaacagugguuucucgagaggagagccgcccuccaaaacucgugauggaauccgucacccugcccuuagagacucuggugucaccucacgaagagagcauuucucuaugucccgaagaacaacucguaaucgagagacugcaaggagaaaaggagcagaaggaaaauuccgagcuuaguacgggcuugauggauagcgaaaugacaccaaccaucgaggggugcgugaaagacguuucuuaccagggagguaaguccauuaaacugucaagugagacugaaagcucguucuccucuagcgcagauaucucaaaggccgacgucaguuccucuccuacccccagcuccgaucucccaucacaugacaugcugcacaacuauccgagcgcucuuaguucuuccgccggcaauauuaugccuacaaccuacauaagcgugacucccaaaaucgggaugggaaagccagcaauuacaaaaaggaaguucucgcccggccggccucgcucaaagcagggugcguggucuacgcacaacaccgugaguccacccuccuggagcccugauaucucugaggggagagaaaucuuuaaaccgaggcaacugccaggcagcgcuauuugguccauaaaggucggacguggcucaggguuccccggaaaacggcgaccuagaggugccggcuugagugggaggggaggccgcggucggagcaagcucaaaucugggaucggcgcaguugugcugccaggaguguccacugccgacauuucaaguaauaaggaugacgaggagaacagcaugcauaauacaguagucuuauuuuccucuucggauaaguucacccugaaccaggacaugugugugguuugcggcagcuuugggcagggagcugaaggcagacuacucgccuguucacagugcggucaauguuaucaccccuacugcguguccaucaaaauuacaaaggucgugcugaguaaaggguggaggugucuugagugcacuguuugcgaagcauguggaaaggcuaccgacccuggccgcuugcugcucugcgaugacugugauaucucuuaucauacguacugccuggacccgcccuuacagaccgugccaaaagguggcuggaaguguaaguggugcguauggugucgacacugcggggccacaagcgcgggacugcggugugaguggcagaauaacuacacucagugcgccccuugugcuucccuuucaucuugccccgucugcuaucguaacuacagagaagaggauuugauacuccaauguaggcagugcgaccgcuggaugcaugcagugugucagaaucugaacaccgaggaagagguggaaaaugucgccgauaucggcuucgacugcagcaugugucggccauauaugccugcuaguaacguucccuccagcgauugcugugagucuagccuaguggcccagauuguaacaaaagugaaggaacuggacccaccgaaaacuuacacccaagauggggucugccucacggaguccggaaugacacagcugcagagucuuaccgugacuguuccuagaaggaagcgaagcaaacccaaguugaagcugaaaaucauuaaucaaaacucgguggcagucuuacagacaccacccgacauccagucugagcacucccgcgacggcgaaauggaugacagccgggagggugaacucauggauugugacgggaagucagagaguucuccugaaagagaggcgguggaugacgagaccaaaggaguugaaggcacugauggugugaagaaaaggaagcguaaaccauaucgccccggcauagggggauuuaugguccggcagagauccaggaccggccaagggaagacaaagcgaagcguaauucggaaagacucaaguggaagcaucuccgagcagcugccuugccgcgaugacggcuggucugaacagcuuccggauacgcugguggacgagagcguuuccgugaccgagucaacugaaaagauuaaaaagagauacaggaaacggaagaauaaguuggaggaaacauucccagccuaucuccaggaggcauuuuucgguaaagaucugcuagacaccucucgacaaaguaagaucucgcuggacaaccucagcgaagauggggcccagcugcuuuacaaaacaaauaugaacacuggauuuuuggaccccucccuggauccuuuacucucuucaagcuccgcacccaccaagaguggcacgcacgguccagcugacgauccucuggccgacauaucugagguccuuaauacagaugacgauauccugggcauuaucagcgacgaucuagcaaaaucaguggaccauuccgauauugggcccguaaccgacgacccaaguagccucccucagccgaacgugaaucagucuuccagaccccugucagaggaacaauuggauggaauccugagcccagaguuagacaagauggucacugauggcgccauacucgggaagcuguacaaaauuccugaacuuggaggcaaggacguugaggaucuguucaccgcuguguugucgcccgcgaacacacagccaacuccucucccccagccgccaccucccacccaacugcuaccaauccacaaucaggacgccuuuucucgcaugccccugaugaacggucuuaucgggaguuccccucaucucccgcacaacagccugcccccaggaucaggcuugggcacauucuccgcaauugcucagucuagcuauccugaugccagggacaaaaauagugccuucaaccccauggcuuccgauccuaauaacagcuggacgucuucagcaccaaccguggaaggggagaaugacacuaugaguaacgcccagcguuccacacugaagugggagaaagaagaggcguuaggagaaauggcuaccgucgcccccgugcucuacacuaauaucaacuuuccuaaucugaaggaggaguucccagauuggacaacccggguuaagcaaauugcaaaacuuuggagaaaggccagcucucaggagagggcucccuauguacagaaagcacgcgacaaccgagccgcgcugagaauaaauaaggugcagaugucgaacgacucaaugaaacggcaacagcagcaggauagcaucgacccguccaguaggauugauucugaguuguuuaaggacccucucaagcaacgcgaaagcgagcaugaacaggaguggaaauuccgucagcagaugagacaaaaguccaaacagcaggcuaagaucgaggccacgcaaaaacuggaacaggucaagaaugagcagcagcaacagcagcagcaacaguuugguucacagcaccuacuggugcagaguggcucugauacuccaagcuccgggauucaaucaccccuuaccccucagccaggaaacggcaauaugagccccgcacagucuuuccacaaagaacucuuuacaaagcaaccgccuuccacccccacaaguacaagcucggacgauguuuucgugaagccacaggccccucccccacccccugcuccaucccggaucccgauacaggacucucugucacaggcccaaaccagccagcccccuaguccacaggucuuuucccccgguucuagcaacucaaggccuccaucccccauggauccuuacgcaaaaaugguggggacaccgcgcccacccccuguaggacauaguuucagccgaagaaacucugcugcccccgucgagaauuguacuccauugucauccgugagccggccuuuacagaugaacgaaaccacggcgaauaggcccucuccaguucgcgaccugugcaguucguccacaaccaacaaugauccguaugccaagccucccgacacuccaagacccgugaugaccgaucaauuuccuaaaagccucggccugucaaggucuccagucgugagcgagcagacagcaaagggccccaucgcugccgggacuuccgaccacuucaccaaaccuaguccgcgggcugacguuuuucagcgucagcgcauuccagauucauacgcacgaccccuucugacgccugccccauuggacucuggacccgguccuuucaagacacccaugcaaccaccgccuagcucccaggaucccuauggcagugugagccaggccuccagaaggcuaucugucgacccauacgagcggccugcucugacaccccgcccaaucgauaacuucucacauaaucaaagcaacgacccuuacucgcagcccccgcucacuccacacccugcggugaaugaauccuuugcacaccccaguagagccuucucucagccagggacaauuagcaggcccaccucacaggauccuuauucccaaccgccaggaacuccccggccuguaguggacucuuacagucagagcuccggcacagcucgaucaaacaccgaucccuauagccagccaccugguacgcccagaccaacuaccguugacccuuacucucagcaaccgcagacaccccgcccaaguacccagacagaucuguuugucacuccugugaccaaucagaggcauuccgaccccuaugcccacccaccugggacgccccggccgggaaucagcgugccauacucacaaccucccgcaacaccacgucccagaauaucugagggcuucacuagguccucgaugacccgcccuguccuuaugcccaaccaggacccauuuuuacaggccgcucagaaucggggcccugcgcugccggggccccucguacgaccaccugauacaugcagccaaacccccagaccaccuggacccgguuugagugacacuuucucuaggguguccccgagcgccgcacgcgauccuuaugaccagucaccaaugacaccccggagucaguccgauagcuuuggcacaucucaaacggcucaugacguugccgaucagccuagaccagggucagaaggauccuucugugcauccucuaacagucccaugcacucgcagggccagcaauuuagcggugugucccagcugccugggccaguccccacuucaggagugaccgacacacagaauaccguuaacauggcccaggcugauacugagaagcuccgucaaaggcagaaacugcgggaaauuauccuucagcagcaacagcagaagaaaaucgccggccgccaagagaagggcucucaggacagcccggcggugccucaucccgggccacugcagcacuggcagcccgagaaugucaaccaagcauucacacgaccuccacccccuuacccaggaaacauuagaaguccgguggcacccccuuuggguccaagguacgcuguauuucccaaagaucagcggggcccuuauccacccgacguggccuccauggggaugcgcccgcacggauucagauucggcuuuccuggugggucacauggaaccaugccaucucaggaaagguuccuaguucccccucagcaaauacagggcagcggcgucagcccccaacugcgacggagugugagcguggauaugccacguccgcucaauaacucucagaugaauaacccugucggguuaccccaacacuuuucaccacagucccugcccguucagcagcauaauauccuuggacaggcuuacauugagcugagacaccgcgcaccugacgguaggcagcggcucccauucagcgcacccccuggcagugugguagaggcuucuuccaacuugagacacgggaauuuuaucccacgcccggacuuccccggaccuaggcauacggauccaaugcgacggcccccucagggccugccaaaccaacuccccgugcacccugaccuggagcaggucccgcccucgcagcaggaacaaggucauagcgugcacucauccucuaugguuaugagaacucuuaaucauccacuagggggcgaguuuagugaggccccucugagcacaucagugcccuccgaaaccaccagcgauaacuugcagauuacuacacagccaucugacggauuagaggaaaagcuggauagugacgauccuuccgucaaggagcucgacguaaaagaucuggagggcguggaaguuaaggaccuugaugacgaggaucuggaaaaucucaacuuggacaccgaggacgggaaaguggucgaacuggauacacuagacaaucuggagacuaacgaucccaaucucgacgaucuucugaggagcggagaguucgacaucauagcauauacggauccagaauuagacaugggugauaagaaaucaauguuuaacgaggaauuggaccugccgaucgaugacaagcucgacaaccagugcgugucugucgagccuaagaaaaaggaacaagagaauaaaacccuggugcuuucggauaagcacagcccccagaaaaaguccacaguuacuaacgaggugaaaaccgaaguacugaguccaaauucuaagguggagucaaagugugaaacagagaaaaacgacgaaaauaaggauaacgucgacacccccugcagccaggcguccgcccacagugaucucaaugacggcgagaaaacuucuuugcauccuugugauccagaccuguucgagaagcgcacgaaccgugaaaccgcugggcccagcgccaauguuauucaggcauccacacaauuaccugcucaggaugugaucaacucaugcggaauuacuggcagcaccccgguccuaucuucccugcucgccaaugagaaaagugacaacucagauauccggcccagcgguucgccaccucccccaacacuuccugcaucccccucuaaucacgugaguagccugccaccguuuauagccccucccgggagaguauuggacaacgcuaugaacucaaacgugaccguuguguccagggucaaccauguguucucucagggcguccaagugaauccaggacugauuccuggccagagcacuguuaaccacagucucgggacaggaaagcccgcgacgcagaccgguccacagacuucccaaagcggcacaucuucaauguccgggccucagcagcugaugaucccccagacccuugcccaacagaaucgcgaacgaccgcuccuguuggaggagcagccacuguuacuacaggaucugcucgaccaagaacggcaggagcagcaacagcagagacagaugcaagcaaugaucaggcagcgcagcgaacccuuuuucccuaacauugacuucgaugcuaucaccgacccaauaaugaaggccaaaaugguagcccuuaagggaauuaauaaagugauggcacagaacaaucugggcaugcccccuauggucaugaguagauuuccguucaugggucaggugguuacagggacucaaaacucugagggccagaauuugggaccccaggcuaucccacaggauggcucaauuacgcaccaaaucucccggccuaaucccccaaauuuugggccuggauucgugaacgacagccagaggaagcaguacgaagaguggcugcaggagacccaacagcuccugcagaugcaacagaaauaucuugaggaacagauaggcgcccaucguaagucgaagaaagcguuaucugcuaagcagcgaacagccaaaaaggcaggucgcgaauuucccgaggaagaugccgagcaacugaaacacgucacugagcagcagaguauggugcagaagcaacucgaacagauuagaaagcagcagaaagagcaugcugaauugaucgaggacuaccggaucaagcaacagcagcaaugugcaauggccccaccuaccaugaugcccuccguacagccgcagccuccacugauucccggggcgacaccuccaaccaugagccagcccacuuucccgauggugccucaacagcuacagcaccagcaacauacgacaguuaucucaggacacaccucucccgucaggaugccaagccugcccggcuggcagccuaauuccgcuccagcccaccucccccuuaacccuccacgcauucagccgcccauagcacagcugccuaucaaaacuugcaccccagcccccgguacagugaguaaugcuaacccucaaucaggcccacccccgagaguggaauuugaugacaacaauccuuucagcgaguccuuucaggagcgggaaaggaaggagcgauugcgugaacagcaggagagacaacgcauucagcugaugcaggaggucgaucggcaaagggcccuccagcagagaauggaaauggagcagcaugggaugguuggaucugaaaucaguagcucccgcacuucagugucucaaaucccauucuauucgagcgaccugcccugugauuuuaugcagccuuuaggcccccuucagcaguccccacaacaccagcagcagauggggcaaguacugcagcagcaaaacauucagcagggaaguauaaauucuccuagcacccagacauucaugcaaacgaacgagcggagacaggugggacccccaucauuugucccggacucccccagcaucccuguggguucuccaaauuucaguuccguuaaacaggggcauggaaaccucucaggcaccagcuuccagcaaucucccgugcgaccuucguuuacuccagcacuacccgcugccccuccggucgcaaauuccagucugccaugcggucaggauagcacaauuacccacggccauucauaccccgggucuacucaguccuugauccagcuguacagcgacauuaucccugaagagaagggcaagaagaagagaacacggaaaaagaaaagggacgaugacgccgagaguaccaaggcaccaucaacgccccacuccgauauaaccgcuccucccacaccaggcaucagcgaaacuaccucuacaccggccgugaguacuccuagcgagcucccccaacaggcagaccaggaauccguagagccaguugggccuucuacccccaacauggcugccggacagcuuuguacagaacuggagaauaaauugccaaacucagauuucagccaagccaccccgaaucagcagacuuaugcgaacuccgagguggacaagcugucgauggaaacgccugcuaagacagaggaaauuaaacucgagaaggcagaaaccgagucuugccccggccaagaggaaccaaaauuagaggaacagaaugguaguaaggucgaggggaacgccguggcuugucccgugagcucagcccaguccccuccacacucugcaggagcccccgcugcgaaaggcgauagcggcaaugagcugcuuaagcaucugcuaaagaacaaaaaguccaguucacuccugaaccagaaaccugaagggagcaucugcucugaggacgauugcacuaaggacaauaaauuggucgaaaagcaaaacccggccgagggacugcagacccucggugcacagaugcagggcggguuuggauguggcaaucaacuuccaaagacagaugguggguccgaaacgaaaaagcagcgcaguaaacguacccagagaacuggagagaaggcugcaccccgaagcaaaaagaggaagaaagacgaggaagagaagcaggcaauguacucaucuacagacaccuucacucaccugaaacaacagaacaauuuauccaacccucccacacccccugccucgcugcccccaaccccuccgcccauggcuugccagaagauggccaauggcuuugcgacaacugaagaguuggcaggcaaagccgggguucucgugagccaugaaguaaccaagacgcugggaccaaaaccuuuccaacuacccuuucggccacaggaugaccuucuggcucgcgcccucgcacaggguccuaagaccguggauguccccgcuagucugccgacaccaccccacaacaaucaggaggaguugaggauucaagaccacuguggcgauagggacacuccugauuccuucgugccaucuucaagccccgaauccguugugggggucgaggugucucgguauccugaccugagccucguaaaggaggagcccccagaaccuguuccgagucccaucauaccaauucuuccuucaaccgccggaaaauccagcgagucucgcagaaacgauaucaagacagagcccggcacucuguacuuugcuaguccauucgguccuucccccaaugggccgcgaagcggauuaauuucaguggccaucacccugcauccaacggcagcggaaaacauaucgucugucguggccgcuuuuagcgacuugcuccacguuaggaucccuaauuccuaugaggugaguucagcccccgaugucccaucuaugggccuggugagcucccaucggauuaacccuggccuagaauaccgucagcaccuucugcuccgcgggcccccgccuggaagugcaaaucccccaagacugguaagcucuuauagguugaaacagcccaacgugccuuucccacccacauccaacgguuuaucaggcuacaaggacagcucgcaugggaucgcugaguccgccgcacugcggccucaguggugcugucacugcaaagucguuauucucggaucuggcgugagaaagaguuuuaaggaucuuacccugcuaaauaaagacucacgcgagagcacuaagcgagucgaaaaagacaucguguucuguuccaacaauugcuucauacuguacucuagcacagcccaagcgaagaacagugagaauaaagaaucaauuccaucccucccccagagcccgaugagggagaccccuucuaaggcuuuucaccaguauuccaacaauaucaguacuuuggauguacauugucugccacagcuucccgaaaaggccagcccuccagcaucacccccuaucgccuucccacccgcuuuugaggccgcacaaguggaggcuaaaccggacgaacugaagguuaccgugaaacucaagccucgguuaagagccguccacgguggguucgaggauugccguccacugaacaaaaaguggcgcggaaugaaguggaaaaaguggucuauucauaucgugauacccaaaggcacauuuaagccucccugugaagacgagauugaugaguucuugaaaaagcugggcacgucccucaaaccagacccgguucccaaggauuacaggaagugcugcuuuugucacgaggagggggacggacuuaccgaugguccugcgcggcugcuaaaucuggaccucgauuuguggguccaccugaacugcgcucuuuggagcacugaaguguaugagacacaggccggcgcacugaucaauguggaauuagcccucagacgagggcugcagaugaaauguguauucugccauaagaccggagcuacuucgggcugucacagguuucgcugcacaaacauuuaccauuucaccugugcaaucaaagcccaaugcauguuuuucaaggacaaaacgauguuguguccaaugcacaagcccaaggguauacaugagcaggaacugaguuauuuugcggucuuccggagaguguacguucagagggaugaggugcgccagaucgccucuauuguccaacguggggagcgggaccacacauucagagugggaucacucaucuuucacaccauuggccagcuucugccucagcagaugcaggcuuuccauuccccaaaagcacuauuucccguuggcuaugaagccagccgacuguacuggucuacuagguacgcuaaucgccggugcagauaucucuguagcaucgaggaaaaggacgggaggccuguguucguaauucgcaucgucgagcagggacacgaggauuuggugcuguccgacauaaguccaaaaggugugugggauaagauuuuagaaccgguugccugcgucaggaaaaagucagagaugcuucagcuguuucccgcauaccucaagggcgaagaccuguucggguugaccgugagcgcuguagcccggaucgcggagucccugccuggaguggaagccugcgagaacuauacauuucgauacggcaggaauccacucauggagcuuccccuggcagucaacccuacugguugugcucguucugaaccaaaaaugagugcccaugugaagagauucguucuacggccccacacccugaacucaacaagcacguccaaaucuuuucagucgacugugaccggggaguuaaaugcaccguauagcaagcaauucguccauuccaaaaguucacaguaccgcaagaugaagacagaauggaaaucuaacguguaucucgccaggagccgaauccagggacugggcuuguacgcugccagagauauugagaagcacaccaugguuauagaauacaucggcacuauuauccggaaugagguggcgaaccgcaaagagaaacuuuaugaaucccagaauagagggguauacauguuuagaauggacaacgaucacgucauugacgcuacacugaccggagguccugcacgguauaucaaucauaguugcgcccccaacuguguggcugagguugugacguucgaacguggccacaaaauaaucauuucuagcucacgcaggauccaaaagggggaggaacucugcuacgauuauaaauuugacuucgaggaugaccagcauaagauuccaugucacugcggagccgucaauugucgaaaguggaugaacuga

SEQ ID NO: 58223 - RNA, 16614 nt, Artificial Sequence
  derived and/or modified sequence opt3 from KMT2D__Homo_sapiens__XP_005269219
auggacucccagaagcuggccggcgaggacaaagacuccgaacccgcugcagaugggccugccgcgucugaggacccaucagcuaccgaaagcgaucucccgaacccccacgugggagaggucagcguucuuuccucugguucgccuagacugcaagaaacgccacaggacugcucaggcgggcccgugaggcggugugccuugugcaauuguggagagccuagcuuacauggccagcgcgagcugcgacguuucgaacugccauuugauuggcccaggugcccuguagugagcccagguggguccccgggacccaacgaggcaguccucccuucugaagaccugagccagaucggcuucccagagggccuuacucccgcccaccugggggagccuggagguuccuguugggcucaucacuggugcgcagccuggucagcuggcgugugggggcaagaaggaccagaguuguguggcguugauaaggccauuuuuagcgguaucagccagaggugcucucauuguacgcggcucggggcguccauccccugccgcucaccgggauguccuagacuguaccacuuccccugcgcaaccgccagcggcaguuuucugucuaugaaaacccuccaguuacugugcccagaacacuccgagggcgcugccuaccuugaagaggcaaggugugcugugugcgaggggccuggagaauugugugaccuguucuuuugcacuagcuguggucaucacuaccauggcgccugcuuggauaccgcgcucacagcccggaagcgcgcaggguggcagugucccgagugcaaagucugucaggcuugccgaaagccaggaaaugacucgaagaugcuggugugugaaaccugcgauaaaggcuaucacacuuucugccuuaagcccccuauggaggaacugccagcccacucuuggaaauguaaggcuugcagaguauguagggccugcggugcaggguccgccgaguugaacccaaauucagagugguuugaaaacuacagucucugucaucggugccacaaagcucagggcggacagacaauucguagcguugcggagcagcauacccccguguguucccgcuucucuccuccagaacccggcgacacgccuacugacgagccagaugcacuguaugucgccugccaagggcagcccaagggaggucacgugaccagcaugcagccgaaggaaccuggcccauuacaaugugaggcuaaaccccuggggaaggccggagugcagcucgagccucagcuugaagcaccccugaaugaggaaaugccauugcuaccucccccagaggagucaccgcugaguccucccccagaagagucccccacaagcccuccacccgaagccucuagacucucaccuccgccagaggaacugcccgcuaguccucuuccagaggcccugcauuugagcaggccccucgaggaauccccucugucuccgcccccagaggaaucgccuuuaagucccccgccugaguccucacccuuuaguccacuggaagagucuccgcuaagcccucccgaggaauccccacccagcccugcucucgagacuccacugagucccccuccggaagcgucuccacuuagcccucccuucgaggaaagucccuugagcccaccucccgaggagcugccaaccucuccuccgcccgaggcuucccggcucucaccaccucccgaggaaaguccaaugagcccucccccggaggagucgccaauguccccucccccagaagccucucgacuguuucccccuuucgaggaaagcccgcuuucacccccaccugaggaaaguccccuguccccuccacccgaggcaucucgcuugagcccuccacccgaggacuccccgaugucaccuccacccgaagagagcccuaugaguccacccccggaagucucuagacucuccccucugcccguugugagcagguuaucgccaccucccgaggaaucaccacugucucccccuccagaggagaguccgacaucacccccuccagaagccagccggcuaucucccccuccagaggauagccccaccuccccuccgccagaagacucacccgcuaguccucccccagaggauagccucaugucucugccucuugaagagucccccuugcugccacucccggaggaaccucagcugugcccccgcucagagggcccacacuuaagucccagaccugaggaaccacaccugagccccaggccugaggaaccgcaucuuuccccacaagccgaggaaccccacuugucuccucagccagaggaacccugucucugcgcaguaccugaggagccccaucugucgccacaggcugaagguccgcaccuaagcccucagcccgaggaacugcaccucucaccacaaacggaggaaccucaucugucccccgugccagaggagccuugccuuaguccccagccggaagagucucacuugagcccacaguccgaggaaccuugucugucaccccguccagaagagucucauuuaagccccgagcucgaaaaaccuccgcugaguccacggcccgagaagccucccgaggaaccagggcagugcccugcccccgaggaacuuccacuguucccuccgcccggcgagccauccuugagcccucuccugggagaacccgcgcuaucugagccaggcgaaccuccccugucaccgcucccagaggagcugccucuuucccccaguggggaaccauccuugucgccccaacugaugccucccgacccauuaccuccgccccucucuccaaucauuacugccgcugcaccucccgcccuguccccacuuggagagcuggaauacccuuuuggugcuaaaggcgauagcgaccccgagucaccgcuagccgcaccuauccucgaaacaccaauaagucccccuccagaggcgaacuguaccgaucccgagccugucccacccaugauccugccgccuucucccggguccccagugggacccgccagcccuauuuugauggaaccacugcccccucagugcucaccauuacuccagcacagucugguuccgcagaauagcccucccucccaauguucuccacccgcacuuccucugagcgugccaucccccuugucaccgaucggcaaggucguggguguaucugacgaggccgaacuccaugagauggaaacugagaaaguuagugagccugaaugcccagcacuggagcccucggcuacaagcccucuacccuccccaaugggggaucugucuuguccggccccuucacccgcaccagcccuugacgacuucagcggccucggagaagauaccgcuccccuggacggcauugaugcgccugggucccagccagagcccggacagacgccuggcaguuuggccucugagcugaaggguagcccaguguuacucgacccggaggaacuggcacccgucaccccuauggaaguguauccagagugcaagcaaacagcugggcagggaucacccugugaagaacaagaggaaccucgagccccagucgcccccacuccuccgacccuuaucaaauccgauauagugaacgagauuaguaaucugagccagggcgacgcuucugcauccuuucccgguucagaaccauugcucggcagcccugaucccgaagggggcgggucgcugucuauggaacuagggguuaguacagacguguccccagccagagaugagggaagccugaggcuuugcacugacucacucccugagaccgaugacucccuguugugugaugcgggcacagcuaucucuggugggaaggccgaaggagagaaaggccgccggagaagcagucccgcaaggucccgcauuaagcaaggucgauccucuucauucccaggccggcguagaccgagagggggagcccacggcgggcgcggacggggcagagcuagguuaaaaaguaccgcauccagcaucgaaacucugguagucgccgacaucgacucuucgccuucaaaggaggaagaggaggaagaugacgauacgaugcagaacacagugguucucuuuagcaauaccgacaaguucgugcugaugcaggauaugugcgucgugugcgguuccuuugggcgaggagcggagggccaccuucuggcuuguagucagugcucucaauguuaccaucccuacugcguaaacagcaaaauuacuaaggugauguugcuaaaagguuggcgcuguguugaaugcauagucugugaggugugcggccaggccuccgacccaucacggcugcuccugugugaugacugcgauaucaguuaucacaccuacugucuugaucccccuuuacugacagugccaaaagggggauggaaaugcaaguggugcgucucuuguaugcagugcggcgcagccagccccggguuccauugugaguggcaaaauuccuauacccacugcggaccuugugcuucacucguuacuugcccgauuugucaugcccccuacguggaagaggauuugcugauccaaugcagacacugugaaagguggaugcacgcaggcugcgagagccucuuuacagaagacgauguggagcaggcugccgacgaggguuucgacuguguaucuugccagccauaugucgugaagccuguugcgcccguggccccaccugaacugguccccaugaaagugaaggagccagaaccgcaauacuuucguuucgaggggguuuggcuuacggaaaccggaauggcacuguugcgcaaccuaacuauguccccucugcauaaacggagacagaggcgaggccggcucggcuuacccggggaggcuggacuggaggguagugaaccaagcgaugcccuuggcccugacgauaagaaagacggggaucuggacacagaugagcucuugaagggagaaggcgguguggagcacauggaaugcgagauaaagcuggaggggcccguaucgccagacgucgaaccuggaaaagaggaaaccgaggaguccaagaaacgcaagagaaaacccuauaggccgggcauuggcggguuuauggugcggcagcgaaagucucauacaagaacuaaaaagggaccagcugcacaggccgaagugcucucaggugauggccaacccgacgaggucaucccugccgaucugccagcugaaggggcgguugagcagagccuugcagaaggagacgagaagaaaaagcagcagcgcaggggccguaaaaagaguaaacuagaggacauguuccccgccuaccugcaagaggcuuucuuugguaaggaguuguuagaucugucccggaaggcccucuucgcaguggggguaggaagaccuucuuuuggccugggcaccccgaaagccaagggggacggagguagcgaaaggaaagagcuucccacgucacagaagggcgaugacgggccagauaucgcugacgaagagucccgcggacuggagggcaaagcggauaccccuggucccgaagacgggggagugaaggccaguccagucccuagcgaucccgagaagccaggcacaccuggcgaagggaugcucucuucagacuuggaucgaauuuccacugaggaacugcccaaaauggagagcaaggaccuacagcagcuguucaaagaugugcucggaucugagagagaacaacaccuugguuguggcaccccggggcuggagggaagucggacaccuuuacagaggccauuuuugcagggcggucugccccucgggaaccugccuucguccagcccaauggacucauaccccggacuuugccagucuccguuccuggacagccgcgaacguggcggcuuuuucuccccugagcccggggagccagauagucccuggacuggaucagguggcaccacgccuucuacaccaaccacucccacaaccgaaggggagggagacggccucagcuauaaucaaagauccuugcagcggugggaaaaggaugaggaacugggucaguuaaguacuaucagcccuguucuauacgcaaacauuaauuuuccaaaccugaaacaagacuauccggauugguccucuagguguaagcagauaaugaagcucuggcgcaaagugcccgcugccgacaaggcaccuuaccuucagaaagccaaggauaaucgagcugcccacagaaucaacaaaguccagaagcaagcggagucacagauuaauaaacagaccaaggugggggacaucgcacggaagacagauaggccagcccugcauuugcgcauacccccucagccaggcgcucugggaagucccccgccugccgcugcaccaacgauuuucauaggcucgcccaccacuccugccgggcucuccacaagugcugacggauuucugaaacccccagccgguucuguuccuggccccgauagcccaggggagcuuuuccucaagcugccgccccaagugccugcacaggucccaucacaggaccccuuuggauuggcgccugccuauccacuggaacccagauucccuaccgcuccgccaacauaucccccuuauccaucccccacuggcgccccugcacagcccccaauguuaggugcuucuaguaggccgggggccggccaaccuggagaguuccacaccacgcccccaggcacaccucggcaucagcccagcaccccagauccguuucuaaaaccucguugccccucccuggacaaccucgcaguaccagaaucacccggggugggagguggcaaggccagcgagccucuucugucuccacccccuuucggggaaagucgcaaggcuuuggagguuaagaaggaggaacugggagcguccagcccgucauacggcccacccaaucucgguuuuguggacucuccuuccucggggacucaccugggcggacuugaguuaaaaacccccgaugucuucaaggccccacugacaccucgagcaagccagguggaaccccaaaguccaggccucggguugagaccucaggagccgcccccagcucaggcccuggccccuucucccccaucccauccugacaucuuuaggcccggaagcuacacugauccguaugcacagccaccccuaaccccucggccacaacccccucccccagaaucauguugcgcucugccuccgcgcagucuccccuccgacccauucagcagaguaccugccucuccccagucacagagcuccucucagaguccacuuacaccuaggccccugucggcggaggcuuuuuguccgagcccagugacgccucgguuccaaucccccgauccauacucacgaccucccucuagaccgcagagccgcgacccuuuugcccccuugcacaaaccacccaggccucagccacccgaggucgcauucaaggccggcagucuggcucacaccucccucggugcagggggauuuccugccgcgcugccagcuggccccgccggugaauuacaugcaaaaguuccgucaggccagccuccaaacuucgugcggucucccgggacuggagccuucgugggcacaccuagcccaaugcguuuuaccuucccccaagcugucggggagccuucccuuaagccacccgugccgcagccuggacugccacccccucacggcauuaauagucauuuuggucccgggccaacucucggaaagccgcagagcacaaacuauaccguugccacgggcaauuuccaccccucugguucaccucuaggcccauccagcgggaguacuggagaaucuuacggccugucccccuugagaccuccaucgguacugcccccuccagcaccggaugggagccuccccuaucuuucacacggagcuucccagaggucuggcaucaccaguccuguggagaaacgcgaggacccagguacagggaugggaagcucacuggccaccgcggaauugcccggcacucaagauccuggcauguccgggcugagccagacagagcucgaaaagcagcggcaacgacagagauuaagggagcugcuuauucgccagcagauccaacggaacacccugagacaggaaaaagagacagccgcagcugccgcaggagcugucgguccacccggcucuuggggagccgagccgaguuccccugccuuugaacagcuaagccguggacagacucccuucgcgggcacccaagacaagucaucucucgugggucugccaccuucgaaauugagcgggcccauacugggaccaggcuccuuuccuagugaugacaggcucucucggcccccgccacccgcuacgccuucaagcauggacguuaauucccgccagcuugugggcgggagucaggcauucuaccagcgagccccauaucccggaucucugccuuuacaacagcagcaacagcagcuguggcagcaacagcaggcuacagccgcaaccagcaugagauuugccauguccgcuagguucccaucaacucccgguccugaguugggccggcaggcgcucgggagcccgcuggccggaaucucuacccgccuacccggcccaggugaaccuguccccgggccagcaggaccugcucaauuuauugagcuuagacauaacgugcagaagggccugggccccgggggaacaccguucccaggucagggcccuccccagaggccacgauuuuacccuguauccgaagauccccaccggcucgccccagaggggcugcguggauuggcagucaguggccugccgccccaaaagccuucagccccacccgcuccugagcucaacaauagccuucaucccacuccacacaccaaagguccuacgcugccgacaggguuagaacuggugaacagacccccaucguccaccgaguugggacgcccuaauccccucgcccuggaagcgggcaagcuaccaugcgaggacccugaacuugaugacgauuucgacgcacauaaagcccuggaggaugacgaggaacucgcucaccugggcuuggggguugauguggccaagggagacgaugaguuagguacucuggaaaaccucgagacaaaugacccccaccuugaugaccugcuaaacggcgacgaguucgaucugcucgcauacaccgacccagaauuggauacuggggacaaaaaggauaucuuuaaugagcaucugaggcuugucgaaucugcuaacgagaaggccgaacgggaggcucugcucagaggaguggagccuggcccguuaggucccgaggaacgcccaccucccgccgcagacgcgagugaaccaaggcuggccagcguuuugccugaggugaaacccaaggucgaagaagggggacgacacccgucacccugucaguucacaauugcuaccccaaaaguggagccugcccccgcagcuaauucccugggccucggccuuaagccugggcagucuaugaugggaagccgggauacgagaauggguacuggcccauuuaguuccagcgggcauaccgccgaaaaagcaucuuucggagccacaggcggucccccugcgcaccuguuaaccccaucaccgcuguccgggcccggaggcagcagucucuuggagaaguuugaacuggagucuggcgcucuuacacugccugggggaccagccgcaucaggugacgaauuagauaaaauggaguccagccucguagccucggagcugcccuugcugaucgaagaccuccuugagcacgaaaagaaggagcugcagaagaaacagcagcuaucugcucagcugcaaccugcccagcagcagcaacagcagcagcaacagcauagucucuuguccgcaccaggccccgcucaggccaugagccugccgcacgaggggucaucuccuagcuuagcgggaucccagcaacagcuuagucugggccucgcuggugccaggcagccagggcugccccaaccuuugaugcccacucagccaccggcacaugcccugcagcagcgccucgcucccucaauggcaauggugagcaaccaaggccacaugcuuuccggacagcauggcgggcaggccggacugguuccucagcaaucuagucagccaguccuaagccagaaacccauggguaccaugccuccauccaugugcaugaagccccagcaacuggcgaugcagcagcaauuagccaauucauucuuuccugauacggaccucgacaaauucgcugcagaagauauaauugacccaaucgccaaggcuaagaugguggcccugaaaggcauuaagaaagugauggcacaggggucuaucggagucgcucccggcaugaaccgucagcagguaucguugcuugcccaacggcugagcggugggccguccagugaucuccagaaucacguggcggccggcucuggacaggagagaagcgcaggcgacccuucacagccaaggcccaacccuccaacauuugcucaagggguuauaaaugaagccgaucagcgccaguaugaggaauggcuguuccacacucagcaauugcugcagaugcagcuaaaggugcucgaggagcagaucggaguccaucgaaaaucccggaaggcacuuugugccaagcaaagaaccgcuaaaaaggccgguagggaauuucccgaggcggacgcugaaaaacugaaguuagugacagagcagcagagcaaaauucaaaagcagcuggaucagguucgcaagcagcaaaaagaacacaccaaccucauggcagaguacagaaacaagcagcagcagcaacagcagcagcaacagcagcaacagcagcagcauucugccgugcuggcuuugaguccuucccaaucaccgcggcuucugacuaaacuccccggccagcugcuaccagggcacggauugcagccuccccagggcccaccugguggccaagccgggggacugaggcucacccccggcgggauggcacuuccaggacagccgggcggucccuuccugaauacagccuuagcucagcagcaacagcagcaacauagcgggggagcgggcucucuggccgguccuucgggcggguuuuucccaggaaaccucgcacugcguuccuugggccccgacagucgacuucugcaggagcgccagcuccagcugcaacagcagagaaugcagcuagcccaaaaguuacagcagcagcaacagcagcagcaacagcagcaacaccuguuggggcaggucgcuauccagcagcaacagcagcagggaccuggcgugcaaacgaaucaggcacucgguccaaaaccccaggggcugaugccuccgagcucacaccagggacuucugguacaacagcucucuccacagcccccucaaggcccccaggguaugcugggcccagcccagguggcuguuuugcagcaacagcauccuggggcccuuggaccccagggcccacaccggcagguccugaugacucaauccagggugcuaagcaguccgcagcucgcgcagcaggggcaaggacugaugggccaucgcuuagugaccgcacagcagcagcaacagcagcaacagcaccagcagcaagguucaauggccgggcugucccacuugcagcagagccucaugucucauaguggacagccuaagcugagcgcucaacccaugggcucccuucagcagcugcagcaacagcagcaacuccagcagcagcaacaguugcagcagcaacagcagcagcaacugcagcagcagcaacagcuucagcaacagcagcugcagcaacagcagcagcaacagcaguuacagcaacagcagcaacagcagcuacagcaacagcagcagcaacuccagcagcagcaacagcagcaacagcagcaguuccaacagcagcagcaacagcagcagaugggccugcugaaccaaucuagaacauugcucucaccacagcagcagcaacagcagcaagucgcccuggggccuggaaugcccgcaaaaccacuucagcacuuuagcuccccuggugcucugggccccaccuuacuccugacugggaaggaacagaauacaguugauccggccgugucgucugaggcgaccgaaggaccaaguacgcaucagggcggucccuuggccauugggacuacaccugagagcauggcuaccgaaccaggagagguaaagcccucacuuuccggcgacucucaacugcuacucgugcagccucagccccagccacaaccuagcucccugcagcugcagccgcccuugcggcucccaggccagcaacagcagcaagucagucugcuucacaccgcagggggagguucacauggccagcuggggagcggaucuuccagugaggccagcucagugccucacuuacucgcucagcccucuguuucccugggcgaucagccagguucgaugacucaaaaccuauuggggccucagcagcccaugcuggaaaggccgaugcagaauaacacaggaccacaaccucccaaaccaggcccugugcuucagagcggccaggggcuccccggagucgguaucaugccgaccguaggccagcugcgagcacaacugcaggggguguuggccaagaauccacagcuucgucaccucaguccccagcaacagcagcaacugcaggcuuuacugaugcagagacagcuacaacagucccaggccguucgccagacaccucccuaucaagagccaggaacucagacgucuccucuccagggccuguuggguugccagccccaacuagggggauucccaggcccucagaccggcccgcuucaggaacucggggcaggaccccggccucaagguccacccaggcugccugccccacccggcgcguuaucaacagggccggugcugggaccuguccauccaacucccccucccagcuccccacaggagccuaaaagacccucucaguugccaagcccgaguucacagcuccccaccgaggcucaacugccuccaacacaccccggcaccccuaagccacagggucccacucuugaaccuccgccagggcgcgugucccccgccgcagcccagcuggcugacacgcuauuuagcaaaggacucggcccuugggauccacccgacaaccuggccgagacccagaagccugaacaaucuaguuuggucccaggccaucuggaccaggugaaugggcagguugugcccgaggcaucccagcuuagcauaaagcaagaaccgcgggaggagccuugugcucucggagcccagucaguaaaaagggaagcgaacggugagcccauuggcgcaccagggacaucgaaucaccuguuacuggccggaccucgaucugaagcuggccacuugcuccugcagaaacuucugagagccaaaaacgugcaacuaagcacuggucggggguccgagggccucagggcugaaaucaauggacauaucgauaguaagcuggcaggcuuggagcagaaacugcaggggacccccucaaacaaggaggacgccgcggcccgcaagccacuuacacccaaaccuaagcguguccagaaggcuucugauagauuaguuagcucccgaaagaaacugaggaaggaagacggagugcgggcaagugaggcccuccugaagcaacuaaaacaggaauugagccugcucccgcuuaccgagccagcuauuacugccaacuucucucuguuugcacccuucgguuccggcugcccugucaaugggcagucacagcuccgcggagccuuuggcagcggugcucugccaacagggcccgauuacuauucgcaauuauugacgaagaacaaucuguccaacccuccaacacccccgucuagucuuccucccacuccaccucccucagugcagcagaaaaugguaaauggcgugacaccaagcgaggaacugggagagcacccuaaggacgcggccuccgcaagagauucugaaagggcucuccgggacaccagcgagguuaaaagucuggaucuacuugccgcacugcccaccccgccacauaaccagacagaagacgugcgcauggagucagaugaggacuccgauagcccugacucuaucguccccgccuccaguccagaaagcauucucggcgaggaagcuccuagauucccccacuuggggucaggacgaugggagcaagaagacagggcgcugucuccagugauaccguuaaucccccgggccuccauuccugucuuuccagauacuaagcccuacggugcacugggccucgaggugccugggaaacuucccguuacgaccugggagaagggaaagggcagcgaaguaucggugaugcugacagucagugcugccgccgcuaaaaauuugaacggugugaugguugcaguggccgagcugcucucuaugaagaucccaaauucauaugaaguccuauucccugaguccccggcucgugcggggacugaacccaaaaagggcgaggccgagggaccaggcgggaaagaaaagggacuggaggguaagagcccugacaccggccccgauuggcuuaaacaguuugacgcagugcugccaggguacacacucaagucucaguuggauauucugagcuuacugaaacaggaauccccugcccccgagccgccaacccaacauaguuacacuuauaacguaucaaaucucgacgugcgccagcuuagcgcuccucccccagaggaaccuucucccccacccagcccucuggcaccgagucccgccucaccaccuacggagcccuugguugaacugccaacagagccucucgcugaacccccggucccaagcccucuaccccuggccuccucuccugagucggcaagaccaaagcccagggcgcggccuccagaggaaggagaggauagcagacccccgcgccugaaaaaguggaagggcgugcgauggaaaaggcuacggcuccuuuugaccauccagaaggguuccggcagacaagaagacgagcgugaaguggccgaguucauggagcagcuggggacugcucugcgcccugauaaagucccaagggacaugcggagaugcuguuuuugccacgaagagggagauggcgccaccgacgggcccgcacgacuccuuaaccuggacuuggaucuguggguucaccucaauugugcucuauggaguacagaaguguacgagacucagggaggcgcccugaugaacguagaaguggcguuacauaggggucuucugaccaagugcucacucugucagcgcacaggggccacgucuagcugcaaucggaugagauguccuaacgucuaucacuucgcuugcgcaauaagggccaaauguauguucuuuaaggacaagaccauguugugccccaugcauaaaaucaagggaccaugugagcaagagcuguccaguuucgcuguguuucgccguguuuacauugaacgggaugaggugaaacagaucgcaucuauuauccagagaggcgaacgacugcacauguucagggucgguggccucguguuucaugccauagggcagcuucugccgcaccaaauggccgacuuccacagcgcuacugcauuguaucccguaggauacgaggccacacgcauuuauuggucacuacggaccaauaacagaaggugcugcuaccgcuguuccaucggcgaaaacaaugggagaccugaguuuguuaucaaggugauugagcagggacuggaagaucucgucuucacugacgcgagcccacaggcuguguggaaccggauaaucgagcccguggccgcaaugcgaaaagaagccgauauguuaaggcuguuuccugaguaccuuaagggcgaggaacuguucggucucacaguccaugcuguuuugcguauugccgagucucugccagggguggaaucaugccagaauuaucuguuuagauacggacggcacccccucauggagcuaccucugaugaucaacccaaccggcugugcacgcagugaacccaagauucuuacgcauuauaaaaggccgcacacccuaaauuccacaagcaugucgaaggcuuaccaaucuacuuucaccggugagacaaacacuccuuauuccaaacaguuuguacacagcaagucaagucaguaccgaagacugcggaccgaguggaaaaauaacguguaucucgcccgcucuaggauccaaggcuuagggcuguacgcggcaaaggaccuugaaaaacauacaauggucauagaguacaucggaaccauuaucagaaaugaaguggccaaccggcgugagaagauuuaugaggaacagaaucgcggcaucuacauguucaggauaaacaaugagcacguuauugaugcuacucugacagggggaccagcccgauauaucaaccauuccugcgcucccaauuguguggcagaagucgugacauucgacaaggaggauaaaaucauuaucauaagcucaagacggauuccuaagggcgaggagcucaccuacgacuaucaguuugauuucgaagacgaccagcacaaaaucccaugccauuguggugccuggaacugcaggaaguggaugaacuga

SEQ ID NO: 58224 - RNA, 5577 nt, Artificial Sequence
  derived and/or modified sequence opt3 from KMT2E__Homo_sapiens__NP_061152
augucaaucgugauuccccugggcgucgacaccgccgagacauccuaccucgaaauggcugcagggucugaaccugaaucaguugaggccaguccagugguuguggagaaaagcaacuccuauccgcaccagcuuuacacuucuucgucacaucacucccauaguuauauaggacugcccuacgcggaucacaacuauggugcuagaccuccacccacgccuccagccucucccccuccaagcgucuugaucagcaaaaacgaagugggcauuuucaccacaccgaauuuugacgagacuuccucagcaaccacaaucaguaccagcgaagaugggucuuacggaacugacguuacaaggugcauuuguggcuucacccaugaugacgguuauaugaucugcugugauaagugcuccguguggcaacacauagacuguauggggaucgaucggcagcacauucccgacacguacuuaugcgagcgcugucagccucgaaaccuggauaaagaacgugccguccuacuccagagaaggaagcgggagaauaugucagacggagauacuagcgcuaccgagaguggcgacgaagugccaguagagcuguacacagcauuucaacauacucccaccucuaucacacuuaccgccucccgcguuagcaaagugaacgacaagagaaggaagaaaucgggcgaaaaggagcagcacauuucuaaaugcaagaaggcuuuccgggaagggucccgcaagucaagucgagucaagggaagcgccccugagaucgauccauccucugacgguagcaauuuuggcugggagacgaaaauaaaggcguggauggauagauaugaagaggcaaacaauaaccaguacucagaaggggugcagagggaggcccaacggauugcucugcguuugggaaauggcaacgacaaaaaggaaaugaauaaaagugaucucaacacuaauaaccugcuguucaagcccccgguggagucccauauccagaaaaacaagaagauucucaaaagcgccaaggacuuaccucccgaugcacugaucaucgaguaucgcgguaaauuuaugcuuagagaacaguucgaggcuaauggguacuuuuucaagaggccauauccuuuugucuuguucuacucuaaauuucacggacuggaaauguguguugacgcccggacauucggcaacgaggcgcgauucauucgcagaucaugcacccccaaugccgaagugaggcacgagauacaggauggcacuauccaucuauauauuuacaguauccacagcauaccaaaggggacagagauuaccaucgcauuugacuucgauuacggaaacuguaaguauaaaguagacugcgcuugccucaaggaaaaucccgaguguccugugcugaaacgguccucugaaucgauggagaacaucaauagcgguuacgagacgcgcagaaagaaaggcaagaaggacaaagauauuuccaaggaaaaagacacccaaaaccagaauaucacacuugauugcgaggggacuaccaacaagaugaaaucaccagaaacaaagcagaggaagcugaguccguugcgucucucugucagcaauaaccaagagcccgacuuuauugaugacauagaagagaaaacuccuaucuccaaugagguggaaauggagucagaagaacagauugccgaacggaagcgaaaaaugaccagagaggagaggaagauggaagcuauccugcaggccuucgcacgcuuagagaaacgggaaaagagaagggagcaggcccuggaacgcaucagcacagcuaaaaccgagguuaagacugaguguaaggauacgcaaauugugucugacgcggaagucauacaggagcaggcaaaagaagagaacgccuccaagccaacacccgcuaaagugaaucgaaccaagcagcggaaaaguuuuagccguucuagaacucauaucggacaacagaggcgccggcacagaaccguauccaugugcucagauauucagccuaguagcccagacaucgagguuacaucgcagcaaaacgauauugaaaacaccgugcucacuaucgagcccgaaacagagacggcccuugcagaaauaaucaccgagacugaggucccggcccugaauaaguguccuacaaaguauccaaaaaccaagaaacauuuggugaacgaauggcuauccgagaagaaugagaaaacaggcaagcccucugacggucugagcgagaggccucuccgaauuacuaccgaucccgaaguccuggcuacgcagcuuaacucacugccaggguugaccuacaguccucacguguauuccacacccaagcacuacauccgcuucacuucuccauuucucagcgagaaacggagaaggaaggagccgaccgaaaauauuuccggcucaugcaaaaagcguuggcugaaacaggccuuagaggaagagaacagcgcaauccugcaucgcuucaauaguccuugucaggaacggucuagaucccccgcgguuaacggagagaauaagagcccacuacuccugaacgacucgugcucacuucccgacuugacaacuccucugaagaaaaggcgauuuuaucaacuccuggauucuguguacagugagaccuccacgccaacacccagcccuuacgcuaccccgacucacacagacauaaccccaauggaucccucuuucgccacuccuccacggauuaagagcgacgaugaaaccugucgcaauggcuauaaacccaucuacuccccuguaacaccggucacgcccgggaccccaggaaacacuaugcauuuugagaauauuucaaguccugaaagcucucccgagaucaagagaaggacauauucccaggaggguuacgaccggucaaguaccaugcuuacacugggcccauuccgaaacagcaauuugacugaacucgggcugcaggagauaaaaaccaucggauauacguccccuagaucucgcacagaagugaacaggcaaugccccggcgagaaggaaccaguuucggauuuacagcugggucuagacgcaguggagccgaccgcccuccacaaaacucuggagaccccugcucacgaucgugccgaacccaacagccagcuugacucaacacauuccgggcggggcacuauguacaguucuugggucaagagcccagauagaaccggagugaauuuuuccguaaacucaaauuugagggaccugacacccucucaccagcucgaggugggcgggggauuccgcauuagcgaaaguaagugucugaugcaagaugacacgcgagguauguucauggagaccacuguauuuugcacauccgaagacggcuuagucagcggguucggaagaaccgugaacgauaaucugaucgacggcaacugcacuccucagaauccaccccagaaaaagaaagugucucuuuuggaguaucggaagaggcagcgcgaggcacguaaaucagguuccaagacagaaaacuuuccucucauuagugucagcccgcaugcuucggggucucuguccaauaacggcgauggaugugccagcucaaaugacaacggcgagcaaguugaucacaccgcgagucuaccacugcccacgccugccacuguguacaaugcuaccucugaagagacauccaacaauugccccgugaaggacgcaaccgccagcgagaaaaacgagccagagguacaguggacugcuucaacaagugucgaacaggugagagagcggagcuaccagagggcccuccugcuuuccgaucaucgcaaggacaaagauucugggggagaaagcccuuguguuuccugcucacccucucacgugcaaaguucgccaagcucccacucuaaccauaucccucaguugcaggcaaagggcccgguccccucauucagcgagcugauggaggacccagauccugaaaaucccgagccaaccacaacuaacgaauguccuucccccgacaccagucaaaauacgugcaaaucuccgccaaagaugagcaagccugguucacccggguccgugauaccagcgcaggcccacggaaaaauuuuuacaaagcccgacccucagugggauaguaccguuagcgcuucugaggccgaaaacggcgugcauuuaaaaacugagcuccagcaaaagcagcuguccaauaacaaucaggcacuuagcaaaaaccacccgccccagacccauguacgaaauagcucggagcaacugucucagaaguugccaagugucccuacaaagcuccacugucccccuuccccacaccuggaaaaucccccuaaaagcucaacuccacauacccccgugcagcacgguuaucuauccccgaagccuccaucucagcaacugggcagccccuacagaccucaucacagucaguccccacagguggggacgccccagcgggagccgcaaaggaauuucuauccugcugcccagaaccuccccgcaaauacacagcaagccaccagcggaacucuguuuacacagaccccaucuggccagucaagugcuacuuacucccaguucaaccaacagagccuuaauucuacagcgccucccccacccccuccaccgcccccuucgucaagcuauuaccagaaccagcaaccauccgccaauuuucagaacuauaaccaguugaaagggagucugucucagcaaaccgucuucacgagcggacccaaucaggcauuaccuggcacuaccucccagcaaacaguuccaggucaccaugugacccccgggcacuuucucccuucacagaacccgacaauccaucaccagacugcugccgccguagugccacccccucccccaccucccccagcuccgggaccucaucugguccagcaacccaauagucaccagcagcacucuguggcacauguugugggcccaguccacgccgugacccccgguagccauauccacucccagacggcgggccaccaucuuccuccacccccuccgccacccgggccugcuccacaccaucaucccccuccccacccaucaacaggacugcaaggccuacaggcccagcaccagcacguugugaacagcgcaccgccucccccaccucccccaccucccucuuccguccucgccagugggcaucacacuaccagcgcucaagcacugcaucacccgccacaccagggaccucccuuguucccaucguccgcccaucccacaguaccuccguacccaucucaggcgacccaccauacuacccugggccccgguccucagcaccaacccucagggacaggaccacauugcccuuuacccgugacgggcccacaccuccagccucaggguccgaauagcauucccacuccaaccgcuaguggcuuuuguccucaccccggguccguugcccugccacauggagugcaaggcccucagcaggcaucucccgucccggggcagaucccaauucaccgcgcccaagugccucccacauuccagaacaauuaccauggaagcggcuggcacuga

SEQ ID NO: 58225 - RNA, 1284 nt, Artificial Sequence
  derived and/or modified sequence opt3 from KNG1__Homo_sapiens__NP_000884
augaagcugaucaccauucucuuccuuugcagcagacuguuguuaucccugacacaggagucucaaucagaagagauagacuguaacgauaaagaccuauuuaaggccguggaugcugcacucaaaaaguacaauagucagaaccagagcaauaaccaguucguccuguauaggaucacugaagccacgaaaaccguuggcuccgacacauuuuacucuuucaaguaugagauuaaggaaggggauugccccgugcaaucgggaaaaacuuggcaggacugugaguacaaggaugcggcuaaagccgcaaccggugagugcacagccaccguaggcaagcggucaagcacuaaauuuaguguggcuacacagaccugucagaucacgccugcagaagggccagucgugacugcccaauaugacugccuuggauguguucacccgauuuccacccagucucccgaucuggagccuaucuugcgccauggcauacaguacuucaauaacaauacacagcacagcucccucuuuaugcugaacgaagugaagcgagcucaacgucaggucguggccggucugaauuucagaaucacuuauucaauuguacagaccaacugcaguaaggagaauuuucucuucuuaacaccagacuguaaaagccuguggaacggggauaccggagagugcacggacaaugcguacaucgauauucaacuuaggaucgcaucuuuuucccagaacugugacauauaccccggcaaggacuucguucagccuccaacuaaaauuugcgugggcugcccccgggauaucccuacaaauucaccagaauuggaggaaacccugacucauacaauuaccaagcuaaacgccgagaacaaugcuacguuuuauuucaaaaucgacaacgucaagaaagcccgcguccaggugguggcagggaagaaguacuucaucgauuuuguugcuagagaaaccacauguagcaaagagaguaaugaggaacucacugagucuugcgaaaccaagaaacugggacaaucccuugacuguaacgccgagguguauguagugccgugggaaaagaaaauuuaccccacagucaauugccagccucuggguaugaucagcuugaugaagaggccacccggcuucucgccuuuucggucuucccgcauaggggagauuaaggaggaaacuaccucacaccuccgaaguugugaguauaaaggaagaccacccaaggcgggcgccgaaccggcaagcgagagggaaguguccuga

SEQ ID NO: 58226 - RNA, 861 nt, Artificial Sequence
  derived and/or modified sequence opt3 from KNSTRN__Homo_sapiens__NP_001136233
auggccgcucccgaggcaccuccacuggacagaguguucaggaccacauggcucagcacugaaugcgauucccacccgcuucccccuucuuaccggaaguuucuguucgagacgcaggccgcggacuuggcuggcgggaccacagucgccgcaggaaacuuacugaaugaaucagagaaagauuguggucaagaccgccgagccccaggcguucagcccugccgucuagugacuaugaccaguguagugaagacagucuauagccuccagccuccauccgcucugucugggggacagcccgcagauacccaaacuagagccacaucgaaaucacuucugccugugaggagcaaggaaguugacgugaguaaacaguugcauuccggcgguccagagaacgaugucaccaagaucacgaagcuccggcgcgagaaugggcagaugaaagcuacugacaccgccacaagaaggaacgugcggaagggauacaaaccgcugucuaagcagaaaagcgaagaggaacugaaggauaagaaucaacucuuagaggcgguaaacaaacagcugcaccagaaacuuacugagacccagggcgaauugaaggaccugacacaaaagguugagcuacucgaaaaauuucgcgauaauugucuggcaauucuugaguccaagggccuggaccccgccuuggggucagaaacccucgcuagucgacaggagagcacgacugaucauauggacucuaugcuguuacuggagacacuccaggaggaacuuaaacuguucaacgaaaccgccaagaagcaaauggaggaauugcagauagcauggaugaaucacggaauccuacaucagauguga

SEQ ID NO: 58227 - RNA, 6630 nt, Artificial Sequence
  derived and/or modified sequence opt3 from KNTC1__Homo_sapiens__NP_055523
auguggaacgacaucgagcugcucaccaaugaugacacaggcagcggguaccuuuccgugggaucuagaaaggaacacgguacugcccuguaucaggucgauuuguuaguuaaaauuucaagugagaaggcuagccugaaccccaaaauacaagcaugcucccuaucugacggcuucaucauuguggccgaucagucgguaauccuccuggacucaauuuguaggagccuucagcugcauuugguguuugauacggaagucgacgugguugggcucugccaggagggaaaguuccugcuggugggcgaacggagugguaaucuccacuuaauccaugucaccuccaaacaaacacugcuuacuaacgcguuugugcagaaggcuaaugaugagaaccgccgaaccuaccagaauuugguaauagagaaggacgggucuaacgaaggaacauauuacaugcugcuacucaccuauagcggcuucuuuuguaucacuaaucugcagcuucugaaaauucaacaggccaucgagaacguugauuucuccacagcaaagaaauugcagggccagauuaagucaaguuuuaucagcaccgaaaauuaccacacgcucgggugccugucuuuaguggccggagaccuggcuuccgaggucccugugauaauugguggcacugggaacugugcauucucaaaaugggagccagauagcaguaagaagggaaugaccgugaaaaaucucaucgacgccgaaauuaucaagggcgcuaaaaaguuucaacuuaucgacaaccuguuguucguccuagauacagacaauguucugucucucugggauauuuauacucugaccccgguguggaacuggcccucccuucauguagaggaauuucuguugacaaccgaggccgacagcccuucgucugugacguggcaggguauaacuaaccucaaacugaucgcguuaacagcauccgccaauaagaaaaugaagaaccugauggucuacucacuaccaaccauggaaauucucuacagucuggaggugagcuccguuucuagccuugugcagacugggaucucaacagauaccauauauuugcuggagggagucugcaagaaugaccccaaacucagugaagauuccgugagcguacugguucuucguugucugacggaggcuuugccugaaaacagacucucuaggcuguuacacaagcaccgguucgccgaggcagaaucauuugcuauucaauucggccuggacguggagcuagucuacaaagugaagaguaaucauauccucgagaaacuggcccuuagcuccgucgaugcgucugaacagaccgaguggcagcaguugguggacgaugccaaggaaaaccugcacaagauccaagacgacgaguucguugugaauuauugccucaaagcacaguggauuacauacgaaacuacccaggagaugcugaacuaugcuaagacacgcuuacugaaaaaggaggauaaaacugcccuuaucuacucggacggcuugaaggaaguacucagagcucaugccaagcugaccacauuuuauggggcauucggaccagagaaauuuagcgguuccucauggauugaauuccuaaauaacgaggaugaccugaaggauauauuucuccagcugaaagagggcaaucuugucugugcccaauacuuguggcugaggcaccgggcuaacuucgaaagucgcuuugacgugaagauguuagagucucuccugaauagcauguccgcgucaguuagccuucagaaacugugccccugguucaagaacgaugugaucccuuuuguccgaagaaccgugccagaagggcagauuaucuuggcaaaguggcucgagcaggccgcuaggaaucuggaacuaacugacaaagccaacuggccggagaacggacugcaacucgcagagaucuucuuuacggccgaaaagacagaugagcugggccuugcuucuuccuggcacuggauuaguuugaaagacuaccagaauaccgaagagguaugucagcugcggacuuuagugaacaaucuccgugaacugauaacccuucaucgcaaguauaacugcaaacuggcccuaagcgauuucgagaaggagaauacaaccacuaucguuuuuagaauguucgacaaaguccucgcacccgaacugauuccuucuaucuuggagaaguucauuaggguguacaugcgggaacacgaucugcaggaggaagaguuacuccugcuuuauaucgaggaccuguugaaccgaugcuccucaaagaguacaagccucuuugaaacggcgugggaggcuaaagccauggcagugauagccugucugucggacaccgaucuaaucuucgacgcuguccugaagauuauguacgccgcaguugugccaugguccgcugccguggaacaacuuguaaaacagcaucucgagauggaucaccccaaggucaaacuguugcaggagucuuauaagcugauggaaaugaagaaauuacuccgcgguuacgggaucagagaggugaaucugcuuaacaaggaaauuaugaggguugugcgguauauccugaaacaagacgucccuagcucauuggaggaugcgcucaagguggcccaggcuuuuaugcugagugacgaugaaauauacucccuacgcauuaucgaccugauugauagagagcagggcgaggacugccuucuccuguugaaaucuuuaccacccgcagaagccgagaagacugcugaaaggguuaucauaugggcccgucuggcacuccaggaggaaccggaucauagcaaggagggaaaagcguggcggauguccguggccaagacaucaguagacauccugaaaauucuuugugauauccaaaaggacaaucugcagaaaaaggacgagugcgaagagauguugaagcuauucaaagaagucgcuagccugcaggagaacuuugaaguguuccucaguuuugaggauuacucuaauuccagccugguggccgaccuucgagagcagcacauuaaggcacacgaagucgcucaagccaaacauaagccuggcucgacccccgagccaaucgcagccgaaguuagaucaccuucuauggagaguaaauuacacaggcaggcucuggcgcuccagauguccaagcaggaguuggaagccgagcugacacuccgcgcacugaaagaugggaacauaaagacugcucuuaagaaauguagcgaccuguucaaguaucauugcaaugccgauaccggaaaauugcuauuucugacgugucaaaagcucugccagauguuagccgacaacgugcccguaaccgugccagucggucugaaucuucccucuaugauucacgaucuggcuagccaggcagccacaaucuguuccccugacuuccucuuggaugcgcuggaacucugcaaacacacucugauggcuguggagcuuucacggcaaugucagauggacgauugcggcauccuaaugaaggccaguuuugggacccauaaggacccauacgaagaguggagcuauucugacuucuuuuccgaggauggaauuguucuggaaucacagaugguguugccggucaucuacgaguuaauuaguagccuggugccccucgcagaauccaaaagauauccucuggagucuacaucgcuuccauacugcagccugaacgaaggcgacggucucguuuugcccgugauaaacucaaucuccgcccugcuacagaaucugcaagagaguucucagugggagcucgcucuuagguucgucguagggagcuucggcacuugucugcagcacuccgugucaaacuuuaugaaugcaaccuuaucugaaaaguuguucggagagacgacacugguuaaaagccgccauguggucauggaacucaaggagaaagccgugauuuuuauccgagaaaacgcgaccacucugcuucacaagguauucaauugccggcugguggaucucgacuuggcucugggcuauuguacauuacuaccucagaaggaugucuuugagaaccuguggaaacucauugacaaggccuggcaaaauuacgauaaaauccuugcaauaagucugguuggguccgaguuggccagccuguaccaggaaaucgagaugggacucaaguuccgugaacugucuaccgacgcucagugggguauuagacuuggcaaacucgggaucucauuucagccaguguucaggcaacauuuucugacuaagaaggauuugauuaaagcccugguggagaacaucgacauggauaccuccuuaauacuagaguauugcaguacauuccagcuggacugugaugcaguccuccagcuuuuuauugaaacgcuguugcacaauaccaacgcuggacagggccaaggugacgccagcauggacucggcgaagcgccggcaccccaaacugcucgccaaggcacuggagauggugccgcuuuuaacuucuacaaaagaucugguuaucucccucagcgggaucuugcauaagcuggacccuuacgauuaugaaaugauugagguagugcuaaaggucauagaaagagcugacgagaaaaucaccaauauuaacaucaaucaggcccugucaauucucaagcaccuuaaaaguuacaggcgaaucucuccacccguggaucuggaguaucaguacauguuggaacauguuauaacacugccuuccgcugcacaaacucgccuccccuuccaccugaucuucuuuggcaccgcccagaacuucuggaagauuuuaagcacggagcuuucagaagagaguuuuccaacacugcuccuaaucagcaaacugaugaaguucuccuuggacacccuguaugugucuacugccaaacaugucuuugaaaagaagcucaaaccuaagcuucugaaauugacccaggcuaagagcuccacacugauuaauaaagagaucacuaagauaacccagacaauugagucaugccucuuaucuaucgugaaccccgaaugggcgguagcaaucgccauuagucuggcucaagauaucccagagggaucguucaagauaagcgcccuuaaauuuugucuguaccuagcagaacgguggcuccagaacauuccgucccaggacgagaagagagaaaaagccgaggcucuguugaagaaacugcacauccaguacaggcguucuggcacggaggcgguccucauugcccacaagcuuaauaccgaagaguaucugcgcgugaucgggaagccugcacauuuaauaguuucacuguacgaacaccccagcauuaaccaacggauccagaauuccaguggaacugauuauccagacauccaugcugccgcaaaagagauugccgaggugaacgaaaucaauuuggagaaggucugggauaugcuccuggaaaaauggcuaugccccucuacaaagccuggcgagaaaccaagcgaacuuuucgagcugcaggaggacgaagcucucagaagggugcaguaccuguugcugucacgacccauugauuauuccagucggaugcucuuuguuuucgccaccagcacuacaaccacgcuugguaugcaccaacugacuuuugcgcaccgcaccagagcauuacagugucuguucuacuuggccgacaaggagacaauagaaucucucuuuaagaaaccuaucgaggaagugaaguccuaucugaggugcauuaccuuccuagcuucauucgagacucuuaacaucccgaucacauacgagcuguuuuguagcucgccaaaagaagggaugauuaagggacucuggaaaaaucauucucacgagaguauggccguccggcuggugaccgaauugugcuuagaguacaagauauaugaccugcagcucuggaacggccuucugcaaaaacuacuggguuucaauaugauccccuaccuccgaaagguauugaaggcuauuuccagcauccauucacuguggcaggugccuuauuuuuccaaagcauggcagagaguuauucagaucccacuucugucugccagcugcccccucaguccugaucaauuauccgacuguagcgaaucucugauagcugucuuggagugcccggugucaggcgaucuggaccucaucgggguggcccgccaguacauucagcuugagcugcccgcauucgcgcuagccugucugaugcucaugccacacagugaaaagaggcaucagcaaaucaaaaacuuuuugggauccugcgauccucaggucauucugaagcagcuugaggaacacaugaauacaggccagcuggcuggguucagccaccaaauccguucuuuaauacucaacaauauuaucaacaaaaaggaguuuggaauucuggccaagacuaaauauuuccagauguugaagaugcaugcaaugaauaccaacaauaucacggagcugguaaacuaccucgcuaacgaccuuucgcuggaugaagccucagugcuaauaacagaguauagcaaacacuguggcaagcccguuccaccugacaccgcacccugcgaaauccugaaaauguuucucuccgguuugaguuga

SEQ ID NO: 58228 - RNA, 1617 nt, Artificial Sequence
  derived and/or modified sequence opt3 from KPNA1__Homo_sapiens__NP_002255
augaccacacccggcaaggagaacuucagacugaaaagcuacaagaauaaaucccucaacccugacgaaaugaggcggcgccgagaggaagaggggcuucagcugcguaagcagaaaagagaagaacaguuguuuaagaggcggaauguggccacugcugaggaagagacggaagaggaggucaugucugauggagguuuccacgaagcacagaucucaaacauggagauggccccaggcgggguuauuaccagugacaugauagaaaugaucuuuagcaaguccccggagcagcaauuaucugcgacacagaaauuccgcaagcugcuaucgaaagaacccaauccuccaauugaugaggugaucucaacucccggaguaguggcuagauuugucgaguuccucaagaggaaagaaaacugcacccugcaguuugagagcgccugggugcuuacaaauauugcaaguggcaacucccugcagacccggaucguuauacaagccggugcugugccuaucuucauugaauugcucucuagcgaguuugaagacguccaggagcaggcagugugggcccuggggaauaucgcuggagauuccacuaugugucgcgacuauguacuggauugcaacauucucccacccuuacugcagcuuuucucaaagcaaaaucgauugacaaugaccagaaacgccguuugggcgcugaguaaucuauguaggggcaagagcccuccaccggaguuugcaaaagugucucccugccucaacguccuguccuggcuucuguucgugucagacacggauguguuggccgacgcuuguugggcccucagcuaccugagugauggcccuaaugacaagauccaggcagucauagaugcugggguuugccggcguuuaguggaacugcucaugcauaacgacuauaaaguagugucuccagcccuucgcgcggucggaaacauugugacuggugacgauauccagacccaaguuauucugaauuguuccgccuugcagagccuacugcaccuccugucgucucccaaggaguccaucaaaaaggaagcaugcuggacaaucucaaacauuacugcuggcaauagagcccagauacagaccgugaucgacgcuaacauuuuuccugcccuuaucaguauacugcaaacagcagaguucaggacccggaaagaagccgcuugggcgauuacgaaugcaacuagcgggggauccgccgagcagaucaaguacuuggucgagcucggcuguaucaagccacugugcgauuuacugacagugauggacucuaaaauuguacagguugcucuaaacggucucgaaaauauccugcgacuuggggagcaggaagccaagcgcaacggaaccggcauuaaucccuauugugcauugauagaggaggccuacggccuggauaaaaucgaguuccuccaaagccaugagaaccaggaaauuuaucagaaggcuuuugaccugaucgagcacuacuucgggacugaagaugaggacucaaguaucgccccgcaaguggaucuuaaucaacagcaguacauuuuucagcaaugcgaggcaccuauggaaggauuccagcuguga

SEQ ID NO: 58229 - RNA, 1590 nt, Artificial Sequence
  derived and/or modified sequence opt3 from KPNA2__Homo_sapiens__NP_001307540
augagcaccaacgagaaugccaacacacccgcugcaagacugcacagguucaagaauaaaggcaaggacuccacugaaaugcggcgccgacguaucgaggugaacgucgaacucagaaaagccaagaaagaugaccagaugcuuaagaggcggaauguuucuucauuuccugaugacgcgacgaguccacugcaagagaaccgcaauaaccaggggaccgugaauuggagcguagaugacauugugaagggaauaaacuccucuaaugucgaaaaccaguugcaggcuacacaagccgcaagaaaauuacugucgagggagaagcagccgcccaucgauaauauuauccgggccggucuaauuccuaaauucgugucauuucucggccgcacugacugcagcccaauccaguucgagagugcuugggcacugaccaacauagccuccgggacaucugaacagaccaaggcuguuguggauggaggcgccauccccgcguuuauuagccuucuggcauccccucaugcccacaucucagagcaagcugucugggccuuggguaauauugcaggggacggaaguguguuccgagaucucguaaucaaauacggcgcuguugacccacugcuggcccucuuagcggugcccgauaugagcucucuggccuguggcuaucuuagaaacuugacuuggacacuguccaaccuaugcaggaauaagaacccugcaccaccgauagacgcugucgaacagauucuccccacccuggugcggcuucugcaucacgacgauccugagguguuggccgacacguguugggcuaucucauaccucacugaugggccaaaugagcguauuggaauggucguuaagaccggugugguaccccagcuggugaaauuacugggcgccagcgaacucccuaucgucacaccagcacuucgcgccaucgggaacauugugacuggaaccgacgagcagacacaaguugugauagaugcuggcgcgcuggcagucuuucccaguuugcuaaccaauccgaagacgaacauccagaaagaagccacuuggacaaugucuaauauuaccgcugguagacaggaccaaauccaacaggugguaaaccaugggcugguuccuuuccucguguccguccugagcaaggccgauuuuaaaacucagaaggaggcagugugggccgucacaaauuauaccucgggaggcacgguggaacagauaguuuaccuugugcacugcggcauuaucgagccccugaugaacuugcucaccgcuaaagacacaaagaucauucugguaaucuuagaugccauuucuaauauauuccaggcagcggagaagcugggggaaacugagaaacuauccaucaugauugaagaguguggaggucucgacaagaucgaagcucugcagaaccacgagaaugagucagucuauaaagccagucuuagcuugaucgaaaaguacuuuuccguggaggaagaggaagaucagaacguugugccagagaccacaucugagggcuauacuuuccaaguccaggacggggcaccuggaaccuuuaauuucuga

SEQ ID NO: 58230 - RNA, 1566 nt, Artificial Sequence
  derived and/or modified sequence opt3 from KPNA3__Homo_sapiens__NP_002258
auggccgagaaccccagccuggaaaaucacagaaucaaguccuucaaaaacaagggcagggacguggagaccaugcggcgccaucgaaaugaagucacaguugagcuccguaaaaacaagagagaugaacaccuucugaaaaagaggaaugugccucaggaggagucuuuggaagacucagauguagacgcugauuuuaaggcacaaaacgugacuuuagaggccauucugcagaaugcgacgagugacaacccagucgugcagcuaagcgcuguucaggccgcacggaaacuccuguccucugaucgcaauccgcccauagacgaucuuaucaagucggggauucugccuaucuuggugaaaugccucgaaagagacgauaacccaucacugcaauucgaggccgcuugggcacugaccaauauugccagcggaacaagugcucagacucaggccgucgugcaguccaacgcgguaccccucuuuuuaaggcugcuucggucuccucaucaaaauguuugugagcaggcagugugggccuuggguaacaucauaggcgacgggccacagugccgcgauuacgucaucagccugggaguggugaagccccuacucuccuucauuucaccuaguaucccaauuaccuuucugcgaaaugucacauggguuaucgugaaccuuuguagaaacaaagacccgcccccuccaauggaaaccguacaggagauacugcccgcuuugugcgugcucauuuaucacacugacaucaauauucuggucgauacagugugggccuuaagcuaccugaccgacggcgguaacgaacaaauccagaugguuaucgauucugggguggucccuuuccucgugccacuucugucccaucaggagguaaagguucaaacggcagcuuugagggccgugggaaauauugucacuggcaccgacgaacagacacaggugguccuaaacugugaugugcugucacacuuucccaaucuccugagccacccgaaggagaaaauaaacaaggaggcgguuugguuccuuaguaauaucacugccggcaaccagcaacaggugcaggcaguaauugacgcugggcugaucccuaugauaauucaucaguuggccaaaggagauuuugguacccaaaaggaagcugccugggcaaucucuaaucucacaaucuccggccggaaagaccaggucgaguaucuggugcagcagaacguuauucccccauucugcaauuuacugagcgugaaggauucgcaagucgugcagguagugcuagacgggcucaaaaacauccugauuauggccggagaugaggcuucuaccauagcggaaaucauugaagaguguggcggucuugagaagaucgaaguuuugcagcagcacgagaaugaagacaucuacaagcuggcauuugagauuauagaccaauauuucuccggggaugacaucgaugaagacccuugccucauucccgaggccacgcagggaggcacuuacaacuuugauccaacagcuaaucugcagaccaaagaguucaacuucuga

SEQ ID NO: 58231 - RNA, 1566 nt, Artificial Sequence
  derived and/or modified sequence opt3 from KPNA4__Homo_sapiens__NP_002259
auggccgacaacgagaagcuggauaaucagagacucaaaaacuucaagaauaaaggcagggaccuugaaaccaugcggcgccaacgaaacgagguggucguugaacugcguaagaauaaaagagaugagcacuuguuaaagaggcggaacgugccccaugaagacaucugcgaggauagcgacauugauggggacuaccgcguacagaauacaucccuggaggcuauagugcagaacgcaucuucagauaaucagggaauccaacuaagugccguccaggcggcuagaaagcuccugagcuccgacaggaacccuccaauugaugaccuuaucaaaucugguauucugccgaucuuggugcacugucucgaacgggaugacaaucccucgcugcaguuugaggccgcaugggcccugacuaacauagcuucaggcacgagcgaacagacccaagcaguugugcagaguaaugccgucccucucuucuuacgccugcuucauuccccacaccagaacgugugcgagcaggcuguaugggccuuggggaauaucauuggagacggcccccaaugucgagauuauguuaucucucuggguguggucaagccucuacucagcuuuauuuccccaucaauccccauaacauuccugagaaacgugacuugggugauggucaaccuuugcaggcauaaagacccuccaccgcccauggagaccauucaggaaauccugccugcguuguguguucucauucaccacacagaugugaauauccugguagacaccgugugggcauuaaguuaccugacugaugccgggaacgagcagauccaaauggucauugacagcggaauagugccacaucucguuccccuucugucucaccaggaagugaagguccagacagcugccuugcgggcagugggcaauaucguaaccggcacggaugagcagacucaaguugugcuaaacugcgacgcucugucccauuuuccugcccuccugacccacccaaaagaaaagauuaauaaggaggcggucugguuccuuucaaacaucacagccgggaaucagcaacaggugcaggcagucauagaugcuaaccuggugcccaugauuauccacuugcucgacaaaggagauuuugguacucagaaggaggccgcuugggccaucagcaaucugaccauuaguggccguaaagaccagguugcauauuuaauccagcaaaacgugauuccgccuuucuguaaucugcuaacaguaaaggacgcccaggucgugcagguugugcucgaugggcugucuaacauacuuaaaauggcugaagacgaggcggaaaccaucggaaauuugauugaggaaugcggcggucuggagaagaucgagcagcuccaaaaccaugaaaaugaggauaucuacaaacuggcauaugaaauuauagaccaguuuuucuccagcgaugacaucgaugaggaccccucgcuugucccagaagccauucaagggggaacguuuggcuucaacucuuccgcuaacgugccuacugagggcuuucaguucuga

SEQ ID NO: 58232 - RNA, 1608 nt, Artificial Sequence
  derived and/or modified sequence opt3 from KPNA6__Homo_sapiens__XP_011539462
augaccauggccagccccggcaaggacaacuacagaaugaaauccuauaagaauaacgcucugaauccugaggaaaugaggcggcgccgagaggaagaggggauccagcuccguaaacaaaagagagaacagcagcuuuucaaaaggcggaacguggagcugauuaaugaggaagcagccauguuugauucuuuguuaauggacucauacgucaguagcacaacuggagaguccguuauaacgcgcgaaaugguggagaugcuguucucugaugacucggaucuacagcucgcgaccacacaaaaguuuagaaagcugcuuucaaaagagccaagcccgcccaucgacgaaguaauuaacacuccuaggguggucgaucgguucguggaguuucugaagcgcaaugaaaacugcaccuugcaguucgaggcugccugggcacucacaaauaucgccagugguaccucccagcagacuaaaauuguuaucgaagcuggcgcagugccaauauuuaucgagcugcugaacucugacuucgaggauguccaagaacaggccgugugggcucucgggaauauugccggagacagcuccguaugucgagauuauguuuuaaacugcucaauccugaauccccuuuugacacugcuaaccaagaguacgagacucacuaugaccaggaacgcggugugggcacugagcaaucuuugucggggcaaaaacccuccacccgaguuugccaaggucucuccuugccugccaguguugucccgucuccuguucucaagcgacagugauuuacuggcugacgccuguugggcacucucuuaccuuuccgacgguccgaacgaaaagauucaggcugugaucgauagcggggucugccgcagacugguugaguugcuaaugcacaaugacuauaaaguggccucgcccgcgcugagggccguaggaaacauagugacaggcgaugacauucagacucaagucauccucaauuguucugcacugccuugccuucugcauuugcucuccucaccaaaggaaaguauucggaaagaggcuuguuggaccaucagcaacaucacagccggcaaucgagcucagauucaggccgugauagaugcaaacaucuuucccguucugauugagaucuuacaaaaggccgaguuccgcaccagaaaagaagcugcgugggcaauaacgaaugccacuuccgggggaacaccugaacagauuagguaccuggugucucuagguugcaucaagccacucugugaccugcuuaccgucauggauagcaaaaucgugcagguagcuuugaacggccuggagaauauucuccggcugggggaacaggagggaaagcgcucaggcagugguguuaaccccuauugcgggcuuaucgaggaagccuacggacuggacaagauugaguuuuugcaaucccacgaaaaucaggagauauaccagaaagcauucgaucucaucgagcauuauuucggcguggaagacgaugacagcucucuggccccgcaggucgacgagacucaacagcaguuuauuuuccagcaaccugaagcucccauggagggcuuucaguuauga

SEQ ID NO: 58233 - RNA, 1551 nt, Artificial Sequence
  derived and/or modified sequence opt3 from KPNA7__Homo_sapiens__NP_001139187
augcccacccuggacgccccugaggaaagaaggcggaaguucaaauaccgcggcaaggaugugagccuccgacgucagcaaagaauggcugucucccuugagcugaggaaagcaaagaaagacgaacagacauugaagcggcgcaacaucacuucuuuuugcccagauacgccgucagagaagaccgccaaagggguugcggugaguuuaacacugggagaaauuauaaaggguguaaauagcuccgaccccgugcuauguuuccaggcuacucagaccgccagaaaaaugcucucucaagagaagaacccuccacugaaacuugucaucgaggcaggccugauucccaggaugguggaauuuuugaagucgucacucuauccuugccugcaguucgaggccgcuugggcacugacaaauaucgccagcgggaccagugaacagacucgggcuguuguggagggaggcgccauucagccacucaucgaguuacuguccucuagcaacgucgcggugugugaacaagcaguaugggcccuugguaauauagcuggggauggacccgaguuucgcgacaacguuaucacauccaaugccauuccucacuugcuggcacuaaucucaccaacccucccgauuacguuccugcgaaacaucacuuggacccuuaguaaucugugcagaaacaagaaucccuacccuugugauacagcugugaaacagauauugccagcccuccugcauuuacugcagcaccaggacagcgaaguccucucugaugcgugcugggcccuuuccuaucugacugacggcucaaacaagaggauuggccaaguggugaauaccggggucuugccccggcuaguugugcugaugacaagcagugagcucaacguacugaccccuucucuucguacggugggaaauaucgucacugguacagaugaacagacccagauggcaauugacgcuggcaugcugaacguguugccacaacuccugcagcauaacaaacccuccauccagaaggaggccgcuugggccuuaagcaauguugcagccgggccgugucaccauauccagcaacugcuagcuuacgaugugcucccuccccuggucgcgcuuuugaaaaacggagaguuuaaggugcagaaagaagcaguauggaugguugccaauuucgcuacuggcgccacaauggaccagcugauucagcucgugcacucggguguccuggagccacuugugaaccuguugaccgcaccugacgucaagauagugcucaucauucuggauguuaucucuugcauauuacaagccgcugaaaagcgcuccgagaaagaaaaucugugucuacucauugaggagcuugggggaaucgacagaaucgaagcccugcaguugcacgagaacaggcagauuggccagucagcacugaauaucauugaaaagcauuuuggcgaggaagaggaugagagucaaacgcuccugagccaggugauagaccaggauuaugaguucaucgacuacgaaugcuuagcgaaaaaguga

SEQ ID NO: 58234 - RNA, 2196 nt, Artificial Sequence
  derived and/or modified sequence opt3 from KPNB1__Homo_sapiens__NP_001263382
augaaggagagcacccuggaagccaucggcuacauuugccaggacauagaucccgagcaacuccaggacaaauccaacgaaauccuuacagcuauuauccaggggaugagaaaggaggaaccuucuaauaacgugaaacuggcagccacuaaugcguuguuaaacucacuggaguucacgaaggcuaauuuugauaaagagagugaaaggcacuucauuaugcaggucguuugugaggccacccaaugcccagacacacgggugcgcguagcagcccuacagaaccucgugaagaucaugagccuguauuaccaguauauggaaacuuacaugggaccggcucuuuuugcaauaaccaucgaggccaugaaguccgauauugacgaggucgcucugcaggguaucgaguucuggucuaaugugugugaugaagaaauggacuuggccauugaggcgucggaagcagccgagcaaggccgacccccugagcauacaucaaaauuuuaugcuaagggggcccuccaguaccugguuccaauccugacccagacucucacaaaacaggaugaaaacgacgaugacgaugacuggaaucccugcaaggcagcuggaguguguuuaaugcugcuugcuaccugcugugaggacgauauagucccucacguguugccauucauuaaagaacauaucaagaaccccgacuggcguuauagagaugcggccguaauggcauuuggcugcauucuggaggguccugaaccaagccaacuaaagccgcucguuauccaggcuaugcccacgcugaucgagcuuaugaaagacccuaguguggucgugagggauacugccgcuuggaccguggggcggauuugugagcuguugccagaagccgcaauaaaugacgucuaccucgcuccccuguuacagugccugaucgagggacucuccgcugaaccucgcguugcgucuaacguguguugggcauucagcucccuugccgaggcugccuacgaagcagccgauguagcugacgaucaagaggagccagccacauauugccugucaaguagcuuugaauugauugugcagaagcuacuggagacuaccgacagacccgauggccaccagaauaaccucaggucuuccgcauacgaaucacugauggagaucgucaaaaauagcgcgaaggacugcuauccggcugugcagaaaacaacccuuguuauaauggagcggcugcaacagguguugcagauggaaagucauauucagucuacguccgaccgcauccaauucaacgaucuccagagccuguuaugugccacucugcagaacguccuacgaaaggugcagcaccaagacgcacuccagaucucggauguaguuauggccucucugcuuagaauguuucaguccacagcuggcucagggggagugcaggaggacgccuugauggcagucaguacccugguggaaguccucgguggcgaguuccugaaauacauggaagccuuuaagccuuuccuugggauuggacugaagaauuaugccgaguaccaagugugcuuggcggccguuggccucgugggugaucuguguagggcuuuacagagcaacaucauucccuucugcgacgagguaaugcagcugcuacucgaaaaucuggggaacgagaauguccaccgguccgugaaaccacaaauacuuucuguuuuuggagauaucgcauuggccauuggcggcgaguucaagaaauaucuggaagugguccucaacacucugcagcaggcuagccaggcccaaguggacaagucagauuacgacaugguagauuacuuaaaugaacugcgugagaguugucuugaggcauauacagggaucgugcagggauugaaaggugaccaggaaaacguucauccugaugucaugcucgugcagccccgcguggaguuuauccuguccuucauugaccacauagcgggcgacgaagaucauaccgacggggucguugccugcgcugccggacuaaucggcgaucuguguacggcauuugguaaggacgugcucaagcugguggaggcuagaccaaugauucacgaacuuuugaccgaggggaggcggagcaaaacaaauaaggccaaaacucuggcaaccugggccacaaaggaguuacgaaaacucaagaaccaagccuga

SEQ ID NO: 58235 - RNA, 1740 nt, Artificial Sequence
  derived and/or modified sequence opt3 from KPRP__Homo_sapiens__NP_001020402
augugcgaccagcaacagauccaguguagacugccccuccagcaaugcugugugaagggcccuagcuucugcuccucucagucaccauuugcccagagucaggucguugugcaagcuccgugugagaugcagauuguagauugccccgcaagcuguccugugcaggucugccagguguccgaccaagccccaugucagucucagaccacacaaguuaaaugccagucgaagacuaaacaggugaaggggcaggcgcaaugucagucaaaaacgacccaggucaagggacaggcugccagccaaagucagacauccucugugcagagccaggcacccugccaauccgaaguaucauacguucagugcgaggccagucagccugugcagacuuguuucgucgaaugcgcuccaguguguuauaccgagacaugcuacguggaaugucccguccaaaacuauguuccuugcccagcaccgcagcccgugcagauguacaggggucggccugccguaugucaaccacagggccgcuuuagcacccagugccaguaucaagggucuuacuccucauguggaccccaguuccagagccgagcuacuugcaauaacuauacaccucaguuucaacuucguccaaguuacucuuccuguuucccccaguacagaagcaggaccucguuuucuccgugcgugccucagugccagacgcaaggcuccuaugguucauucacugagcagcaccggagucgcagcaccuccagaugucugcccccaccuaggcgguugcaguuauuuccccgcucuugcagcccaccccgaagauucgagccuuguucaaguuccuaccugccacuaaggccgagcgaaggguuucccaauuauugcacaccuccacggcguucugagcccauauacaacucacgcuguccuagaaggccaaucaguagcugcucccaacggcgaggacccaagugucgcauugaaaucucuucgccgugcuguccuagacaggucccaccccagaggugcccuguggagauucccccaauccggcgcagaagccaguccuguggcccucaacccucauggggcgccaguugcccagagcucaggccgcauguugaaccucguccccugccaucuuucugucccccucggcgacuugaucagugcccagagagcccccugcagagaugcccuccgccagcgcccaggccucgcuugcggccagaacccuguauaucccucgagccuagaccgaggccccugccacgccagcugucagaaccuugccucuaucccgagccauuaccugcacugcgacccacuccacggccggugccucuuccccguccagggcaaugugagauccccgaaccuagaccaugcuugcagcccugugagcacccugaaccgugcccaaggcccgagccuauuccccugccagccccuugucccagcccagaaccuugccgcgagaccuggcggucuccgucccccuguuggggaccaaauccuguccccuacccaggugaccuaggcugccaugagaguagcccucacagacucgauacagaagcucccuauugcgggccgucuuccuacaaccagggacaggagucaggcgccgguugugggccaggagacguguuuccugaaaggcgaggccaagauggccauggggaccagggaaaugcauucgcugguguaaaaggcgaggccaagagugcguacuucuga

SEQ ID NO: 58236 - RNA, 1143 nt, Artificial Sequence
  derived and/or modified sequence opt3 from KPTN__Homo_sapiens__NP_001278225
augaugggcgaggccgcuguggcagccgggcccugcccucugagagaagacagcuucaccagguuuuccucucagucaaacgucuacggacucgcggguggcgcugggggacggggcgagcuucuggccgcaacauugaaggguaaaguuuuaggguuccgcuaucaagaucugcgacagaagauccguccaguggccaaagaacuacaguuuaauuacauuccggagaguugucucaaccuggaacuucaguucacucccuuucaacugugccacgcugagguacaggugggagaccaguuggagacggucuuccuccugagcggcaaugauccugcaauacaucuguauaaggaaaacgagggccuccaccaguuugaggaacaaccaguggagaauuuauuccccgaacugaccaaccuuacauccucuguuuuguggcuggacgugcauaauuuuccugggacuucgagaaggcuaucagcccucggaugucagagcgguuacguccggguggcucacguagaucagcgcaguagagagguucugcagaugugguccgugcuucaagacggcccaaucucuagggucauuguguucagccuguccgccgcgaaagaaaccaaggaucggcccuugcaggacgaguauucagugcucgucgcaaguaugcuggaaccugccguuguguaccgcgauuuacugaaccgagggcucgaggaccagcuucuguugccaggaagcgaucaauuugacucuguacuaugcucccuggugacagaugucgaccucgacggcagaccggaggugcugguugcuaccuauggucaggaacuucuguguuacaaguacagggggcccgagucaggauugccugaagcccagcauggcuuccaccuccuguggcagcggagcuuuaguucuccauuacuggcaauggcucacguggaucuaacuggcgacgggcuccaagagcuggccgucgugucccuuaaaggaguacauaucuugcagcacagccugauucaggcgucggaacucguucugacacgucuucgccaucagguggagcaaagaaggcggcgacugcaggguuuggaggauggcgccggggcaggacccgcugaaaaugccgcuucuuga

SEQ ID NO: 58237 - RNA, 567 nt, Artificial Sequence
  derived and/or modified sequence opt3 from KRAS__Homo_sapiens__NP_004976
augaccgaguacaagcugguggucguuggcgccgggggaguggguaaaagcgcucucacaauccagcuuauucaaaaccacuucguagacgaauaugaucccacuauagaggacuccuacagaaaacagguggucaucgauggcgaaacgugccuguuggacauuuuagauaccgcagggcaggaggaauauucugccaugagggaccaguacaugcggacaggagagggcuuucuguguguguucgcgaucaauaacacuaagucauuugaggauauucaucacuaucgcgaacaaaucaagcgaguuaaagacagugaggaugugccuaugguccuaguggguaauaagugcgaccucccaagccguaccguagauacaaagcaggcucaggaccuggccagauccuacgggauaccguucaucgaaaccucugcaaaaacuaggcagggaguugaugacgccuuuuauacacuugugcgggagauucgcaagcauaaagagaagaugucgaaagacggcaagaagaaaaagaaaaagucaaaaaccaagugugucaucauguga

SEQ ID NO: 58238 - RNA, 516 nt, Artificial Sequence
  derived and/or modified sequence opt3 from KRBOX4__Homo_sapiens__NP_001123370
auggccaugagccaggagucccugaccuucaaggacguguuugucgauuucacacucgaagaguggcaacagcuugacucugcucagaaaaaccuguacagagauguuauguuggaaaauuauucacacuuagugaguguaggcuaccugguggcaaagcccgacgucaucuuuaggcuagggccuggagaggaaagcuggauggccgaugguggcacuccagugcggacgugcgcgggggaggaccgcccggagguuuggcaaguggaugaacagauugaccauuauaaagagucccaggauaagcuccccuggcaggcugccuucauaggaaaagaaacccugaaggacgagucuggccaggagucgcgaacaugucguaagucaaucuaccuuagcacugaauuugauagugucagacaaaggcugccuaaauauuacuccugggagaaggcauucaaaaccucuuuuaaguugagcugguccaaauggaagcucugcaagaaagaacgguga

SEQ ID NO: 58239 - RNA, 1377 nt, Artificial Sequence
  derived and/or modified sequence opt3 from KREMEN1__Homo_sapiens__NP_001034659
auggcucccccugccgcaagacuggcccuccuuagcgcggcugcccugaccuuggcagccaggccagcuccgucccccggcuuagggccuggaccagagugcuucacagcaaacggugccgacuaccggggcacucagaauuggacggcucugcaagggggaaagcccugucuauuuuggaacgaaaccuuccagcacccuuauaauacacucaaauacccaaacggcgagggugggcugggagaacauaauuauugccgcaaccccgauggcgacgugucuccuugguguuacgucgccgagcacgaagauggcguuuauuggaaguacugcgagaucccagcgugucagaugccggggaaucuuggaugcuauaaagaccaugguaaucccccuccacugacuggcaccucaaagacaaguaacaaauugaccauucagacuuguaucagcuuuugccgaucccaacguuucaaguuugcagggauggagucuggauacgccuguuucugcggcaacaaucccgauuacuggaaguauggugaagcugccucgacagaguguaacucagugugcuuuggggaccacacccagccuugcggaggcgauggcagaauaauucucuucgacacgcugguaggggcauguggagguaauuacagcgcuaugaguuccguggucuauucuccagauuuucccgacacuuacgccaccggcagggugugcuauuggacaauccggguuccgggggcgagccauauucacuucuccuuuccucuguucgauauccgcgacucagccgauaugguggaacucuuagacggauacacucacagaguccuggcaagguuucauggccggagucgacccccacuuagcuucaacgugucuuuggacuucguaauacuguacuuuuucuccgaucgcaucaaucaggcucaggguuuugccguucuauaucaagcugugaaagaggagcucccucaggaaagacccgccgucaaccagaccguggcagaggugauuacagaacaggccaaccugucagucagcgcugcgaggaguucuaagguucuuuacgugaucaccacguccccaagccaucccccucaaacuguaccaggguggacaguguauggccuggcaaccuugcucauucugacugucacagccaucguggcuaaaauauuacugcacguuaccuucaagucgcaccgggugccggccucuggagaccuccgugauugucaccagcccggcacguccggggagauuuggucaaucuuuuacaaaccuaguaccagcauuuccaucuucaagaagaaacuuaagggacagucucaacaggacgaucgcaauccacuggucagcgacuga

SEQ ID NO: 58240 - RNA, 2067 nt, Artificial Sequence
  derived and/or modified sequence opt3 from KRIT1__Homo_sapiens__NP_001013424
augggcaaccccgagaauaucgaagacgccuacguggcugucauuagaccuaagaacaccgcaagccuuaauuccagggaguaucgggccaaaucuuacgaaauacuccuucacgagguuccaaucgaagggcagaagaaaaagcgcaaaaaggugcuguuggagacaaaguuacaaggaaacucagagauuacucaggguauccuggauuauguaguggaaacgaccaaaccgauuagucccgcgaaucagggcauccgagggaagcgugucgugcuaaugaaaaaguucccucucgacggagagaaaaugggcagagaagcuagccuguuuauaguuccauccguggucaaggauaacacaaaguacacuuauacccccgguugcccuaucuucuacugucuucaggacauuaugagggugugcucugagucgucaacacauuuugccacccugacugcacggauguugaucgcccucgauaaauggcuggacgagcgccacgcucaaagccauuucauuccagcacuguuuagacccaguccucucgaaaggaucaagacaaauguaauaaacccagccuaugcuaccgaguccgggcagacggaaaauucuuuacacaugggauacagcgcccuggagauuaaauccaagaugcuugcguuggaaaaagcagauacuuguaucuacaacccgcuguucggcucagaccuacaguauaccaaucggguugauaagguggucauuaaccccuacuuuggccucggggccccugacuauaguaaaauccagaucccaaagcaagagaaguggcagcgcagcaugucuuccgugacagaggauaaauacggaaagguggaagcuacucgaauacugcuugagaaagguaagugcaaucccaaccuguugaauggccagcucucaagcccucugcauuucgccgcagggggaggccacgcugaaauuguccagaucuuacugaaccacccagagaccgacagacauauuacagaucaacaggguaggaguccccucaacaucugugaagagaauaaacagaacaauugggaggaagccgcgaagcugcugaaggaggccauaaacaaaccguaugaaaagguucggauuuaccguauggacgggucuuaucgcuccguggaguugaaacacggaaauaacaccacgguacaacagaucauggaaggcaugagacuaagccaggagacucagcaauacuuuacaaucuggauuugcucggagaaucugucucuccagcugaagccuuaccauaaaccccuucagcacgugagggacuggccagaaauccuggcagaguugaccaaccucgauccucagcgggaaacuccccaacuguucuuacgacgcgacgucagacugccacuagagguggagaagcagauugaagauccccucgcuauacugauccuuuuugacgaggccagguauaauuugcugaagggcuucuacacagcuccugaugccaaacucauuacccuggcaucccuucuguugcagaucguuuaugggaacuacgaaucaaagaaacacaagcagggauuucucaaugaggaaaaccugaaaaguaucgugccagucacgaaguuaaagagcaaagccccgcauuggaccaaucggauucugcacgaguauaagaaccuauccacaucugagggugugagcaaagaaaugcaucaccuccaacgcauguuccugcagaauuguugggagauacccacuuacggcgcugcguucuuuaccgggcagaucuucacaaaggcaucaccuaguaaccauaaaguaauuccaguuuaugugggagucaacaucaagggccuucacuugcugaauauggaaacuaaagcccuccugauuuccuuaaaguacgguugcuuuauguggcagcugggggacaccgauacauguuuccaaauccacagcauggagaacaagaugucuuuuauagugcauaccaaacaggcuggccuugucgugaaguugcucaugaaacugaauggacagcuaaugcccacugaaagaaacucauga

SEQ ID NO: 58241 - RNA, 1755 nt, Artificial Sequence
  derived and/or modified sequence opt3 from KRT10__Homo_sapiens__NP_000412
augagcgugagauacuccucuucaaagcacuauaguagcuccaggucuggcgggggagguggcgggggaggcugcggugggggaggcggcgucucgucacugcggaucagcaguuccaaagggucucucggagguggcuucagcuccgggggauuuucaggcgguaguuucagccgcgggucuuccggaggcggcuguuuugggggaucaagcgguggcuacgggggacuuggcgguuucgggggcggaaguuuucgaggcucuuauggguccagcucguucggagguucuuacggcggguccuuuggaggcgguucauucgggggcggaaguuuuggcgggggcagcuucgguggcgggggauuuggcggugggggcuucggaggcggguuuggaggcgguuucgggggagacggcggucuguuguccggcaacgagaagguuaccaugcagaauuuaaacgaucgucuggccucuuaucuagacaaagugagagcucucgaagagagcaauuacgaacuggaggggaagauuaaagaaugguaugagaagcauggaaacucacaccaaggcgagcccagggauuacaguaaguacuauaaaacaauagacgaucuuaagaaucagauccugaacuugacuacggacaaugcaaacauucuccugcagaucgauaaugcccggcuggcggcugacgauuuccgccucaaauacgaaaacgagguagccuuaagacaguccguggaagcagacauuaaugggcugaggcggguccuugaugaguugacccugacaaaggccgaccuagagaugcaaaucgaaagccucacugaggaacuggcuuaucuuaaaaagaaccaugaggaagagaugaaggaucugcgcaaugugucuaccggagacguuaacguggagaugaaugcagccccuggcgucgacuugacacagcuccugaacaacaugcgaucacaguacgaacaguuagcugagcaaaauagaaaagaugccgaagcgugguuuaacgagaagaguaaagaacugaccacugagauagacaauaacaucgagcagauuagcuccuauaagucugaaaucacagagcucaggcggaaugugcaggcacuugaaauugagcugcagucgcaauuggcccuaaaacagagccuggaggcuucccucgccgagaccgagggucguuacugcguacagcugucacaaauccaggcacagauaagugcucuugaagaacagcugcaacagauucgcgccgaaacggagugucagaacacugaguaucagcaauugcucgauaucaagauuagacuggaaaaugagauccagaccuacaggucuuuacuggaaggggagggaagcuccggcgguggcgggcggggaggcgggucauucggaggcgguuacgggggaggcagcucugguggcggguccaguggaggcgggcacggaggcggucaugggggaagcucuggcggcggguauggagguggcuccucagggggaggcaguagcggugggggauacggcggcgggucguccucuggaggucacggcgggagcucaaguggaggcuauggugggggauccucuggcggcgggggagguggcuacgggggaggcagcuccggugggggaucaagcaguggcggcggguauggagguggaucuuccagcgggggacacaaaucgucaucuaguggcuccguuggugaaagcucuagcaaggggccacgauacuga

SEQ ID NO: 58242 - RNA, 1485 nt, Artificial Sequence
  derived and/or modified sequence opt3 from KRT12__Homo_sapiens__NP_000214
auggaccugagcaacaauaccaugucccucucugugagaacacccggccuuucaaggcggcugaguagccaguccgucaucgggcgcccucgaggaaugucugccucgucaguugguagcggcuacgggggaagugcuuucggcuuuggugcauccugcgggggaggcuucucugccgcgagcauguuuggcuccucaaguggguucggagguggcagcgggucuuccauggcuggaggcuugggugccggguauggacgugcauuaggcggcgggucauuuggaggucugggcaugggguucggaggcagcccaggugggggcagucuaggcauucucucuggaaacgaugggggacugcuuuccgguagcgagaaggaaacuaugcaaaaucugaacgacagauuggccucguaccucgauaaagugagggcucuggaggaagcaaauacggagcuggaaaacaagauacgggagugguaugagacccgcggcacagggacugccgacgcuucucaguccgauuacucaaaauauuacccgcucaucgaagacuuaagaaauaagauuaucagugccagcauuggaaacgcgcagcugcuuuugcagaucgauaaugcaaggcuggccgcugaggacuuucggaugaaauaugaaaacgagcuagcccuccgccaaggcguagaggcagauauaaauggucugcgaagagugcuugacgaacugaccuugacaaggaccgaucucgagaugcagaucgaaucccugaacgaggaauuagcuuacaugaagaagaaucacgaggacgagcugcagucuuuccgggucgggggccccggagaagugagcguugagauggaugccgcgccuggcguggaccucacucgucuucugaacgacaugcgcgcccaguacgaaacaauugcagagcaaaauagaaaagaugcugaagccugguuuaucgagaagucaggggaguugaggaaagaaauuaguaccaacacggagcagcuacaguccagcaagucugaagucacugaccugcggcgagcuuuccagaaccucgagaucgaacugcaaucacagcuugccaugaaaaagagucuggaggauagcuuggcagaggccgaaggagacuauugugcucagcucucccaagugcagcagcugauaucuaauuuagaggcgcagcugcuacaaguacgcgcagaugccgaaagacagaacguugaccaucagaggcuccugaaugugaaggcucggcuugaguuggagauugaaaccuaccgcagacugcucgauggugaggcccagggcgacgggcuggaagagucgcuuuuugucacagauagcaaaucccaagcacagucaacugacaguucuaaggauccaaccaaaacaaggaagaucaaaaccguggugcaggaaauggucaacggagagguugugagcucccagguacaagagauugaggaacugauguga

SEQ ID NO: 58243 - RNA, 1263 nt, Artificial Sequence
  derived and/or modified sequence opt3 from KRT13__Homo_sapiens__NP_002265
augagccugagacuccaguccucuucagccaguuacggcgggggauucgguggcgggagcugccaacuuggaggcgguagagggguguccaccuguucuacacgguuugucucgggaggcucagcuggcggguauggagguggcguuagcugcggguucggaggcggugcagggaguggauuuggcggcggguacggagguggccucgggggaggcuauggugggggcuugggaggcggguucggagguggcuuugccgggggauucguggacuuuggcgcgugugaugguggguuacugacuggcaacgagaagaucacgaugcagaaucuaaacgaccgccucgcuuccuaccuggaaaaaguacgagcccuugaggaagcaaaugccgaucuggaggugaagauucgugacuggcacuugaaacagucucccgcuagcccugaaagggauuauuccccauacuauaagaccauagaggagcugagggacaaaauccugacagcaacuauugaaaacaaucgggucauccuggagauugauaacgcccgccucgcugccgacgauuucagauuaaaguacgaaaaugagcuggcgcuuaggcagucaguggaggcagacaucaacggauugcggcgcguucuggaugaacuaacccucaguaagacagaccuggagaugcaaauagaaagccuuaaugaggaacuggccuacaugaaaaagaaccaugaggaggaaaugaaagaguuuucuaaucagguggucggccaggugaacguagaaauggaugcuaccccggggaucgacuugacucgaguucucgccgagaugagagaacaguaugaggcaauggcugagaggaaucggcgugacgccgaagagugguuccacgcgaaguccgccgaacugaacaaagaggugucaacaaauaccgcaaugauucaaacgagcaagacugaaaucaccgaguuacgcagaacacugcagggacucgagauugaacuucagagucagcugucuaugaaggcugguuuggagaacacugucgccgaaaccgagugcagguacgcucuacaacugcagcagauccaaggccucauauccagcauugaggcccagcugucggaacuucggucugagauggaaugucagaaccaggaguauaaaaugcuguuggauaucaagacacgacucgaacaagagauugcaaccuaccgcucccuguuagaggggcaggacgccaaaaagagacagcccccuuga

SEQ ID NO: 58244 - RNA, 1419 nt, Artificial Sequence
  derived and/or modified sequence opt3 from KRT14__Homo_sapiens__NP_000517
augaccacaugcagcagacaguucacuuccucuucaaguaugaagggcagcugugggaucggagguggcauugggggaggcuccucuaggauaucgucagugcuggccggugggagcugccgggcucccaguacguacggaggcggccucuccgucucuagcucccgcuuuucaagugggggagcauauggucuuggcgggggauacggcgguggguucucuagcuccucaagcaguuuuggaucuggcuucggcgggggauaugguggcgggcugggagccggcuugggugggggcuuuggaggcggguucgcgggaggugacggcuuacugguuggguccgagaaagugaccaugcaaaaccuaaaugaucgacucgcuagcuaccuggacaagguacgugcccuugaagaggcaaacgccgaucuggaagugaaaaucagagacugguaucagaggcagcggccugcugagauuaaggauuacucgccauauuuuaaaacaaucgaagacuugcgcaauaagauucucacugcaaccgucgauaacgccaaugugcugcugcagaucgacaacgcuagacucgccgcggaugacuucaggacaaaguacgagaccgaguuaaaucugcggaugucuguugaagcagauauaaacggacuucgccgaguguuggacgagcugacucuagccagagcugaucucgaaaugcaaaucgagucccugaaagaggaacuugccuaccugaagaaaaaucacgaggaagagaugaacgcauugaggggccaggucgguggggacgugaauguagaaauggacgcugccccgggcguugaucucucacggauucugaacgagaugcgugaccaguaugagaagauggcggagaaaaaucgcaaggaugccgaagaaugguuuuucacaaagaccgaggaauuaaacagagagguggcaacgaauagugagcugguccagagcggaaaauccgaaaucucugagcucaggcggacuaugcaaaaccuugaaauugagcugcagagccaguugucaaugaaggcuagucuagaaaacucccuggaggagaccaaaggccgauacuguaugcagcucgcccaaauccaggaaaugauagggagcguggaggaacagcuggcucaacuucgcugcgagauggagcagcagaaucaggaauauaagauucuguuggacgugaaaacaagacucgagcaagaaaucgccacuuacaggcggcuguuagagggagaagaugcacaucugucuucaagucaguuuagcuccgguucucagucgagccgcgacgucaccuccucaaguagacagauuaggacaaagguuauggaugugcacgacggcaaaguagugucuacccaugagcaaguccuacguacgaagaacuga

SEQ ID NO: 58245 - RNA, 1371 nt, Artificial Sequence
  derived and/or modified sequence opt3 from KRT15__Homo_sapiens__NP_002266
augaccacaacuuuccugcagacgagcuccucuaccuuuggcgggggaucaacaagagguggcagucuccuugccgggggaggcgguuucgggggaggcagccuguccggcgggggagguucuaggucgaucucagcuagcagugcacgguuuguguccucuggcagcgggggaggcuacggugggggaaugcgcgucugcggcuucggcgggggagccgguuccguuuuuggcgggggauucggcgguggggugggcggaggcuuugggggagguuucggcgggggagacggcgguuuguuaucagggaacgagaagauuacuaugcaaaaucugaacgaucgacuagcgaguuaucucgacaaaguacgugcucuggaagaggccaaugcagaucuugaagugaagauacacgacugguaccagaaacagacccccacaagcccugagugugauuauucucaguacuuuaagaccaucgaagaacugagagacaaaauuauggccacuacaaucgauaacuccagggucauuuuggagaucgacaaugcucggcucgcagccgaugacuuccgccugaaguaugaaaacgagcuggcucucagacaaggcguggaagccgauauaaauggauuaaggcggguucuggacgagcuuaccuuggcgcgcacggaucuggagaugcagaucgaaggccuaaacgaggaacucgcauaccugaagaaaaaucaugaggaagagaugaaggaguuuucaagccagcuugccggacaggugaacgucgaaauggacgcugccccagggguggaccugacucgaguauuggcagagaugagagaacaauaugaggcuauggccgagaaaaauaggcgggauguugaggcgugguucuuuaguaagaccgaggaacucaacaaagagguggccucuaauacagaaaugauucagacuuccaagaccgagaucacagaccugcgucgcaccaugcaggaauuagagauugagcugcagagccaacucucgaugaaggcaggucuugaaaacucucuggcugagacggaaugcagauacgccacucaguugcagcaaauccagggccuaauagggggacuggaggcucagcucuccgagcugaggugugaaauggaggcccagaaucaagaauacaaaaugcuucuggauauuaagacacgguuggagcaggaaaucgcaaccuaucgaucacuccuggagggccaggacgccaaaauggcugguauugggauccgcgaggcgaguagcggcggaggcggguccucuagcaacuuccacaucaacgucgaagagucaguggauggacagguggucaguucccauaagagagaaauuuga

SEQ ID NO: 58246 - RNA, 1422 nt, Artificial Sequence
  derived and/or modified sequence opt3 from KRT16__Homo_sapiens__NP_005548
augaccacaugcagcagacaguucacuuccucuucaaguaugaagggcagcugugggaucggagguggcauugggggaggcuccucuaggauaucgucagugcuggccggugggagcugccgggcucccaguacguacggaggcggccucuccgucucuagccgcuuuuccucagggggagcauguggucuuggcgggggauauggcgguggguucaguagcagcuccucauuuggaagcggcuucggcgggggauacgguggcgggcugggagccggcuuuggugggggcuugggagcgggcuucgggggagguuuugcuggcggggacggauuacugguuggcagugagaaagugaccaugcaaaaccuaaaugaucgacucgccucuuaucuggacaagguacgugcacuugaagaggccaacgcugaucuggaagugaaaaucagagacugguaccagaggcagcggccuuccgagauuaaggauuauagcccauacuucaaaacaaucgaagacuugcgcaauaagauuaucgcagccacuauagagaacgcucagccgauccuccaaauugauaaugccagacuggcggcagacgauuuuaggaccaaguaugagcacgaacuggcccuccggcagacagucgaggcugacgugaacgguuuacgccgaguucuggaugaacuuaccuuggccagaacugaccuggagaugcagaucgaggggcuaaaagaagaacucgcauaccugaggaagaaucaugaagaggaaaugcuugcucugcggggccagacaggaggcgaugugaacgucgagauggacgccgcgcccgggguggacuugucgcguauucucaaugagaugcgcgaucaauacgaacagauggccgagaaaaacagaagggacgcagaaaccugguuccugucuaagacggaggaauuaaauaaagagguagcuuccaacucagagcugguucagaguagccgguccgaagugacugagcuccgacgcguccuucagggacuggaaaucgaguugcaaucucagcuaagcaugaaggccucacuggaaaauagucucgaggagaccaaggguagauauugcaugcagcugucccaaauacagggccuuauugggagcguggaggagcagcuggcucaguugaggugugaaauggagcaacagucucaggaguaccagauccuccuggaugugaaaacacgguuagaacaagagauugccacuuaucgcagacugcuagaaggagaggacgcacaccucucaagucagcaggccagcggccaguccuacucuucgagggaagucuuuaccagcuccucaaguucuagcucccgucaaacacggccuauccugaaggagcagucaucuucuuccuucagucagggucagagcucuuga

SEQ ID NO: 58247 - RNA, 1299 nt, Artificial Sequence
  derived and/or modified sequence opt3 from KRT17__Homo_sapiens__NP_000413
augaccacaagcaucagacaguucacuuccucuucaaguauuaagggcagcuccgggcugggaggugggucuucgaggacgucaugccggcucagcggcggacuuggcgccgguaguugucgccugggguccgcuggaggcuugggcucuaccuuagggggaagcuccuacucaaguugcuauagcuuugguucuggcgggggauacggcuccucauucggugggguggacggacugcuagcaggcggcgagaaagccacaaugcaaaaccucaaugaucgacuggcgagcuaucuugacaagguccgugcucuggaagaggccaacacugaauuggagguuaaaauaagagauugguaccagaggcaggcacccgggccugcccgggacuauagucaguacuaucgcaccaucgaagaacuccaaaauaagauucugacagcuaccguggauaacgcaaauauccugcuccagauugacaacgccagauuagcugccgaugacuuuaggacuaaauucgagacagaacaggcgcugcggcuuucuguagaggcagauaucaauggauugcgccgagugcuggacgaacuaacccucgccagagcugaucuggagaugcagauagagaaccuuaaggaagaacuggccuacuugaagaaaaaucacgaagaggaaaugaacgcacucaggggucaagucggcggggagaucaauguggagauggacgcugccccaggaguugaucugucccggauuuuaaacgaaaugcgugaccaguacgagaagauggcggagaaaaaucgcaaggacgccgaggauugguuuuucagcaaaacggaggagcugaacagagagguggcaacuaauucggaacucguccagucuggcaaguccgagaucucagaacuuaggcggaccaugcaggcucuggagauugaauugcaaagucagcuaagcaugaaggccucccuggaggguaaccucgcugagacagaaaaccgauauugugugcagcugucucaaauccaggggcuuauaggcagcguagaggaacagcuggcccaguugcgcugcgagauggagcaacagaaucaggaauacaaaauucuccuggacguuaagacuagauuagagcaggaaaucgcaaccuauaggcggcugcuagagggagaagaugcccaucucacacaauacaaaaaggagccggugaccacgcgccaggucagaacuauuguggaggaagugcaggacggcaaagucaucucaaguagggagcagguucaccaaacaacccguuga

SEQ ID NO: 58248 - RNA, 1293 nt, Artificial Sequence
  derived and/or modified sequence opt3 from KRT18__Homo_sapiens__NP_000215
augagcuucaccacaagauccacuuuuucuacgaacuacaggucacugggcagugugcaggcccccagcuauggggcucggccugucuccucugcagccucgguuuacgcgggagcugguggcucagggagccgcaucagugugucccgaucuaccagcuuccguggaggcauggguuccgggggacucgccacaggcauugcaggcgggcuugccggaauggguggcauacaaaaugagaaggaaacuaugcagucacugaacgacagauuggcuaguuauuuagauaggguacggagccuggagaccgaaaaucgcagacuagagucuaaaaucagggaacaccucgagaagaaagggccacaggugcgggacuggucccauuacuuuaagauuaucgaggaucugcgcgcacagauuuucgccaacacagucgacaaugcucgaaucgugcuucaaauagauaacgccagacuggcggcagacgauuuuaggguuaaauaugaaaccgaguuggccaugcggcagucaguggaaaaugacauccacggacuccguaaggucauugaugacacuaacaucacacgccugcagcuggagaccgagauugaagcucucaaggaggaauuacuguucaugaaaaagaaucaugaggaagaggugaaaggccuucaggcccaaaucgcaagcagugguuugacgguagagguugaugcuccgaagucucaggaccuggccaaaauaauggcggauauuagagcccaguacgacgaacuagcaaggaagaaccgggaggaacucgacaaguauuggucccagcaaaucgaggaaagcacuaccguggucacaacucagucggcugaggugggggccgcugagaccacacugaccgaacuucgacgcacggugcagucucuggagauugauuuggacuccaugagaaaucucaaagccucacuggaaaacaguuuaagggaggucgaagcacgguacgcccugcaaauggagcagcucaauggaauccuucugcacuuggagagcgaacuagcucagacucgcgcggagggccagagacaagcacaggaauacgaggcccugcucaacaucaagguuaaacuggaggcugaaauugccacauauaggcgucuucuggaggauggcgaagacuuuaauuugggggaugcacucgacuccucuaacagcaugcagaccauacagaagacuacaacccggcgaaucguggauggaaaaguagugucagagacgaacgacaccaagguccugagacauuga

SEQ ID NO: 58249 - RNA, 1203 nt, Artificial Sequence
  derived and/or modified sequence opt3 from KRT19__Homo_sapiens__NP_002267
augaccagcuacuccuauagacagucuucagccacaaguagcuucggcgggcugggagguggcuccgugagguuugggcccggagucgcuuuccgggcaccuucuauccacggcgguucagggggacgcggcguuucggugagcagugcccgauuuguauccucuagcuccucaggcgcguacgggggagguuauggcggggugcucacugcuagugacggacuucuggccggcaacgagaaguugacgaugcaaaauuuaaacgaucgucuggcaagcuaccuagacaaagucagagcccucgaagcugcaaauggugagcuggaagugaagauuagggauugguaucagaaacaggggccaggaccgucucgggacuacucccauuauuacaccacaauacaggaucuucgcgacaagauccugggcgccacuauugagaacucaagaaucguuuugcaaauugauaaugcuaggcucgccgcggacgauuuccggaccaaauuugaaacagagcaggcacugcgcaugagcguggaggccgacaucaacggccugcgaagaguccucgaugaauuaacccuggcuaggacugaccuugagaugcagauagaaggguugaaggaggagcuggccuaccuaaagaaaaaucacgaagaggaaaucaguacacuccggggacagguggguggccaaguaucuguugagguggauuccgcacccgggaccgaccuggcuaagauucuuagcgacaugcguucgcaguaugaagucauggccgagcagaaccgcaaagaugcggaggccugguucacgucuagaacugaggaacugaauagggaaguggcaggacauaccgagcaguugcaaaugucccggucagaagugacagaccuccgacgcacucugcagggcuuagagaucgagcugcagagucaacucagcaugaaggcugcccuugaagauacccuggcugagacagaagccagauuuggugcacaguuggcccacauucaggcucuaaucuccgggauagaggcgcagcugggcgacgucagggcagauucugaacggcaaaaccaggaguaccagcgccucauggacauuaaaagcagacuggagcaggaaaucgccaccuauaggucacuucuggagggacaagaagaucauuacaauaacuugagugcuuccaagguucucuga

SEQ ID NO: 58250 - RNA, 1935 nt, Artificial Sequence
  derived and/or modified sequence opt3 from KRT1__Homo_sapiens__NP_006112
augagcagacaguucuccucuaggucaggcuaccggagugggggagguuuuagcuccggcucugccgggaucauuaacuaucaacgccgaaccacaucgucaagcacucguagaaguggaggcggugggggaagguucuccucuugcggcggcgggggagguagcuuuggcgcugggggaggcuucgguucccggucacuggugaaucucgggggaaguaagagcauaucuaucuccgucgcacgcggcggcgggagaggaucagguuuuggcgggggauacggcggugggggcuucggaggcgggggauuugguggcgggggauucggcggugggggcauuggaggcgggggauuugguggcuucgggagcggaggcgguggguuuggcggaggcggguucggaggcgguggguauggaggcgguuacggccccguuuguccuccagggggaauccaggaggugacgauuaaccagagucuucugcagccguugaauguagaaaucgaccccgagauacaaaaagugaagucuagggaacgggagcagaucaaauccuuaaacaaucaguuugccagcuucauugauaagguccgcuuccuggaacagcaaaaccaggugcuacagaccaaaugggagcuccugcagcaaguugacacaucgacucgaacccacaaucuugagccuuauuuugaaucuuucaucaacaaucugagaaggcggguggaucaguugaaguccgaccagucacgucucgauagugagcugaagaacaugcaagacauggucgaagauuaccgcaauaaauaugaggacgagauuaacaagagaacaaaugcggaaaacgaguuugugaccaucaaaaaggauguagacggcgcuuacaugacuaaaguugaucugcaggccaagcucgacaauuuacagcaggaaauagauuuccugacagcacuuuaccaagccgaguugagccagaugcagacccagauuuccgaaacgaacgugauccugucuauggacaacaauaggagccuagaccucgauucaauuaucgcugaggucaaggcacaauaugaggacaucgcccagaaaaguaaggcugaagccgagucccuguaccagagcaaauaugaggaacuucagauuacugcggggcggcauggagauucugugcgaaacucaaagauagaaaucagugagcugaaucgcgugauucaaagauugaggagcgagaucgacaacgucaaaaagcagauauccaaucuccagcagucuauuucggaugcagaacaacggggcgagaacgcccugaaagacgcuaagaauaaguuaaacgaucuggaagacgcccuccagcaggcaaaagaggaucuugcucgccuguugagagacuaccaagaacuaaugaauaccaagcuggcccucgaucuggagaucgcgacauauaggacucuucuggagggugaagagagccguauguccggggaaugcgccccaaacguuucagugaguguaucuaccagccacacaaccaucuccggaggcgguucacggggcgggggaggcgggggauacggcagcggugggucuuccuauggaaguggcgguggcagcuacgggucuggaggcgggggaggcggugggcgaggauccuacggcucaggcgggaguagcuauggaucggguggcggguccuacggaucuggcggugggggaggcggccaugggagcuauggaucagguaguuccucuggcggguacagaggaggcagcggugggggaggcggcggguccucaggagguaggggcagcgggggaggcaguucugguggguccauuggaggccgcggcagcucgucagggggagugaaaucuagugguggcuccagcucugucaaguuugugagcacgacuuauuccgggguuacacgguga

SEQ ID NO: 58251 - RNA, 1275 nt, Artificial Sequence
  derived and/or modified sequence opt3 from KRT20__Homo_sapiens__NP_061883
auggacuucagcagaagguccuuucaccggucucugucaaguagccuccaggcccccguggucuccaccguuggcaugcaacgccuugggacaacuccuucuguguacggaggugcuggcgggcgaggaauccguauuucgaacucaagacauacgguaaauuauggcagcgaucugaccggugggggagacuuguucgugggcaacgagaagauggcaaugcagaauuuaaacgauaggcuggccaguuaccuagaaaaaguccggacacucgagcaguccaauucuaagcuggaagugcagauaaaacaaugguaugagacuaacgcgccacgcgcuggcagagacuacagcgccuauuacaggcagaucgaagaacuucggucccagauuaaggaugcacagcugcaaaaugcccgcugcguuuugcagaucgacaacgcuaaacucgcagccgaggauuuucgacugaaguaugaaaccgagagagggauuaggcugacaguggaagcugaccuccagggauuaaauaaggucuucgaugaccugacccuucacaaaacugauuuggagauccagauagaggaacugaacaaggaccuagcccuccugaaaaaggagcaucaagaagagguggauggucuucacaaacaucugggcaauacaguaaacguugaaguggacgcggcaccgggguugaaucucggagucaucaugaacgagaugcggcagaaguacgaggugauggcccagaagaaucugcaagaagcuaaagagcaguuugaacgucagaccgccguguuacagcaacaggucacgguuaacacugaggaacugaagggcaccgaggugcagcucacagagcuucgcagaacuucacagagucuggaaauugaguugcaaagccaccuaucuaugaaagaaucccuggagcacacccucgaagagacaaaggcaagguacucaagccagcuggcuaaccuucagagucuguugucuucccucgaggcccagcugaugcaaauccggagcaauauggaacgacagaacaaugaguaucauauuuuacuggacaucaaaacccgccuagaacaggagauagcgacguacagaaggcuccuggagggugaagauguaaagacuacagaguaucagcuuucgaccuuggaggagcgggacauuaaaaagacucgcaagaucaaaacagugguccaagaagugguugaugggaagguggucucuuccgaggugaaagagguagaagagaacauuuga

SEQ ID NO: 58252 - RNA, 1269 nt, Artificial Sequence
  derived and/or modified sequence opt3 from KRT23__Homo_sapiens__NP_056330
augaacagcggccacuccuucucucagacccccucagccaguuuucauggggcuggagguggcugggggagaccuaggagcuucccacgggcaccgacagugcacggaggcgccgguggggcgcgcaucucccugucuuuuacuacgcgaucgugucccccuccaggaggcucauggggcagcgggcguaguucaccccuccuuggagguaauggcaaggcuaccaugcaaaaccugaaugacagauuggccucuuacuuagagaaagucagggcacuggaagaggccaacaugaagcuagaaagccggauucucaaauggcaucagcagcgcgauccuggguccaagaaagacuauucacaguacgaggaaaauauaacacaucugcaagagcagaucguugauggaaagaugacuaacgcucagauuauccuucugauugacaaugcaagaauggccguggaugacuucaacuugaaguaugagaaugaacacaguuuuaaaaaggaucucgagaucgaaguagagggccugaggcggacccuggacaaccucacaauagugaccacugauuuagagcaggaagucgaggguaugcgcaaagaacugauccuuaugaagaaacaccacgagcaagaaauggagaagcaucacgugccaagcgacuucaauguuaacgugaaggucgauacagggccccgagaggacuugauuaaagugcuggaagauaugagacaggaguacgaacuaaucauuaagaaaaagcauagggaccucgacaccugguauaaagagcagucugcugccaugucccaggaagcggcauccccugccacgguacaaagccggcagggagauauccacgagcugaagcguacuuuucaggcucuugagauagaccugcaaacccaguacaguacaaaaucugccuuggaaaauaugcucuccgagacucagagccgcuauucgugcaagcugcaggauaugcaagaaauuaucucucacuacgaggaagaguuaacccagcugagacaugagcucgaaaggcagaacaaugaguaccagguucuucugggcauuaagacacacuuggaaaaagagaucaccacguaucggcgacuacuggagggcgaauccgaggggacucgcgaagagucaaagaguagcaugaaaguguccgcaacaccaaagaucaaagcuauuacccaagaaacuauaaacggaagacucguccugugccaggugaacgagauccagaagcaugccuga

SEQ ID NO: 58253 - RNA, 1920 nt, Artificial Sequence
  derived and/or modified sequence opt3 from KRT2__Homo_sapiens__NP_000414
augagcugccagaucuccuguaagucuagaggcaggggaggggguggcgggggauuccggggcuuuucaagugguagcgccguggucuccgggggaucucgccgaucgaccaguagcuucaguugccugucccgucacggcggcgggggagguggcuuugggggaggcgguuucgggucuagaagccucguuggacuuggcggcacaaaauccauuucaauaaguguggcugggggagguggcggguuuggagcagccggcgguuucgggggcaggggaggcggguuuggagguggcagcucuuucgggggaggcuccgguuuuucagggggcggauucggcgggggagguuuuggcgggggacgguucggcgguuuugggggccccggaggcguagggggacugggcgguccugggggauucggcccagguggcuaccccgggggaauccaugaggugagcgucaaccaaaguuuguuacagccgcugaaugugaagguugacccugaaauucagaacgugaaagcgcaggagcgcgaacaaaucaagacucuaaauaacaaauucgcuucuuuuauugauaaggucagauuccucgagcagcagaaucaggugcugcaaacgaagugggaacuucugcagcagaugaacguaggcaccaggccaaucaauuuggagcccauauuucagggguauaucgacucccucaaacgguaccuggauggacugacagccgagcgcacuagccaaaacucggaacucaauaacaugcaggacuuaguugaggauuauaagaaaaaguacgaagacgagauuaauaaacgaaccgcagccgagaacgauuucgugacacugaagaaggacgucgauaaugcuuauaugaucaaaguggaacuucagucuaagguggacuugcugaaccaagagauugaauuucuaaaaguccucuacgaugcagagaucucccagauacaccagucaguuaccgacacuaaugugauucugaguauggauaacagcagaaaccuugaccuggacuccaucauugccgaaguaaaggcucaguaugaggagaucgcccaaaggucuaaagaagaggcggaagcauuguaccauagcaaguacgaggaacuccaggugacagucggccggcacggugauucacugaaagagaucaagauugagauaagugaauuaaaucgugugauccagcgccugcagggggagauugcccauguuaagaaacaauguaagaacgugcaggacgcuaucgccgaugcagaacagagaggagagcacgcucucaaagacgccaggaauaaacuuaacgaucuggaagaggcguugcagcaagccaaggaggaccuagcacggcugcuccgagauuaucaggaacugaugaaugucaaacuugcucuggacguggagauagccaccuaccgcaaguugcucgaaggcgaggagugcagaauguccggugaucugagcucuaacguaacgguuucagugacuucaagcaccauuuccucuaaugucgcuucgaaggccgcauucggcgggagcggaggcaggggguccucaaguggaggcgguuauucuagcggguccucaagcuacggaucuggcggucggcaguccggcagucgcgggggaagcggcgggggaggcucuaucuccggugggggauauggcucaggcgggggaagugguggcagauacgggagcggaggcgguucgaaagggggauccaucucuggcggcggguauggaagcgguggcgggaagcacucaaguggaggcgguucccgugggggaucuagcuccggcggcggguacggaucagguggcgggggaagcaguucugugaagggcuccagcggugaagccuuugggucgucagucacauucucuuuuagguga

SEQ ID NO: 58254 - RNA, 1251 nt, Artificial Sequence
  derived and/or modified sequence opt3 from KRT31__Homo_sapiens__NP_002268
augcccuacaacuucugccugccuagccucuccuguagaaccucuugcucaaguaggccaugugugccgcccagcugccacuccuguacacuuccuggcgccugcaauaucccagcuaacgucucuaauuguaacugguuuugcgaggggucguucaauggaucagaaaaggagacuaugcaguuucugaacgaccgguuggcaagcuauuuagaaaaaguucgccaacuggagcgagauaaugccgaacuagagaaccucauucgugagagaagucagcagcaggaaccccugcuuuguccuuccuaccaaucuuauuucaagacgauagaggaacugcagcagaaaaucuugugcaccaagagcgagaaugcgaggcucgugguacagauugacaacgcuaaacuggccgcagaugacuuucggacaaaguaccaaacugagcugucccuccgccaguuaguggaaucagauaucaauggucugagaaggauucuugacgaguugacccuguguaagagugaucuagaagcccaggucgagagccucaaagaagaacugcuuugccugaagucuaaccaugagcaggaagugaauacauugcggugccaacucggcgaccgccugaacguugagguggaugcugcaccaaccgucgacuuaaaucgagugcugaacgaaacuagaucccaguaugaggcccucguagaaacaaacaggcgggagguugagcagugguucaccacgcaaacugaggagcuuaauaaacagguggucucaagcagugaacagcugcagucuuaccaagcugagaucauagaauugcgucgcaccgugaacgcccuagagaucgagcugcaggcgcagcacaaucucagagauucccuggaaaacacacuuacugagagcgaagcaagguauucgucucagcugucccaagugcagucauugauuaccaaugucgagagucagcucgccgagauccggagcgaccuggaacgacagaaccaagaguaccagguuuuacuggaugugcgcgcuagacuagaaugugagauuaauacauacaggucccuccuggaaucugaggacugcaaccuucccagcaauccuugugccaccacgaacgcaugcucaaagccaaucgggccguguuugaguaaucccugcacuuccuguguaccuccagcucccugcacaccuugugccccacggccccgcugcggaccguguaacagcuuugugagauga

SEQ ID NO: 58255 - RNA, 1347 nt, Artificial Sequence
  derived and/or modified sequence opt3 from KRT32__Homo_sapiens__NP_002269
augaccagcuccugcugugugacaaacaaucugcaggccucucucaagucaugccccagaccugcuagugucuguagcuccggcguuaacugcaggccagagcuuugucugggguacgugugccaaccgauggcauguuugcccucuguaugcuuaccuacuacguuccggccagccucgugucugucaaaaaccuaucuaagcaguuccugccaggcggcuucuggaaucagcgguuccaugggccccgggucaugguacagugaaggagccuuuaauggcaacgagaaggaaacaaugcaguuccucaaugaccgccuggcaagcuaucuuacucgagugcgucagcuggagcaagaaaacgccgaguuggagucuaggauucaggaggcuucccacucacagguccucaccaugacaccugauuaccagagccauuuuagaaccauagaggaacugcaacagaaaauccuguguacuaaggcagagaaugcccggauggugguuaacauugacaaugcuaaacucgccgcggaugacuuccgcgcaaaguaugaggccgaauuagcuaugagacagcugguggaggccgauaucaacggucuuaggcggauuuuggacgaucugacacuaugcaaggcagaccucgaagcucaggucgagagucugaaagaagaacuuaugugccugaagaaaaaucacgaggaagagguggggucuuugcgcugucaacucggagaucgacugaacaucgaaguagacgccgcgccacccguugauuuaaccagagugcuggaggaaaugaggugccaguacgaggccauggucgaggcaaaucggcgugacguggaagagugguuuaacaugcagauggaggaacucaaucaacagguggcuacguccagcgaacagcuucagaacuaucaaucggauauaaucgaccugcgcagaacugucaacaccuuggagauugagcuacaggcccagcauucucugagggacucccucgaaaauacacugacugagucagaagcucgguacaguagccagcuugcccaaaugcaguguaugaucaccaacguugaggcacagcuggccgagauucgagcugauuuggaacgccagaaucaagaguaccaggugcuccuggacguaagagcgagguuagaaggcgagaucaacacauaucggucccugcuagaaaaugaggauugcaagcucccuuguaacccaugcucuaccccgagcuguacgacuugcgugcccucaccuugugucccacgcacagugugcguucccagaaccgugggcaugccuuguaguccaugcccccaggggagguacuga

SEQ ID NO: 58256 - RNA, 1311 nt, Artificial Sequence
  derived and/or modified sequence opt3 from KRT34__Homo_sapiens__NP_066293
augcuguacgccaagcccccuccaaccaucaacggcauuaaagggcuccagagaaaggagaggcuuaaaccggcucacauacaucugcaacaguugacaugcuucagcaucacuuguuccucuacgaugucauauaguugcuguuuacccagccugggaugccggaccuccuguucuucgcgcccuugcgugccacccucaugucacgguuacacacuaccuggcgcaugcaauauuccagccaacgucagcaauuguaacugguuuugcgaagggaguuucaauggauccgagaaggaaacuaugcaguuucucaacgaccgacuggcgucuuaucuugagaaaguucgucagcuggaaagagauaaugcugaguuggagaagcucauccaagaaaggagccagcagcaggagccccugcuguguccuuccuaccaaucauauuucaagaccauugaagaacuccagcagaaaaucuuaugcgccaaggcagagaacgcccggcuggugguaaauauagacaacgcuaaacuugcaagugaugacuuucgcagcaaguaccagacagaacaaucuuugagacugcuaguggaguccgauaucaauucaauuaggcggauccucgacgaacugacccuuugcaaaagcgaucuggagagucaggucgaaucuuugcgcgaggagcucauuugucugaagaagaaccaugaagaggaagugaauacuuuacgaucccagcugggcgacagacucaacguugagguggauacagccccaaccgucgaccuuaaucaagugcugaacgaaacgaggagccaguaugaggcuuugguagagaucaaccggcgugaaguugagcagugguucgccacucagaccgaggagcuaaauaaacaaguggucucgucuuccgaacagcugcagucaugccaggcggagauaauugagcuccgcagaacagugaacgcacuggaaaucgagcuucaagcccagcacaaucugagggauaguuuggaaaacacucucaccgagagcgaggcucauuacuccucucagcugagccaggugcaaucauuaauuacaaaugucgaaagucagcuggccgagauccggugugaccuagaacgacagaaccaggaguaccaaguucuccuggaugugcgcgcaagacuugaaugcgagaucaauaccuauagguccuugcuggagagcgaagacuguaagcucccgugcaaccccugugcuacgacuaaugccucugguaacucaugcgggccuuguggaacaagucagaaaggcugcuguaauuga

SEQ ID NO: 58257 - RNA, 1368 nt, Artificial Sequence
  derived and/or modified sequence opt3 from KRT35__Homo_sapiens__NP_002271
auggccagcaagugccugaaagcuggcuucuccucugggucacucaagagucccggaggugcaagcggcggguccaccagagugucugccauguacucgucaagcaguuguaaacuuccuucccugucuccagucgcgaggagcuuuuccgcuugcucaguuggauugggccggaguagcuaucgcgccacaucuuguuuaccggcacugugccuacccgccgguggguucgcuacuuccuacucaggaggcggcgggugguuuggagaggguauccucacgggcaacgaaaaggagaccaugcagagccugaaugaccgacuugcaggguaucuggaaaaagugcgucaauuggagcaggaaaacgccagucucgagucuagaauuagggaguggugugaacagcagguaccuuacaugugcccagauuaucaauccuacuuccggacaauagaggaacugcagaagaagacucuguguagcaaagcugagaaugcccgccucguggucgagaucgacaacgcgaaguuagcagccgaugacuuuagaaccaaauaugaaacagaggugucgcugaggcagcuuguugaaucugauauuaauggauugcggcgcauccuggacgaucuaacccucugcaaguccgaccuggaggcucagguggaaucacuuaaagaggagcuguugugucucaagaagaaccacgaagaggaagucaauagucugcgaugccaauuaggcgauagacugaacguggagguagacgccgcacccccuguugaucucaauagggugcuugaagagaugcggugucaguacgagacucuggucgaaaacaaucgucgcgacgcugaggauugguuggacacacagagcgaggaacuaaaccagcaagugguguccucuagcgaacagcugcagucaugccaagccgagauuaucgagcucagaaggaccgucaaugcgcuggaaauagagcuucaggcccagcauaguaugcgggacgcacuggaauccacguuggcugagacugaggcccgauacagcucucagcucgcucaaaugcagugcaugaucaccaacguugaagcccagcuggcagagauucgcgccgauuuagaaagacagaaucaagaguaucaggugcugcuagacguaagggcucggcucgaaugugagaucaacacauaccgcggucugcuugagucagaagauaguaaauugccaugcaaccccugugcgccugacuauagcccauccaagucuugccugccgugucuccccgcagccucgugcgggccuagcgcugccagaacuaauuguuccccaaggcccauuugcgugccuuguccaggaggccguuucuga

SEQ ID NO: 58258 - RNA, 1887 nt, Artificial Sequence
  derived and/or modified sequence opt3 from KRT3__Homo_sapiens__NP_476429
augagcagacaggccuccaagaccucuggcgggggaucacaagguuucaguggcaggagcgcuguggucuccgggucuucgcggaugucaugcguugcacacagcggaggcgccggugggggagcguacggcuuucgcaguggcgcugggggauucgguucccgaucucuguauaaccucggcgggaauaaaagcaucuccauuucaguggccgcaggaggcagucgugccgguggguuuggaggcggcagaagcucuugugcuuucgcagggggauacgguggcggguuuggauccggcuauggugggggcuucggaggcggguuuggagguggcagggggaugggaggcgguuucgggggcgccggaggcuuugggggagcugguggcuucgggggagccggcgguuuugggggccccggaggcuucgggggaucaggcgguuuugggggaccuggcagccuugguaguccaggcggguucggaccgggcggguuccccggaggcauacaggagguaacaaucaaccagucucuguugcagccuuuaaauguggaaauugacccacaaaucggucaggucaaggcgcaggagcgggaacagauuaaaacucugaacaauaaguuugcauccuucaucgauaaagugcgcuuucuagagcaacagaacaagguucucgaaacgaaguggaaucugcuucagcagcaagggaccagcucgauaucuggaacaaacaaucuggagcccuuguucgagaaccauaucaauuaccucagauccuaucuggacaacauucugggcgaaaggggucggcucgauucagagcugaaaaauauggaagacuuaguggaggauuuuaagaaaaaguacgaggacgaaaucaacaaacgcacugccgcugagaaugaguucgucacccuuaagaaggauguggacagugccuauaugaacaaaguagaauugcaggcaaagguugaugcucugauugacgaaaucgauuuucuacgaacacucuacgacgccgagcugagccagaugcaaucccacauaucugauaccagcgugguccuuucaauggacaacaauagaagucuggacuuggauuccauuaucgcggaggugagggcccaguacgaagacauugcacagcggagcaaagcugaggccgaagcucucuaucagacuaagcugggcgaguuacaaacaaccgccgggcgucauggagaugaccugcgcaacacgaaaucugaaaucaucgagcucaauagaaugauucagaggcuucgggcagagauagaaggcgugaagaaacagaacgccaaucugcagacugcuaucgcggaggcagaacaacacggggagauggccuugaaggaugcuaacgccaagcuacaggaacugcaggcagcccuccagcaagcuaaagacgaucuggcccgacuucugcgcgacuaccaggaguugaugaaugucaagcucgcacuggauguugagauugcgaccuauagaaaauuacuggaaggagaggaauacaggaugucaggcgagugcccuagugcugugagcaucuccguagugucuucgagcacaacuuccgccucagccgguggguauggaggcgguuacggcgggggaaugggcgggggacuaggcgguggguucagugcaggaggcggcucugggagcggauuuggucggggcgggggaggcgguauagggggaggcuucggcgggggauccucagguuuuagcggcgggucuggauucggcuccauuaguggugcucgcuauggggucagcggaggcggcuuuucuuccgccucaaacagagggggaaguaucaaguucagccagucgucccagucuagccaaagguacucacguuga

SEQ ID NO: 58259 - RNA, 1563 nt, Artificial Sequence
  derived and/or modified sequence opt3 from KRT4__Homo_sapiens__NP_002263
augaucgccagacagcaaugcgugaggggcgggccccggggauucagcugugguuccgcuauugucggcgggggaaagcgcggcgcauuuucuucaguuaguaugagcgguggggccggacgaugcuccucuggcggcuucgggucgcguucacuguacaaccucagaggaaauaaaagcauaaguauguccguggcggguucuaggcagggcgcuuguuuugggggagccggcgguuucgggaccggaggcuuuggcgggggauucgguggcagcuuuuccgggaagggaggcccugguuucccaguaugcccggcagggggcauccaggaggugacaauuaaccagucacuucugacucccuugcacgucgaaaucgacccugagauucaaaaagugcggacggaggaacgcgaacagaucaaguuacugaauaacaaauuugccaguuucauagauaagguucaguuucuagagcagcaaaauaaggugcucgagaccaaauggaaccugcuucagcagcagacaacuaccacaagcucuaagaaucuggaaccauuguucgagaccuaucucuccguccugagaaaacaacuggacacucucggaaacgauaagggcagguuacagucagaacugaaaacaaugcaggacagcguggaggauuuuaagaccaaguacgaggaagagaucaauaaacggacggcugcagaaaacgacuucguaguucuuaagaaagauguggacgccgcuuauuugaauaaggucgagcuggaagccaaaguggauagucuaaacgacgagauuaauuuccucaaggugcuguacgaugcggagcuuucucaaaugcagacucaugucuccgacaccagcguugugcugucgauggauaacaaucgcaacuuggaccucgacucuaucauugcagaaguacgagcccaguaugaggaaaucgcucagagauccaaagccgaggcagaagcucuguaccaaacaaaggugcagcaguuacagauaucagucgaucaacacggggacaaccugaagaauacuaaaagugagauugccgagcucaacaggaugauccagcggcuucgugcggaaauugagaauaucaagaaacagugucagacccugcaagugagcguugccgaugcagaacagcgcggagagaacgcuuugaaggacgcccauuccaaaagaguggaacuagaggcugcccugcagcaggcaaaggaggaacucgccaggaugcugcgggaguaucaagaacuuaugucugucaagcuggcuuuggauaucgagauugcgacauaccgaaaacuccuggagggugaagaguaccgcaugagcggcgaaugccagucagcagugaguauauccguaguuagcgggucuaccucaacgggaggcaucagugguggguuaggcagcggauccggcuuugggcugucuucgggauucgguagcggcuccgggucaggauuuggcuucggugggagugugucuggcagcuccucaagcaagauuaucucuacuacaacccuaaauaaaagaagguga

SEQ ID NO: 58260 - RNA, 1773 nt, Artificial Sequence
  derived and/or modified sequence opt3 from KRT5__Homo_sapiens__NP_000415
augagcagacaguccucugugucauucaggaguggcgggagccgguccuuuucuaccgccucggcuaucacacccucagucagccgcacuagcuucacguccguuucucgaagcggagguggcgggggaggcgguuuugggcgugugucccuggcaggagccugcggcguaggcggguacggaucaagaagucucuauaaccuugguggcagcaagaggauuucuauauccaccucagggggaaguuuccggaaucgcuuuggcgcgggugcugggggaggcuacggcuucgggggaggugccggcaguggguuuggauucggcgguggggcaggcggaggcuuugggcugggagguggcgccggguucggaggcgguuuugggggcccuggauucccaguguguccgcccggcgggauccaagaggucacagugaaccagucuuuguuaacuccucugaaucuacagauugacccauccauccagagaguuaggaccgaggaacgggaacaaauuaaaacacucaacaauaaguuugcuagcuucaucgauaaagugcgcuuccuggagcagcagaacaagguccuugacaccaaauggacucuguugcaggaacaaggaacaaagaccgugcgacagaaucucgagccccuguuugagcaguauauaaacaaucugagaaggcagcucgauucgaucguaggugaacggggccguuuagacucugagcugcgcaacaugcaagaucuuguugaagacuucaagaauaaauacgaggaugagauuaacaagagaacgacugcagaaaaugaguuugugauguugaaaaaggacgucgaugccgcuuauaugaacaaaguggaacuggaggccaagguggacgcgcuaauggaugaaaucaauuucaugaagauguuuuucgacgcagagcucucccagaugcagacccacgucucagauacaaguguugugcugagcauggacaacaacaggaaucuugaccuggauuccauuaucgccgagguaaaagcucaauacgaagagauagccaaccggucucgaacugaagcagagagcugguaucagaccaaguacgaagaguugcagcagacagcugggcgccauggagacgaucucagaaauaccaaacacgagauuucagaaaugaacaggaugauccaacggcugcgcgccgagauugacaaugugaagaaacagugcgcgaacuuacagaaugccaucgcagaugcugaacagagaggcgagcuggcccucaaggacgcuaggaacaaacuugccgaacuggaggaggcauugcaaaaggccaagcaggauauggcucgucuacugcgggaauaccaggagcucaugaauacgaaacuggcgcuugacgucgaaaucgcaacuuaucgaaagcuguuggagggugaggaauguagacucaguggggagggcgugggaccuguuaacauuuccguggucacaagcucugugucaaguggcuacgggagcggauccggcuauggugggggacugggcgguggcuuagggggaggccuagggggaggccuggccggugggucuucgggaagcuacuauuccucaaguucuggcgguguaggccucgggggaggccugagcguugggggauccggcuuuucagcuagcucugguagggggcuuggagugggcuucgguuccggcgggggaaguaguucuuccgucaaauuugugucaaccacuagcagcucgcgcaaguccuucaaaucuuga

SEQ ID NO: 58261 - RNA, 1695 nt, Artificial Sequence
  derived and/or modified sequence opt3 from KRT6A__Homo_sapiens__NP_005545
auggccagcaccuccacaacuaucagaucucacucaaguagcaggcggggcuucuccgcuaacucugcacgccugcccggggugucgcgaucaggauuuagcagugucuccguuucucguagcagagguuccggcgggcucggaggcgccugcgguggggcgggauucggcucaaggagucuuuacggccugggaggaagcaagcggauuucuauagguggcggguccugugcuaucucaggaggcuaugguagccgcgccgggggaaguuacggcuuuggcggggcaggaucugguuucggcuuugggggaggcgccgguauuggguucggcuugggaggcggggcuggauuagccgguggcuuugggggaccuggcuucccagugugcccgcccggugggauccaggagguaacggugaaucaaucccugcuaaccccucucaaccugcagauugacccaacaauccagagagucagggcagaagaacgggaacagauaaaaacucuuaauaacaaguuugcuagcuucaucgauaaagugcgcuuucuggagcaacagaauaagguuuuggaaaccaaauggacacuccugcaggagcagggcaccaagacugugcgacaaaaccuggagccccucuucgaacaguauauuaauaacuuaagaaggcagcuggacucgaucgucggagagcggggccgucuugauucugaauugcgcgggaugcaggaccugguggaggauuuuaagaauaaauacgaggacgaaauuaacaagagaacagccgcggagaaugaguucguaacccugaaaaaggauguugacgcagccuauaugaacaaaguggagcuccaagcuaaggccgauacgcugacugacgaaaucaauuuccuuagggcacuguacgaugcugaguugucccagaugcagacccauauaucagacacaagugucgugcucagcauggauaacaaucggaaccuggacuuagacuccauuaucgccgaggugaaggcgcaauaugaagagauugcccagcgaucucgcgcagaagcugagagcugguaccagacuaaauacgaggaacugcaggucaccgccggaagacacggugaugaccucaggaacacaaagcaagagaucgcugaaaucaaucggaugauucagcgccuuagaucagagauagaucauguuaaaaagcagugugccaaccugcaggcagccaucgcugacgcggaacaaaggggcgagauggcauugaaagaugccaagaauaaacuagaagggcuggaggacgcucuccagaaggccaagcaggaucuggcacgucuucugaaagaguaucaggaauugaugaacgugaagcucgcccuggacguagagauugcuaccuaccggaaauuacuggaaggagaggagugccgacuaaauggcgaagguguggggcaagucaacaucagugugguucaguccacggugagcucuggcuauggaggcgccucaggggucggaaguggccucggucuagggggaggcagcuccuacucuuaugguucgggccuuggggugggaggcggguuuagcuccucaagugggagagcaauaggcgguggguugucuagcguaggaggcgguuccucaacuauuaaguacacaaccacuucuagcuccaguaggaaaagcuauaagcacuga

SEQ ID NO: 58262 - RNA, 1695 nt, Artificial Sequence
  derived and/or modified sequence opt3 from KRT6B__Homo_sapiens__NP_005546
auggccagcaccuccacaacuaucagaucucacucaaguagcaggcggggcuucuccgcuaacucugcacgccugcccggggugucgcgaucaggauuuagcaguauuuccgucucucguagcagagguuccggcgggcucggaggcgccugcgguggggcgggauucggcucaaggagucuuuacggccuggguggaagcaagcggauaucuaucgguggcggguccugugcuauuucaggaggcuaugguagccgcgccgggggaaguuacggcuuuggcggggcaggaucugguuucggcuuugggggaggcgccgguaucggguucggcuugggaggcggggcuggauuagcagggggcuuugggggaccuggcuucccaguuugcccgcccggugggauucaggaggugacgguaaaucaaucccugcuaaccccucucaaccugcagaucgacccagccauacagagagugagggcugaggaacgggaacagaucaaaacacuuaauaacaaguuugccagcuucauugauaaaguccgcuuucuggagcaacagaauaagguguuggacacuaaauggacccuccugcaggaacagggcacaaagaccguucgacaaaaccuggagccccucuucgagcaguauaucaauaacuuaagaaggcagcuggauaauauugugggagaacggggccgucuugacucggaguugcgcaacaugcaggaucuggucgaagaccuaaagaauaaauacgaggaugagaucaacaagagaacugcggcagaaaaugaguuugugacacucaaaaaggacguagaugccgcuuauaugaacaaaguugaacugcaagccaaggcagacacccuuacggaugagauaaauuuccugagggcuuuguacgacgccgaacucucucagaugcagacucauauuuccgauaccucagugguccugaguauggacaacaaccggaauuuagaccuggauagcaucauugcggaggugaaggcccaauaugaggaaaucgcacagcgaucccgcgcugaggccgaaucuugguaccagacaaaauacgaggaacuccagaucacugcugggagacacggagacgaucuuaggaacaccaagcaagagauugccgagauaaaucggaugauccagcgccugagaagcgaaauugaccaugugaaaaagcagugugcaaacuugcaggccgcuaucgcggaugcagagcaaaggggugaaauggcccuaaaagacgcuaagaauaaacuggagggccucgaagaugcccugcagaaggcaaagcaggaccuugcccgucuguugaaagaguaucaggagcucaugaacgucaagcuggcuuuagauguugaaauagccacauaccggaaacugcuagagggggaagagugccgacucaauggagagggcgugggucaaguaaacauuucagugguccagaguaccguguccagcggguauggcggagcaucuggcguugggucaggacugggccuuggugggggaaguagcuacuccuauggcucugguuugggcgugggagggggcuucucgagcuccucagggagagcgacgggaggcggucugaguucugucgggggaggcagcuccacuaucaaguacacaaccacuucaucuagcuccaggaaaaguuauaagcacuga

SEQ ID NO: 58263 - RNA, 1695 nt, Artificial Sequence
  derived and/or modified sequence opt3 from KRT6C__Homo_sapiens__NP_775109
auggccagcaccuccacaacuaucagaucucacucaaguagcaggcggggcuucuccgcuaacucugcacgccugcccggggugucgcgaucaggauuuagcaguauuuccgucucucguagcagagguuccggcgggcucggaggcgccugcgguggggcgggauucggcucaaggagucuuuacggccuggguggaagcaagcggauaucuaucgguggcggguccugugcuauuucaggaggcuaugguagccgcgccgggggaaguuacggcuuuggcggggcaggaucugguuucggcuuugggggaggcgccgguaucggguucggcuugggaggcggggcuggauuagcagggggcuuugggggaccuggcuucccaguuugcccgcccggugggauucaggaggugacgguaaaucaaucccugcuaaccccucucaaccugcagaucgacccagccauacagagagugagggcugaggaacgggaacagaucaaaacacuuaauaacaaguuugccagcuucauugauaaaguccgcuuucuggagcaacagaauaagguguuggacacuaaauggacccuccugcaggaacagggcacaaagaccguucgacaaaaccuggagccccucuucgagcaguauaucaauaacuuaagaaggcagcuggauucgauugugggagaacggggccgucuugacucugaguugcgcaauaugcaggaucuggucgaagaccuaaagaacaaauacgaggaugagaucaauaagagaacugcggcagaaaacgaguuugugacacucaaaaaggacguagaugccgcuuauaugaauaaaguugaacugcaagccaaggcagacacccuuacggaugagauaaacuuccugagggcuuuguacgacgccgaacucucccagaugcagacucauauuucagauaccagugugguccugagcauggacaauaaccggaacuuagaccuggauuccaucauugcggaggugaaggcccaauaugaggaaaucgcacagcgaucucgcgcugaggccgaaagcugguaccagacaaaauacgaggaacuccaggugacugcugggagacacggagacgaucuuaggaauaccaagcaagagaucgccgagauuaaccggaugauacagcgccugagaucagaaaucgaccaugucaaaaagcagugugcaaguuugcaggccgcuauugcggaugcagagcaaaggggugaaauggcccuaaaagacgcuaagaauaaacuggagggccucgaagaugcccugcagaaggcaaagcaggaccuugcccgucuguugaaagaguaucaggagcucaugaacguuaagcuggcuuuagauguggaaaucgccacauaccggaaacugcuagagggggaagagugccgacucaauggagagggcguaggucaagugaacgucuccgugguucagagcaccauaucuucaggguauggcggagcaaguggcguggggagcggacugggccuuggugggggauccucuuacucguauggcagcgguuugggcauugggggaggcuucuccucaaguucugggagagcgaucggaggcggucugagcuccgucgggggaggcucaagcacgaucaaguacacuacaaccucuuccaguagcaggaaaucuuauaagcacuga

SEQ ID NO: 58264 - RNA, 1572 nt, Artificial Sequence
  derived and/or modified sequence opt3 from KRT71__Homo_sapiens__NP_258259
augagcagacaguuuaccugcaaguccggcgccgcugcaaaagggggauucucugguuguucagccgugcugaguggcgggagcuccucuucguucagggcgggaucaaagggccucagcgguggguuuggaagucggucccuuuacucucugggcggcguccgcagcuugaacguugcuuccgggucaggaaaaagugguggcuauggguucggacgaggccgugccagcgguuuugcagggucuauguucggauccguggccuuaggccccguaugcccuacaguguguccaccgggcgggauccaccaagucacugugaaugagucacugcuagcuccccucaacguugaacuggacccugagauucagaaggugagagcacaggaaagggagcagauaaaagcccuuaauaacaaguuugcuagcuucaucgauaagguccgguuucuggaacaacagaaucagguguuggagacgaaaugggagcuccugcagcaacuggaccucaacaauugcaagaacaauuuagaaccaauucuggagggauacaucaguaaccuucgcaaacaguuggaaacccugucuggugauagaguaaggcuagacuccgagcuccggaauguucgcgauguggucgaggacuauaagaaacgauacgaagaggaaauuaacaagagaacagccgcggagaaugaguucgugcugcuuaagaaagauguggacgcagccuaugcuaacaaggucgaacugcaggccaaaguugagagcauggaucaggaaaucaaguuuuucagguguuuguuugaggcagaaauaacucaaauccagucgcauauuucugacauguccgugauccucucaauggauaauaaccggaaccuggacuuagauaguauuaucgacgagguacguacccaguacgaagagauagcucugaaaagcaaggccgaggcggaagcccucuaucaaacaaaauuccaggagcuucagcuggcagcuggccgccacggggacgauuugaagaauaccaagaacgaaauuuccgagcuaacuagacugauccagaggauucggucugaaaucgagaaugugaaaaagcaagccagcaaccucgagacagcuaucgccgacgcagaacagcgaggagauaaugcccugaaagacgcucgcgcgaaacuugaugagcuggaaggcgcauugcaucaggccaaggaggagcucgcuagaaugcugagggaauaccaggaguuaaugucacugaagcuagcccucgacauggaaauugcaaccuaccggaagcugcuugagagugaagagugccgcauguccggugaguuccccagcccugucucuauaucaaucauuaguagcacguccgggggcucuguguauggauuuagaccaucgaugguuagcggcggguacguggccaacuccucaaauuguaucaguggagucugcucugugagggguggcgaagggcguagccggggauccgcuaacgauuauaaagacacuuugggcaaggguucaagccugucugcccccuccaaaaagaccagucgauga

SEQ ID NO: 58265 - RNA, 1410 nt, Artificial Sequence
  derived and/or modified sequence opt3 from KRT72__Homo_sapiens__NP_001139698
augagcagacagcugacacacuuccccaggggcgagcggcucggguuuuccggaugcucugccgugcuuucagguggcaucgggaguagcuccgcuucuuuccgcgcacgagucaagggaucggccucauuuggcagcaaaagucuguccuguuugggugggucucguagcuuagcgcuguccgcugccgcaagaaggggaggcggccggcuagggggauucguugguacagccuuuggcucagcugggcucggaccuaagugcccaaguguguguccgcccggcgguauuccucaaguaacugugaacaaaagccugcuugcaccacugaaugucgaaauggaccccgagauacagcgcgugagagcccaggaaagggagcagaucaaggcuuugaacaauaaauucgccucuuuuauugauaagguucgguuccucgaacaacagaaccaggugcuggagacgaaguggaaucugcuccagcaauuagaccugaacaauugccgcaaaaaccuugagccuaucuacgaaggguauauuuccaauuugcagaagcagcuggagaugcuaucaggagauggcguccgacucgacagcgaacugagaaacaugcaggaucuuguggaggacuacaaaaagagguaugagguagaaaucaaucggcguaccgcggcagagaacgaauuuguugugcugaaaaaggaugucgacgccgcuuacaugaauaagguggaguugcaagccaaaguggauagucucacagacgaaauaaaguucuuuaaaugucuguaugagggcgagaucacucagauucagucucauaucuccgauaccagcauugucuuaucgauggacaacaaucgcgaucuggaccucgacucuaucauagcagaaguuagagcucaauacgaggaaauugcccuuaaguccaaagcggaggccgaaacacuguaucagaccaagugcgcagauuuggagacugcuaucgccgacgcugagcagaggggagauugugcccuaaaagacgcacgggccaagcuggaugaacucgagggggcucugcaccaggcgaaggaggaacuugcacgaaugcugcgcgaauaccaagaguuggugucacucaaacuggccuuagacauggagauugcuacauacagaaagcugcuagaaagugaggaaugcaggaugagcggugaguauccaaacuccguaucuaucagcgugaucucaaguaccaacgccggcgcagggggagccggcuucuccauggguuuuggggcuucuagcucauacaguuauaaaacggccgcagcggaugucaagacuaaaggcagcuguggauccgagcucaaggacccccuggcuaagaccucuggcucgagcugcgccaccaaaaaggcaucccgguga

SEQ ID NO: 58266 - RNA, 1590 nt, Artificial Sequence
  derived and/or modified sequence opt3 from KRT74__Homo_sapiens__XP_011536204
augagcagacagcugaacaucaaguccucuggcgacaaagggaauuucucagugcacagugccgucguucccaggaaggcugugggaagccucgcauccuacugcgccgcgggucggggcgcuggggccggauuuggcucucgcucgcuuuauucacugggugggaaccgacguauuagcuucaauguagcaggaggcggcgugagagccgggggauacgguuuuaggccuggcaguggguauggaggcggucgggcuuccggguucgcaggaucuauguuuggcagcgucgccuugggcccagcuuguuuauccgugugcccgcccgggggaauacaucaaguuaccgugaacaaaucacugcuagccccucucaaugucgagcuggauccagaaauccagaaggugcgcgcgcaggagagagaacagauuaaaguacuuaacgacaaguucgcaaguuuuaucgauaagguuagguuccuggagcaacagaaucagguguuggaaacaaaaugggagcuccugcagcaacuggaccucaacaauuguaagaaaaacuuagagcccauucuggaagguuacaucagcaaucuucggaagcaguuggagacucugucuggcgaucgcguccgacuagacuccgaacucagaucaaugagggaucugguggaggacuauaaaaagcgguacgagguggaaauaaaccgucgcacgaccgccgagaaugaauuugucguucuuaagaaagaugcugacgccgcauaugcugugaagguagagcugcaggccaaaguggauagcuuggacaaggaaaucaaauuccucaagugccuguacgaugcggagauugcccagauccaaacacacgcaagugagacuucugucauuuuauccauggacaacaauagagaccuggaucucgacagcaucauagcugaagugaggaugcauuacgaggaaauugcccuuaaaucgaaggcugaggccgaagcacuguaucagaccaagauccaggaguugcaacuagccgcuucucggcacggggaugaccugaaacauacacgauccgagaugguugaacucaaccgccugauucagagaaucaggugugagaucggaaacgugaagaaacagcgggcgucacuugaaaccgcaauugccgaugcugagcagcgcggcgacaaugcccugaaggaugcacaagccaaauuggacgaacucgagggugcucugcaccaggccaaggaggaauuagcaagaaugcugagggaguaccaggaacuaaugagucucaagcuggcgcuugauauggagauagcuacuuaucguaaauugcuggagggggaagagugccggaugagcggcgaaaacccuuccucugucagcaucucagugauuaguuccagcucuuacucauaucaccauccaaguagcgccggaguagaccucggcgcauccgccguugcugggucuucgggaagcacacaguccggucaaaccaagacgacugaggcccgaggcggggaucugaaagacacccagggaaagucaacacccgcaaguaucccugcuagaaaagccacuagguga

SEQ ID NO: 58267 - RNA, 1656 nt, Artificial Sequence
  derived and/or modified sequence opt3 from KRT75__Homo_sapiens__NP_004684
augagcagacaguccucuaucaccuuccaaucaggcaguaggcggggguuuagcacaacuuccgccauuacgcccgcugcaggacgcucucgauucucgucagugagcgucgcccguagugcggcugguuccggcgggcugggaagaauaucuagcgccggcgcauccuuugguucaaggagucucuacaaccuugggggagccaagcggguuagcaucaauggcugcggcagcuccugucgcucaggguucggagguagagcuagcaacagguuuggcgugaauaguggguucggauauggcggugggguaggaggcggcuuuucugggccuuccuucccagugugcccgcccggagguauucaggaggucaccgugaaccagagccuguugacaccuuuacaucugcagaucgacccaacuauucaacggguucgcgcagaagaacgagaacagaucaaaacccuaaauaacaaguuugccucguucauagauaaagugagauuucucgagcagcagaauaagguccuggaaacaaaaugggcccuucugcaagagcagggcucuaggaccgugcggcagaacuuggagccccucuucgacuccuacacuucagaacugcgucgccagcuggagaguaucacaaccgaaagagggaggcucgaggcugaguuacggaauaugcaagauguaguugaagacuuuaaggugcgauaugaggaugaaauuaacaagcgcacggcggcagagaaugaguucgucgcccugaaaaaggacguggaugcugccuacaugaacaaaguggagcuugaggcaaaggucaaaucuuugccugaagagaucaauuucauucacuccguuuuugacgcugaacugucucagcuacagacucaagugggagauaccagcguagugcucucaauggacaacaauagaaaccuggaucuugacaguaucauagccgaggucaaggcgcaguaugaagauauugccaacaggucccgggcagaggcugagagcugguaccagacaaaguaugaggaacuucaggugacugccggccgccacggugacgacuugagaaauaccaaacaagaaaucucugagaugaacaggaugauucagcgucuccgggcugaaaucgauucaguuaagaaacaguguaguagccugcagacagccaucgcagacgccgagcaacgaggggaguuagcucugaaggaugcgagagcaaaacucguggaccuugaagaggcccugcagaaggcuaaacaggauauggccagguugcuacgcgaauaccaggagcugaugaauauuaagcucgcacuggacgucgagauagccaccuaccggaagcugcuggaaggcgaggaaugcagauuguccggagagggcgugucuccaguaaacaucucgguugugacgagcacucucuccucaggguauggaagugguucuagcauuggcgggggaaaucugggcuuaggugggggcuccggauacucauucacaaccagcggcgggcauucucugggagcuggucuaggcggguccggauuuagugccacuagcaacaggggccucggugggucuggcuccucagucaaauucgugaguacaaccagcucgucccaaaagucuuauacgcacuga

SEQ ID NO: 58268 - RNA, 1917 nt, Artificial Sequence
  derived and/or modified sequence opt3 from KRT76__Homo_sapiens__NP_056932
augaacagacaggugugcaagaaaucuuucuccggcaggucucaaggguuuucaggacggagugccgucguuagcgguuccucucgcaugucguguguggcucgaucaggcggggcaggaggcggugccugcggguuccguagcggagcgggcaguuuuggcuccagaucucuguacaaucucgggagcaacaaguccaucucaauuaguguagcugccggaagcucuagggccgguggcuucgggggaggccgguccucaugugguuuugcagggggauauggcggcggguucggagguagcuacggcgggggauuuggcggugggcgcggcgugggaaguggcuucgggggagcugguggcuuugggggagcaggcgguuucgggggccccggagucuuuggcgggccuggaucuuucgguggcccagggggauuuggcccggguggguuccccggcggaauacaggaggugaucguuaaucagucccuucugcagccuuugaacguggaaauugacccacaaaucggccaggucaaagcccaggagagagaacagauuaagaccuuaaauaacaaauucgcuagcuuuaucgauaaggugagguuccuggagcaacagaauaagguacuagaaacaaaaugggagcuccugcagcagcaaacuacggggucgggacccucuucccuugagccuugcuuugaaucauauauaaguuuccuguguaagcaguuggacagccuccugggcgagcgggguaaccuggaaggggagcucaaauccaugcaggauuuaguugaggacuuuaagaaaaaguacgaagaugagaucaauaagcgcaccgccgcggaaaacgaguucgugggacugaaaaaggacgucgaugcagccuuuaugaauaaaguggaacuucaagcuaagguggacucuuugacagaugaggucagcuuccugcgaacucuauaugagauggaacucucacagaugcagagucacgccuccgacaccagcguugugcugucuauggauaacaauagaugccuugaccugggcucaauuaucgcagagguaagggcucaguacgaagagauugcccaacggaguaaaagcgaagcggaggccuuguaucagacaaagcucggugagcugcagaccacugcaggccgucauggggaugacuuacgcaacacaaaauccgaaaucauggagcugaauagaaugauacagaggcuccgggcugaaauugagaacgugaagaagcaaaacgccaaucuucagaccgcuaucgccgaagcagagcagcgaggagagauggcccugaaagacgcuaacgcgaaguugcaggaucuacaaacggcacugcagaaagccaaggacgaucucgcucgccugcuuagagacuaccaggaacugaugaaugucaaauuggcccucgauguggagauugcaacuuacaggaagcuguuagaaggcgaggagugucggaugucuggggaaugccagucggccguuuguaucagcguggucuccaacgugaccucaacaaguggaucuagcggcuccucacgcgguguauuugggggaguuagcggcucugguuccggcggguauaagggaggcaguagcagcuccucaaguagcggguacggagugucgggcgguuccgggucuggauauggcggugucagcucaggcaguacugggggaagaggcuccucugggagcuaccaauccucaagcaguggaucuaggcugggcggugcuggguccaucagcgugucgcacucaggaaugggcucuaguuccggcagcauucagaccucugggggaagcgguuauaaauccggcgggggaggcucaacaaguauacguuucagccagaccacgucuuccucacaacauaguagcacuaaguga

SEQ ID NO: 58269 - RNA, 1233 nt, Artificial Sequence
  derived and/or modified sequence opt3 from KRT78__Homo_sapiens__NP_001287743
auggagggccacgaagccagccccgcucagguggggcaaggagacagagguaaggucagguuccuggagcagcagaacaaaguucucgaaaccaaguggcaucuucugcagcaacagggcuuguccgggucucagcagggauuagagccuguguuugaagcaugccuggaucaacuacggaaacagcucgagcagcugcagggcgagcgcggugcccuugacgcggaacugaaggcuugucgagaucaagaggaagaguacaaaucaaaguaugaggaagaggcccaccguagagcaacauuggaaaaugacuucguagugcucaagaaagaugucgacgggguguuucugaguaagauggagcuggaaggaaaacucgaggccuuaagggaguaccuguauuuccuuaagcauuugaacgaagaggaacugggccagcuacagacucaagcuagcgauacguccguugugcucucuauggacaauaaccgguaccuggauuuuucgucaaucauuaccgagguccgcgcaagauaugaagagauagccaggagcaguaaagcugaggccgaagcgcuuuaccagacaaaguaucaggaguuacagguguccgcacaauugcacggcgaccggaugcaggaaacuaagguacagaucucucagcuccaucaagagauucagcgccugcagagccagaccgaaaaucugaaaaagcaaaacgccucccugcaggcugccaucacagaugcagagcagcgaggggagcucgcucuuaaagacgcccaggcgaagguugaugaacuggaggccgcauugagaauggcuaaacaaaaucuagccaggcugcucugcgaauaccaggagcugaccucaacuaaacuuagucuggacguggagauugcuacauaccggcguuugcucgaaggagaggaaugucgcaugagcggugagugcaccucucaggucacgaucuccucagugggcgggagcgccgugaugaguggaggcgucggugggggacugggcucuacuuguggcuuaggguccggaaaggguagcccaggcucgugcuguaccucuauaguuacagggggauccaacaucauucugggcucagguaaggacccggugcuagauaguugcagcguauccgggucuagcgcaggcucaaguugucacacuauccucaagaaaaccguggaauccagccugaagacaucuauuaccuauuga

SEQ ID NO: 58270 - RNA, 1410 nt, Artificial Sequence
  derived and/or modified sequence opt3 from KRT7__Homo_sapiens__NP_005547
augagcauccacuucuccucucccguguuuaccucaagaagugccgcuuucagcggcaggggagcacagguccggcuguccucugcccgcccugggggucucggcucgucaagccuuuacgggcugggagcgagucgaccacguguugcugugagauccgccuauggcgguccgguaggggcaggaauuagggaggugacaauaaaccaaucuuuguuagcuccccugcggcuagacgccgauccuagccuccagcgcgucagacaggaagaguccgaacagaucaagacucugaauaacaaauuugcaucauucauugacaaggugagguuucuugagcaacagaauaaacuguuggaaacgaaguggacccuccugcaggagcagaaaagugccaagagcucucggcugccagauaucuucgaggcucaaauugccggccuccgcggccaguuagaagcgcugcagguugacgggggacgacuugaggcagaauugagauccaugcaggauguggucgaggacuuuaagaacaaauacgaggaugaaaucaaucauaggacagccgcugagaacgaguucgugguacugaagaaagacguugaugccgcauauaugucaaagguggagcuagaagcuaaagucgacgcccucaaugaugagauaaacuuucugcggacucuuaaugagaccgaacugacagaguugcaaagccagaucagugacaccucuguggugcucuccauggauaacagccguucgcuggacuuagacgguauuaucgcggaagucaaggcccaguacgaggaaauggcaaagugcucucgcgcugaggccgaggcuugguaucaaacuaaauucgaaacacugcaggcccaggcaggcaagcacggggaugaccucagaaauaccaggaacgagauuuccgaaaugaaucgggccauccagcgacuucaagcugagauagauaacauuaaaaaucagcgcgcgaagcuggaagcagccaucgcugaggccgaggaaagaggagaguuggcacuaaaagacgccagggcuaagcaggaagaacuggaggccgcacuccagcggggcaaacaagauauggcgcgccagcugagagaauaccaggagcuuaugucaguuaagcuggcuuuggacauugaaaucgccacguauaggaagcuccuggagggugaagagagucguuuagcaggggauggagugggcgccguaaacaucagcgugaugaacuccacuggcgggucuagcucaggagguggcauugggcugacccuaggaggcacaauggguaguaaugcucucuccuuuucuagcucagccgggcccggccugcuuaaagcauacaguauacggacugcuagcgccucccgaagaucugcgagggacuga

SEQ ID NO: 58271 - RNA, 1269 nt, Artificial Sequence
  derived and/or modified sequence opt3 from KRT80__Homo_sapiens__NP_001074961
auggccugcagaagcuguguggucggcuucuccucucugucaaguugcgagguuacccccguggggagcccuaggccaggaacauccgguugggacucuugucgggcuccgggccccggguuuucgucacgcagccucacuggaugcuggagugcaggcacgaucuccaagguaaccgugaacccuggucuucuggucccauuggaugugaaauuagaccccgccguucagcaacugaagaaucaggaaaaagaggaaaugaaggcgcuaaacgauaaauucgcuucucucauugggaaggugcaggcccuggagcagcgaaaucaacuucuggaaacacguuggagcuuuuugcagggacaggacuccgcaauauucgaucucggccaccuguacgaggaguaucagggcagacugcaagaagaacucaggaaggucucacaggaacgggggcaguuagaggccaaccugcuucagguguuggagaaaguagaagaguuucgcaucagauacgaagacgagauuaguaagaggacugauauggaguucaccuuuguucaacugaaaaaggaccuagaugcugagugucuccaucggacagagcuggaaaccaaacuuaagagccuggagucuuucguggaauugaugaagacuaucuaugagcaggaacucaaagaccuggcagcccaggucaaggauguguccgugacagucggaauggacucacgcugccacauugauuuaagcgguaucguugaggaggugaaagcucaauacgacgccguagcggcacgaagucuggaagaggccgaggcuuauucuagaucccagcucgaggaacaggccgcaaggagcgcugaguacggcucgucucuucaguccucacggagugagauagccgaccugaaugugcguauccaaaaguugcgcagccagauucuauccgucaaaucucauugucugaagcucgaagagaacaucaaaaccgcggaagaacagggggagcuggccuuucaggaugcaaagacgaaacuugcucaacuggaagccgcuuugcagcaggccaagcaggacauggcaagacaacucaggaaguaucaggagcugaugaaugugaaauuagcccuggauauugaaaucgcuacuuaccggaagcuaguugagggagaagagggccgaauggacagcccuucagcgaccguggucagugcagugcagucccgcugcaaaacagccccaagccuccccuacccucuguguucucuuuga

SEQ ID NO: 58272 - RNA, 1518 nt, Artificial Sequence
  derived and/or modified sequence opt3 from KRT81__Homo_sapiens__XP_011536636
augaccugcggcagcggguucggagguagagccuuuuccuguaucucugcuugcggccccaggccugggcgguguugcauuacagcagccccauaccgcggaauaucauguuaucgaggccugacugguggguucggaagucacagcgugugcggcggcuuucgugcgggguccuguggaagaucuuucgguuacaggucgggcggggucugcggaccgucacccccuuguaucacgaccguuagcgugaacgagagucuccuuacaccacugaauuuggaaauugaccccaacgcucagugcguaaagcaagaggaaaaagagcagaucaaguccuuaaauucucgguuugccgcauucauugauaaagugcgcuuucuggaacagcagaacaagcuacucgagacuaaacugcaauucuaucagaauagagaguguugccagagcaaccuugaaccucuguuugagggcuacaucgaaaccuugaggcgggaggccgagugcgucgaagcugacuccggucgccucgcaucagagcugaaucaugugcaggaaguucuggagggguauaagaagaaauacgaagaggaggugagucuccgagccacagcugaaaacgaguucgucgccuuaaagaaagauguggacugugcguaucugagaaagagcgaucuugaagcaaauguagaggccuugauacaagaaaucgacuuucugaggcggcuauacgaggaggaaauucucauccugcagucucacauuuccgauaccucaguuguggucaaacuugacaacagccgugaucugaauauggacugcaucauagcugagauuaaggcccaguacgaugacaucgugacucgcaguagagcagaagcugagucuugguauagguccaagugugaagagaugaaagccacagugauucggcauggagagaccuugcgacgcacgaaggaagagaucaacgaacucaauagaaugauccagaggcugacugcggaggucgagaacgccaaaugccaaaauagcaaguuagaagcagcuguugcccagucggagcagcaaggcgaagcugcccugucugaugcacgguguaaacucgccgagcuugaaggcgcucugcagaaggcgaaacaggacauggcaugcuugauucgcgaguaccaggaggugaugaacuccaagcuagggcuggacauagaaaucgccaccuauagaaggcuccuggagggagaggaacaacgucuuugugaagguauuggcgcuguaaacgugugcgucucaaguagccgagggggagugguuuguggcgaucugugcguguccgguucucggccagucacagggagcguguguucagcccccugcaauggcaacguagcaguuaguacuggauugugcgccccuuguggccagcucaauaccacaugcgggggagguuccuguggcguggggagcugcggaaucucuucacugggcgucgguaguugugggagcuccugcagaaaguguuga

SEQ ID NO: 58273 - RNA, 1542 nt, Artificial Sequence
  derived and/or modified sequence opt3 from KRT82__Homo_sapiens__NP_149022
augagcuaccacuccuuccagcccggcucuagaugcgggucacaaaguuuuagcuccuauucugccgugaugccuaggauggucacccauuacgcuguuucgaagggaccaugucggccggguggcgggcgcggacugcgagcacucggcugccuugguucacguagccuguguaacgugggguucggaagacccaggguagccagucggugcggcggcacauugccuggguuuggauaucgcuuaggugcgacuuguggcccauccgcuugcaucacgcccgugaccauuaaugagucucugcuagucccucucgcccuggaaauagacccaacagugcagagaguuaaaagggaugagaaggaacagaucaaaugucuuaacaaucgguucgcuagcuuuauuaacaaggugcgcuuccuggagcagaaaaauaaguugcucgaaacuaaguggaacuuuaugcaacagcagcgaugcugucagaccaauaucgagcccauuuucgagggguacaucuccgcccugagaaggcaacuggacugcgucucaggagaucgggugcgucucgaaagugaguuauguagccugcaggcugcacuugaaggcuauaaaaagaaauacgaggaggaauugucucugcgcccuugcguagagaacgaauuuguugcccuaaagaaagacguggauacagcuuuccucaugaaggccgaccuggagaccaaugcggaagcacuuguccaggagauagauuuucugaaguccuuguaugaggaagagaucugccuccugcagucacaaauuagcgaaacuucggugaucgugaaaauggacaacucuagagaguuagaugucgacgguauuaucgccgaaauaaaggcucaguacgaugacauugccuccaggagcaaagcagaggcugaggccugguaccagugucgguaugaagaacugcgaguuacagcggggaaucacugcgauaaccuccgcaauagaaagaacgaaauccuugagaugaauaaacugauucaaagguugcagcaggaaaccgagaacgugaaggcccagcgguguaaacuagagggagcaaucgcugaagccgagcaacagggcgaagcugcccugaacgacgcaaagugcaagcucgccggccuggaggaggcacuucagaaagcgaagcaggacauggcaugucuguugaaagaauaccaagagguaaugaauaguaagcucgggcuggauaucgaaauugccacguaucgcagauuacuggagggagaggagcauaggcuaugcgaggguauaggcccagugaacaucucugucuccucaaguaaaggggcuuuccucuacgaaccguguggagugagcacucccguucuguccaccggcgugcuucguucuaauggugggugcagcauugucggcacaggagaguuguaugugccuugugaaccacagggccugcucucaugcgggaguggacggaaguccagcaugacucugggugccggcgggucuucacccagucacaagcauuga

SEQ ID NO: 58274 - RNA, 1482 nt, Artificial Sequence
  derived and/or modified sequence opt3 from KRT83__Homo_sapiens__NP_002273
augaccugcggcuucaacagcaucggguguggauuuagacccgguaauuucuccugcgugucugccuguggcccuaggccaucacggugcuguauuacagcugcaccguaccgcgggauaaguugcuaucgaggacugacuggcgguuuugggagccacuccgucuguggaggcuuccgugccggcucuugcgggagaucguuuggauacaggucagguggcguuugugggcccagcccuccaugcaucacgaccgugaguguaaacgagucccuccuuacaccccugaauuuggaaauugacccuaacgcgcagugugugaagcaagaggaaaaagagcagaucaagucuuuaaauagccgguucgcugccuuuauugauaaaguccgcuuccuggaacagcagaacaagcuacucgagacuaaacugcaauuuuaucagaauagagagugcugccaguccaaccuugaaccacuguucgcaggauacaucgagaccuugaggcgggaagccgaguguguggaggcugacucaggccgccucgcaagugaacugaaucauguucaggaggugcuggaagguuauaagaagaaauacgaggaagaggucgcccuccgagcuacagccgagaacgaauuuguggcguuaaagaaagauguagacugcgcauaucugagaaagagcgaucuugaggccaauguugaggcuuugauacaagaaaucgacuuccugaggcggcuauacgaagaggagauucguauccuccagucucacauuuccgauaccucaguggucgugaaacuggacaacagccgcgaucuuaauauggacuguaucguggccgaaauaaaggcacaguacgaugacauugcuacuagaaguagggccgaggcggaaucuugguaucgguccaagugcgaggaaaugaaagccacagucauccgacauggggagacccugcgcagaacgaaggaggaaauuaacgaguugaauaggaugauccagcggcucacugcagaaguugagaacgcuaaaugucaaaacagcaagcuggaggccgcuguggcccagucggaacagcaaggagaggcagccuuaucugaugcucgcugcaaacuggcggaacucgagggcgcacuucagaaggccaaacaggacauggcuugucugaucagagaauaccaggagguaaugaacuccaaguugggccuagacauugagauagccaccuauaggcgucugcucgaaggggaggaacaacggcugugcgagggaguggaagcagucaauguguguguuucaaguagccgagguggcguggucugcggggaucuuuguguguccggaucuagacccguaacaggcagcguuugcucagccccuugcaaugguaaccugguggucaguacuggguuguguaagccaugcggccagcucaauaccacauguggaggcggguccugcggacaggguaggcacuga

SEQ ID NO: 58275 - RNA, 888 nt, Artificial Sequence
  derived and/or modified sequence opt3 from KRT85__Homo_sapiens__NP_001287739
augguguucaagguccaguuucugagcuccagacccucucucucacacacccaagacguugauugcgccuaccuuaggaagagugaccuggaggcuaacguggaagcauugguagaggaaagcuccuucuuacggcgccuguaugaggaagagauccgagugcuacaggcccauauuucugauacaucggucauagugaagauggacaauucacgugaucucaacauggacuguaucauugcggagaucaaagcucaguacgaugacguugccagcagaaguagggcagaagccgaguccugguaucggucuaagugcgaagagaugaaagcuacugugauucgccacggcgagacgcugagaaggaccaaggaagagaucaaugaacuuaaccggaugauacagcgccugacagcagagaucgaaaaugccaagugucaacgagcuaaauuggaggccgcggucgcagaggccgaacagcagggggaggcugcccucagcgaugcaagaugcaagcuggcugaacuggagggagcccuccagaaagcgaagcaagacauggccuguuuacugaaagaauaccaggaggugaugaacuccaaacuugguuuggauauugagaucgcaacuuauaggcggcugcuagaaggcgaggaacaucgucucugcgaggggguaggaucaguuaaugugugugucaguagcucucgcggcgguguguccugcgggggacugucauacagcaccacaccuggcagacagauuaccaguggcccaucugcuaucgggggauccauaacuguggucgccccggacagcugugcucccugccagccuaggucgucuuccuuuucaugugguaguagccgguccguucgauucgccuga

SEQ ID NO: 58276 - RNA, 1692 nt, Artificial Sequence
  derived and/or modified sequence opt3 from KRT86__Homo_sapiens__XP_005268923
augugcgaggaacugaaggccaccgugcagaaacacacacaaagccucaagcccuccaaagaggaccuuaacagacugaaucaggcuauccagugguugacugucgaaguuggcucugcagagucacaggccuacaggggcgcgaguagcgaacgguuaacgccucgcccacuguguuccccguucggacgacuacauccccaaaaccuccugucuucgccuaagucaaccaugacaugcgguagcuauuguggcgggcgugcuuuuaguugcauuuccgccuguggaccaagacccgggaggugcuguauaacugcagccccuuaccgggguaucucuugcuaucgcgggcuuaccggaggcuucggcagccacuccgugugugggggauuuagagcugguucaugcggcaggaguuucggguaccggagcggaggcguaugugguccaucucccccuugcauuacaaccguguccgucaaugagucacuguugacuccacucaaccuggagaucgauccgaaugcacagugcgugaaacaggaagagaaggaacagauuaagagccugaacagucgcuuugccgcuuucaucgacaaaguucgauuucucgagcaacagaauaaguuacuggagacaaaacuucaguucuaucagaacagagaauguugccaaucuaauuuggagccccuguuugaaggguacauagagacccuaaggcgggaagccgaguguguggaggcggauuccggacgucucgcaagcgaacugaaccauguccaggaggugcuugaaggcuauaagaaaaaguacgaggaagagguaucgcugcgcgccacggcugagaaugaguucguugccuugaagaaagacguggauugcgcauaccucagaaagucugaccuggaagcuaacgucgaagccuuaauccaggagauugauuuucugaggcggcucuaugaagaggagauccgagugcuucaaucccacauuucagacacuucaguggucguuaaacuggauaauagccgcgacuugaacauggauuguaucauagcggaaauuaaggcccaguacgacgauaucgugaccagauccagggcagaggcugaaucuugguaucggagcaaaugcgaggagaugaaggccacaguaauucgccauggcgaaacucuaagaaggaccaaagaggaaaucaaugagcugaaccguaugauccagcggcucacagcugaaguggagaacgccaagugucagaauaguaagcuggaggcagccgucgcucaaagugaacagcagggggaggcggcacuuuccgacgcccgaugcaaacuggcugaauuggagggagcccuccagaaggcaaaacaagacauggccugucugauuagagaauaccaggaggugaugaacagcaaguuaggucuggauauagagaucgcuaccuauaggcgccuacucgaaggcgaggaacagcggcugugcgaggggguuggaucugugaaugucugugugucaaguagcagaggcgguguaguuugcggggaccuuugcgccuccacgacugcaccuguggucucuacaagggugucgagcgucccauccaacucaaaugugguugugggcaccacuaacgcgugugcucccagugcccgcguaggagucugcggcgggucuuguaaacgaugcuga

SEQ ID NO: 58277 - RNA, 1536 nt, Artificial Sequence
  derived and/or modified sequence opt3 from KRT8__Homo_sapiens__NP_001243211
augaacggcgugagcuggucccaggaccugcaagaggggaucucugccugguucggacccccugcuucaaccccagcaaguacaaugagcauuagagucacucagaaguccuacaaaguuucuacgucggguccgagggccuuuucaagccggaguuauaccuccggccccgggucucgcauaagcuccucaaguuucagccgagugggaucuuccaauuuucguggcggucucgggggaggcuacggcggggcgucaggaauggguggcaucacagcuguaacugugaaccagagccuucugaguccuuuggucuuagaaguggauccaaauauucaggccguuagaacccaagagaaggaacagaucaaaacacugaacaauaaguucgcaucuuuuauugacaaagugagguuccuagagcagcagaacaagaugcucgaaaccaaguggucccugcuucaacagcagaaaacugcccggagcaauauggauaacauguuugagucguauaucaauaaccugcgcagacaguuggagacacucgggcaagaaaagcugaaacuggaggcugaacucggaaauaugcagggcuuagucgaggacuucaagaacaaauacgaggaugaaauaaauaagaggaccgagauggaaaacgaguuugugcugaucaagaaagacguagaugaagcauauaugaauaagguugagcuugagucucgguuggaaggucugacggacgagauuaacuuccuacgccagcucuacgaagaggaaauccgagagcugcaaucccagauuucagauacuagcgugguccuuagcauggacaacuccagaucucuggauauggacagcaucauagccgaggugaaagcucaguaugaagauauugccaauaggucacgggcggaggcagaaaguauguaccagaucaaguacgaggaauugcaaucccucgccgggaaacacggagacgaccugcgucgcaccaagacagagauuagcgagaugaacagaaauaucucuagguuacaggcugaaaucgagggccugaaaggccagcgggccucacucgaagcagcuauugccgaugcggagcagcgaggggagcuugccauaaaggacgcaaacgcuaagcugagugaauuggaggccgcucuacaacgcgccaaacaggauauggcaagacagcugagggaauaucaggagcucaugaaugugaagcuggcccuugacaucgaaauugcuacuuaccggaaacuguuggagggagaggaaagccgccucgaguccgguaugcaaaacaugucuauccauaccaagacaaccucgggcuaugcagggggacugagcuccgcguacggcgguuuaacgucacccgggcugaguuauucucuaggcagcuccuuuggaucaggcgccgggaguucuuccuucaguagaacuucuagcuccagggcugucguugugaaaaagauagaaacacgugauggaaagcucguaucagagaguagcgacgugcugccuaaauga

SEQ ID NO: 58278 - RNA, 1872 nt, Artificial Sequence
  derived and/or modified sequence opt3 from KRT9__Homo_sapiens__NP_000217
augagcugcagacaguucuccucuucauaccugaguaggagcggcgggggagguggcgggggacucggcuccggugggucuauccggucgucauauagccgcuuuaguuccucuggaggcggcgggggagguggccgauucagcuccucaaguggguacggaggcgguagcucucgugugugugggagaggaggcggcggguccuuuggauauucauacgguggcgggagcggaggcgguuucagugccucuucccuugggggcggauuuggcgggggaagcagggguuucggcggggcuucgggaggcgguuauucuuccucagggggcuuuggaggcggguucggagguggcagugggggaggcuuuggugggggcuacggaagcggcuucgggggauuuggcgguuucgggggaggcgccgguggcggggacggaggcauucugaccgcaaacgagaaguccacaaugcaagaauugaauagccgguuagcgagcuaucuggauaaaguccaggcucuagaggaagccaacaaugaccucgagaacaagauacaggauugguacgacaaaaaggggcccgcagccauccagaaaaauuacucaccuuauuacaacacuauugaugaccugaaggaucaaaucguugaccuuacggugggaaauaacaagacccuguuggauauugacaauacacgcaugacucucgaugacuuuagaaucaaauucgaaauggagcagaaccugaggcagggcguagaugcugacauaaauggucugcgccaggugcucgacaacuuaaccauggagaagagugaucuggaaaugcaauaugagacacuucaggaagaguugauggcacugaaaaagaaucacaaagaggaaaugucccagcuaaccgggcagaacagcggagacgucaauguggagaucaacguugccccaggcaaggaucucacuaagacacugaacgacaugcggcaagaauacgagcagcuuauugcuaaaaaucgaaaggauaucgaaaaccaguaugagacccaaauuacgcagaucgagcaugaagugucuucaaguggucaggagguccagagcuccgccaaagaagugacucaacugagacacggcguacaggaguuggaaauagagcuccagucucagcugucgaagaaagcggcauuagagaagucucuggaagacaccaaaaauagguacugcgggcaacuccagaugauucaggagcagaucuccaaccuugaagcccaaauuacagauguucggcaggagaucgaaugucagaaucaggaguauucacuguugcuaaguaucaagaugcgucuggagaaggaaauugagacuuaccauaaccuccuggaaggaggccaagaggacuucgagucuagcggggcuggaaaaauaggccuuggugggcgcggaggcuccgguggcucauacgggagaggaagcaggggcgggucuggaggcuccuauggugggggaggcaguggcgggggauacgguggcgggagcggaucucggggcgguuccgggggaucauauggcggcgggaguggaagcgguggcgggucgggaggcgguuacgggggaggcuccggcgggggacacucugguggcagcgggggaggccauucaggugggaguggaggcaauuauggcgggggauccgguucuggcgggggaagcggcgguggguacggaggcggcuccgggucacgaggagguagcggcgggagucacggaggcgguucuggguuuggcggagaauccggcgggagcuauggagguggcgaggaagccucggggucaggaggcgguuacgggggcggaucuggcaagaguucccacagcuga

SEQ ID NO: 58279 - RNA, 492 nt, Artificial Sequence
  derived and/or modified sequence opt3 from KRTAP11-1__Homo_sapiens__NP_787054
augagcuucaacugcuccaccagaaauuguucuucaaggcccaucggcgggcggugcauugugccugucgcccagguuacaacuacgaguaccacagacgcugauugucugggagguauaugccucccaagcuccuuucaaacuggcucuuggcuucuggaccacugucaggagaccugcugugaaccgacagcaugccagcccaccuguuaccgccgaacuucgugcgugucaaacccuugucagguaacaugcagccgucaaaccacgugcaucaguaauccauguuccacuaccuauucuagacccuugacauucgugagcuccgggugccagccuuuaggaggcauuucaagugucugucagccagugggugggaucagcacuguuugccagcccgugggaggcgucucuaccgugugucaaccugccugcggcguauccaggacauaccagcagucauguguuagcaguugccggcgcaccuguuga

SEQ ID NO: 58280 - RNA, 837 nt, Artificial Sequence
  derived and/or modified sequence opt3 from KRTAP5-1__Homo_sapiens__NP_001005922
augggcugcugugggugcagcggagguuguggcuccucuugcgggggauguggcucagguugcgggggauguggcaguggcugcgggggaugugguagcggcugcgggggauccgguucuucguguugcgugcccgucugcuguugcaagccuguuuguugcagagugccaaccuguucaugcagcaguuguggcaaagggggaugcggcuccucuggcgggagcaagggagguuguggcuccugcgggggauguaaaggcgguugcgggucaugcggcggaaguaagggcggguguggaagcugcgguggcucuaaagggggauguggcuccugcggugggucaaagggcggauguggcagcgggugcggagguuguggcaguucuugcuguguaccggugugcuguugcaagcccaugugcuguugcgucccugccuguuccugcagcucgugugggaaaggaggcugcgguucuugugggugcuccaagggcgcuuguggaucaugcggcgggaguaaaggaggcugugguagcugcgggggaugcaagggcgguuguggcuccugcgggggaucuaaaggcggguguggaagcggcugcgguggguguggaucaggcugcggugugccaguuuguugcuguaguugcuccagcuguggcucuugcgcagggucaaagggaggcugcgggaguagcuguucccagugcucuuguugcaagcccuguugcuguucgagcggaugcggcuccucauguugccaaaguucuuguugcaaaccuugcuguagccaguccucaugcugugugccagucugcugucagugcaagaucuga

SEQ ID NO: 58281 - RNA, 510 nt, Artificial Sequence
  derived and/or modified sequence opt3 from KRTAP5-9__Homo_sapiens__NP_005544
augggcugcugugggugcagcggagguuguggcuccucuugcgggggaugugacucaaguugcggcagcugugguuccgggugcagaggauguggccccucuugcugugccccuguguacugcugcaagccagucuguugcuguguuccggcuugcucguguucaagcugcggcaaaaggggguguggaaguugcgguggcuccaaagggggauguggcucuugcgguuguagccagugcuccugcuguaagcccugcuguugcucaaguggguguggaagcucuugcugucaaugcuccuguugcaagccuuauuguucacagugcagcugcuguaaaccaugcuguaguucuuccggccggggcagcucgugcugucagucuuccugcuguaagcccugcuguucaaguagcgggugcggauccucuuguugccagagcucaugcuguaagccuugcuguagucaaucccgcugcugugugccaguaugcuaccaguguaaaaucuga

SEQ ID NO: 58282 - RNA, 2787 nt, Artificial Sequence
  derived and/or modified sequence opt3 from KSR1__Homo_sapiens__XP_006722214
auggacagagccgcucugagggcagccgcgaugggcgagaagaaagaagggggagguggcggggaugcugccgcagccgagggaggcgcuggugcagccgcuagccgggcccuccagcaaugcgggcagcuucagaagcugaucgacauuuccauaggaucuuugcgcggcuuacgaaccaaaugugcggugucaaacgaucugacacagcaagaaauccguacucuagaggcaaagcucgucagauacauuugcaaacagaggcaguguaagcugaguguugcccccggcgaacggacgccugagcuuaauagcuauccacgcuucuccgacuggcuguacaccuuuaacgugagaccggagguagugcaggaaauccccagggauuugacacucgacgcucugcuggagaugaaugaagccaaggucaaagagacucuccggcgcugcggggcaucuggagaugaguguggucgauuacaauaugcucugaccugccuuagaaaggugacaggcuugggcggagaacacaaagaggacucgucauggagcagucuggaugccaggcgggaauccggcucugguccuagcaccgacacucuauccgcggccucacucccauggcccccugggaguagccagcugggacgugcaggcaacucugcucagggcccacgcuccauuucaguuagcgcccuucccgcuagugauucuccuacaccauccuucagcgaggggcugucggacaccuguaucccguugcaugccucuggaagacucacgcccagggcacugcacuccuuuauaacuccuccaaccacaccccaguuacggcgacauacuaagcugaaaccuccacgcacacccccgccucccucaagaaagguguuccaacuccuuccaaguuuuccuacccugaccaggagcaagucccacgaaucucaguuggguaaucggaucgaugacgucagcucaaugcgcuucgaccuaagucauggcagcccccagauggugagaagggauauugggcugagcguaacgcaccguuuuucuacuaaaucauggcucagucaaguuugccacgugugucagaaguccaugaucuucggagucaaaugcaagcauugucggcugaaaugccacaacaagugcacaaaagaggccccagcuugucgaauuuccuuucuuccccugaccagauugaggcgcacugagucugugccuucggacaucaauaacccaguggaucgggcggcagaaccgcauuucggcacacuccccaaggcccugaccaagaaagagcacccuccagcuaugaaucacuuagacagcuccucaaaccccaguucuacgaccagcuccacaccuucaagcccagcccccuuuccgacuucuuccaauccuaguagcgcaaccacaccacccaacccuucucccggucagagagauuccagguucaauuuuccagccgcuuacuucauacaucaccgccagcaauucauuuuuccugacaucucagccuucgcacaugcggcuccccugccagaagccgcagaugggacucgacuagacgaucagccgaaggccgacguccucgaggcucacgaagccgaggcagaggaaccugaggcuggcaaaagugaagccgaggaugacgaagacgagguugaugaccugcccagcucgcggcguccauggagaggacccauuuccaggaaggcgucucagaccagcguguaucuucaggagugggauaucccuuuugaacaaguagaguugggcgaaccaaucgggcagggacgcuggggucgggugcauagagggagguggcacggggaggucgccauucgacugcucgagauggacggacacaaccaggaucaucugaaacuuuucaagaaggaagugaugaauuaccgccagacacggcacgagaacguugugcuguuuaugggcgcuugcaugaaucccccucauuuggcaauaaucaccucauucuguaaagguagaacucuccacaguuuugucagggacccgaagacgucccuggauauuaacaaaacacgucaaaucgcccaggaaauaauuaaggggaugggcuauuuacacgcuaaaggaaucgugcauaaggaccugaagucuaaaaacguauucuacgauaauggcaagguugugaucaccgacuuugggcuauucggaauuagcggugucgugcgcgagggccggagagaaaaccagcucaaacugucccacgauuggcuuugcuacuuggccccagagaucgucagggagaugacucccgggaaggacgaagaucagcugccuuuuucaaaagcagcggacguguaugccuucggaaccguuugguacgagcuccaagcucgagacuggccacugaagaaucaggccgcagaagcuagcauuuggcagauaggcaguggugaggggaugaagcggguguuaacaucuguaucccugggcaaagaagucagcgagauccuuucggccuguugggcauuugauuugcaagagcgccccucauucucucuccugauggacaugcuagaaaagcugccuaaacucaacagaaggcugagucauccgggacacuucuggaaguccgccgaucgguggcgaagcagauauuacggcaaagggcgcuauggacaucccgacuuuaagucuagcugcccaauucuugaggaauacaucaauuccucaaaagugguuccuagguucgagcguuuuggcuugggugugcuggaaaguagcaaccccaagauguga

SEQ ID NO: 58283 - RNA, 2766 nt, Artificial Sequence
  derived and/or modified sequence opt3 from KSR2__Homo_sapiens__NP_775869
augaucgaccugagcauuuccaaccucgagggccuuagaaccaagugcgccacaucuaaugaucugacucagaaagaaauaaggacguuggagucaaaguuagugaaauacuucagucggcaacugagcuguaagaaaaaggucgcucuacaggaacgcaacgcagagcucgacggguuuccccagcugcgacacugguuccguaucguugaugugagaaaggaaguacuugaggagauuuccccuggacagcugucuuuggaagaccuccuggagaugaccgaugaacaagugugcgagacagucgagaaauauggugccaauagggaagagugugcgcggcugaacgcuucgcucucaugcuuacgcaaugugcauaugagcggcgggaaccugaguaagcaggacuggacuauccaguggccaaccacagaaaccggaaaagagaauaacccgguuugucccccugaaccaacucccuggauuagaacacaccuuucccagucuccuagggugccaagcaagugcguccaacauuacugucacaccucccccacgccuggcgccccaguguauacucauguagaucgguugaccguugacgcauacccgggucugugucccccuccaccccuagagucagggcaccgcagucucccuccaagcccccgacagagacacgccgugaggacaccgccucggacucccaauaucgucaccacagugaccccaccuggaacgcccccaaugcguaaaaagaacaagcugaaacccccuggcacuccaccgcccucuucccgcaaacuuauacaucugaucccuggcuuuacagcuuugcacagaucaaaaagccaugaguuccagcucgggcacaggguggaugaagcacacaccccaaaggccaaaaagaaaaguaagccccugaauuuaaagauucauucuuccgucggaagcugcgagaacaucccuucgcagcaacggucuccacugcucuccgaacgaucacuucgcagcuuuuucguuggucacgcucccuuucugccgaguacuccuccagugcauacagaggccaauuucuccgcgaacaccuugucuguacccagauggagcccucagauucccaggcgggaccuaggcaauucaaucaaacaccgcuuuaguacgaaguauuggaugucccagaccugcacagugugugggaaaggaaugcuguucggccucaagugcaaaaacugcaagcugaagugucauaacaaaugcacuaaggaagcaccaccuugucaccuucugauaauucacagaggugaucccgccagguugguccguaccgagagcgugccaugcgacaucaauaacccgcuccggaaaccuccccgauacucugaucugcauauuucacaaacauuaccaaagacuaauaaaaucaacaaggaccacauccccguuccuuaucagccagacaguagcuccaaucccucuucgaccacaagcuccaccccuucaaguccggcuccaccccugccuccaucugccacucccccuagcccgcuacaucccuccccacaguguacgagacagcaaaagaacuuuaaucucccugcaucacacuacuacaaauauaagcagcaguucauuuuucccgauguggucccagugccugagacacccaccagggcuccacagguaauacugcacccgguuacuagcaacccuauccuugaagggaaucccuugcugcaaauugagguggaaccaaccucugagaacgaagagguccaugacgaggccgaagaguccgaagaugacuucgaggagaugaaucucagucugcuuagcgcgcgcucuuucccccggaaagccucccagacaucaaucuuucugcaggaaugggauauaccuuucgagcaguuggaaauuggagagcucaucggcaagggcagauuugggcaaguguaccacggaagguggcauggugaagucgcaauccgccugauugacaucgagcgagauaacgaggaccaguuaaaggcuuucaagcgggaagugauggccuaucgucagaccagacacgagaauguugugcuguuuaugggcgcuugcaugaguccaccccaucuagccauuauaacuagccucuguaaggggaggacacuguacucgguaguccgcgaugcaaaaaucgugcuugacguuaacaagacgcggcagauugcccaagaaaucgugaaaggaaugggcuauuugcacgcuaaggguauccugcacaaagaucucaaguccaaaaaugucuucuacgacaacgggaaggugguaauuaccgacuuuggccuguucucuauaagcggaguguuacaggcgggcagaagggaggauaagcugcgaauccagaacggguggcuuugccauuuggcaccugaaauuauccgccaacucucaccggacacugaggaggauaaacugccauuuaguaagcacuccgacguuuucgcccuaggaacaauuugguaugaacugcaugcucgggaguggcccuuuaaaacccagccugccgaagcaaucauauggcagauggguacaggcaugaagcccaaucucucucagaucgggaugggaaaagagauuagcgauauccugcuuuucuguugggccuuugaacaagaggagagaccaacuuucaccaaguugauggacaugcuggaaaaguuaccuaaaaggaaccgucgccucucccaccccggccauuucuggaagucagcugagcuguga

SEQ ID NO: 58284 - RNA, 4074 nt, Artificial Sequence
  derived and/or modified sequence opt3 from KTN1__Homo_sapiens__NP_001072989
auggaguucuacgaaagcgccuauuuuaucgugcugauucccuccauagucaucaccguuauuuuccucuuuuucuggcuuuuuaugaaggagacacuguacgacgaaguguuggcuaaacagaagagagagcaaaaauuaaucccuacuaagacggauaaaaagaaggcagaaaagaagaaaaacaagaaaaaggagauucagaauggcaaccugcacgagucugacucagaaaguguaccaagggauuucaagcuaagcgacgcccucgcgguggaggaugaccaggucgcuccggugccccugaauguuguggaaaccuccucuucgguccgggagcgcaaaaagaaagagaagaaacagaagccugugcuugaagaacaaguaaucaaagaaucagaugccagcaagauaccagggaagaaaguugagcccgugccugucacaaagcagccaacucccccuagugaagcagccgcuuccaaaaagaaaccaggacagaagaagucuaaaaacgguagcgacgaucaggacaagaaaguggagacccugauggugccguccaagcgacaagaggcauugccccuccaucaggaaacaaaacaggagucaggcagugggaagaagaaagccagcucuaagaaacagaagaccgaaaaugucuuuguugaugagccucugauccacgcuacuacauauauuccacugauggacaacgccgauuccucacccgugguagacaaacgugaagugaucgaccucuuaaagccugaucaagucgagggcauucaaaagagcggaaccaaaaagcugaaaacggagacugacaaggaaaaugcggaggugaaauucaaggauuuucuuuugagucugaaaaccaugauguucucugaagacgaggcacuaugcguuguggaucuccugaaggaaaaguccggugucauccaggacgcccuuaaaaagagcucgaaaggggagcugacaacuuugauacaucagcuccaggagaaggauaaacuguuagcugccgugaaggaagacgcagcugccaccaaggauagauguaaacagcugacacaggagaugaugaccgaaaaggagaggucuaacguaguuauuacgcggaugaaagaccgcaucggaacucucgagaaggaacacaauguguuucaaaacaaaauucaugucuccuaccaggagacacagcagaugcaaaugaaguuccaacaggugagagaacagauggaggcggaaaucgcccaccuuaagcaggagaauggcauccugagggaugcagucucaaacaccacuaaucaguuggagaguaaacagagcgcugaacuaaacaagcugcggcaggacuaugcccgccucgugaaugagcugacagaaaagaccggcaaacuucaacaggaggaaguucagaaaaagaacgcugagcaagccgcaacgcagcugaaggugcaguugcaggaggccgaacgaagaugggaggaaguacaauccuacauuaggaaacggaccgcugagcacgaagcggcacagcaggaccuccagucuaaguuugucgccaaagagaacgaggugcaaagccugcauucaaaguuaacagauacucugguuaguaaacagcagcuagaacagcgucucaugcaacugauggaguccgaacagaagcgcgugaauaaagaggagagccuucagaugcaaguccaggacauauuggaacagaacgaggcucugaaggcccagauccaacaguuccacucucagauugcagcccagaccucagcuagugugcucgccgaggagcugcauaagguaaucgcagaaaaagauaagcaaauaaaacagacagaggacagccuugcguccgagagagauaggcugacuucuaaggaagaggaauugaaagacauucagaauaugaacuuccuccugaaggcugaggugcagaaguuacaagcccuggcaaaugaacaggccgcugccgcacacgagcuagagaaaaugcagcagucgguuuaugucaaggaugacaaaauccggcuccuggaggaacaacuucagcacgaaaucagcaacaagauggaggaauuuaaaauuuugaaugaucagaacaaggcucugaaguccgaggugcaaaaacuccagacccuggugucagagcagccaaauaaggacgucguugaacagauggagaaaugcauccaagaaaaggaugagaaauuaaagacaguggaggaacugcuugagaccggguugauucagguggccacuaaggaagaggaacucaacgcgauacgaacggagaauaguucucugacaaaagagguacaggaccuaaaggccaaacagaacgaucaagucagcuucgcuucccugguggaggaacucaagaaaguuauccaugaaaaggacggaaagauuaaaucaguggaggaacugcuugaggcagaguugcugaaggucgccaauaaagaaaagaccgugcaggacuuaaaacaggagaucaaggcucucaaagaagagaucgguaacguucagcuggaaaaggcccaacagcuuagcauuacuucuaaggugcaggagcugcaaaauuugcucaaaggcaaggaggaacagaugaacaccaugaaagcaguacuggaggaaaaggagaaagaucuagcgaacacagggaaguggcugcaggaccuccaggaggaaaaugagucccugaaggcccacguccaagaaguggcucagcauaaccuuaaagaggccaguagcgcaucucaguuugaagaguuggagauagugcugaaggaaaaagagaaugaauuaaagcgccucgaggcuaugcugaaagaaagagaguccgaucuuucaaguaagacccagcugcuacaagacguccaggaugagaacaaacucuucaaaagccagaucgaacagcugaagcaacagaauuaccagcaggccucguccuuucccccgcacgaggaauugcugaaaguuauuucugagagggaaaaggagaucagcggauuauggaacgagcucgacucacugaaagaugcaguggaacaucaacggaagaagaauaacgaccuucgcgagaaaaauugggaagccauggaggcucuggcgaguacugagaagauguugcaggauaaaguaaacaagacauccaaagaaagacagcaacagguggaggccgucgaacucgaggcaaaggaagugcugaaaaagcuauucccuaagguuucugugcccagcaaucuguccuacggcgaguggcuucacgguuuugagaaaaaggcuaaagaauguauggccgggacgucaggaagcgaggaagucaaggugcucgagcacaaacugaaggaagccgacgagaugcauaccuugcugcaguuagagugcgaaaaguauaaaaguguucucgcugagacugaaggcauucugcagaaacuucaaaggucuguggagcaggaagagaacaaguggaaggucaaaguagaugagucccacaagacaaucaagcagaugcagagcucguucaccucaucugaacaagagcuggaacguuugcggagugagaauaaagacauagagaaccuccgaagagaaagggagcaucuggaaauggagcuagaaaaggcagagauggagcgcuccacauacgugacugaaguucgggagcugaaagaucuucucaccgaacugcagaagaaauuggacgacagcuauucugaggccgugagacagaaugaagaguuaaaccugcucaaggcgcagcugaacgagacgcuuaccaagcugaggacagaacaaaaugagcgccagaaagucgcuggcgauuugcacaaggcccagcaaagccuagaacugauccaguccaaaauugugaaggcagccggggacacuaccguaaucgagaacucagaugugaguccagaaacagagagcucugagaaagaaacuauguccgucucacucaaucagaccguuacgcagcugcaacagcuuuuacaggcugugaaccagcaacugacaaaggagaaagaacacuaccaggugcucgaguga

SEQ ID NO: 58285 - RNA, 924 nt, Artificial Sequence
  derived and/or modified sequence opt3 from KYNU__Homo_sapiens__NP_001028170
auggagcccagcucccuggaacucccugccgacaccgugcagagaaucgcugcagagcuuaagugccacccaacagaugaaagggucgcccugcauuuggacgaggaagauaaauuacggcacuuccgcgaguguuuuuacauuccgaagauacaagaccugcccccuguugaucuaucucucgugaacaaagacgagaaugcgaucuauuuccugggcaacucacuugggcugcagccaaagaugguaaaaacuuacuuggaagaggaacucgauaagugggcuaagauugccgcauauggacaugagguggguaaacgacccuggaucacgggcgacgagaguauugucgggcugaugaaggauaucgugggagccaaugaaaaagagauagcucugaugaacgcacucaccguuaauuuacaucugcuuauguugagcuuuuucaagccuacaccaaaacguuacaagauccugcuagaagccaaggcuuuucccuccgaccacuaugccauugagucucagcuccagcugcacggccuuaacaucgaagagucgaugagaaugauuaaaccuagggagggugaagagacucugcggaucgaagauauauuggaggugauugaaaaggagggggacucaaucgcggucauucucuucagcggagugcacuuuuacaccggccaacauuucaauaucccagcaaucacaaaagccggccaggcuaaggggugcuauguaggauuugaucuggcccacgcaguugguaacguggaguuauaccugcaugacuggggcgucgacuucgcuuguuggugcaguuacaaauaucucaaugccggggcgggaggcauugccggugcauuuauacacgaaaagcacgcucauaccaucaaaccggcccgcuccgaguucuuuaacuga

SEQ ID NO: 58286 - RNA, 3774 nt, Artificial Sequence
  derived and/or modified sequence opt3 from L1CAM__Homo_sapiens__NP_000416
augguggucgcccugagauacguuuggccccuccuucugugcagcccuuguuuguuaauccagauuccagaggaauaugagggccaccaugugauggaaccgcccguaauaaccgagcaauccccuaggcggcugguggucuucccaacagacgauaucucucuaaagugcgaagcgucagggaaacccgaggugcaguuucgcuggacucgagacggaguucacuucaagccuaaagaggaacucggugugacggucuaccagaguccacauagcggcuccuuuaccauuacagggaacaauucuaacuucgcacagcguuuucaaggaaucuauagauguuucgccucgaauaagcugggcacugcgaugucacacgagauuaggcuuauggcugaaggugcccccaaauggccuaaggagaccgugaagccaguagagguugaagagggggaaagcgugguccugccgugcaaucccccuccaagugcagagcccuugcggaucuacuggaugaacuccaaaauacuccauaucaagcaggaugaacgcgugacaaugggacagaacggcaaucuguauuuugccaacgugcugaccucugacaaucacagcgauuacauuugucacgcucauuucccuggcacuagaacaaucauucagaaagagccaaucgaccucagggucaaggcaaccaacuccaugauagaucggaaaccccgcuuacuguuuccgacuaauucaaguagccaccuuguugccuugcaagggcagccucuggugcuagagugcauugcugaaggauuccccacuccaaccaucaaguggcuccgaccuucuggucccaugccagccgacagaguaacauaucagaaccauaauaagacucugcagcuucugaaagugggcgaggaagaugacggggaguacagguguuuggcggaaaacucccucggaucagcacggcacgccuacuaugucaccguggaggcugcccccuacuggcugcacaagccucaaagccauuuauauggcccaggugagacagcacgucuggauugccagguucaggggcgcccgcaacccgaagugaccuggagaauuaauggaaucccugucgaggaacucgcuaaagaccagaaguacaggauccagcggggcgcccuuauucugaguaacgugcagccaucugauacgaugguaacucaaugugaggcgcgaaaccgccacggcuugcuacuggccaaugcauauauauacguugugcagcuccccgcuaaaauccugacagccgacaaccagaccuauauggcuguccagggguccacugccuaccuucugugcaaggcauuuggagccccugugccaagcguccaaugguuggacgaagaugguacaaccgugcuccaggacgagagauucuuucccuacgcuaauggcacgcuggggauuagggauuuacaggcgaacgacaccggacgguauuucugucuggcagccaaugaucagaacaauguuacaaucauggcuaaccuaaaagugaaggacgccacucaaauaacccagggcccgcgcucgacaauugagaagaaagguucuagaguaacuuuuaccugccaggcauccuucgauccuucacuccagccaaguaucacauggcguggggacggcagggaucugcaagaacuuggagacagcgauaaguacuucaucgaggacggccgguuggucauucauucccuggacuauucugaucaggggaauuacagcugcguggccucaaccgaacucgacguuguggagagucgagcucagcugcuugucgugggaucccccgguccuguacccagacugguguugagcgaucuccaccuguuaacucaaucucagguuagggucucauggaguccagccgaggaccauaacgcaccuaucgaaaaauaugauauugaguuugaagacaaggagauggcgcccgaaaaaugguacagccugggcaaggugccagggaaucagacguccacaacccuaaagcucucuccguaugugcacuacacuuuccgcgucaccgcuauaaacaaauacggaccuggcgagcccucgccaguuagcgagacaguggugacccccgaagccgcaccugagaagaauccaguagaugucaaaggugaagggaacgagacuacaaauauggugaucacguggaagccccugcgguggauggacuggaacgccccucagguucaauauagagugcaguggaggccgcagggcacccgcggaccauggcaggaacaaauugucuccgaucccuuucuugugguuucaaacacgaguacauucgugccuuacgagaucaaaguacaggcugucaauucucagggcaaggggccagagccccaggugaccaucggauauagcggugaagacuacccucaagccauuccggaguuggaaggcauagagauccugaacuccucagcagugcucgucaaguggcgacccguugaucuggcucaggugaaagggcacuuacggggauauaauguaacauacuggcgugaaggcagccagagaaagcauucuaaaaggcacauucauaaggaccacguggucgugccagccaacacuaccuccguuauccugaguggucuucgcccuuauagcucuuaccacuuggaggugcaagcguuuaaugggcggggcuccggacccgccucagaguucacguuuaguaccccagaaggcgucccugggcaucccgaggcucuccaccuggaaugucagagcaacacaucgcuacugcucagauggcagccaccgcugucccauaauggagugcuuacuggcuacguuuugucuuaucacccucuggaugagggugggaaaggacagcucagcuucaacuuaagggaccccgagcugcgaacccauaaucuuacagaccugucaccacacuugcgcuaccgguuucaacuccaggcaacuaccaaggaaggccccggugaggccauugugagagaaggcgggacgauggcucugaguggaaucuccgauuucggcaacauaucugccacagcaggggagaauuauagcgucguauccugggugccuaaggaaggacagugcaacuuuagguuccacauccuauucaaagcgcugggcgaggagaaggguggggccucacucagcccacaguacguuaguuauaaucaaucuuccuacacccagugggaccugcagcccgauacugacuaugaaauucaucuuuuuaaagagcguauguuccgccaccagauggcugugaagacaaacggaaccggccgggucagauugccuccggccgguuuugcaacugaaggcugguucaucggguuugugagcgcuauuauccuguuacuccugguacuucugauacuauguuucauuaaaaggucgaagggaggcaaauacucagugaaggauaaggaggacacccaagucgauucugaagcccgaccaaugaaagacgagacauuuggggaguaccggagucucgaauccgauaaugaggaaaaggcauucggaagcucucagcccagccugaacggcgacaucaaaccuuuggguuccgaugacucacuggccgauuaugggggaaguguugacgugcaguuuaacgaggacggcagcuucauuggucaguacucuggcaagaaagaaaaggaggcugcugggggaaaugauuccucaggcgccacgagucccaucaacccagcaguggcuuuagaguga

SEQ ID NO: 58287 - RNA, 1392 nt, Artificial Sequence
  derived and/or modified sequence opt3 from L2HGDH__Homo_sapiens__XP_005268132
auggugcccgcccugagauaccucgucggcgcuugcgggagggcacggggacuuuucgccgguggcagcccuggggcguguggauuugcuuccggccgcccacgaccgcugugcggugggucucguucagccaguaccagcuccuucgacaucguuauugugggaggcggcauaguaggguuggcaucugccagagcuuuaauccugaggcaccccucgcuaucaauuggagugcucgagaaggaaaaagaucuggcaguccaucagacaggucacaacagcggcgugauccauagugggauuuauuacaagccugagucccuuaaagccaagcuguguguucaaggagcugccuugcucuaugaauacugccagcagaaaggcaucucuuauaagcagugugguaagcugauaguggcggucgagcaagaagagaucccacggcugcaggcacucuacgagaaaggguuacagaauggagugcccggccugcgccuuauucagcaagaagacaucaagaaaaaggagccuuauugcagaggcuugauggccauugauuguccacacacugggaucguagacuacaggcagguugcucugagcuuugcccaggauuuccaggaagcaggagguuccgugcuaacgaacuuugaggucaaaggcauagagauggcuaaggaaucacccagucggagcauugacgggaugcaauacccuaucgugauuaagaauaccaaaggagaggaaauccgcugccaguauguggucacaugugccggccucuacucugaucgaaucuccgagcugucagguugcacuccagacccgagaauuguucccuucaggggcgauuaucuucuguugaagccugaaaaauguuaccucgugaaggggaacauauauccaguacccgacagccgguuuccuuuccugggagugcauuuuaccccacguauggauggcaguaucugguuagggcccaaugcgguccuggccuucaaacgcgagggauacagaccguuugacuucucugcaacagaugugauggacauuaucauaaacuccggucucauuaaacuugcuagccagaauuuuucguauggcguuaccgagauguacaaggccugcuuccugggggcuacugugaaguacuugcaaaaguucaucccugaaaucacaauuucugacauccuaaggggacccgccggcguccgggcacaggcccuggaucgagacgguaaccucguggaggauuuuguauucgacgcugggguuggcgauauuggaaaucgcauacugcacgugagaaacgcgccauccccugcagccaccucaaguaucgcuauuagcggcaugaucgccgacgaaguccagcagagguuugagcuuuga

SEQ ID NO: 58288 - RNA, 2319 nt, Artificial Sequence
  derived and/or modified sequence opt3 from L3MBTL1__Homo_sapiens__NP_056293
augagaaggcgggagggccacgggaccgacagcgaaaugggacagggucccgugcgcgagucccaaucuucagauccuccagcccugcaguuccgaaucagugaauacaagccgcucaacauggcuggcgucgagcagcccccuagcccagaacuucgucaggaggggguuacagaguaugaagacggaggcgcacccgccggugauggggaggcgggaccucaacaggcugaagaccauccacagaaucccccugaggauccaaaccaggacccgcccgaggaugacuccacuugccaaugucaggccugcggcccucaccaggcagccggcccagaucuggggucuucgaaugacggauguccccaguuguuucaagaaagaucagugauuguagagaacagcagugguuccacgucugcuagcgaauuacugaaaccuaugaagaaaaggaagcggcgcgaguaccaguccccaucagaagaggagagugaacccgaggcaauggaaaaacaggaggaaggcaaggauccggaggggcaaccuaccgccagcacacccgagucugaagagugguccucaagccagccagcuacuggagaaaagaaagagugcuggaguugggaaucuuaucuagaggagcagaaggccauaaccgcgccugugucccucuuccaggacagccaagcagucacacauaauaaaaacggcuuuaagcuggguaugaaacuugaagggaucgauccccagcacccaucgauguacuucauucugaccguggccgagguuuguggauauagauugaggcuccauuuugacggcuacucugaaugccacgacuucugggugaaugcuaacucccccgauauccacccugccggcugguuugagaagacugggcauaagcugcagccaccgaaaggauauaaggaggaagaguucucauggagucaguaccugcggagcacacgcgcacaagcugcccccaaacaccucuuugucucccagucucauagcccuccacccuuagguuuccaggugggcaugaagcuggaagcgguagaccgaaugaauccuucacuuguuuguguggccagugucaccgaugugguggacuccagauuuuugguccacuucgauaacugggacgauacguacgacuauuggugcgauccaagcucucccuacauucacccgguuggguggugucagaaacaaggaaagccucugacuccaccccaggacuauccugaucccgacaauuuuugcugggagaaauaccuagaagagaccggcgcaucagcugugccaacaugggccuucaagguaaggccuccccauaguuuccucgugaacaugaagcuggaggcugucgaccggcguaauccagcccuuauccgcguggcaagcguugaagauguggaggaccacagaauaaaaauccauuuugaugguuggucccacggguaugacuucuggauugaugccgaccauccggauauccacccugcuggcugguguucuaagacuggacacccccugcagccacccuugggcccuagggaaccaucgagcgcgucccccgggggaugcccuccgcucucauaccggagucugccacauacccgaacaucuaaauauagcuuucaccaucgcaagugccccaccccugguugugacggcuccgggcacgucacgggaaaauucacugcacaccauugcuuaucaggcuguccacuggccgagagaaaccagagcaggcucaaggcugaacuuucugauuccgaggccagugcacggaagaaaaaucugagcgguuuuucuccccgcaagaaaccuagacaccaugggaggauuggccguccgcccaaguaccggaaaaucccacaagaggacuuccagacauugaccccugaugugguacaccagucccuauuuaugucagcccugagugcucaucccgaccgaagccucucgguuugcugggaacaacacuguaagcugcuuccaggaguggccggcauauccgcaucuacugucgcgaaguggacaauugaugagguguucggguuuguccagacccugacgggaugcgaagaccaggcuagauuguucaaagacgaggccaggaucgugcgcguuacccacgugagcgguaagacacucguauggacugucgcacagcugggcgauuuaguguguucagaccaucugcaagaagggaaaggcauucuagagaccggaguucacagucuccugugcucccuuccuacacauuugcuggccaagcucucuuuugcuagcgauucccaguacuga

SEQ ID NO: 58289 - RNA, 2118 nt, Artificial Sequence
  derived and/or modified sequence opt3 from L3MBTL2__Homo_sapiens__NP_113676
auggagaagcccagaagcaucgaagagaccccuuccucugaaccaauggaggaagaggaggacgaugaccuggaacucuucggcggguacgauucauuuaggaguuauaacagcuccgugggaucugagucgucaagcuaccuugaagagaguuccgaggccgaaaaugaggaccgggaagcuggugagcugccgacaucucccuugcacuuacugagcccuggcacuccacgcucccuagaugggucaggaagugaacccgcagucugcgagauguguggcauuguugguacgcgagaggccuucuuuagcaaaaccaagcguuucugcucuguguccuguucaagaagcuauaguucuaacuccaaaaaggcgagcauacucgcuaggcugcaggggaaaccuccaacaaagaaggccaaaguacuucauaaggcagccuggucggcuaaaaucggagcauuucugcacucucaaggcacuggccaguuggccgacgggacccccacaggacaggaugcucucgugcuggguuucgacuggggcaaguuucugaaagaucauuccuacaaggccgcgccugucucaugcuucaagcacgugccacucuaugaccagugggaagauguuaugaaagggaugaagguggaggucuuaaauagugacgcagugcugccgagccggguauacuggauugccuccguuauccaaaccgcuggauaucgcgugcuuuugagauacgaaggcuuugagaacgaugccucucaugacuucugguguaaucuggguacugucgacgugcaccccauuggguggugcgcaaucaacagcaaaauccuagugccuccaaggacaauacacgcuaaguuuaccgauuggaaaggauaccucaugaagcggcuggucggcucacgcacgcuucccguugacuuccauauuaaaaugguggaaaguaugaaguauccuuuucgacagggcaugagacuggagguaguggauaagucccaggucagcaggacucggauggccgugguugacaccgugaucgggggacguuugcgccuccuguacgaggauggugacucugaugacgauuucuggugucacauguggucaccauuaauucaucccgucggcuggaguagaaggguggggcacggaaucaaaaugagcgaacggcgauccgacauggcgcaccauccgacauuccgcaagauauauugcgaugccguaccuuaccuguuuaaaaagguuagagcaguguauacugagggcgguugguucgaagaggggaugaaacucgaagcuauugacccccuuaaucugggcaacaucugugucgccaccgugugcaaggucuugcuagacggauaccugaugauuuguguggauggcgggccaucuacagacggacucgauugguuuugcuaucacgcuucgagccaugccaucuucccugcaaccuuuugccagaagaaugacaucgagcugacgcccccaaaagguuacgaggcccaaacuuucaacugggaaaauuaccuugagaagacaaaauccaaggcugcgcccucaaggcuguuuaacauggauuguccuaaucacggcuucaaaguugggaugaaguuggaagcaguggaccucauggagccacggcugauuugcguagccaccgucaagcgcgugguucauagauuacugaguauacacuuugauggaugggacucugaguaugaucaguggguggacugugaaagcccggauaucuaccccgucggcuggugcgagcuaacugguuaucagcuccagccuccaguggcugccgaacccgcaacaccucugaaagccaaggaggcuaccaaaaagaaaaagaagcaauucgggaaaaagaggaaacguauuccacccacgaagacccggccgcuucgacagggcuccaaaaagccuuugcuggaagacgauccacagggagccagaaaaaucucaagcgagcccguaccuggcgagauaauugcagugaggguuaaggaggaacaccucgacgucgcgucucccgacaaggcuuccaguccagaacugccugugagcguggagaacaucaaacaagaaacagaugacuga

SEQ ID NO: 58290 - RNA, 2268 nt, Artificial Sequence
  derived and/or modified sequence opt3 from L3MBTL3__Homo_sapiens__NP_001007103
augaccgagagcgccuccucuacaucaggccaggaguucgacguguuuagugucauggauuggaaggacgggguuggaacucugcccgguagcgaucucaaauucagagugaacgaguuuggcgcucuugaaguaaucacggacgagaaugaaauggagaacgugaagaaagcaaccgccacaacuaccuggauggucccuacagcgcaagagguguucuccgaaaagaccgggaugccauuuaggcugaaagauccgguuaagguggagggauugcaguucugcgaaaauuguugccaguacggcaacgucgacgaguguuuaucuggugggaauuauugcucgcagaacugugcucggcacauuaaggauaaagaccaaaaggaggaacgcgauguggaggaagacaaugaggaagaggaucccaaaugcucacgaaagaaaaagccuaagcugagccuaaaagccgacacuaaggaggauggagaagaacgugacgacgaaauggagaacaaacaggauguaagaauacucaggggcagucagcgggcacgcagaaagaggcggggcgacuccgccguucugaaacaggggcuuccacccaaggguaaaaaggcuugguguugggcaucuuaccuggaagaggagaaggccguggcugucccugccaaauuguuuaaggaacaucagagcuucccauauaauaaaaacggauuuaaggugggcaugaaacucgaggggguggaucccgaacaccaauccgucuacugcguucugacaguggcggagguauguggauaucgcaucaagcugcauuucgacggcuacucagauugcuaugacuuuugggugaaugcagaugcccucgacauucacccugucgguuggugugaaaagaccgggcauaaauuacacccaccgaagggauacaaagaggaggaguucaacuggcagacguaccugaagacuugcaaagcucaggccgcacccaagagucuuuuugaaaaucaaaacaucaccgugauuccuagcggcuuccgaguuggcaugaaguuggaagcuguggauaaaaagaauccaucuuucaucugcgucgccacagugacugacaugguagauaacagauuucugguucacuucgacaacugggacgaguccuaugauuacuggugugaggcgucaagcccccauauacacccugugggguggugcaaagaacauaggcggacccuaaucacaccacccggauauccgaaugucaagcacuuuaguugggacaaauaccucgaggaaaccaacucucugccugcccccgcacgugcuuucaaggugaagccaccucacgguuuucagaaaaagaugaaacuugaggucguggauaagcgcaaucccauguucauuagaguugccacgguggcugacacugaugaccauaggguaaaaguccacuuugauggcuggaacaauuguuaugacuacuggaucgaugccgacuccccagauauucaucccgugggguggugcagcaagacaggacacccucugcagccaccguugucgccccucgaacugauggaggcaucugagcauggcgguuguuccaccccugggugcaaaggcaucggacacuucaagcgggcccgacacuuaggcccacauucagcugcgaacugucccuauagugaaauaaaucugaacaaggaccgcauuuuuccugauagacucagcggggagaugccacccgcauccccgucuuucccuaggaauaaacggacugacgccaacgaaagcucaaguuccccagagauccgcgaccaacacgcugaugacguuaaggaagauuuugaggagagaacagaaagcgagaugaggaccucucaugaagcccguggagcacgggaggaacccacggugcagcaggcccagcgaagaucagcugucuuccuuaguuuuaaaagcccuauucccugccugccauugaggugggagcaacaguccaagcuacugccuaccguggccgguauccccgcaucuaaaguaucgaaguggagcacagacgagguguccgaguucauccagucacucccaggcugugaagaacacgggaagguuuucaaagaugagcagauugacggagaggcguuucugcuuaugacucaaaccgauauagucaagaucaugaguauuaaacugggcccggcuuugaagaucuucaauucuauacucauguuuaaagccgcagaaaagaacagccacaaugagcuguga

SEQ ID NO: 58291 - RNA, 1872 nt, Artificial Sequence
  derived and/or modified sequence opt3 from L3MBTL4__Homo_sapiens__NP_775735
augaagcagcccaacagaaaaaggaagcugaauauggacagcaaagagcggcucgaucaagacggccgccuugaacaggccgaggaagagaagaaaccuaaggauuccaccacaccacugucucacgugccgucagcugcagcccagggggcguggaguugggaaugguacuugaaggagcagaaagcugucgccgcacccguugaguuauucagcaaggaccaauccuuuccugaacaugagaacggauuccagaucgguaugcgacuggaaggcauugauccacgucaccccucuguguuuugcguacuaucgguggccgaggucuguggguauagacucaggcugcauuucgacggauaccuuucaugcuaugauuuuuggacuaaugcuggcagcccugacauacacccaguggguuggugugagaaaacgaagcaugaacugcacauccccaaaggguaccggaaggauaaguucguuuggauggacuauuugaaagcaugcaagcuccagaacgccccuaaaaagcuguuucgcaauagaaguccaaacggaccgauguccaaagaguuccaggugggcaugaagcuggaagcugucgauaggaaaaaucccucucucguguguguagccaccauugcggacaucguugaggaucgguuacuggugcacuuugacaacugggacgauagcuacgacuauuggugcgaugucaauuccccuuacgugcaaccagugggcuggugucaggaaaacgggcgcacacuuauugcaccccagggauacccuaauccagagaacuucucauggacugaguauuuggaagccacccagacaaaugcuguccccgccaagguuuuuaagaugcgacugccgcaugguuuccuaccuaacaugaaacucgaggugguagacaagagaaaucccaggcugauccggguggcaaccauagucgauguggacgaucaacguguuaaagugcacuuugacggcugggaucauaaguacgacuauugggucgaagcugauaguccagacauccacccuauuggguggugcgacgugacuggacacccccuugagguaccacagcgcacaaacgaucugaaaaucuugcccggccaggccguuuguccuaccccagguugcagagggauuggacauaucaggggcccgcgguacagcggccaccauucugcguucgggugucccuauuccgacaugaaccucaagaaggaagccacgcugcacgaucgauuacgcgagcaaacucaggcaaaucuggagucagacagcagucauucuaaauccaagagccucugcucgcuuaacuucaauggaaaacacgaaaaggugaacucucagccuagacugguccagcaagcuaaaugcuugaagauaaaggguaaagaggauauugaccuagauaaucuguuuagggugcucguccugcacccacggggccuugaauacuccguggagcaggcccagcagguucugcaucaaucagugaguaugagcaccguauccgcucaccccuuccgcgacuugccucucgggagagaacagcauuguaagcuguuaccaggagucgccgauaucagggcaucucagguggcccguuggacaguugacgagguggcugaguuuguccagagccugcuaggcugcgaggaacacgcgaaauguuucaagaaagaacaaauugaugguaaggcauuucuccugcuuacucagaccgacaucgugaagguaaugaaaaucaaguuggggcccgcccugaaaauuuauaacucaauacucauguuccggcacagucaggagcugccggaggaagauaucgcuuccggccaggaggugcgaggauga

SEQ ID NO: 58292 - RNA, 1293 nt, Artificial Sequence
  derived and/or modified sequence opt3 from LACC1__Homo_sapiens__XP_006719829
auggccgaggcugugcugaucgaccucuucggccuuaagcugaacagccagaaaaauugccaccaaaccuuguuaaagacacugaacgcaguccaguaccaucacgccgcgaaagcuaaguuucuauguauuaugugcuguuccaauauaucuuaugaaagagauggggagcaggacaacugcgaaaucgagacuucaaauggacucagugcccugcuugaagaguucgagauuguuagcugucccuccauggcagccacgcuguacaccaucaaacagaagauugaugaaaagaacuugucuucgaucaaagugauaguaccuaggcaucggaagacacucaugaaggcuuuuaucgaccaacuguucacugauguguauaauuuugaguucgaagaccugcaggucaccuuucgcgguggccucuucaaacagucaauugagaucaacgugauuacagcacaggaguuacgagggauccaaaaugaaauagagaccuuucugcguagccuuccagccuugagaggaaaacugacuauuaucacaaguucccuaauuccggauaucuucauccacggcuuuaccacgaggacuggugggauuucuuacauacccacccucagcuccuucaaccuguuuucaaguagcaagcggcgcgacccuaagguugugguccaggaaaaucuuagaaggcuggcuaacgccgcgggauucaauguggagaaauucuaucggaucaagacacaucacucuaacgauauuuggaucaugggccgcaaagaaccagacuccuacgauggcauaacuaccaaucagcgagggguaacaauugcagccuugggagcugacugcauccccaucguuuuugccgauccugugaagaaagcauguggugucgcucacgccggcuggaaggggacccuccugggaguggcgauggccacggugaacgcaaugauugcugaguauggcugcucauuagaggacaucgucguugugcuggguccaagcguagggcccuguugcuucacucucccuagagaaagugccgaggcuuuucauaaccuucacccagccugugugcagcuguucgacucuccgaaucccugcauugauauaaggaaagcaacacggaucuugcuagaacaaggaggcauucugccucagaacauccaggaccaaaaucaggaucucaaccugugcaccuccugucauccagacaaguuuuucagccacguccgugauggccuuaauuuugggacucagaucggauucauuucgauaaaggaguga

SEQ ID NO: 58293 - RNA, 1446 nt, Artificial Sequence
  derived and/or modified sequence opt3 from LACE1__Homo_sapiens__NP_660358
auggccgcuagcuggucccugcucgugacccuuagaccccuggcacagucuccuuugaggggccggugcgucggguguggagccugggcggcugccuuagcaccacuggccacagcuccggguaagcccuucuggaaagcauacacuguucaaacgucagagaguaugaccccuacagccacuagcgaaaccuaucuaaaggcucucgccgugugccacggcccacuggaccauuacgauuuucuuaucaaagcgcacgagcugaaggacgaugaacaucagcgccgaguaauucaguguuugcagaaacuccacgaggaccugaagggguauaacauagaagcagagggacuguucuccaagcucuuuucucguucgaaacccccuagaggcuuauacguguauggugaugucgggacaggaaagaccauggugauggacauguucuacgccuauguugagaugaaaaggaagaaacgggugcauuuucacggcuucaugcuggauguccacaagcgcauccauagacuuaagcaaucauugccaaaaaggaagcccggcuuuauggcuaaaagcuacgacccuauugccccaaucgcagaagagauuagugaagaggcuugccugcuauguuucgaugaguuucaggugacugacaucgccgaugcgaugauacucaagcagcuguucgaaaaucuuuuuaaaaacgggguaguuguggucgccacauccaaucggccgcccgaggaccuguacaagaacggauugcagcgcgcaaauuucgugccuuuuaucgcugugcucaaagaauauugcaacaccguccaacuggauucugguauugacuaccgaaagagagaguuaccagccgcuggcaagcuguauuaccucacgagcgaagccgacguugaggcagugauggauaaacuuuucgacgagcuggcccagaagcagaaugauuugacuaggccccggauccuaaaaguacaggggcgugaacugcgccucaacaaggcuuguggaaccguggcggacugcacauucgaggaacugugugagagaccucuuggcgcauccgauuaucuggaauugaguaaaaauuuugacacuauuuuccucaggaacaucccacaauuuacccuggccaaucggacacagggucgacgcuucauaaccuuaauugauaacuuuuacgaccugaaggucagaaucauuugcucagcuagcacgcccaucucuucccuauuccuccaccagcaucacgauucagagcuggagcaaagcaggauccuuauggacgauuuggggcugagucaggacucugccgaaggacucuccauguuuacuggcgaggaagagauuuucgcauuucagcggacaauaagccgccugaccgaaaugcagacugagcaauauuggaaugagggcgacagaacaaagaaauga

SEQ ID NO: 58294 - RNA, 417 nt, Artificial Sequence
  derived and/or modified sequence opt3 from LACRT__Homo_sapiens__NP_150593
augaaguucaccacacugcucuuucuugccgcuguggcaggcgcccuggucuacgcggaggacgcuagcuccgauucuacuggggccgaccccgcacaggaagccggaacgucaaaaccuaacgaggaaaucagugguccagcugagccggcaagcccucccgaaaccacaacuaccgcccaagagacauccgcugccgcgguucagggcaccgcaaaggugacuucuucgagacaggaguugaauccauuaaaaucaauuguagaaaagagcauacugcuaacagagcaggcccucgcuaaagccgggaagggaaugcacggcggugugcccgggggaaagcaauucaucgaaaacggcagugaguuugcacagaaacugcuuaagaaauucucccuguugaagccuugggcuuga

SEQ ID NO: 58295 - RNA, 1644 nt, Artificial Sequence
  derived and/or modified sequence opt3 from LACTB__Homo_sapiens__NP_116246
auguacagacugaugagcgccgugaccgcuagggcagccgcgcccggcgggcucgcuuccucuugcggacggcgcgguguccaccagcgagccggccuuccuccacuggggcauggauggguuggcgguuugggguuaggacugggccuagcacucggcgugaagcuggccgggggacuucguggugcugcaccggcccaaucacccgcugccccugacccagaagcgaguccccuggcagaaccuccacaggagcagagcuuggcccccugguccccucagacaccagcuccgcccuguucuagaugcuucgccagggcaaucgaaucgucacgggaucuccugcaccgcauuaaagacgagguaggcgcuccugggauaguggucggagugagcguugauggcaaggaaguguggagugagggucugggguaugccgacgucgagaacagagugccauguaaacccgaaacuguaaugaggaucgcguccauuucuaagagccucacgaugguugccuuagcaaaacugugggaggcuggaaaacuugauuuggacaucccugugcaacauuacgucccagaauuucccgagaaggaguaugaaggcgagaaaguguccgugaccacacggcugcuaauuucacaccucaguggcauccgccauuacgaaaaggauauaaagaaggucaaagaggaaaaggccuauaaggcucugaaaaugaugaaggagaauguugccuucgagcaggaaaaagagggaaagagcaacgaaaagaaugacuuuacuaaguucaaaaccgagcaggaaaacgaggcaaagugccgaaauucuaagccggggaaaaagaaaaacgauuuugagcagggugaacuuuaccugagagagaaguucgaaaauuccaucgagucauugaggcucuuuaaaaacgacccucuguucuuuaagcccggcagccaauucuuauauaguacauuuggguacacccugcucgccgcuauuguggaacgggcgucuggauguaaguaccuugauuauaugcagaaaaucuuccacgaccuggauauguugacuacaguacaggaggagaaugaaccagugauuuacaaccgugcacgcuuuuaugucuacaauaagaaaaagaggcuagugaacaccccuuauguugacaauuccuacaaaugggccggcgguggguuccugagcacggugggcgaccuccugaaguucggaaacgcuaugcuuuauggcuaccaggucgggcuguuuaaaaauucgaacgagaacuugcuccccggauaccugaaaccagaaacuauggugaugauguggacccccguaccuaauacagagaugucuugggauaaggaggguaaauaugccauggcauggggcguuguggaaagaaagcaaacuuacggguccugccggaaacagcgacacuaugccucacauaccggaggcgcugucggugccaguagcguguuacugguccuaccagaggaacucgacacagagaccaucaacaauaaggugccgccccgcgggauaauuguuuccaucauuuguaacaugcagucugugggccugaauagcacggcacuuaagaucgcguuggaguucgauaaagacagaucagauuga

SEQ ID NO: 58296 - RNA, 1554 nt, Artificial Sequence
  derived and/or modified sequence opt3 from LAD1__Homo_sapiens__NP_005549
auggccgugagcagaaaggacugguccgcucugucuucacucgcaaggcagcggacccuugaggaugaagaggaacaagagcgcgaacgacguagaaggcaccggaaccugaguagcacaacugacgaugaggcgccccgcuugucccagaauggcgacagacaggccucugcuucggagagguuaccuucagucgaagaggccgaaguuccaaaaccgcugcccccugcaagcaaggaugaggacgaggauauccagaguauucuacggacgcgccaagaacgaagacagaggagacaggugguagaggccgcucaggcaccaauacaagaacgucucgaggccgaagaggggcgcaacucccugucucccgugcaggcuacccagaaaccucuugucagcaagaaagagcuggaaaucccacccagaaggcgguugucccgagagcagcgcggaccuugggcccucgaagaggaaucacugguggguagagagccagaggaaaggaagaagggcguuccggagaaaagucccgugcuggaaaagagcucuaugccuaaaaagacagcgccagagaaaucccucgucucagacaagacuagcauuagugaaaagguguuagcaucugagaaaaccucccugagcgagaagaucgccguaucggaaaaacggaauagcuccgagaagaaaucaguucuugaaaagacaagugugagcgagaaauccuuggcucccgggauggcccugggaucuggccgccggcuagucagcgagaaggcaucaauuuucgaaaaggcucucgccagugagaaauccccuaccgcggaugccaagccagcacccaaaagggcuacugccagcgaacaaccgcuggcucaggagccucccgccucuggugggucaccagcaacaaccaaggaacagcguggacgggcccuuccuggcaaaaaccugcccaguuuggcuaagcaaggcgcgagcgacccacccacgguggcaucccgacucccuccagugacucugcaggucaagaucccgucuaaagaggaggaagccgauaugucgagccccacccagagaacauacuccucaaguuuaaagaggucuagcccucgcacuauauccuuucggaugaaaccaaagaaagaaaauucagagaccacacugaccagaagcgcuucuaugaagcuccccgacaacacgguuaaacuuggggagaagcuggaaagguaucauacugccauccgccgauccgagagugugaagucucggggauugccuugcacagagcuauucguagcaccagugggugucgccucuaaacgucaccuguuugaaaaggagcucgcuggccaguccagagccgaacccgcaucaaguaggaaagagaaucugcgccuuagcggggugguuaccucgcggcugaacuuguggauuuccagaacucaagaaucuggagaucaggacccgcaggaggcgcagaaggcuagcucagccacagagaggacccaauggggccagaagagugacuccucucucgaugcagaaguguga

SEQ ID NO: 58297 - RNA, 1578 nt, Artificial Sequence
  derived and/or modified sequence opt3 from LAG3__Homo_sapiens__NP_002277
augugggaggcccaguuccugggccuccuuuuucugcaacccuuguggguggcuccugucaagccauuacagccgggggcagaaguucccgugguaugggcccaggagggagcgccugcucagcugccaugcagccccaccaucccucuacaagaccucucccugcuuagaagggccggugugacauggcagcaccagccagauucugggcccccugcagccgcuccaggccacccgcuggcacccggaccucacccagccgcucccucaaguuggggcccucggccacgccgauacacugucuugagcgugggucccgggggacuccguuccggcagacugccgcugcagccuaggguucaacucgacgaacggggccgccagagaggggauuucucuuuauggcugaggcccgcccggcgcgcggacgcaggagaguaucgagccgcugugcaucuuagagauagggccuugucgugucggcugcgucuacgccucggucaggcaucaaugacggcuagcccaccuggcagucugagagccuccgacugggucauucuuaacugcucuuuuagcaggcccgaucggccagcguccgugcacugguuccgaaaucgcgggcagggaagaguacccguuagggaaucaccucaucaccaccuggccgagaguuuucucuuccucccacaagugagcccgauggacucuggccccugggguuguauacugaccuaccgggauggguuuaacgucuccaucauguauaauuuaacagugcugggacucgagccuccaacuccccuuaccguguacgcaggcgcuggcucacgcgucgggcugccuugcagauugccagccggaguugguacaaggagcuuccuaaccgcuaaauggacucccccgggcgggggaccugaccugcucgugacaggcgauaacggugacuuuacccugcgucuugaagauguaagucaggcccaggcagggacguauacuugucauauucaucugcaagagcagcaguugaaugccaccgugacacucgcuaucauuacugucaccccaaagucuuucggcucccccggaagccugggcaaauuacugugcgaagugacaccuguuucggggcaggagcgguuuguguggucuucccuagacacccccucacaacgaaguuucagcggaccauggcucgaggcgcaggaagcacagcugcuuucccagccuuggcaaugucaguuguaccagggugagagacugcucggcgccgcugucuauuuuacggaacugucuagccccggggcccagaggucaggacgcgcaccaggcgcccuuccggcuggucaccuguuguuguuccugaucuuaggggugcugagucuacuccugcuuguaacuggcgccuucggauuucacuuguggcggagacaauggaggccucgccgauucuccgcacuggagcagggcauacaucccccacaggcgcagagcaagaucgaggaacucgagcaagaacccgagccugaaccagagcccgaaccugagccggagccagaacccgagccugaacagcuguga

SEQ ID NO: 58298 - RNA, 843 nt, Artificial Sequence
  derived and/or modified sequence opt3 from LAIR1__Homo_sapiens__NP_001275955
auggagagagaaauggugcugugccucgcccagaccauccacacacaagaggaccuucccaggccuagcauuuccgcugaaccaggcacugucauaccgcuggggucucauguuacguucgugugucggggacccguaggugugcagaccuuucgcuuggagcgagauucacguaguacauacaacgacacugaagaugucagccaggcauccccuucugagucggaggccagauucaggaucgacucagugcgggaaggcaaugcgggguuauaucgcugcauuuacuauaagccacccaaauggagcgagcagagugauuaccuggaacuacucguuaaggaguccucuggaggcccugacagcccagauaccgagcccgguuccucagcugggccuacacaaagaccaagugacaacagccacaaugaacaugccccggcaucucagggacugaaagccgagcaccuuuauauccugauuggcguguccgucguguuuuuguucugucuccugcugcucguauuauuuugccugcauaggcagaaccagaucaagcaagggcccccucggucaaaagaugaggaacagaagccacagcagcgccccgaccuugcuguugauguguuggaacgaaccgcagacaaggccacugucaauggccugccugagaaagauagagagacagacaccagcgcucuagccgcgggaaguucucaagaagugacguacgcacagcucgaccacugggcccugacucagaggaccgcucgggccguguccccacaaagcacaaagcccauggcagagucgauaacuuaugcugccgucgcgcgucacuga

SEQ ID NO: 58299 - RNA, 459 nt, Artificial Sequence
  derived and/or modified sequence opt3 from LAIR2__Homo_sapiens__NP_002279
augagcccccaccugaccgcccuccuuggccugguguugugcuuagcucagacaauccauacucaagagggggcacugccuagaccauccauuucugccgaaccgggaacggucauaucacccgguagucacguuaccuucauguguaggggcccuguggggguacagacauuucggcuagagcgcgaagaccgagcgaaguacaaagauagcuauaacguguuccgucucggaccauccgagucugaagcuagauuucauaucgacucggucucagagggcaaugccggucuguacaggugccuuuauuacaagcccccuggguggagcgagcacagugauuuccuggaauugcucgugaaagaguccucuggaggcccagacagccccgauacugaaccuggcuccucagcagggaccguuccaggaacagaggccagugguuuugacgcuccguga

SEQ ID NO: 58300 - RNA, 462 nt, Artificial Sequence
  derived and/or modified sequence opt3 from LALBA__Homo_sapiens__XP_011536644
auggaggaccugcaguuccucggcguggccaagaugagauuuuucgucccccuuuuucugguugggaucuuguucccugcuauuuuagcaaaacaauuuaccaagugcgaacugagccagcuacucaaagauauagacggauacgguggcaucgcccugccagagcuuauuuguacaauguuccacacuuccggguaugauacgcaggcgaucguggaaaacaaugagucuaccgaauacggacuguuucagauuucaaacaaguuguggugcaaaaguagccaaguaccgcaguccaggaauaucugugacauaucuugcgauaaguuccucgacgaugacaucacagaugacauuaugugugcuaagaaaauccuggauauuaagggcaucgacuauuggcuggcccauaaagcacucugcacugagaaguuagagcaguggcugugugaaaaacuuuga

SEQ ID NO: 58301 - RNA, 9228 nt, Artificial Sequence
  derived and/or modified sequence opt3 from LAMA1__Homo_sapiens__NP_005550
augagaggaggggugcugcucguccuucuguugugcguugccgcucaauguaggcaacggggauuauuccccgcaauccugaaccuagccagcaaugcgcacauuuccaccaacgcuacaugcggugaaaaaggcccugaaauguuuuguaaacucguggaacauguacccgggcgcccggugcgaaauccccagugccguauaugugacggaaacucugccaauccuagagaaaggcacccaaucucacaugcaauugauggcacuaacaauugguggcagagucccagcauccagaacggucgggaauaccacugggucacgauuacccuggaccuucgccaaguguuccagguugccuaugugaucauaaaggcugcaaaugccccuagaccagggaacuggauccuggaaagguccuuggauggaacaacuuuuucucccuggcaguacuaugcugucucggacucagagugccucagccgguacaauauuaccccucgccgaggcccaccgacauauagagccgaugacgaggugaucuguaccaguuacuauuccaggcugguaccccuggaacauggcgagauucacacuucucucaucaacgggcggccuagcgcggaugacuuauccccaaaacugcuugaguucacaucagcacguuacauacgcuugagacugcagaggauucggacccuaaaugccgaucucaugacgcugagucaccgagagcccaaggagcuugacccuaucguuacucgcagauacuauuacagcauuaaagauaucucugugggagguaugugcaucuguuauggccaugcuuccucaugcccaugggacgaaaccacaaagaagcugcaaugucagugcgagcacaacacuugcggggaaagcuguaauaggugcugucccggauaccaucagcagccguggcggccuggcaccgucaguucugguaacacaugcgaggccuguaacugccacaauaaagcaaaggauuguuauuacgacgaauccguggcuaaacaaaagaagucguugaacaccgccgggcaguuucgcggaggcggcgugugcauuaauugucuccagaacacgauggggauaaauugcgagacuuguaucgacggauauuacagaccccacaaggucagcccauacgaggaugaaccuugcaggcccugcaacugugacccaguugguucucuguccucagugugcauuaaggaugacuuacauagugaucugcacaauggcaaacaacccgggcaguguccuugcaaggagggauauacaggcgaaaaaugugaccguugccagcucgguuacaaggauuauccaaccuguguaagcugcggguguaacccggugggcuccgcgucugacgagcccugcacuggaccuugugucugcaaagaaaauguggagggcaaggccugcgaucgguguaaaccaggguucuacaaccuuaaggagaagaauccccgaggaugcagcgaauguuuuugcuucgguguuucagacguguguaguucccugagcuggccugucggccaggugaacucuaugucagggugguugguaacagaucuaaucaguccaagaaaaauacccagccaacaggacgcacugggaggcaggcaucagguuuccauuaauaacaccgcugugaugcagcgccucgccccgaaguauuacugggcugccccugaggcauaucuggguaauaaacuuacggccuuugggggcuuccugaaguacaccgucucuuacgacaucccaguggaaacagucgauucgaacuugaugagccacgcugacgugaucauuaaaggaaacggccucacucuguccacccaagcggagggguuaucacugcagcccuaugaagaguaccuaaauguugugcggcucguaccugagaacuuucaggauuuccauaguaagagacagaucgacagggaucaacugaugacaguccuugcaaaugugacucacuugcugauucgcgccaacuauaauucugcuaagauggcccucuaccgacuggaaagcguuucccuugacauagcaucaagcaacgccaucgaucugguggucgcugccgacguggagcacugcgaauguccccagggauauaccgguacaucuugcgaguccuguuugaguggcuacuaucggguagaugggauucucuuuggaggcaucugccagccaugugagugccauggucacgcagcggaaugcaaugugcaugggguuuguaucgcuugcgcccacaacaccacuggcguccacugugagcagugccugccuggauucuacggcgaacccagccgugggacgccaggagacugucaaccgugcgcauguccuuuaacaauugccucuaauaacuucuccccaaccugccaucugaaugauggcgacgagguggugugugauuggugcgcuccagguuacucaggggccuggugugaaagaugcgcagacggauauuacggcaaccccacugucccuggugagaguugcguuccaugugacugcagcggcaauguggaucccucggaggcugggcacugugacuccgugaccggagaaugccuaaaaugucucggcaacacagauggggcccauugcgagaggugugcggacggauuuuauggcgaugccguaaccgcuaagaauugccgcgcaugugaaugccacgucaaagguucucauagcgccgugugucaccuggagacugggcuuugcgacugcaagccuaacguuacaggacagcagugugaucaaugcuugcacggcuacuauggucuggacucaggccaugggugucggccgugcaacuguaguguggcuggauccgucucugauggcugcacggacgaagggcagugucacugcgugccaggaguugccggcaaaagaugugauaggugcgcacaugguuucuacgcguaucaggacgggagcuguacccccugcgauuguccucacacucagaauacaugcgacccagagaccggagagugcgugugucccccucauacacaaggcguaaagugcgaagagugugaagacggucacuggggcuacgaugccgaggucgggugccaggcuuguaacugcucccucgugggaucaacucaccaucgaugugacguggucaccggccacugccaguguaagagcaaauuugggggacgcgccugcgaucaguguagucugggcuaccgggacuucccggauugcguucccugcgacugugauuuaagagguacgucuggggacgcaugcaaucuggaacaaggacuuuguggcugcguggaggagaccggcgcuuguccaugcaaggaaaacguauuugggccucaguguaaugagugcagggaaggaacauucgccuugcgugcagauaacccccucgguuguuccccaugcuuuuguagcggccugucgcaucuaugcucagagcuggaggacuaugugcgcacuccugucacccucgggucugaucagccccugcuucgggugguuagucaguccaauuugagaggaacaacugaaggcguguacuaucaagccccagacuuccuguuagacgcugcgaccgucaggcagcacauacgagccgagccguuuuacuggcggcucccucagcaauuccagggugaucagcugauggcauaugggggaaaacuuaaguacagcguggcuuuuuauucucuggacggcguuggcacgagcaacuucgaaccccagguguugaucaaagggggacgcauuagaaagcaagucaucuacauggaugccccagcccccgagaaugguguaaggcaggaacaggagguggcuaugcgggagaacuuuuggaaguacuucaauuccguuucagaaaaaccugugacacgagaggacuucaugaguguccucagcgauauugaauauauccugauaaaggcaucuuacggccaggggcuacaacaguccagaaucucagacauuaguauggaggugggacgcaaagccgaaaagcugcacccagaggaggaaguagcgagccuccuggagaacugcgugugucccccuggcaccgucgguuuuuccugccaggauugugcuccgggguaucauaggggaaaacuuccagccggcucugaccguggcccccggccuuugguugcacccugcgugccauguucgugcaauaaccacagcgauacuugugacccuaauacagggaagugccugaacuguggagauaacaccgccggugaccauugcgauguguguacuucaggcuacuaugggaaagucaccggauccgcuagugacugcgcauuaugcgccuguccccacucuccuccugcgagcuucuccccgacaugcgugcucgaaggcgaccaugauuuuagaugugacgcuugccugcuugguuacgaggggaagcacugugaaaggugcucaucuagcuauuacggaaauccccagacgccaggcggcaguugucaaaagugcgauuguaacccucacggguccguucauggagacugcgaucgcaccagcggucaguguguaugccgacugggcgccucugggcuaagaugcgacgagugugagccccggcacauccucauggaaacugauugcgugucaugugacgaugagugcgucggagugcuguugaaugaccuggaugaaauuggcgacgcaguuuuaucccucaaccugacagguaucauaccagugccuuacgggauucuuaguaaucuggagaacaccacaaaauauuugcaggagagccuccugaaggaaaauaugcagaaagaucuaggaaagaucaaacuggagggcgucgccgaagagacugacaaccuucaaaagaagcucaccaggaugcuggcuucgacgcagaaagugaaucgcgccacagaacguauuuucaaggagucucaggacuuggcaaucgcuauagagagacugcaaauguccaucaccgaaauuauggagaaaacuaccuuaaaccagacacucgaugaagacuuucugcuucccaauagcacucugcagaacaugcagcaaaauggcaccucauugcucgagaucaugcagauucgggauuucacacagcugcaucagaacgccacgcuagaacugaaggcggccgaggaccuucucagucaaauccaggagaauuaccagaaaccgcuggaagaguuggaaguauuaaaggaggcagcuucucacguccuguccaagcacaacaaugaacucaaagccgcugaggcacuggugagggaggccgaagccaagaugcaggagagcaaccaucuucuguugaugguuaacgcuaaucuacgcgaauuuucagauaaaaagcugcacgugcaagaggagcagaaccucaccagugaacugauaguccaggggcgaggacuuauugacgcggcagccgcucaaacugaugccgugcaggacgcauuagagcaucuggaagaucaccaggacaaacucuugcuguggagcgccaagaucagacaucacaucgaugaccucguuaugcacaugucccagcggaaugcuguggaccuggucuauagggcggaggaucaugccgcagaguuccaacgccuugcugacgugcuguacucugguuuggagaacauuagaaauguaagccuaaacgccacauccgcagccuaugugcacuacaauauccagucacugauugaggaaucugaggaacucgcuagggaugcccaucggaccguuacugagacaaguuuacugucggaaagccuugucuccaacggcaaggcggcagugcagcguucuucacgcuuucugaaagaggggaauaaccucagccgaaaguugccaggaauagcccuggagcucuccgaacugagaaauaaaaccaacagguuccaggagaaugcuguggaaaucacgcggcaaacuaacgagagucuucuaauucugcgcgccaucccuaagggcauuagagacaaaggugcuaagaccaaagaauuggcaacaucugccagccagucagcugucuccaccuuaagggauguagccgggcugagucaggagcuccugaauacuagcgcaucucuuucccgggugaacacaacccugcgagagacacaccagcucuugcaagacucaacuauggcgacccugcuagccggcagaaagguuaaggauguggaaauccaggcuaaccugcucuuugaccgccuuaaaccccugaagauguuagaggaaaauuugagcaggaaccugucggagauaaaacuccugaucucucaggcccggaagcaggcagcuaguauuaaagucgccguguccgcagaucgugacuguaucagagccuaucaaccacagauuagcucaacgaauuacaacacacuuacccugaauguuaagacucaggagcccgauaaccucuuguucuaccugggauccucuaccgcuagcgacuuuuuagcgguggaaaugaggcgcggccgggucgccuuccuaugggaucuggggaguggauccacacgacucgaguucccugacuuuccgaucgacgauaauagauggcacagcauacauguggcaagguucgguaacauuggcucucuuucaguaaaggaaaugaguuccaaucagaaaagccccacuaagaccucuaaaucgccagggacggcuaacgugcuggacguuaauaacucaacauugauguuugucggaggccugggugggcagaucaagaaaagcccugccgugaaggugacccacuucaagggcugccucggagaggccuuucugaauggcaaauccaucgggcuuuggaacuauauugaacgcgagggaaagugucgggguugcuucggcaguucucagaaugaggaucccagcuuucauuucgacggguccggauacucagucguugagaaaagucucccugcaacugugacacagauaaucaugcuguuuaacaccuucucuccaaacggcuugcuguuauaucuagguagcuacgggacuaaggauuuucuguccauugaacucuucagaggccguguaaaagugaugacagaccuuggaucaggccccaucacccuguugacggauaggcgguauaauaacgggacuugguacaagauugcuuuccaacgcaaucgaaagcagggaguccuggccgugaucgacgcguauaacaccagcaauaaagaaacaaagcagggcgagaccccuggugcuucuuccgaucucaacagacuggacaaagauccaauauacguugggggacuucccaggagucgggugguccgcagaggcguaacaacuaagagcuuuguggguuguaucaaaaauuuagaaauuucgagguccaccuucgaccugcuccgaaacucuuacggcguucggaaggggugcuugcuggagccgauccguucagugagcuuucuaaagggaggcuauauugagcugccuccaaaaagucucucccccgaaucugaguggcuugucacguucgccacaacuaauagcucagggaucauacuggcagccuugggaggcgacguggaaaagagaggugaucgcgaggaagcucacgucccauuuuucuccgugaugcugauugggggaaacaucgagguucaugugaauccaggcgacgguaccggccucaggaaagcacuguuacacgcccccacagggaccuguagugauggacaggcgcacagcaucucucuuguacggaacagacgcauuaucacugugcaacuggacgagaauaacccggucgaaaugaagcucggcacccuaguugagucaaggacaauaaauguguccaaccuguacgucgggggcauuccugaaggcgaggguacgagcuugcugacuaugcgacggucuuuucaugggugcaucaaaaaccucauuuucaaucuugagcuguuggauuuuaacagugcugugggacacgaacagguagaccuggauaccugcuggcucucggagagacccaaguuagccccagacgcagaagauuccaaacugcuuccugagcccagggccuucccagaacagugugugguugacgcugcccuggaguaugugcccggcgcacaucaguuuggccuaacacaaaauagccacuucauccucccuuuuaaccagucagcuguccgcaagaagcugucuguggaguugagcauacguaccuucgccuccagugggcugauuuacuauauggcgcaucagaaucaagccgauuacgcaguccuccagcuucacggaggucggcugcacuucauguuugacuuaggcaaagggagaacuaaggugucacauccagcucuguugucugauggaaaauggcacacaguuaagaccgacuauguaaaaaggaagggcuucaucacgguggacggucgcgaaagcccgauggucacugugguuggggauggaacaaugcucgacguggagggccuguuuuaccuaggcgggcuucccucccaguaccaggcccgaaagaucggaaacauuacccauaguaucccugcaugcauuggugaugucaccgugaauagcaaacaacuggacaaggauuccccaguaucugcuuucacugugaaccgguguuaugccguugcccaggaaggcacauacuuugacgggucaggauaugcggcucucgucaaagagggcuacaaggugcagagcgaugugaauauaacccuggaguucagaacaucgucccagaacggugucuugcuggggaucaguacugcaaaaguugacgccauuggacucgagcuuguggauggcaagguacuguuucacgugaauaacggcgcugggaggaucacggccgcauaugagcccaagaccgccacagucuuaugcgacggaaaauggcacacucugcaagcuaauaagucuaaacaucgcaucaccuugauuguggaugguaacgcgguuggcgccgaaagcccucacacacagucaaccuccguggacacuaauaacccaauauacgucgggggauaucccgcaggcgugaagcagaaaugucucagaucucagacgaguuuccgggguugccugaggaagcuagcucuuaucaagagcccucaaguacaguccuuugauuucucacgugccuuugagcugcaugggguuuuccuccacagcuguccgggaaccgaaucuuga

SEQ ID NO: 58302 - RNA, 9369 nt, Artificial Sequence
  derived and/or modified sequence opt3 from LAMA2__Homo_sapiens__NP_000417
augccaggagcagcuggggugcugcuccuucuguuguuaagcggaggucugggagggguccaggcacagagaccucagcagcagaggcagucccaggcccaccagcagcggggacuguucccagcgguucucaaccuggcuucuaaugcccuuaucaccacaaacgcaacuugcggcgaaaaggguccggaaauguacuguaaacugguggagcacguacccgggcaaccugugcgcaauccacagugccgaauuuguaaccaaaauucaaguaaccccaaucagcgucacccuauaacgaacgccaucgacggaaagaauaccugguggcaaagcccauccauuaaaaacggcaucgaauaucauuacgucacaauuacuuuggaucuccaacagguguuucaaaucgcuuauguuauagugaaggcagccaauucucccagaccuggcaacuggauccuggagaggucgcuggacgaugucgaauacaaaccauggcaguaucacgcugugaccgacacagagugccucaccuuauacaauauuuauccgcggacugggcccccuucauacgccaaggaugacgagguaaucuguacuagcuucuacaguaagauucauccacuggaaaacggagagauccacauaucccuuauuaauggucgccccucugcggaugacccuagcccagaauugcuggaguuuaccuccgcaagauauaucaggcuacgguuccagcgcauucgaacgcucaacgccgaucugaugauguuugcucacaaagaccccagagagaucgauccgaucguuacuaggcgguacuauuacucagugaaggacauuagugucggcgggaugugcauauguuauggacaugcccgugcaugcccucuugaucccgcuaccaacaaaagccgcugugaaugcgagcacaauacauguggcgacucuugcgaccagugcuguccagguuuccaucaaaagccuuggagagccgggacuuuucugaccaaaacagaaugcgaggcguguaacugccacggaaaggccgaagaguguuacuaugaugagaauguggcaaggcggaacuugucccucaauauccgaggcaaguacauuggcgggggagugugcaucaacuguacccagaauacggcugguauaaacugcgaaacuuguacagacggcuucuuucgccccaaaggggucucaccaaauuaccccagaccuugccagccaugucacugcgauccgauuggaagccugaacgagguuugcgugaaggacgaaaaacaugccaggcggggcuuagcucccgguaguugucacugcaagaccggguucggcggaguaucuugugaucgcugcgccagaggcuauacuggguacccugacuguaaagcaugcaauuguuccggacuggguagcaagaacgaggauccaugcuuuggccccuguaucugcaaagaaaauguggaagggggagacuguucgaggugcaagucuggcuucuuuaaccuccaggaggauaauuggaaggguugcgacgaauguuucugcuccggggucucaaaccguugucaaaguagcuauuggacauacggcaaaauccaggauauguccggaugguaucuuaccgaccugccuggccggauucgaguggccccacagcaggacgauuuggacucuccccaacagaucagcauuucaaacgcugaggcgagacaggcacuaccgcauaguuacuauugguccgccccugcuccauaccuggggaauaagcuccccgccguuggaggucagcugacguucaccauaagcuacgaucuugaagaggaagaggaggacacagaaagggugcugcaauugaugaucauucucgagggcaacgaucugucuaucucaacugcacaggacgaagucuauuuacacccuagugaggagcauaccaaugugcugcuacucaaagaagagagcuuuacaauccacgggacucacuuccccguacgccggaaggaauuuaugaccguucuggccaaccuuaaaagaguguugcugcagauuacauacuccuucggaauggaugcuauauuuaggcucucuucggucaaucuggagagcgccguguccuauccaaccgacggcucaaucgcagcggcugucgaagugugccaauguccucccgguuacacugggaguucuugcgagagcuguuggccacgccaucgacggguuaacggcacgauuuucggaggcaucugcgagccgugucagugcuuugggcacgccgaauccugugaugacgugacaggagagugccuuaauugcaaggaucauaccggcgguccuuauugugacaagugccugcccggguucuacggagaaccaacuaaaggcaccucagaggauugucagcccugcgcauguccuuugaacauuccaagcaauaacuuuucucccacaugccaccucgaccguucccuggguuuaaucugugacggcugcccuguaggguauaccggaccgagaugugaaaggugcgccgagggcuacuucgggcagccaaguguccccggaggcagcugucaaccuugccagugcaaugauaaccuggacuuuucuauaccagguuccugugauucacuaagugggagcugccucaucuguaagcccggaacuacaggccgcuacugcgagcugugugcugacgguuauuucggcgaugccguggacgccaaaaauugccagccuugucggugcaacgcugggggaucguuuuccgaaguuugucacucucagacgggccaaugcgaguguagagccaaugugcaggggcagaggugcgauaagugcaaagcgggaaccuucggccuucagagcgcccgagguugugucccgugcaacuguaacucauucgggaguaaguccuuugacugcgaagagucuggacaauguuggugccagcccggcgugacugguaagaaaugugaucgcugcgcucauggcuacuucaauuuucaggaagggggauguacagcaugcgaguguagccacuugggcaacaauugcgacccaaagaccgggcgguguauuugcccucccaacacaaucggagagaaaugcuccaagugugccccaaauacuuggggccauucaauuaccacggguugcaaggcuuguaacugcagcaccguagggagucuggauuuccaauguaaugugaacacaggacagugcaauugucacccuaaguuuucuggcgccaagugcacugaauguuccagaggccauuggaacuaucccaggugcaaucucugugacugcuuccugccagggaccgaugcaacaacuugcgacagcgagaccaaaaaguguucgugcucagaccagacgggacaguguacaugcaaaguuaacgucgaagguauccacugugaucguugccgcccgggcaaguuuggguuagacgcgaaaaauccucugggauguucuaguugcuacuguuucggcaccacuacacaaugcuccgaggccaagggucuuauacggaccugggugacuuugaaagcugagcagaccauucucccccugguggaugaagcccuacagcacacaacgaccaaggggaucgucuuucagcauccagagauuguugcacacauggaccugaugagagaagaucuccaucuggagcccuucuauuggaaacuuccugaacaauuugagggcaagaaauugauggcuuacggcggcaaacugaaauaugccaucuacuucgaggcaagggaagagacuggguuuagcacauacaacccacaggugauaauccgaggagguacccccacacacgcccggauuaucgugcgccauauggcugcgccuuuaauuggccagcucacuagacacgaaaucgagaugaccgaaaaagaguggaaguauuacggggacgauccgaggguacaccggacggucacacgagaggacuuccuggauauacuuuaugacauucauuacauccugaucaaggccaccuauggaaauuucaugagacagucucgcauuagcgaaaucuccauggagguggcagaacaaggcagggguacuaccaugacaccacccgcugauuugauugagaaaugugacugcccucucggguacucaggacugaguugcgaagccugucuacccggcuuuuaucgucugcggagccagccaggcgggagaacuccuggacccacccucgguacaugcguuccaugucagugcaacggccacucuucccugugugacccugagacgucaauaugccagaacugucaacaucacaccgccggggauuucugcgagaggugugcucuuggauacuacggcaucgugaaggguuugccgaaugacugccagcagugugcaugcccccugauuaguagcuccaacaauuuuucuccaucgugcgucgccgaaggguuagaugacuaucgcuguacugcgugcccucgaggauacgagggccaauauugugaaagaugcgcucccggcuacacagggagcccaggaaacccugguggcucaugucaggagugcgagugugaucccuaugggucccucccggugccaugcgacccuguuaccggauucuguacuugccggcccggcgccacagguaggaaaugugaugggugcaagcacuggcaugcacgcgaaggaugggagugcguguuuuguggcgacgaaugcaccggccugcuucugggggaucuagcccgucucgagcagaugguaaugaguaucaaucugacgggaccauugcccgcuccuuacaaaaugcuguaugguuuagaaaacaugacucaggagcucaagcaucugcuuucuccgcaaagagcacccgagcggcugauucaguuggccgaaggcaaucucaacacccuggucacagagaugaaugaacuacugaccagggcgacuaaggugacagcugacggggagcagaccggacaggaugccgaacgcacaaacacucgagcaaaaagccuuggcgaguucaucaaggagcucgccagagacgcugaagccgugaaugagaaagcaauaaagcugaacgaaaccuuggguacgcgggaugaggcuuuugaaaggaaucuggagggguuacaaaaagagaucgaccagaugauuaaggaacuccgcagaaagaaccuggagacacagaaagaaaucgccgaggacgagcuugucgcggccgaagcacuguugaagaaaguuaagaaacucuucggcgaguccaggggagaaaaugaggaaauggagaaggaucugcgggagaaacuagcugacuacaagaacaagguggaugacgccugggaucugcuucgugaagcuaccgacaaaauucgcgaggcaaaucgacucuuugccguaaaccagaagaacaugacugcccuggagaaaaagaaagaggcuguggaaucaggcaagagacaaaucgagaauaccuugaaggaggggaacgauauauuagacgaagcgaauaggcuggcagaugagauuaacucuaucaucgacuacgucgaagauauucagacaaaacucccaccuaugagcgaggaacugaaugacaagauagaugaccuuagucaggagaucaaagaccggaagcuggccgagaaagugucccaagcugaaagccaugccgcacaguugaacgauucuucagccguucuagacggcauucuggaugaggcuaagaauaucuccuucaacgcgacugccgcauuuaaggcuuauaguaauauuaaagacuacaucgaugaagccgagaagguggcaaaagaggccaaggaccucgcucacgaagccaccaaacuggcgacggguccccgcggccuuuuaaaggaggaugcaaaggggugucugcaaaagagcuucagaauacucaacgaagccaagaaauuggcuaaugacgucaaggagaacgaagaucaucugaauggacucaaaacaaggaucgagaacgccgacgcucggaauggcgaucugcuucgaacccugaacgacacuuuggguaagcuaucggcaauuccuaacgacacagccgcuaagcugcaggccgugaaagauaaggcaagacaggcgaaugacaccgccaaagauguucucgcucagaucacugaguuacaccagaaccuggacgggcuuaagaaaaauuauaacaagcuggccgauucuguggcaaaaacaaaugcugucguaaaggacccauccaagaacaaaauuaucgccgaugcagacgccaccgugaagaaucucgaacaggaggcugaucgcuugauagacaaacugaagcccauuaaagaacucgaggauaaccugaagaagaauaucagcgaaaucaaagagcuuauuaaccaagcgaggaagcaggccaauucaaucaaaguuagugugucuuccggcggagacugcauacggacguacaagccugagauuaaaaagggcagcuauaacaauaucgucgugaacguaaagacugcaguggcugauaaucuacuguucuacuuggggucagccaaauuuauugacuucuuagccaucgaaaugcguaagggaaaagucaguuuucugugggacguugguagcggcguggggagaguggaguauccagaucucaccauagacgauuccuacugguacaggauugucgcaucucgcacaggacggaacggcaccaucagcgugcgagcucuggacggucccaaggccuccaucguuccgucaacacaccauucuacaaguccuccaggguauaccauucuugauguagacgcgaacgcuaugcuguucgugggcggacucacgggcaaauugaagaaggccgaugcagucagagugaucacauuuacuggguguaugggagaaaccuacuucgacaauaaacccauuggccuguggaacuuuagggagaaggaaggugauugcaaaggguguacaguuucgccucagguggaggacagcgagggaaccauacaguucgauggcgaagguuaugcccuagucucccgcccaauccggugguaccccaauauuucuacugugauguuuaaguucagaaccuuuucaagcuccgcucugcucauguaucuugcaacacgugaccugagggacuucaugaguguagaguuaacggauggccacaucaaagucucuuacgacuuggggagcggaauggccucagugguuuccaaccaaaaucauaacgauggcaaguggaaaaguuuuacucugagccggauccagaagcaggcgaauauuucuauaguggacaucgauaccaaccaggaagagaauauugcuacauccucaagcgggaacaauuucggacucgaccugaaggccgaugacaaaaucuauuucggcggucuuccgacccugcgcaaccucucgaugaaggcacgaccugaggucaauuugaaaaaguacucugggugccugaaagauauugaaaucaguagaacucccuacaacauauuauccagcccagacuaugugggaguuacaaagggcuguucacuagagaauguguacaccgucuccuuuccuaagcccgguuucguggaacugucuccaguacccaucgaugugggcacggagauuaaccucagcuuuaguacuaaaaacgaauccgggaucauucuucugggaagcggcgggaccccugcaccaccgaggcggaagcgcagacaaacaggacaggcuuauuacguuaucuugcugaauaggggccgacucgagguccaccugucuaccggugcccggacuaugcguaaaauagugauuagacccgagccuaaccuuuuccacgacgggcgcgaacauucagugcacgucgagaggacacggggaaucuuuaccguacagguggaugaaaauagacgcuauaugcaaaaccucacaguugagcagccaauugaagugaagaaacuguucgucggcggcgcacccccugaguuucagccaagucccuugaggaauaucccuccguucgaggggugcauauggaaccuggugaucaauuccguuccaauggacuuugcucgacccgugagcuucaagaacgccgacauuggacggugugcgcaucagaaguuaagagaagaugaggacggugccgccccugcugaaaucgucauucaacccgagccagugccuacucccgccuuuccaacgccgaccccuguacuaacacacggccccugcgcagcugaaucugagccagcccugcucaucgggucgaaacaguucggacuuucaaggaauagccauauagccauugcguuugaugacacuaaggugaaaaaccgccugaccaucgaguuggaaguucguacagaggcugaauccggccuacucuucuacauggcacggaucaaucacgccgauuucgcuaccguccagcugagaaacggucuucccuauuuuaguuacgacuuagggucuggagauacucacacgaugauuccuaccaagaucaaugacggccaguggcauaaaauaaagauuaugaggagcaagcaagagggcauccuguacguggauggggccuccaaccgcacaauuucacccaaaaaggcagacauccucgauguggucggaauguuguauguugguggccugcccauaaauuacacuacccgacggaucgggccugugacauauaguauugacggaugcguaagaaaccuacacauggccgaggcuccggcggaucuggaacagccaaccucuagcuuccaugugggcacuuguuuugccaacgcacagagggguacauacuucgacgggacgggauuugcuaaagccgucggcggcuucaagguggggcucgaccuucugguugaguuugaguuccgcaccacuacaaccaccggaguguugcuggguaucuccucacagaaaauggauggcauggggauugagaugaucgacgaaaagcucauguuucacgucgauaauggagcaggcagauucacagccguauaugacgcuggugugcccgggcaccugugcgauggacaauggcauaaaguuacugccaacaagauuaagcaccggaucgaguuaacgguggacggcaaucaggucgaggcgcagagcccuaacccagcaucuaccuccgccgauacaaaugaccccguguuugucggcggguucccugaugaccuuaaacaauuuggacugacuaccaguauacccuucagggguuguauucguagccucaagcuaacaaaaggcaccgggaagccacuggaagugaacuucgcuaaagccuuggagcugcgaggaguucagccggugucgugcccugcaaauuga

SEQ ID NO: 58303 - RNA, 5175 nt, Artificial Sequence
  derived and/or modified sequence opt3 from LAMA3__Homo_sapiens__NP_000218
augccuccagccgugaggaggagcgcuugcuccaugggcuggcuguggaucuucggggcagcccucggacagugucuugguuacucuucacaacagcagcgggucccauuucugcagccgcccggccaaagucaguugcaggcgagcuauguugaguuccgcccuucccaggggugcucuccaggauacuaucgagaccacaagggcuuauacaccggucguugugugcccugcaacuguaaugggcauucgaaccaaugccaggauggaucaggcauuuguguaaauugccagcacaacacagcuggcgagcauugugagagaugccaggaaggguauuacggaaaugccgugcacgguagcuguagggcaugcccuugcccacauacuaacaguuuugccacgggcugugucgugaaugggggagacguucggugcuccuguaaagcuggcuauaccgguacacaaugcgagcgcugugcacccggguacuucggaaacccucagaaguuuggcggcucuugccagccauguagcugcaauuccaacgggcaacugggaucaugucacccguuaacuggugauugcauaaaucaggaacccaaagacaguagcccugccgaggagugugaugacugcgauucuugcgugaugacccuccugaacgaccuugcuacaaugggcgaacagcugagauuggucaagucccagcuccaagggcugucagccagcgcgggacugcucgagcagaugaggcacauggaaacccaggcaaaagauuuacggaaucagcugcuuaacuaccgcagugccaucucuaaucauggcuccaagauugaggguuuggagcgagaacugacugaccugaaccaagaguucgaaacacuccaggagaaggcucaggugaacagcagaaaagcccagacccugaauaacaauguaaacagggcaacgcaaucggcuaaggaacuugauguuaaaaucaagaaugugauucggaacguccacauccuguugaaacagauaucugggacugacggcgagggaaauaacgugccauccggcgauuuuucacgugagugggccgaagcgcagcgcaugaugagagagcucaggaaucggaacuucgggaagcaucugcgagaagccgaggcagacaagcgcgaaagucaguuacugcucaauagaaucaggaccuggcaaaagacucaccagggagagaacaauggucuugcuaacagcauucgggacucccugaaugaguaugaagccaaguugucugaucuacgcgcuagacugcaggaggccgcagcccaagcuaaacaggcgaacggccucaaccaggaaaaugagagggcacugggggccauccagcgucaagugaaggaaauuaacagccuucagucagacuuuacuaaauaccugaccacagcugauaguuccuugcuccagaccaauaucgcccugcaguuaauggaaaagagccaaaaagaguaugaaaagcuggcagccucucuaaacgaggcucggcaggaacucucagacaagguccgagagcugaguagaagcgccggaaaaacgucccuuguugaggaagcagagaagcacgcgaggucuuugcaggaacuggcuaaacagcucgaggaaauaaagcgcaaugccucgggcgaugagcuggugcggugugcaguagacgccgcuacugccuacgagaacauucuuaaugcaaucaaagcugccgaagaugcggccaacagagcugcaagcgccuccgagucagcucugcaaacagugauuaaggaagacuugcccaggaaggccaaaacccucaguucuaauagcgauaagcuguuaaacgaggcaaaaaugacucagaagaaacugaagcaggaagucuccccugcgcuaaauaaccuccaacagacacugaauaucgugaccguucagaaggaggugaucgacacgaaccuuaccacauugcgcgauggucugcaugggauucagcgaggcgacauagacgccaugaucucaagcgcuaaaucuaugguccggaaggccaaugauauuacugacgaggugcucgauggacugaacccaauccaaaccgacguagaacguauaaaagauacauauggcagaacucagaacgaggacuucaagaaagcauuaaccgaugcugacaauuccguuaacaagcugacaaauaaacuucccgauuuguggaggaaaauugaaaguaucaaccagcagcuccugccgcuagggaauaucagcgacaacauggaucgcauucgggagcugauccaacaggccagagacgcagccucuaagguggcugucccuaugagguuuaauggaaaauccgguguggaaguccgacuccccaacgaucuggaggaccuuaagggcuacaccucauugagucuguucuuacagcgcccaaauagccgggagaacgggggaacugaaaauauguuugugauguaucucggcaacaaagacgcgucgagagauuacauugguauggccguuguggacgggcagcugacgugcguauacaaucuuggcgauagggaggcagaacugcaagucgaccagauauugacaaaguccgagaccaaagaggcugugauggaucguguuaaguuccagcgcaucuaucaguucgcccggcucaacuacacuaagggagccaccucuagcaaaccugaaacacccggcguguaugacauggaugggagaaauucaaacacccugcuaaaccuggacccagagaaugucguguuuuacguaggaggcuaucccccugauuucaagcucccaaguaggcuguccuuuccgcccuacaaagguuguauugaacuugacgauuugaacgagaaugugcugucuuuauauaacuucaagaaaacuuuuaaucucaacacaacggaaguugagccuugccgacggcgcaaggaggaaagcgacaagaauuacuucgaggggaccggauacgcuagagucccaacucaaccccacgcaccuaucccaacauuuggccagaccauccagacaacuguggauaggggucugcuuuucuuugccgaaaacggcgaccgguucauuucccugaauauagaggacgggaaacuaauggugcgauauaagcucaacucagaacugcccaaagagagaggagucggcgaugcgaucaauaacgggcgcgaccauagcauucaaaucaagauuggaaaauugcagaagaggauguggaucaauguugaugugcagaacaccauaaucgacggcgagguguuugauuucaguacguacuaucugggugggauuccgaucgcuauucgugaacgguuuaauaucucuaccccugccuucagaggauguaugaagaaccuaaagaagacauccggcguagucaggcucaaugacacuguggguguuaccaaaaagugcagcgaggauuggaaacuggugcgcucggcaucauucucucgaggcgggcagcuuaguuuuacagaccugggauugccacccacugaucaccuccaagccuccuucggcuuucagaccuuccagccuagcgggauacugcuagaccaucagacguggacaagaaaccugcaagucacccuugaagauggauacauugagcucucuacuagcgacuccggcggucccaucuuuaagucaccacagacauauauggacgggcuguugcacuacgugaguguuauuagcgauaacucuggacugcgguuacucaucgacgaucagcugcuuagaaauuccaagcgccugaaacacauaucaaguagccgucaguccuugagacucggcgguucuaacuucgaaggcuguaucucgaauguguuuguacaacggcugagccuaucaccugagguccuggaccuuaccuccaacagucucaagagggaugugucucuagggggaugcagcuugaauaaacccccauucuuaaugcugcucaagggcuccacucgcuuuaacaaaaccaagacauuccgaauuaaucagcugcuucaggacacgccgguggcuucaccuagaucugucaaaguuuggcaagaugcauguagcccccugccaaagacccaggccaaccauggggcguugcaguuuggagacauccccacaagucaccuacuguucaagcucccucaggagcugcuuaaaccacggucccaauuugcuguggauaugcagacaaccagcucuaggggcuuaguauuccauacagguacuaaaaauucauucauggcccuguaucucuccaaagggcgcuugguguuugcacugggaaccgacggcaagaaacucagaauuaagaguaaggaaaaaugcaacgauggcaaguggcacacggucguguucgggcacgacggagagaaagguaggcugguuguggauggccuucgggcccgugaagggagccugcccggaaauucgacaaucucuauacgcgcuccugucuacuugggcuccccgccaagcgguaagcccaaaucacuaccuaccaacaguuuuguggggugucugaagaauuuccagcucgacucuaagccauuauacacucccuccagcucauuuggaguuaguagcugccugggcggcccucuugagaaagggauuuauuucuccgaggaaggaggucaugugguccuggcccacucuguacucuugggcccggaguuuaagcugguguucagcauccgacccagaucccucaccgggauccugauucauaucggaucacagccaggcaaacaccuuugcguuuaccuagaagcagguaaggugacagcuucuauggacaguggggccggaggcacuucgaccagcgucacaccuaaacaaucccugugugauggccaguggcauucuguggcgguaacgauuaagcagcacauauugcacuuagagcuggacaccgauucaagcuauacugccgggcagauccccuuucccccugcauccacacaagaaccccuccaucugggaggugcuccagccaaccuuaccacucugaggauuccgguguggaagaguuucuuuggcugccuccggaauauccacgucaaccauauuccuguucccgugacagaggcuuuggaggugcaggggccagucucucugaacggaugucccgaccaguga

SEQ ID NO: 58304 - RNA, 5472 nt, Artificial Sequence
  derived and/or modified sequence opt3 from LAMA4__Homo_sapiens__NP_001098676
auggcccugagcuccgcuuggagaucugugcucccccuuuggcuguuguggucagcagccugcaguagggcggcuagcggcgacgauaacgccuucccuuuugacaucgagggguccucugcagucggacggcaggauccaccggaaaccucggagccccgcguugccuuaggucgacugccuccagcugcagaaaaguguaaugccggcuucuuucacacauuaucaggggagugcgugcccugugacugcaacggaaauagcaacgaaugucucgauggcagugguuauugcguacauugucaacguaauacuacgggggagcacugcgagaaaugucuggacggauauauuggcgauuccauaagaggcgcuccucaguucugccagccaugucccugcccucuuccacaucuggccaacuuugcggaaucuugcuacaggaagaauggggcagugcgguguaucugcaacgagaauuaugccggaccgaacugugaacgcugcgcucccgguuacuauggcaauccuuugcucauugggagcaccuguaaaaagugcgacuguuccggaaacucagauccaaaucugaucuucgaggacugcgaugaggucacaggccaguguagaaacugccugaggaauacuaccgguuuuaaaugugaacggugcgcccccggguacuauggagacgcacgcauugcuaagaacugcgccguguguaacugcggcggcgggccuugugauaguguuacaggagagugccucgaagaggguuucgaaccacccaccggcauggacuguccgacuaucagcugcgacaagugugugugggauuuaacagacgaucugcgacuugcggccuugucuauagaggaggggaaauccggaguccugucagugagcaguggcgcagcugcccacagacauguaaaugaaaucaacgcuaccauuuaccuacucaagacgaaacugucugagagggaaaaucaauacgcccuucggaagauccagauuaacaaugcagagaacacuaugaaaucccuguugagcgacguugaggaacucguggagaaggaaaaucaggccucgcguaagggucagcugguccaaaaagagucuauggauaccaucaaccacgcuucccaguuaguggaacaggcgcacgacaugcgcgauaagauacaggagauuaauaacaaaaugcuguauuacggggaggaacacgagcucucaccuaaggaaaucagugagaaacuugugcuggcacaaaagauguuggaagagauuagaagcaggcagcccuuuuucacacagcgggagcuagucgacgaagaggccgaugaggcuuaugagcugcucucccaagccgaaucuuggcagcgacugcacaaugagacucgcacccuuuuuccaguugugcuggagcaguuggacgauuacaacgcaaaacucagcgaccugcaggaagccuuagaccaagcucugaauuauguaagagaugccgaggacaugaacagggcaacagcggcucggcagcgcgaucaugaaaagcagcaggagagagugagggaacaaauggaggucgugaauaugucacuaaguaccuccgccgacagccucacgacuccucgucugacacuuucugaguuggaugacaucaucaagaacgcaucaggcauuuacgccgaaauagauggagcuaaaagugagcugcagguuaagcucagcaaccuguccaaucuuucucacgaccuggugcaggaagccaucgaucacgcacaggacuugcaacaggaggcuaacgaacucucgcggaaacugcauagcuccgauaugaauggcuuaguccagaaggcccuggacgcgucaaacguguaugagaauauuguaaacuacguuagugaggccaaugaaaccgcugaguucgcacuaaacacuacagaucgaaucuacgacgccgugucugggauagacacccagauuaucuaucacaaagaugaaagcgagaaucuccugaaccaagcuagagagcuucaggccaaggcagaauccucaagcgacgaggcggucgccgauacgucuaggcgcgugggaggugcuuuggcccggaaguccgcacugaaaaccagacucagugacgcugucaagcagcugcaagccgcagaaaggggcgaugcccagcagcgcuuagggcagagccgacugaucacagaggaagcuaaucggacuaccauggaggugcaacaggcgacagcccccauggcaaacaaucuuacuaacuggucucagaauuugcagcauuuugacuccucagcuuacaacaccgccguuaacagugcccgugaugcugugagaaaucucacagagguagucccacaacugcuagaccagcugaggaccguggaacagaaacgccccgcaagcaacguuucggccuccauucagcggaucagagagcucauugcgcaaacuaggucuguggcuagcaagauacaggucucaaugauguucgauggacagagugccguggaaguacacucccgaacgucuauggacgaucugaaagcauucacaagccuuuccuuguauaugaagccuccagugaagcgcccggagcugaccgaaacugccgaccaauuuaucuuauaccucggcagcaagaaugcuaagaaagaguauaugggucuggcaauuaagaacgauaaucuuguuuacgucuauaaccuggggaccaaagacguggagauccccuuggacagcaagccugugaguucuuggccagccuacuucuccaucgucaagauugaacggguuggcaaacauggaaagguguuucucacagugcccagccugucgucaaccgcggaggaaaaauucauaaagaaaggcgaguuuucuggggaugacagucuacuggaucucgacccugaagauacuguauucuacgucggaggugugccauccaauuuuaagcugcccacaagccuuaacuugccgggcuucguugggugccuggaguuagcuacgcucaauaacgacgugaucucucuguauaauuuuaaacacauuuacaacauggauccuagcaccuccgucccaugugccagagacaaacuugcauucacucagucaagggccgcuaguuacuuuuucgauggaagcggcuacgccgugguucgugacaucacacgccgggguaaguuuggacaggugaccagauucgauauugagguaaggacacccgcagacaauggccugauccuacucauggucaacggaucuauguucuuucgacuggaaaugcggaauggcuauuugcacguguucuacgacuuuggguucuccggaggcccugugcaucuggaggauacucucaaaaaggcucagauaaacgacgccaaauaucacgaaaucucaauuaucuaccauaacgauaagaaaaugauucuagucguugaccgcagacacgugaagaguauggauaaugagaagaugaaaauccccuuuaccgacauauacauugguggggcgccaccugagauccugcaaagcagggcccuucgggcacaucugcccuuggauauuaacuuccgaggaugcaugaagggcuuucaguuccagaaaaaggacuuuaaucuccuggaacagacggagacccuagguguaggcuauggguguccagaagauucccugaucucuagacgcgcuuacuucaacggacaaucguuuauagccagcauccagaaaauuucauucuuugacggcuucgaaggcggguucaauuuuaggacacuucagccgaacgggcuccuguucuauuacgcuuccgguagugauguguuuucuaucagcuuggacaaugggacugucauuauggaugugaagggaaucaagguucaguccguggacaaacaauauaacgacggccugucacauuucgucauaucuagcgugaguccuacccguuacgaauuaauuguugauaagucccggguggguagcaaaaaucccacaaagggcaaaaucgagcagacucaggcaucugagaagaaguuuuauuucgggggaucaccaaucuccgcccaguacgccaacuuuaccggcugcauuaguaaugcuuacuucacgagagucgacagggauguagaaguggaggacuuucaacgcuauacagaaaaaguucacaccagccucuacgagugccccaucgaaucgucuccucuguuccuucugcauaagaaagggaagaacuuguccaaaccaaaggcgagccagaauaaaaagggaggcaagucaaaagaugcacccaguugggacccuguggcccucaagcugccggagcgaaacacuccaagaaauucucacugucaucuauccaacagcccccgggcuauugagcacgccuaucaguacggugggacagcaaauucaaggcaagaauuugagcaccugaaaggagauuucggcgccaagagucaguucagcauacgccuucguaccagauccucucaugguaugaucuuuuaugucagcgaccaggaagagaacgauuucaugacucucuuucuggcucacggccgguugguguacauguucaacguagggcauaaaaaguuaaagauuaggucccaggaaaaauauaaugacggacuguggcacgaugugaucuuuauucgcgagcgaucaucuggcagacucgucaucgacgggcugcggguucuugaggaaagucugccuccaaccgaggcgacauggaagauaaaaggacccaucuacuugggcgguguggccccugggaaggcagugaaaaacguccaaauuaauucgaucuacagcuucuccggaugccuaucuaaccugcagcucaauggcgcuucaauuacgagcgccucccagaccuuuagugugacuccguguuucgaaggccccauggagacagggaccuauuuuucuacagagggagguuacguuguacuggaugaaucauucaacaucggccuuaaguuugagauagcauucgaagugaggccacgcucauccagugggacuuuaguccauggacacagcgugaauggcgaguaucugaacguucacaugaagaauggucaggugauugucaaagugaacaaugggaucagagacuuuucuaccuccguaacgccuaagcaaucacucugcgacggaagguggcaucggaucacagucauucgugauagcaacgugguucaguuggacguggauucggaagucaaucacgugguuggcccccugaacccaaaaccuauagaccaucgcgagcccguguucgucggcggggugccagagucucuccugaccccgcgacuugccccuaguaagcccuucacuggauguaucagacacuuuguaauugauggucacccaguguccuucagcaaagcugcccugguuucaggcgcggucuccaucaauucuugccccgcagccuga

SEQ ID NO: 58305 - RNA, 11088 nt, Artificial Sequence
  derived and/or modified sequence opt3 from LAMA5__Homo_sapiens__NP_005551
auggccaagaggcugugcgcuggcagcgcccucugugugagggggccccggggaccugccccacuucuguuggucgguuuagcgcuguugggcgcugcccgcgcacgagaagaagccgggggaggcuucucccuccacccgcccuacuuuaaccuggcugagggugcacguaucgccgcuucugcaaccugcggggaagaggcgccugcaagaggaucaccaaggcccaccgaagaccuuuauuguaaacugguuggcggcccuguggccgggggagauccaaaucagacuauucggggucaauacugcgacauauguacggcugccaacagcaauaaggcacaucccgcuagcaacgccaucgauggcaccgagcgcugguggcaguccccuccauugucuagagggcucgaguauaaugaaguaaacgugacacuggaccugggacaggucuuccacguggcguacguucucauuaaauuugccaauucgccgaggcccgauuuaugggugcuggagcggucaauggacuucggccgcacuuaucagccuuggcaauuuuucgcaagcaguaagcgagauugccuugaaagauuugguccacagaccuuggagaggaucacacgggacgaugcugccauuuguaccacugaguacucccguaucgucccccuggaaaacggggagauagugguaucucugguuaauggacgcccuggcgcuaugaacuucagcuauuccccacuccugagagaauuuacaaaagccaccaaugugaggcuucgguuccugcgaacgaacacuuugcucggccaucugauggggaaggcauuacgcgaccccaccgucacaagaagguacuacuauucaaucaaggauauuaguaucggaggucggugcgugugucacggccaugccgacgcuugcgaugcgaaagacccgacugacccuuuucgccugcaguguaccugccagcacaauacaugcgggggaaccugugauagaugcugucccggcuucaaccaacagccauggaagccugcaacggccaauagcgcuaacgagugccagucuuguaacugcuacggucacgccacugacuguuauuacgaucccgaaguggacaggcgucgggcaucccagucacucgaugggacauaucaaggcggaggcgucugcauugacugucagcaucacaccacugggguuaauugcgagcgaugucuuccaggauuuuacagaagccccaaccauccucuggauaguccacacgugugcaggcgcugcaauugugagucugacuucacagaugguaccugcgaagacuugacgggccgguguuauugcagaccgaacuucuccggggagaggugugauguaugcgccgaaggauuuaccggcuuccccagcuguuacccuacaccaucgucuuccaaugacacucgcgaacaagugcuacccgcuggucaaaucgucaacugcgacuguucagccgcagggacccagggcaaugcgugccgaaaagauccucgggugggacguugucugugcaagccaaacuuucagggcacacacugcgaacucugugcucccggguucuacggaccggguugccagccuugucaaugcaguagcccaggcguugccgacgauagaugugaccccgauacugggcaguguaggugccgcgugggauuugagggcgcaaccugcgaccggugugccccugguuauuuccauuuuccccugugccagcuuugugggugcuccccagcuggcacacugccugagggaugcgaugaagccggcagauguuugugccagcccgaguucgcagggccacacugugacaggugccgaccgggauaccauggcuuuccuaauugucaggcuugcaccugugauccccgcggugcccucgaccagcugugcggggcgggaggcuuaugucggugcagaccagguuauacuggcacggccugucaggaaugcucucccggguuccacggauuuccuagcugcgucccaugucauugcucagcugagggcagucugcacgcagccugugaucccagguccgggcagugcagcugucguccucgcgugacaggacuacggugcgacaccuguguaccgggcgcuuacaacuucccauauugcgaagccgguucuugucaccccgcagggcucgcgccuguugauccagcccugcccgaggcucaagugccuugcauguguagagcccaugucgagggaccgucaugcgacaggugcaaacccggcuuuuggggucuuaguccaagcaauccugaaggcuguacucgaugcuccugugacuugcgggggacccugggaggcguggcagagugccagcccgggacaggacaguguuucugcaagccacacgucuguggccaggcuugcgccucuuguaaggaugguuucuuugggcucgaccaagcagauuacuucggaugccgcucguguagaugcgacauaggcggugcccugggccagagcugugaaccuaggaccggggugugccggugccgacccaacacucagggaccaacauguuccgagccggcuagagaucauuaucuuccugaccugcaccacuugcgccucgagcuggaagaggcggccacgcccgaaggccaugcaguuagguuuggguucaauccauuagaguuugaaaacuucucauggcguggauacgcucaaauggcccccgugcagccucggauuguagccagacugaaucuaaccaguccagaucucuuuuggcuggucuucagguacgugaaccgcggcgcuaugucuguuagcggucgaguguccgucagagaggaggggcggucagcaacuugcgccaacuguacagcgcagagccagcccguggcuuuuccuccgucuaccgaaccagccuucaucacaguaccccaaaggggauuuggcgagccuuucgugcuuaaucccggcacuugggcauugcgcguugaagccgaggggguccugcucgacuauguggugcuguuaccauccgcuuacuaugaagcagcccugcuucaguugcgugucaccgaggcgugcacguacagaccuagugcucagcagagcggagauaacugucuccuguauacccaccuaccccuggacgguuuuccaucugccgcaggccucgaggcccugugccggcaagauaauucccuuccuaggccgugucccacagaacaguugucaccaagucauccuccccugauuacuugcaccgggagcgacguugaugugcaguuacagguggcuguaccacaaccuggacgcuacgcccucgucguggaguaugcaaacgaagacgcucgacaggagguuggcguggccguccacacaccccagagagcgccgcaacagggucugcuuucgcugcauccauguuuguacuccacucucugccgggggaccgccagggacacgcaggaucaccuggcaguguuccaccuagacucugaagcuagcguucgccugacagccgagcaggcuagauucuuucuccauggagugacccugguaccuaucgaggaguucucacccgaguuugucgaaccaagggugaguuguaucuccucucacggcgcauucggccccaauagcgccgccugccuuccuucccgguuuccgaaacccccacaaccuauuauauugcgugauugccaggugaucccccugccuccaggguuaccccucacucaugcucaggaccugacaccagcgaugucaccagcaggaccccgcccgcgaccuccaaccgccgucgaucccgacgcugagccuacucuucugagagagccacaggccaccguuguguucacaacgcacguacccacccuagguagguacgcauuucuccugcauggcuaucaaccggcccacccuacuuuccccguggaagucuugauuaacgcugggcggguguggcagggacacgcgaaugccagcuuuuguccacauggcuacgguugccgcacacugguugugugugaggggcaggcauuacucgaugucacccacagugaacugacagugacuguuagagugccuaagggaagguggcuuuggcuggacuaugucuugguagugcccgagaacguuuacucuuucggcuaucuccgggaagaaccacuggauaaauccuacgacuuuaucagccauugcgcugcccagggcuaucacauaucgcccucaucuaguucccuauucugucgaaaugcagccgcuagccugucucuuuucuacaacaauggggccagaccuugcggaugucacgaggugggugcgaccggcccaacgugcgaaccguuugggggacaaugucccugccaugcacacgucauuggccgcgauuguaguaggugcgccacagguuacuggggguucccuaacugccggccaugugacugcggagcucgucucugugacgagcugaccggccagugcaucugucccccuagaacuaucccacccgauugcuugcugugucagccucagaccuuuggcugccauccguuaguggggugugaagagugcaauuguuccggaccagguauucaagaacucacagaccccacuugcgauaccgacucaggccagugcaaguguaggccuaacguaacagggcgccggugcgauacguguagucccggauuccacggcuauccacgaugcagaccuugugacugccaugaggccgguaccgcucccggggugugugauccacugacuggacagugcuacuguaaagagaauguccaaggcccgaagugcgaccaguguagccuuggcacauuuucucuggaugcagccaacccuaaagggugcaccaggugcuucuguuuuggagcuacugaacgcugccgguccucaaguuauacaagacaggaguucguugacauggaagguuggguguugcucagcaccgaucgucagguggucccccacgagaggcaaccaggcacggaaaugcugcgggccgaccuacgccacgugcccgaggcaguuccugaggcguuuccagaacuguacuggcaggcacccccuuccuaucuuggggaucgaguaucuucguacggaggcacucucagauaugagcugcauagcgaaacccagaggggugacguguucgucccgauggagucacggccagacgugguuuugcaggggaaccaaauguccaucacauuuuuagagcccgcuuacccuaccccaggccacgugcaucgcggacagcugcagcucgucgaaggcaauuucagacacacugagacaaggaacaccgugagucgagaagaacugaugaugguacuugccucucuggaacaguugcaaauucgggcacuauuuagccagauauccucagcugucuuccugcguagaguggcccucgagguugcaucucccgccgggcagggagcucuggcgagcaauguggagcuuuguuuaugcccugccaguuaccgcggugauuccugucaagaaugcgcacccggcuucuauagggacgucaaggggcuguuucucggacggugugugccaugccagugucacggccauagcgauagaugcuugccggguucugggguuuguguggacugccagcacaacacagagggcgcucauugcgaacgcugucaggccggauucgucucauccagggaugacccuagugcccccugcgugagcuguccaugcccucugucgguacccucuaauaacuuugcagagggcugugugcuccgagggggacggacucaaugccuguguaagccagguuacgcuggcgccuccugcgaaagaugugcgccuggguucuuuggaaauccccuuguucugggcagcucaugccagccgugugauugcagugguaacggggacccaaauuugcuauucucugauugcgacccucugaccggcgcuuguaggggaugccuccgccacacgacaggcccccguugugagaucugcgccccaggguuuuauggaaacgcauuacugcccggcaauuguacccggugcgauuguacuccuugcgguaccgaggccugugacccgcauuccgggcacugccuuuguaaagcuggagucacaggcagaaggugcgaucgcugccaggaaggucacuucggcuuugacggguguggaggcugccgaccaugugcaugcgggcccgccgcggagggaagcgaaugucauccucagucaggccaaugccacugucggcccgguacuauggggccacagugcagagagugugcuccuggauacuggggccugcccgaacaggguugcaggcgcugucagugcccaggcgggagaugcgacccucauaccggacgguguaacugcccgcccggccucaguggggagaggugugauacgugcagccaacagcaccaggugccagugccuggaggccccgucggucacuccauucauugugagguaugcgaccacugugugguuuugcugcucgaugaccuggaacgugccggggcacuucuaccagccauccaugagcagcugcgaggaaucaaugcuucuagcauggccugggcacgcuugcacagauuaaacgcuuccauugccgaucugcaaucacagcuccggucuccucugggccccaggcaugaaacagcgcagcaacuugaggugcuggagcagcagaguaccucgcucggccaggacgcccgcagauugggcgggcaagcagucgguacucgggaucaggcuagccagcugcuagccggcacagaagcaacccuggggcacgcuaagacucuccuugccgccauaagggcgguggaccgaacacuguccgaguuaaugucucagaccggacacuugggccuggcuaaugcaucagccccgagcggugaacaacuccugcguacgcuugcugagguugaaagacugcucugggagaugcgcgcccgggauuugggggcaccacaggccgcugcggaggccgaacuggcagcugcccagagguuacuagcaagagugcaggagcaacuguccagucucugggaagagaaccaggcccuugcuacucagacccgcgaccggcuggcccaacaugaagcgggauugauggaucugagggaggcacucaaccgagccgucgacgcuacaagagaggcccaggaacuaaauucucggaaccaggagaggcuugaagaggcacuccagcgcaaacaagaacugagccgugacaaugcuaccuugcaggccacacugcacgcugccagagauacuuuagcaucaguguuccgacuacugcauucccucgaccaggcgaaggaggagcuugaaaggcuggccgcuaguuuggauggcgcccggaccccucugcuccagcgcaugcaaacguuuagccccgcaggcucuaaacugagacuuguagaggcugccgaagcacacgcccagcaguuagggcagcuggcgcucaacuuguccucaaucauucuggacgugaaucaagauaggcuaacacagcgggcuaucgaggccagcaacgcauauucgcgcauucugcaggccguucaagcugccgaggacgcagcuggacaggcccuccagcaggcggaucauacuugggcuaccgucgugagacaaggucuuguggaccgagcccagcagcuguuggcaaauucuacagcccuggaagaggcuaugcuccaggaacaacagaggcugggcuuagucugggcagcccuucagggggcgcggacccagcugcgugauguucgcgccaagaaggaccaacucgaggcucacauccaggcagcccaggcuaugcuagccauggauacugacgaaaccaguaaaaagauagcacacgcuaaagccguggcggccgaggcacaggauacagcuacgagaguacaaucccagcugcaggccaugcaagagaacguggaaagguggcagggacaguacgagggcuugcggggucaggaccuggggcaagcaguccucgacgccggacauagcgugucaacucuugaaaagacccugccacaguugcuggcuaaacucuccaucuuagagaauagaggcguucacaacgccucucuggcgcuuagcgcuaguauuggccgcgugcgagaacugaucgcacaggccagaggggcugccuccaaggucaagguacccaugaaauucaauggacggagcggugugcagcuaagaacaccucgugaucucgcagaccuggccgcuuauaccgcguugaaguuuuaccugcaaggccccgagccagagccugggcagggaacugaagaucgcuucguuauguacaugggcucuaggcaggccacaggugacuauaugggggugucacuccgggauaaaaagguccauuggguguaccagcuuggagaggcaggcccggccguccugaguauugacgaagauaucggcgagcaauucgcugcaguguccuuagacagaacccugcaguuugggcacaugagcguuacgguggaacgacagaugauacaagagacuaaaggagauacaguagcccccggugcugagggcuugcucaaccugaggccagacgauuucguguuuuaugucgggggauacccuucuaccuucacacccccaccucuacuucgcuuucccggcuaucgggguugcauugaaauggacacucugaaugaggaaguugugucgcucuacaacuucgagagaacauuucagcuggacaccgccgucgauaggccgugugcgcgcucaaagagcacaggggacccuugguugacugauggauccuaucuggacggcacgggcuucgcacguaucaguuuugauucucagauuagcaccacaaagcgguucgagcaggaacucagacuuguguccuacucagggguacuguuuuucuuaaaacaacagagucaguuucugugcuuggccgugcaggagggaucucucguucugcuauacgacuucggugcuggccuuaagaaagccgugccacugcaacccccuccaccccucacuagcgcauccaaggcuauccaggucuuccugcuagggggaucacgaaaaaggguguuaguccgcguggaacgggccaccguuuauagcguagagcaggauaaugaccuggaacucgcggaugccuacuaucuuggcggugugccuccagaccagcugcccccgucucuaagaaggcuguuuccuacagggggauccguccgcggcugugugaagggcauaaaagcucucgggaaguacguugauuugaagagacugaacaccacuggagugagugcagguugcacggccgaccuucuggucggccgggcuaugaccuuccacgggcauggauuucuccgauuagcacugagcaauguggcccccuugacaggcaacguauauucggguuucggguuucacuccgcucaagauucugcccugcucuacuauagggcaucaccagacggccuuugccaggugagccugcagcagggacguguuagucuacaacugcucagaacugaggucaaaacccaggccggcuucgcggacggggcuccccauuacguggccuuuuacuccaacgcaacaggagugugguuguaugucgaugaccagcugcaacagaugaagccucaccgggguccacccccugagcuucagccacagccggaaggacccccucgccuguuacucgggggacugccagagucuggcaccaucuacaauuucagcgguuguauuucaaacguuuuugugcaaagguugcuggggccccagcgaguauucgaucuccagcagaaucuuggcuccgugaacgucaguacuggaugcgccccugcucugcaagcccagacaccaggccuagggcccagaggacugcaggcaacggcucggaaagccagccgcaggucuagacagccggcgcggcauccugcauguaugcucccaccccacuugcguaccacucgcgacucauaucaauuugguggcucccugagcucucacuuagaguucguggggauccuugccaggcaucgaaauuggccuagucugucgaugcacguucuccccagauccagccggggacuguugcuguuuacagcuaggcuccgcccaggcucaccgucucuugcccuguuccuaagcaacggucauuucguggcucagauggagggccuggggaccagauuacgggcacaguccaggcaacgcagucgaccuggaagauggcacaaggucucagugcguugggagaaaaaucggauucuccugguaaccgauggcgccagggcguggucucaggaggggccccaccgccagcaucagggagccgagcacccacaaccccauacauuguuuguuggcggucuuccugcuagcucccacaguagcaagcugccagugacugucggguucuccggaugcgugaagagacuccggcugcauggcaggcccuugggugcaccuacgcgaauggccggcgugaccccauguauccuggggccgcuagaagcuggacucuuuuuccccggcucugggggagucauaacacuugaccugccuggcgccacuuuaccagauguuggucuggagcucgaagugagaccccuggcaguaaccggguugauuuuucaccuuggacaggcccgcacaccuccauaccugcagcuccaggugaccgagaaacaaguccugcuacgggcugacgauggcgcgggugaguucucaacuagcgugacgaggcccucgguuuugugcgacggccaguggcaccgucuggccgugaugaaguccgggaacguccucagacuugagguggaugcacagaguaaucauacaguaggaccucuguuagcugccgcagccggcgcuccggcgccccuguaucucgggggacugccagagccuauggccguucagcccuggccuccugccuacuguggcugcaugcgcagguuggcugugaaccggucucccgucgccaugacccgaagcguggaaguucacggugccgugggggcuucaggauguccagcagccuga

SEQ ID NO: 58306 - RNA, 5361 nt, Artificial Sequence
  derived and/or modified sequence opt3 from LAMB1__Homo_sapiens__NP_002282
augggccugcuccagcuucuggccuucagcuuuuuggcuuuaugccgggcaagggugcgggcccaagagcccgaguucuccuacgggugcgcggagggaucuugcuauccugcuaccggugaccugcuaaucggccgcgcccagaagcucucagucacgaguacuugugggcugcacaaaccagaaccguacugcauuguuagccaucuucaggaggauaagaaauguuuuauaugcaacucccaggaccccuaucacgaaacucugaauccugauucucacuugaucgagaacgugguaaccacauucgcaccaaaucgacucaagauuugguggcaaucggagaacggaguggaaaaugucacuauccagcuggaccuggaggccgaauuucacuucacccaucucauuaugacauuuaaaaccuuccgucccgcugcaauguuaaucgagagaucaagcgauuuuggcaagacuugggguguguacagguauuucgccuacgacugugaggcuaguuuuccugggauauccacaggaccaaugaagaaaguugaugacaucauuugcgauucucgguauagcgacaucgaacccuccaccgagggcgaagugauuuuccgcgcccuggauccugcguuuaagaucgaggacccauacucaccgagaauacagaaccuuuugaaaauuacgaaucugaggaucaaguucgucaaacuacacacucucggcgauaaccugcuugacagucggauggaaauucgcgagaaguacuauuacgcaguguaugacaugguaguucgagggaauuguuucugcuacggacacgccagcgagugugcucccguggaugguuuuaacgaagaggucgaaggcauggugcaugggcacugcaugugcagacauaauaccaagggacugaacugugaguugugcauggacuucuaucacgaucucccuuggaggccagccgaaggcagaaauucuaacgcauguaaaaagugcaauuguaacgagcacuccaucucaugccauuuugacauggcuguguaccuggccacagguaacgucagcgggggaguuugugaugacugccagcacaauacuaugggccguaacugugagcaaugcaaacccuucuauuaccagcauccugaacgcgauaucagagacccaaauuuuugugagagguguaccugcgaucccgcgggcagucagaacgaagggauuugugacucuuacacagauuucuccaccggauuaauagccggucagugccgguguaagcugaauguggagggcgaacacugcgacguauguaaagagggguuuuaugaccucagcucggaggauccguucggaugcaagucuugugcaugcaacccucuuggcacgauccccggugggaauccaugugacuccgaaacuggccauugcuacuguaaacgacuggugacaggacaacacugcgaucagugcuugccugagcacuggggccuaucaaacgaccuggaugggugucgccccugcgacugugaucucggaggugcucugaauaacaguugcuuugccgaaagcggccaguguuccugcagaccacauaugauugggaggcaauguaaugaggucgagcccggauauuacuucgcuacccuugaccacuaucuguacgaagccgaggaagcaaacuugggcccuggugugucuaucguugagcggcaguauauacaggaucgcauuccaagcuggacuggggccggcuuugugagagucccggaaggagcuuaccucgaguucuuuaucgacaauauccccuacucaauggaguaugauauucugaucagguacgaaccucaguuaccagaccauugggagaaggcggugauuacaguacaacgucccggccggauaccuaccaguucccgaugcgggaacacgaucccagaugacgacaaucagguugugagccugucucccggaucaagauaugucgugcuaccgaggccugucuguuucgaaaaggguaccaacuacacagugcgccucgagcugccacaguauacaaguagcgauuccgacguugaaucucccuacacccuuauugauucguuggugcugaugccuuauugcaaaagccucgacaucuucacaguaggcggguccggagauggcgucgugacuaacucagcaugggagaccuuucagcgguacagaugucuggagaauaguaggucuguugugaagacacccaugaccgacgucugccgcaacaucauuuucagcauauccgcccuucugcaccaaacugguuuggcuugcgaaugugauccacaggggucacucagcucugugugcgacccuaauggcggacagugucagugccgacccaacguagugggccggacguguaaucguugcgccccagggacauuuggauucggcccguccgguuguaaaccuugcgagugucaucugcaagggaguguuaacgcauuuugcaaucccgucaccggacagugucauugcuuccagggcguguacgccagacagugcgauagguguuuaccaggucacuggggcuuucccagcugccaaccuugucagugcaacgggcaugcugacgauugugacccagugacuggagaaugccugaauugucaggauuauaccaugggccacaacugcgagcgcugucuagccggguacuauggagaccccaucauuggcucuggugaccauugccggccuuguccgugcccagaugggcccgacuccggaagacaauucgcaaggucaugcuaccaggauccugucacacuccagcuggcguguguuugcgacccaggcuauaucgguagucgaugugaugacugcgcuagcggcuacuuugggaaucccucggaagugggaggcuccugucagccuugccaaugucacaacaauauugauaccacugacccggaggccugcgauaaggagacagggcgcugucuuaaaugcuuguaucacacggaaggagagcauugucaguucugccgguuuggcuacuacggugacgcacugcagcaggauuguagaaagugcgugugcaacuaucucgggaccguacaagaacacuguaauggaucugacugccagugugacaaggccacuggccagugccuguguuuacccaacgucaucggucagaacugcgauaggugugcuccaaauacauggcaacuggccagcggcaccgggugcgacccuuguaacugcaaugcagcucauucauucggacccaguuguaacgaguuuacaggccagugccagugcaugccaggguucggaggccguacuuguuccgagugccaagaacuuuucuggggugauccugacguggagugucgcgccugcgauugugacccccgggggauagaaaccccacagugcgaucagucuacgggacaguguguuugcguggagggcgucgaaggcccgagaugugacaaaugcaccaggggguacagcggaguguuuccugauuguacacccugccaccaaugcuucgcguugugggacguuaucauugccgagcucacuaaucgaacccaucgguuucuggagaaggcuaaagcacuaaagaucuccggugugauuggcccauaucgcgaaacaguagauucagucgagagaaaagugagcgaaaucaaggacauacuggcccagagucccgcugccgagccucucaagaacauugggaaucuguucgaagaggcagagaaacuuaucaaggaugugacugaaaugauggcgcaggucgagguuaaauugucugacaccacgucccagagcaacucgacagccaaggaacuggacucauuacaaaccgaggcugaaucucucgauaauacugugaaagagcuggccgagcagcuugaauuuauuaagaacagugacaucaggggagcacuggauuccauaacaaaguacuuccagaugagcuuggaggcugaagaacggguaaaugccucuaccacugagccaaacagcaccguggaacaguccgcacucaugcgagacagagucgaggaugugaugauggaacgcgagucacaauuuaaagaaaagcaggaggagcaggccaggcugcuagacgaacuggcuggcaaacuccagagucuggaucuuagcgcggccgcagagaugacaugugguacgcccccuggggcuucuugcuccgaaaccgaguguggaggcccgaauugccguacugacgaaggcgagcggaagugugggggaccagguugcggcggguugguuacaguggcccacaacgccuggcaaaaagcuauggaucuggaccaggaugucuuaucagcacucgccgagguggaacagcugaguaagaugguuagcgaggcgaaacuuagagcugacgaagccaagcaauccgcagaggauauccugcuaaagaccaaugccacaaaagaaaagauggacaaaucuaacgaggagcucaggaaccugauuaagcagauccgcaauuucuugacucaggacucggcugaucuggacagcauugaagcaguggccaacgaggucuuaaaaauggaaaugcccucaaccccucagcaacuccagaaucugacggaggauauccgagagagaguagaaucccuuagucagguggagguuauacugcagcacucugcggcugacauugcccgggcagaaauguugcucgaggaagccaagagggcuagcaaguccgccacagaugugaaagucaccgcagacauggugaaggaggcucuggaggaagccgagaaagcgcaaguagccgcagaaaaggcuaucaaacaggccgaugaggacauccagggaacucagaaccuacugaccucaauugaaucugagacagcugcaagcgaggaaacucuuuuuaaugccagucaacgcaucuccgagcucgaacguaacguggaggaacugaagagaaaggccgcucagaauagcggcgaggcggaguauauugaaaaagucguuuacaccgugaagcagucugcagaggaugugaaaaagacauuggacggugaacuggaugagaaauauaagaaggucgagaacuuaauagccaaaaagacggaagagucagcugacgcccggaggaaagcagaaaugcuccaaaaugaggccaagacccugcuugcucaggcgaacuccaaacugcaguugcucaaggaccuggaacgcaaauacgaggauaaucagcgauaccuagaggacaaggcccaagaacuggcaagacuugagggggaagugcggagucuccugaaggauaucagccagaaaguugcuguauauucgacuuguuuguga

SEQ ID NO: 58307 - RNA, 5397 nt, Artificial Sequence
  derived and/or modified sequence opt3 from LAMB2__Homo_sapiens__NP_002283
auggagcugaccagcagagaaaggggccgggggcagccccucccuugggagcuucgccugggauuguuacuguccgugcuagccgcuacacucgcacaagccccagcgccggacguccccgguugcucucgaggcucauguuacccugcuacuggggaucugcuuguuggacgugccgacagacugacggcaaguagcaccugcggcuugaacgguccacagcccuauuguaucgugucccaccuccaggaugaaaagaaaugcuuccugugugacucuaggcggccuuuuucggcccgcgauaauccacauucacacagaauucagaacguagugacaagcuucgcuccccaaaggcgggcagccugguggcagagugagaaugggauaccugcugucacuauccagcuggaccucgaagccgaguuucauuucacccacuuaauuaugacauuuaagaccuuccgcccagcggcaaugcugguggagcgauccgccgauuuuggaagaacuuggcauguuuacagguauuucucuuacgacugcggcgcugauuuuccgggcgugccccuugccccuccacggcacugggacgaugucgugugugaaagccguuauuccgagaucgaacccucaacagagggggagguaauuuaccgcguuuuggacccugcaaucccaauacccgauccguauaguagcagaauccagaaccugcuaaaaauuaccaaucucagggugaaccugacgcggcuucacacucugggagacaauuugcucgacccucgacgcgaaaucagagagaaguacuacuaugcucuguacgaauuagucgugagggguaacugcuucuguuauggccaugccucugagugcgcgcccgccccaggggcaccugcucacgccgaaggaauggugcauggcgcuuguauuugcaaacacaauacccggggucugaacugcgagcaaugucaggauuuuuaccgcgaccuccccuggagaccagccgaggaugggcacucccaugcaugcaggaagugugaaugccacggacauacacacucaugucauuucgacauggccgucuaucuugcuagcggcaauguuaguggcggggugugcgauggaugucagcacaacacugcgggucgucacugcgagcugugucggcccuuuuucuaccgagacccuaccaaggauuugagagacccagcaguaugcaggucuugugauugcgacccgaugggcucccaggaugggggacgcugcgacagccaugacgaucccgcccuaggccuggugucgggucaaugucggugcaaagaacacgucguggggacaagaugucagcagugcagggacggcuucuuuggacucucuaucuccgaucgccugggcugucgacggugccaauguaaugcucgugggaccguuccuggaucaacgccaugcgaccccaacagugguagcuguuauugcaagagacuugugacuggcagggggugugaucgcugccugccuggacauuggggcuugucccacgaccuccuggguugccggccaugugauugcgacgucgggggcgccuuagauccccagugugacgagggaacaggccagugccacuguagacagcauaugguggggaggcgaugcgaacaaguacagccgggauacuuccgcccuuuucuggaucaccuaauaugggaggcagaggacacccggggucagguucucgauguggucgaaagacuggugacuccaggcgagacacccucuuggaccgggagcggauucgucaggcuucaggaaggccaaacguuggaguuucugguggccucaguuccuaaagcuauggacuacgaccuccugcuucgucuggaaccccaggugccagagcagugggccgaguuggaacucauuguacagcgcccuggucccgucccagcacauagucugugugggcacuuagugccgaaggaugaccggauccaaggcacccugcagccucaugcgagauaucuaauuuuccccaauccaguuugccucgagcccggaaucuccuacaaacugcaccuuaaguuggugaggacaggcgggagcgcucagccugaaacuccauauucuggacccggccugcucaucgauucacuggucuuacugccucgagugcuuguauuggagauguuuagugguggggacgccgcagcccucgagcggcaggcuaccuucgaacgcuaccaaugucacgaggaaggacuggugccgagcaagacauccccaucugaggccugcgcaccccuacugauuucgcucagcacucugauauauaacggcgcucuuccuugucagugcaacccacaggguuccuugucaagugaaugcaauccccauggcgggcaaugucugugcaaaccuggaguugucggcagaaggugugauuuaugcgccccgggguacuauggauuuggccccaccgguugucaggcgugccaguguucucacgagggggcccucagcucccugugcgagaagacaucaggacagugucuuugccggaccggcgcuuucggucugcgaugugacagaugccaacgcggccaguggggguuuccaagcugcaggccuugugugugcaacggacaugcagaugaauguaauacucacacgggcgccugcuuggggugucgugaccauacaggaggcgagcacugcgaacgguguaucgcugguuuccacggggaucccagacucccauacggaggccagugcaggccuugucccugcccagaggguccgggcucucagcgccauuuugccaccuccugucaccaagacgaauacagucagcagauugugugccauugccgagcaggguauacuggacugagaugugaggcgugcgccccuggccacuucggggaucccagccggccaggaggcaggugucagcuaugcgaguguucugguaacaucgaccccauggauccugacgcuugcgacccacacaccgggcaaugucugcgcugccuccaucacacagaaggaccccauugugcccacugcaaaccuggcuuccauggccaggcagcucgucaguccugucacagaugcaccuguaaucugcuugggacuaacccgcaacagugcccaucacccgaucagugccacugugacccuaguagcggacagugccccuguuugccaaauguccaagguccuucgugcgaucggugugcccccaacuuuuggaaucugacauccggccaugggugccagccaugugcaugccacccuucuagggcccgcggaccgacguguaacgaguucaccggccagugccauugucgagcugguuuugggggaagaacuugcagcgaaugccaggaguuacacuggggcgaccccggccuccaaugucacgcgugcgauugugacucacgggggauagauacaccacagugccauagguucaccggacacuguaguugccgcccugguguuuccggcgugagaugugaccagugcgccaggggguuuucuggaauuuuccccgcaugucauccaugccacgcuuguuuuggcgauugggaccgggugguacaggaucuggccgcccguacacaacgccuugaacagcgagcucaggagcugcagcaaacugguguccuaggggcauucgagagcuccuuuuggcauaugcaggaaaagcucggaaucgugcagggcaucguuggcgccagaaauaccucagcggcuagcacggcccaacugguggaggcaaccgaagaguugaggcgggagauuggggaagccacagagcaccugacucaguuagaagcugaccucaccgacguccaggaugagaacuucaaugcaaaccacgcccugaguggacuugaacgcgacagacuggcguugaaucucacacugaggcagcuagaucaacaucuggaccuucucaaacacucuaacuuucugggugcuuacgauuccauccggcaugcccacagccagucggcagaggccgagcgaagagcuaacacuucagccuuggcagugccuucucccguuaguaauuccgcuagcgcccgccacaggaccgaagcgcugauggacgcccagaaggaggauuucaacucuaaacauauggcaaaucagcgggcuuuaggcaagcucagcgcccacacgcauacacugucccuuaccgacauuaacgaacuggugugcggggcuccgggagaugcaccaugcgccacuucaccuuguggcggugccgggugccgugacgaggauggacaacccagauguggcggcuugaguugcaauggggcugcggcaacagccgaccucgcucugggaagggcccgccacacccaggcagaacuacagcgggcccuggcugaggguggcagcauacuuucucgaguagcggagacuagaaggcaggccuccgaagcacaacagcgcgcucaggccgcacucgauaaggccaacgcuucacgggggcaagucgagcaggccaaucaggaacugcaggaguugauccaaagugugaaagacuuuuuaaaccaggaaggagcggacccagauagcauugagaugguggcaaccagaguccuggagcucuccauccccgccucugcugaacagauccagcaucuggccggcgcuauugcagagcguguuaggucgcuugccgacguggaugcuauacuggcccggacaguaggugacgugcgccgagcagaacaauugcuacaggaugcgagaagggcccggagcugggcugaggacgagaagcagaaagccgaaacgguccaggcagcucuggaggaagcccaacgcgcacaggggaucgcccagggagcuauuagaggcgcgguggccgauaccagggacacugagcagacacucuaucaaguucaggaacgaauggcaggcgcugagcgggcccugucauccgccggggagcgugcaagacagcuugaugcuuuacuggaagcccucaaguugaaacgcgcgggaaauagucuggcugccucuaccgcagaggaaacagccgguagcgcucaaggcagggcacaggaggccgaacagcuccugcgggggccucuuggagaccaguaccaaacugugaaggcgcuggcugagagaaaggcccagggcgucuuggcagcccaggcucgcgccgagcagcuaagggaugaagcacgagaccugcuccaagcugcccaggauaaauuacagcggcugcaggagcuugaagguaccuaugaggaaaacgagagagcgcuggaguccaaggccgcacaacucgacggguuggaagcuaggaugcgcucagugcugcaggccaucaaucuccagguucaaauuuacaacacgugucaguga

SEQ ID NO: 58308 - RNA, 3519 nt, Artificial Sequence
  derived and/or modified sequence opt3 from LAMB3__Homo_sapiens__NP_001121113
augagacccuucuuucugcucugcuucgcccuuccuggccuguugcacgcucagcaagcauguagcaggggagccugcuacccaccggugggggacuuacuggucggucggacccgcuuucuacgagcguccucuacauguggccucacuaagcccgagacguauugcacccaguacggggaauggcagaugaaauguugcaagugugauucacgucagccucauaacuauuacagucacagaguugagaauguggcuagcuccucuggaccaaugaggugguggcaaucgcagaacgacguaaaucccgugucacugcagcuugaucuggaccggcgcuuccaguugcaagaagucaugauggaguuucagggcccuaugccagccgguaugcucaucgaaagaagcagugauuucgggaaaacauggaggguguaucaguaccuggcagccgacugcacuuccaccuuuccccggguucgccagggacgaccucaaucuuggcaggaugugagaugucagagccugccacaaaggccgaacgcucggcucaauggcggcaagguccaguuaaaccugauggaccuuguguccgggauucccgcaacacagucacagaaaauacaagagguaggagagaucaccaauuugcguguuaacuucacucgccuggccccugugccacagagagguuaucaucccccuagugcuuacuacgccgucagccagcuaaggcuccagggcucuugcuuuugucacgggcaugcggaucggugcgcaccaaagcccggagccuccgcuggcccgucaacagccgugcaagugcacgacgucugcguuugucagcacaauaccgcagguccuaacugcgaacgaugugcucccuucuauaauaaccgcccauggagaccugccgaggggcaggaugcgcaugaaugccagaggugugacugcaauggacacagcgagacgugucauuuugaucccgccguguucgcagcuagucaaggcgccuacggcgggguaugcgacaacugucgggaccacacugagggaaagaauugcgaacgcugucagcugcacuauuuuagaaacaggcguccaggugcuucuauucaggagaccugcaucuccugcgaaugugaucccgacggcgccgugccuggggcaccaugcgauccggucacaggacagugugugugcaaagagcauguucaaggcgaacggugugaccuuugcaagcccgguuucacugggcugaccuacgccaacccucagggcugucaccgaugcgauuguaauauuuugggaagcagaagggacaugccaugcgaugaggagucgggccgcugucucugccugcccaacguggucgggccuaaaugcgaccagugugcuccauaucauuggaaguuagcgucuggacaagguugcgaacccugugcaugcgauccgcacaauucccugucaccucaguguaaccaguucacaggccagugcccaugucgggagggguuuggaggccucaugugcagugccgcugccaucagacaaugucccgacaggaccuacggugauguggcaacggggugccgcgccugugacugcgacuuccgaggcacugaaggaccuggcugcgauaaagcuagcgggcggugucuuugccgucccggacugacagguccaagaugugaccagugccagaggggcuauuguaaucgcuacccuguaugcguugccugucaucccugcuuucagaccuacgaugcagacuugcgggagcaagcgcuaagauucgggaggcugcgaaacgcuacugccucccucuggucuggaccaggccuggaagaucgcggucuugcaagccggauacuggacgccaagucaaagaucgagcagauuagagcuguguugaguuccccggccgucacagagcaggaaguggcacaggucgcuagcgccauccucucucugaggcguaccuuacaagggcugcagcuagaucucccucuggaggaagagacgcuuucauugccccgcgaccuggaaagucucgaucggagcuuuaauggccugcuuaccauguaucagagaaaaagggagcaauucgagaagauuuccucugcggacccaucgggagccuuucgaaugcugagcacagcuuacgaacaguccgcacaggccgcucagcaagugucagauaguucucgguugcucgaccagcugcgcgauagcagaagggaggccgaacgguuaguucgacaggcaggcgggggaggcgguacugggucccccaaacugguggcgcuaagacucgagaugucaagccugccugaccuuaccccaacauucaacaaguuguguggaaauucucgccagauggccugcacucccaucuccuguccuggcgagcugugcccgcaagacaacgguaccgcuugcggcaguaggugucgugggguacucccacgggccggaggcgcauuucugauggcugggcaggucgccgaacaguuaagaggauucaaugcacagcugcaaaggacacgccagaugauacgagccgcugaggaaagcgcgucucagauucaguccucagcccaaagacuugagacccaggugagugcaagccggucgcagauggaagaggauguuaggcgcacucguuugcucauccaacaggugagagacuuucugacggaucccgacacagaugcugccaccauucaggaggucuccgaagccgugcuagcucuguggcucccuacugacucugcaaccguacugcagaaaaugaacgagauccaagccaucgcggcucggcuuccaaauguggauuugguucugagccagacaaagcaggacauugccagggcacgccgauuacaggccgaagcugaggaagcaagaucacgggcccacgcggucgagggccaaguggaggauguggucgguaaccucaggcaggggaccguugcucugcaggaagcccaggacacuaugcaaggaacaagucgcucccuuagacugauacaggauaggguggcagaggugcagcaaguauugcggcccgccgaaaaacucgucacgucuaugaccaagcagcugggcgacuucuggacucguauggaggaacuacgccaccaggcucgacagcaaggugccgaggcagugcaggcucagcagcuggccgagggcgcgagcgaacaagcccucuccgcacaggagggguuugaaagaaucaagcagaaauaugcugagcugaaggauaggcuuggacagucaagcauguugggcgagcaaggggcccggauucagaguguuaaaacagaagcugaggaacuguucggagagaccauggaaaugauggaccgcaugaaggacauggaguuagagcuccugagaggcucucaggcaaucaugcuuagguccgccgaucugacaggucuagaaaaacggguggagcagauacgagaccauauuaaugggagaguccucuacuaugccacuugcaaguga

SEQ ID NO: 58309 - RNA, 5286 nt, Artificial Sequence
  derived and/or modified sequence opt3 from LAMB4__Homo_sapiens__NP_031382
augcaguuccaacugacccucuuucuucaccugggaugguugagcuacuccaaggcacaggacgauugcaauagaggggcuugucaucccacaacuggagacuuacugguggguaggaauacgcagcuaauggcaucuucaaccugcggccucagucgggcccagaaauauuguauccugagcuaccuugaaggggaacaaaagugcuucauuugugauucccgcuuuccuuaugacccauacgaucagccgaacucucacacaauagaaaaugucaucguuucguucgaacccgaccgagagaaaaagugguggcagucagaaaacggacuggaucaugugagcauucguuuggaccucgaagcgcuguuuagauucagucaccugauccucacuuuuaaaaccuucaggccugcugccauguuaguagagcgguccacagauuauggccauaauuggaagguguuuaaguacuucgcaaaagacugcgccaccucuuuuccaaacauuacuagcggucaggcucaaggggucggagauaucgugugugacuccaaguauucagauauagaacccaguacaggcggcgagguugugcugaaaguccuugacccuagcuucgaaaucgagaauccauacucucccuacauucaggacuuggugacccugacgaaccuacgcaucaauuuuacuaagcuccacacccugggggaugcacuucugggaagaaggcagaacgacuccuuggauaaauauuacuaugcccucuacgagaugauuguacgggguucaugcuucuguaauggccacgcuagcgaaugccgcccuaugcagaagaugcgaggggacguuuucaguccaccgggaauggugcauggccaaugugucugccagcacaacacagauggucccaauugcgagagauguaaggacuuuuuccaggaugccccuuggaggccagcggcagaccugcaagauaacgccugccggucuuguuccugcaauagccauucgucucguugucacuuugacaugacuaccuauuuagcuuccgggggacugucaggcggcgugugcgaagauugucagcacaacacagaggggcagcauugcgaccgcuguagaccccucuucuacagggacccucuuaaaaccaucagugauccauaugccugcauacccugugaaugcgacccggauggaacgauuagcgguggcaucugcgugucccacucugacccugcacuggggagcgucgcuggacaguguuugugcaaggagaacguugagggcgccaaaugugaucaaugcaagcccaaucauuacggucuaucagcgacugacccacuggggugucagccuugcgauuguaacccccucggcagucugccauuucuuacaugcgacguggauaccggacagugucugugcuuguccuacguaacuggcgcccacugugaagagugcacagugggguauuggggacucgguaaucaucugcacggcugcagccccugugacugcgauauugggggagcauacucuaacgucuguucaccuaaaaauggccagugcgaaugucggccacacgugaccggucgaaguugcagcgagccggcucccggguauuucuuugccccuuuaaacuucuaccuguaugaagcugaggaggccacgacccuacaaggccucgcaccacugggauccgaaacauuuggccagucucccgccguucaugugguccuuggggagccugugccaggaaaucccguaacuuggaccgguccgggcuucgcucgcguuuugccuggggcgggacugagauuugcagugaacaauaucccauuccccgucgacuuuacaaucgccauucacuacgaaacucagucggcugccgauuggaccgugcagauagucgugaacccucccggcgguagcgagcauuguaucccaaagacacuccaauccaaaccucagucauucgcacugcccgccgcuaccaggauuaugcuucugccaacuccgaucugcuuggaaccugacguucaguauaguauagacguguacuucucucagccccuccaaggggagagccacgcccacucccauguacuggucgauucauuaggccugauuccacagaucaauagccuagagaacuuuuguucuaagcaggaccucgaugaauaccaacugcacaauugcguggagaucgcauccgcgaugggaccccagguucuuccuggcgcuugugaacgguugauuaucaguaugagcgccaagcugcaugacggggcaguggccugcaaaugccacccacagggaucugucggcuccucauguagucgccucggugggcagugccaauguaagccccuggugguaggaagaugcugugauaggugcagcacgggcucguaugacuuaggucaucacggcugucacccuugccauugucacccgcagggguccaaagauacagugugcgaccagguuaccggacaguguccaugccauggcgaggucucugggcgucggugcgaucgaugucuggcuggauacuucggcuuucccagcugccacccuuguccaugcaacagauucgccgagcuuugugaccccgaaacugguucaugcuuuaauugugggggauucaccacaggcaggaacugcgagcgcuguauugaugguuauuacggcaacccuaguuccgggcaaccgugccggcccuguuugugcccagacgauccuucuagcaaucaguauuuugcacauuccugcuaccagaaccucuggucaagcgacgugauauguaauugccugcagggauauaccggcacucaauguggggaaugcaguacaggauucuacggcaaccccagaaucucuggugcuccaugucagccuugcgccuguaauaacaauauugacgugacggaucccgaguccugcagcagggucaccggggaaugucuacgcugccugcacaacacucagggagcgaauugucaacucugcaagccaggccacuacgguucggcccugaaccagacaugucgacggugcucaugccaugcuucuggcguuaguccgauggaguguccucccgggggaggcgcaugccuuugugacccagugaccggggccugccccuguuugccuaaugugacaggacuggcuugcgaucguugugccgacggcuauuggaacuuaguaccagguagagggugccaguccugugauugcgaccccaggacuagccagucuagccacugugaucaacucaccggacagugcccuugcaaacugggcuacggcgggaagcgcuguuccgagugccaggaaaauuauuacggagacccgccaggucgguguauccccugcgauuguaacagagcaggcacgcagaagccuaucugcgaccccgauaccgggauguguaggugccgagagggagucucaggccaacgcugugaccggugcgcgagaggucauagucaggaauuuccaacaugucuucagugccaccugugcuucgaccagugggaucacacuauuagcucuuuguccaaagccgugcaagggcucaugaggcuggcugccaauauggaggacaagcgugaaacccuaccuguuugugaggcagauuuuaaagaccugcgcggaaacgugucagagauagaacggauccucaagcaucccgucuucccaaguggcaaauuucugaaggugaaggauuaucacgacagcguuagaaggcagauuaugcagcuuaacgagcaguugaaagcuguguacgaguuccaagaucugaaggacacaaucgagcgagccaaaaaugaagcagauuuacuccuggaggaccuucaggaggaaauugaucugcaguccucuguacuaaacgccucgaucgcugacagcucagagaauauaaagaaauauuaccauaucuccaguucugcggaaaagaagauuaacgagacuagcuccaccaucaauacgucagccaacacacggaaugaucuccugaccauuuuggacacucugacaucuaaaggcaacuuaagccucgagcgccugaagcaaaucaaaauaccugacauucagauccuuaaugaaaaggucugcggggauccgggaaacgugcccugugugccacugccuugcgguggcgcauuguguaccgggagaaaaggacacaggaagugccggggccccgguugucaugggagucucacucuguccaccaaugcucuacagaaagcccaggaggccaagagcauuauccgaaaccuggacaagcaagucagaggacuuaaaaaucagauagaaucuaucucagagcaggcugaaguuuccaagaacaaugcacuccagcugcgcgagaaauugggcaacauuaggaaccaaagugauagcgaggaagagaauaucaaccuguucauuaagaaagugaagaacuuuuuacucgaagagaacguaccaccugaagacaucgagaagguggccaauggcguccuggauauacaccuucccauuccgucgcagaaccugacagacgaguuggugaaaauccagaagcacaugcagcucugcgaagauuaccguacggacgagaaucggcugaacgaagaggcggauggggcucaaaaacuacugguuaaggccaaagcagccgaaaaggcugcaaauauccuucucaaccuggacaagaccuugaaucaguuacagcaagcccagauuacucagggcagagcgaacucuacaaucacccagcugacagcuaauauuacuaaaauaaagaaaaacgugcuccaagccgagaaucagaccagggagaugaaguccgaacuggagcuugcaaaacagcgcagcggucuggaagauggcuugucacuacugcagacgaagcuccaacgacaucaggaccacgccgucaacgcuaaggugcaggccgagagugcacagcaucaagcugggucucuggagaaagaguucguugagcuuaagaaacaguaugccaucuuacagagaaagacauccaccacuggacugaccaaagaaacacucggcaaggugaaacaguugaaggaugcggccgagaagcuggccggugacacugaagcuaaaauucggaggaucaccgaccucgagcgcaagauucaagaucugaaucuuagccgucaggccaaagcugaccagcugagaaucuuggaggaucaagucguagcaauaaagaacgaaaucguggagcaggagaaaaaguacgcccgguguuauucauga

SEQ ID NO: 58310 - RNA, 4830 nt, Artificial Sequence
  derived and/or modified sequence opt3 from LAMC1__Homo_sapiens__NP_002284
augagaggcagccacagggccgcucccgcacugcggccucgcgggcgacucuggccagugcuugccguccuggcggcugccgcagccgcuggaugcgcacaggccgcuauggacgaguguaccgaugaagguggccguccgcaaagaugcaugcccgaguucguuaacgccgcguuuaaugugacaguaguggcaacuaacacgugugggaccccuccagaagaguacugcguccagacaggagugacuggcguuaccaaguccugucauuugugcgacgccggucagccccacuuacagcauggggcugccuuccugacagauuauaauaaccaagcagacaccacuugguggcagucucagacaaugcuagcuggagugcaguacccuucaaguaucaaucucacccugcaccuuggcaaagccuuugauauuacguaugucaggcugaaguuccauacuagccggccagaauccuuugcgauauacaaacgcaccagagaggacggccccuggaucccuuaucaauacuauucugggucgugugagaacacauacucaaaggccaauaggggauucauucggacugguggcgaugaacagcaggcauugugcaccgacgaguuuagcgauaucaguccacucacagggggaaacguggcuuucuccacccuggaaggccgcccgucugccuacaauuuugacaacagccccguacugcaggaguggguuacggcuacugauauucgagugacacucaauagauuaaacaccuucggugacgaggucuuuaaugauccuaaagugcugaaguccuauuacuaugccaucucagacuucgcagucgggggaagguguaagugcaacggccacgccagugaauguaugaaaaaugaguuugacaaacuugugugcaacugcaaacacaacacuuacggcguugauugugaaaagugcuugccauucuucaaugaccggcccuggcgucgcgcuacagcggagagcgcaucugaaugucugccuugcgauuguaacgggagaucccaagagugcuauuuugacccagagcuauacaggucaaccggacaugguggccacuguacgaauugccaggauaacaccgacggggcccauugugaacggugccgagagaauuucuuucgccucggaaacaaugaagcauguagcaguugccacugcucucccgugggcucccugagcacacagugugauucguaugguagaugcucuuguaaaccggggguaaugggcgacaagugcgauaggugucaaccuggauuccacucccuuacugaggccggcugccggcccuguucaugcgacccaagugggagcauagaugaauguaacaucgagaccggacgcugcguguguaaggacaaugucgaggguuuuaacugcgaaagaugcaaaccuggcuucuuuaaucuggaguccucuaaccccaggggguguacaccaugcuucuguuuuggacauagcucagugugcacuaaugcaguuggcuacaguguguacuccauuagcucuaccuuccagaucgacgaagaugguuggcgugccgagcagcgggacgggucagaagcuaguuuggaguggagcuccgagcgacaggauauugccgucaucucugacucguauuuucccagauacuucauagcuccugcgaaguuucucggcaaacaagugcugagcuauggacagaacuuauccuucucauucaggguagaucgccgggacacaagacugagugcugaagaucucguucuugagggcgccgggcugagggugucugucccauugauugcacagggaaauagcuacccguccgaaaccacugugaaguaugucuuucgccuacacgaggccacggacuaccccuggcgaccugcucugacaccauucgaguuucagaaacuccugaacaaccuuaccucaaucaagauucgggguacuuauagcgaacguucugccggcuaccuggaugacgugaccuuggcauccgcuagacccgggccuggaguuccagccacauggguggagaguuguaccugccccguaggcuacggugggcaauucugugaaaugugccucagcggcuauaggcgcgagacuccgaaucugggaccuuacucuccaugugucuuaugcgcguguaacggccauuccgaaacaugcgaucccgagacgggggugugcaauugucgggacaacaccgccggaccucacugcgagaaauguucagauggcuauuacggugacaguacugcugggacaagcucggacugccagcccuguccaugcccuggaggcuccucuugugcaguugugcccaagaccaaggaagucgugugcacaaauuguccaacugguaccacgggcaaaagaugcgagcugugugaugacggguauuuuggagauccgcuaggcaggaacgggccuguacgacucugccgccugugccaguguagcgacaauaucgaucccaacgccgugggaaauugcaaccggcuuaccggcgaauguuugaagugcaucuacaauacagcugguuucuauugugacagaugcaaagauggguuuuucggaaacccacuggcccccaauccugcagacaaguguaaagcgugcaacuguaaucucuacggcacuaugaagcagcaaucaaguugcaacccaguuaccggucagugugagugccugccccaugucacaggccaggauugcggggccugugacccuggauuuuacaaccuucaguccggccaagggugcgaaaggugugauugccacgcucugggaucuacuaauggccagugugacauucguaccggucagugcgagugucaaccggggauaacgggacagcacugcgagcgcugugaagugaaccauuucggcuuugguccagagggcugcaagcccugugauugccacccugaagggagcuugucccuccaguguaaagacgacggacggugcgagugcagagaaggcuucguggggaauaggugugaucagugcgaggagaacuauuuuuacaaucgaucauggccaggaugucaagaaugccccgccuguuaucggcuggucaaggacaaaguugcagaucaucgcgugaaguuacaggagcuggaaagccuaaucgcuaaccucggcacaggugacgagauggugaccgaucaggccuucgaggacagacugaaagaagcagagagggaaguaauggaucuuuugcgggaggcccaggacgucaaggauguggaccaaaaucugauggaucgacuccagagaguuaacaauacucugaguucucagauuucccgcuuacagaacaucaggaauacaauagaagagaccgggaaccuggcugagcaagcgcgugcccacguggaaaauacugagcggcuuauugaaaucgcaagcagagaguuggaaaaggcuaaagucgccgccgcuaacgugucgguuacccagccugagucaacaggagacccgaauaacaugacgcuccuggcagaggaagccaggaagcuagcggagcgccacaaacaggaagcugacgauaucgugcgaguagccaagaccgcaaacgacacuucuacagaggccuacaaucugcuccugagaacccuugcuggcgaaaaccaaacagcauucgagauugaggaauugaaucggaaauaugagcaggccaagaacaucagucaggaucuggaaaagcaggcggcuaggguccaugaggaggccaaacgcgcaggcgacaaggccguggaaauuuacgcuuccguggcccaauuaagcccccucgauucugagacucuggaaaaugaggcaaacaauauaaaaauggaagcugagaaccuugagcagcugaucgaccagaaguugaaagauuaugaagaccuccgugaggauaugagagggaaggaacuggaggucaaaaaucuacuggaaaagggaaagaccgagcagcaaacggccgaccagcuccuggcgcgggccgaugcagcuaaagcccuugcugaggaagcagccaagaaagguagggacacauugcaggaggccaacgauauucugaauaacuuaaaggacuuugaccgccgaguuaaugauaacaaaaccgcugcggaagaggcacucagaaagaucccagccaucaaucagacuauuaccgaagcuaacgagaagacacgggaggcccaacaggcacugggcagcgccgcugcggacgccacugaagcaaagaauaaggcucacgaggccgaaaggauagcauccgccgugcagaaaaacgcuaccucaacaaaggccgaggcggagcgcacguucgcagaaguaaccgaucuugacaacgaggugaauaacaugcugaaacagcuacaagaagccgagaaggaacucaagagaaaacaggaugacgcugaucaggacaugaugauggccgggauggcuagucaagcagcccaggaggcugagaucaaugccaggaaggcgaaaaacagcgucacuucucuguuguccauuaucaaugaucuguuagaacagcucggacagcuggacacaguggaucuuaacaagcugaaugagauugaaggcaccuugaacaaagcaaaggacgagaugaagguuucagaucucgaccggaaagugagugaccuggaaaaugaggccaagaaacaagaggcugccaucauggauuacaaccgugacauagaagagaucaugaaggauauucgcaaucuagaagacauccgaaaaacucugccuagcgguugcuuuaacacacccuccauugagaagccauga

SEQ ID NO: 58311 - RNA, 3582 nt, Artificial Sequence
  derived and/or modified sequence opt3 from LAMC2__Homo_sapiens__NP_005553
augcccgcccuguggcucggcugcugucuuugcuucagccuguuguuaccugcugcaagagccaccuccaggcgggaggugugugacugcaacgggaagucucgccaguguaucuuugaucgagaacugcaccgucaaacaggaaaugguuucagaugccuaaacuguaaugacaacacugauggcauucacugcgagaaauguaagaauggguuuuacaggcaccgggaacgcgacagaugccucccauguaacugcaauucaaaaggaagucugagcgcgaggugcgauaacuccggccgguguucuugcaagccgggugucacgggggcucgcugugaccgaugccuucccggauuccauaugcugaccgaugccggcuguacacaggaccagagauugcucgauucgaaaugcgacugugauccugcaggcauagccgggccaugcgacgcuggaagguguguuugcaagcccgcagugacuggugagcggugugaucguugccgcucaggcuauuacaaucuggacgggggaaacccugaaggcugcacccaguguuuuugcuauggucacagcgccaguuguagauccucugcugaguacagcguacauaagaucacauccaccuuccaccaagacguggauggguggaaagccguccagaggaauggaucaccagcgaagcugcaguggagucagcggcaccaagacguguuuagcucugcacagcgacucgaucccguuuauuucguggccccugcuaaauuuuuaggcaaccagcaggucuccuacggccaaucacugagcuucgacuaucgcguggauagagggggaaggcauccaagugcccacgacguaauucuugagggugcaggcuugcggaucacugcuccgcugaugccccuagggaagacacucccuugcggacugaccaaaacguacacuuuucgccuuaaugaacauccaucuaacaauuggagcccccagcugagcuacuucgaguauagaagguugcuccguaaccugaccgccuuacggauucgagcgacauacggcgaauauucgacugguuacaucgauaacguuacccugauaucugccagaccuguguccggggcaccagcucccugggucgagcaguguaucugcccggugggcuauaagggacaauuuugucaggacugcgccucaggcuacaagagggauagugcucgccucgggccuuucggaacauguauucccugcaauugucaggguggcggggccugcgacccagauaccggagacugcuauagcggcgacgagaacccugauaucgaaugugcagacugccccauugguuucuacaaugauccacacgacccccgguccuguaaaccuugcccaugucacaacggguuuucuugcagcgugaugccggagacggaagaggucguuuguaauaacugucccccuggcgugacuggagccagaugcgaacuuugcgcugauggcuacuucggggacccauuuggagagcauggucccguaaggccuugucagccaugccaaugcaauaacaauguggaucccucagcgaguggcaacugugaccgccugacagggcgaugcuugaaguguauccacaauaccgcaggaauauauugcgaucaguguaaagccggcuacuucggugacccgcuagcuccuaacccagccgauaagugccgggcauguaauugcaaccccaugggguccgagccugucggcugucguagcgacggaacuugcguguguaaacccggcuuugggggaccaaauugcgaacauggcgccuucucuugcccugcuuguuauaaccagguuaagauucagauggaucaauuuaugcagcagcugcagagaauggaggcccucaucucaaaagcacaagguggggacggagugguccccgacacagaacuggagggcaggaugcagcaggcggaacaggcucugcaagauauucugcgcgacgcccagaucagugagggugcaagccgguccuugggccuccagcuggccaaggugagaucucaagagaacucguaccagagcagguuagaugaccugaagaugaccguagaacgaguucgcgcucuagggucccaguaucagaaucgggugagagauacgcacaggcucaucacccaaaugcagcugucacuugccgagagugaagcaucuuugggaaacacaaauauuccagcuagcgaccauuacgucggcccgaacggguucaaaucccuggcccaggaggcgacucgucucgccgaaucacacguggagagcgcuucuaauauggagcagcugacccgcgaaacagaggauuauuccaagcaagcacuuagucugguccggaaagccuugcacgaaggagugggcagcgguucuggguccccugacggagcuguugugcagggccucguagagaagcuggagaaaacuaagucauuagcccagcagcugaccagagaagcaacacaagcggagauagaagccgauaggaguuaccagcauagccuacgacuccuggacucggucucccggcuucagggugugucugaucaauccuuucagguugaggaagcuaagcgcaucaaacagaaggccgacucauugaguucccuggugaccagacacauggaugaguucaaaaggacucagaagaaccucggcaauuggaaagaggaagcacaacagcuguuacagaacgggaagucuggacgggagaaaagcgaccagcugcuuucccgagcuaauuuggccaaaucaagagcacaagaagcccucagcaugggcaacgcuacguuuuacgaggucgaaaguauucugaagaaucuacgcgaguucgaccuucagguggauaacaggaaagcggaggccgaagaggcaaugaagcgucucucuuauaucucccagaaaguaagcgacgcuucggauaagacacagcaagccgaacgggcccuggggucagcugcagccgacgcgcagagagcuaagaauggagccggcgaggcacuugaaauaucuagugagauugagcaggaaaucgguuccuugaaccuggaggccaaugugaccgcugauggggcauuagccauggaaaaaggacucgcgagccugaagucugagaugagggagguugaaggcgagcuugaacgcaaagagcuggaauuugacacuaacauggaugcuguccagauggugaucaccgaggcccaaaagguggacacacgagcaaagaacgccggugucaccauucaggauacuuugaauacacucgacggccugcuacaucugauggaucagccccucagcguugacgaggaagggcuggugcuuuuggagcaaaagcuguccagagcuaaaacgcagaucaacucacaguuacggccaaugaugagugaacucgaggaaagggcccgccagcaacguggacaucugcaccuucuggagaccagcauugacggcauacuagcagaugugaagaaucucgagaacaucagagacaaucugcccccugggugcuacaacacucaggcuuuggaacagcaguga

SEQ ID NO: 58312 - RNA, 4728 nt, Artificial Sequence
  derived and/or modified sequence opt3 from LAMC3__Homo_sapiens__NP_006050
auggccgcugcagcccugcuccuuggccuggcguuguuagcucccagagccgcaggggccggaaugggugcuugcuacgacggcgcagggaggccucagcggugucugccaguguucgagaacgccgcuuuuggacgccuagcccaagcgagccauaccugcggcuccccgcccgaagauuucuguccucacgucggugcagccggggcuggagcccacugccagcgaugugacgcagcugauccacagcgucaucacaaugccucuuaucucacagacuuucauucacaggaugagaguacuugguggcaaagccccuccauggcguucggcguucaguacccuacgucugugaacaucacccugagacuuggcaaggccuaugaaauuacauacguaaggcugaaauuucacacuucgcggccagagucauucgcaauauauaagcgcagcagagcugacgggcccugggaaccuuaccaguuuuauagugccuccugccagaaaaccuacggaaggccagagggucaauacuugcggccgggcgaggaugaacgcguggcuuucuguacaucugaguuuagcgacaucuccccucucucagggggaaaugucgccuucaguacccuggaaggccgacccagcgcauauaacuuugaggagucuccaggucugcaggaaugggugacuuccacagagcucuuaauuucacuggauagacuuaauaccuucggggacgauaucuuuaaggaccccaaaguuuugcagagcuacuauuacgccgugagugauuucucugucggagggaggugcaaguguaacggccacgcuuccgaaugcggcccugacguggcgggacagcuggcaugucggugccaacauaauacgacugguaccgacugcgagcguugucuaccauucuuucaggaucgccccugggccagaggcacagcugaagccgcacacgagugccucccguguaacugcagcgggaggucggaggaauguacuuucgaccgggagcuguuucgaucuaccggacauggcggucgcugccaccacuguagagaucauacagccgggccucacugcgaaaggugucaggagaauuucuaucauugggacccccggaugccaugccaaccuugugauugccaguccgcuggcucacuucaucugcagugcgacgauaccggaacgugugccugcaagcccacuguaacaggcuggaaaugugaccgcugcuugccaggguuucacagucucagcgaaggagguuguagacccugcaccuguaacccugcaggcucccuggauacuugcgacccaaggucugggcguuguccgugcaaggagaauguugagggaaacuuaugugaucggugccgacccggcacauucaaucugcagccucacaacccagcggguugcagcucauguuuuugcuacgggcacaguaaagugugugcuuccaccgcccaauuccagguccaucacauucucagcgacuuucaucagggcgcagaaggauggugggccagaucugugggcgggucagagcaucccccucaguggaguccaaauggagugcuucugagccccgaagacgaggaagaguugacggcuccggagaaguuccuaggugaucaaagguuuuccuauggccagccucugauccucaccuuccgcgucccacccggggacucuccucugcccguucagcuucggcuggaaggaacaggcuuggcccucucgcugagacacagcuccuuaucagguccacaggaugcagggcacccuagggagguggaacugcgcuuucaccuacaagagacuagcgaggacguagcucccccacucccgccuuuccauuuccagcgacugcuugccaacuugaccucucugcggcuccgugugagccccggcccaucccccgcgggaccugucuuucugacagaagugagacuuacuucagccaggccaggccugagucccccugcuucuuggguugagauaugcuccuguccgaccggguacacaggacaguucugcgaaaguugugcaccaggcuacaaacgcgagaugccccagggugggccuuaugccagcugcgugccauguaccugcaaccaacacggaacuugugaucccaauacgggcaucugcgucugcucucaucacacagaagguccuuccugugagcggugcuugccgggcuuuuacgggaaccccuucgcuggacaggccgacgauugucagccaugcccuugucccggccaaucagcaugcaccacuauuccagagaguagagaagugguauguacccacugcccucccgggcagaggggacgacgcugugagguuugcgacgauggcuuuuucggugacccacucgggcuguuuggacauccgcagccuugucaccagugccaaugcagcggcaauguggaucccaacgcggucgguaauugugacccauuaucgggccauugccugcggugucuacacaacacaaccggggaucauugcgaacacugucaggagggauucuauggcuccgcccucgcucccagaccugccgacaagugcaugccauguucuugccacccccaggggagcgugucagaacagaugccuugugacccggucacuggacaaugcaguugucugccacaugugacagcaagggauugcucccguugcuaccccggcuuuuucgaccuucagccuggucgcgggugucggucuugcaagugucaccccuugggaagccaggaggaucagugccauccaaaaacgggccaauguaccugcagaccugguguuacuggccaggcuugugacaggugccagcugggguuuuucggauuuuccaucaagggcugucgagccugccgguguucaccccucggggcagccagcgcucaaugccacgagaauggaacaugugugugccgcccaggcuucgaagguuauaaaugcgauagaugucacgacaacuucuuucugaccgcggaugggacacauugccagcaguguccuaguugcuacgccuuaguaaaggaggaagcagcuaaacugaaggccaggcuuacuuugaccgagggauggcuccagggcucugacuguggcuccccgugggggccccuggauauucuacugggagaagccccacggggugacgucuaucaaggccaccaucuccugccuggggcucgagaggcauuccuugagcagaugaugagcuuggaaggagccgugaaagcggcuagagagcagcugcagcgcuuaaauaagggcgccaggugcgcacaagccgguucgcagaagacguguacccagcucgcugaucuggaagcaguucuugagucaucugaggaagagauccugcacgccgcggcuauauuggccagucucgaaauuccccaggaggggccaucccaaccuacaaaauggagccaucuggcaacugaagcccgugcucuagcccggucucacagagacaccgcaacaaagaucgcugccacugcguggagggcccugcucgcaagcaacaccuccuacgcucugcuuuggaauuugcuggagggacgcguggccuuagagacgcagcgagaucucgaagacagauaccaggagguccaggcugcacaaaaagcccugcggacagccguggcugaaguacuucccgaggcggaaucagugcuggcaaccguucagcaggucggcgccgacacugcuccguaucuagcccuccuggcaaguccaggcgccuugccucaaaagagcagggcugaggaucugggguuaaaagcgaaggcccucgagaagacaguggcaucuuggcagcacauggcuaccgaagccgcacgcacucugcagaccgccgcucaggccacacuucgucaaacggagccccugaccaaauugcaucaggaagcgagagcagcccucacucaggcuuccucaagugugcaggccgcuacagucaccguuaugggagcacggacacugcuagccgaccuggaggguaugaaacuucaauuuccaaggcccaaagaucaggcugcccuccagcgcaaggcagacagcguguccgaucgacuguuggcggacacuagaaagaagaccaagcaggccgaacggaugcugggcaacgcugccccuuuaucuucgagcgcuaaaaagaaagggagggaggcugaggugcucgccaaggauucagcaaaacuggccaaggcacuucugcgcgaaagaaagcaagcgcacaggcgggccucccguuugacgagucagacacaggcaacccuccaacaggcuucucagcagguacuggccagcgaggcccgccgacaagaacuagaggaggcagaaagagucggagcuggccuguccgagauggaacagcagauuagggagucacggaucucucuugaaaaagacaucgagacucucagcgagcuguuggcccgcuuagguagucuggauacccaucaggcgccggcucaagcccucaaugaaacacagugggcacuggagagacuuaggcugcaguuggggucccccggaagccuacagcggaagcugucucuccuggaacaagagucacagcagcaggaacuucaaauucagggcuucgaguccgacuuagccgagauacgagcugauaaacagaaccuggaagcaauccuccacaguuugccagagaauugcgccagcuggcaauga

SEQ ID NO: 58313 - RNA, 1254 nt, Artificial Sequence
  derived and/or modified sequence opt3 from LAMP1__Homo_sapiens__NP_005552
auggccgcucccggcagcgcaagaaggccucugcuccuucuguuguuacugcuacuccuggggcuuaugcacugcgccuccgcggcuauguucauggugaagaacggaaaugguaccgccuguaucauggcaaacuuuucugccgcuuucucagucaauuacgacacaaaaaguggcccaaagaacaugacuuuugaucugccgagcgacgcaacgguuguguugaaucgguccucuugcgggaaagagaacaccucggaucccucacucguaauugccuucggacgcggccauacacugacucugaauuuuacccgaaacgcuacacguuauagcgugcagcucaugaguuucgucuacaauuuauccgacacccaccuguuuccuaacgccucuagcaaggaaauaaaaacuguggaguccaucacagauauuagagcggacaucgauaagaaguauagguguguuucagguacccaagugcauaugaauaacgucacggugacucuucacgacgcaaccauucaggccuacuugaguaauagcucuuucucccgcggggaaacacggugcgagcaggauagaccaucacccacuaccgcuccuccagcucccccuagcccaaguccgucucccguaccuaaauccccaagcguugacaaguauaacgugucgggaacaaauggcaccugucugcuagcaucuaugggccuccagcugaaccuuacguacgaaaggaaagauaacacuacagucacccggcuguugaauaucaaccccaauaagacuuccgcuucagggaguugcggagcccaucucgugacacuggaguuacacagcgaggguaccacggugcugcucuuucaauucggcaugaacgcguccucuagccgcuuuuuccuucaggggauacagcugaauaccaucuugccugacgcccgagauccagcauuuaaagcugccaacggaucacuaagagcucugcaggccacagucggcaauaguuauaaguguaacgcagaggaacacguuagggugacuaaggccuucuccguaaauauuuucaaaguguggguccaagccuuuaagguggaaggugggcaguucggaagcguugaggagugccuccuggacgaaaacucuaugcuuauccccauugcggugggcggcgcacuggccggguugguccucaucgugcugauagcuuacuuaguaggacggaaacguucacaugccgguuaccagaccauuuga

SEQ ID NO: 58314 - RNA, 1236 nt, Artificial Sequence
  derived and/or modified sequence opt3 from LAMP2__Homo_sapiens__NP_001116078
auggugugcuucagacuguuucccgucccuggcagcgggcucguucuugugugucugguauugggagccgugagguccuacgcuuuagagcugaaccuaaccgacucugaaaaugcaacaugccucuaugccaaguggcagaugaacuucacuguccgguacgagacgaccaauaaaacauauaagacugugaccaucucagaucacgguacaguuaccuacaacggcaguauuuguggggacgaucaaaauggaccaaaaauagcggugcaguuuggcccggguuucagcuggaucgcuaacuuuacuaaggccgcauccacauauucuauugacucggucucauucagcuacaauaccggggauaacacgacuuuucccgacgccgaagauaaaggaauccugaccguggacgagcuucuggcuauucgcaucccuuugaaugaucucuuccgaugcaacagucuguccacacuggaaaagaaugacguaguucagcauuauugggaugugcucguccaggcauuugugcaaaacggcacugugucuaccaaugaguucuuaugugacaaggauaaaacaagcaccgucgccccaacgauacacacuacaguucccuccccuaccacuacaccaacccccaaggagaaaccugaagcuggcacguacucagugaacaaugggaacgauaccugccugcuugccacaaugggauugcagcugaacaucacucaggacaagguagcgagugugauuaauaucaacccaaauaccacacauagcacugguucuugucguucccacaccgcacuacucagacugaacucaagcacaauuaaauaccuugacuuugucuucgccgugaagaaugagaacagguuuuaucugaaggaaguuaauaucaguauguacuuggugaacggcucugucuucuccauagcuaauaacaaucucagcuauugggacgccccgcuggggucgucuuacaugugcaacaaagagcagaccguguccguaucaggagcauuccaaauuaauacuuuugauuuacggguucagcccuucaacgugacgcagggcaaguauaguacagcugaggaauguagcgccgacuccgaucugaauuuucucaucccugucgcggugggugucgcccuuggguuccugauuaucgugguuuuuaucucuuacaugauuggacgcagaaaaagcaggaccggcuaucagucaguguga

SEQ ID NO: 58315 - RNA, 1251 nt, Artificial Sequence
  derived and/or modified sequence opt3 from LAMP3__Homo_sapiens__NP_055213
augcccagacagcugagcgccgcugcagcccucuucgcgucccuugcugugauccugcacgacggcucucaaaugagggccaaggcauuuccugagacccgggauuacucacagccaacagccgcugcaacuguccaggacauuaaaaagccgguucagcaacccgccaaacaggcuccucaucagacguuggccgcgcgcuucauggaugggcacauaaccuuucagacagcagccacugugaagaucccaaccacaacccccgcuacuacuaaaaacaccgccacgacaaguccuauuaccuauacauuaguaacuacccaagcaacaccaaauaacagccauaccgcucccccugugacggaagucacugugggaccaucccuggccccguacucucuacccccuacaaucaccccacccgcgcacacuacagguaccucgucaagcacgguuagucauaccacaggcaauacuacccagccuuccaaccagacaacucucccagccacccugucuauugcacuucacaagagcacaaccgggcagaagcccgugcaaccgacucacgcuccuggaacgacagccgcugcccauaauaccacucgaaccgcagcccccgcuuccacagucccaggcccuacccuggcgccccagccaucaagugugaaaacugguaucuaucagguauugaacgggagccgucucugcauaaaggcagagaugggaauccaacugauuguucaggacaaagaaucuguguucucccccagaagguacuuuaauaucgauccuaacgccacacaggcuucaggcaauuguggcacgcgcaagagcaaccugcucuuaaauuuccaagggggauuugucaaccugaccuucacuaaagacgaggaaaguuauuacauuucugaggugggugccuaucuuacaguguccgauccagagaccaucuaccagggcauaaagcacgcagucguuauguuucagacagccguggggcauagcuucaagugcguaucggaacagucuuugcagcuguccgcucaccuacaagugaaaacuaccgacguccagcuccaggccuuugauuucgaggacgaucacuuuggaaauguggacgaauguucaagugauuacacgauuguucugccggugaucggcgcaauugucgugggucuuugccugauggggaugggaguauauaagauccgguugagaugucagagcuccggcuaccaaaggaucuga

SEQ ID NO: 58316 - RNA, 486 nt, Artificial Sequence
  derived and/or modified sequence opt3 from LAMTOR1__Homo_sapiens__NP_060377
augggcugcuguuacagcuccgagaacgaagacucugaucaggacagagaggaaaggaagcugcuccuugaucccucaaguccuccaaccaaagcccugaauggggcugagccgaacuaucacagcuugcccuccgcacggacagacgaacaagccuuacugucuucgauccuagcgaagacugcuucaaauauuauagaugugagcgccgcagacagucagggaauggagcagcaugaguacauggaucgcgcccgacaguauuccacgcgucucgcuguccugucuagcucccuuacccacuggaaaaagcugccuccauugcccucacucacaagucaaccucaucagguucuggcaagcgaaccaauccccuucucugaccugcaacagguguccagaauugccgcuuacgccuauucagcgcucagccagaucaggguagaugcaaaagaggaauuagugguccaguuugguauuccuuga

SEQ ID NO: 58317 - RNA, 288 nt, Artificial Sequence
  derived and/or modified sequence opt3 from LAMTOR2__Homo_sapiens__NP_001138736
augcugagacccaaggcccucacccaggugcuuagccaagcuaacacaggcgggguccaguccacucuguuguuaaauaacgagggaucucugcuagcauacucagguuauggcgacacggaugccaggguuaccgcggcuaucgccaguaauauuugggcagccuacgaccggaacgggaaucaggcuuucaacgaagauaaucucaaauuuauacugauggacugcauggcacaggcccuugugcaauaucuggaggaaccuuugacacagguagcugccagcuga

SEQ ID NO: 58318 - RNA, 375 nt, Artificial Sequence
  derived and/or modified sequence opt3 from LAMTOR3__Homo_sapiens__NP_068805
auggccgacgaucugaagagauuccucuacaaaaagcugcccagcguggagggccuucacgcuaucgucguuuccgacagggauggggugccuguaauuaaaguggcaaacgacaaugccccagaacaugcguugcggccgggauuuuuaucuaccuucgcucuggccacagaucaggguucaaagcuaggccucaguaaaaacaagagcauaaucugcuauuacaauacuuaucaagucgugcaguuuaaccgccugccccuuguuguguccuucauugcaucuucgucagccaauacggggcugaucgucagcuuggagaaggaacucgcuccucuguuugaggaacugcgacaggugguagagguuaguuga

SEQ ID NO: 58319 - RNA, 1200 nt, Artificial Sequence
  derived and/or modified sequence opt3 from LANCL1__Homo_sapiens__NP_001130047
auggcccagagagcuuuccccaacccuuacgcagacuauaauaagagccuggccgagggcuacuuugaugcggcugggaggcucaccccagaguucucccaacggcuuacaaacaaaauccgcgaacuguugcagcagauggaacgaggauuaaagucugccgacccgcgugaugguacuggcuauacggggugggcaggaauugccgugcuguaccuacaccucuaugacgucuuuggcgaucccgcuuaccugcagcuugcacaugguuauguuaaacaaucacugaauugcuugaccaagagaaguauaacauuccucuguggggacgccggaccucuggcuguggccgcgguacuguaccacaaaaugaacaaugagaagcaggcagaagauugcaucacuaggcucauucauuuaaacaagaucgacccacacgcccccaaugagaugcuguacggccggauuggcuauaucuacgcucuuuuguuugugaacaaaaauuucggggucgagaagauaccucagagccauauccagcaaauuugugaaaccauccugacauccggagagaaccuagcccgcaaaagaaauuuuaccgcaaagucuccacucauguaugaaugguaccaggaguauuacgugggugcugcccacggccuggcggggauuuauuacuaccuuaugcagcccucgcugcagguuucacaaggaaaauugcacagccucgugaagccuagugucgauuaugugugccagcugaaguucccauccggcaacuacccgcccuguaucggugacaauagggauuuacugguacauuggugccacggggccccuggaguuauauauaugcucauucaggcauacaaaguguuucgggaggaaaaguaucuuugugacgcuuaccaaugcgccgaugucaucuggcaguauggccuguugaaaaagggcuacgggcuaugucauggaucugcugguaacgccuacgcauuccugacucucuauaaucugacacaggacaugaaauaccuuuaucgcgccugcaaguuugcugaguggugucuggaauacggcgagcacgggugccgaaccccagacacgcccuucagcuuguuugaaggaauggcgggcacuauuuauuuccucgcagaucuguuagugccuaccaaagccagauucccagcuuuugagcuguga

SEQ ID NO: 58320 - RNA, 1353 nt, Artificial Sequence
  derived and/or modified sequence opt3 from LANCL2__Homo_sapiens__NP_061167
augggcgagaccaugagcaagagacugaaacuccaccuugggggagaagccgagauggaagagagggcuuucgugaaccccuuuccugacuacgaagcagccgcgggugcucuguuggccuccggcgcagccgaggagacagggugcguccggccaccggcuacuacggaugaacccggauuaccuuuccaucaggacggcaagaucauucacaauuuuauacgccgaauccaaaccaaaauuaaggaucugcuacagcagauggaggaaggucucaaaacagcagacccacaugauuguucugccuauacuggguggaccggaaucgcucugcuuuaccugcaguuguaucguguuacaugcgaccaaaccuaccuccugagaucacuggauuaugugaagaggacucuccggaacuuaaauggccgcagaguaacauuccuguguggcgacgccgggccccuugcggugggagcagucauuuaccacaaguugaggagugauugcgagagccaggagugugugaccaaacugcuacagcuccagcgguccguugugugccaagaaucugaccugccugaugagcuucuguauggucgcgccggcuacuuguacgcucuccuguauuuaaacacggaaaucgggccaggaacugucugugagucggccauaaaggaagugguaaaugcaaucauugagucaggcaaaacccugagccgagaggaaagaaagacagagaggugcccccuccuuuaccaguggcaucggaaacaguauguuggugcugcccacgggauggcgggaaucuacuauaugcugaugcagccugccgcaaagguggaccaagaaacuuugaccgagauggucaagccaaguauugauuacgugcgucacaaaaaguuucgcuccggcaacuauccgucuagccuauccaaugaaacagacagacuggugcauuggugucacggcgcucccggggucauccauaugcucaugcaggccuacaaaguuuucaaggaggagaaauaccugaaggaagcuauggagugcucagacgugauauggcagaggggacuucugcggaaagguuauggcauuugucacgggaccgccggaaacggcuacagcuuuuugagucucuaucgacugacgcaagauaagaaguacuuauaucgcgcaugcaaauucgccgaauggugccuggacuacggugcucacggguguagaaucccugauaggccauauucucuauuugagggcauggcgggagcaauucauuuccucuccgacguacugggccccgaaacuucacgguuuccugccuucgagcuugauagcaguaagcgcgacuga

SEQ ID NO: 58321 - RNA, 1560 nt, Artificial Sequence
  derived and/or modified sequence opt3 from LAP3__Homo_sapiens__NP_056991
auguuccugcucccccuuccugccgcuggcagaguggucguuaggcggcuggcagugcgccgauuugggagccguuccuugucuaccgccgacaugacaaagggauuaguacuggguaucuacucaaaagagaaggaagaugacgugccacaguucacgagugcgggcgagaacuuugauaaacuacucgcugggaagcugagagaaacucuuaauauuagcggaccgccccugaaagccggcaagaccaggacauucuaugguuugcaccaagacuuuccuuccgucgugcucguugggcugggaaagaaagcagccggcauagaugagcaggaaaacuggcaugagggcaaggagaauauccgggcugcaguggccgcugggugccgccagauucaggaccuggaacucucuucggucgagguggauccauguggagacgcccaagcggcagccgaaggugcuguauuaggccuguacgaguaugaugaccuuaaacagaagaaaaagauggccguuucagcaaaguuguacgggagcggagaucaggaggcuuggcagaaaggcgugcuguucgccaguggucaaaaccuagcgagacagcucauggaaacucccgccaaugagaugaccccuacaagguuugcagaaaucauugagaagaaccugaaauccgcuucuagcaagaccgaaguccacauccggccaaaauccuggauagaggagcaggccauggggucauuccuuaguguggcuaagggaagcgacgaacccccuguguuucuggagauccauuauaaaggcucuccaaaugccaacgaaccgcccuuggucuucguuggcaaggggauuacuuuugauuccggagguaucucaauuaaggcaagcgccaauauggaccucaugcgcgcugacaugggcggggcggcaacaaucugcagugccauagugucugcugccaaacugaacuuaccuauuaauaucauuggacuggcaccacucugugagaacaugcccuccggcaaggccaauaaaccuggugauguagugcgagcuaagaacgggaaaaccauccaggucgacaauacggaugccgaaggcagacuuauccuggcagacgcguugugcuacgcucacacuuucaacccaaaggugauucuaaacgccgcaacccugacaggagccauggauguugcucucggcagcggggccacuggaguguuuaccaauucgucuuggcuguggaacaaacuuuucgaggcauccauagagacaggugacagggucuggcggaugccccuguucgaacauuauacccgucaagugguagauugucaguuggcugacguuaauaacaucggcaaguaccgcucagccggggcgugcacggccgcugcauuucucaaggaguucgugacucacccgaaaugggcccaccuggauauugcuggagucaugacaaauaaggacgaagugccuuacuuaagaaaaggcaugaccgguaggcccacucggacacugaucgaguuucuacuccgauucagucaggauaacgccuga

SEQ ID NO: 58322 - RNA, 954 nt, Artificial Sequence
  derived and/or modified sequence opt3 from LAPTM4B__Homo_sapiens__NP_060877
augaccagcagaacaagggugacuuggcccuccccuccacggccgcugcccgucccugccgcugcagccguugcguucggcgcuaaggggacggacccagccgaggcacgaucuucacgcggaaucgaagaggccgguccccgugcucacggcagagcagggagggaaccugagcggcgcagaaguaggcagcaacggcgcggaggccuccaggcccgaagaagcacccuucugaaaacaugcgcuagggcccgggcgacugcaccaggugccaugaagaugguggcucccuggacccguuuuuacuccaacucuuguugcuuguguugccauguacgcacagggaccauuuuacugggagugugguaucuaauaaucaaugccgucgugcuccugauucuucugucggcauuggcugauccugaccaguacaacuucucaagcagugaacucggcggcgauuuugaguucauggacgaugccaauauguguaucgcgauugccaucucccugcugaugauacucaucugcgcaauggcuacuuauggggccuacaaacagagagcugccuggauuaucccauuuuucuguuaucaaauuuuugacuucgcauuaaacaugcugguugccaucacagugcuuauauaccccaauucuauucaggaguauaucaggcaguugcccccuaacuuuccauaccgggaugacgucaugagcgugaauccgaccugccugguacuaauuauccuccuguucaucuccauuauacuuacguuuaagggauaccugaucucauguguuuggaacugcuaucgauacauuaauggucgcaacaguagcgauguguuggucuaugugacuucuaaugacaccacagugcuccugccuccauacgaugacgcuacugucaacggcgcggcaaaagaacccccgccucccuauguuuccgccuga

SEQ ID NO: 58323 - RNA, 2271 nt, Artificial Sequence
  derived and/or modified sequence opt3 from LARGE__Homo_sapiens__XP_005261889
augcugggcaucugcagagggaggcggaaguuccucgccgcuagccuuucccuguuguguauucccgcaauaaccuggaucuacuuauuuucuggaucauucgaggacgguaaaccugugagucugagcccacuagaaucccaggcccacucuccgcgcuauacagcgucgucacaacgagagcgugaaagccucgaggucagaaugagggaaguugaggaggaaaaccgggcucugcgcagacagcuuagucuggcccagggcagggcacccucccaucggcgcgggaaucacucuaagacuuacagcauggaggaaggaacgggcgauuccgagaacuugcgagccgguauuguggcugggaauagcagugagugcggacagcaaccuguaguggaaaaaugugagaccauccaugucgcaauugugugcgccggcuauaacgcuagcagagacguugugacacucgucaagucugugcuguuucacaggcggaauccacugcauuuccaccucaucgccgauuccauagcggaacagaucuuagcaacucuguuucagaccuggaugguacccgccguucguguggacuucuacaacgcugaugagcuuaaaucagaagucagcuggauuccuaauaagcacuauaguggcaucuacggguugaugaagcuggugcuaacaaaaacccucccagccaaccuggagcgcgugauuguccuugacacugauaucacauuugcaaccgacauagcugagcugugggccguuuuccauaaguuuaaaggacagcaaguguugggucucguagaaaaucagucugauugguaucugggcaacuuauggaagaaucacagacccuggccugcgcuggggaggggauacaacacgggcgugauucuccuucuguuggacaaacuacggaagaugaagugggagcagauguggcgacugacugccgaacgcgagcucauggguaugcuguccaccagccuugcagaucaggacaucuucaaugcugucauuaaacaaaacccauuucugguguaccaguugccguguuucuggaauguucagcucucggaucauacaagaucugaacaaugcuauagggacguguccgaccugaaggucauccacuggaacucacccaaaaaguuacgggugaaaaacaagcacguagaguuuuuccgcaaucuguaccuaacuuuccucgaguaugaugggaaccugcuuagaagggaauuguuuggauguccuagugaggccgacguuaauagcgaaaaccugcagaaacagcucuccgagcuggaugaagacgaucuuugcuacgaguuccgucgggagcgauuuaccgugcauagaacacaccuguauuucuugcauuacgaauaugagccagcugccgacucuaccgaugucacgcucguggcacagcugagcauggacagguuacaaaugcuggaagccaucuguaagcacugggagggccccauuucacuagcucucuaccugagugaugcggaggcacagcaguuucuucgcuacgcccagggcuccgaagucuugaugagccggcauaaugugggguaucacauaguuuacaaggagggacaauucuauccugugaaccugcucagaaauguagcuaugaaacacaucucuacuccauacauguuucugucagacauugauuucuuacccauguauggucuguacgaauaucuuaggaagagugucauccaguuggaccucgccaacaccaaaaaggcaaugauagugccggccuuugagacacugcgcuaccgacuaucauucccuaaauccaaggcugaacugcucucuaugcuggacaugggcacucuuuuuacauuccgguaccauguuuggaccaaggggcacgcccccacgaauuuugcaaaauggcguaccgcgacaacuccauauagaguggagugggaggcugauuucgaaccuuacgucgugguaaggcgcgacugccccgaguaugaucggagauucgugggauuuggcuggaacaagguugcccauauuauggaauuggacguccaggaguacgaguucaucgugcugccaaaugcauauaugauccacaugccccacgccccuucguuugauauuaccaaauucaggagcaacaagcaguaccgaaucuguuuaaaaacacucaaggaagaguuucaacaggacaugucccgccgguaugguuucgcugcccugaaguaccuuacugcagaaaauaacucauga

SEQ ID NO: 58324 - RNA, 3060 nt, Artificial Sequence
  derived and/or modified sequence opt3 from LARP1__Homo_sapiens__NP_056130
augcuguggagagugcuccuuagcaagaggcccccuuucccacacccggagcuggacuuucaggaagcccccaucccuuccugcccaggccgguugcccgggcgcaaaaacucugucgcuuuagcagccgcgccucgaaaggagccaaccggagaucgugaaaaaccccugccuuucccaguucuagcuccguuuucaaaucccgagcauagugccccugcaaaggugguaagagccgcugugccaaaacaaaggaaggguagcaaggucggcgacuucggggaugcaauuaacuggcccacaccuggagaaauagcccacaaauccgugcagccacagucucauaagccccagccgacucggaaacucccucccaagaaagacaugaaggagcaagagaagggcgaagguucggauucaaaagagagcccaaagacgaaaagugacgaauccggggaggagaagaauggagaugaagacugucagcgcggcggccagaaaaagaaagggaacaagcacaaguggguuccucugcagaucgauaugaaacccgaggugccaagagaaaaacuugcuucuaggcccacccggccuccagagccgcgccauauucccgccaaucgaggagaaaucaaagguagcgaguccgcgacauacgucccuguggcaccacccacuccugccuggcaaccagagauuaagcccgaaccggcuuggcacgaccaggaugagaccucaaguguaaaaagcgacggcgccgggggagcaagagcuucuuuuaggggccggggucgugggcgcggaagaggcaggggccgggggcgaggagguacacgcacccacuucgauuaucaguuuggcuacagaaaguucgacgggguugaaggaccuaggacuccaaaguauaugaacaauaucacauacuauuuugacaacguguccucaaccgagcuguacagcgucgaucaggaauugcucaaagacuauauaaagcggcaaaucgaguacuacuucaguguggauaaucuggagcgcgacuuuuuccugagaaggaaaauggaugccgacggcuuucuccccauuacguuaaucgcgucuuuccaucgugugcaggcccugacuaccgauauuucccuuaucuucgcagcuuugaaggacagcaaagucguugaaauaguggaugagaagguacggcgaagagaggaaccugaaaaguggccccugccaccuauuguggacuauucgcagacagauuuuucucaacuacucaacugccccgaguucgucccaaggcagcacuaccagaaagagacugaauccgccccggguucaccucgcgcugugacccccguuccaacaaagaccgaggaagugaguaaucugaaaacgcuucccaaggggcugagcgccuccuugccugaccucgacucugagaacuggaucgaggucaaaaagcggccaagacccagcccugcaaggccgaagaaaucagaagagagucgcuuuucccaucugacuagcuuaccacagcaacugcccucucagcagcucaugucaaaggaucaggacgaacaagaggaacuugauuuccuguuugacgaggagauggaacagauggauggccgaaagaauacauucaccgccuggagugacgaggaaagcgauuaugagauugacgaucgggacgugaacaagaucuugaucguaacucagacaccucacuacaugcguagacacccaggaggcgauaggaccgggaaucauacgucccgcgcuaaaaugucugcggaacuagcaaagguuauuaacgacggacuguuuuauuacgagcaggaucucugggccgagaaauucgaacccgaguauucgcaaauaaagcaggaaguggagaacuuuaagaaagucaauaugaucagccgggaacaguucgacacccugacaccugagccgcccguggacccaaaccaggaggucccucccgguccaccuagauuucaacaggugcccacugaugcucuugccaauaagcuguucggcgcaccagaaccguccaccauugccaggucauugccuacaacuguucccgagaguccaaacuaccgaaauacccgcacaccccggaccccuagaacuccacagcucaaagacucuagccaaacguccagguuuuaccccgugguaaaggaagggcguacacuggaugcuaaaaugccucgcaagcggaagaccagacacucaagcaacccgccauuagagucucaugucggaugggugauggacuccagggagcaccgaccccggacugccaguaucucuucuuccccuucagaaggcacccccacaguugguaguuauggguguaccccacagagccugccuaaauuccagcaucccucgcacgagcuacucaaggaaaauggcuucacucagcacguguaccauaaauaucgcagaaggugccugaacgagcggaagcgacuuggaauaggccaaucccaggaaaugaauacauuguuuagauucuggagcuuuuuccugcgcgaucacuuuaacaaaaagauguacgaggaguucaagcagcucgcacuggaagacgcgaaagagggguauagguacggacuugaaugucuguuucguuauuacagcuacgguuuggagaagaaauuccggcucgauauuuuuaaggacuuccaggaagagacggucaaagauuaugaggcuggccaacuguacggguuagaaaaguuuugggccuuccugaaguauucaaaagcaaagaaucuagacaucgauccaaaacuccaggaguaccugggaaaguuuagaaggcuugaagacuuccgcguggauccuccgaugggcgaggaagguaaccauaaacgacacaguguaguggccgggggcggaggcggggagggaagaaagcggugccccucccagucuagcuccaggccagcugccaugaucucacagccucccaccccaccuacuggccaacccguucgcgaggacgcaaaauggacaagccagcacaguaauacccagacauuggguaaguga

SEQ ID NO: 58325 - RNA, 1749 nt, Artificial Sequence
  derived and/or modified sequence opt3 from LARP4__Homo_sapiens__NP_001164274
augcuccuguucgucgagcaggucgccagcaagggcaccgggcuuaaccccaaugcuaaaguuuggcaagaaaucgcaccuggaaacacagacgccacuccagugacgcacgguaccgaguccucuuggcaugaaauugcggcuacaucaggcgcccacccggaggggaaugcagaacugagugaggauauaugcaaggaguacgaaguaauguauagcuccucuugugagacuaccagaaacacaaccggaaucgaagagucgacugacggcaugauuuugggucccgaggauuuaucauaccagaucuaugacgugagcggggaaaguaauuccgccgucucuacagaggaucugaaagaaugccuaaagaaacagcucgaguuuuguuucagcagggaaaaccuguccaaggaccuuuaccugauuucacagauggauagugaccaauuuaucccuauauggaccguggcuaauauggaggagaucaagaaauugacgacugauccagaccucauucuggaaguucugcggagcucucccauggugcaggucgaugagaagggagaaaaagugcgcccuucccauaagcgaugcaucguaauucuccgugagaucccagaaaccacacccauagaggagguuaaaggcuuauucaagucagaaaacuguccuaaggugauuagcugcgaguuugcacacaauaguaacugguauaucacuuuccagucugacaccgaugcccagcaggcuuuuaaauaccugagagaagaggucaagacauuccaaggcaaaccaauuauggccccguuucccaauggguccuucgugaacggauuuaauagcccugguucguauaagaccaacgcggcagccaugaauaugggcaggccauuccagaaaaaccggcgcacgcuuuuuagagggaggcggcgccgagaagacgacagaaucucuaggccccauccuuccacugcugagucaaaggccccaacacccaaauucgauuugcuggcaaguaacuucccgccucuacccggaagcuccucucggaugccaggcgagcucgugcuggaaaaucguaugagcgacgucguuaaggguguguacaaggagaaagauaacgaggaacuuaccaucucauguccuguacccgcugacgagcagacugaaugcacaagugcccaacagcugaauauguccaccagcucuccaugugcggccgaguugacggcacucucaaccacacagcaagaaaaggaucugauugaggacaguagcgugcagaaagauggguuaaaccagacuaccauacccgucuccccuccaucuacaacuaagccgucgcgcgcuagcaccgccucccccugcaauaacaauaucaacgcugccacagcaguggcccugcaggaaccuagaaaacucucauacgcugagguuugucaaaagccacccaaggagccuaguucugugcuuguccagccacugagggaauugcggagcaaugugguaucccccaccaaaaacgaggacaauggagcgccggaaaacucaguugagaagccucacgaaaaaccagaggcacgagccagcaaggauuauucuggcuuucgcggcaauauuauccccagaggggcugccggaaaaauaagggagcagcggcgccaguucucccacagagcaauuccucaaggugugacuaggcguaacggcaaggaacaguacgugcccccacggaguccuaaguga

SEQ ID NO: 58326 - RNA, 1476 nt, Artificial Sequence
  derived and/or modified sequence opt3 from LARP6__Homo_sapiens__NP_060827
auggcccagagcggcggggaggcuagacccggaccuaagaccgcagugcaaaucagggucgccauucaggaagcggaggacguugaugaacuggaggacgaagaggagggugcugaaacacggggcgccggggauccagcacgcuaccucuccccgggauggggcucugccucagaggaagaacccagucgaggucacagcgggacuacggcuuccggaggcgagaacgaacgugaggaccuugaacaggaguggaaaccuccagaugaggagcugauaaagaaauugguggaccagaucgaguucuauuuuucugaugaaaauuuagagaaggacgcauuccugcuaaaacauguaagaaggaacaagcucggcuacgugucggucaagcugcuuaccucauuuaaaaaggugaaacaccugacacgggauuggcgcacuaccgcccaugcuuugaaguauagcguugugcucgaacugaaugaggaccacagaaaagucaggcggacaacccccgugccucuguucccaaacgaaaaucuccccaguaagauguuacugguauacgaucuuuauuuguccccuaagcugugggcccuagcgacuccacagaaaaacgggcgcguucaagagaaggugauggagcaucuccugaaacuuuuuggaacauucggugucauuucuagcgugcgaauccugaagccgggcagagaauugcccccugacauuaggcggaucuccucacguuacagucagguggggacccaggagugcgcaauagucgaauuugaggaaguugaggccgcuaucaaagcccacgaguucaugauuacggaaagccaaggaaaggagaauaugaaagcagugcucaucggcaugaagccacccaagaaaaagccugcuaaagauaagaaccacgacgaggaaccaacugccucuauucaucugaauaaauccuuaaacaagcgcguagaggaacugcaguauaugggugacgagucaagcgcgaauaguucuuccgaucccgaaagcaacccgaccucgccuauggccgggagaaggcacgcagcuacaaauaagcucucucccuccggacaucagaaccuuuuucugucaccaaaugccaguccuuguacuagccccugguccucuccauuggcucagcggaaaggcgugagccgaaagucaccccuagccgaggaaggccgccugaacugcaguaccuccccugagaucuucagaaaauguauggacuacagcucugauucaagugucacaccaagcggguccccgugggugaggcggcgcagacaagcagagaugggaacccaggaaaagucucccgguacgucgccucuccugagcaggaaaaugcagacugccgacggccuuccaguuggggugcugcguuugccccggggaccugauaacacacgaggcuuucacggucacgagagauccagggcuugcgucuga

SEQ ID NO: 58327 - RNA, 1770 nt, Artificial Sequence
  derived and/or modified sequence opt3 from LARP7__Homo_sapiens__NP_001253968
augauccccaacauugagggcauggaaaccgagagcgggaaucaggaaaaggugauggaggaagaguccacagagaaaaagaaagaagucgagaagaaaaagagaucuaggguuaagcaagugcuggccgacauagcuaaacagguagauuucugguuuggagacgcaaaccuccacaaggaucgguuccuucgcgaacagaucgagaaaucacgagacgguuacguggauauuagucuguuggucagcuuuaauaagaugaaaaaguuaacuacggacggcaagcugaucgcccgugcgcuaagauccucugcugugguugagcucgaucuggaagggaccaggauucggcgcaaaaagccucuuggagagagaccaaaagacgaagaugagaggacaguguaugucgaacuguugccgaagaacgugaaucauucguggaucgagcggguauucggcaaaugcgguaacguuguguacauaucaaucccccacuauaagagcacuggggacccuaaaggauuugccuucgucgaguuugaaaccaaggagcaggcagccaaggcuauugaguuccucaauaacccacccgaagaagcaccucgcaaaccaggcaucuuucccaagacagugaaaaauaagccuauuccagcccugcgaguggucgaggagaaaaagaagaaaaagaaaaagaaaggcagaaugaagaaggaagauaacauccaagcuaaagaggaaaauauggacaccaguaacacuuccauaucuaagaugaaaaggagccggccgacauccgaggggucagauauugaaaguaccgagccccagaagcaguguagcaaaaagaagaaaaagcgugaccgcguugaggccucuucccugccugaagugagaacgggaaaaaggaagcggucaagcagugaggacgcggaaucucucgcaccacgauccaaaguaaagaaaaucauucagaaggauaucaucaaggaggccagcgaggcuucgaaagaaaaucgcgacauugagauaucuacugaagaggaaaaggauaccggugacuuaaaagauuccucacugcuuaagacaaaaagaaagcauaagaaaaagcacaaagagaggcauaagaugggcgaggaagugauccccuugcggguccugaguaaaagcgaguggauggaccuaaagaaggaauaccucgcccugcaaaaagcauccauggcuucucuuaagaaaacuauuagccagaucaagucagagagugaaauggagaccgauuccggggugccucagaacacaggaaugaaaaaugagaagaccgccaaccgcgaagagugcagaacgcaggaaaagguuaacgcgacuggcccacaauucgugagcggugucauagugaaaauuaucucuacagagccccugccggggaggaagcagguacgugacaccuuggccgcaaucucagaaguucucuauguggaucuguuagagggagacacugagugucacgcucgguuuaaaacaccugaagaugcccaggcugucauuaaugccuacaccgagaucaacaagaaacacugcuggaagcuggaaauucucaguggcgaccaugagcaacgauauuggcagaaaauacuuguggacagacaggcaaagcugaaucagcccagggagaagaaacgcggcacggaaaaguugaucaccaaagccgagaagauucggcuagcuaaaacacaacaggcgagcaagcacaucagauucuccgaauacgauuga

SEQ ID NO: 58328 - RNA, 2712 nt, Artificial Sequence
  derived and/or modified sequence opt3 from LARS2__Homo_sapiens__NP_056155
auggccagcguguggcagagacugggcuucuacgcuucccuccuuaagaggcaacugaacgggggacccgacgucaucaaaugggagcggcgcguuauuccugguugcacccgaucuauauauucagcaacaggcaaguggacuaaagaauacacguugcagacccguaaggauguggagaaaugguggcaccagagaaucaaggaacaggccaguaagauuagcgaggcggacaaauccaagccaaaauuuuauguauuaucuauguucccguaccccucggggaagcugcauaugggacacgugagggucuauacaaucucagauacuauugcucgguuucagaaaaugcgcggcaugcaagugaucaauccuauggguugggacgccuucgggcuaccagcagaaaacgccgcuguugagagaaaucuccauccccagagcuggacccagaguaacauaaagcacaugaggaagcaacuggaucggcuuggacuguguuuuuccugggaccgcgagaucacaaccugcuugccugauuacuauaaauggacucaguaccucuucauuaagcuguacgaagcaggccuggccuaucagaaagaggcucucgugaauugggacccagucgaucagacaguguuagccaacgaacaaguagacgagcauggcuguucuuggcgaagcggggcgaagguugagcagaaauaccugagacagugguuuaucaagaccacggcauaugccaaagcuaugcaagaugcccuugcagacuugcccgaaugguacggaauuaaggguaugcaggcucacuggaucggcgauugcguggggugucaccuggacuucacucuaaagguccauggacaggccaccggcgagaaacucacagcguauacugccaccccugaagcaauauacgguacaucccacguggcuauuucaccaagucauaggcugcuucacgggcacagcucucugaaggaggccuugcggauggcucucgugccgggaaaagacugccugacccccgucauggccguuaauauguuaacgcagcaagaagugccuguagugauccuggcaaaggccgaucucgagggcucccuugacucaaaaauuggcaucccaagcacaaguucugaggauacuauccuggcucagaccuuggggcuagcguauuccgaagucauugagacucugcccgacggaacagaacgucucagcucgucugcagaguuuaccgguaugacgcgccaggaugccuuccuggcucuuacccagaaggccagaggcaagaggguugggggagacgugacauccgauaaacugaaggacugguugauaucacggcaacgauacuggggcacuccuaucccaauugugcauugucccgucugcgguccgaccccugugccccucgaagaucugccaguaacauuaccuaacaucgcaaguuuuacugggaaaggcggacccccacuggccauggcuagcgaguggguuaauuguuccugcccccgcuguaagggcgccgcaaaaagagagaccgacacaauggauaccuucguggacucugcgugguacuauuuuagguacacugacccucacaacccacauagcccguucaauacggcugucgccgauuauuggaugcccguggaccuauacauagggggaaaggaacacgcagucaugcaucucuucuaugcccgguuuuucucacacuuuugccacgaucagaagauggugaaacaucgcgagccuuuccacaagcugcuugcucaggguuugauuaaaggccagacauuuagacugccaagugggcaauaccuccagagggaagagguugaccugaccggauccgugcccguacaugccaagacuaaagaaaaacuugaggucaccugggagaagaugagcaaaucuaagcacaacggcguggauccugaagagguuguggaacaguaugguaucgacacaauccgucuguacauuuuguucgcagcuccacccgagaaagauauccucugggacgucaagaccgaugcccugccggggguguuacgguggcagcaacgacuguggacucuaacaacgagauuuauugaggcgagggccucaggcaaaaguccucagccacagcuccugagcaauaaggaaaaagcugaggcacgcaaacuuugggaauacaagaacuccguaauaucucaagugaccacucacuucacagaggacuuuucguugaauagcgccaucucccagcugaugggacucucaaacgcucugagucaggccucucagagcguuauuuuacauucccccgaguucgaagaugcacugugcgcgcuuauggucauggccgcuccuuuggcaccccacgugaccucagagaucugggccggccucgcucuggugccacggaagcuaugugcccauuauacaugggacgcaagcguccugcuccaagccuggccugcuguugaucccgaauuucugcagcagccagagguggugcagauggcgguacuuaucaacaauaaggccugcgggaaaauuccggucccucaacagguggcaagagaccaggacaagguucacgaguucguguugcagucugaacugggagucagguuacuccaaggucgcuccauaaagaagaguuuucugagcccccgaacugcucuuaucaacuuccuggugcaggauuga

SEQ ID NO: 58329 - RNA, 3531 nt, Artificial Sequence
  derived and/or modified sequence opt3 from LARS__Homo_sapiens__NP_064502
auggccgagagaaagggcaccgcuaaaguggacuuccugaagaaaaucgaaaaggagauucagcaaaaaugggauacagaaagggucuuugagguuaacgcaagcaaucucgaaaagcagacuuccaaggggaaauacuucgugacguuucccuauccuuacaugaacggacggcuucaccugggucauaccuucucuuugucaaagugcgaguuugccguaggcuaucagcgcuuaaaagggaaguguugccuguucccauuuggacuacacuguacaggcaugccgauaaaagcgugcgcugacaagcucaagcgagagaucgaacuguacgguugucccccugauuucccagacgaggaagaggaggaagaggaaaccagugugaaaacugaggauauuaucauuaaggacaaagccaaggggaaaaagagcaaagcagccgcuaaggcaggauccucuaaguaucaguggggcaucaugaaaucgcuuggccugucagaugaagagauagucaaguuuagcgaggccgaacauugguuggacuacuuucccccucucgcuauccaagaucugaaacguauggggcugaagguggacuggagaaggaguuucauuacaaccgauguuaauccauauuacgacuccuucgugcgguggcaguuucucacuuuacgcgagagaaacaaaaucaaguucggaaagagguacacaauuuauucucccaaagauggucagccuugcauggaccacgaccggcagaccggcgaaggggucggaccacaagaguacacgcugcuuaaguugaaagugcuggaaccguaucccagcaagcuauccggccucaaagguaagaauaucuuccugguagccgcgacucuucgcccugagaccauguuugggcagacaaacuguuggguucgaccagauaugaaguacauaggauucgagacugugaauggcgacauuuuuaucugcacccagaaagcagccagaaacaugucauaucagggcuucacaaaggauaauggggucgugcccguggucaaagaacugaugggagaggaaauuuugggugcuagucucagcgccccucugaccucuuacaagguuaucuauguguuaccaaugcugacgaucaaagaggacaagggcacugggguagugacauccguccccucagauagcccggacgauauugcagcucucagggaccuuaagaaaaagcaagcccugcgggcgaaauacggaauacgugaugacaugguguugccuuuugaacccguuccagugaucgagauuccuggcuucgguaaccuaagugccgucaccaucugugaugagcugaagauacagucucagaaugaccgcgaaaaacucgcagaggcuaaggaaaagauuuaccugaagggguuuuaugagggcaucaugcuuguggacggauucaagggccaaaaaguacaggauguuaagaaaacuauccagaagaaaaugauugacgccggggaugcucugaucuacauggagcccgaaaaacaggugauguccagaagcucggacgagugcgucguggccuugugugaucaaugguaucucgacuacggagaagagaacuggaagaaacagacaucucagugccugaagaauuuagaaaccuuuugcgaggagacgaggcggaacuucgaagcaacccuggguuggcuacaggagcaugccuguucccgaacauauggccucgggacucaucugccaugggaugaacaauggcuuauugagucauugagugacagcaccauauacauggcuuuuuauacagucgcgcaucugcuccagggaggcaaucugcacggucaggcagaaucaccccuugggauccgcccucagcaaaugacuaaagaggugugggauuacguuuucuuuaaggaggccccauucccgaaaacccagauugcuaaggaaaagcuggaccaguugaaacaggaguucgaauuuugguaccccguggaucucagaguaucuggcaaggaccuggucccuaaccacuuaagcuauuaccuguauaaccacguggccauguggccagagcaaucagauaaauggcccacagcaguuagggccaauggacaccuacuccugaacagugaaaagauguccaaaagcaccggcaauuuccuuacuuugacgcaggcuaucgacaaguuuucugccgacgggaugcggcuggcacucgcggaugcuggagacacaguggaggaugccaacuucgucgaggcaauggccgacgcugguauccugcgcuuauacaccuggguggaauggguaaaggagaugguggccaauugggauucacugagaaguggcccugcaagcacuuuuaacgacaggguuuucgcuuccgaacuuaaugccgggauuauaaaaaccgaucagaacuaugagaagaugauguuuaaagaggcguugaagacaggauucuuugaguuccaagccgcuaaagacaaguaccgugaacucgcagucgaaggcaugcaccgggagcugguguuucgauucaucgaagugcagacccuacugcucgccccauuuugcccccaucugugugagcacauuuggacucuuuuggguaaaccggauucuaucaugaaugcuucguggccugucgccgggccaguuaacgaggugcugauucauagcucccaguauuuaauggaagugacacacgaccucagacugaggcuuaagaauuacaugaugcccgcaaagggcaaaaagacggauaaacagccucugcaaaagcccucacauugcaccaucuacguagcgaaaaacuauccaccuuggcagcacacuacauugaguguccuccgcaagcacuucgaggccaauaacggaaagcugcccgacaauaaagugauagcuucugaacuaggcagcaugccagagcugaagaaauacaugaagaaaguuaugccguucguggccaugaucaaggaaaaccucgagaagauggggccucggauucuggaucuucaguuggaguuugacgaaaaagcaguccugauggagaacaucguguauuuaaccaauucccucgaacuggagcauauugaaguuaaguucgcuucagaggccgaggacaaaaucagagaagauuguugccccggaaagccacuuaacguguuuaggauagagcccggcguaagcgucucucuggugaauccucagccauccaacggucacuucaguacaaaaauugaaauccgccaaggggacaauugugauagcauuauccgacggcuaaugaagaugaaccguggaauaaaggaccucucuaaagugaagcugaugagauuugaugaccccuugcugggcccuaggcgcgucccgguuuuagguaaagaguacacugagaagaccccaaucuccgaacaugcaguguucaauguagaucucauguccaaaaagauucaccugacggagaacggcauccggguggacauuggggauaccaucauauaucuuguccacuga

SEQ ID NO: 58330 - RNA, 2154 nt, Artificial Sequence
  derived and/or modified sequence opt3 from LAS1L__Homo_sapiens__NP_001164120
augagcugggaguccggcgccgggcccggacuggguucucagggcauggaccucguguggucagcuugguacgggaagugcgucaaaggaaagggcagucuuccucugagcgcacacgguaucguuguggccugguuguccagagcggaaugggaucaaguaaccguguauuuauucugugacgaucauaaacugcagagguacgcucuaaaccggauuacagucuggcgcucucgaucggggaaugagcucccacuggccguggcaucaacugccgaccuuauacguugcaagcuguuggauguuacgggaggccucggcaccgacgaacugagacugcucuaugggauggcuuuagugagguuugucaaccugaucagcgagcggaaaacaaaguucgcaaaggugccgcuuaaauguuuggcccaggaaguaaauauucccgauuggaucguugaccugcgccacgagcuaacucauaagaaaaugccucacauuaacgauugcagaaggggauguuacuuugugcucgacuggcugcagaagaccuauuggugccggcaacuugagaauagucugcgcgaaacaugggaguuggaagaguuccgagaggguaucgaagaggaagaucaggaggaagacaaaaacauagucguggaugacaucaccgagcagaagccagagccccaggacgauggcaaguccacugaaucugacgugaaagcugauggggacagcaagggauccgaggaagucgauucacauuguaaaaaggcccucagucacaaagagcuguacgaaagagcgagggaguuacugguuagcuaugaggaagaacaauuuacagugcucgaaaaguuccgguaccuuccuaaagcaauuaaggccuggaauaacccaucuccccguguagagugcgugcuggcugaauugaagggcgucaccugugagaaucgcgaggccgugcuagacgcauuucuggaugacgguuuccucguuccuacguuugaacagcuggcugcccuucagaucgaguacgaagagaacguggaucugaaugacgucuuggugccaaaaccguucucccaguuuuggcaaccccuccugagaggguuacacucacagaacuucacucaggcgcugcuagagaggaugcucagcgaacugccugcccuuggaauuaguggcauccggccaaccuauauauugcgauggacaguagagcugauuguugcaaauacuaagaccggccgcaacgcuagaagguuuucugccgggcaaugggaagcucggcgcggauggagacucuucaauugcuccgccagccuggauuggcccaggaugguggagucgugucuugguucuccuugcugggcauccccacagcuguugcguaucauuuucaaagccaugggccaggggcuccccgacgaagaacaggagaagcuguuacggaucugcucaaucuacacacaaaguggagaaaacagccugguccaggagggcuccgaggcuucuccgauugguaaaagcccuuauacccuagacucacucuacuggagugugaagcccgcguccagcucuuuugggucagaggcaaaggcccagcagcaagaggagcagggcagugucaacgaugugaaagaggaagagaaggaagagaaagaaguucugccagaccagguggaggaggaagaggaaaaugaugaccaggaggaggaagaggaagaugaggacgaugaagacgaugaggaggaagaccgaauggagguaggaccuuucagcacgggccaagaaucccccacugcugagaacgccagacuuuuggcacagaagcgcggggcccugcagggaucugcuuggcaggucucgagcgaagaugugaggugggacacauuuccacucggucggaugcccggccaaaccgaggauccugccgagcugauguuagaaaauuaugacacuauguaccugcuugaccagccaguuuuggagcagagacucgaaccguccacauguaaaaccgauacgcuggggcuaucaugcggagugggcagugguaacuguucuaauagcuccucaagcaacuucgaggggcugcucuggucucaaggccagcugcauggacuuaagaccggcuugcagcuguuuuga

SEQ ID NO: 58331 - RNA, 618 nt, Artificial Sequence
  derived and/or modified sequence opt3 from LASP1__Homo_sapiens__NP_001258537
augcugccccucagagaccuucaggaugacaccgagcacgaagaacugcaaggcuugagggaagaggccuuacugcagcgggugcgcuacaaggaagaguucgagaaaaacaaggggaaaggauuuagcgucguugcugauacaccugaacuacagcgaaucaagaaaacucaggaccaaauuuccaauauaaaguaucaugaggaguucgagaagucucguauggguccaucaggcggggagggaauggaaccggagagaagggauagucaggacggcagcuccuaccggcgcccccucgaacagcagcaaccucaccauaucccaacgucugcacccguguaucagcagccucagcaacagccaguagcccagucguacgguggguauaaagagcccgcggcuccugugucaauucaaagaagcgccccaggaggcggcgggaagagguaccgggcagucuaugauuacagugccgcugacgaagaugagguguccuuucaggacggagauaccaucguuaacgugcagcagauugacgaugguuggauguacggcacagucgagcgcacuggggacaccggaaugcugccggcaaauuauguggaagccaucuga

SEQ ID NO: 58332 - RNA, 732 nt, Artificial Sequence
  derived and/or modified sequence opt3 from LAT2__Homo_sapiens__NP_115852
augagcuccggcaccgagcugcucuggcccggggccgcacuucugguguuguuaggagucgcugccucucugugcguuagauguucaaggccuggugcgaagcggagugagaaaaucuaccagcaacgcagccuacgagaagaccagcaguccuucacaggcucucguacuuauucgcucguggggcaggcuuggccaggaccgcuggccgauauggcacccacgagaaaggacaaacuucugcaauuuuacccuucauuggaagauccagccagcaguagguaucagaacuucuccaagggcucucggcacgguagcgaggaggcuuacauugaccccauagcaauggaauauuacaauugggggcgcuuuuccaaaccuccagaggaugacgaugccaacucauaugaaaauguacucaucugcaagcagaagaccacagagacuggagcucagcaagaaggcauuggcgggcuguguagaggagaccugagucucagcuuagcccugaaaaccggucccacaucuggccuuugcccuuccgcgucaccagaggaggaugaagagagcgaagacuaccagaacagugcaucuauccaucaguggagggagucccggaaggugauggggcaguugcaacgcgaagccagcccgggacccgucggcucgccugaugaggaggacggugaaccagauuacgugaauggggagguugcugccaccgaagcauga

SEQ ID NO: 58333 - RNA, 702 nt, Artificial Sequence
  derived and/or modified sequence opt3 from LAT__Homo_sapiens__NP_001014987
auggaggaagccauccuggugcccugcguccucggccuucuguuguuaccuauucuggcuaugcuaauggcacucuguguucacugccauagacugccagggagcuacgacuccaccucuucagauagucuuuauccgaggggaauacaguucaagcggccccacacaguggccccuuggccacccgcguacccuccaguaacuagcuaucccccucugucccaaccagacuugcucccgaucccccgcucuccucagccacuggguggcucgcaucgaacgcccucaagccguagagauagugacggggcuaacuccguggccucuuacgagaaugaggaaccugcaugugaagaugccgacgaggaugaggacgauuaucacaacccaggauaccuggucgugcuccccgacagcaccccggcuacauccacugcagccccuucagcucccgccuuaaguaccccaggcauuagggauagcgcguuuucuauggaauccaucgacgauuauguuaaugugccugagucaggugaaagcgcagaggccagucuggacgggucucgggaguacgucaacgugucccaggaacuucaucccggagcugccaaaacagagccagcagcuuugagcucgcaggaagccgaggaaguagaggaggaaggcgcgcccgacuacgagaaucugcaagaacuaaacuga

SEQ ID NO: 58334 - RNA, 2073 nt, Artificial Sequence
  derived and/or modified sequence opt3 from LATS1__Homo_sapiens__NP_001257448
augaagagaagcgagaaacccgaaggcuacaggcagaugcggccuaagaccuucccagccuccaacuauacagugucuucacgccaaaugcugcaggagauccgagaaagucuccguaaucuuagcaaaccguccgacgcugcaaaggccgagcacaacaugucuaaaaugucgacugaagaucccagacaggucaggaauccuccaaaguuugggacgcaucacaaggcgcugcaggagauucggaacucauuguuacccuucgcuaaugagaccaacagcagucgcuccacaucugaaguuaauccucaaaugcugcaggaccuacaggccgcaggauuugaugaggacauggugauacaggcccuccagaaaacuaacaauagaagcaucgaagcugcaauugaguucaucuccaagaugucauaccaagauccaaggcgggagcagauggccgcugccgcggcacgccccauuaacgccaguaugaaaccugguaauguacagcaaagcgugaaccgaaagcagucuuggaaaggcuccaaggaaucacuggucccacagagacaugggccgccccuuggagagagcguggcuuaucacagugaaucuccuaauucccaaaccgacguuggcaggccacugagcgguucggggaucucugccuuugugcaggcacaucccuccaacggacagcgggucaauccuccacccccgccucaggugcguucaguaacacccccaccucccccacgcggccaaacucccccuccaagaggcaccacaccgcccccuccaaguugggagcccaacagccagaccaagagguacuccgggaacauggaauauguuauaucucggaucagcccugugccacccggagcuuggcaggaggguuacccgccuccacccuugaauacgucaccuaugaaucccccaaaccagggccaacgagggauuaguuccgucccugugggacgccagcccaucauuaugcagucuagcucaaaauucaacuuuccaaguggcagaccggguaugcagaaugggacuggacaaaccgauuucaugauccaccagaacguggucccugccggcacaguuaauaggcagcccccacccccuuauccacucacugcggccaacggccagagccccuccgcacugcaaaccgggggaucugcugccccuucgagcuacacaaaugguuccauaccgcagucaaugauggugccaaaccggaauagucacaacauggagcuguacaauauuucuguacccggccuccagaccaacuggccucaaagcuccucagcuccagcccagagcucucccuccagugggcaugaaaucccuacguggcagccgaauauucccgugcgcagcaacucuuuuaacaauccauuaggaaacagagcaucccacucagccaauagucagccuagcgcuacuacagucaccgcgaucacucccgcaccaauccaacagccugugaagucgaugaggguucugaaacccgagcuucagacagccuuggcuccaacccauccguccuggauuccucagcccauacaaacggugcagccaucucccuucccugaaggcaccgccagcaacgucacagugaugccacccguagcagaggccccuaauuaucaggguccgccacccccuuaccccaagcaucugcuacaccagaacccaucaguuccucccuaugaaaguaucuccaaaccaucuaaggaggaccaaccuagccucccgaaagaggaugaauccgagaagucauacgaaaauguggacagcggggauaaggagaaaaagcagauuacuaccagucccaucacaguccguaaaaacaagaaagacgaggaacggcgagagucuagaauacaguccuauagcccacaggcuuuuaaguucuuuauggaacaacacguggagaauguccugaagucgcaccagcagaggcuucaucgcaaaaagcaacuggaaaacgagaugaugcgggugaaaccuuucaagaugucaauuuucaucuugaaucaccucuuugccuggugccuguucuga

SEQ ID NO: 58335 - RNA, 3267 nt, Artificial Sequence
  derived and/or modified sequence opt3 from LATS2__Homo_sapiens__XP_005266399
augagacccaagaccuucccugccacaacuuacagcggcaacuccaggcagcggcugcaagagauccgcgaagggcucaaacagccaucuaagucaagugugcagggacuuccggcuggucccaauagcgacacgucccuggaugcaaaagucuugggcucuaaggacgccacccgacagcaacagcagaugcgugcgacaccuaaauuugggccauaucagaaggcuuuaagagagauuagguacucgcugcuacccuucgccaacgaaucaggaacuagcgcagccgcugagguuaaucggcaaaugcuccaggaacuggugaacgcaggcugcgaucaggagauggccggucgcgcucuuaagcagaccgggaguagauccauagaggccgcgcuggaauauaucucuaaaaugggauacuuggacccuaggaaugagcaaauuguacgggugaucaagcagacaagcccaggcaaaggccucaugcccaccccugucacucgccgaccauccuuugaagggacaggagauucauucgcaaguuaucaccagcugagcgguaccccguacgagggccccucuuuuggggccgacggaccuacggcucuggaggaaaugccaagacccuauguggauuaccucuucccuggcguugguccacaugggcccggacaccaacaucagcacccgccuaagggcuacggcgccuccguggaggcagcuggggcccauuuucccuuacagggagcgcacuaugguaggccacaucugcuugucccuggcgaacccuugggguacggagugcagcggucaccuagcuuccaaaguaaaacucccccugagaccggcgguuaugccucucugccaacaaaggggcagggcggaccgcccggcgcagggcuagcuuuuccuccacccgccgcuggacucuacguaccucacccacaccauaagcaggccggucccgcagcccaccagcugcacguucuuggcucccguagccaaguguucgcuucggacucuccgccucagucccuguugacuccaucacgcaacagucucaaugucgaucuguaugaauuagggagcaccuccgugcagcaguggcccgcggcaacacuggccagaagggacucucuccaaaaaccuggacuugaggcucccccacgggcccauguggcauuucgaccugauugucccgucccaagccgcaccaacucauucaauagucaccagccgagaccuggucccccaggcaaggccgagcccucccugccugcuccaaacacgguuacugccgugacagcagcgcauauuuugcaccccguaaaaagcgugaggguccuacggccugaaccgcagaccgcuguggggccaucucaucccgccuggguuccugcaccagcccccgcuccugccccggcacccgcuccagccgcggagggccuggacgccaaggaggaacacgcucucgcacugggaggcgccggggcuuuuccucuugauguggaauacggaggucccgaccgcagaugcccaccucccccauauccgaaacaccuguugcucaggucaaagagugagcaguacgaccuggauagcuuaugugccggcauggagcaaucccugcgugcagggccuaaugaacccgagggaggcgacaaaucucggaagucggcgaagggugauaaagggggcaaggacaaaaagcagauccagacuagcccaguccccgugcgaaagaacuccagagaugaagagaaaagggaaucacgcauaaagaguuacucuccuuaugccuucaaauucuuuauggagcaacauguagagaauguuaucaagacauaccagcagaaagugaaccggagacuacagcucgaacaagagauggcuaaggccggacugugcgaagcagagcaggagcagaugaggaaaauucuuuaucagaaggaaagcaauuacaaccgcuugaagcgagcuaaaauggacaaguccauguucgucaaaaucaagacccugggcauuggggccuuuggagaggugugucucgcaugcaaagucgauacgcacgcccuguaugcuaugaagacccuucggaagaaagacgugcugaaccguaaucaaguugcgcaugugaaggccgaaagagauaucuuggcagaggcugacaacgaauggguagucaaacucuacuauucauuccaggauaaggacagccuguacuuugugauggacuacauaccaggcggugauaugaugucuuuacugauuaggauggagguuuuccccgagcaccuagcccgcuuuuauaucgccgaacucacacuggcuauugaguccgugcacaaaaugggguucauccaucgggacaucaagccugauaauauucuuauagacuuggauggacacaucaaacugacugacuuuggccucuguaccgguuucagauggacacauaacaguaaguacuaucagaagggcagccacgucaggcaggauucuauggaaccguccgaccugugggaugacgugucaaauugccgauguggggaucgcuuaaaaacucuggagcaacgggcaagaaagcagcaucagaggugccuugcccacaguuugguaggaaccccaaacuacauugcgcccgaagugcuccugcguaaaggcuauacacaacuaugugacugguggagcguuggggucauccuguuugagaugcucgugggacagccucccuuccuggcuccaaccccuacugagacgcagcuuaaggugauaaauugggaaaacacauugcacauucccgcccaggucaaacugucgccagaggcacgcgauuuaaucaccaagcucugcugcuccgccgaccaucggcugggcagaaauggugcugacgaucuuaaggcacacccauuuuucucugccaucgacuucagcucagauauuaggaaacaaccggcgcccuacguuccaacuaucagucauccuauggacaccuccaacuuugaucccguggacgaagagucuccauggaaugaugcuagcgaaggguccacaaaggccugggacacccugacuucaccuaacaauaaacaccccgagcaugcauucuaugaguuuacauuccgacgguuuuucgaugacaacggauacccguuucgcuguccaaagccuagcggcgccgaagcuagucaggccgagucuuccgauuuggaaagcucggaccucguggaucagacggaggguugccagcccguauacgucuga

SEQ ID NO: 58336 - RNA, 1149 nt, Artificial Sequence
  derived and/or modified sequence opt3 from LAX1__Homo_sapiens__NP_001129662
augagaagccacuuccugcagugggcccucgcuaccuccaggaacaaggaccaaaucacaaauauauuuucuggcuucgcagggcuucuggccauuuuguuaguggucgcgguguuuugcauccuguggaacuggaauaaacggaagaaacgccagguucccuaccuacgaguaacugugaugccucuccugacgcuuccacagacccgucagagagcuaagaacauuuaugauauccugccguggaggcaagaggacuugggacggcaugaaucacgcaguaugagaauuuucagcacagagucccuccugucuaggaacucggaaucacccgagcacgucccuagccaggccgguaaugcauuucaggaacauacugcccacauccaugcuaccgaguacgcagugggcauauaugauaaugccaugguuccacagaugugugggaaccugacacccagugcucacugcaucaaugugcgggccucccgcgacugugcgucuauuagcuccgaggauucacacgacuacgucaacgugccuaccgcagaagagaucgccgaaacucucgcuaguacaaaaagcccaucucgaaauuuauucguacugcccuccacccaaaaacuugaguuuacggaggaaagagaugagggaugcggcgacgccggugauuguacuucauuguauagcccuggggcagaagacagugauucucuguccaacggagagggcagcucgcagauuucuaaugacuacguuaacaugaccggccuagaucucuccgcuauccaggaaaggcagcuguggguggccuuccaaugcugucgggacuaugagaaugucccagcggccgacccgucagggagucagcagcaagcagagaaggaugugcccagcuccaacauaggacauguggaagacaagacagaugacccugguacucacguccagugcguuaagcguaccuuucuugcuucuggcgauuacgccgacuuccagccauuuacacagagcgaggauucacaaaugaaacaucgcgaagagaugaguaacgaagacuccagcgauuacgagaaugugcugaccgcuaagcucgggggaagagacucugagcagggccccgguacgcaguugcugccugaugaauga

SEQ ID NO: 58337 - RNA, 1149 nt, Artificial Sequence
  derived and/or modified sequence opt3 from LAYN__Homo_sapiens__NP_001245319
augagacccggcaccgcccugcaggcugugcuccuugcaguccuguugguuggguuaagggccgcgacaggacggcugcuaagcgcuuccgaccucgaucugcgcgguggccaaccugugugccgagggggaacucagcguccauguuacaagguaaucuauuuccacgacacgucuagaaggcuuaacuuugaggaagccaaagaggcaugccggcgcgauggcggucagcuggugucaauugaaagugaggacgaacagaaguugauagagaaauucaucgagaaucuccugccgagcgauggggacuuuuggauuggacugagaaggcgggaagagaagcaauccaacucuaccgccugucaggaucucuacgcuuggacagacggcucgaucucacaguuccgcaauugguaugucgaugaacccagcugcggcagugagguguguguugugauguaccaucagccuuccgcaccagccgggauuggaggucccuauauguuucaauggaacgacgaucgaugcaauaugaaaaacaauuucaucuguaaguacucugacgagaagccugcugucccaagcagagaagccgagggcgaagagacugaauuaaccacacccgugcugccugaggagacccaggaagaggaugcgaaaaagacuuuuaaagaauccagggaggcagcccuuaacuuggcuuauauacugaucccaucaauuccgcuacuccugcuucugguaguuacaaccguggucugcuggguguggaucugucggaagcguaaacgcgaacagcccgacccuaguacgaagaagcagcacacuauuuggccaagcccccaucaaggaaauucuccugacuuggagguguacaacgucaucagaaaacaguccgaggccgaucucgcagaaaccaggccagaccugaagaauauaucauuccggguuugcagcggggaggcuacacccgaugacaugaguugugauuacgacaacauggccgugaauccgucugaauccggcuuuguaacuuuagugagcgucgagucggguuucgugaccaacgauauuuaugaauuuucuccugaccagauggggcgauccaaagagucaggauggguugagaaugaaaucuacggcuauuga

SEQ ID NO: 58338 - RNA, 318 nt, Artificial Sequence
  derived and/or modified sequence opt3 from LBH__Homo_sapiens__NP_112177
augagcaucuacuuccccauucacugcccugacuaucugagauccgccaagaugaccgaggugaugaugaacacacagccaauggaagagauaggccucucuccgaggaaagaugggcuuucauaccaaaucuuucccgacccuagugauuucgaccgguguugcaagcugaaagaucgcuugccaagcauugucguugaacccacugagggagaaguggaguccggugaguuacgauggccuccagaagaguuucugguacaggaagacgagcaggauaauugugaggaaacggcuaaggagaacaaagaacaguga

SEQ ID NO: 58339 - RNA, 1446 nt, Artificial Sequence
  derived and/or modified sequence opt3 from LBP__Homo_sapiens__NP_004130
augggcgcccuggcuagagcacuccccagcauccuucuggccuuguuacugaccuccacaccugaggcgcuaggggcuaacccaggacucguggccaggauuacugacaagggucugcaguacgcagcccaagaaggccuucuggcuuugcagucugagcuccugcggauaacgcugccggauuucaccggggaccuccgcaucccccacgucggacgaggccguuaugaauuucauucauuaaauauucacaguugcgagcugcuucauagcgcauugagaccuguuccaggucaggggcugucccuaucuaucucggauucaagcauuagggugcagggacgguggaaaguacgcaagaguuucuuuaaacuccaaggcuccuucgacgugucugucaagggcaucagcauauccgugaaccugcuucuggggucagaaaguagcggaagacccacaguuacugccucuuccuguucaagcgauaucgcugacguggaggucgauaugaguggugacuugggcuggcuccugaauuuauuucacaaccagauugagucuaaauuccagaaggugcuggaauccaggaucugcgagaugauucaaaagagcguaucgucugaucuccagccuuaccuucagacccugccaguuacaaccgaaaucgacuccuuugccgauauagacuauucauugguggaggcgccccgggcaacugcccagaugcuagaggucauguucaaaggggaaauuuuucaucgcaaucaccgaaguccugugacacugcucgcugccgugaugagccugccagaggaacacaacaagauggucuacuucgcaaucuccgauuauguuuuuaauaccgcuucucuuguguaccaugaggaaggauaucugaacuucagcauuacggacgacaugaucccgcccgauucaaauaucagauugacuaccaaaaguuuuaggccuuucguaccacggcucgcccgucuguaccccaacaugaauuuagagcugcagggcuccgugccuagcgcgccacuacucaacuucucucccgguaaucugucagucgacccguacauggagauugaugccuuugugcuuuugccuaguagcuccaaggaacccguuuuccgccugucuguggcaacaaacgucucggcuacucucaccuuuaauacaagcaaaauaaccggguuccugaagccaggaaaggugaaaguagagcuuaaggaauccaaaguuggccuguuuaacgccgaguugcucgaagcucuguuaaacuauuacauccugaauacguucuauccuaaguuuaacgacaaacuagccgagggcuucccccucccacugcuuaagagagugcaauuguacgaucuggggcuccagauucacaaagacuuucuguucuuaggagcaaauguccaguauaugaggguguga

SEQ ID NO: 58340 - RNA, 1722 nt, Artificial Sequence
  derived and/or modified sequence opt3 from LBR__Homo_sapiens__XP_005273182
augcccagcagaaaguucgccgacggcgagguggucagggggcgguggccuggauccucucuguacuaugaaguugagauccucucacacgauaguaccagccagcuuuacacagugaaauauaaggacgguacugaacuggaguugaaagaaaacgauauuaagccauuaacguccuuucgccaacgaaaaggcgggucuaccucgucaagcccgagucguagaaggggaucccggucucgcagcagauccaggucacccggccggccuccaaagagugcucgccgaagcgcaucugccucccaucaggcggacauaaaggaggcuagaagggagguagaagugaaacugacaccccuaauccucaagccuuucgguaauucaauuagccgguacaacggggagccagaacacaucgagcguaaugaugcaccccauaaaaacacucaggagaaguuuagucugucucaggaauccagcuauauugccacccaauacucgcuucgcccuagaagggaggaagucaaacugaaggagaucgacucuaaggaagagaaauauguggccaaggaguuggcuguucggacauucgaagugaccccaauacgagcaaaagaucucgaguuuggaggcgucccgggcguguuccugaucauguuugggcugcccguauuccucuuuuuacugcuuuugaugugcaagcagaaagacccuucccugcuaaauuucccacccccucucccagcccuguacgaacuuugggagacucgcguuuuuggaguguaccuguugugguuccucauucagguccuguuuuauuuacugcccaucgguaaggugguggaaggcacaccgcucauugaugggagaaggcuuaaauaccggcugaacggauucuaugcuuucaucuugaccucagccgucauaggcacgagucuauuucaggguguugaguuccacuacguguauagccauuuucugcaauucgcgcucgcagccacuguauuuugugugguccuguccguguaccuuuauaugcgcucucugaaggcuccuagaaaugacuugagccccgccucaagugggaacgcaguuuacgauuucuuuauuggaagggagcucaauccacguaucggcaccuucgaccugaaguacuuuugcgaauuacggccuggccugauugggugggaggcucuacucacaacuauggauaucauccacgacggauucgguuuuaugcuggccuucggcgaccuuguguggguccccuuuauuuauuccuuccaggcguucuacuuggugagccacccaaacgaaguaucuuggcccauggccucacugauaaucguucucaaacuguguggguaugugauuuuucgaggagcaaauagucagaagaacgcuuucagaaagaauccuagcgauccaaaacuugcccaucugaaaaccauccacacauccaccggcaagaacuugcucgucucugguugguggggguuugugaggcauccgaauuaccugggcgacuuaauaauggcucuggccuggucgcuacccugcggauucaaccacauucucccuuauuuuuacaucaucuauuucacgaugcugcuuguccaccgcgaggcacgggaugaauaccauuguaagaaaaaguacggcguggccugggagaaauauugccagagaguuccauacaggauuuuucccuauaucuacuga

SEQ ID NO: 58341 - RNA, 846 nt, Artificial Sequence
  derived and/or modified sequence opt3 from LBX1__Homo_sapiens__XP_005269500
augaccagcaaggaggacggcaaagccgcucccggggaagagagaaggcgguccccucuggaucaccucccaccgcccgcaaacucuaauaagccucuuacaccauucucaaucgaagacauucugaacaaacccagugugcgccgaagcuacuccuugugcggagccgcgcauuuacuggcugccgcagauaagcacgcccaggguggccuaccucucgcugggcgugcacugcuuucucaaacuucgccacugugugccuuggaggaacucgcuucaaaaacguuuaagggacuggaggucagcguucugcaggccgcggagggcagagacgguaugaccauauucgggcagaggcagacacccaagaaacggcgcaagaguagaacugcauuuaccaaucaucaaaucuaugaacucgagaaaagguucuuauaccagaaguaucuguccccugccgaucgggaccagauugcucagcaacuuggauugacaaacgcccaggugaucaccugguuucagaaucgccgagcaaaacugaagagagaucuagaagagaugaaggcugacguagagucugccaaaaagcucggcccaagcggccagauggauauuguggcgcuggccgaacuugagcaaaacuccgaagcaacugcugggggagguggcgggugcggaagggccaaaucacggccgggcagucccguccugccuccaggugcucccaaggccccuggggcaggagccuugcagcucagcccagcuucuccccugacagaccagccggcguccucacaagauuguagcgaggacgaagaggaugaggaaaucgacguggacgauuga

SEQ ID NO: 58342 - RNA, 585 nt, Artificial Sequence
  derived and/or modified sequence opt3 from LBX2__Homo_sapiens__NP_001009812
augggcaagagaaccagccuggaggugucccucggggaacuuggaggugagaaaugcaggggcgggcggcgcucuuuucccccucuggccgcuucacgaccagcacguccgggaggcuggagaugggccaggcgggacuuguguaagacagcgagucgcgcugaaaacaauagccaggccugcagaccccaaaggcgggcagguccugaugccuuagggccaggacccuucggccgcaaacgaagaaaguccaggacugcuuucacggcacagcagguccuggagcuagaacggcguuuuguuuuccagaaauaccucgccccuucugagcgcgacggccuggcuaccagacuugggcuggccaacgcgcaagugguaacaugguuucagaauaggcgggcaaaguugaagcgagauguggaggaaaugcgcgccgacgucgcuucgcucagagcccugucaccagaggugcuguguagccucgcauuacccgaaggagcuccugauccaggucugugccuuggcccggccgggcccgacaguaggccucacuuguccgaugaggagauccagguugacgauuga

SEQ ID NO: 58343 - RNA, 2094 nt, Artificial Sequence
  derived and/or modified sequence opt3 from LCA5__Homo_sapiens__NP_001116241
augggcgagagagccgggagccccggaaccgaccaggaaaggaaggcugguaaacaccauuacuccuaucugucugauuucgagacaccucaaucaaguggccggagcucccucgugucuucgucaccagcaagcguccgccgaaagaacccgaaacgucagacgagugacgggcagguucaccaucaggcccccagaaagccuuccccaaaaggacuucccaauaggaagggcgugcggguagguuuucgcucucaaagccugaacagagaaccuuugaggaaggauacugacuuagugaccaaacggauccuguccgcgcgccuacucaagauuaaugagcugcagaacgaagucucagagcuucaggugaaacuggcugaguugcucaaggaaaauaaaagucugaagcgacugcaguacagacaagagaaggcccucaacaaauucgaagaugcagagaaugagauaagccaguuaaucuuuaggcacaacaaugaaauuacagcccugaaggagcggcuucguaaaucucaggaaaaggagcgcgcuacugagaaaagaguuaaggacaccgaguccgaguuguucaggacaaaauuuucacugcagaagcuaaaggaaaucagcgaggcacggcaucucccagaacgagaugaccuggccaaaaagcuggugagugcugagcuuaaauuggaugacaccgaacgcagaauuaaggagcucucuaaaaaccuggaguuauccacuaauagcuuccaaaggcagcugcucgccgaacggaagcgcgcguaugaggcacacgaugaaaacaagguccuucagaaagaggugcaaagacuguaccacaaguugaaagaaaaggagagggagcuagacaucaaaaauauauauucgaaccgucugcccaagucuuccccuaauaaggaaaaagagcucgcccugcggaagaacgcugccugccagucagauuuugcagaccuuuguacaaaagggguacagaccauggaagacuucaagccagaggaguacccgcugacgcccgaaacuaucaugugcuaugagaacaaaugggaagaaccuggacauuugacccucgaucugcagagucaaaagcaggaccgacacggcgaagcuggcauuuuaaauccaaucauggagagagaggaaaaguuuguuacagaugaggaacugcauguggucaaacaggagguggaaaagcuagaggacgagugggaaagggaggaacucgauaaaaagcagaaagagaaggccagccugcuugaacgcgaggagaaacccgaaugggagacugggcgguaccaauugggaauguacccuauucagaacauggacaagcugcagggugaagaggaggaaagacucaagagggagaugcugcuugcgaaacugaaugaaaucgaucgcgaguugcaggacucccgaaaccucaaguauccagugcugcccuuacugccggauuucgaaucuaaacuacacagcccugagcggucacccaagaccuaccguuuuagugaguccagcgaaagacucuucaauggccaccaucugcaagacauaucuuuuucaacaccaaaaggggagggacagaacaguggcaaugucaggagcccugccucccccaacgaauuugcauucgguucuuauguuccaucguuugcuaagaccagcgagcgcuccaaucccuucucacagaagaguucuuuucuugauuuccagcggaacagcauggaaaaauuguccaaggacgggguggaccugauuacgagaaaagagaagaaagccaaucucauggagcaacuguuuggagcuucaggcagcucuacuaucuccaguaagagcucugauccuaacuccguagccucaaguaagggcgacauugauccauuaaauuuccugccggggaacaaaggaagcagggaccaggaacacgaugaggacgaagguuucuuccuuucggagggccgauccuuuaaucccaaccgccaucgguugaagcacgcagaugacaaaccugccgugaaggcugcggauucugucgaagacgagaucgaggaaguggcacucagauga

SEQ ID NO: 58344 - RNA, 1323 nt, Artificial Sequence
  derived and/or modified sequence opt3 from LCAT__Homo_sapiens__NP_000220
auggggcccccuggcagcccauggcagugggugacccugcuccuuggccuguuguuaccgcccgccgcuccuuucuggcugcuaaacguccucuuuccaccccacacaacuccuaaggcagagcuguccaaucauacgagaccaguuauccuugugcccgguugccugggcaaccaauuggaagccaaacucgacaagccugauguagugaauuggauguguuacaggaaaaccgaggacuucuuuacaauuuggcuggaucugaacauguuccucccauuaggggucgacugcuggauagauaauacucgggugguuuauaaccgaucuucaggacuggugaguaaugcgccgggcguccagauccgcgugcccgguuuugggaagaccuacagcguagaauaucuugacuccucuaaauuggcuggauaccugcacacacuuguucagaaccucgugaauaacggcuauguccgugaugagaccgugagagccgcaccuuacgacuggaggcuggaaccaggccagcaagaggaguauuaccggaagcuagccgggcugguggaagagaugcaugcugcauacggaaagcccgucuucuugauuggucacucgcucggcugucugcauuuacuguauuuucuccuucgccagccucaggccuggaaagauagauucaucgacggguuuauuucacugggagcuccauggggcgguagcaucaagcccauguugguucuagccaguggggauaaucagggaauaccgaucauguccucuauuaaacugaaggaggaacaaaggaucacuacaaccagcccuuggauguuccccucccggauggcguggccagaggaccacguguuuauuucaacgccuaguuucaacuacacuggccgcgauuuucagcgauucuucgcagaccuccacuuugaagagggcugguauauguggcugcagagcagagaccuucuggccggguugcccgcuccaggaguagaaguguacugccucuauggugucggccugcccaccccuaggacauacaucuaugaucauggguucccauacacugacccggugggaguuuuauacgaggauggcgacgauaccguggccacacggucuaccgaacuguguggucuauggcaggggcgucaaccccagccuguccaccuccugccacuucauggcauacagcacuugaauaugguguuuuccaaccugacgcucgagcacauuaaugcaauccugcuuggagcuuaucgccaaggacccccugccucaccaacugcgagccccgagccgccuccacccgaauga

SEQ ID NO: 58345 - RNA, 267 nt, Artificial Sequence
  derived and/or modified sequence opt3 from LCE1C__Homo_sapiens__NP_001263260
augagcugccagcaaucccagcagcagugucaacccccuccaaacgugucuucaggcgggugcuguggaaguagcuccgguggcucuugcgggucgucaagcggaggcuguugcaguuccggugggggaggcuguugccugucucaccauagaaggcggcgcagccacugucaucgaccgcaguccucaggcugcuguagucagcccagcgggggaucuuccugcugcgguggcgggucaggacagcacagcggcgguuguugcuga

SEQ ID NO: 58346 - RNA, 270 nt, Artificial Sequence
  derived and/or modified sequence opt3 from LCE3A__Homo_sapiens__NP_848518
augagcugccagcaaaaccagcagcagugucaacccccuccaaagugcccggccaaaucccccgcucagugucugccuccagcaucuucaaguugcgcccccagcuccggcggguguggaccuucuucggagagaucaugcugucucagccaccauaggugccggcgcagucaccgaugucguugccaguccucuaauagcugugacagagguuccggccagcaagggggaucaaguagcugcggccauucuuccgcggguugcuguuga

SEQ ID NO: 58347 - RNA, 288 nt, Artificial Sequence
  derived and/or modified sequence opt3 from LCE3B__Homo_sapiens__NP_848520
augagcugccagcaaaaccagcagcagugucaaccccugccuaagugcccauccccgaaaugucccccuaagucuucagcccagugccucccacccgcuaguagcuguugcgcaccuagaccaggcuguugcgggggacccuccucugaggguggcuguugccuuucgcaccauagguguugccggucacaccgcugccgacgucagagcaguaauuccugugacagagggucuggacagcaagauggcgccagcgacugcgguuacggguccggaggcuguugcuga

SEQ ID NO: 58348 - RNA, 285 nt, Artificial Sequence
  derived and/or modified sequence opt3 from LCE3C__Homo_sapiens__NP_848521
augagcugccagcaaaaccagcagcagugucaacccccuccauccugcccgucucccaaguguccuccaaaaucacccgcccagugccugccuccacccaguagcgacugugcucucuccucuggcgggugcggaccuucgucagagagcgguuguugccuuagucaccauagacacuucaggucccaucagugucggcgccagcgaucuaauagcugcgaucguggcuccgggcaacagggaggcgguucauguagagggcacggaaguggcggcugcugcuga

SEQ ID NO: 58349 - RNA, 279 nt, Artificial Sequence
  derived and/or modified sequence opt3 from LCE3D__Homo_sapiens__NP_115952
augagcugccagcaaaaccagcagcagugucaacccccuccaaagugcccgucccccaaauguccuccaaagucucccgugcagugccugccuccagccucaaguggcugugcucccagcuccgggggaugcgguccuucuucggagggcggguguuuccucaaucaccauagaaggcaccaucggugccgccgacagcguccaaacucaugugacagaggaagcggccagcaaggugggggaaguggcugcggccacggguccggagguuguugcuga

SEQ ID NO: 58350 - RNA, 279 nt, Artificial Sequence
  derived and/or modified sequence opt3 from LCE3E__Homo_sapiens__NP_848522
augagcugccagcaaaaccagaagcagugucagcccccuccaaaaugcccgucccccaaguguccucccaaaaauccagugcaaugccugccuccagccucuucaggcugugcucccaguagcgggggaugcgguccuuccucugagggcggguguuuccucaaccaccauagaaggcaccaucggugccgccgacagcguucaaauucgugugacagaggaagcggccagcagggugggggaaguggcugcugucacggcuccgggggaugcugcuga

SEQ ID NO: 58351 - RNA, 357 nt, Artificial Sequence
  derived and/or modified sequence opt3 from LCE5A__Homo_sapiens__NP_848525
augagcugccagcaaucccagcagcagugucaacccccuccaaagugcaccccgaaaugucccccuaagugcacaccaaaaugucccccuaagugcccacccaaauguccuccacagugcucugccccgugucccccuccagugucaaguugcuguggcagcuccucugggggaugcugcucgucagaggguggcggguguugccugagccaccauagacccaggcagagucuccggcgccgaccucaguccucuagcuguugcggauccggcucaggucaacagagugggggaagcucuuguugccacuccucaggcggcagcggguguugccauaguucuggagguuguugcuga

SEQ ID NO: 58352 - RNA, 1551 nt, Artificial Sequence
  derived and/or modified sequence opt3 from LCK__Homo_sapiens__XP_011539756
augggcugcggguguagcucccaccccgaggacgauuggauggaaaacaucgacgugugcgagaauugucauuacccuauugucccacuggauggaaaggguacccuccuuauaagaaacggcucugaaguuagggacccgcuggugacauaugaggggucaaaucccccugccaguccauugcagggagauccccggcaacagggcuuaaaagacaaggcuugcgguagccuggcaguaggguuccaccuauccccuacuuacuuucucccaggacuggccuuccuugugccccauccugucacgccaggcuuucugccgauccccgcgcgcuucucuuugaugccucucguguuuaccgauaaccugguuauugcucugcacucguaugaaccaucacaugacggcgaucucggguucgagaaaggagagcaguuacgaauccuggaacagagcggugagugguggaaggcccaaagucuuacaacuggccaggaaggguuuauucccuucaauuuuguggcaaaagccaacuccuuggagccugagccaugguucuuuaagaaucugucucguaaggacgcugaaagacagcuacucgcacccggaaacacccacggcagcuuccugaucagggaguccgaaucaacagccgguaguuuuagccuuucuguccgggauuucgaccagaaucaaggggaggugguaaaacacuacaagauacgcaaccuggauaauggaggcuucuauaucuccccgagaauuaccuuuccuggcuugcaugaacucguuaggcacuacacucgguauuacaacgggcauacaaaaguggcugucaagucacugaaacagggaagcaugagucccgacgccuucuuagcggaggcaaaucugaugaagcagcuccagcaccaacgccuugugcgacuguacgccguggucacccaggagccaaucuauauuaucacggaauacauggagaacgguucuuugguugacuuucuaaagacuccuuccggcauaaaacugaccauuaauaagcuccuggauauggcugcccagaucgcagaagggauggcuuucauugaggaaagaaacuauauccacagggaccuucgggccgcgaacauccuggugagcgauacauugucguguaaaauugccgacuuuggacucgcacgucugauagaggauaaugaguacacugcucgcgaaggcgccaaguuccccaucaaauggaccgcuccagaggccauuaacuaugguacauuuaccaucaagucugacguaugguccuucgggauauuacugacggaaauugugacucauggcagaauccccuacccuggaaugacaaauccagaggucauccaaaaccuagaaaggggcuaucggauggugcgaccggauaauugccccgaggagcucuaccagcugaugcgccuuuguuggaaagaaagaccugaggacaggccaaccuuugauuacuugcggucaguucuggaagacuucuuuacugcaacagaggggcaguaucagccccaaccuuga

SEQ ID NO: 58353 - RNA, 1131 nt, Artificial Sequence
  derived and/or modified sequence opt3 from LCLAT1__Homo_sapiens__NP_001291374
auggugagcuggaagggcaucuacuucauucugacccucuuuuggggguccuucuuuggaucuauauucaugcuuucacccuuucugccuuugauguucgucaacccaaguugguauagauggaucaauaacagguuaguugccacauggcugacucuaccgguggcucuccuggagacgauguuugguguaaaagugauuaucaccggcgacgcauucguccccggggaacggagcgugauuaucaugaaucaccgcacacgaauggauuggauguuucuuuggaacugccugaugcguuacuccuauuugagacucgagaagauaugucugaaagccucucugaagggaguuccuggcuucgguugggcgaugcaggcugccgcauacaucuuuauucauaggaaauggaaggacgauaagucgcacuucgaagacaugaucgauuauuuuugcgacauucaugagccacuccaauuacugaucuuccccgaagggacugaucuuaccgaaaauucaaaaagccggaguaacgccuucgcugagaagaauggauugcagaaauacgaguaugugcugcacccucgcacaaccggcuuuacuuucgucguggacagacuaagggagggcaagaaccucgaugcaguacaugacauaacaguugccuacccacacaauauuccccaguccgaaaaacaucugcuucagggggauuuuccucgggagauccacuuccacgugcaucgcuacccaauugacacccugccgacgucuaaggaggauuugcaacucuggugucacaagcgaugggaagagaaagaagagagacugaggagcuuuuaucagggagaaaagaacuucuacuuuacuggucaguccgucauucccccuugcaaaucagaguuacgggugcugguggucaagcuccuuaguauccuguauuggaccuuguucagcccagcuaugugucuacugaucuaccucuauucucugguuaaaugguacuuuauaaucacaauugugaucuucguacuucaggagcguauauuuggcgggcuggaaauuaucgaguuggccugcuaucgccuccugcacaagcaaccccauuuaaauuccaaaaagaacgaauga

SEQ ID NO: 58354 - RNA, 840 nt, Artificial Sequence
  derived and/or modified sequence opt3 from LCMT1__Homo_sapiens__NP_001027563
auggccaccagacagagggagagcuccaucacaucuugcuguucaacuagcagcugcgacgcugaugacgaaggcgugcgggggacgugugaggaugcaucccugugcaagcgcuucgccgucucuauuggauacuggcacgaccccuauauacaacauuuuguucgacucucgaaagaacguaaggcgccugagaucaacagagguuacuucgcuagggugcacggcguaucacagcuuauuaaagccuuucugcggaagaccgaaugucauugccagaucgugaauuugggggcaggaauggauacaacuuucuggcgcuuaaaagacgaggaucugcuaccaagcaaguauuuugaggucgacuucccgaugauugugaccagaaagcuccacaguaucaaacugcccacacuucugauagccgaauguguuuugguguacaugaccccugagcaguccgcuaaccuccugaagugggcagccaauucuuuugaaagggcuauguucaucaacuaugagcaagucaauaugggcgaucgguuuggucagauuaugaucgagaaccugcgccgaagacagugcgaccucgccgggguggaaacuuguaaaaguuuagagucccagaaggaaaggcugcuuucaaauggaugggagacagcgagugcaguagauaugauggaauuguacaaccggcugccacgugccgagguuagccgcauugagucucuagaguuccucgacgaaauggaacugcuugagcaacugaugagacauuauugcuuguguugggcuaccaaaggcggcaaugaacucgggcugaaggagaucacguacuga

SEQ ID NO: 58355 - RNA, 531 nt, Artificial Sequence
  derived and/or modified sequence opt3 from LCN1__Homo_sapiens__NP_001239546
augaagccccugcuccuugccgugagccugggcuugaucgcugcauuacaggcccaccaucugcuagcguccgacgaggaaauucaagaugucucugggaccugguaccucaaagcuaugacaguugacagagaguucccugaaaugaaccuggagucagugacuccaaugacgcuuaccacacuggaaggagguaauuuggaggccaagguaacuaugcucauaagugggaggugccaggaggugaaagcaguccuggaaaagaccgaugagccgggcaaauauacagccgacggaggcaagcacguggcuuacaucauucggagccauguuaaggaucacuauaucuuuuacugugaaggugagcugcaugggaaacccgugcgcggagucaagcucgugggccgagacccuaaaaacaauuuagaggcacuggaagauuucgagaaggccgcuggcgcccgugggcuuuccaccgaaucuauuuugaucccaagacagucggagacuugcucacccggaagcgacuga

SEQ ID NO: 58356 - RNA, 597 nt, Artificial Sequence
  derived and/or modified sequence opt3 from LCN2__Homo_sapiens__NP_005555
augccccugggccuccuuuggcugggguuggccuuacugggagcucuacacgcacaggcccaagacagcaccuccgaucucaucccugcgccaccgcugucuaaggugccccuucagcagaacuuccaggacaaucaauuucaggguaaaugguacgucguuggccuggcugggaacgccauuuugagagaggauaaggacccucagaaaauguaugcaacaauauacgaacucaaggaggauaaaucauauaaugugacgaguguacuguucaggaagaagaaaugcgacuacuggauccggacuuuugugccaggaugucagcccggcgaguucacccuggguaacauuaagagcuauccugggcucacauccuacuuaguccgcgugguuucuacuaauuauaaccaacaugccaugguguuuuucaaaaaggucucgcagaaucgagaauacuuuaaaaucacccuguacggacguacaaaggaacuuaccucagaguugaaggagaacuucauuagauuuagcaaaagucugggccuaccagaaaaucacaucguguuccccguaccuauagaucagugcaucgacggcuga

SEQ ID NO: 58357 - RNA, 1221 nt, Artificial Sequence
  derived and/or modified sequence opt3 from LCOR__Homo_sapiens__NP_001164237
augcagagaaugauccaacaguucgccgcugaguacaccagcaagaacuccucuacacaggaccccucacagccuaauaguacuaaaaaccaaagccugccaaaggcauccccggugacgaccucucccacagccgcgacuacccagaauccuguccucucgaaacuucugauggcugaucaggacucaccauuggauuuaacaguuaggaaaagccagagugaacccuccgagcaagacggcgugcuggaucuaucuaccaaaaagagcccuugcgccggguccacuucacucagucacagcccaggauguucuuccacacaggguaacggccggcccgggcgcccuucacaguaucgaccagacggacugcguagcggcgaugguguaccgcccagaagucuucaggacgggaccagggaaggauuuggccauucuacgucccugaaggugccuuuggcacggagccuccaaauuucggaggaacugcugucucgcaaucagcucuccacugccgcuucauuaggcccaagugggcugcagaaccacggacaacaucuuauauugagcagagaggcauccugggccaaaccccacuacgaguucaaucugucuaggaugaaguuucgggguaacggcgcucuaagcaauaucucagaucucccuuuccuggccgaaaacagugcguuuccaaaaauggcacuucaggccaagcaggacgggaaaaaggaugucucccauagcucucccguggaccugaagauuccgcagguucgcggaauggauuugucaugggagagucgaaccggcgaccaauauagcuacuccucucucgugauggguucgcagacagaaagcgcucuguccaaaaaguuaagagccauccugccuaaacagucaaggaagaguaugcucgacgcagggcccgauucuuggggaagcgacgcugagcaguccacuucaggccaaccauauccuaccagcgaucaggagggcgaccccgggucuaaacagccacggaagaaacguggacgcuacagacaguauaauuccgaaauucuugaggaagccaucagugucgugaugagcgguaagaugucuguauccaaggcgcaaucaauauacggcaucccccacaguacacuggaguacaaaguuaaggaaagguuggggacccuaaagaacccuccaaagaaaaagaugaagcugaugagcggauga

SEQ ID NO: 58358 - RNA, 1884 nt, Artificial Sequence
  derived and/or modified sequence opt3 from LCP1__Homo_sapiens__XP_005266431
auggccagaggcagcguguccgacgaggaaaugauggagcugagggaggcuuucgcaaaggucgauaccgacgggaacggauacaucucuuuuaaugaacucaacgaucuuuucaaagccgcgugccugcccuugccugguuaucggguucgcgaaauuacagagaauuuaauggcuacuggcgaccuggaucaggacgggcgaauaucauuugaugaguucaucaagauuuuucacggacuaaaaaguacggacguggccaagaccuuccguaaagcaaucaacaagaaggaaggcauuugugccaucggugggacaagcgagcaauccucuguaggaacucagcauucguacucagaagaggagaaauaugcuuuugugaauuggauaaacaaggcacucgaaaaugauccagacugcagacacgucaucccgaugaaccccaauaccaacgaucuguucaaugccgugggcgacggcauuguucuuuguaaaaugaucaaccugagcgugccugauacaauugacgagaggaccaucaauaagaaaaaguugacuccauuuacaauacaggaaaaccucaaucuggcucugaacagugccuccgcgauugggugccaugucgugaacaucggagcagaggaccucaaggaagguaaacccuacuuaguacugggccuuuuguggcagguuauuaagaucgggcuguucgccgauaucgagcuaucucggaaugaggcucucauugcccugcuucgcgaaggagagagccuggaagacuugaugaaacucuccccugaggaacuguuacugagaugggcaaacuaucaccucgagaaugcuggcuguaacaagauagguaauuuuucaaccgauaucaaagacaguaaggccuacuaucaucuucuggagcaaguggcgccaaaaggggaugaagagggaguccccgccguggugauugacaugagcggcuugagggaaaaggaugacauccagcgggcagagugcaugcuacagcaggcugaacgccugggcugucgacaauucgucacggccacugauguugugagagggaacccuaagcucaaucuggcuuuuauagccaaccuuuucaauagguacccagcacugcacaaaccggagaaccaggacauugauuggggagccuuggagggugaaacccgggaggaacguacauuccgcaauuggaugaacucucucggcguaaaucccagagugaaccaccuguacuccgacuuaucagacgcucuggucaucuuucagcuauaugagaagaucaaagugccuguugauuggaauagggugaacaagccacccuacccuaaacucgggggaaacaugaagaagcuggagaauugcaacuaugcggucgaacuuggcaaaaaucaggcaaaguucagcuugguggguauugggggccaagaccugaacgagggaaaucggacucucacccuggcccuuaucuggcagcugaugcgacgcuacacauugaacauucucgaagagauaggcgggggacagaaaguaaaugaugacaucauuguuaacugggugaaugaaacccugagagaggcuaagaaaaguucuuccaucagcucguuuaaggauccaaagaucucuacguccuuacccguccuggaccuaauugaugccauacaaccggguucaaucaacuaugaccuccugaaaacugagaaucuuaacgaugacgaaaaguugaauaacgcaaaauacgccauuaguauggcuaggaagaucggcgcccggguguaugcacugccugaggaucucgucgaagugaaucccaaaaugguuaugacaguguucgcgugucugauggggaagggaaugaagcgcguauga

SEQ ID NO: 58359 - RNA, 1602 nt, Artificial Sequence
  derived and/or modified sequence opt3 from LCP2__Homo_sapiens__NP_005556
auggcccugagaaacgugcccuucaggagcgagguccucggcugggacccugauucccuugcugacuacuuuaagaaacugaauuauaaggauugcgaaaaagcaguuaagaaauaccacaucgacggggcccgguucuugaacuuaaccgagaaugauauucagaaguuuccaaagcugcgcgugccgauacuaucuaaacucucacaagaaaucaacaagaaugaggaacgacguaguauuuucacaagaaaaccccagguaccuagguuuccagaggagacugaaagccaugaggaagacaacggagguugguccucuuucgaggaggaugacuaugaaucgcccaaugaugaccaggauggcgaggacgauggggacuacgaaucaccuaacgaggaagaggaggcgccaguggaagacgaugcugacuaugagcccccuccaagcaaugaugaagaggcccugcagaacaguauccuuccggcaaagcccuuuccuaauuccaacucuauguacauugaccggccacccagcggaaaaacgccucaacagccacccgucccgccucagcgccccauggccgcucugccaccucccccagcaggcagaaaucacucccccuugccuccaccgcagaccaaccaugaggaacccucaaggagucggaaucacaagacagccaagcucccugcuccaagcaucgaucgcucuacuaaacccccucuggaccgaucccuggccccauucgauagagagcccuuuacccucgguaagaaaccgccuuucucagacaagccaagcauacccgcggggaggaguuuaggagaacaucugccuaaaauccaaaagcccccacuuccucccacaaccgagcggcacgaacguucuuccccauugccgggcaaaaagccucccgugccaaagcacggcugggggcccgaucgcagagagaacgacgaagaugacguucaucagaggccucugccacagcccgcacuacucccuaugagcucgaacacuuuuccgucucgguccacaaaaccaucacccaugaauccucugccaaguagccacaugcccggagccuucuccgagucuaacagcucauuuccucagagugcuucccuuccgcccuauuucagccaagguccaucuaaucgaccucccauucgcgccgagggcagaaacuucccacugccuuugcccaauaagccaaggccgccuucacccgcagaagaggaaaacagucucaaugaggagugguacgugagcuacaucacccggccagaagcugaggccgcgcugcgcaaaauuaaccaggacgggacguuuuuagucagagauuccucuaagaaaacuaccacaaaucccuaugugcugaugguacucuacaaggacaagguuuauaacauccagauaagguaccaaaaagaaagccagguguaucuucugggaacuggcuugcgugguaaggaggauuuccuaucggucuccgacauuaucgauuacuuucggaaaaugccucugcuccugauugacgggaagaaucgaggaucaagauaucaguguacccuuacacaugccgcaggcuacccauga

SEQ ID NO: 58360 - RNA, 5784 nt, Artificial Sequence
  derived and/or modified sequence opt3 from LCT__Homo_sapiens__NP_002290
auggaacugagcuggcacguggucuucaucgcccuccuuuccuuuucuugcuggggcucagacugggaaagcgacagaaacuucauuagcaccgcugggccccugacaaaugacuuguuacauaaccuguccggacuacucggugaucagucuucgaauuuuguugccggcgacaaggauauguacgugugucaccaaccucugccaacuuuccuuccggaauauuuuucaagccugcaugccagucagauaacgcacuacaaaguguucuuguccugggcgcagcuccugcccgcugggucuacccagaacccugacgaaaagacagugcaaugcuauaggcggcugcucaaagccuuaaagacugcacgccugcagccaauggucauccuucaucaccagaccuugcccgccagcacacugcgacguaccgaggcuuuugcagaucuauucgccgacuacgcuacuuuugccuuccacuccuuuggagaucucgugggcauuugguucacauuuucagaccuggaagaaguuaucaaagaacuuccucaucaggaaaguagagcgagccaacugcagaccuugucugaugcacacaggaaggccuaugagauuuaccaugaauccuaugcuuuccagggugggaagcucucagugguccugcgggccgaggacaucccagaguuacugcucgaacccccuauaagcgcacuugcucaggauacgguggacuuccugaguuuggaccuaucuuacgagugucaaaaugaagccucccugcgccagaaacucagcaagcugcagacuaucgagccaaaaguaaagguuuuuauuuucaaccuuaaacugccggauugccccucgaccaugaagaauccugcgucuuugcucuuuucccuguucgaagccaucaacaaggaccaaguguuaacaauuggauuugauaucaaugaguuccugucauguaguagcuccucuaaaaagagcaugucaugcagucuaacuggcucccucgcacugcagccagaccagcagcaagaucacgagaccacagacagcucucccgcuucagccuaccagagaauaugggaggcuuuugccaaccagaguagggcagagcgggaugccuuccuucaggacaccuuuccugaaggcuucuuguggggagcuagcacgggagcguuuaaugucgaggguggcugggcagaagggggacgcggcguguccauuugggauccacgaagaccccugaacacuacagagggucaagccacccucgagguggcuucugacucguaucacaaagucgccagcgauguugcacugcuuugugggcugagggcccagguguacaaguucuccaucucauggagucggauuuuuccgaugggacauggcucuagcccuuccuugcccggcguagcuuauuacaauaaacucaucgaccgucugcaggacgccgggaucgaaccaauggcaacuuuauuccacugggaucugccucaggcgcuacaagaccauggagguuggcagaacgagucaguggucgaugcuuuccucgacuaugccgcauuuugcuucagcacauuuggcgaucgcgugaagcuguggguuaccuuccacgaacccugggugaugucuuacgccggguauggaacgggccagcauccacccgguauuuccgacccuggggucgcuaguuuuaaaguggcccaccuuguauugaaggcacacgcuagaaccuggcaucacuacaauagccaucacaggccacagcaacagggccacguuggaauagugcugaacucugauugggccgagccgcucucccccgaacggccugaggaccugcgagcgucagagcgcuucuuacauuuuaugcugggcugguucgcccacccagucuuuguggauggggacuaccccgcuacacuuagaacucagauccaacagaugaacaggcaguguagucauccugucgcacaguugccagaguucaccgaggccgaaaagcaacuccugaaaggaagcgcugauuuucuaggucugucgcacuauacaucccggcucauuucuaaugcaccccagaacacuugcaucccgagcuacgacaccauaggcggguucucacagcaugugaaucacguuuggccucagacaaguuccucuuggauucgcgugguaccauggggaaucagaaggcugcuucaauuugucagcuuggaguauacccguggcaaggugcccaucuaccuggcagguaacgggaugccuauuggcgaguccgaaaauuuauucgaugacucacuccggguugacuauuucaaccaguacaucaaugaggugcugaaagcgauuaaggaagauagcgucgacgugcgaaguuauauagccagaucucuuaucgauggauuugagggccccuccggguacagccagagguucggacugcaccauguaaacuuuucggacucaucuaaaagucgcacuccacggaaguccgcuuacuucuuuacgagcauuaucgaaaagaaugguuucuugacaaaaggcgccaagagacuccugccucccaacaccgugaaucuaccaucuaaaguuagggcauuuacuuucccgagcgaggucccuuccaaggcuaaaguggugugggagaaguuuucaagucagcccaaguucgaacgcgaucuguuuuaucacgggaccuuccgagacgauuuccucuggggagucaguucuuccgccuaccaaaucgagggcgcaugggacgccgaugguaaagggccaucaauuugggacaacuuuacacauacccccggcaguaauguuaaggauaacgcuacuggagacauagcgugugauagcuaucaccagcuggacgccgaccuuaauauguugcgggcacugaaagugaaggcuuaccguuucuccaucucuuggucgagaauuuuuccuacaggcaggaacagcucaaucaacucccaugggguggauuauuacaaucgcuuaauuaacggacucguagccaguaauaucuucccaauggucacgcuguuucacugggaccuuccccaggcccugcaagauauaggcgguugggaaaacccugcucuaaucgaccucuucgauucuuaugcagacuuuugcuuccagaccuuuggggaucgggugaaauucuggaugacuuuuaaugagccgauguaccuggccugguugggauacggcagcggugaguucccacccggcguuaaggacccugggugggcgccauauagaauugcucacgccgugaucaaggcacaugccagggucuaccacacauaugaugagaaauaccgacaggagcagaagggagugauuucccugucauuaucuacccauugggcugaacccaaaagcccuggcguuccgcgcgacguggaggcagccgaucggaugcuccaauuuagucuggggugguucgcgcaccccaucuucagaaacggagacuauccagacacaaugaaguggaaaguaggcaauagguccgaacuucagcaccuggcuacuagccguuugccuucuuuuaccgaggaagagaagcgcuucauacgggccacggcagaugucuuuugccucaacaccuacuauucaagaauugugcagcauaaaacacccaggcugaauccaccuuccuacgaggacgaucaggaaauggccgaggaagaggaccccaguuggccaagcacugcuaugaaccgagccgcaccgugggguacccggcgccuacugaauuggaucaaggaggaauacggggauauuccuaucuauauaacagagaacggagugggccuuacuaaucccaacaccgaagacacggauagaaucuucuaccacaagacauauauuaaugaggcucucaaagccuacaggcuggacgguaucgauuugcggggcuaugucgcguggucgcugauggacaacuuugaaugguuaaacggguacaccguuaaguucggacucuaucauguggauuuuaauaacacuaaucgaccaagaacagcccgcgcaucugcuagguacuacaccgagguaauuacuaacaauggcaugccccuggcccgugaggacgaguuccuuuaugggcgguuuccugagggauucaucugguccgcugcaagcgccgccuaccaaauagaaggcgcuuggagagcggaugguaaagggcugucaauuugggacaccuuuagucacacaccauugaggguggagaacgacgcaaucggagaugucgccugugacucuuaucauaagaucgcugaagaucucgugacgcugcagaaucuaggcguuucccacuaccgcuucagcauuucauggagucgaauccugcccgacgguaccacuagauauauuaacgaggccggccuuaauuacuaugugcggcucauagauacacuguuggcagccagcauccagccucaggucaccauuuaccacugggacuuaccgcaaacacugcaggaugugggcgggugggagaacgaaacuaucguucagagguuuaaagaguacgcugacguacucuuccagcgccugggggauaaggucaaguucuggauuacccuuaaugaaccauuuguaaucgcguaucaaggguacggauauggcacggccgcacccgguguguccaaccguccugggacagcucccuacauaguuggacauaaucugaucaaagcccacgcagaggccuggcauuuguauaacgacguguacagagcuucucagggcggcgucauuagcaucaccauuuccucagauugggccgaaccacgggacccuucuaaucaggaggauguggaggcggcaaggcgcuauguacaauucaugggagggugguuugcccaccccaucuucaagaacggugacuacaacgaagugaugaaaacucgaauaagagaccggagucuagcugccggccugaauaagucgaggcucccagaguuuaccgaaagcgagaaacgcagaauuaacgggacauacgauuucuuuggauucaaucacuauacuaccguccuggcuuacaaccuuaauuaugcaacagccaucuccucuuuugacgcugauaggggcguugccucaaucgcagaccggagcuggccugauuccgguaguuucugguuaaagaugacgccguuuggguuccgucgcauucugaacuggcucaaggaggaauacaaugaucccccaauauaugugaccgagaacggagugucucagcgagaagagacugauuugaaugacacagcgagaaucuacuaucugaggaccuacauuaacgaagcccucaaagcuguccaggauaagguggaccugcggggcuacacuguuuggagcgccauggauaauuuugagugggcaacaggcuucucagagcgcuucgggcuucauuuuguaaacuauuccgacccuagucugcccagaaucccaaaagcuagcgccaaguucuacgcaucuguggucaggugcaauggauuuccugaccccgccaccgguccgcacgcuuguuugcaucagccagaugcgggcccuacgauuucccccgugcggcaagaagagguucaguuccuagggcugaugcucggaacuaccgaagcccagacagcauuauaugugcuguuuucacuuguccugcucggcgugugcgguuuggcuuuccugagcuacaaauauuguaagcgaucgaagcaggggaaaacccaaagaucucagcaggagcucaguccaguauccagcuuuuga

SEQ ID NO: 58361 - RNA, 1236 nt, Artificial Sequence
  derived and/or modified sequence opt3 from LDB1__Homo_sapiens__NP_001106878
augagcgugggcugcgccugucccgggugcuccucuaagucauucaaacuguacaguccuaaggagccaccgaacggaaaugcuuuucccccuuuccacccagguaccaugcucgacagagaugucggccccacaccuauguauccacccacuuaccuugaaccugggaucggaaggcauacgccauauggcaaccagaccgacuaccggauuuuugagcugaauaaacgcuugcaaaacuggacagaagagugugauaauuuauggugggacgcauucacuaccgaauuuuucgaggaugacgccaugcugacaauaaccuuuugccuagaggaugguccgaagcgauauacuaucgggcguacacucauucccagauacuucaggagcaucuuugaaggaggcgcgaccgagcuguauuacguucuuaaacacccuaaggaggcuuuccauuccaacuuugugucucuggacugugaucagggcucgaugguaacgcagcacgggaagccaauguucacucaggugugcgucgaaggacgguuguaccucgaguuuauguucgacgauaugaugcgcauuaaaaccuggcauuucucaaucagacaacacagggaacugauaccccggagcauccuggccaugcacgcacaggacccucagaugcucgaucaguuaaguaagaauauuacacgcuguggucuguccaacucuacucuuaauuauuugcgacugugcgugauccuagagccaaugcaagaacucaugagcagacauaaaaccuacucccugucacccagggacugucuuaagacaugccuguuucagaaauggcagcggaugguugccccgccugcugagcccacccgucagcaaccaaguaagcgcagaaagaggaaaaugagcggcgggucuacgauguccucaggaggcgguaacacuaauaacagcaauaguaagaaaaagucuccugcauccacauucgccuugagcucucaggugcccgacgucauggugguaggggaaccaacccucaugggaggcgaguuuggcgaugaggacgaacggcugauuacucgauuagagaacacacaguucgaugcugccaaugggaucgacgaugaagacucguuuaacaacucccccgcgcugggagcaaauucaccuuggaacaguaaaccaccgagcucccaagagucuaagagcgaaaaucccaccucacaggccagucaguga

SEQ ID NO: 58362 - RNA, 996 nt, Artificial Sequence
  derived and/or modified sequence opt3 from LDB2__Homo_sapiens__NP_001124306
augagcuccacaccccacgacccuuucuacucuucaccauuuggcccguucuauagaaggcauacccccuacauggugcagccugaguaucggaucuacgaaaugaacaagcgccugcaaagucgaacugaggauagcgacaaucucuggugggaugccuuugcuacggaguucuuugaagacgaugcaacccuuacacuguccuucugcuuggaagacgggccaaaacguuauacuauuggaagaaccuuaauacccagguacuuuucuacagucuucgaggguggcguuaccgaucuguauuacauccuaaagcacucgaaagagucauaccauaacagcaguauuacuguggacugugaucagugcacaaugguaacccagcacgggaagccuauguuuacgaaaguguguacugaaggacggcucauccuggaguucaccuuugacgaucuuaugcgcauuaagacauggcauuucacuaucagacaguauagggaacuggucccacgguccauauuggccaugcacgcgcaagacccccaggugcucgaucagcugucuaagaauaucacccgcaugggccugacaaacuuuacccucaauuacuuacgacugugcguuauucuugagccuaugcaggaguugaugagcagacacaaaacguauaaccuguccccaagggacugucuaaagacuugccucuuccaaaaauggcagcggaugguggcuccgcccgccgaaccuacacgucagccaaccacuaagcgcagaaaaaggaaaaauucaacaaguagcaccucuaacuccucagcagguaauaacgccaauagcacggggaguaagaagaagaccacagcugcaaaccugucucuuuccagccagguccccggacugggcgccaucccuaauuguucguugaacccaggccgggacggggaucucugccauucuacugcugugacccccuccggacaauucaaagagaagcacuga

SEQ ID NO: 58363 - RNA, 1854 nt, Artificial Sequence
  derived and/or modified sequence opt3 from LDB3__Homo_sapiens__NP_001073583
augagcuacuccgugacccugacaggccccgggccuuggggauucagacuccaggguggcaaggacuuuaacaugccacuuacuaucucuaggauuacgccggggucaaaagccgcucaaagucagcugagccagggagauuuggucguugcaauagacggcgugaauaccgauacaaugacucacuuagaggcccagaacaagaucaaauccgcgucuuauaaucugucgcuaacccuccaaaagucaaaacggcccauuccuaucagcacaaccgcuccacccguacagacuccucugccagugauuccccaucagaaggucgugguuaacaguccugccaaugcagacuaccaggaacgcuucaacccauccgcccuuaaggauucugcucugagcacacacaaaccgaucgaggugaagggucucgggggaaaagcaaccauaauccaugcccaauauaauacgcccauuuccauguacucacaggacgcuaucauggaugccauugcgggccaggcacaggcccaaggcagugacuuuagcgggucuuugccuaucaaggaucuggcugucgacuccgccucaccaguguaucaggcaguaauaaaaagccagaacaagcccgaagaugaggcugacgaaugggcccgacguaguucuaaucugcaauccagaucguucaggauucucgcgcagaugacuggaaccgaguuuaugcaggauccugacgaggaagccuuacggcgcagcagaccacaggcaucuuccuacucacccgcuguugccgcuaguagcgccccggcaacacacacuuccuauucugaggguccugccgcucccgcgccaaagccuaggguggucaccacagcaagcauccggcccucaguguaccaaccagugcccgccaguaccuacuccccuagcccaggcgcuaacuauucuccgacgcccuacacuccuucaccagcccccgcauauacaccuaguccagcccccgcuuacaccccgagcccugucccaacuuauacacccuccccugcccccgcauacaccccaucuccugcgcccaauuauaacccagcuccgucgguugccuacagcgggggaccugcagaacccgccucccgcccacccugggugacggacgauucauucagucagaaauuugcuccuggcaagucuaccacaagcauuuccaaacagacucugccacgaggugggcccgccuacaccccugcaggaccgcagguaccaccccuugcuagaggcacagugcaaagggccgagcgguucccugcgucaagccguacuccauugugcggccauuguaauaacgucauccgcgggcccuuucugguggccaugggaagaucuuggcacccugaggaauuuaccugcgcuuauuguaagacaucccuagcagacguuugcuucguggaggaacagaauaacgucuacugugagaggugcuaugaacaguucuuugccccgcucugugcuaaaugcaacaccaagaucaugggugaggugaugcacgcccugcggcagacuuggcauacgacauguuucguaugcgcagcguguaaaaagcccuucggcaauagucuuuuucacauggaggauggggaaccauacugcgagaaggacuauauuaaccuguucagcaccaaaugccauggaugugauuuuccuguugaagccggcgacaaguucauagaggcuuugggucacacuuggcacgauaccugcuuuaucugugccgugugccaugucaaucucgaagggcaacccuucuacucuaaaaaggaccgaccacuguguaaaaagcacgcacauacaauuaacuuauga

SEQ ID NO: 58364 - RNA, 825 nt, Artificial Sequence
  derived and/or modified sequence opt3 from LDHA__Homo_sapiens__NP_001128711
auggccacccugaaggaccagcucaucuacaaccuucugaaagaggaacaaacaccccagaauaagauuacuguggucggcguuggggcugugggaauggcaugcgccauaagcaucuugaugaaagauuuagcggacgagcuggcucuaguagaugugauugaagacaagcucaaaggugagaugauggaucugcagcacggcucccuuuuccugagaacgccuaagaucgucucugggaagguggacauuuugaccuauguugccuggaaaaucucaggauuuccaaagaacagggugauaggcagugguuguaaucucgauagcgcacgguuccgcuaccugaugggggaacgacugggaguccauccgcucuccugccacggcuggguguuaggcgagcauggggacucuucgguacccguuuggucaggaaugaacguggccggugucagccugaaaacacuucacccugauuugggcacugacaaggauaaagagcaguggaaggaagugcauaagcaaguggucgagagugcuuaugaaguuaucaaacugaagggguacaccuccugggcaauuggacuaucuguggccgaccucgcugagagcaucaugaaaaaucugcguagaguacacccaguguccacaaugauuaagggccuuuaugguaucaaagaugacgucuuucugucagugcccuguauauuggggcagaacggaauuagugaccucguuaaggugacccugacuagcgaggaagaggccaggcugaaaaagucugcggauacauuauggggcauccagaaggaacuccaguucuga

SEQ ID NO: 58365 - RNA, 1146 nt, Artificial Sequence
  derived and/or modified sequence opt3 from LDHAL6B__Homo_sapiens__NP_149972
augagcuggaccgugcccgucguuagagccucccagagggugucuucaguaggcgcuaacuuccugugccucgggauggcacuuuguccucggcaagccacacgcaucccacugaauggaacuugguuguuuacgccggugaguaagauggcgaccgucaaaagcgaguuaauugaacgauucacauccgagaagcccgugcaccauucuaaaguuucgauaaucgguacuggcucaguggggauggcuugcgccauuagcauccugcuaaagggacucagugacgaacuggcacuugucgaucuggacgaggauaaauugaagggcgaaaccauggaccuccagcacgguuccccuuuuacaaagaugccaaacauuguguguucuaaagauuacuucguaaccgccaauagcaaccugguuaucauaacugcuggggcacgucaggagaagggagagacaagacugaaucucgugcagaggaacgucgccaucuuuaaauuaaugauuuccucaaucgugcaauauaguccccauugcaagcugauuaucgugagcaauccugucgacauacuuaccuacguugcuuggaaauugucugccuucccaaagaaccggauuaucggcuccggcuguaaucuggauacggcgcgcuuuagauuccuaauugggcagaagcucggaauccacucagaaagcugccaugguuggauccugggcgagcacggggacaguucugugcccguaugguccggagugaacauugcaggcgucccucuuaaagaucugaauagcgacauagguacugauaaggacccagaacaguggaaaaacgugcacaaggagguuaccgccacagcuuaugagaucauuaaaaugaagggguacacuucgugggccaucggauugucuguggcagaucucaccgaauccauacugaaaaauuuaaggcggauucauccggucucaacaaucaucaagggccuguauggcauugacgaggaaguguuucucaguauccccuguauucuuggggagaacggaauaaccaaucugaucaagauuaaauugacgccugaagaggaggcucaccuaaagaaaagcgccaagacucugugggaaauccagaacaaacucaagcuguga

SEQ ID NO: 58366 - RNA, 1005 nt, Artificial Sequence
  derived and/or modified sequence opt3 from LDHB__Homo_sapiens__NP_002291
auggccacccugaaggagaaacucaucgcucccguggcagaagaggaagccacagucccuaacaauaagauuacuguugugggcguaggacagguggggauggcgugcgcuauaagcauccuugguaaaucccuggccgacgaguuggcauuagucgaugugcuggaagacaagcuaaaaggcgagaugauggaucuccaacacgggucucuguuccuucagacgccaaagauuguugccgacaaggauuacucagugaccgcuaacaguaaaaucgucgugguaacagcaggaguuagacagcaggagggcgaaagcaggcugaauuuggugcaacggaacgucaauguguuuaaguucauuaucccgcagauagugaaauauucccccgacuguaucauuaucgucguuucuaacccuguggauauucucacuuacguaaccuggaagcugucgggucugccaaaacaucgcgugaucgggucaggaugcaaucucgacagcgcccgauuucguuauuuaauggcugagaagcugggcauacaccccaguuccugucauggcuggauucuuggggaacacggagauucuagcgucgccgugugguccgguguuaacguggcgggcgucucauugcaggagcugaauccugagauggggacagacaacgauagugaaaauuggaaggaggugcauaaaaugguaguugaaagcgcauacgaggugaucaagcuaaaaggauauaccaacugggccauuggccucucugucgcugaccugaucgaauccaugcuuaagaaucugucaagaauccacccagugagcacuauggucaaagguauguacgggauugagaacgagguguucuugagucuccccugcauacugaaugccaggggauuaacaucuguuaucaaccagaagcugaaagaugacgaaguggcacaacucaagaaguccgcugacacccuuugggauauucagaaagaccugaaggauuuguga

SEQ ID NO: 58367 - RNA, 999 nt, Artificial Sequence
  derived and/or modified sequence opt3 from LDHC__Homo_sapiens__NP_059144
augagcaccgugaaggagcagcugauugaaaaacucauugaggacgaugaaaacucccaaugcaagauaacaaucgucggcacuggggccguuggaauggcuugugcaauuucuauccuucugaaagacuuggccgaugaguuagcgcugguggacguagcucuagauaagcucaaaggugaaaugauggaccugcagcacggcucacuuuucuuuaguacgagcaagauuaccuccgggaaggauuacucugugucggccaauucaagaaucgucauagugacagcaggagccaggcagcaggagggcgagacucggcuggcuuugguucaacgcaacguggcaaucaugaaaagcauuauccccgccauuguccauuauaguccugacugcaagauccucgugguauccaauccaguugauauacugaccuacauuguguggaaaaucucuggucugccggucacacgagugauugggagcggauguaaccucgacuccgcucguuucagauauuuaaucggcgaaaagcugggcgugcaccccaccucaugccauggguggaucauuggagagcacggugauaguagcgucccucuuuggucuggcguuaauguggccgggguagcguugaaaacucuggacccaaagcuaggaacagauuccgacaaggaacauuggaaaaacauacacaaacaggugauccagucagcauacgagauuaucaagcucaagggcuauaccagcugggccauaggucugagugucauggaccuuguggggucuauucugaaaaauuugaggcggguucaccccguguccacgauggucaagggacucuacggcaucaaagaggaacuguuuuuaagcaucccuugugugcugggccgcaacgggguaucggauguugugaagauuaaucucaacucugaggaagaggcucuuuucaagaaauccgccgaaacucuguggaauauccagaaggacuugaucuuuuga

SEQ ID NO: 58368 - RNA, 1524 nt, Artificial Sequence
  derived and/or modified sequence opt3 from LDHD__Homo_sapiens__NP_705690
auggccagacugcucaggagcgcuaccugggagcuuuuccccuggcggggcuacugcucccagaaggcaaaaggggaacugugucgcgacuuuguggaggccuugaaggcggucguuggagguucucacgugucaacagcugccguagugcgagaacaacauggccgugaugagaguguccacagaugcgaaccuccagacgcagugguuuggccgcagaacguggagcaggucagcagguuagccgcucuguguuaucggcagggggugcccaucauuccuuucggaacuggcacgggucuagaagggggaguaugcgcaguucaaggcggcgugugugucaaucucacccauauggaucgcauacuggaacuuaaccaggaggacuuuuccgugguggucgaaccagggguuacaagaaaagcccugaaugcucacuugagggauucuggacucugguuccccguggacccuggugccgaugcgucgcugugcggcauggcagccacuggggcuucaggaaccaacgccguacgguacggcacaaugcgcgacaaugugcugaaccucgaggucguguuaccagauggucgacugcuucauaccgcagggagaggaaggcacuuucgguucggcuuuuggcccgagaucccucaccauacugcuugguauagcccauguguuaguuugggccgucgcaaguccgccgcgggguacaaucugacaggacuauucguggguucugaaggcacccucgggcugauuacggccacuacccuuagacugcacccggcacccgaggcuacagucgccgcuacuugcgccuuuccuagcgugcaggcagccguagacuccaccguucauaucuugcaggcugcggugccagucgcaaggauugaauuucucgaugaggugaugauggacgccuguaaccgguauucaaaacugaauugcuuagucgcucccacacuguuccucgaguuccacggaagucaacaggcccuugaggagcagcugcagcgaaccgaagagaucgugcaacagaacggcgcaagcgauuuuucuugggccaaggaagcugaggaacgcuccagauuguggacggccaggcacaaugcaugguacgcggcucuagccacucggccugguuguaagggguauucaacagacguuugcgugccaauaagccgccugcccgagaucguaguccagaccaaagaggaccucaacgcaaguggccugacuggaucuauugugggccauguuggggauggaaauuuccacugcauccuucuggugaacccggacgaugccgaagaguuggguagagucaaggcuuucgccgaacaacucggcaggcgugcacuggcuuuacaugggacauguaccggagagcacggcauugguauggggaaacggcagcugcuacaggaagaggugggcgccguaggaguggagacgaugcgacagcucaaggcgguucuggacccucaaggccuuaugaaucccgggaaagucuuguga

SEQ ID NO: 58369 - RNA, 1038 nt, Artificial Sequence
  derived and/or modified sequence opt3 from LDLRAD3__Homo_sapiens__NP_777562
auguggcugcucggcccccuuugccuguuguuaagcuccgccgcugagucucagcugcuaccugggaacaauuucaccaacgaauguaauaucccaggaaacuuuaugugcucaaaugguagauguauuccgggcgcauggcaaugcgacgggcuccccgauuguuucgacaagagugaugagaaagaaugcccuaaggccaaaagcaaguguggaccaacauuuuuccccugcgcguccggcauacacuguaucauugguagguuucggugcaacggguucgaggacuguccugauggaucugacgaagagaauugcacugcuaacccacugcuuugcucgacggcccgcuaccauuguaaaaauggccugugcaucgauaagucauuuauuugugacggccagaacaauugccaggauaacagcgacgaggaaaguugugaguccucucaggaacccgggagcggacaaguguucgucaccuccgagaaucaguugguuuauuacccuucaaucacauaugcaauaaucgguaguagcgugauuuuuguacucguggucgcccugcuggcucucguguuacaccaucagcgaaagcguaacaaucugaugacucuuccaguucacagauugcagcauccggugcugcuaucuaggcucgucgugcuggaucacccccaccauugcaacguaaccuacaacguuaauaacggcauccaauauguggcaucccaggccgagcagaaugcuucagaagucgggagcccuccaaguuacucugaggcccuucuggaccagcggcccgcgugguaugauuugccuccacccccguacuccagcgacacagaaucgcucaaccaagcagaccugccucccuaccgcucuagauccggaucagccaauagugcuagcucccaggccgcaucuagcuuacugucaguggaggauaccagucacuccccaggccagccugguccccaagaagggacugcugagccaagggacagcgagcccucucagggaacagaagagguguga

SEQ ID NO: 58370 - RNA, 810 nt, Artificial Sequence
  derived and/or modified sequence opt3 from LDLRAD4__Homo_sapiens__NP_001003674
augagcuccgaccaccugaacaauucuacccucaaggaggcccaguucaaagaucuuuuucugaagaaagcugaauuggaguucgcacaaaucauuauaaucguggucguugugacaguaaugguggucgugauuguuugcuuacugaaccauuacaaggugucaacuagaaguuuuaucaauaggcccaaccagagccggcgccgagaagacggccuaccucaggaggggugucucuggccauccgauucugccgcgccgcgucugggagcuucggaaauuaugcacgcccccagaucaagggaccgguucacggcaccuagcuuuauccagcgcgauagauucaguagguuucaaccaaccuaucccuacguccagcaugagauagaccuuccuccaacaaucucccugucugauggugaggaacccccuccauaucagggcccgugcacuuugcagcuccgggaccccgagcaacagauggaacugaaucgcgagagcgugcgagccccuccaaacagaaccauuuucgauuccgaccugaucgauauugcuauguacucagggggacccuguccuccaaguagcaauucuggcaucuccgcaucaacaugcagcaguaacgguaggauggaggggcccccgccuaccuauucugaaguaaugggacaccaucccggcgccuccuuucuccaccaccagcggagcaaugcucaucguggcucgcgcuuacaguuccaacagaacaaugccgagucuacuauaguuccaauuaaagggaaggacagaaagccuggaaaccugguguga

SEQ ID NO: 58371 - RNA, 2583 nt, Artificial Sequence
  derived and/or modified sequence opt3 from LDLR__Homo_sapiens__NP_000518
augggccccuggggguggaagcugagauggaccguggcccuccuucuggcugcagccggaacagcggucggugacaggugcgagcggaacgaauuucagugucaagauggcaaaugcaucagcuacaaguggguuugugacggguccgcugagugccaggauggaucugacgaaucacaggagacuuguuugagugugacgugcaaaagcggcgauuuuuccuguggugggcgcguaaaucgaugcauuccucaguucuggcguugugacggacaaguggauugcgacaacggcucugaugaacagggcuguccaccgaagaccugcucgcaggacgaguuuagaugccacgaugggaaauguauaucaaggcaguucgucugcgacagcgaucgggacuguuuagacggaagugaugaggccuccugccccgugcugacaugugguccugcaucuuuucaaugcaauagcuccacuuguaucccacagcuaugggccugcgacaacgaucccgacugugaagauggcucagacgaguggccucagcgcugcagagggcucuauguuuuccagggagauaguagcccauguucugcuuuugaguuccauugccuguccggcgaaugcauucacucaagcuggaggugugacggugggcccgauugcaaggacaagagugaugaggaaaauugugcaguggcuaccugccggccugacgaguuucaauguucugacggaaacugcauccauggcucccgccagugugaucgagaauacgacugcaaagauaugagcgacgaggucggcugugugaauguaacacuuugcgaagggccaaacaaguucaaaugucacucgggagagugcauuacccuggauaagguuugcaauauggccagagacuguagggauuggucugacgagccgaucaaagaaugcgguacuaacgaguguuuggauaauaacggcgggugcucccauguguguaaugaccucaagauaggauaugaaugccugugucccgauggcuuucagcuggucgcccaacggcguugcgaggacaucgaugaaugucaggacccugacacaugcucacagcucugugugaacuuagaggguggguacaagugccagugcgaggaaggcuuccaacuggauccacacaccaaagcguguaaggcagugggaaguauugccuaucuuuucuucacgaaucgccacgaggucagaaaaaugacuuuggacaggagcgaauacaccucccugauccccaaccuacggaacguuguggcucucgauacagagguagccucuaaucgaauuuauuggagcgaccugucacagcgcaugaucugcaguacucagcuugauagagcacauggcguguccagcuacgacaccgucauaucuagggauauucaggcuccugacgggcuggccguggauuggauccacucaaacauuuacuggacagacaguguuuugggaaccgugagcgucgcggauacgaagggugugaaacggaagacucucuuccgcgaaaauggcuccaaaccaagagccaucguaguugaccccgugcauggguuuauguauuggacagauuggggaaccccggcaaagaucaagaaaggcggucugaacggggucgacauuuacucuuuagugacugagaauauacaauggccuaacggcaucacacuggaccuccuuucgggaaggcuguauugggucgauagcaaguugcacuccauuucaaguaucgacgugaauggcgggaaccguaaaaccauacuagaggaugaaaagcggcuggcucaccccuucucucucgccguuuuugaggacaaaguguucuggacggauauuaucaaugaagcuaucuuuagcgccaaccgacugaccggauccgacguaaaucuucuggcagagaacuugcucucaccagaggauaugguccuguuccauaauuuaacacagccuagaggugugaacuggugugaaaggacuacccugagcaauggcgggugccaguaccuaugucuccccgccccacagauuaacccccacucuccuaaguuuacaugcgcuuguccagacggaaugcugcuugcgcgcgauaugcgguccugcuugacugaggcagaagccgcuguugccacccaagagacaaguaccgugagacugaaggucagcucuacugcagugaggacgcagcauacaaccacucgcccgguacccgacaccucccgacucccuggcgccacaccaggucugaccacuguggaaaucguuacaaugucacaccaggcucuuggggaugucgccggccggggaaacgagaaaaagcccaguagcgugcgugcacugucgauuguguugccuauaguccuccugguuuucuuaugucugggcguguuucuacucuggaaaaauuggagacugaagaacaucaauuccauuaacuucgacaauccaguguaucagaaaacgaccgaggacgaaguacauaucugccacaaccaagauggguacucuuaucccagcaggcagauggucucacuugaggacgauguggcguga

SEQ ID NO: 58372 - RNA, 441 nt, Artificial Sequence
  derived and/or modified sequence opt3 from LDOC1__Homo_sapiens__NP_036449
augguggacgagcugguccuccuucugcacgccuuguuaaugagacauagggcucugagcaucgaaaacucccagcuaauggagcaacuccggcugcuuguuugcgaacgcgcaucucuguugcgacaggugcgucccccuucauguccaguaccguuccccgagaccuuuaauggcgaaaguagcagacucccugaguucauugugcagacagccuccuacaugcuggucaacgagaauagguuuugcaacgaugcgaugaagguggcuuuccugauaucucucuuaacuggggaagccgaggaauggguugugccauauaucgagauggacucgcccauucugggagauuaccgggcauuucuugacgagaugaaacaguguuucgguugggaugacgaugaagacgaugacgaugaggaagaggaagacgauuauuga

SEQ ID NO: 58373 - RNA, 720 nt, Artificial Sequence
  derived and/or modified sequence opt3 from LDOC1L__Homo_sapiens__NP_115663
auggugcagccccaaaccagcaaggccgaguccccugcucuggcagccucuccaaacgcgcagauggacgaugucaucgacacacucacuucacuuagacugacgaauagugcuuugaggcgggaagccagcaccuuacgcgcagagaaagccaaccugacaaauaugcuagaauccguuauggcugagcucacucugcuucgaacccgugcaaggauuccgggcgcccugcagauaacacccccuaucucuucgauuaccucaaacgggacuagaccaaugacaacgcccccuaccagcuugccagaacccuucaguggagauccuggucggcucgcuggcuuucugaugcagauggaccgcuucaugaucuuucaagccuccagauucccaggggaggcggagaggguggcauuucugguaucucggcucacuggagaagccgagaagugggcuauuccgcacaugcagcccgauagcccuuuacgcaauaacuaccagggcuuccuggccgaacuucgaagaaccuauaaauccccauugaggcaugcacggcgugcucagauccgcaagacaucagccaguaauagagcggugagggagcggcaaaugcugugccgacagcuagccagcgcagguacugggcccuguccuguccacccagcuucuaacggaaccucccccgccccggcucucccugcccgcgcaagaaaucuguga

SEQ ID NO: 58374 - RNA, 234 nt, Artificial Sequence
  derived and/or modified sequence opt3 from LEAP2__Homo_sapiens__NP_443203
auguggcaccugaagcucugcgccgugcuuaugaucuuccuguuguuacugggccagauugacgggagccccauaccugaggucuccucugcuaaaagaaggccacggcgcaugaccccguuuuggcgaggaguuucacuacgucccaucggugcaaguuguagagaugacagcgaaugcauuacaaggcucugucggaagcgcagaugcucccugucuguggcccaagaguga

SEQ ID NO: 58375 - RNA, 1002 nt, Artificial Sequence
  derived and/or modified sequence opt3 from LECT1__Homo_sapiens__NP_001011705
augaccgagaacagcgacaaggugcccaucgcccuggucggcccugaugacguugaguucugcuccccaccggcuuacgcaacacucacugugaaacccucuaguccugccagacuucugaagguaggggcgguggucuugauuucaggagcuguguuacugcuauuuggugccauaggcgcauucuauuuuuggaaagggagcgauucccacaucuacaauguucauuauacgaugucuauuaacggaaagcuccaggacggcucgauggaaaucgaugccgguaauaaccuggaaaccuucaaaauggggucaggagcugaggaagcaauugccgugaaugacuuucaaaacggcaucacaggcauaagguucgcugggggagagaaguguuacaucaaggcccaggucaaagcgcggauuccagaggugggugcaguaacuaagcagagcaucaguuccaaacuugaaggcaagauuaugcccguuaaauaugaggaaaauucucugaucuggguggccgucgaucagccugugaaggacaacagcuuuuuguccucaaaggugcucgagcugugcggggaucugccaauauucuggcucaaacccaccuacccuaaggagauucaacgcgaacgacgugaggucguuagaaaaaucgugccaacaaccacuaagaggccgcacaguggaccccggagcaauccuggcgcuggucgcuuaaacaaugaaacaagaccaucuguacaggaggacucccaggccuuuaaccccgauaauccuuaucaucaggaaggggagucaaugaccuucgacccaaggcuggaucacgagggaauuuguugcaucgaaugucggcgcagcuacacgcauugccagaaaaucugugagccccuuggcggcuacuauccguggccuuacaacuaucaagggugccgaagugcauguagagugauuaugcccugcucuuggugggucgcuaggauauugggaaugguguga

SEQ ID NO: 58376 - RNA, 456 nt, Artificial Sequence
  derived and/or modified sequence opt3 from LECT2__Homo_sapiens__NP_002293
auguucagcaccaaggcccugcuccuugcuggccugaucuccacagcauuggccgggcccugggcgaacauuugcgcuggaaaaucuucaaaugagauaagaacuugugacaggcacgguugcggccaguacagugcccaacggagccagcgcccucaucaggggguggauaucuuauguuccgcaggaucuacggucuaugccccauuuaccggcaugauuguuggucaggaaaagccguaccaaaacaaaaaugcuaucaacaauggggugcgaauuucgggacguggcuucugcguaaagauguuuuauaucaaacccauaaaguacaagggcccuaucaaaaagggggagaaacugggaacacuacucccacugcagaagguguaucccgguauucagucacacguccauaucgaaaacugugacagcagugauccuacugcauaccuuuga

SEQ ID NO: 58377 - RNA, 1116 nt, Artificial Sequence
  derived and/or modified sequence opt3 from LEF1__Homo_sapiens__NP_001124185
augccccagcugagcggcgggggagguggcgggggaggcgacccugagcucugcgccaccgaugaaaugaucccauucaaggacgagggugauccgcaaaaagaaaagauuuuugcugagauaucccaccccgaagaggagggggaccuugcagauaucaaaucuucacuggugaacgaaagugagauuaucccugccagcaauggacaugaagucgcgagacaggcucagacaucccaggagccauaccacgacaaggccagggagcaucccgaugacggcaaacacccugauggcggguuguauaacaagggaccaucuuacucgucauauagcgguuacauuaugaugcccaauaugaacaaugacccuuauaugaguaacggcuccuuaucuccaccgaucccccggacuagcaauaagguuccugugguacaaccaucccaugcagugcacccccugacgccucuaauaaccuacucagaugaacacuucaguccagggagccaucccucucacaucccguccgacgucaacucaaaacagggaaugagccgccauccucccgccccagauauuccuacauuuuauccccucaguccaggcgguguggggcagaucacucccccucugggaugguucucucaccacaugauuccaggcccgcccggcccucauaccacagggaucccacaccccgcuauaguuaccccucaggugaagcaagagcauccacacacugacuccgaccuuaugcaugucaaaccccagcacgaacagcgaaaggagcaggaaccgaaacguccucacauuaagaagccacugaaugcauuuauguuguacaugaaagagaugagagccaacgugguagcugaguguacacucaaggaaagcgccgcgaucaaucaaauucugggaaggcgguggcaugcacugucgcgcgaggaacaggccaaauacuaugagcucgcuagaaaggaaaggcaguuacacaugcaacuguaccccgguuggucugcccgggauaacuauggcaaaaagaaaaagcgcaagcgagagaaacuucaggaguccgcaucagggaccggaccuagaaugacggcugccuacaucuga

SEQ ID NO: 58378 - RNA, 1101 nt, Artificial Sequence
  derived and/or modified sequence opt3 from LEFTY1__Homo_sapiens__NP_066277
augcagccccuguggcucugcugggcccuuugggugcugccuuuggcuagcccaggcgcagccuuaaccggggagcaacugcuaggaucccuccugagacagcuucagcugaaggaagucccgacauuggacagggcggauauggaggaacucguuauccccacucacgugcgggcucaguacguagcccugcugcaacgcucucauggugaccgaucacguggcaaaagauucagucagagcuuuagggagguggcagggcgguuccucgccuuagaggcuuccacgcaucugcuugucuuuggaauggaacagcgcuugccuccaaacucugagcuggugcaggcaguucuaagacucuuccaagaacccgugccuaaggccgcucugcacaggcacggccggcuuucgccacgcucagcccgagcgagagucaccguggaguggcugaggguacgggaugacgguagcaaucguacaaguuugauugauucccgccucguuucugugcaugaaagcggguggaaagcauuugacgucacugaggccgugaacuucuggcagcagcuguccagacccaggcagccuuuacugcuccaagugucaguccagcgggagcaccuuggaccacuggcuaguggcgcccacaaguugguucgauuugcaagccagggcgcuccggccgggcuaggagaaccccaacuggagcuccauacccuggaucuuggugacuauggcgcgcagggggauugugacccugaagccccaaugacagagggaacccgcugcuguagacaggaaauguacauagaucugcagggcaugaaaugggcagagaauuggguguuggagcccccugguuuccucgcuuaugaaugcguagggacuuguaggcaaccacccgaggcccuggcuuuuaaguggccguucuuaggaccucggcagugcaucgccucugaaacagacucccugcccaugauugugucaaucaaggagggcggccgcaccagaccacaggucgugagccuaccuaacaugaggguucagaaauguaguugcgcaucugauggggcccucgugccccgucggcugcaaccauga

SEQ ID NO: 58379 - RNA, 999 nt, Artificial Sequence
  derived and/or modified sequence opt3 from LEFTY2__Homo_sapiens__NP_001165896
auguggccccuguggcucugcugggcccuuugggugcugccuuuggcuggcccaggggcagccuuaaccgaggagcagcugcuaggaagccuccugagacaacuucagcuguccgaggucccgguuuuggacagggcggauauggaaaagcucgugauccccgcucacguacgggcccaguacgugguccugcugcgccgaucucauggugaccguucaagaggcaaaagguucagucagagcuuucgggagguggcagggcgcuuccucgccuccgaagcugcauuacacagacauggaaggcugucuccucggucggcccaagcucgcguuacaguggaguggcuucgagucagagaugacggcucaaacaggacuagcuugauugauagucggcugguguccguacacgagucugguuggaaggccuuugacguuacggaagcggugaauuucuggcagcagcuaagccguccacgccagccccuccugcuucaagucuccgugcagagagagcaucuggggccuuuggcaucaggagcccacaaacucgugagguuugcuagucagggcgccccagcaggccugggggaaccccaguuagagcugcacacccucgaucuucgggacuauggagcucaaggugauugugacccugaggccccaaugacagaaggcacucgaugcugucgccaggagauguacauagaucugcaggggaugaagugggcgaaaaacugggucuuggaaccgcccggauuccuagccuaugagugcguuggcaccugucaacagccuccagaagcacuggcuuuuaauuggcccuuccucgguccuagacagugcaucgccagcgagacagcuucucugccaaugauuguguccaucaaggaagggggaaggacccggccccagguagugucacuuccgaacaugcgcguccaaaaguguagcugcgccagugacggcgcacuggugccuagaagguugcagcccuga

SEQ ID NO: 58380 - RNA, 2079 nt, Artificial Sequence
  derived and/or modified sequence opt3 from LEKR1__Homo_sapiens__NP_001004316
auggaccaccauauccccaugcacgcccugccugaggaaauucagaagaugcucccagaggaaaaagugugcaaguacuguggcgucagcuaucuuauacugcaugaguucaaagcuauggaagagaagguuaaagcaauggagaaggaaaugaaguuuuaccaaggguccguggauagagagaaaagguugcaggaaaaguuacacucucugucacaggagcuagagcaguauaaaaucgacaacaagaguaaaaccgaacggauuuacgauguaggaaugcaacucaagagccagcagaaugaguuccagaaggugaaaaagcaacugucccaucuucaggacgaacugaaaaucaaguaucgccagucuuacauuuuuagccagcgauugucagaguauaaauacuucuggaacaagacacucagccugcugacuuuuacgaaacgugaacucaccaguaucaagaaugaggucuacgauaacuaucaaaauuggacauccuuaaagggugccguguuccugcagauaaaaucuaucagcgagacugcgcuuaccgaaauugacaucuugaacaagucccugacaguuucacagagaaauaaagugugccuagagaaggaaaugaaaaaccucaagcugcuuagugaugcugccauucugaggagccaacagauccggaccucucgccagcaggaggucaauuugcaaacuagauguuacgaccuccagaaggaagugcuggauuuacagugccugguagaggcacucggccuuaaacugcagaaggccguuacagagauggacaacuauaaagaaauguugaugaauaaguccaacgaggcugaugacugucaaagggaacuaaagaagcugaaguuugagucaauaauuagcgaaagucagcacaccaugcuccugaaagagaaggaggauucucuuaugacgugccagcagaucuacaaagcacugcaagaagaguugacugugaaggaaaaacaggaggaggacauuaagcggcgcaucaaucucgccgaaaacgagcuggaaaucaccaagacauuacugaaucagacucgagaggaaguccuaacccucaaaaacgagagagagcugaugcuuauuucccaccagaaaagcauagaacaauugcaggagacacugaggcagaaacuccugucggacgauaacuggaaggaaaagaucgaggcugaacuugccaaggagcgggcgcaacaucugguggaguucgaggaacaggcauugcucuuuaaagaagagaccaagcugcaguuagacauugaaaaggagaaacaccaggaugugauccaaaaguauaaaaaggagcaggaggaacugcagaugaaaauaucugaccuaauuacgggggccacucgugaucuccgccaggaagucacaacccugaaggagaaacuucauaaaucccacaucagauacacugaggaaucaaauaguaaggagaaagaaaucgagaacuugaagaaucugguugcugaguucgaaagcaggcucaaaaaggagauugacuccaacgauucugugagcgaaaaucugcggaaggagauggaacaaaaaucagacgaguuaaagcgaguaaugcuggcccagacacagcuuaucgaacaguuuaaccaaagucaggaggagaauaccuucuugcaggaaacggugcgcagagagugugaagagagguuugaacucaccgaggcacugucccaagcucgggagcagcuacuggaacucagcaaacugcgcggaucucuuccguucucacccugcaguuugagcaagggcucccugacaucuccugccgcggccgucucgaaccacggugagagaucguuagcaaggcucaauuccgaaaaagggauucagauaccaaaccugcguggagugucaaagcccacuaccuucccuacaagugauaagccaaaacggguucgaucuggcgugcccauccuuccucagccacauccgcccagaggcggggcuagcuccgccaaugagacuaggcaacgccuggcugccauuuugcggagaaggcgcucacagcaguga

SEQ ID NO: 58381 - RNA, 606 nt, Artificial Sequence
  derived and/or modified sequence opt3 from LEMD2__Homo_sapiens__NP_001137416
auggaggcccaggaauacaucgcuaacgugaccagcuccucuucagcaaaguucgaggccgcgcugacauggauucucaguagcaauaaagacgucggcauauggcuuaagggggaagaucaauccgagcugguuacuacgguggacaaaguagugugcuuggaaucugcucaccccagaaugggagucgguuguagguuaucgcgggcccugcuaaccgcagugacaaacguucucaucuuuuucuggugccuggccuuucuuuggggccuguugauucuccugaaguaucgcuggcgaaaacuggaggaggaagaacaggcuauguacgaaauggugaagaagaucauugaugucgugcaggaccauuauguagauugggagcaggacauggagcguuacccuuauguugggauccuccacgugagagauucauuaauaccaccgcaaagcaggcggcgcaugaaaagagucugggacagggcaguggaguuccuggccaguaaugagucccggauccagacugaaucucaucgcguggcuggagaggauaugcuugucuggcgauggaccaagcccagcuccuuuucagacagugaaagauga

SEQ ID NO: 58382 - RNA, 2736 nt, Artificial Sequence
  derived and/or modified sequence opt3 from LEMD3__Homo_sapiens__NP_055134
auggccgcugcagccgcgagcgcuccccagcaacuguccgacgaggaacucuucucucagcuuagaagguacggccugucaccugggccagugaccgagaguacacggccggucuauuugaagaaauuaaagaaacugcgcgaagaggaacagcagcaacaccgaagcggaggucguggcaacaagacuagaaauuccaacaauaacaauacggccgcagccaccguugcugcagccgggcccgcugccgcggcagccgcuggaaugggcgugaggccuguaucuggugaucuaucguaccuccggacaccagggggacugugccgcaucucagccagcggccccgagagucuucugggcgggccuggaggugcauccgcugccccagcggccggcucuaaaguguugcucggguuuagcuccgacgagucagaugucgaagcaagucccagagaccaggcuggaggcggugggaggaaggaucgggccagccugcaguaucgcggacugaaggcuccuccagccccgcucgcagccucugaggugacuaacuccaauucagcugaacgaagaaaaccccauagcugguggggcgcgaggcggccugcaggcccagaguuacagaccccgccugggaaggacggagccguugaggaugaagagggugaaggcgaggacggggaggaacgugauccagagacagaggaaccccugugggcuagucgcaccgugaacggaucuagacuugucccguacuccuguagggaaaauuauagcgacucggaggaagaggaugacgaugacguggccucuucccggcaaguauugaaagacgauucacugagucgacaccgcccuagaaggacucauagcaagccccuaccaccucucacagcaaaauccgccggcggucggcuggagaccucuguucagggcggcggaggccuugcuaugaacgaccgcgccgcagcggcugggagccuggauagaucaaggaauuuggaagaggccgcagccgcugaacagggagguggcugcgaccagguggauaguucccccgucccacguuaccgggugaacgccaagaagcucacgccccuguuaccuccaccgcugacugacauggauagcacccucgacucuucaacagggagucuucugaaaacuaauaaccacauuggaggcggugcauucagcguggauucuccccgaauauauuccaauucguugccuccaagcgcugccgucgcggccuccucaagucuaagaaucaaccaugcuaaccacaccgggucuaaucacacauaccugaagaacaccuacaauaaacccaagcucagcgagccugaagaggagcugcuucaacaguuuaaaagggaagagguuuccccaacgggcucauucagcgcacauuaucugucuauguuuuugcucacugccgcuugucuguucuuuuuaauucugggacuaacauaccucggcaugcgcgggaccggaguguccgaagacggugagcugaguaucgagaaccccuucggcgaaacuuuugggaagauucaggagagcgagaaaacacuuaugaugaauaccuuguauaagcugcacgaucggcucgcccaacuggcaggagaccaugaaugcgggucuuccucacagagaacgcuuaguguacaggaagcggccgcuuaccugaaggacuuggguccggaguaugaggggaucuucaacaccagccuccaguggauacuggaaaauggcaaagaugugggaaucaggugugucggcuuugggccugaggaagaguuaacaaacauuacugacgugcaauuccugcagucgacccgcccacuaauguccuuuuggugccgauuccggcgugccuucguuacagugacucacagacuccugcuuuugugucugggagucgugaugguaugcguugugcucagguacaugaaguaucgcuggaccaaagaagaggaggaaacacggcagauguacgauauggucgugaagaucauugacguccugagaucucacaaugaggcaugucaggaaaacaaagauuuacaacccuacaugccuaucccccaugugagggacagccugauacagccacacgaucgaaagaagaugaaaaagguuugggaccgcgcuguggauuuucuugccgcaaaugagucacggguaagaaccgaaacuaggcguauuggcggugccgacuucuuggucuggcgcuggauccagccuagugcuuccugcgauaaaauucucgugauccccucuaagguuuggcaggggcaagcguuucaucuggaccggagaaacagcccacccaauucccuaacgccuugucugaaaaucaggaacauguucgaucccgugauggagauuggagaccaguggcaccucgccauacaggaggcaauccuggaaaagugcucagacaaugauggcauuguccauaucgcuguggacaagaacagccgagaggguugcguauaugugaaaugucuuaguccagaauacgccggcaaggccuuuaaggcuuugcacgggucuugguucgauggaaaacugguuacagucaaauauuuacggcucgaccgcuaccaccauagauuuccccaggcacugaccuccaacacuccucuuaagccaagcaauaagcacaugaacucgaugucacaucugagguugcggaccggccucacaaauucucaagggaguuccuga

SEQ ID NO: 58383 - RNA, 1821 nt, Artificial Sequence
  derived and/or modified sequence opt3 from LEO1__Homo_sapiens__NP_001273359
auggccgacauggaggaucuguucggcagcgacgcugauuccgaagcagagagaaaggacucugauucagggagugacagcgauuccgaccaggaaaacgccgcgucuggaucgaaugcuucagguagcgagagugaucaagacgaaaggggcgauuccgggcagcccucuaacaaagagcucuuuggagacgauagcgaggacgaaggcgccucccaccauucagguagugacaaucacagcgagcggucugauaaccgcuccgaagcaucagagcgaagcgaccaugaggauaaugacccuagugauguggaccagcacucuggguccgaagccccaaacgaugacgaggaugaaggacaucguagcgacggcggcucgcaccacucugaggcugaaggguccgagaaggcacauucagaugacgagaaauggggaagagaagacaagagugaucagagcgacgaugagaaaauccaaaauuccgacgaugaagagagggcccaggguucugacgaagauaaacuucagaacagcgacgaugacgagaagaugcagaauaccgaugacgaggaacggccgcaacugucagaugacgagcgccagcaguugagugaagaggaaaaggcuaacuccgacgaugagagacccgucgccagcgacaaugaugacgagaagcagaacucugaugacgaagaacaaccucaguuaucagaugaagagaaaaugcagaauagugacgaugagaggccacaagcgagcgacgaggagcaccggcauuccgaugacgaagaggaacaggaucacaagucugagucggcacgcggcagcgacuccgaggacgaaguucugcgaaugaaaagaaagaacgccauugcuucagauagugaggccgacucugauacagaagugcccaaggacaauagcgggacuauggaucuauucggaggcgcagacgauauauccucagguagcgacggggaggauaaaccuccaacgcccggacagccuguagacgaaaacggccucccacaggaucaacaggaggaggaaccgauccccgagaccaggauugaaguggagaucccuaaggucaacacagaccugggcaaugaccuuuacuuugugaaacugccaaacuucuugucuguugaacccuccaugagucuccaccuggggaaugagguguuugaugucuauaaggcuccucugcagggagaccauaaccaccucuucauucggcaggguacuggcuuacaagggcaggccguguuuaaaaccaagcugacauuccguccacauagcaccgauucugcgacucaccgcaaaaugacacuuuccuuggccgacagaugcucaaagacccagaagaucaggauacugcccauggcaggacgggauccggagugucagcgaacggaaaugaucaaaaaggaggaggaacgccuaagagcuaguauuaggcgggagagccaacagcgcagaaugagggaaaaacagcaucagcguggccucucggccuccuaccuggagccugaccgguaugaugaagaggaagagggugaggaaucuaucagccuugcugccauuaagaaucgauacaaagggggcaucagagaggaaagggcacgcauauauucaagugacuccgaugagggaucugaagaggacaaggcccaacggcuguugaaggcuaaaaagcucacuagcgaugaggaaggcgagcccuccgggaaaagaaaggcggaagacgaugacaaagcaaacaagaagcacaaaaaguacguaauuucagacgaggaagaggaggaugacgauuga

SEQ ID NO: 58384 - RNA, 504 nt, Artificial Sequence
  derived and/or modified sequence opt3 from LEP__Homo_sapiens__NP_000221
augcacuggggcacccugugcggguuccucuggcuuuggcccuaccuguuuuaugugcaggccgucccuauccaaaagguucaggacgauacaaaaacuuugauuaagacgauagugaccagaaucaacgacauuagccauacacaguccguaucuucaaaacagaaggugacuggauuagauuucaucccaggucugcacccgauucuaacccucaguaaaauggaccaaacacuggcugucuaccagcagauccuuaccagcaugcccuccaggaaugugauacagaucucuaacgaucuggagaauuugcgggaccuccugcauguucuggcauuuucgaagucaugucaccucccuugggccagcggcuuagaaacucuggauagucuugggggaguguuggaggcguccggcuauucuacagaagucguggcucugagccgccuacaagguucccuccaggacaugcuguggcagcuugaucugucaccagggugcuga

SEQ ID NO: 58385 - RNA, 510 nt, Artificial Sequence
  derived and/or modified sequence opt3 from LEPROTL1__Homo_sapiens__NP_001121680
auggccggcaucaaggcucugauuagccucuccuucgggggagcaauaggucuuauguuucugauguugggcugcgccuuacccaucuacaacaaauauuggccucuguucgugcuauuuuucuacauucucucuccaaucccguauuguauugcgagaaggcuggucgacgauaccgacgcuaugucaaaugccugcaaggagcuugcaaucuuucugacaacugggauaguugugagugccuucggauugcccaucguauuugcucgggcacaccucaugggccgccugccuuucuuuagcaaaauggguacggccgaauccgaggggcgagaaacccugacacagcaacucccauuacccgcugccgcgaugcguagacugcuuccugcaucuagggugucgacucagccagucuugcggcuggccgauucagcugagagccuacucggacgccccgcccugugggcacuuggcuuccuguuguguccuccaagucaggcucaguga

SEQ ID NO: 58386 - RNA, 2220 nt, Artificial Sequence
  derived and/or modified sequence opt3 from LETM1__Homo_sapiens__NP_036450
auggccagcauccugcucagauccugcaggggccgggcucccgcacgccuuccuccaccgccccgauacaccgugccucgugggucuccaggagaccccgcccaccugucaugugcgaguacauuggguuuaagaaacugccugaaugucccuuucggcuguugcacuccaauucaucccguuuauacgagcuccaggggagaucaccuaggguguugggcucuccggccugagugccugcgcauagugucuagagccccauggaccucgacaucaguaggcuuuguggcagucgguccgcagugucuucccgugaggggguggcauagcagucggccuguucgcgacgauuccguggucgaaaagucucugaaaagccuuaaggacaaaaacaagaaacucgaggaaggaggcccaguguacucacccccugccgagguaguugugaagaagucccugggccaacgaguccuggaugaacucaaacacuauuaccauggguucagauuacuguggaucgacacuaagauugcugcaaggaugcuuuggcggaucuugaauggacacagucugacccgucgcgagagaaggcaguuucuacggauuugcgccgaucucuuccgacuggugccauuucuuguguucgucguugugcccuuuauggaguuccuguugccgguagcugugaaacucuuuccuaacaugcugcccagcacauucgaaacccagucuuuaaaggaggaacgccugaaaaaggagcucagagucaaguuggagcuggccaaauuuuugcaggacacuaucgaagagauggcgcuaaagaauaaagcagccaaggguuccgcuacaaaagauuucucaguguuuuuccaaaagauaagggaaaccggcgagcggccaagcaacgaagagaucaugcgcuucaguaaacuguuugaggacgaacucacgcuggauaaucuuacuagaccucagcugguugccuuguguaagcuccuggaguuacagucuauugggaccaacaauuuccugagguuucagcuaacaaugcgucuccgguccaucaaggcagacgauaaacugauugcugaagagggaguggacagccuuaacgucaaggaauugcaagccgcgugccgagccagaggcaugagggcacugggugugacugaggaccgccuccgggggcagcugaaacaguggcuugaucugcacuugcaucaggagauccccaccucgcuccugauauuaucuagagcuauguaucugccagacacacuaucccccgccgaucaacucaagucaacccugcagacgcuuccugaaauuguagcuaaagaggcccagguuaagguggcagaagucgagggagaacaaguggacaauaaggccaaauuggaggcuacucugcaggaggaagcggcaauccagcaggagcacagggaaaaggagcuccaaaaacgcagugaggucgccaaggauuucgaaccagagcgagugguugcugccccgcagcggcccggcacagaaccucagccagagaugcccgacaccgugcugcagagcgaaacuuuaaaagauacagcaccuguacuggagggccuuaaggaggaagagauuaccaaggaagagaucgacaucuuguccgaugccuguucuaaacuccaagaacagaagaaaagccugacgaaggagaaagaggaacuagagcugcucaaggaagacguccaggauuacucagaggaccugcaggaaauuaagaaagagcuuaguaagaccggggaggaaaaauauguggaggaauccaaggcuagcaaacguuugacaaagagaguucaacagaugauaggacagaucgacggucugauuucucaguuagagauggaucaacaggccggcaaacucgcaccagcgaacgggaugcccacuggagagaaugugaucucagucgcugaacugauaaacgccaugaagcaagugaagcauauuccggagaguaaacuuaccagccuggcagccgcuuuggacgaaaauaaggauggcaaaguaaacaucgacgaucucgugaagguuaucgagcuggucgacaaagaagaugugcacauuuccacaucucagguggccgagaucgucgcaacucuagagaaggaagagaagguugaagagaaagaaaaggcuaaagagaaggccgagaaagaaguggcggaggugaagucguga

SEQ ID NO: 58387 - RNA, 1122 nt, Artificial Sequence
  derived and/or modified sequence opt3 from LETMD1__Homo_sapiens__NP_001230618
auggcccugagcagagugugcugggcuagguccgcagucuggggcucugccguuacccccgggcacuucgugacacggcgccuccagcuuggacgaucaggucuggcguggggcgcuccucguaguagcaaguugcauuuauccccaaaagccgacguaaagaaccugaugucuuacguggucacuaaaacgaaggcaaucaaugggaaauaucacagauuucuaggaaggcauuucccgcgguuuuacgugcucuauaccauuuucaugaagggccugcaaaugcuuugggccgaugcuaagaaagcacgcagaauaaagacaaacauguggaaacacaauaucaaguuucaucagcugcccuacagggagauggaacacuugcggcagguuugggcccgcggucgauauccugaggugcacggggaguucagacaggacgucacuaaaugucucuuucugggaauuaucucgauuccacccuucgcuaacuaccugguguuucucuuaauguaucuguucccuaggcaacuuuugauccggcauuuuuggaccccaaagcagcagacagauuuccuggacauauaccacgccuuucguaagcagucacaucccgaaaucauuagcuaccuagaaaaaguaaucccucucauuagugaugcgggccugcgcuggagacuuaccgaccugugcacuaagauccaaaggggcacacacccagcaauacacgauauuuuggcccuccgggaguguuucuccaaucauccgcuggggaugaaccaguuacaggcucugcacguuaaagcccucucucgagcaaugcuucugaccagcuauuugcccccuccacuacugcgccauagacucaagacgcacacuaccgugauccaucagcuggacaaagcucuugccaagcugggaauuggucaauugacagcgcaggaggucaaauccgccugcuaccucaggggcuuaaauucaacucacaucggggaagaucggugucgcaccuggcugggagaguggcugcagaucaguugcagccuaaaggaagcagagcucucucugcuuuugcacaacguggugcugcucuccacaaauuaucugggcaccagaagguga

SEQ ID NO: 58388 - RNA, 507 nt, Artificial Sequence
  derived and/or modified sequence opt3 from LEUTX__Homo_sapiens__NP_001137304
augcaccccagccuggccaccaugggcaagcucgcuuccaaacuucagcuggacuugucuguggucaagaucugguucaaaaaccaaagagcaaaguggaaaaggcagcagcggcagcaaaugcagacacgcccuucauuagggccagccaaucagacuacgaguguuaagaaggaggaaaccccgagcgcgauuacaacugcuaacauacgacccguguccccuggaaucucugaugccaaugaccaugaucugcgugagccaucggguauuaaaaaccccggcggggcaucagccagcgcuagaguaaguuccugggacucucagagcuacgauaucgaacaaauuugccuaggagcauccaauccuccaugggccucaacccucuuugagaucgacgaguucgugaagauauaugaucugcccggcgaagacgauacaaguagccuuaaccaguaccuguuuccugucuguuuggaguaugaccagcuccagucuuccguguga

SEQ ID NO: 58389 - RNA, 1140 nt, Artificial Sequence
  derived and/or modified sequence opt3 from LFNG__Homo_sapiens__NP_001035257
augcugaagagaugcggcaggcggcuccuucuggccuuggcuggggcauuacuggccugucuacucgugcugaccgcggaucccccuccaccgccccuuccugcugagcgcggacgacgugcccugaggagcuuggcagguccagccggcgcugcacccgccccugggcucggagcugccgcggcagccccaggcgcucuggucagagacguucacucccugucugaauacuucucacucuuaacacgggcccgcagagacgcaggucccccuccaggggcugccccgaggcccgcggauggacauccucggccacuggccgagccccuugcaccucgcgacguguuuaucgcuguaaaaacuacgaagaaauuccaccgagccagauuggaucugcuacucgaaaccuggauuaguaggcauaaggagaugacauuuauauucacugacggcgaagaugaggcucuggcccggcacaccggcaacguggucaucacaaauugcagcgcagcccauucccgucaggcucuuucuuguaaaauggcgguggaguaugaccgcuuuauugaaucggggagaaagugguucugccacguugaugacgauaacuacgugaaucugagggcauugcuccggcuguuagccucauauccacacacccgagacgucuacgugggaaagcccagccuggaucgcccgauccaggcuauggagagaguaagugaaaacaaaguuaggccugugcauuuuugguucgccacugguggcgcaggguuuuguauuucccggggacucgcccuuaagaugucucccugggcuagcggcggucacuucaugaauacagccgagcgcaucagacugccagacgacugcaccauaggguauaucgucgaggcauugcuaggagugccucugauuagguccggccucuuucauucacaccuggaaaaccuucaacaggugcccacgagugagcugcacgaacaggucacuuugagcuacggcauguucgagaauaaacguaacgcgguucaugugaaggggccauuuucuguagaagcugaucccucccgguuccgaucaauccacugucaucucuauccugacaccccauggugcccgagaacagccauuuucuga

SEQ ID NO: 58390 - RNA, 1014 nt, Artificial Sequence
  derived and/or modified sequence opt3 from LGALS12__Homo_sapiens__NP_001136007
augagccagcccuccggcgggagagccccuggaaccaggaucuacucuuggucaugcccaacagugaugaguccgggugagaagcuggaccccauuccugauagcuucauacuccaaccacccgucuuucacccuguugugccauauguaacuacgaucuucggcgggcuucaugcuggaaaaauggugaugcugcagggcgucgugcccuuggacgcacacucccgguuucagguugauuuccagugugguugcucuuuauguccucgcccagacauugccuuucauuucaacccgcgauuucacaccacaaagccccaugugaucugcaauacucugcacgggggacguuggcaaagagaagcgagguggccucaccuagcucuccggcgcggcucgucauuccugauucuuuuucuguucggcaacgaggaagucaaagugagcguaaaugggcagcauuuucuccacuucagauacaggcucccacugagucauguugauacccugggaaucuuuggugacauacucguggaggccgucggcuucuuaaacaucaaucccuucguggaagggucccgggaguauccugcaggacacccauuucugcuuaugucuccccgcuuggaggugccguguagccacgcccugccucagggccuaucccccggucaggucauuaucguucgagggcucgugcugcaagaaccaaagcauuucacaguaucacuuagagaucaggcugcacacgccccugugacccugagggcuaguuuugccgaccggacuuuggcguggauuagccguuggggacagaaaaagcucaucucugcacccuuccuguuuuacccacagcgcuucuuugaggucuuacuguuguuccaagaaggcggccuuaagcuggccuugaacgggcagggacuaggugcuacauccaugaaucagcaagcccuggagcagcucagagagcugaggauaucaggcagcgugcagcuuuauugcguucauaguuga

SEQ ID NO: 58391 - RNA, 420 nt, Artificial Sequence
  derived and/or modified sequence opt3 from LGALS13__Homo_sapiens__NP_037400
augagcucccugcccgugccuuacaagcucccagucucucuuucaguuggcaguugcgugaucauuaaagggaccccgauacacagcuucaucaacgacccccagcugcaaguagauuuuuauacagacauggaugaggacuccgauauugccuucagauuuagggugcauuucggaaaucacgucgugaugaaccggcgcgaauuugguaucuggauguuggaggaaacuacggacuacguuccuuucgaggauggcaagcaguuugaauuauguauuuaugugcauuacaaugaguaugagaucaaagucaacgggauacgaaucuacggauucgugcaccguauuccacccucuuuuguaaagaugguucaggugucgagagacaucucacugaccagcgucugcguguguaauuga

SEQ ID NO: 58392 - RNA, 420 nt, Artificial Sequence
  derived and/or modified sequence opt3 from LGALS14__Homo_sapiens__NP_064514
augagcucccugcccgugccuuacacccucccagucucucuuccgguuggcucaugcgugaucauuacagggacucccauacugacguucguaaaggacccucaguuggaggugaacuuuuauaccggaauggaugaagacagugauaucgccuuccaauuuagauuacacuucggucauccagcuauuaugaauagcugugucuuuggcaucuggagguacgaggaaaaaugcuauuaccugcccuucgaggacgggaagccuuuugaacuauguauuuaugugcggcacaaagaguacaagguuauggugaacggacagcgcaucuauaauuucgcacaucgauuuccacccgccuccgucaaaaugcuccagguguuccgugauauaucucugacaagaguacuuaucucggacuga

SEQ ID NO: 58393 - RNA, 429 nt, Artificial Sequence
  derived and/or modified sequence opt3 from LGALS16__Homo_sapiens__NP_001177370
augagcuuccugaccgugcccuacaagcucccugucucccuuucuguuggcucaugcgugaucauuaaagggacacugauagacaguagcaucaacgagccacaguugcaaguagauuuuuauacugaaaugaaugaggacuccgaaauugccuuccacuuaagagugcaucugggaaggcgggucgugaugaacucucgcgaguuugguaucuggaugcuagaagagaaucuccacuacguuccguucgaggauggcaagcccuuugaccugcgaauuuaugugugucauaacgaauacgaggucaaagugaauggggaauauaucuacgcuuucguacaccguauaccuccaucguauguuaagaugauccagguguggagagaugucucacuugacagcgugcuggugaacaauggaaggcgguga

SEQ ID NO: 58394 - RNA, 408 nt, Artificial Sequence
  derived and/or modified sequence opt3 from LGALS1__Homo_sapiens__NP_002296
auggccugcggccugguggcuagcaaccucaaucuuaagcccggggagugucugagagucaggggagaaguugcaccugacgccaaauccuucguguugaacuuagguaaggauucuaauaaccugugccuacacuuuaauccacgguucaacgcgcauggcgacgcuaauaccaucguauguaacucaaaagaugggggagccuggggcacagagcagcgcgaagcaguguuuccguuccaacccgguagugucgccgaggugugcauuacuuuugaccaggcuaaucucacgguuaagcugccugauggguacgaguucaaauuuccaaaccgacuuaaucuggaagcaauaaacuauauggccgcugacggagauuucaagaucaaguguguggccuuugacuga

SEQ ID NO: 58395 - RNA, 399 nt, Artificial Sequence
  derived and/or modified sequence opt3 from LGALS2__Homo_sapiens__NP_006489
augaccggcgagcuggaagugaagaacauggacaugaaacccgggagcacacucaagaucacuggauccauugccgaugguacggacggcuucgucauaaaucuugggcagggaaccgauaaacugaacuugcacuuuaauccuagauucucugagucaacaaucguuugcaacaguuuagacggcagcaauuggggucaagaacagagggaggaucaucuguguuuuuccccagggucugaagugaaguucacuguaaccuuugagucggacaaauucaaggugaagcuaccggauggacacgagcucacauuucccaaccggcugggccauucacaccuuagcuaccugaguguccgcggcggguucaauauguccucuuuuaaauugaaggaauga

SEQ ID NO: 58396 - RNA, 1758 nt, Artificial Sequence
  derived and/or modified sequence opt3 from LGALS3BP__Homo_sapiens__NP_005558
augaccccaccuagacuguucuggguguggcuccuugucgccggcacacaggggguuaacgacggagauaugaggcuggcugacgguggcgcaacuaaucaagggcggguggagaucuuuuaccgcggacaguggggcacgguaugcgauaacuugugggacuuaaccgaugccagcguggucugucgagcgcuggguuucgaaaaugcuacacaggcccuagggcgugcagccuuuggacagggcuccggcccaauuaugcucgacgaggugcaaugcacugggaccgaggcuucucuggcagauuguaagucacuuggauggcugaaaaguaacugcagacacgaaagggacgccgguguuguguguacaaaugaaacccggagcacucauacauuggaucucucccgcgagcugucugaggcucugggccagauauucgacucgcagagagggugcgaucucucaaucagcgucaacgugcagggagaagacgccuuaggcuuuuguggucacaccguaauucugacggcgaaucuugaggcacaagccuuguggaaggaaccggggaguaacguuacuauguccguggaugcugagugcguccccauggugagggaccugcuacgguauuucuacucucgccgaaucgacauuacccucagcuccgugaaauguuuucauaagcuggccucagcauauggagcuagacagcuucagggcuacugcgccagucuguucgcgaucuugcucccucaggaucccagcuuucaaaugccccuggacuuauaugccuacgcagucgcuacaggcgaugcccugcucgagaaacuuugucugcaguucuuggcuuggaauuuugaagcccuaacucaggcagaggccuggccuucuguuccaaccgaccugcuccaacugcuucugcccagguccgauuuggcugugccuucagaacucgcgcuguuaaaggcaguagacacauggagcuggggagagcgggccagucacgaagagguggaggggcuggucgaaaagauacguuucccaaugaugcuaccggaggaacucuuugagcugcaguucaaccuuucuuuguauuggucccaugaagcucuguuccagaaaaagacccuccaggcccuggaguuucacacggugcccuuccaacuucuggcacgcuacaaagguuugaaucucacugaggauacauacaagccuagaaucuauaccagcccaacuuggucggccuuuguuacagacucuuccuggucagcuaggaaaagucagcugguguaccagagccggcgaggccccuuagucaaguauuccucugauuacuuccaggccccuagcgacuaucgcuacuauccauaccaaucauuucagacgccccagcacccgaguuuccuguuucaggauaagagaguguccuggagccuaguauaccucccuaccauucaaucuugcuggaacuauggguucucaugcaguagcgacgaacugcccguucuuggauugaccaaauccggcgguucugacaggacaaucgcauacgagaauaaggcgcugaugcucugugaagggcuguuuguggcugaugucacugacuucgagggcuggaaagccgcaauuccaucggccuuagauaccaacagcuccaagucaacaaguucuuuuccuugccccgcuggacauuucaauggcuuucggacugugauccgcccauucuaucugaccaacagcuccggggucgacuga

SEQ ID NO: 58397 - RNA, 603 nt, Artificial Sequence
  derived and/or modified sequence opt3 from LGALS3__Homo_sapiens__NP_001170859
auggccgacaacuucagccugcacgaugcucucuccggcucugggaaucccaacccucagggauggccaggugcauggggcaaucaaccggccggggcgggaggcuaccccggugcuucauauccuggggccuacccaggacaggcacccccuggcgccuauccaggccaggcucccccuggggcauacccaggagccccgggugcuuaucccggcgccccugcgccagggguguaccccggaccuccaaguggccccggugcauauccgagcuccgggcagccuucugccaccggagcuuaccccgccacaggcccauacggcgcuccugcagggccccuuaucgucccauauaaccugcccuugccuggagguguugugccaagaauguuaauuacuauacugggcacgguaaagccgaaugccaacaggaucgcgcuagacuuucaacgggggaaugauguggccuuccauuuuaacccccgcuucaaugagaacaaucgacgugucauugugugcaccuacauguguaaaggauuuauguucacaguuucggaaaacuuuuauauccaccaguacccuucaugcaagagcaguacuuga

SEQ ID NO: 58398 - RNA, 972 nt, Artificial Sequence
  derived and/or modified sequence opt3 from LGALS4__Homo_sapiens__NP_006140
auggccuacgugcccgcuccuggcuaucagccaaccuacaacccgacacugcccuauuaccaaccuaucccagggggacucaaugucgguaugagcguuuauauucagggcguggcauccgagcacaugaagagauucuuuguaaacuucguggucgggcaggaccccggaucugauguggccuuucauuucaauccuagguuugacggcugggauaaaguuguguucaacacucuucagggugggaaguggggaucagaagaacggaaacgcaguaugccauuuaagaaaggcgcggcuuucgaacuggucuuuauaguguuggccgagcacuacaagguaguugugaauggcaaccccuucuaugaauacgggcaucgauuaccucugcaaauggucacgcaccuacagguggacggagaucuccagcugcagagcaucaauuuuauugguggccaaccacuucguccgcaggggcccccuaugaugccacccuacccuggaccaggccauugccaccagcagcugaacuccuugcccaccauggaggguccgccuacauucaaucccccagugccuuauuuugggagacuccaaggaggccugacugcaaggcggaccaucauuaucaagggcuacguucccccaacagggaaaucuuucgccauaaacuucaaggucggaucgucaggugacaucgcucugcacauuaauccccgcaugggcaacgggaccgugguaagaaauagccucuuaaacggaaguuggggcuccgaggagaaaaagaucacucauaauccuuuugguccagggcaguucuuugaucugucuauuagguguggccuugaccgguucaaaguguaugcaaacggacagcacuuguuugauuucgcccaucgccugagcgcuuuucaacgagucgacacacuagagauccagggcgaugugacccucuccuacguucagauauga

SEQ ID NO: 58399 - RNA, 411 nt, Artificial Sequence
  derived and/or modified sequence opt3 from LGALS7B__Homo_sapiens__NP_001035972
augagcaacgugccccacaaguccucucugccugagggcauuagaccagggaccguccucaggauucggggacuuguuccgcccaaugccucacgcuuccaugugaaccuguugugcggugaggaacagggcagugacgcugcauuacacuuuaauccucgacuggauacaagcgaaguaguguucaacuccaaagagcaagggucuuggggacgugaagagagaggcccagguguccccuuucagagggggcagccuuucgaggugcuaauaaucgccucggacgauggauuuaaggcgguugugggcgacgcucaguaccaucacuuccggcaucgccucccacuggccagagucaggcuuguggaaguaggcggggauguucaacuggacucagugcggaucuuuuga

SEQ ID NO: 58400 - RNA, 1080 nt, Artificial Sequence
  derived and/or modified sequence opt3 from LGALS8__Homo_sapiens__NP_006490
augaugcugagccucaacaaucuucagaacaucauuuacaaucccgugauaccuuucgucggcaccaucccagaccaacuggauccggggacauugauuguuaucagaggacacgugcccuccgacgccgauagguuucagguagacuuacagaacgguucuucaaugaagccucgggcugauguggcauuccauuuuaauccacgcuucaaacgagccggcugcauugucuguaacacucugaucaaugagaagugggggcgugaagagauaacguaugacacccccuuuaaaagagaaaagaguuucgagaucgugauuaugguucuaaaagauaaguuucagguggcggucaacggaaagcacacacuccuguacggccauaggaucgguccugagaaaauugacacucuugggaucuauggaaaggugaauauacacagcauuggcuucuccuuuucuucggaucugcaaucaacccaggcuagcaguuuggaacucacagagaucucccgggaaaacguaccaaaaucuggcacuccccagcugccuagcaaucgcgggggagacauuuccaagaucgccccaagaaccguuuacacaaaaucaaaggauaguaccgugaaccauacgcugacuugcaccaagaucccgcccaugaauuaugucagcaaaaggcucccuuucgcagcccgguuaaacacaccaaugggucccggccgcacugugguggucaagggggagguuaaugcuaacgcaaaaucuuuuaacguggaccugcuugccggaaaguccaaagauauugcuuugcaccugaauccucgacuaaacauaaaggccuucguaagaaauucauuucuccaggaaagcuggggcgaggaggaaaggaacaucaccaguuucccauucucucccgguauguacuuugagaugauuaucuauugugacgugcgggaguucaaagucgcggugaaugggguucacucccuggaauacaagcaucguuuuaaggaacuuagcucgauagacacacuggagauuaacggagauauccacuugcucgaggugcgcucuugguga

SEQ ID NO: 58401 - RNA, 972 nt, Artificial Sequence
  derived and/or modified sequence opt3 from LGALS9__Homo_sapiens__NP_002299
auggccuucagcggcucccaggcucccuaccugucuccugcagugccauuuucagggaccauccaaggaggucuccaggacggccuucagauuacagucaacgggacuguucugaguagcuccggaacgagauucgccgugaauuuucagaccggcuucucugguaacgauauagcguuucacuucaauccgagguuugaggacgggggauauguagugugcaacacacggcaaaauggcucguggggccccgaggaacgcaagacucauaugccuuuccagaaagggaugccauuugauuuguguuucuuaguccagucaagcgacuuuaaggugaugguuaacggaauccuguucgugcaguacuuucaccgaguccccuuccaucguguggauaccauuaguguaaaugguuccguucaacuaucuuauaucagcuuccagccuccaggcguguggcccgcuaacccugccccaauuacacagaccgucauccacacugugcaguccgcaccggggcaaauguuuucaacacccgccauaccuccaaugauguacccccauccugcuuauccaaugcccuucaucaccacgauucucggaggccuguacccgaguaaaagcauccuucugucugguacuguguugccuuccgcacagagauuucacauuaaucucugcucagggaaccacaucgccuuccaucugaaucccagguuugacgaaaacgcugucguucggaauacccagauagauaacagcuggggaagugaggaacgcucucugccaagaaagaugccuuucgugaggggccaauccuuuagcguauggauucucugugaggcccacugcuuaaaaguggcggucgacggccagcaucuguucgaguauuaccaccggcuucgcaauuugcccacaaucaaccgacuggaaguugggggagauauucagcuaacucacgugcagaccuga

SEQ ID NO: 58402 - RNA, 519 nt, Artificial Sequence
  derived and/or modified sequence opt3 from LGALSL__Homo_sapiens__NP_054900
auggccggcagcguggcugacuccgaugcagucguuaagcuggacgaugggcaccucaacaauucucuuucaagucccgugcaggccgacguauacuucccuagacugaucgugccauuuugcggacauauuaaagguggcaugaggccggggaagaaagucuuggugaugggaauaguugauuuaaaccccgagagcuucgcgaucucccugaccuguggcgacucugaagauccuccagcugacguggccauugagcuaaaggcagucuuuacagaucggcaacuccugcgcaauucgugcaucucaggugaacgaggggaggaacagagcgccauucccuauuucccuuuuaucccagaccagcccuuccguguggagauacuuugugagcacccuagauuuaggguauucguugauggacaucagcuguuugacuucuaccaccggauccaaacuuugagugcuauugauacgaucaaaauuaacggcgaccuccagaucaccaagcugggcuga

SEQ ID NO: 58403 - RNA, 1674 nt, Artificial Sequence
  derived and/or modified sequence opt3 from LGI1__Homo_sapiens__NP_005088
auggagagcgaaagauccaagaggaugggcaacgccugcaucccccugaaacggauugcuuacuuccucugucuucugucugcauuguuacugaccgaggggaagaaaccugccaagccaaaaugcccggcgguguguacaugcacuaaggacaaugcucuaugugaaaacgcccgcucaauaccccgaacggucccuccagauguuaucagucucagcuuugugcguuccggauucaccgagauuucugaagguucguuucuguucacacccucacuucagcuguugcucuuuacuagcaauaguuucgacguaaucuccgaugacgcauuuauuggccugccucaccuggaguaucucuucaucgagaacaauaacauaaagucuaucagcagacauaccuuuaggggguuaaaaucccugauucaccuuucauuggccaauaacaaucugcaaacacuaccaaaggauaucuucaaaggacucgacagucugaccaacguggaucuucggggcaauagcuuuaacugcgacuguaagcugaaaugguuggucgaauggcucggucauacuaaugcuacaguggaggauauuuacugcgaagggcccccugaguauaagaagcgcaaaaucaacucucuguccucaaaggacuucgauuguauaauuaccgaguuugcaaaaagccaggacuuaccauaccagagucugucuaucgauacguucuccuaucucaaugacgaauacguugugauugcccagccguucacuggaaagugcaucuuucuugagugggaccacgucgagaaaaccuucagaaacuaugauaacaucacaggcacuagcaccgugguauguaagcccauuguuauagaaacacaacuguacgugaucgucgcucaguuguuuggcgggucgcauauuuacaaaagggacucuuucgccaauaaguuuaucaagauacaggauauugaaauccuaaaaauccggaagccuaacgacauugagaccuucaaaaucgagaauaacugguauuuugugguggcggauuccucaaaggcaggauucacgacuauuuacaaauggaaugguaacggcuuuuauagucaccagagccugcacgccugguaccgcgacacagaugucgaauaucucgagauaguucgaaccccacaaacucugagaacaccccaucuuauccuguccucuagcucacagaggccugugauuuaccaguggaauaaggcuacccaguuguucacgaaccaaaccgacaucccaaauauggaagauguauaugccgugaagcacuuuagugucaaaggggacguguacaucugccucacacgguucauuggagauuccaagguuaugaaauggggcgguagcucuuuucaggacauacagcguaugcccucacgcgggaguaugguguuccaaccgcugcagaucaacaauuaccaguaugcaauuuuaggaagcgacuacuccuucacucaggucuauaacugggaugcugagaaggccaaauuugugaaguuccaagaacugaauguacaggcgccuagaucuuuuacccauguuucgaucaacaagaggaauuuccuauuugccagcuccuucaaaggcaacacacagauuuacaagcacgugaucgucgaccucucagcauga

SEQ ID NO: 58404 - RNA, 1638 nt, Artificial Sequence
  derived and/or modified sequence opt3 from LGI2__Homo_sapiens__NP_060646
auggcccugagaaggggcgggugcggagcucucggucuucuguuguuacugcuaggcgcagccugucucaucccccggagcgcucaggugcgccgacuggcgcguugcccugccaccuguuccugcacaaaggagucuauuauaugugucgggucaaguuggguuccaagaaucgugccgggagacauuagcucccuuucucugguaaacggcacuuucucggaaaucaaagauaggauguuuucacacuugcccagccuccaacugcugcucuuaaauaguaacuccuucacgauuauccgggacgaugcauuugccggucuguuccaucuugaguacuuguuuauagaagggaauaagaucgagaccauuucucgcaacgcuuucagaggacugagggaccuaacacaccucagccuggcaaauaaccauaucaaagcccuuccucgggauguguuuuccgaccuggauucauugauugaacucgaccugcgcggcaauaaguucgagugcgauuguaaagcuaagugguuauaucuguggcucaagaugacuaacaguaccgucagcgacgugcuuugcaucggcccacccgaguaccaggagaaaaagcugaaugauguuacaucuuuugacuaugaauguaccacuacagauuucgugguccaccagaccuugccuuaccaguccgugucaguagacacguuuaacagcaaaaaugacguuuauguggccauagcgcaaccaaguauggaaaacugcaugguccuagagugggaucauauugagaugaauuuccgaucuuacgacaacaucacugggcaguccauugugggauguaaggcaauccugaucgaugaccagguguuugucguuguggcccagcucuuugguggcagccacauuuauaaauacgaugaaucguggaccaaguucguaaaguuucaagacauagaggugucuagaaucuccaaacccaaugauauugaacuguuccagaucgacgaugagacauuuuucgucauagcugacucaaguaaggccgggcuuagcacuguguacaaauggaacuccaagggauuuuauucuuaccagagccugcacgaaugguucagggauaccgacgcagaguuuguugacauugauggcaaaucacauuugauccucaguucccggagccaggugccuaucauucugcaauggaacaagucuaguaaaaaguucgucccacacggugacaucccgaauauggaggauguguuagcuguaaagucauuucguaugcagaacacacuguaucuaagccucacccgcuucauuggggacuccagaguuaugagguggaacucuaaacaguuuguggaaauacaagcccugcccucgcggggagcgaugacgcuucagccuuucagcuuuaaggauaaucauuacuuggcccugggcuccgacuauacuuucucacagaucuaccagugggauaaagagaagcaacucuucaaaaaguuuaaggaaauuuauguccaggcaccacgaaguuucacagcugugucuaccgaccgcagagauuucuucuuugccagcuccuucaaaggcaagacuaaaaucuuugagcacaucauugucgaccugucacuuuga

SEQ ID NO: 58405 - RNA, 1614 nt, Artificial Sequence
  derived and/or modified sequence opt3 from LGI4__Homo_sapiens__NP_644813
augggcggggccggaauccugcuccuucuguuggcuggugcaggcguggucguugccuggagacccccuaaggggaaaugcccauuaagguguagcugcuccaaggacucugcgcugugugagggaucaccggaucuacccgugaguuucagcccuacccuccugucccuuucucugguacggacaggcgugacucaguugaaagcugguucguuucuccgcauuccaucacugcaucugcucuuauucacgagcaacaguuuuuccgucauagaagacgaugccuucgcagggcugucucaccuucaauacuuguuuaucgaggacaaugaaauuggaagcaucuccaagaacgcccugcgaggccuacguucacucacccaccugagucuugcuaauaaccaucuggagacauugcccagauuccucuuuaggggccuggauacuuuaacccacguggaccugcgggggaauccuuuccagugcgauugucgcguucucuggcuucugcaguggaugccaacagugaacgcaagcgucggaaccggugccugcgcuggccccgccucuuugucccauaugcagcuacaccaccuggacccuaaaacuuuuaaguguagagcgauugaacucucaugguuccaaacagugggggagagcgcacugaguguagagccauuuucuuaucagggagaaccgcauaucguucuugcccagcccuucgcugggaggugccugauauuguccugggauuacagccuccagcgguuucgcccugaggaggaacugccagccgcaucgguggucucuuguaagcccuuagugcuggguccuucccuauucgugcucgcugcccgacuguggggcggaucacaacuuugggcgagaccaagucccggcuugaggcuggccccgacccagacgcucgcaccucggcgucugcuucgccccaaugacgcugagcuguuguggcucgaaggccagccaugcuucgucguugccgaugcuagcaaagccggguccacuacccuguuauguagagacggaccugguuuuuauccccaccagucucugcaugcauggcacagggauacagacgccgaggcucuagaacucgacggccggccacaucugcuuuuggcgagcgcaucacaacgacccgugcuguuccacuggacugggggacgcuuugagagaaggaccgauaucccugaagccgaggacguauacgcuacacggcacuuccaggccggcggugauguguuucucugccugacccgcuauauuggggacaguauggucaugagaugggauggcuccauguucagguuacugcagcaacuuccaagccguggagcacauguguuucagccguugcucaucgcccgggaccagcuggcuauucuaggcucugauuucgccuuuucacagguucugcgacucgagcccgacaaggggcugcuugaaccuuugcaagagcugggaccacccgcauuaguggcgccuagagcuuucgcccacaucacgauggcagguaggcgcuuucucuucgccgcuugcuuuaaaggcccaacucagauauaccagcaucacgaaauugaucugagugccuga

SEQ ID NO: 58406 - RNA, 1302 nt, Artificial Sequence
  derived and/or modified sequence opt3 from LGMN__Homo_sapiens__NP_005597
augguguggaaggucgccguuuuccugagcguggcucucggcaucggggcaguacccauugacgauccugaggacggagguaaacacuggguggucauaguggccggcuccaacgggugguacaauuauagacaucaggcggaugcuugccacgccuaccaaaucauucauaggaacggaaucccagacgaacagauuguugugaugauguaugaugacaucgcauacucugaggauaauccgacccccggcauagucaucaaccggccuaaugguacagacguguaucaggggguaccaaaggauuacacuggagaagacguuacgccccagaacuuucuugccgugcugcgcggcgaugcugaggcagucaaaggcauugggucaggaaagguguugaaaagugguccucaagaccacguguucaucuauuuuaccgaucauggcagcacagggauuuuagucuucccaaaugaagaccugcacguuaaggaccuaaacgagacuauccacuacauguacaagcauaaaauguaucgaaagaugguguuuuacauagaggccugugaauccggaucuaugaugaaucaccuccccgauaacauuaauguauaugcuaccacagccgcgaacccucgugagucgucauacgcaugcuauuacgacgagaaaagaagcaccuaucugggcgauugguacagugugaauuggauggaagacuccgaugucgaggaccuuacuaaggaaacacugcauaaacaguaccacuuggugaagucucacaccaacacgagccauguuaugcaguaugguaauaagacuaucuccaccaugaaagugaugcaguuccaagggaugaagaggaaagccucaaguccagucccgcugcccccugugacacaccucgaucugacuccaagccccgacguaccucucaccauuaugaagcggaaauuaaugaacacaaacgaucuggaggaaucucgccagcuuaccgaggaaauccagagacauuuggacgcuaggcaccugaucgagaaguccguucggaaaauugugucacuacucgccgcaagcgaggcugaagucgagcagcugcuuagugaacgcgccccacugacgggacauucuuguuaccccgaggcguugcuccacuuucgaacucacugcuucaauuggcauuccccgacauaugaauacgcccugagacacuuauaugugcuggucaaccucugugagaagccuuacccccuucauaggauaaagcugagcauggaucacgugugcuugggccacuauuga

SEQ ID NO: 58407 - RNA, 2856 nt, Artificial Sequence
  derived and/or modified sequence opt3 from LGR4__Homo_sapiens__NP_060960
augcccggcccucuggggcuccuuugcuuccuggccuugggauuacuggguagcgcuggcccauccggggcagccccgccccuaugugcggcuccuugcucuugugacggagauagaaggguggacugcucaggcaagggucucaccgccgucccagaggggcugagugcauuuacacaggcccuugauaucagcaugaacaauauuacucaacugcccgaagacgcuuucaaaaacuuuccuuucuuggaggaacuccagcuggcaggaaaugaucuguccuuuauacacccaaaggcccucucuggcuuaaaagagcugaagguucuuacguugcagaacaaucagcugaaaaccgugcccucggaagcuauccggggccuaucagcccuccaaagccugcgccuugacgcgaaccauauuacaaguguaccugaggauuccuucgaggggcuggugcaguugcgacaccucuggcuggacgauaauucuuuaacugaagucccagugcauccgcugagcaaccuccccacccuucaggcacugacauuggcccuaaauaagaucuccucaauuccugacuuugcuuucaccaaccugaguagccucguugugcugcaccuucauaauaacaagauccguucucugucccagcacuguuuugauggauuggacaaucucgagacucuggauuuaaacuacaauaaccugggugaauuuccacaagccauaaaagcacuacccucacucaaggagcugggcuuucacagcaacaguaucucugucauuccugacggggcuuucgacggaaauccacuuuugagaacaauccaucuguaugauaacccccucuccuuugugggcaauagcgccuuccacaaccugucggaccuucauucucugguaauuaggggugcguccaugguucagcaguucccgaauuugaccgggacggugcaccucgagucacugacuuuaaccggaacaaaaaucaguagcauaccuaacaaucugugccaggaacaaaagaugcuacggacucucgaucuguccuacaacaauauucgcgaccuucccucuuuuaacggcugucacgccuuggaggaaaucagccugcagagaaaucagauuuaucaaaucaaagagggcaccuuccaggggcucaucucacugaggauuuuagaucugagucggaaccuuauacaugaaauccacucccgcgcauuugcuacauugggaccaauuaccaaucucgacgucagcuucaacgagcugacgucuuuuccuacugagggucuaaauggccugaaccagcucaagcugguggggaacuucaaacuuaaggaagccuuggcugccaaggauuuugugaaucugcgaucauuaaguguccccuacgcauaucagugcugugccuucuggggaugcgacagcuacgcuaaccucaauacagaggauaacucccugcaagaccauucuguugcgcaggaaaaaggcaccgcagaugccgcuaaugugacuucgacacuugagaacgaggagcacagccagaucauaauucauuguaccccauccacgggugccuuuaagcccugcgaguaucuguuggggucauggaugaucagacucaccguaugguucaucuuucugguggcacuauucuuuaaucugcucgucauucugacaacuuucgccaguugcaccucucuuccuagcuccaaauuguucaucggccugauuucagugagcaacuuauuuaugggaauauacacaggcauccucacuuuccuggacgcuguuucuugggggagguuugccgaguucggaauuuggugggaaaccgguuccggcuguaagguggcaggguuucuugcggucuucaguagcgaaucugcuaucuuucugcuaaugcucgccacaguggagcggucccugucagcaaaagacaucaugaagaauggaaagaguaaccacuugaaacaguuccguguagccgcucuguuagccuuucucggcgcaaccguugcugguugcuucccacuguuucaccgcggggaauacagcgccucgccgcuuugucugcccuucccuacuggcgagacgccauccuugggauuuacagugacccucguccugcuaaauucucuggcguuccuucucauggccgugauuuauacuaagcuguacugcaacuuggagaaagaagaucugagcgaaaauucacaaaguuccaugauaaagcaugucgcuugguuaaucuucaccaacuguauuuucuucugccccguggcauuuuucucuuuugccccucucaucacagcuauuagcaucuccccagaaauaaugaaaucaguuacccugaucuucuuuccccuuccggccugucugaauccuguguuguauguauucuuuaacccaaaguucaaggaggacuggaaacuccugaagagaagggucacuaaaaagagcggcagugugucuguuuccauuagcucgcaagggggaugccuagagcaggauuuuuacuaugacugugguauguacucacaucugcagggcaaccuuacagugugcgauuguugcgaaucuuuccuccugacgaaacccgucaguugcaagcacuugaucaagucccacagcuguccugcauuagcgguggccucuugccagcggcccgagggguauuggagcgacuguggaacccaguccgcucacucagauuacgccgacgaagaggauaguuucguaagcgacucuuccgaucaggugcaggcaugcggccgagcuuguuuuuaccaaucacgcgguuucccacugguuagauaugccuacaaucucccuagggucaaagacuga

SEQ ID NO: 58408 - RNA, 2652 nt, Artificial Sequence
  derived and/or modified sequence opt3 from LGR5__Homo_sapiens__NP_001264155
auggacaccagcagacugggcgugcuccuuucccugcccgucuuguuacagcuggccacagggggaucuucaccuaggagugguguucuacuccggggcugcccaacucacugucauugcgagccggaugggcgcaugcugcuucgaguggacuguagcgaucugggauuguccgaacuccccucuaaccugucgguauucacgucauaccuggaccucagcaugaauaacaucagucaauuacugccuaauccacuucccuccuugcguuuucuggaggaacuaagacucgcuggcaacgcacugaccuauauuccuaagggugccuucacagggcuuuacucucugaaaguguugaugcuccagaauaaccagcugaggcacgucccaacugaggcguuacagaaucugcggagccuccaaucccuucgccuggaugcuaaccauauaucauaugugcccccuaguugcuuuagcggauugcacucucuaagacaucuguggcucgacgauaaugcccugaccgaaaucccaguucaggcauucaggucccuuucagcccugcaggcuaugacauuggcacucaacaagauucaccacaucccggacuacgccuuuggcaaucugagcaguuuagugguccugcaucuacacaacaaucggauucauucucucggcaaaaaguguuucgaugggcugcacucccuugagaccuuggaccugaacuauaauaaccucgaugaguuucccacugcuauccgcacacugagcaaccuuaaagaacugcacuucuacgacaauccuauacaguuugugggacgaucggccuuccaacauuugccagagcucagaacccugacguuaaacggugcgucucagaucacugaauuucccgaucugaccggcacagcaaaucuagagucccucacucugaccggggcccagauuucaagucuuccucagacaguaugcaaccaauugccaaaucugcagguucucgaccugagcuauaacuuacuggaggaccuucccuccuucucugugugucagaaguugcaaaagaucgaucucaggcacaaugaaauuuacgagaucaaagucgacaccuuucagcagcugcuaagccugcggucacucaaccuggcuuggaauaagauagccauuauccauccgaacgcauucaguacgcuuccuuccuugauuaaacuggauuuaagcucuaaucuccugucaaguuuccccaucacuggacuucacggccugacacauuugaagcucaccgguaaccacgcucugcagagccuaaucuccucugaaaauuuuccagagcugaaagugauugaaaugccuuacgccuaucaaugcugugcguucggggugugcgagaacgccuacaagauaucgaaucaguggaacaagggagacaacagcuccauggaugaccuccacaaaaaggaugcaggcauguuucaggcucaggacgagcgugaucuggaagacuuccuuuuggauuuugaggaagaccugaaagccuuacauucaguccaauguagucccucuccaggccccuucaagccuugcgagcaccuccuggacggguggcuuauccgcauuggaguuuggacuaucgcugugcuggcccuaacaugcaaugcacucguaaccagcacgguguuuagauccccacuguauauaucaccgauuaaauugcugaucggugucaucgccgcugugaacauguuaaccggcguuagcucugcggugcucgcaggggucgaugccuucacauuuggauccuucgcuaggcauggcgccuggugggaaaaugguguggggugucacguaauuggcuuucugaguaucuucgcaagcgagucuuccguuuuucuucugacuuuggccgcucucgagcggggauucucagugaaguacagugccaaauucgaaaccaaggcacccuuuagcucgcugaaggucauuauacuacugugcgcgcuucucgcucugacaauggccgcagugccuuugcugggcggguccaaauauggagccucuccauuaugucucccccugccuuucggugagccaagcacuaugggcuacauggucgcucuuauccuguugaacucacucugcuuucugaugaugaccauugccuauacaaagcuauacuguaaucuggacaaaggggaucuugaaaacaucugggacugcaguauggugaagcacaucgcacuccuguuguucaccaauuguauuuuaaacugccccguugcuuuucuguccuucucuagccucauaaaucugacuuuuaucuccccggaggugauuaaauucauccuucugguagucgugccuuugccagccugucuaaacccccugcucuacauucuguuuaauccucauuucaaggaagaucuuguuucauuacgaaagcagacguauguguggacacgcagcaaacaccccagucugaugucuaucaacuccgacgaugucgagaagcagagcugcgacucgacccaggcgcucgugacuuuuaccucaucuaguauaacauacgauuugccaccuuccagcguacccucuccagccuauccggugaccgagagcugucaucuguccucaguugcuuucgucccuugccucuga

SEQ ID NO: 58409 - RNA, 2904 nt, Artificial Sequence
  derived and/or modified sequence opt3 from LGR6__Homo_sapiens__NP_001017403
augcccagcccuccaggccugagagcccucuggcuuugcgcugcacugugugccuccaggcgggcagggggagcuccgcagcccgguccuggcccaaccgccugccccgcaccuugucacugccaagaggacgggaucauguugucugccgauuguucagaauuaggacugagugcugugccaggcgaccuagauccccucacagcauaccuggaccuuagcaugaacaaucugacugaguugcagccuggucucuuccaucaucugcgcuuucuggaggaacuccgauuauccgggaaccaccugucucacauuccaggacaggccuucucgggccuuuauucauugaagauacugaugcuacagaauaaccaacucggcgggaucccggcugaagcccugugggagcuucccagccugcagaguuugcgucucgaugcgaaucugauuuccuuagucccugagagaucuuuugaaggacugagcucccucaggcaucuuuggcuggacgauaacgcauugacggagaucccaguucgggcccuaaauaaccugcccgcucuccaggccaugacccuggcacuuaaucgcauuucacacaucccugacuacgcuuuccagaaccugacaaguuuggugguacuccaucugcacaauaacagaauacaacacuuagguacucauagcuuugaaggccugcacaaucuagagacccucgaucugaacuauaauaaacuucaggaguucccaguggccaucaggacauuggggcggcugcaggaacucggauuucacaacaacaauauuaaggcgauccccgagaaagccuucaugggcaacccgcugcuucagaccauucauuuuuacgacaauccuauccaauucgucggucgcucugcauuucaguaucugcccaaguugcacacucucucccugaacggggcuauggauauacaggaguucccagacuuaaaaggaacaaccucacuggaaauucuaacgcucacucgagccggcaucagacugcuuccuagcggcaugugccaacaguugcccaggcugcgggugcucgaacugagucauaaucagauugaggaguuaccaucucugcaccguugucagaagcucgaagagaucggguugcaacauaaccgcaucugggaaauuggagcugauaccuuuucccagcucagcucgcugcaggcccuagaccugucuuggaaugcaauaagauccauccaccccgaggccuucucaacacuccacagucugguuaaacuugacuugacugauaaccagcugaccacauuaccucucgcuggucugggcgggcuuaugcaucugaaguugaagggaaaucucgcgcugagccaagcauucuccaaagacucuuuuccaaagcuaaggauucuggaagugccguacgccuaucagugcugucccuacggcaugugcgcuagcuucuuuaaagccucaggucagugggaggcagaggaucuccaccuggacgaugaagagaguuccaagcggccucuuggguugcuggcccgacaggcugaaaaccauuacgaccaagauuuagacgagcuccagcuggaaauggaggauagcaagccacaccccucuguccaguguucaccuaccccaggccccuucaaaccgugcgaguaucuuuuugaaaguuggggaauccgccuggccgugugggcaauaguacuacucagcguucugugcaauggcuuggugcuguuaacggucuucgcugggggaccugugccacuucccccugugaaguuugucguuggugcgauugccggcgcaaacacucugacagggaucuccuguggacuucuggccucuguggacgcuuugaccuucggccaguuuucggaguacggugccagaugggaaacugggcucggcugcagggcaacaggauuccuggcuguacuaggcagcgaggccuccgugcugcuucucacccuggcggccguccaauguucagugaguguuucuugcgugcgggcuuaugggaaaagccccuccuugggaucaguccgcgcgggugugcugggcuguuuagcccucgcugggcuggccgcagcgcuuccacuggccagcguaggagaguacggcgcuucuccuuugugccuccccuaugccccaccggaaggucagccugcagcucugggguuuacgguugcccuagugaugaugaacuccuucuguuuucuggucguggcaggcgccuacaucaaacuuuauugcgaucuccccagaggagacuucgaggcugucugggacugugcgauggugaggcacguugccuggcugauuuucgcagauggcuuguuauacugcccaguggcuuuucugaguuucgccagcaugcucgggcuguuucccguaaccccugaagccgucaagucugugcuucugguuguguugccacuacccgcuugucugaauccucuccuguaccuuuuauucaauccgcauuuucgugacgaucugcggcgacucagaccaagggcaggagacuccggccccuuggccuaugcggcugccggugagcuggaaaagucaaguugcgauagcacacaggcacucgucgccuucucggacguggaucugauccuugaggcuuccgaggcagggcgcccuccaggacuggaaacuuacggcuuucccucuguaaccuugauuagcugccaacagccuggugccccgcggcuagagggcucacacuguguggaacccgaggggaaccauuucggaaacccacagccuaguauggacggcgaacugcucuuaagagcggagggguccacacccgcuggaggcggucugucugggggaggcgguuuucagccaagcggccuugccuucgcaucccacguuuga

SEQ ID NO: 58410 - RNA, 627 nt, Artificial Sequence
  derived and/or modified sequence opt3 from LGSN__Homo_sapiens__NP_001137412
augaacaaugaggaagaccugcuccaggaggauagcaccagagacgaaggcaacgagacagaagccaauuccaugaacacucuuaggcggacgcgcaagaaagugaccaagcccuacgucugcucuacagagguuggggagacugauaugucaaauaguaacgacuguaugcgagauagcucccaaauccugaccccuccacaguugucuucgcguaugaaacacauuagacaggcuauggcaaagaauagguuacaguucgugcgguuugaagccacagaccugcauggaguaucacgcagcaaaaccauaccggcgcacuucuuucaagagaaggugagucauggugucugcaugcccagaggcuaucuagaagugaucccuaacccaaaggauaaugagaugaacaauauuagggcuacuuguuucaacuccgacaucguucucaugcccgagcugucuacauuucgggugcuuccuugggccgaucgcaccgcacgagucauuugcgacacguucacugugaccguaagcgggauguccaucggaagaaaaacauguucagccgcucuguuggaacucaguagcucuaggucccugggcaagaaugguuggcaggauucauga

SEQ ID NO: 58411 - RNA, 426 nt, Artificial Sequence
  derived and/or modified sequence opt3 from LHB__Homo_sapiens__NP_000885
auggagaugcugcagggccuccuucuguuguuacugcuaagcaugggaggggccugggcuuccagagaaccccucaggccuuggugccacccaaucaacgcaauucuggccguggagaaggaagguuguccggucugcauaaccguuaauacaacuaucugugcgggcuacugccccacgaugaugcgggugcuucaagcuguacugccuccauugccccagguggucuguaccuaucgcgacgugcgauucgagucuauucgucucccugggugcccaagaggaguugaucccguggucucauuuccuguggcccugaguuguaggugcggcccaugucggcgcagcacauccgacugcggugggccgaaagaucauccccugacuugugaccacccucagcucucuggauuacuguuccuuuga

SEQ ID NO: 58412 - RNA, 2100 nt, Artificial Sequence
  derived and/or modified sequence opt3 from LHCGR__Homo_sapiens__NP_000224
augaagcagagauucagcgcccugcaacuccuuaaacuguuguuacugcuacagcccccucucccaagggcucugcgggaggcacuuugcccggaacccuguaacugcgugccugacggcgcccugcgcuguccagggcccaccgcgggauugacacgacucucccuggcuuaccugccugucaagguuaucccaucucaggccuuucguggucucaaugaggugauuaaaauagaaaucucacagauugauaguuuagagagaaucgaagcaaacgccuucgacaaucugcuuaacuugagcgagauucugauccaaaauacuaagaaccuaagguauauagagcccggcgcuuuuaucaaucucccucggcugaaauaccuuuccauuugcaacacggggauccgcaaguucccagauguaaccaagguguuuucuucggaaucaaauuucauucuggagaucugugacaacuugcacauaacaacuauuccgggaaaugcauuucagggcaugaacaaugaaagcgucacccucaaacuguaugguaacggguucgaggaggugcagagucaugccuuuaauggaacaaccuuaacuucccuggaacucaaggagaacguucaccuugaaaagaugcauaacggcgcuuucagaggcgccacagggcccaagacccuggauaucucuagcacgaaauugcaggcgcuaccuuccuacggacuggagucaauucaaaggcucaucgcaaccaguagcuauucucugaagaaacuuccaucccgggaaacuuuugugaaucuguuggaggccacacucacuuaccccucacacugcugugcuuuccgcaaccugccuaccaaagagcagaauuuuagccauaguaucucugaaaacuucuccaagcagugcgagagcacaguccgaaaagugaauaacaagaccuuauauucgucuaugcuggccgaauccgagcuaucagguugggacuacgaauacggcuucugucucccaaaaacgcccagaugcgcaccggagccugaugcuuuuaaucccugugaggacauuaugggguaugauuuccugaggguacuuauaugguugaucaacauucuggccaucaugggaaauaugacuguucucuuugugcugcuuacaagucgguacaagcugaccgucccacguuucuugaugugcaaccucagcuuugcggacuucugcaugggccuguauuuacugcuaauagccuccguggauucucagacuaaaggucaauacuauaaucacgcaauugacuggcagacagggagcggauguucaaccgcuggcuuuuucacgguguuugccagugaacucuccgucuacacccugacaguuaucacucuugagcgcuggcacaccaucacauaugcuauucauuuggaucagaagcugagacucaggcacgccauccugauuauguuaggcggguggcuguucagcucucuuauagcaauguugccucucgugggaguaucaaacuacaugaaggugaguaucugcuuucccauggacgucgaaacuacccugagccaaguguacauucuaacaauccugauccucaauguuguggccuucuuuauuauaugugcuugcuauaucaaaauuuacuucgcgguccggaacccagagcugauggcaaccaauaaggacacuaaaaucgccaagaaaauggcuauucuuaucuucacggauuuuacauguauggcccccauauccuucuuugcaaucucugccgcuuucaaggugccuuugauuaccguaacuaacucgaagguucuguuagugcucuuuuauccaaucaacagcugcgccaauccguuccuguacgcaauuuuuaccaaaacauuccagcgagacuuuuuccuucuguuguccaaguuugguuguugcaaacgcagagcggaacucuauaggcggaaggauuucucagcuuacaccaguaacuguaaaaauggcuuuacugggucuaacaagcccagccaguccacacugaagcuaucaacgcugcauugccagggaaccgcccuccuggacaaaacucgcuauacagaguguuga

SEQ ID NO: 58413 - RNA, 603 nt, Artificial Sequence
  derived and/or modified sequence opt3 from LHFP__Homo_sapiens__XP_011533163
auggccagcucccugaccugcacaggcgugaucugggcucuccuuucuuuccugugugcagccacuucaugcgucggguuuuucaugcccuacugguuguggggaagucaguuagguaagccuguuagcuuuggcacguucagaagguguuccuauccagugcacgacgagucucggcaaaugaugguaaugguggaagagugcgggcgcuacgcgucguuucagggcauuccgucagcugaauggcgaauauguaccaucgucacaggacuggguugcgggcuacuccugcuuguggcccugacugcauugaugggauguugcguuagcgaucucauuagucguaccgugggcagagucgccggcgggauccaguuccugggaggucugcucauuggcgcugggugugcauuauauccccugggaugggacuccgaggaagugaggcagacaugcggcuacaccucuggucaauuugaucuugggaaaugugagaucggaugggccuauuacugcacuggcgcuggcgccacagcggcaauguugcugugcaccuggcuagccuguuucagcgggaagaaacagaagcauuauccuuacuga

SEQ ID NO: 58414 - RNA, 732 nt, Artificial Sequence
  derived and/or modified sequence opt3 from LHFPL1__Homo_sapiens__XP_011529245
auggugaccuacugcaucugguguugcgaccccacacacuuaccuauuccagccgagaagccggucacuaugagaagcucccucacgaugguuggcacccuuugggcuuuccugucuuuggugacagcaguaacuucaaguaccagcuauuuucugcccuacuggcuguucgggucccagaugggaaaaccugugucuuuuucgacauucaggcgguguaacuauccaguccgcggugaaggccauucacuaauaaugguggaggaaugcgggcgauacgccagcuuuaaugcgauccccagucucgcuuggcaaauguguaccguugugacuggagccggcugcgcacugcuucuguuggucgcccucgcugcagugcuggguuguugcauggaggaacugauuucccguaugauggggagauguaugggagccgcucaguucguaggcggccucuuaaucucuagcgggugcgcccuguauccucuuggauggaacuccccagagauuaugcagacaugugguaauguuucaaaccaguuucaauuggggaccugcaggcugggcugggcguacuauugcgcaggaggcggugccgcugccgcaaugcuaaucuguacguggcucaguugcuucgcugggcggaaucccaagccugugauacuggucgagagcaucaugcgcaacacuaauucuuacgccauggaacuugaucacugucugaaaccauga

SEQ ID NO: 58415 - RNA, 687 nt, Artificial Sequence
  derived and/or modified sequence opt3 from LHFPL2__Homo_sapiens__NP_005770
augugccacgugaucgucaccuguagaagcaugcuguggacacuccuuuccauuguuguggccuucgcugagcugauagcauuuaugucugccgacugguugaucggcaaggcgaggucacgcgggggaguagaacccgcugguccuggcgggggaaguccagagccguaccaucccacuuuaggcauuuaugcccggugcauccgaaacccuggugugcagcacuuccaacgugauacgcugugugggccauacgcagagagcuuuggagaaauugccuccggcuucuggcaggcuaccgcaaucuuucuagccgucggcauauucauccucugcaugguggcucugguuucuguguuuacaauguguguccagucgauuaugaaaaagucaaucuucaaugugugcgggcuucugcagggaauugccgguuuguuucucauccugggccugauacucuaucccgcgggguggggaugucaaaaagcaauugacuacugcggccauuaugccagcgcuuacaagccuggugauuguaguuuagggugggccuucuauacugcaaucggaggcaccguacugacauuuauuugcgcuguuuucuccgcccaggcggaaaucgccaccucuagcgacaaagugcaggaggagaucgaagagggcaagaaccuuauuuguuugcuguga

SEQ ID NO: 58416 - RNA, 711 nt, Artificial Sequence
  derived and/or modified sequence opt3 from LHFPL3__Homo_sapiens__NP_945351
augcccggcgccgcugcagccgcggcugccgcagccgcugcaaugcugccugcccaggaggcugccaagcucuaccacaccaacuaugugagaaauagcagggcgaucgggguccuuugggcaauuuucacaauaugcuuugccaucguuaacgugguauguuucauucaaccauacuggaucggagacgguguggauacuccgcaggcuggcuauuuugggcuguuccauuacugcauuggaaauggcuuuucccgggaauugacgugucgcgguucuuucaccgacuuuucaacauuacccaguggggccuucaaagcagcuagcuuuuucaucggacuguccaugaugcuaauaaucgccugcauuaucuguuuuacucucuucuuuuucugcaacaccgcgacagucuauaagauuugugccuggaugcagcugaccucugcagcuugccuugugcugggcuguaugaucuucccugauggcugggacucggaugagguuaaacgaaugugcggggaaaagacugacaaauacacauugggagccuguucagugcguugggcuuauauacucgccauuaucgguauucuggaugcacugauccucagcuuuuuagccuucguccugggcaauagacaggacagucuuauggcugaggaauugaaggcggagaacaaggugcugcuaucccaauacucucucgaguga

SEQ ID NO: 58417 - RNA, 744 nt, Artificial Sequence
  derived and/or modified sequence opt3 from LHFPL4__Homo_sapiens__XP_011531995
augcugcccagccaggaggccuccaagcucuaccacgaacauuauaugagaaacucuagggcuaucggcgugcuuugggcaauuuucaccauaugcuuugccaucauuaaugucguuguguucauccaaccuuacuggguaggggacucagugaguacaccaaaaccgggauauuuuggucuguuccacuacugugucggcagcggguuggcgggacgggaguuaacuugccgcggcuccuuuacggauuucucuaccauucccucgucagcuuuuaaggccgcagccuucuuugugcugcuaagcaugguucucauccuggguuguauaacaugcuucagucuguuuuucuuuuguaacacugcuaccguguauaaaaucugcgcauggaugcagcuuuuggccgcucucugucugguccuggggugcaugauuuucccugacggaugggaugccgaaacaauccgagacauguguggcgcgaagaccggcaaauacucccucggggauugcucugugcguugggcauauauuuuagccaucauagguauucugaaugcucuuaucuugagcuuccuggccuuuguacuaggaaacagacagacugaccuccugcaggaggaacuuaagccagagaauaaggauuucguuggcuccacagugucaaguguccugaggcccgggggagacgugagcggcugggguguguugccuuguccagucgcacauucucaagggcccuga

SEQ ID NO: 58418 - RNA, 660 nt, Artificial Sequence
  derived and/or modified sequence opt3 from LHFPL5__Homo_sapiens__NP_872354
auggugaagcugcuccccgcccaggaggcugcaaaaaucuaccacaccaacuaugucagaaauagcagggccguuggcgugaugugggggacacuuacuauuugcuucuccguacuggugauggcguuguuuauacaaccuuacuggaucggagacucugucaacacgccacaggcugguuauuucggcuuauuuucauacuguguggggaauguucugaguagcgaacuaauuugcaagggaggcccgcucgauuucuccucuauccccucgcgggccuuuaaaaccgcaauguucuuuguggcccuggguauguuccuuauuaucgggucaauaaucuguuuuagccuguucuuuauuugcaacacagcuacugucuauaagaucugugcauggaugcaguuggccgcugccaccggacucaugauuggcugccugguguacccugacggcugggauaguuccgagguacgccgaauguguggggaacagacaggaaaauauacccugggucauugcacuauccguugggcguucaugcucgcaauauuaucuauuggcgacgcccugauccuuagcuuuuuggcuuucguucugggguacagacaagauaagcuacucccagacgauuacaaggccgacggaacagaggaaguguga

SEQ ID NO: 58419 - RNA, 633 nt, Artificial Sequence
  derived and/or modified sequence opt3 from LHPP__Homo_sapiens__NP_001161352
auggcccccuggggcaagagacuggcuggggugaggggaguccuccuugacaucagcgguguucuguacgauuccggcgcagggggaggcaccgccauugcggguucuguggaggcuguagcccgguugaaacgcucacgauuaaaggugcguuucugcacaaacgaaagucagaaaagcagagcagagcuggucgggcaacuacagaggcucggauuugacauauccgaacaggaggugacugccccugcuccagcagccugucagauccugaaggaacaaggccuucggccguaucuguugauucacgauggcguucgcucugaguucgaccagaucgauacgucgaaucccaacugcguggucauugcugacgccggggagucauuuagcuaccagaauaugaacaaugcguuccaggugcucauggaacuggagaaaccuguacugaucagucucggaaaggguagauauuacaaggaaaccuccggcuuaaugcuggauguugggccauauaugaaagcacuugaguacgccuguggaauaaaggcugagguggucggcaaacccucuccugaauuuuucaagagcgccuugcaagcaaucgguguggaggcucaucaggcccaguga

SEQ ID NO: 58420 - RNA, 1221 nt, Artificial Sequence
  derived and/or modified sequence opt3 from LHX1__Homo_sapiens__XP_011545112
auggugcacugcgccggcuguaagagacccauccuggacagguuccuccuuaacguccuggaucgggcuuggcacguuaaaugcgugcaguguugcgaguguaagugcaauuugaccgaaaaauguuuuagccgcgaggggaaguuauacugcaaaaacgacuucuuucgauguuucggaacaaagugcgcagguugugcccaaggcauuuccccuucugaucugguacguagagcgaggucaaagguguuucaccuaaauugcuucacuugcaugauguguaacaaacagcucaguacgggggaggagcuguauauaaucgacgaaaauaaguuugucugcaaagaggauuaccuuagcaacuccucuguggcuaaggaaaauucgcugcauucagccaccacaggaagcgacccaaguuuguccccggauucucaggaccccagccaggaugacgcaaaagauuccgaaucagccaacguuagugacaaggaggcuggcagcaaugaaaacgaugaccaaaaucucggugcaaagcggcgcgggccuagaacuaccauuaaagccaagcagcuggagacacugaaagcugccuucgcggcaaccccaaagcccacuaggcacauccgggagcagcucgcccaggaaacaggauuaaacaugcgcgugauucaagucugguuucagaaucgaagaucuaaagagaggcggaugaagcagcuguccgcucuuggcgcccgucgccaugcauucuuuagaucaccuaggcggaugcgaccauugguggaccgccuggaacccggcgagcuaaucccuaacgggccauucagcuuuuauggagauuaccagagugaauauuacgguccgggcgggaauuaugacuucuucccccaaggaccuccaucuucccaggcucagacccccguagaucucccuuuuguuccaagcucgggccccucugguacgccgcuugggggacuggagcacccucugcccggccaccauccauccucagaggcccaaagauucacugacauauuggcgcacccucccggcgauaguccaagccccgaaccuucccucccagggccgcugcauucuaugagcgccgagguguuuggacccucaccuccauucaguuccuuaagcgucaacgguggcgcaucuuacgggaaccaccugucacaucccccugaaaugaaugaggcugccgugugguga

SEQ ID NO: 58421 - RNA, 1221 nt, Artificial Sequence
  derived and/or modified sequence opt3 from LHX2__Homo_sapiens__NP_004780
augcuguuccacagccucuccggccccgaggugcauggggucaucgacgaaauggauagaagggccaagucugaggcuccugcaauuucaagugccauagaccggggagauaccgaaacaacuaugccaagcaucuccucugaccgcgcggcucuuugcgccgguuguggcgggaaaauuucggaucgauacuaucuguuggcaguugacaagcaguggcacaugcguugcuuaaaauguugcgaguguaagcugaaccuagaaucagagcucacgugcuuuagcaaagauggaaguaucuacuguaaggaggacuauuacagaagguucuccgugcaacggugcgcccgcugucaucugggcauuucugcuagcgaaaugguaaugagagcaagggaucuuguguaucaccugaauugcuuuaccuguacaacuugcaacaagauguugaccacaggugaccauuucgggaugaaagauucccucgucuacugccggcugcacuuugaggcccugcuccagggagaauauccggcucacuucaaucaugccgacguggcggcagccgcugccgcagcugccgcggccaagucagcaggcuuaggcgcugccggggcuaacccccugggacuuccuuacuacaaugguguuggcaccgugcagaaagggcgcccacgaaagagaaaaagucccggaccuggcgccgauuuggcagccuauaacgcugcgcugagcuguaaugagaacgacgcagagcaccuagacagggaucagccauaccccucuucccaaaagacuaagcggaugcguacaucauuuaaacaucaccagcuccgcaccaugaaaagcuauuucgccaucaaucacaacccugacgcuaaggaucugaagcagcuugcccagaaaacgggucugacuaagagagucuugcaagugugguuucagaaugcaagggccaaauuccggcgaaaccuccugcgccaggaaaauaccgggguagacaagaguacagaugcugccuuacagacuggaaccccaucuggcccggcauccgagcugagcaacgcgucgcucucucccuccucaacaccuaccacgcuuacugaccugacaaguccaaccuugcccacuguuacaagcgugcuaaccuccgucccuggcaaucuggaagggcaugagccacacucucccagccaaacgacccucacaaaccuguuuuga

SEQ ID NO: 58422 - RNA, 1209 nt, Artificial Sequence
  derived and/or modified sequence opt3 from LHX3__Homo_sapiens__NP_055379
auggaggccagaggcgaacuggggcccgcuagggagagcgcaggaggugaccuccuucuggccuuguuagcgcggcgcgcugaucugcgacgugaaaucccucuaugcgccggcugugaccagcacauucucgauagauucauacugaaggcacuugacaggcauuggcacuccaaaugccugaaguguucugauugccauaccccauuggccgagcgguguuuuucacgcggggaaaguguguacugcaaagacgauuucuuuaagagauucggaacaaaaugugcugcaugccaacucggcaucccgcccacucaggucguuaggcgggcccaggacuuuguguaucaccuacauuguuucgcuugcguaguguguaagcgccagcuggccacgggugaugaguuuuaccucauggaggacagccgauuagucugcaaggcggauuaugaaaccgcaaaacaaagagaggccgaagcuacagccaagaggccucggacuaccauuacagcaaaacagcuggagacccuuaaguccgcuuacaacacuucuccaaaacccgcccgucacgugcgcgagcaguugucgucagaaacagggcuggacaugagaguugugcaggucugguuccaaaauaggcgggcgaaggagaagcgacugaaaaaggaugccggacgccagagauggggccaguauuuuaggaacaugaaacggagccgcggcgggaguaaguccgacaaagacucugugcaggaaggacaagauagcgacgcagagguauccuucccugaugaaccaucacucgcugagaugggucccgccaauggccuguacgggagucuuggagagccuacccaggcucugggcagaccaagcggugccuuggggaacuuuucucucgaacacggaggccuggcaggcccggagcaguauagggaauuacgucccggguccccuuacggaguuccacccucacccgccgcuccacaaagccugcccgguccgcagccucuccuuaguucucugguguaccccgacacguccuugggccuagucccaagcggggcgccuggaggcccuccacccaugcgggugcuggcagguaaugggccuucgucugaucucuccacuggcucaaguggaggcuauccagacuucccggccagccccgcuuccuggcuggaugagguggaccaugcccaguuuuga

SEQ ID NO: 58423 - RNA, 1173 nt, Artificial Sequence
  derived and/or modified sequence opt3 from LHX4__Homo_sapiens__NP_203129
augaugcagagcgccaccgugcccgcugagggcgcagucaaggggcugccugaaaugcucggaguuccaaugcaacagaucccgcagugcgccgguuguaaccagcacauucuugacaaauucauacugaagguguuggauagacauuggcacuccucuugcuuaaaaugugcggacugccaaaugcagcuggcugauagguguuuuucacgggccggcaguguauacugcaaggaggacuucuuuaaacgcuucgggacaaaguguacugcaugccagcagggaaucccucccacgcaagugguccgaaaggcccaggauuuuguguaucaucuacacuguuucgcuugcauuaucuguaaucgucagcucgcaaccggcgacgaauuuuaccugauggaggaugguagacuuguuugcaaagaagacuaugagacagccaagcagaacgaugacagcgaggcuggggccaaaaggccacggacuaccauuacagcgaagcaacuggaaaccuugaaaaaugcauacaagaacucccccaagccugcccgccaugugagagagcagcucucuucggaaacuggacuggauaugagggucgugcagguaugguuccaaaaucggcgcgcuaaagagaagcgacugaaaaaggacgccggcagacacagguggggccaguuuuauaaaucaguuaagcggagccgugggaguuccaaacaggagaaggaaucuagcgcagaggauugcggaguguccgacucagaacucaguuuccgcgaggaccagaucuuaagcgaacugggucacacaaacagaauauacggcaaugucggggaugugaccggaggccaacuuaugaacgguucuuuuuccauggacgggacgggacagucauaucaggauuugagggacggcagcccauacggcaucccccagaguccuucuuccauuagcucgcugccaucucaugcuccgcuacucaaugggcuggauuacacuguggacuccaaccuuggaaucauugcccacgcgggucaaggcgucucacagacccugcgggccauggcagggggacccacaagugauaucagcacuggcuccucuguugguuauccugacuucccaaccagccccgggucaugguuggaugagauggaccauccuccauuuuga

SEQ ID NO: 58424 - RNA, 1209 nt, Artificial Sequence
  derived and/or modified sequence opt3 from LHX5__Homo_sapiens__NP_071758
augauggugcacugcgccggcugugagagacccauccuggacagguuccuccuuaacguccuggaucgggcuuggcauauuaagugcguucaguguugcgaauguaaaaccaauuugagcgagaagugcuuuucccgcgaagggaaauuauacuguaagaacgacuucuuucgacguuucggaacaaaaugcgcagguugugcccaaggcauaucuccuucagaucuggugagaaaggcgaggaguaagguauuucaccuaaauugcuucacuuguauggugugcaacaaacagcucagcacgggggaggaacuguaugucaucgacgagaauaaguuugugugcaaagaugacuaccuuuccucuucgucacugaaggagggcagcuugaacaguguuuccucuuguaccgaucggagccucuccccagaccugcaggaugcucugcaggacgauccgaaagaaacagacaauucaacuagcagcgauaaggagaccgccaacaaugaaaacgaggagcaaaauucuggaacaaagcgcagaggucccaggaccacuauuaaagcaaagcagcucgaaacauuaaaagccgcuuucgcagccaccccuaagccaacgcggcauauccgcgagcagcuggcucaggaaacugggcuuaacaugcgagugauucaagucugguuucagaauagaagguccaaagagcggcguaugaagcaguugucagcccugggagcgcgcagacacgcauucuuuaggagcccccggcgaaugcgcccucuaggcggcagacucgacgaaagugagaugcuggggucuaccccauauacauacuauggagacuaccagggugauuauuacgcccccggcuccaacuacgacuucuuugcucaugggccuccaagccaagcccagucgccggcagauucuuccuuccuugcugccucaggacccggcaguacuccucugggugcguuggagccaccccucgccgggccucacgcagcugacaauccaagguucaccgauaugaucagccaccccgacacaccguccccugaacccggacugccaggcaccuuacauccuaugcccggcgagguguuuucugggggaccaagucccccuuucccaaugucagguacgaguggcuauuccgggccgcugagccaccccaacccugaacucaacgaggccgcuguaugguga

SEQ ID NO: 58425 - RNA, 1101 nt, Artificial Sequence
  derived and/or modified sequence opt3 from LHX6__Homo_sapiens__NP_001229262
augagaaggggccugugccggcgcagcgccgagaaccccgacgccgggccugugauggcacagccaggauccgguuguaaggccaccacacgaugccucgaaggcacugcgccgcccgcuauggcccaaucugaugcagaggcccuugcuggggcacuggacaaagaugaaggacaggccucaccuuguacgccaaguacccccagcgucugcuccccuccaucugcugccucgucaguucccagcgcgggcaagaauaucuguaguuccugcgguuuggagauuuuagaccguuaccugcuaaaagugaacaaucucauauggcacguaagaugucuggaaugcucuguguguaggacaagccuucggcagcagaacuccugcuauaucaagaauaaagagauuuucuguaagauggauuacuuuucacgcuucgggacuaagugcgcaagaugcggaaggcaaaucuaugccagugacuggguccggcgcgcucgaggcaacgccuaccaucuggcauguuuugcuugcuucagcuguaaaagacaguugucuaccggcgaggaauuugggcucguggaggaaaagguucugugcaggauucacuaugauacaaugaucgagaaucugaaacgggccgcggagaacggaaauggucucaccuuagaaggcgccgugccuuccgagcaggacucacagccaaagccggcaaaacgugcucgcacuagcuucacagccgaacaacugcaggucaugcaggcucaguuugcccaagauaacaaucccgacgcacagacccuucagaaguuggccgauaugacggggcugaguagaagggugauacaaguaugguuccagaacugucgggcucgacauaagaaacacacuccucagcauccaguucccccuucuggagcgccacccucccgccuaccgagcgcacucucggacgauauccacuacaccccuuuuucuucccccgagagagccaggauggugacacugcacggcuauauugaaucacauccauucaguguccuuacucugccugcuuugccccaccucccagugggugcuccccagcugccuuuaagccgguga

SEQ ID NO: 58426 - RNA, 1167 nt, Artificial Sequence
  derived and/or modified sequence opt3 from LHX9__Homo_sapiens__NP_001014434
augcugaacggcaccacacucgaggccgcuaugcuuuuccacgggaucagcggaggucauauucagggcauaauggaagagauggaaagaagguccaagacugaggcacggcuggccaaaggggcgcaauugaauggacgcgacgcuggcaugcccccuuuaucuccagaaaagccggcccugugcgcagguugugggggaaaaaucucagaucgauacuaucuacucgccguggacaagcaguggcaucugcguugccuuaaauguugcgaguguaagcuggcuuuggagagugaacucacgugcuuugcaaaggauggcagcauuuacuguaaagaggacuauuacagaagguucuccguccagcggugcgcccgcugucaccugggcaucucugcuucggaaaugguuaugagagccagggauucaguguaucaccugagcugcuuuaccuguaguacaugcaacaagacucucaccacaggggaccauuucggaaugaaagauuccuuaguauacugccgggcgcacuuugagacccugcuucagggugaguaucccccucaauugucuuacacugaacuggcagccaagagcggcgggcuagcucucccauacuucaauggaacaggcaccgugcagaaaggucgcccccgaaagagaaaguccccugcccugggggucgacauugugaacuauaauucaggauguaacgagaaugaagcagaucaccuugacagggaucagcagccauaucccccuagucagaaaacgaagcggaugcguacuagcuuuaaacaucaccaacugcgcaccaugaagucuuacuucgcuaucaaccauaauccagacgccaaagauuugaagcagcucgcgcagaaaacaggccugacuaagagaguuuuacaagugugguuucagaacgccagggcaaaguuccggcgaaaucugcuccgccaggagaacggcggggucgacaaagcugacggaaccucccuuccggcucccccuucagccgauagcggugcccugacaccacccggcaccgcaacgacuuugacagaccuaaccaauccuacuauaacagugguaaccaguguuacgucuaacauggauucccacgaaagcgggucgccaucucaaaccacacugacuaaucucuuuuga

SEQ ID NO: 58427 - RNA, 1119 nt, Artificial Sequence
  derived and/or modified sequence opt3 from LIAS__Homo_sapiens__NP_006850
augagccugagaugcggcgacgccgcuaggacccucgggccccggguguucggacgcuacuuuuguuccccuguccgaccacuuucuucacugccggauaagaaaaaggaauuguuacagaacggucccgaccugcaagauuucguuaguggcgaccuagcagaucguagcacaugggacgaauauaaagggaaucucaagagacagaaaggagagaggcugcggcuuccuccauggcugaagacugaaauccccaugggcaagaacuacaauaaauugaagaacacgcuccgcaaucugaaccugcacaccgugugcgaggaagccagauguccuaauauuggugagugcuggggagggggcgaguaugcgacagcuacugccaccauaaugcucaugggcgauacauguaccagggggugccgguuuuguuccguaaaaacugcacgcaacccacccccuuuagacgccucugaaccauacaauacagcuaaggcaaucgccgaguggggacuggauuaugugguccuuaccucgguggaccgagaugacaugccggaugguggcgcugaacauauugccaaaacgguuucauacuugaaggagagaaaccccaagauccugguggagugccuaacuccugacuucaggggagaccucaaagcgauugaaaaggucgcacugagcgggcuugauguguaugcccacaauguagagaccguuccagaacugcagaguaaagugcgggacccccgugcuaacuuugaucaguccuugcgcguccucaagcaugccaaaaaggugcaaccugacgugaucucuaaaacaagcauaaugcugggcuuaggugagaaugaugaacaggucuacgcaacuaugaaggcucugagagaggccgacguugauugucucacccuugggcaguacaugcagccaacaaggcggcaccugaagguggaggaauauaucacccccgagaaauucaaguacugggaaaaaguaggaaacgaguugggcuuucauuauacggcguccggcccgcuagugcgaucaaguuacaaggccggggaguucuuucugaaaaaucucgucgcaaagcgcaagacuaaagaccuguga

SEQ ID NO: 58428 - RNA, 609 nt, Artificial Sequence
  derived and/or modified sequence opt3 from LIF__Homo_sapiens__XP_011528474
augaaggugcuggccgcuggcgucguuccccuccuucugguguugcacuggaaacauggggcaggaagcccuuuaccaaucaccccgguaaacgccacaugcgcgauuagacaccccugucauaauaaccugaugaaucagauaaggucccaacuagcucagcucaacgguucugccaaugcacuguucauccuuuacuauacugcccagggcgagccuuuuccaaacaaucuggacaaguugugcgggcccaacgugacggauuucccuccauuucacgcuaauggaaccgaaaaagcaaagcucgucgagcuguaccggauugugguuuaucugggcacaucacucgguaacaucacucgcgaccagaaaauuuuaaaucccagugcccugagccuucauuccaaguugaacgcuaccgccgauauccugcgagggcuacucucuaaugugcugugucgucuuugcucgaaguaccacgucggacacguggacguaacauauggcccugauaccucaggcaaagacguuuuccaaaagaaaaagcuggggugucaguugcucggaaaauacaagcagauaaucgcggugcuggcacaggccuuuuga

SEQ ID NO: 58429 - RNA, 3294 nt, Artificial Sequence
  derived and/or modified sequence opt3 from LIFR__Homo_sapiens__XP_011512344
augauggacaucuacgugugccugaagagacccagcuggauggucgauaacaaaaggaugcggaccgccuccaauuuccaguggcuccuuucuacauuuauucuguuguauuuaaugaaccaaguuaauucacagaagaaaggcgcuccucacgaccugaagugugugacuaacaaucuacagguauggaacugcaguuggaaagcaccaagcgggacgggacgcgguaccgauuacgagguguguauagaaaaucgaucccguucuugcuaucagcucgagaagacaucgaucaagauuccggcccugucacauggcgacuacgaaaucacuauuaacagccuucacgauuucgggaguuccaccucuaaauuuacacugaaugagcaaaacgucagcuugauccccgacaccccugaaauacucaaucuguccgcggauuucucaacaaguacucuguaucucaaguggaacgacagaggaagcguguuuccacauaggucuaauguuaucugggagauuaaaguguuacggaaggaguccauggaacuggucaaacuugugacccacaacacgacuuugaauggcaaggauacccugcaucacuggucaugggcuagcgacaugccccuagagugugccauccacuucguagaaauucgcugcuacaucgauaaccuccauuuuaguggucuggaggaguggucugacugguccccuguuaagaacauaagcuggauuccagauucgcagacaaaaguguucccccaggacaaggucauccuuguggggucugacauuacuuuuuguugcgugucccaggaaaaaguccugucagcauugaucggacacaccaauuguccucucauccaucuggauggcgagaacguugccauuaagauaagaaauaucagugugagcgcuuccucuggcacaaacguaguguucaccacggaagacaauauuuuugggacugucaucuucgcaggauauccaccggauacaccccaacaguuaaacugcgagacccacgaccugaaagaaauaauuuguagcuggaauccugguagggugacugcccucguuggcccacgggcuacaucauacacccuuguggagaguuuuuccgggaaguacguccgccugaaacgagccgaggcgcccacgaacgaaagcuaucaguugcuauuccagaugcugccuaaucaagagaucuacaacuucacccucaaugcacacaacccacugggaagaucucagucaacaauccuugugaauauuacugaaaagguauauccccauaccccgacaaguuuuaagguuaaagauaucaacagcacugccgugaagcuguccuggcacuugccuggcaauuucgcuaaaauuaacuuucucugcgagauagaaaucaagaaaucuaacucgguccaggagcaaaggaaugugaccauuaagggugucgagaacagcuccuaccugguggccuuagacaagcugaaucccuauacacuauacaccuuccggauccguugcucaacugaaacguuuuggaaauggaguaaguggucuaacaaaaagcagcaucucacaaccgaggcaagcccauccaaagggccugauacuuggcgcgaauggucaagcgacggaaagaaucugaucauuuauuggaagccccuuccaauaaacgaggcuaauggcaaaaucuugucuuacaacguuuccuguaguagcgaugaagagacccagucucuguccgagauucccgacccucagcacaaggccgaaaucagacucgauaaaaaugacuacauuaucucagugguagcgaagaacagugucggcagcucgccaccguccaaaauagccucuauggagauccccaaugacgaucugaagauugaacaagugguugggaugggaaaggguauccuucugacauggcauuaugacccuaacaugaccugcgauuacgugauuaaaugguguaauagcucaaggagugagccaugcuugauggacuggcggaagguccccuccaacucuacugagacagugaucgaaagcgaugaguuccgaccuggcauacgcuauaacuuuuuccucuacggguguagaaaucagggauaucagcuguuaagguccaugauuggcuacaucgaagaacuggcaccaauuguagcucccaacuuuacgguggaagacaccucagccgauagcauccuaguuaaaugggaggacauaccggucgaggaacuccgggguuuccugcgcggguauuuguuuuacuucggcaagggagagagagauacaaguaaaaugagggugcuugaaucuggccguuccgacaucaaggugaaaaauauuacugauaucagccagaagacccugcggauugcugaccuccaagggaagacaucguaccaccuggucuuacgagccuauacugauggagguguuggcccugagaaaucaauguacguggugaccaaggaaaacucuguagggcugaucauagcaauucuuaucccagucgccguggcuguuaucgugggagucgugacgaguauuuugugcuauagaaaaagggaguggaucaaggagaccuuuuaccccgacauuccuaaucccgaaaacuguaaagcgcuccaguuccagaaguccguuugcgagggcagcucugcacugaagacacuagaaaugaauccauguacuccuaacaauguggagguacuggaaacccgcagcgccuuccccaaaauagaggacacagagaucauuuccccagucgcugaacggccggaggauagaucagacgccgaaccugagaaccacgugguggucaguuauugucccccaaucauugaggaagagauccccaauccugcagccgaugaagcuggugggacugcccagguuauauacaucgacgugcaaagcauguaucagccacaggcaaagcccgaggaggagcaggagaacgauccuguaggcggagcgggcuacaaaccgcaaaugcaucucccaauuaauucuaccguggaagacaucgcugccgaggaagaucuggacaagacggcaggguacaggccccaggccaacgucaauacauggaaccuuguguccccugauucaccacgcaguauugacagcaauuccgagaucguuucuuuuggaucgcccugcagcauaaacucacgacaguucuugauuccuccgaaagaugaagacucccccaagaguaacgguggcggguggucuuuuaccaauuucuuucaaaacaagccaaaugauuga

SEQ ID NO: 58430 - RNA, 2667 nt, Artificial Sequence
  derived and/or modified sequence opt3 from LIG1__Homo_sapiens__NP_001275992
augcagagaagcaucauggccgcucugaaggaguggaacggcguggucuccgaaucugacucacccguuaaaaggccugggcggaaggcagcccgcgugcucggaagugagggugaagaggaagaugaggcgcuuagcccagcuaaaggccaaaagccggcccuggacugcucccagguaucucccccucgaccagcaaccucgcccgagaauaacgccucauugagcgauacaaguccuauggacuccucuccaagcgggauucccaaacguagaacugcuaggaagcaguuaccuaagcggacgauacaggaagugcuggaggaacaauccgaggaugaggaccgcgaagcaaaaagaaagaaagaggaagaggaagagaccccaaaggagucacuaacagaagccgaggucgcuacugaaaaagagggagaagauggcgaccagccgaccacacccccuaagccacucaagaccaguaaagccgagacucccacagagagcgugucugaaccugagguugcgaccaagcaggaacugcaggaggaagaggagcaaacgaaaccacccaggcgggcaccgaagacucuuuccucauucuuuaccccucgcaaacccgccgugaagaaagaagucaaggaggaagaaccaggugcuccugggaaggagggagccgcagaaggcccccuggauccaagcggcuacaaucccgcuaaaaacaauuaucacccuguggaggacgccuguuggaagccagggcagaaaguaccguacuuggcgguugcccgaacauucgaaaagaucgaggaagugagugcaagacucaggauggucgagacucugucuaaccugcuccgguccgugguggcuuuaucgcccccugaucugcuuccagucuuguaucugagccuaaaucaucucggacccccucagcagggucuggagcuuggcguuggggacggagugcuguugaaagccguagcucaagccaccggccgucagcucgaaucugugcgcgcagaggccgcugaaaagggugaugucgggcugguggcggagaacuccagaucaacacagagguuaaugcugccacccccgccucucaccgcaaguggaguuuuuagcaaguuccgggacauugcccgacuuacgggcuccgcuucuacugccaaaaagaucgacauuaucaaaggccuguuuguggcaugccgccacagcgaagccagauucauagcuaggucauugagugggcggcuacgccugggacucgccgagcaauccguccuggcagcgcuuagccaggcugugucucugacaccacccggucaggaguuuccucccgccaugguagaugcaggcaaggggaaaaccgccgaagcuagaaagacuugguuggaggaacagggaaugauccucaagcaaacauucugugagguuccagaccuggauaggauuaucccuguguuacuggaacauggccuagagcgucuccccgagcacugcaaacugucaccagguauuccgcuuaagccuauguuggcccaucccacccgggggaucagugaaguccugaaacgauuugaggaagcagcuuucacgugugaguacaaguaugacggccagagagcccagauacacgcgcucgagggaggcgaagugaaaauuuuuagcaggaaucaggaggauaacaccgggaaguacccagacaucauuucccgcauccccaagaucaaacugccuucugucacaucguucauucuugauacugaagccguggcuugggaccgggagaagaaacaaauacagccauuucagguucugaccacaagaaagaggaaagaaguggaugcaagcgagauccagguacaagucugcuuguaugccuucgaccucauuuaccugaauggagaguccuuagugcgcgaaccccugucacgacggcgucagcuacucagagagaacuucguugaaacugagggugaauuuguguucgcuaccagucuggauacaaaggacaucgagcagauagccgaguuucuugaacagucugucaaagacagcugugagggcuugauggugaagacccuggauguagacgcaacuuacgaaauugcgaagaggucccacaauuggcucaaacugaagaaagauuauuuagacggggugggagauacgcuggaccuuguugucaucggcgccuacuugggucgcgggaagcgggcuggcagauauggaggcuuccuccuggccucauacgaugaggacagcgaggagcuacaagcaaucugcaaacuggggacaggauuuucugaugaggaacucgaggaacaucaccagucccugaaggcucuuguguugccuaguccgaggccauaugugcgaauugacggugccgucauccccgaucauuggcuggacccuagcgcaguuugggaggugaagugugccgauuuaucucucuccccaauuuaccccgcugcgcgcggccugguggacucagacaaagggauaagucuucgguucccuagauuuaucaggguacgugaggauaagcagccggaacaagccaccacuagcgcacaggucgcuugccuguaucgcaaacagucgcagauucaaaaccagcagggagaggacuccggcucugaucccgaagacaccuacuga

SEQ ID NO: 58431 - RNA, 3057 nt, Artificial Sequence
  derived and/or modified sequence opt3 from LIG3__Homo_sapiens__XP_005258027
augagcaaguucagaggccugagguacaugucccucgccuuuaaaaucuucuuuccccagacccuucgggcucugucucgcaaggaguugugcuuauuccgaaaacaccauuggcgugacgugagacaauuuucacaguggagugaaacagaucugcuacacgggcauccucucuuccugaggcggaagccaguccuuagcuuucagggaucccaucugcgcucuagagcaacuuauuugguuuuccucccgggucugcacgugggccuguguucggggcccugcgagauggccgaacagagguuuuguguagacuacgcgaaacggggaacggcuggcugcaagaaguguaaagagaagauugugaaaggugucugccgcauagggaaggugguuccuaacccauucucagaaagcggaggcgauaugaaagagugguaucacaucaaguguauguuugagaagcucgaacgagccagagcaaccacaaagaagauugaggacuuaacugaacuggagggcugggaggaacuugaggauaaugaaaaagagcaaaucacccagcacauugccgacuugaguuccaaggcugcagggacacccaaaaagaaagccgugguccaggcuaagcugaccacuacaggacaggugaccucuccuguaaagggugccagcuucguuacguccacuaacccaaggaaauuuucaggcuucagugcgaagcccaauaacagcggggaagcaccuucuuccccaaccccgaaacggucacuaagcaguucuaagugcgauccccgucauaaagacugucuccugcgcgaguucagaaaacuuugcgccaugguggcugauaauccuuccuacaacacaaagacucaaaucauacaggacuuucugaggaaaggaagcgccggcgaugguuuccacggggacgucuauuugaccgugaagcuccuguuaccaggagugaucaaaacagucuacaaucugaacgauaagcagauuguuaaacucuuuucgcggaucuucaauuguaaccccgacgacauggcacgagaucuugagcagggcgacgugucugaaaccauucgcguauuuuucgagcaauccaagucauuuccuccagcugccaagagucuguugacgauccaggaaguggaugaguuccuacugagacucagcaaacugacuaaggaagacgagcagcaacaggcgcuucaggauauagccuccaggugcacagcaaaugaccugaaaugcauuauccgguugauuaagcaugaucucaaaaugaacucuggcgcuaagcacguccuggacgccuuagaucccaaugcuuaugaggccuuuaaggcaagccgcaaccugcaggacgugguugaaagagugcuacacaaugcccaagaggucgaaaaagagccggggcagaggcgugcucucucagugcaggcgagucugaugaccccuguacagcccaugcuugcagaagccuguaaguccguugaguacgcuaugaaaaagugcccaaacggaauguucagcgagaucaaauacgauggugaacgggugcaaguccauaagaacggcgaccacuuuucuuauuucucacgaaguuugaaaccugugcugccccauaaggucgcccacuuuaaggacuacaucccacaggcauuccccgggggacauagcaugauucucgauuccgaggugcugcuuauagacaauaaaacuggcaagccucugccauucgguacauuggggguucacaaaaaggccgcuuuucaggaugccaacgugugucucuucguauuugacugcaucuauuucaaugaugucucucugauggacagaccguuaugugaaaggcgcaaauuucugcacgauaacaugguggagauucccaaucggaucauguucucggagaugaagagaguuaccaaggcacuagaccucgcggauaugauaacgagggugauucaggaaggccuggagggacuugucuugaaagacgugaagggcaccuacgaaccugggaaacgccauuggcugaaggugaaaaaggauuaucucaacgagggagcuauggccgacacagcagaucugguaguuuuaggugccuuuuacggccaagggagcaagggaggcaugauguccaucuuccugauggguugcuaugacccagggucacagaaaugguguacugucaccaagugcgcuggcggacacgacgaugccacacuugcacgauugcagaaugaacucgacauggugaaaaucaguaaggaucccucuaaaauuccuagcuggcugaaggugaacaagaucuacuacccagacuuuauuguccccgauccgaaaaaggcugccguuugggagauaacuggcgcggaguucuccaaaucagaagcccauaccgcugacgggaucagcauucgguuuccucguuguacaagaaucagggaugacaaggauuggaaaucugcaaccaaucuaccacagcugaaggagcucuaucaacuguccaaagaaaaggccgacuucacugugguggcuggagaugaggguaguagcacgacaggcgggucuuccgaagagaacaagggacccucaggcagugccguaagccgcaaagcaccuucgaagcccuccgcgucuaccaaaaaggccgaggguaaacuuagcaauucaaacaguaaggacgggaauaugcagacugcuaagccauccgccaugaaagucggcgaaaaguuggcaaccaaaucuagcccugugaagguuggagagaaacggaaggcugccgaugaaacacugugccagaccaagguguuacucgacaucuuuacuggcgucagacuguaccuucccccauccacaccggacuucucaaggcugcgacgcuauuucguggcauuugauggggacuugguucaagaguucgauaugacgagcgccacccacgugcucggaagucgggacaaaaacccugcugcgcagcagguaucucccgaauggauuugggccuguauaagaaagaggcgucuggucgcaccaugcuga

SEQ ID NO: 58432 - RNA, 2736 nt, Artificial Sequence
  derived and/or modified sequence opt3 from LIG4__Homo_sapiens__XP_005254115
auggccgcuagccagaccucccaaacaguggcaucucacguccccuucgccgaccugugcucaacucucgagagaauccagaagaguaaaggcagggcggaaaagauucggcauuuucgcgaguuccuugauagcuggcgaaaauuucacgacgcucugcauaagaaccacaaagauguuacggacuccuucuacccugccaugcguuugauauuaccacagcuggaaagagagaggauggcauaugggaucaaggaaaccaugcuagccaagcucuacauugagcugcuuaaucugccgcgggauggaaaagacgcuuugaagcuccugaacuaucgcacacccacugguacccauggcgaugcaggggacuuugccaugaucgcuuacuucgugcugaaaccuagaugucuccagaagggaucuuuaacaauucaacagguaaaugaucugcuugacucgaucgccucaaacaauagcgcgaaaaggaaggauuugauaaagaaaagucugcuacagcucaucacccaguccucugcacuggagcaaaaguggcuuauucggaugaucauuaaagaccugaaguugggcgugagccagcagacuaucuuuuccgucuuccacaacgaugccgcugaacuccacaaugugacaaccgaccuggagaaaguuugccgccaguuacaugacccaucagugggucugagugauauaagcauuacgcucuuuucugccuucaagcccaugcuugcagcuaucgccgacauugaacacaucgagaaagauaugaagcaucaauccuuuuauaucgagacuaagcuggacggggaacgaaugcagaugcacaaagauggagacgucuacaaguauuucucaagaaacggcuacaauuacaccgaucaguuuggcgcgagcccuacagaggggaguuugacuccauucauucacaacgccuucaaagcagacauacaaaucuguauucuagauggagaaaugauggcuuauaaucccaacacccagacauuuaugcagaaggguaccaaauucgacaucaagaggaugguggaggauucugaccugcagacgugcuacuguguauuugacguucucauggugaauaacaagaaacugggccaugaaacucuucggaagcguuaugagauacuguccagcauuuucacaccuaucccagggcgcaucgagauuguccagaaaacccaagcccacacuaagaaugaagugaucgaugcuuugaacgaggccauugacaaaagagaagagggaauaauggugaagcagccgcucucgaucuacaagcccgauaaaaggggcgaagguuggcugaagauuaaaccugaguaugucucuggguuaauggacgagcuggauauccuaaucguuggaggcuacuggggcaaggggucccggggagguaugaugucacauuuucucugcgcaguggccgaaaaaccacccccuggcgagaagccaaguguauuccacacacugagccgagugggguccggauguaccaugaaggaacuuuaugacuugggccugaaacucgcuaaguacuggaaacccuuucaucgcaaggcgccgccuucuagcauucugugcgguacggagaaacccgaagucuacauagagccauguaacucagugaucguucagauuaaggcagccgagaucgugccuagugauauguauaaaaccgggugcacacuuagauuccccaggauugaaaagauccgggacgauaaggaguggcacgaauguaugacucuggacgauuuggagcaacuccgcggcaaggcuuccggaaagcuggccagcaaacacuuauacauaggcggggacgaugagccacaggaaaagaaaagaaaggcagcccccaagaugaaaaaggucaucggaauuaucgagcaucugaaagcuccuaaucuaaccaacgugaauaagauuucuaacaucuuugaagacguagaguucugcguuaugucagguacagacagucagccaaaaccggaucucgaaaauaggauagccgaguuuggcggguauauugugcagaaccccggaccugacacuuacugcgucaucgcaggcagcgagaauauucgugugaagaacaucauacuguccaauaagcacgaugucgugaaaccagcguggcuuuuggaauguuucaagaccaaaucuuuuguucccuggcaaccucgguucaugauccauaugugcccaucgacaaaggagcacuucgcucgagaauaugacuguuacggugauagcuauuuuauugacaccgaucugaaccagcucaaagagguguucuccgggaucaaaaauucaaacgaacagacucccgaggagauggccagucugauugcagacuuagaauacagauacucuugggauugcagcccgcuguccauguuuaggcgccacacgguauaucuugacucauacgccgucaucaaugauuugagcacaaagaacgagggcacccggcucgcuauaaaagcccuggaacuaagauuccauggagcaaaggugguuucuugucuggcugagggcgugucccacgucauuaucggggaagaccauaguaggguggccgauuuuaaagcguuccgccgaacuuuuaagcggaaauucaagauccucaaagagagcuggguaaccgacucuauugacaagugcgagcugcaggaagagaaucaauaucuuaucuga

SEQ ID NO: 58433 - RNA, 1470 nt, Artificial Sequence
  derived and/or modified sequence opt3 from LILRA1__Homo_sapiens__NP_006854
augacccccaucgugacaguccugauuugccucagacuuagccugggcccuaggacucacguucaggccgggacguugccaaagccgaccuuaugggcugagcccggauccgugauaacacaagguucuccuguaacucuguggugucagggcauccuagaaacccaggaguaccggcucuaucgcgagaaaaagacagcaccauggauuacccgaaucccccaggaaauugugaaaaaggggcaauucccuaucccaucaauaacuugggaacauacaggacguuacagaugcuuuuauggcagucacaccgccgguuggagcgagcccuccgacccucuggagcuugucgugacgggggcguacaucaaaccaacucugucugcuuugccgucgcccguugugaccucaggaggcaacgucacacuccauugugugagccagguagccuucggcaguuuuauucugugcaaggaaggggaggaugaacacccucagugucucaauucccagccaaggacucauggauggucucgggcaaucuucagcguuggucccguguccccuucacgcagauggaguuauaggugcuacgccuaugacagcaacucuccacacgucuggucccugcccucagauuuacuggagcuuuuggugcugggcgugagcaagaaaccgagucuaucuguccaaccugggcccauuguugcuccaggagagucccucacccugcagugugugagcgacguaucguacgaucgguuugugcuuuacaaggaaggcgagcgcgacuuccugcaguugccugguccccagccacaagcagggcucucucaggccaauuuuacacugggacccgucucccgaucauauggcggccaguacagaugcaguggggcuuauaacuuaagcuccgaauggucugccccuagcgauccacuggacauccucauagcgggacaauucaggggucggccguuuauuucagugcaccccggcccuaccguugcaaguggggagaaugugacgcuucugugucaguccuggggaccauuccauacauuuuugcuaacuaaagccggcgcugccgaugcaccccugcgucuccgcagcauccacgaauacccuaaguaucaggcugaguucccaaugucucccgucaccucagcccauagugguacuuacagaugcuaugggagccuguccucuaacccguaccuucugucgcacccuagcgacuccuuggagcucauggugucaggcgcggccgaaacacugaguccaccccagaauaaaucugauagcaaggcaggagcugccaacaccuuauccccuucacaaaauaagacggcuagccacccccaggacuacaccguagagaaccugauuaggaugggcaucgccgggcuaguucucgugguccugggaauccuuuuguuugaagcacagcauucucagcggucccuguga

SEQ ID NO: 58434 - RNA, 1401 nt, Artificial Sequence
  derived and/or modified sequence opt3 from LILRA2__Homo_sapiens__NP_006857
augacccccauccugacagugcucauuugccuuggccugagcuuggggccuagaacucacguccaggccggacauuuaccaaagccgacgcugugggcugagcccgguuccguuauaauccaaggcucuccugugacccuaaggugucaggggucacuccaggcagaagaguaccaccuguaucgggaaaacaaaagugccagcuggguacgccguauucaggagccaggaaagaauggccaauuccccaucccuuccauuacaugggaacaugcgggucgauaccacugccaguauuacucucauaaccacucgucagaguauagcgacccacuugagcugguggucacuggggcuuacaguaaacccaccuuguccgcccucccuucuccagugguuacaagcggaggcaaugugacccugcagugugucucccagguggcauuugauggcuucauccugugcaaggaaggggaggacgaacacccgcaaagacucaacucacauagucacgccaggggauggagcugggcuauauuuucuguaggucccguuuccccuucacggcgcuggagcuauagauguuacgcauacgauaguaauucuccauaugugugguccuuacccagcgaccugcuugaguugcuggucccuggcgugucgaaaaagccaucucuauccgugcagcccgggccgauggucgccccuggagagucacucacucugcagugcguuagugaugugggcuacgacagguucguacuuuauaaggaaggugagcgggauuuucugcagcgccccggguggcaaccacaggcuggauugagccaggccaacuucacacucggcccugugucccccucucauggcgggcaauaccgauguuauagcgcgcacaaucugucaagugaaugguccgcaccaagcgaccccuuagauauccugauuaccggacaguuuuacgacagaccuucucucucaguccagccagugccgacgguugcccccgguaaaaacgugacucuucugugccagaguaggggccaauuccacaccuuuuugcuaacaaaggagggggcuggacauccuccacugcaccuccggagcgaacaucaggcccagcagaaucaagcagaguuccguaugggccccgucacuuccgcucacguggguaccuaucgcuguuacucuucgcugagcuccaacccuuaccuucugucauugccaagugauccccucgagcugguaguuucugccagcuuagggcagcauccgcaggacuauacaguggaaaaucugaucagaaugggcgucgcgggacucgugcuagucgugcugggcauucuuuuguuugaggcccagcacucccaaaggucacugcaggaugcagcugggcgguga

SEQ ID NO: 58435 - RNA, 1128 nt, Artificial Sequence
  derived and/or modified sequence opt3 from LILRA3__Homo_sapiens__NP_001166125
augacccccauccugacagugcucauuugccuuggccugagcuuggacccuagaacucacguccaggccgggccauuaccgaagcccacgcugugggcugagccuggauccguuauaacccaagguucuccagugacacuaaggugucagggcucacucgaaacucaggaguaccaucuguaucgggagaaaaagaccgcacuuuggaucacacgcauuccccaggaacuggugaaaaaggggcaauucccuaucuugaguauuaccugggaacacgccggacgauacugcuguaucuauggcagccauacugcgggucucuccgagucuucggauccacuggagcugguagucacaggggcuuacucaaaacccacccucagcgccuuaccuaguccagugguuacguccggaggcaacgugacuauacagugcgacucucaggucgcauuugauggcuucauccugugugugagcaagaagccgucccuuucaguacagcccgggccuguuguggccccaggagaaaaauugaccuuucaaugcgguagugacgcuggcuaugaucguuucguccuguacaaggagugggggagagacuuucuacagaggcccggacggcagccucaggcaggccucagccaagccaauuucacacuggguccagugucucgcuccuaugggggacaguacacuuguucaggcgcuuacaaccuuagcagugaauggucugcccccuccgauccgcuggacauuuugaucaccggccagauuagagcgaggccuuuucucagcgugcggcccgggccaacagucgcaucgggagagaauguuacccuguuaugccaaucucaggguggcaugcacacguuccugcucacuaaagagggggccgcugauuccccucuucgccugaagucaaaacgacagagucauaaguaucaggccgaauuucccaugagcccagugacauccgcacacgcuggaaccuacagauguuauggcucuuugagcucaaaccccuaccuacugacucacccuagugacccacucgagcugguaguguccggugccgcggaaacacuuagcccgccccaaaauaagucugauucaaaagccggggaguga

SEQ ID NO: 58436 - RNA, 1500 nt, Artificial Sequence
  derived and/or modified sequence opt3 from LILRA4__Homo_sapiens__NP_036408
augacccugauccucacaagccuucuguucuuuggauuguccuuagggcccagaacuagggugcaggccgagaaccugcuaaagccuauucucugggcugaaccaggaccggucauaacguggcacaaucccguuaccaucuggugccaagguacacuggaggcacagggcuaccggcuugacaaagaagggaacucuaugucacgccauauucugaagacuuuggagagugaaaauaaagugaagcucagcaucccuuccaugaugugggagcacgccggacgauaucauuguuacuaucagucuccagcgggcuggucggagcccucagauccucuggaacugguagugaccgcuuacagccguccaacacucagugccuuacccuccccugucgugaccucugguguuaacgugacucugagaugcgcaagcaggcuuggguugggacgguucacacugauugaggaaggcgaccaccgccuauccuggacccucaauucacaucagcacaaccacggcaaauuucaagcccuguucccaauggggccgcuuacguuuaguaauagaggaacuuucagguguuaugguuacgagaacaauacccccuaugucuggagcgagccuucugauccacugcaguugcucguguccggcguaucacggaagcccagccuguuaacacugcaggggccuguugugacuccaggagaaaaccucacccuucagugcggcagugacgucgguuacauccgcuacacacuguauaaggagggggcugauggauugccccaacgaccgggcagacagccucaggcaggccuaucucaggccaauuuuacccugucccccgugagcaggucguacgggggacaauaucgguguuacggugcucauaacgugucuuccgaauggucagccccaagugacccucucgauauacugaucgcgggccagauuagcgaccgucccucccuuucuguccagccagggcccacgguuacuagcggagagaaagugacacuguugugccaaucaugggauccuauguucaccuuucuccugacuaaggaaggcgcagcccacccaccguuacgccugagaaguauguauggugcucauaaauaccaggccgaguuccccauguccccuguaacaagcgcacacgcugggaccuauagguguuacggcucucggucaaguaauccauaccuacucagccaccccuccgagccucuggaacuuguggucucuggagccacggagaccuugaacccagcgcagaagaaaucggacagcaagacagcaccccaucugcaggauuauacuguggaaaaucucauccgaaugggcguugccgggcuggugcuucuguuuuugggcauucuccuguucgaggcucaacacucccagcgcucaccgccuagaugcagucaggaagccaacucuaggaaggacaacgcuccauuucgggucguggagcccugggagcagaucuga

SEQ ID NO: 58437 - RNA, 900 nt, Artificial Sequence
  derived and/or modified sequence opt3 from LILRA5__Homo_sapiens__NP_067073
auggcccccuggagccacccuuccgcucagcugcaaccagugggcggcgacgcagucucuccggcccucaugguucuucugugcuugggauuaucacugggucccagaacccaugugcaggcgggcaaccuaaguaaggcuacacucugggccgagccugggagcguaaucuccaggggaaauucugugacuauucggugucagggcacgcuggaagcacaggaguaccgccuugucaaagaagguucgccagagcccugggauacccaaaacccucuggaaccaaagaauaaagcccgauucucaauacccagcaugacagagcaccaugcugggcguuauagaugcuacuauuacaguccugcaggaugguccgagccaucugacccguuggaacucgugguuacuggcuuuuauaacaagcccacccugagcgcccugccuuccccaguggucacaucaggcgagaaugugacccuccagugugggaguagguuacgguucgaucgcuuuauccugacugaagagggagaccacaaacuuagcuggacauuggauucucagcugacccccuccggucaguuccaagcucuauuuccuguaggcccaguuacgcccucacauagauggaugcucaggugcuacgggagccggcgccacauucuucagguguggagugagccgucugaccugcuggaaaucccugucuccggagccgcggauaacuugagccccucgcagaauaagucugacuccggcacugcaucacaccuccaggauuaugccguggagaaccugauucgaauggguauggcuggguuaauccuggugguccucggaauacuuaucuuccaagacuggcauagucagagaagcccacaggccgcagcugggagguga

SEQ ID NO: 58438 - RNA, 1956 nt, Artificial Sequence
  derived and/or modified sequence opt3 from LILRB1__Homo_sapiens__NP_001075107
augacccccauccugacagugcucauuugccuuggccugagcuuggggccuagaacucacguccaggccggacauuuaccaaagccgacgcugugggcugagcccgguuccguuauaacccaaggcucuccugugacacuaaggugucaagggggacaggaaacucaggaguaccggcucuaucgcgagaaaaagaccgcaccauggaucacacguauuccccaggaacuggugaaaaagggccaguucccuaucccaucaauuaccugggaacacacuggucgauacagaugcuauuacgggagugacacagccggaaggagcgaguccucugauccccuugagcugguagucaccggcgcguauaucaaaccuacguugucggcucagccaucaccggugguuaacagcggcgggaaugugacucuccagugugacagucaagucgccuuugauggauucauacugugcaaggaaggugaggacgaacauccccagugucugaacucccagccucacgcacggggcucuagccgcgccaucuuuuccguggggccaguaucacccaguagaagguggugguaccggugcuaugcuuacgauagcaauucuccuuacgaguggucccucccaucagacuuacuggagcuuuugguucugggagugagcaagaaacccagucuaucuguccagccgggcccuauuguggcacccgaagagacccucacacugcaaugugguuccgaugccggguauaaccgcuucgugcuuuacaaggacggagaacgagauuuucugcaguuggcuggcgcccagccacaagcgggccucagccaggcaaauuucacucuggggccugucucgagaucuuauggaggucaguacaggugcuauggcgcccauaacuuauccucagaguggagugcucccagcgacccacuggauauccucauugccgggcaguuuuacgaccggguuucccuuucugugcaacccggaccuaccguagcaagcggcgaaaaugugacacuguugugucagucacaggguuggaugcagaccuuccuacugacgaaagagggggcugccgaugacccauggcgucuccgcaguacuuaucaaucccagaaguaccaggcggaguuuccgaugggccccgucacaagcgcccacgcaggaaccuacagaugcuauggcucucagucaaguaaaccuuaccugcuuacucacccaagcgacccccuggaauuggugguuuccgggccuucuggagguccaucgagccccacaaccggcccgacguccaccucagcugggccugaggaucaaccacucacacccacuggaagugacccucagucuggccuggguaggcauuuagggguggucaucggcauacugguggccguaauucuacuccugcuuuugcugcuccugcuuuuccugaucuugcggcaccgacgccagggaaagcauuggaccagcacacagagaaaggcugauuuucaacaccccgccggcgcaguugggccagaaccuacugacaggggacuccaguggcgguccucacccgccgcugaugcgcaggaggaaaaccuguaugcagccgugaaacacacccaaccagaggacggugucgagauggauacacgcagcccgcaugacgaagauccucaggcugugaccuacgccgaggucaagcacucuagacccaggcgugaaauggcauccccacccaguccuuuaagcggcgaguuccuggacacuaaagaucggcaggccgaagaggaccgacagauggacacggaggcugccgcaucugaagcgccacaagaugugacauaugcucagcuacauucccucacccugagaagggaggccacugaacccccuccgucacaggaggggccaagucccgcaguuccuagcauuuacgccacccuugcuauccacuga

SEQ ID NO: 58439 - RNA, 1449 nt, Artificial Sequence
  derived and/or modified sequence opt3 from LILRB2__Homo_sapiens__NP_001265333
augaccggcgccuaccccaagccuacacugagcgcucagccauccccgguggucacuucugggggaagaguuacgcuccaaugcgagucacagguggcauucgguggcuuuauccuuuguaaagaaggggaggacgaacacccccagugccugaacagucagccucaugccaggggaagcucccgggcgauuuucucuguaggcccagugucgcccaaucgccgauggucacaccguuguuaugguuacgauuugaacagcccuuaugucuggaguuccccaucugacuuacuggagcuacucgugcccgggguuagcaagaaaccuucccugucagugcaaccaggaccggucauggcucccggcgaaagucuuacccugcagugcgugagcgauguaggcuacgacagauuuguuuuguauaaggagggggagagggaucuccggcagcugccuggacgccagccacaagccggucugucucaggcaaauuucacacucggccccguguccagaucauacgggggacaguauagguguuacggcgcccauaacuuaagcagugaaugcucugcuccuuccgacccacuggauauacuuaucacuggucagauucgggggacccccuuuaucagcguccaaccgggaccuacaguggcaucgggcgagaaugugaccuugcugugucagucuuggcgccaguuccacacuuuucuacucacaaaagccggcgcugccgacgcgccccugcgacuuagauccauucaugaauacccaaaguaucaagcagaguucccuaugucacccgucaccagugcccacgcugggacguacaggugcuauggaagccugaacuccgauccauacuugcucucucaccccagcgagccucuggaauuaguugugucagguccaaguaugggcuccagcccgcccccuacugggccaaucucuacccccgccggaccugaggaccagccacugacacccacuggcucagauccgcagaguggucucgggcggcaucuuggcguagugauaggaauccuggucgcagugguuuugcuacugcuccugcuucuguugcucuuucugauuuuacgucaccgcagacagggcaagcauuggaccagcacacaaaggaaagcugacuuccagcacccugccggggcggugggaccagaacccaccgaucggggucugcaguggcgauccucuccugccgcagacgcucaggaggaaaaucuauaugccgcugucaaggacacgcaacccgaggauggcguggagauggacacucgcgccgcagccucggaagcuccacaggauguaacauacgcgcagcuccacagccugacccuuagaaggaaagcaacugagccucccccaucccaggaacgggagccgccugccgaacccucaaucuaugcuacauuggccauucauuga

SEQ ID NO: 58440 - RNA, 1446 nt, Artificial Sequence
  derived and/or modified sequence opt3 from LILRB3__Homo_sapiens__XP_006726238
augacccccgcccugacagcucuccuuugccugggcuugagcuuagggccuagaacuagggugcaggcaggaccauucccgaagcccacgcugugggccgagccugguuccgucaucucuuggggcucaccaguuaccauuuggugucaagggagucuagaagcgcaggaguaccagcucgacaaagaaggaagccccgagccucuggaucggaacaauccacuugaacccaagaacaaagcucgcuuuuccauaccuucuaugacacagcaccaugccggccgauaucguugccacuacuauucgucagcagguuggagcgagccaagugacccgcuggaguuggugaugacuggguucuacaauaagcccacccucuccgcccugccuucuccaguaguggcuagcggaggcaacaugacacugagauguggcucccaaaaaggguaucaucacuuuguccucaugaaggaaggagagcaucaguuacccaggacccuggauucacagcagcuucacagugguggcuuccaagcauuguuuccuguggggccaguuacucccagccaccgguggcgcuucacaugcuacuauuacuacaccaauacgccgagaguguggucucauccuuccgacccccuggaaauccuaccaucaggagucagcaggaagccuagucuccugacucuucagggccccgugcuggccccaggucagucuuugacccuccaguguggguccgauguaggauaugaccgguuuguucuguacaaagagggcgagcgcgauuucuuacaacgacccggccagcagccucaagcugggcugagccaggccaacuuuacacucggaccagugucgccgucucacgguggccaguauagaugcuacggggcgcauaaucuuuccucagaauggagugcacccagcgacccucugaacauuuugauggccggacagaucuaugauacugucucccuaucugcucaaccaggccccaccguggccagcggugagaaugugacacugcucugucagucaaggggguacuucgacaccuuucugcuuacgaaggaaggcgcagcucacccuccacugcgguugcguaguauguauggagcccacaaauaccaggcggaguuccccauguccccggucacuagcgcccaugcaggcacauaccgcugcuaugggucuuacucaaguaacccucaccuccugagcuuuccauccgaacccuuagagcugaugguuucuggacauucggguggcagcucccuaccucccaccgggccaccuucaacucccgcuagucacgccaaggauuauacaguggagaaucucauuagaaugggaauggcuggccugguacuuguguucuuggguauccuccuguucgaagcccagcauucucaaaggaacccacaggacgcagccgggcgguga

SEQ ID NO: 58441 - RNA, 1473 nt, Artificial Sequence
  derived and/or modified sequence opt3 from LILRB4__Homo_sapiens__XP_011546956
auggagcagccccacgacgaaaaggauccugccagcaaaagaccacauccggugugccuguucguccuccccgcucuuaggacccacccuuccgcacaacugggcccauuagggggagacgccaugauccccacauuuacugcguugcugugucuaggucucucucugggcccucggacgcauaugcaggcugggccacuucccaagccuacccugugggccgagccaggaucaguuauuaguuggggcaacagcgugacaauauggugccaggguacuuuggaagcacgcgaguaccgacucgauaaagaagaguccccggcccccugggaccgucagaauccucuggagccaaagaacaaagcuagauucucuauccccucgaugaccgaagauuaugcagggagguaccgguguuauuaccgcucaccuguaggauggagccaaccaagugacccccuggagcucgugaugacaggcgccuauuccaagccgaccuuaucugcucugccuagcccccuugucacuuccggcaagucagugacauugcugugccagaguagaagcccaauggauaccuuucuacucauuaaagaaagggccgcgcacccucugcuucaucugcggucugagcacggggcacagcagcaccaagccgaguuccccauguccccaguuacgucagugcauggagguacuuaccgcuguuuuagcagucacggcuucucucauuauuugcucucccaccccagcgacccucuggaauuaaucgucucggggucucuggaggauccacgaccgucccccaccagaucagugaguacagcugccggaccugaagaccagccacucaugcccacuggcagcguaccucacuccggucuuaggcggcauugggagguucugauugggguguuggucgugucuauccuacugcucagccugcuucuguuuuugcuccugcagcacuggcgucagggaaagcaucgcaccuuagcacaaagacaggcugauuuccagaggccacccggcgccgcggaaccggagccuaaagacggcgggcugcaacggcgaucaaguccagccgcagaugugcagggagagaauuuuuccggugcugccgucaagaacacacagcccgaagacggcguugagauggacacccgccagagcccucacgaugaagacccccaagcugugacguacgccaaaguaaagcauucuagaccaaggcgggagauggcaucaccucccaguccacuaagcggggaguuccucgauacuaaggaccgccaggccgaagaggauagacagauggacacagaagcugcggcauccgaggccccgcaggaugugaccuacgcucaacugcacucuuuuacucuuaggcagaaagccacagaaccucccccaucgcaggagggagcaagccccgccgaaccuuccgucuaugcuaccuuggccauacacuga

SEQ ID NO: 58442 - RNA, 1776 nt, Artificial Sequence
  derived and/or modified sequence opt3 from LILRB5__Homo_sapiens__NP_001074911
augacccugacacucagcgugcuuaucugccugggcuuguccgucgggcccagaacuuguguucaggccggaacguuaccuaagccaacccugugggcugagccggcaucugugauugccagggguaaacccguaacacuauggugccaaggcccucucgaaacugaggaauaccggcuggacaaggaggggcuuccaugggcgcgcaaacgacagaacccccuggaaccuggagcuaaggccaaauuccacauaccaucaaccguguaugauagugcaggccguuacagauguuauuacgagacacccgccgguuggagcgagccuuccgacccauuggaacucgucgcuaccggguuuuaugcagagccgacucugcuggcccuccccucuccugugguugcuucgggaggcaaugugacauuacagugcgauacccuggacggccuuuugacguucguccugguggaagaggagcagaagcuaccaaggacucucuacucacaaaagcugcccaaagggccuagccaggcccuuuuuccaguaggacccguuaccccgaguugucgguggcgcuucagaugcuauuacuacuauaggaagaacccucaggugugguccaaucccucugaucuguuggaaauccucgucccaggugugagccggaaaccuucccuguuaauuccccagggcucaguggucgcgcgcgggggaagucugacacuccaaugucgaagcgacguuggcuacgauaucuuugugcuuuauaaggagggugaacaugaccugguacaggggucuggacagcagccacaagcaggcuugucccaggccaacuucacucuaggccccgugucaagaagccacgggggacaguacaggugcuauggugcucauaaucugaguccucgguggucugccccauccgauccgcucgacauucugaucgcaggccuuauacccgauaucccugcucugagcguccaaccagggcccaaaguggccucgggagagaacguuaccuugcucugucagucuuggcaccagauugacacauuuuuccugaccaaggaaggcgcggcccauccuccauuaugccugaaguccaaauaccagucauaucgucaccaagcagaguuuaguaugagccccgugacguccgcucagggugggacuuaccgcuguuacucugccaucagaagcuauccguaccuacucucaaguccuuccuauccacaggagcuggucgugagcggccccucuggagauccuucacuuagucccacaggcagcaccccaacuccugcugggcccgaagaccagccauugacaccgaccggacuggacccucaauccggucucggcaggcaccuggggguaguuacgggagugucugucgccuucgugcuucuguuguuucuccuguuauuccugcuacuccggcaucgacaccagucgaagcaucgcaccagcgcacacuuuuacagacccgccggcgcugcggguccagagcccaaagaucaggggcugcagaagagggcauccccugucgccgacauucaagaagagauccuuaaugcugccgugaaagauacacagccaaaggacggcguugaaauggaugcacgggccgcugccucagaggcaccccaggacgugacuuaugcgcaguugcacagucugacccuccgcagagaggcuacagaaccuccgccaucucaagagagggaacccccugccgagccaagcauauacgcaccccuggccauucauuga

SEQ ID NO: 58443 - RNA, 522 nt, Artificial Sequence
  derived and/or modified sequence opt3 from LIM2__Homo_sapiens__NP_001155220
auguacagcuucaugggcgggggacuguuuugcgccuggguggguaccauccuccuugucguugcuauggcaacagaccacuggaugcaguauagacuguccggcucuuucgcccaucaaggguuguggagguacuguuuaggaaacaagugcuaucugcagacugauucaauugcguacuggaaugcuacgcgggccuuuaugauacuaagugcacucugugccaucagcggcauuaucauggguauuauggcuuucgcacaccagcccaccuuuucccgcaucucucgaccuuucucggccgggauaauguuuuucucaagcacacuguuugugguacuugcucuggccaucuauacuggagugaccgucaguuucuugggccguagauuuggcgacuggagguucuccuggucuuacauucucggguggguggcgguucugaugacauuuuucgcaggaaucuucuauaugugcgccuaccgggugcaugagugucgcagacugagcaccccaagguga

SEQ ID NO: 58444 - RNA, 1374 nt, Artificial Sequence
  derived and/or modified sequence opt3 from LIMA1__Homo_sapiens__NP_001230704
auggagcagaaggaaaacgugcccccuggcccagaggucugcaucacccaccaagaaggggagaaaauuagcgccaaugaaaacucccuggcuguuagaucuacaccggcagaggacgauucaagggacagucaggugaaaagcgagguacagcagcccgugcauccuaaaccacucucccccgauucucgggccucgucacuuagcgaaaguuccccuccaaaggcgaugaaaaaguuccaagcucccgcccgcgagacuugugucgaaugccagaagacgguguacccuauggagcgacuguuggcaaaucagcagguuuuucacauaucuuguuuccguugcagcuauuguaacaauaaauuaucccugggaaccuacgccucacuacaugguagaaucuauugcaagccacacuuuaaccaacucuucaaaaguaagggcaauuacgacgagggguuuggacauaggccgcacaaagaucugugggcuagcaagaacgaaaaugaggaaauucuugagcggcccgcacagcuggccaacgcucgcgaaacaccucacucuccaggcguggaggacgcccccaucgcgaaggucgguguguuggcagccuccauggaggcuaaagccucaagccagcaggaaaaggaggauaaaccugcagaaacuaagaaacucagaauugcuuggccacccccgaccgagcuggggaguucuggauccgcccuggaagagggcaucaagaugagcaaaccuaaguggcccccagaggacgaaauaucgaagccugagguacccgaagauguugaccucgauuuaaagaagcugaggcggucuuccucacuuaaagagcgcagucgaccauucacaguggcggccagcuuucaauccaccucugucaagagccccaaaacugugucaccuccaaucagaaagggcuggaguauguccgaacagagcgaggagucugucgggggaaggguggcagaacggaagcagguugagaaugcuaaagccucaaagaaaaacgguaaugugggcaagacaaccuggcaaaacaaagaaaguaagggggagacgggaaagcguagcaaagagggccauuccuuggaaauggagaaugaaaaccugguagagaacggugcugacucugaugaagacgacaauucguuccuaaagcagcagagcccgcaggagcccaaaucccucaacuggucaaguuuuguggauaauacuuucgccgaggaauuuaccacacaaaaccagaagucucaggacgucgagcugugggaaggggaggugguuaaagaacuuagcguggaggagcagauuaagcgcaauagauauuacgaugaagacgaggaugaagaguga

SEQ ID NO: 58445 - RNA, 3174 nt, Artificial Sequence
  derived and/or modified sequence opt3 from LIMCH1__Homo_sapiens__NP_001106188
auggccugccccgcucugggccucgaggcacuucagccucugcaaccagaaccgcccccugagccagccuucagcgaagcgcagaaguggaucgaacaggugaccgggagauccuuuggagacaaagauuucaggacagguuuggaaaacggcauuuuacugugugagcuacucaaugcuauaaagcccgggcuggucaaaaagaucaaccggcuuccuacuccaauugccggacuggacaauaucauuuuguuucuccgcggcugcaaagagcugggucugaaggaaucucaacucuucgaucccucagacuuacaggauacgaguaaccgaguuaccguaaagagccuggacuacucccguaaacuuaagaauguguuggugacaaucuauuggcuggggaaagcagccaacucuuguacuucguacucaggaaccacacuaaaucucaaggaguuugaaggccugcuugcucagaugagaaaagauaccgacgauauagagagcccuaagaggaguauccgggacuccggcuauauugauugcugggacucugagcgcagcgauucccugucaccaccgagacacgggagggacgacaguuucgauagcuuggacucuuuuggaucccggucacgccagacucccagcccugaugucgugcuccgagguaguucugacggcagaggguccgauagcgaaucggaccugccacauaggaaguuacccgauguuaaaaaggacgauaugucugcacggcguacaucccacggagagccuaaaucagccgugccauucaaccaguaccugcccaauaagaguaaccaaaccgcuuaugucccggccccucuccgcaaaaagaaagcggaaagagaggaauaccgaaagagcugguccacggcaacuucuccccuuggcggugagcggccauuucgauaugggccucgcacccccgugagcgacgaugccgagucaacaaguauguucgacaugagaugugaagaggaagcugccguacagccacauuccagggcacggcaggagcagcugcaauugaucaauaaccagcuacgcgaagaggacgauaaguggcaggacgaucuggcuagauggaaaagcaggcgucggucuguuucacaagaccucauuaagaaagaggaagagaggaagaaaauggaaaagcugcuugccggagaggauggcaccagugaaagacgcaagagcaucaaaaccuacagggagauagugcaggagaaggaacggagagagagggaacugcacgaggcguacaaaaaugcccgcucccaggaggaagcagagggcauuuugcagcaauauaucgaacgauuuacaauuucugaggcuguccucgaacggcuggagaugcccaagaucuuagagcguucgcauagcaccgaaccuaaccuguccucauuccuaaaugacccaaacccgaugaaauaccucagacagcagagucugcccccuccaaaguuuacggccacuguggagacaaccaucgcuagggccucugugcuugauacuagcauguccgcagggucaggaagccccucuaagacagucaccccuaaagccguuccaauguugacgcccaagccguauucccagccuaaaaacagucaagacgugcugaagaccuucaaaguagaugguaaggugagcgucaauggcgaaacagugcaccgcgaggaagagaaggagcgggaaugcccaacuguugcucccgcgcacucucucaccaaaucccagauguucgaggggguggcaagaguccauggaucaccucuggaacuuaagcaggacaacggcaguauugagauaaauaucaaaaagcccaacagcgugccacaggaacuggccgcuacaacugagaaaaccgagccuaauucgcaagaagauaagaacgacggugggaaauccaggaagggcaauauugaguuggccucuagcgaaccccagcacuuuacaaccacuguaacgcgauguucaccaacaguugcauucguggaguuuccgaguuccccucagcucaagaacgaugucucugaggaaaaagaccagaagaaacccgagaaugaaaugagcggaaagguggagcuggucuuaucccaaaaagugguuaagccaaagucacccgaaccugaggccacccugacuuucccauuucuagacaaaaugcccgaggcuaaccagcuccaucugccuaaucuuaacagccagguggauaguccgucuuccgaaaagagcccaguaaugacuccccaauucaaauuuugggccugggacccugaggaggagcgccggagacaggaaaaguggcagcaggagcaagagagguugcugcaggaacguuaccagaaagagcaggauaagcucaaggaagagugggaaaaagcacaaaaggaggucgaggaagaggaacgccgguauuacgaggaggaaagaaaaaucauagaggacacagugguuccauucaccgugucgucaucuagugcggaucagcuguccacuagcucuagcaugacagaaggcuccgggacgaugaauaagauugacuuaggaaacugccaggaugagaaacaggacaggcgauggaagaagucauuucaaggugaugacagugaucugcuuuugaaaacccgggaaagcgaccgccucgaggagaagggcucucugacugaaggggcucuagcccacuccggaaaucccgucucaaaaggcgugcacgaggaucaucagcuggacacagaagccggugcaccucacugugggaccaacccgcagcucgcucaagaccccagucagaaccagcagacaagcaauccaacucauuccucugaggauguaaagccuaaaacccugccccuugacaagucgaucaaccaccaaaucgaaagcccaucagagagaaggaaauccauuaguggcaagaaguugugcucuagcuguggacugccuuuaggcaaaggggccgcaaugaucauugagacgcucaaucuguauuuccauauacagugcuuucggugcggaaucuguaagggucagcuuggcgaugcuguguccgggaccgacguucgaauuagaaacggacuguugaauugcaacgauuguuacaugcgcucaaggucugccggccagcccacaacucucuga

SEQ ID NO: 58446 - RNA, 2031 nt, Artificial Sequence
  derived and/or modified sequence opt3 from LIMD1__Homo_sapiens__NP_055055
auggacaaguacgaugaccugggccucgaggccagcaaauucaucgaagaucuuaacauguaugaggcuuccaaggacgggcuguuuagaguggauaaaggagcagguaauaaccccgaauuugaggaaaccaggcgggucuuugccacaaagauggcgaaaauucacuugcagcaacagcagcagcaauuacugcaggaggagacucuaccucgcggcucucgagggccaguuaauggaggcggucgucucgggccgcaggcuagaugggaagugguaggaucaaagcugacgguggacggcgccgcaaagcccccucuugccgcuaguaccggcgcaccaggggccgucacaacucuggcugccggacagcccccuuacccaccccaagagcagaggagccggccuuauuugcaugguacccgccacggcucccaggauugcgggucuagagaaucgcucgcgacaucagagaugagcgcauuccaucagccaggaccgugugaggaccccaguugccugacccacggcgauuacuaugacaaccugucccucgccucuccuaaauggggugauaagccaggggugagccccuccauaggauuaucaguuggcaguggcuggccuagcucuccaggguccgacccgccgcugccuaaacccuguggagaucauccacuuaaucacaggcaauugucacugagcaguucucgguccagcgaagguucgcuaggcgggcagaacucuggaaucggcggucgcuccucagagaagccuacugggcucuggaguacagcuagcucccagcgagugucucccggccugccaagccccaaucuugaaaacggagccccugcagucggcccagugcaaccgagaacccccucaguaagugcuccucuggccuuguccugcccaaggcaagggggacucccccggagcaauucuggucugggcggggagguuucaggagugaugaguaaaccuaacgucgacccacagcccugguuucaggacggccccaagagcuacuuauccucuucggcgccuagcuccucaccagccggucuggaugggagucagcagggcgcagugcccggacucggcccuaagcccggguguacggaccuuggaacugguccaaaacugucuccuaccagcuuggugcaccccgucauguccacacuaccagaacugucaugcaaggagggcccgcucggguggagcucugauggaucccugggcaguguucuucuggacagcccuucuucaccccgugugcgcuugccaugucagccccucguaccugguccagagcugagacccuccgcugccgaauuaaaacuggaggcucuaacucagaggcucgaacgggagauggaugcccauccuaaggcagacuauuucggggccugcgugaaauguaguaagggcgucuuuggagcuggccaagcgugccaggcaauggggaaucuguaccacgauaccuguuucacaugcgccgcuugcagccgaaaacuucgcggaaaggccuuuuacuucgugaacggcaagguuuucugugaagaggacuucuuguauucggguuuucagcaguccgcagauagaugcuuccugugugggcaucucauuauggacaugauccugcaagcccuuggaaaaucuuaccacccgggcugcuucaggugugugauuugcaaugagugucuggauggugucccauuuaccguggacagcgaaaacaagaucuauugcguacgggacuaccacaaaguuuuggcucccaagugugccgcaugcggccucccuauacugccacccgaggggucagaugaaacgauccgcguggucaguauggacagagauuaucauguggaguguuaccacugcgaagacugcggauuagagcugaaugaugaggacggccauagguguuauccucuagaagaucaccucuucugccauuccugucacgucaaacgucuggagaagcggccgucuagcacugcgcuucaccagcaucacuuuuga

SEQ ID NO: 58447 - RNA, 384 nt, Artificial Sequence
  derived and/or modified sequence opt3 from LIMD2__Homo_sapiens__NP_085053
auguuccaggccgcuggcgcagcccaagcgacccccagccacgacgcuaaagggggagguuccucuacagugcagagaucaaagaguuuuagccugagggcccaggucaaggagacuugcgcagccugucagaaaacgguuuacccuauggaacggcucguggcugauaaacuuaucuuccauaacuccugcuuuuguugcaagcacugucauaccaagcugucuuugggcucguaugcagccuuacacggggaguucuacugcaagccacauuuucaacagcuguucaaaucaaagggaaauuaugacgaaggcuuuggucgcaaacagcacaaggagcuaugggcucacaaagaaguagauccggggacaaagacugccuga

SEQ ID NO: 58448 - RNA, 1842 nt, Artificial Sequence
  derived and/or modified sequence opt3 from LIMK1__Homo_sapiens__NP_001191355
augcugcucgccagcgcucccagaaggcggcgcuuccuucagcgagcaaagugcugugacugcuccgccucucugucacaccaauacuaugagaaagauggccaguuguuuuguaagaaagacuacugggcgcguuauggggaaaguugccauggauguagcgagcagaucaccaaggguuuagugauggucgcuggcgaacugaaauaccacccugagugcuucauuugucuaacaugcgggacuuuuauaggagauggcgacacguauacccucguugaacauuccaagcuguacuguggucacugcuauuaccagacagugguaacuccagugaucgagcaaauucuuccggauucucccgggucgcaucugccucacaccgucacauuggugucaaucccagccagcagucacggaaagagaggccucuccguuucuauugaucccccucauggcccacccggguguggaaccgagcacagccauacugugaggguccaggguguggacccuggcugcauguccccagacguaaagaacucaauccacguuggggaucggauacuggaaaucaauggaacaccgauucgcaacgugccccuggacgagaucgaucucuuaauucaggaaaccaguagacugcuucaguugacgcuggagcacgacccucaugauacucuaggccacggucucgggccagagaccagcccccugucuuccccugcauacacaccaucaggagaagccggcagcagugcuaggcaaaagcccguccuucggucuugcuccaucgaccgcagcccgggcgcagggucgcugggaucuccugccucccagcgaaaagacuuggguagaucagagagucucaggguggugugucggccccaucguauauuccgcccaagcgaucugauucacggcgaagucuuagggaagggaugcuuuggccaggcuaucaaaguuacucauagagagaccggugaagugaugguaaugaaggagcugauuagguucgacgaggaaacacagcggaccuuucucaaggaggugaaagucaugcgaugucuugaacacccuaaugugcugaaguucaucgggguuuuguauaaagauaagcgccuaaacuuuaucacggaguacauuaaaggcggaacucugagaggcauaaucaaguccauggacucucaauaucccuggagccagagggugucauucgccaaagauauugcgagugggauggcauaccuccacuccaugaauaucauacaucgggaccugaacagccacaauugccuuguccgcgaaaacaagaaugugguaguugccgauuuuggacuggcuagauugaugguggacgagaagacacagccagagggucucaggucucugaaaaagcccgaucguaaaaagcgguauaccgucgugggcaacccuuacuggauggccccagaaaugauuaaugggcgaucauaugacgagaaagucgauguguucaguuuuggaaucguuuuaugugaaaucauuggcagagugaacgcagacccggacuaccugcccaggacuauggauuucggucuaaauguacgcggguuccucgaccgguacugcccuccaaacugucccccuagcuuuuucccaaucacagucagaugcugugaucuggaccccgagaagaggccguccuuugugaaacuugaacauugguuggagacccugcgcaugcaccucgcuggccaucugccucuuggaccacaacuggagcaguuggaucgaggcuucugggaaacguaucggcguggggagucuggacuccccgcccacccugaaguucccgacuga

SEQ ID NO: 58449 - RNA, 2061 nt, Artificial Sequence
  derived and/or modified sequence opt3 from LIMK2__Homo_sapiens__NP_001026971
augggcagcuaccuguccgugcccgccuauuucaccucuagagaccucuuuaggugcucagaaugucaggauagucuuacaaacugguacuaugaaaaggacgggaaacuguacugcccuaaggauuauuggggaaaauucggugaguuuugucacggcugcagcuuguuaaugacugggccauucauggucgcuggagaauuuaaguaccauccggaguguuucgcaugcauguccuguaaaguuaucauugaagacggcgaugccuaugcgcuggugcaacacgcuacgcuauacugcgguaagugucauaaugagguagugcucgcccccauguuugagcggcugucuaccgaaucgguccaggagcagcuuccuuacucagugacacugauaagcaugccagcaacuaccgaagggcgccgaggauucaguguuuccguggagucugccugcagcaacuaugcuacaaccguccaggugaaggagguaaaucguaugcacaucucccccaacaauagaaacgcaauucauccuggcgacaggaucuuggaaauuaauggcacuccaguucggacacuccgcguggaggaagucgaggaugccaucucacaaaccagucagacgcugcagcugcucauagaacacgaccccgugagccagagauuagaucaacugaggcuugaggcucgguuggccccucacaugcagaacgcggggcauccacacgcacugucuacucuagacaccaaagagaaucucgaaggaacacugcgccgaagaucccuuaggcggucaaacagcaucaguaagucuccgggucccuccagcccuaaagagccacuguuguuuucgcgugauauuucucgcuccgaaucacucagauguaguagcuccuacucucagcagaucuucaggcccugcgaccugauucauggcgagguguuagggaagggauuuuucggccaagccaucaaagucacucacaaggcuaccgguaagguuauggugaugaaagaacugauacggugcgaugaggagacacagaagaccuuucucacggaaguaaaagugaugcgaagccuugaccacccuaauguccugaaguucauugggguguuguauaaagacaagaaacuaaaccugcucacugaguacaucgaaggaggcacacugaaggauuuccuucgcucaauggacccauuucccuggcagcaaaagguuagauucgccaaaggcauugcaagugggauggcuuaucugcauuccauguguaucauccacagggauuugaauagccauaacugccucauuaagcuggacaaaaccguggucguggccgauuuuggauuaucucggcugauaguagaggaacgcaagagagcgccgauggagaaagccacuacaaagaagaggacccuacguaaaaaugaccggaagaaacgauacacgguuguggguaacccuuauuggauggcacccgagaugcucaacggcaagucauacgaugaaaccgucgacaucuucaguuuugggauugugcugugugagaucauaggacaggucuacgcugauccagacugccuuccuagaacauuggauuucggccugaaugugaaacucuuuugggaaaaguucguucccacugacuguccacccgccuuuuucccucuggcugccauuugcuguaggcuugagccagagagccgcgcaccgcccggugccgcuggggaaggcccuggaugcgcggacgaugagggcccagugcggagacaggggaagguaaccaucaaauaugaccccaaggaacugaggaaacacuugaaccucgaggaauggauccuggagcaguuaacacgccuguacgauugucaagaggaagagauuuccgaacuagagaucgacgucgaugaacuccuggacauggagucugaugacgcaugggccucgcgagugaaggagcuuuugguugauugcuauaaaccuacugaggcuuuuauuagcggacugcucgacaagauacgggccaugcagaagcuguccaccccacagaaaaaguga

SEQ ID NO: 58450 - RNA, 990 nt, Artificial Sequence
  derived and/or modified sequence opt3 from LIMS1__Homo_sapiens__NP_001180411
augaccugcaacauggccaaugcucuggcaagcgccacaugugagagaugcaagggcggguucgcgcccgcugagaaaaucgugaacuccaauggagaacucuaccacgaacaguguuuugucugcgcccaauguuuccagcaguuuccugagggucuuuucuaugaauuugagggcaggaaguacugcgagcaugacuuccagaugcuguuugcaccauguugccaccaauguggggaguucauuauaggacggguuaucaaagccaugaacaauucuuggcauccggaaugcuuucgcugugauuugugccaggaaguguuagcugacauuggcuucguaaagaacgcaggucgacaccugugccgucccugucauaauagagagaaagccagggggcuaggaaaguauaucugccagaagugucacgcuauuaucgaugagcagccucucauauuuaaaaacgacccauaccaccccgaucauuucaauugcgccaacuguggcaaggaacugacugcggacgcacgggagcuuaaaggcgaacuguauugcuugccuugucacgauaagaugggggugccaaucugcggagccugucgcagacccauugaggguagggucgugaaugcuaugggcaaacaauggcauguugaacacuuugugugcgccaagugugagaagccuuuccucgggcaccggcauuacgagcgcaaaggacuggcauauugcgaaacgcacuacaaccagcuguucggcgacgucugcuuucauuguaaucgagugaucgagggugauguaguuucagcucucaacaaggccuggugcgugaauuguuucgcgugcaguaccuguaacacaaaauuaacucugaagaacaaauuugucgaguucgacaugaagccagugugcaaaaaguguuacgaaaaguuuccgcuugaauugaaaaagagacugaaaaagcuagccgagacccucgggaggaaauga

SEQ ID NO: 58451 - RNA, 1092 nt, Artificial Sequence
  derived and/or modified sequence opt3 from LIMS2__Homo_sapiens__NP_001129509
augaccggcagaaagaggaaauggggagagacagggacugguagcggcgccgcucccgcagccgcgcugcggugguccaacaugucugacgcucucgccaaugcagugugccagcgcugucaagcccgauucaguccugcugaacguaucgucaacucaaauggggagcuuuaccacgaacauugcuuuguuugugcacagugcuucagaccauuuccggagggacuguucuaugaauuugagggcaggaaguacugugagcacgauuuccagauguuguuugcccccugcugugguagcugcggggaguucauuauaggacgggugaucaaagcuaugaacaauaacuggcauccuggcuguuuucgcugcgaauuaugugacguagaacuggccgaucuaggcuucgugaagaaugcggggagacaccucugcaggccaugccauaaccgggagaaagcaaagggacuggguaaguauauuugucagcgcugccaccuugucaucgacgagcaaccccugauguuucgauccgaugccuaccacccugaccauuucaauuguacgcacugcggcaaagaauugaccgcugaggccagagaacucaagggggagcuguauugucugccaugccaugauaaaaugggagugcccauuuguggcgcaugcaggcggccuaucgaaggucguguugugaacgcucucgggaagcaguggcacgucgagcacuuugugugugccaaaugcgagaagccauucuuaggacaucgccacuacgaaaagaaaggccuggcguauugugagacacauuacaaucagcuuuucggcgacguaugcuacaacugcucucacguuauagaaggggauguggucucggccuugaauaaggcauggugugugucaugcuuuagcuguaguacuugcaacuccaaacugacccuaaagaauaaauucguggaguuugacaugaagccggucuguaaaagaugcuaugaaaaguucccccucgagcugaagaaaaggcuuaagaaacugucugaguugacaagccggaaggcucagccuaaagccaccgaucucaacuccgcuuga

SEQ ID NO: 58452 - RNA, 753 nt, Artificial Sequence
  derived and/or modified sequence opt3 from LIN28B__Homo_sapiens__NP_001004317
auggccgagggcggggcuagcaagggagguggcgaagaacccgggaaacugccugaaccagcagaggaagagucccaggugcucagaggaaccggccacugcaagugguucaacgucaggauggguuuuggguucaucucuaugauuaaucgggagggaucaccgcuugacauacccguugauguguuuguacaucaaaguaaacuguucauggaaggcuuucgcagcuugaaggagggcgaaccuguggaguucacauuuaaaaaguccucuaagggguuagagucgauccgagucacuggaccagguggcucacccugucuggggagcgaacguagaccuaaaggaaagacgcuacagaaaaggaagccaaaaggcgaccggugcuacaacuguggugggcucgaucaccaugccaaggagugcagucugcccccucagccaaagaaaugucacuauugccaguccauuaugcauaugguggcgaauuguccgcacaagaacguugcucaacccccugccucuagccagggacgccaggaagcagagucccagccaugcaccucaacacuucccagagaagugggcggcgggcacggauguaccaguccuccauucccccaagaggccagggcugagaucagcgaacggucuggucgcuccccgcaggaggcaucaagcacuaaaaguucuauugccccugaggagcaguccaagaaaggccccagcguccagaagcgaaagaaaacauga

SEQ ID NO: 58453 - RNA, 351 nt, Artificial Sequence
  derived and/or modified sequence opt3 from LIN52__Homo_sapiens__NP_001019845
augggcuggaagauggccagccccaccgacgggacagaucuggaggcuucccuccuuucuuucgaaaaacuggacagagcaucaccugauuuguggccagagcaguuaccgggaguggccgaauuugcggcuaguuucaagagccccaucacuuccucuccuccaaaauggauggccgagauugaaagggacgauauagacaugcugaaggagcuagguucgcucacgaccgcaaaccugauggagaaaguccggggccuucaaaaucuggccuaccaguuggggcucgaugaaucacgcgagaugacacgaggaaaguuucugaacauccuggaaaagcccaaaaaguga

SEQ ID NO: 58454 - RNA, 702 nt, Artificial Sequence
  derived and/or modified sequence opt3 from LIN7A__Homo_sapiens__NP_004655
augcugaagcccagcgugaccuccgccccuacagcugacauggcaacucucacggucguucagccacuuacccuggauagagacguggccagggcgaucgaguuguuagaaaagcugcaagagucuggcgaaguaccggugcacaagcuacagucacucaaaaagguccugcagagugaguucugcacagcuauucgggaaguguaccaguauaugcaugagacuauaaccguuaacgggugucccgaguuucgcgcccgagcaacagccaaagcuaccguggcagccuucgcugccagcgaaggacacucccauccucgugucguggagcuuccaaagacugaugaaggucugggcuuuaauguaaugggagggaaggagcaaaacucucccaucuacauuucgagaaucauuccuggcgguguugcggagaggcacgggggauugaaacggggcgaccagcuccugucagugaauggcgucagcguggaaggggagcaucacgaaaaggcaguggagcugcucaaagccgcuaaggauagugucaaauuaguugugcgcuauacaccaaagguacuggaagagauggaggccagauucgaaaaacuuaggaccgcacggcgccgacagcagcaacaguugcugauccagcagcaacagcagcaacagcagcagcaaacgcagcagaaccacauguccuga

SEQ ID NO: 58455 - RNA, 624 nt, Artificial Sequence
  derived and/or modified sequence opt3 from LIN7B__Homo_sapiens__NP_071448
auggccgcucugguggagccccucggccuugaaagagacgucagcagggcaguugagcuguuggaacgguuacagcgcuccggggagcugccuccacaaaagcuacaggcccuccagcgagugcugcagucucguuucugcucagcgaucagagaaguauacgagcaacuuuaugauacccuggacauuacaggaagugcugagauaagggcccacgcaacugccaaagcuacgguggcagccuuuaccgcuagcgaaggucaugcccacccgcgggucguggaguugcccaagacagaugaaggccucggguucaacaucaugggaggcaaagagcaaaauuccccuauuuacaucucucgcguuauuccaggugggguggcggacagacauggaggccugaagaggggcgaucagcugcucucggucaacggggugucaguagagggagaacagcacgagaaagcaguugaauuacugaaggccgcucaggguagcgugaaacuugucgugcgguauacuccccgcguguuggaggaaauggaggcccgauuugagaagaugagaagugcaaggcggcgucagcagcaucaguccuacucuagccuggaaucccgcggcuga

SEQ ID NO: 58456 - RNA, 594 nt, Artificial Sequence
  derived and/or modified sequence opt3 from LIN7C__Homo_sapiens__NP_060832
auggccgcucugggcgagcccgugagacucgaaagggacaucugccgggcaauugagcuucuggaaaaguugcagcgcagcggggaggucccuccacaaaaauuacaggcccugcagcgaguucuacaguccgaguucuguaacgcggugcgugaaguauacgagcacguguaugaaaccgucgauauaucuucaaguccggaggugagagcuaaugccacagcaaaggccacuguugcugcauuugccgcuagcgaaggacauucccaccccaggguggucgagcucccuaaaacggaggaaggucugggcuucaacaucaugggagggaaggagcaaaauucuccaauuuacaucucgcggauuauccccggcgguauagccgaccgccaugggggacuuaaaagaggcgaucagcuguugucagugaacggcguaagcguugaaggggagcaccaugaaaaggcgguggagcuccugaaggcagcccagggaaaagucaagcugguggugagguauaccccuaaaguccucgaggaaauggagagucgguuugaaaagaugcgcuccgcuaaacgaagacagcaaacauga

SEQ ID NO: 58457 - RNA, 1572 nt, Artificial Sequence
  derived and/or modified sequence opt3 from LIN9__Homo_sapiens__NP_001257338
augcacagaggcgggcagccccugaagaaaaggcggggauccuucaagauggccgagcucgaccaacuuccugaugaauccucuucagcuaaagcacuggugaguuugaaggaggguagcuuauccaacaccuggaaugaaaaauacucuucgcugcagaagacaccagucuggaagggccgcaacacuucaagcgccguugagaugaaauuuacggcgaccaugaguacaccggacaagaaagcuagccagaagaucggguuccgacuacguaaucuccugaaacuucccaaggcccauaaguggugcauuuaugaaugguuuuacucuaacauagauaaaccucuguucgagggagacaaugauuuuugugugugcuugaaggagagcuucccaaaccucaaaacuagaaagcugaccaggguagaauggggcaaaauccggcgccugauggguaagcccagaagguguuccucagcauuuuucgaggaagaacggagugcccucaaacagaagcgccaaaagauucgauuacugcagcagagaaaaguggcugacgucagccaguuuaaggaucuuccugacgagaucccauugccccuggugauugggacaaaaguuaccgcaaggcuacggggagugcacgauggccucuucacuggccaaaucgacgccgucgauacacugaaugcuaccuaucgugugacguuugaccgcacugggcuuggaacccauacaauaccugauuacgaaguacugucuaacgagccacacgaaacuaugccgaucgccgcguucggucagaagcagagacccuccagguuuuucaugaccccuccacgguugcauuauacacccccucuccagucaccaauuaucgacaaugacccccuguuaggccaaagcccguggcgaaguaaaauuucuggguccgauaccgagacgcugggaggcuucccuguugaauuucucauccaggugacucgccuuagcaagauacugaugauuaagaaagagcacaucaagaaauugagagagaugaacacagaagcagagaagcuaaaaucguacucuaugcccauuuccaucgaguuccagaggcgguaugccaccaucguccuggagcucgaacaacugaauaaggaccuuaacaaggugcugcacaaagugcagcaguacugcuacgaguuggcuccagaucagggucuccaaccugccgaccagcccacugauaugcgcagaaggugugaggaagaggcacaggaaauuguccgucaugcuaauucaaguacagggcagccaugcguugagaacgaaaaucugaccgacuuaauaagccggcugacggccauccuacuccaaauuaagugucuggcggagggaggcgaucuuaacuccuuugaguucaaaucuuugaccgacagccugaacgauaucaagucaacaauagacgccaguaauauuuccugcuuucagaacaauguggaaauccacguagcacauauccagagcggccucucucagauggggaaccugcacgcuuucgccgcuaauaacacuaaucgagauuga

SEQ ID NO: 58458 - RNA, 1845 nt, Artificial Sequence
  derived and/or modified sequence opt3 from LINGO1__Homo_sapiens__NP_001288126
augcuggccggcggggugagaagcaugcccuccccucuccuugcuugcuggcagccaauccuguuguuaguccugggaucuguucuaucagguagugcaaccggcuguccgcccaggugcgaguguagcgcccaagaccgggcggugcucugccaccgcaagcgauucguagcugugccugaagggauuccaacagagacucgucugcuugaucugggaaagaacagaauaaagacguugaaucaggacgaauuugccuccuucccccaucucgaggaacuggagcugaacgagaauaucgucucugcaguggaaccuggcgccuuuaacaaucucuucaacuuaaggacccugggucuucggucgaaucgcuugaaacugauuccacuagggguuuuuacaggacucucaaaccugacuaaacuugauaucagcgagaauaaaauugugauccuguuggacuacauguuccaggaucucuauaaccugaagaguuuagaagucggcgacaaugaucugguguacauaucccacagagcuuuuucuggccucaacagccuugagcagcugaccuuggagaaguguaaucuaacauccauccccaccgaagcacugucacaucuccacgggcugauuguacuuaggcugcggcauuugaacaucaaugccauucgcgacuauaguuucaaacgacucuacagacugaagguuuuagagaucagccacuggccuuaucuggauacuaugacaccaaacugccuauacggacucaaccugaccucucuuuccauaacgcacuguaauuugacugcugugccguaucuggccgucaggcaucucguguaccugcgguuucuuaaccugucauacaaucccauuagcaccaucgaagguaguauguugcacgagcuccugcguuuacaagaaauucagcuggugggcgggcagcuagcggucguugagccuuaugcauuccgcggacucaacuaccugagagugcuuaauguaucuggcaaccaguugacaacucuggaggaauccguguuucauagcgucgguaaucucgagacccugaucuuagacucgaacccacuggccugcgauuguaggcuuuuguggguguuccggcgacgcuggagacucaauuuuaacaggcaacagcccacaugcgcuaccccugaauuuguucaggggaaagaguucaaggacuucccagaugugcugcuacccaauuauuucacgugucggcgcgccagaaucagggaccguaaagcacagcaagucuuuguggacgaaggacacacuguacaguucguuugccgggcugauggcgacccgccucccgccauucuguggcucucuccacgaaagcaccugguguccgcgaagucaaacggcagacuuacagucuuuccugaugggaccuuggaggugagguacgcccagguccaagacaauggaacuuaucugugcauagcagcuaacgccgguggcaaugauaguaugcccgcucauuuacacgugcgcagcuacuccccagacuggccccaucagccuaacaaaacauucgccuuuaucucuaaccagccaggggagggagaagcaaauagcacccgggccacgguuccguuccccuuugauauuaagacccucaucauagcuacaacuaugggcuucauuucauuucugggugugguacuuuucugucuggucuugcucuuucuguggaguagagggaaaggcaacaccaagcacaauaucgagaucgaauaugugccuaggaaauccgacgcgggaauuagcucugcagaugccccacgcaaguucaacaugaaaaugaucuga

SEQ ID NO: 58459 - RNA, 1821 nt, Artificial Sequence
  derived and/or modified sequence opt3 from LINGO2__Homo_sapiens__XP_011516032
augcugcacaccgccaucagcugcuggcagcccuuccucggccuugcugugguccugauuuuuaugggguccacaauaggauguccugcaagaugcgaguguucugcccaaaacaagucaguuaguugccauaggcggcgcuugaucgcgauuccagaagguaucccgauugagacuaaaaucuuagaccugagcaagaaucgacuaaaauccgugaaccccgaagaguucauaucuuacccucuccuggaagagaucgaucuuucggacaauauuaucgcuaacguagagccaggcgccuuuaauaaccuguucaauuugcguucacucagacugaaggggaacaggcugaaacucgugcccuuaggagucuuuacgggccugagcaaucuuaccaaguuggauauuagugaaaacaagaucgugauacugcuagacuauauguuccaggaucuccacaaucugaaaucccuugagguuggugacaacgaucugguguacauuucucaucgggcauuuagcggguugcucucccuggaacaguuaacacuggagaaguguaaucucacugccgucccuaccgaggcucuuucacaucugcgcaguuugaucagccuacaccugaaacaccucaacauuaauaacaugccaguguaugcauucaagagacuguuucaccuuaaacaucuggaaaucgacuacuggcccuugcucgauaugaugccugccaacucucuguauggauuaaaucugacaucccuaucaguaaccaacacuaaucucagcacaguuccauuccuggcuuuuaagcaccuuguguacuugacccaucugaaccucaguuauaauccgaucucuacgauugaggccggcauguucuccgaccugauaaggcuucaggaacugcacaucgucggcgcgcaauugcggacuauugagccccacagcuuucaggggcuccgcuuccugcgaguguuaaacgugucgcagaaucugcuagaaacccucgaggagaacgucuucucuuccccuagagcacuggaaguucuuucaaucaauaacaauccauuggccugcgauuguaggcugcucuggauacugcagcggcaacccacauuacaguuuggaggucagcagccuaugugcgcuggcccagacacuauucgugagcgcaguuucaaggauuuucauagcaccgcccuguccuucuacuuuacauguaaaaagcccaaaaucagagaaaagaaacuucaacacuugcucguggacgaggggcagaccguacagcuggaaugcucugcagacggagauccgcaaccugugaucagcugggucacgcccaggcggcgauucauuacuacaaagucaaacggccgcgcuaccgugcuaggugacgggacucuggagaucagauuugcccaggaucaggacaguggaauguacguuuguauugcguccaaugccgcaggcaacgauacauucaccgcuagccucacggugaaaggcuuugccucugacagguuccuguaugcuaaucggaccccaauguacaugacagauucaaacgacacuauaaguaacgggaccaaugccaacacauuuagccuugauuugaagacuauccuggucuccaccgcaaugggaugcuucacauuuuuaggugugguacucuucugcuuccugcuucuguuuguuuggucucgcggcaaggggaaacauaaaaauucgauugacuuggaguaugugccuagaaagaacaauggagccgucguggaaggcgaggucgcuggucccaggcguuucaacaugaagaugaucuga

SEQ ID NO: 58460 - RNA, 1782 nt, Artificial Sequence
  derived and/or modified sequence opt3 from LINGO4__Homo_sapiens__NP_001004432
auggacgccgcuaccgcacccaagcaggccuggccuccauggccgccccuccucuuccuucuguuguuaccuggcgggagcggagguuccugcccagcggugugugauugcacaucucaaccccaggcuguccuguguggccacagacagcuagaggccguuccugggggacucccacuggacacugaacuucuggauuugucaggcaacaggcucuggggucugcagcaagggaugcugagucggcucagcuuacugcaggagcuugacuuguccuacaaucagcugucuacgcuagaacccggagcauuucauggccuccagucgcugcuuacccugcgcuugcaaggcaaccgacuccguaucauggggccuggaguguucucaggucugagcgccuuaacacugcucgaucuuagacugaaucagauuguauuguuucuagacggcgcuuucggggagcugggaagucuccagaagcuggaagugggcgauaaccaccuugucuuuguggcaccaggugccuucgcugggcuggccaaguuguccacucucacccuggagaggugcaauuuaucuacaguuccgggacuggcgcuagcacggcuccccgcccugguggcccuucgcuugagagagcuggacauaggcaggcucccugccggcgcacugcgggggcuuggacagcugaaagaauuggagauccaucucuggccaagccuggaggcuuuagaucccgguucccuggucggccuaaaccucucaagucuggccauuacccgcuguaaucuuagcucugugccuuuucaagcguuguaucaccuguccuuccuccgaguacuggacuuaucacagaacccaaucagcgccauucccgcaagaaggcugaguccgcuuguucgguugcaggagcuccgucugucuggggcuugccuaacuuccaucgccgcucaugccuuucacggacugacagcauuccaccuccuggauguggccgacaaugcgcuucaaaccuuggaggaaacggcuuuuccuagccccgauaagcuggucacuuuacgccucucgggcaacccacugaccugugacugcagacuucugugguugcucaggcugcggcgacaucuagacuucgguaugucuccucccgcaugugccgggccacaccaugugcagggcaaaucccugaaggaguuuucagauauacugcccccuggacacuucacaugcaagccagcucugauccgcaaaaguggcccgagaugggugauugccgaagaagggggacacgcagucuucagcuguuccggugacggcgaucccgccccuacuguuucuuggaugaggccacauggggcuuggcuuggacgggccggccgcgugagaguauuggaagacgguacccuggagaucaggagcgugcaguuacgugaucgaggggcauacgucugcgugguuucaaauguggcgggcaacgacagucuccggacauggcuggaggucauucagguggaacccccuaauggaacccuuuccgauccaaacaucacgguacccggcauaccggggccauuuuuccuggacagcagaggaguugcuauggugcuagccgucgguuuucucccuuuccugacuucugugacauugugcuuuggccugauugcauuauggucaaaggggaaaggaagggucaagcaccauaugaccuucgauuuuguggcuccccgcccuaguggcgacaaaaauagcggugggaaccggguuacugcuaaacucuucuga

SEQ ID NO: 58461 - RNA, 2274 nt, Artificial Sequence
  derived and/or modified sequence opt3 from LINS__Homo_sapiens__NP_001035706
augaagguguucugcgagguccuggaggaacucuacaaaaagguucuucugggcgccaccuuggaaaacgacagccacgauuauaucuuuuacuuaaaucccgcuguguccgaccaagauuguucuacagcaacuucacuggagugggccaacacgugcgggauucaaggaagacaucagccuauaaguguagguguggcgccaaucgcugucgccccggugugucuaaaaaccaauagccagauguccggcucuagggaaguuaugcuccugcagcuuacagugauuaaggucaugacuacccggauccugucggugaaaacagaguuccacgcaaaggagcaauaucgcgacguaauuaagaucuugcucgaaucagccaaaguugauagcaagcugauaugcauguuucagaacagugacaaacugcucucccauauggcugcacaguguuuagcccugcuuuuguacuuccagcugcgagagaagaucacccuaucuaauagcuggauugcuuuuugccagaaaaaccucuccgaauauucagagaguaauaaggccaucuacugucuguggacucuuacagcgauuaucaaggagauauucaaagauagcugcucucaaaagaccgaaauucugaaacaguuuuugacgcacuucgacacuaucuuugagguguucuauaacucccucuuuucacagcauuucgaaaauugucgugauaccagcaagauugucaacauccugaugugcuuuuuagaccugcucgagcuucugaucgcaaguaggauucacuugaaacuacacuucacaugucaaagaauacuguuccucaagcccucuugcaugcuggaagugaucacuuggccuauucaggccuuugugaaacggaaggucaucauauuccuuaagaaaugccuguuguguaagguuggggaggaucucugccgcggauccgugccagcucugaugcccccugaccaucacguagccguggauauguuagcacuggcuaaugccguccuacaggcggugaacagcggccuccugaaaacccuuucgguuuacgagaagcauucuuucuucgguggggacgaagugcaaccagagugugaauugauuacaucccccgaccacgucauccugagagccgcaucacucgugaucaugaaaagucuggagauuaaguuucagaauuacagcuccgcuucugaaaugaagguagaucuucagagguucaugagcgagcuguugaccuuucucaaaccucaucugcagccaucauuacaacugcacaacccgugcaaguggcuaagucggguuuucaucgagcaggacgaugacaugcucgaagccgcuaaagccucccugggaauuuaucuuacguugacucgcggcugugaggcaacagaaagccugacccagggcaaggagaugugggaucaccauacucacgaaaauggguacaacccccauugcauauuucucuucuuucugaaaaacaucggauucgacucuacaguguuacuggauuuucuuauuucaagugagaccuguuucuuggaguauuucguccgauaccucaagcugcuacagaaggacugggauaacuuuuucacgaucugcaauaauuuugacgccaccgaaagcaaauaugauaucuccauuugugguugcgugccuucucugguccaagaccagucgagcaaccagacaauaccacacagacucacugcuccccacucccauagggacgugugugcgcggcacucaugggcaagugaugccccuucugagccacugaaggcuguuaugagcaaaggcgcccauaccaugugcgcauccucacuuagcucuccccgugccucccagaguuugguggacuacgauagcucugacgauuccgacguagaaucaacagagcaaugccuggcuaauaguaagcagacuagcuuacaccagcaggccaccaaagagauccaagaugcagcggggacaucgcgcgacaagaaggaauuuucccucgagccgccuucuagaccccugguccuuaaagaauuugauaccgcuuucagcuuugacugugagguggccccaaacgauguugugucagaagucggaauuuucuauaggaucgugaagugcuuucaggagcugcaggacgcaauuugucgguugcagaaaaagaaucucuucccuuacaaccccacugcccugcuaaaacugcucaaguacaucgagguaauaaguaauaaaacgaugaacacacuguga

SEQ ID NO: 58462 - RNA, 1200 nt, Artificial Sequence
  derived and/or modified sequence opt3 from LIPA__Homo_sapiens__NP_000226
augaagaugagauuccugggccucguggucugccuuguucuguggaccuugcacagcgagggguccggagguaaauuaacagccguggaccccgaaacuaacaugaauguaucugagaucauuucauacuggggcuuuccuagugaagaguaucugguggaaacggaggauggguacauacuaugucucaacaggaucccacauggacggaagaaucacagcgacaaaggcccgaagcccgucguguuccugcagcauggucuucuggcugauuccucuaacuggguuaccaauuuggcaaacucgucacucggguuuauucuggccgacgcgggauucgauguguggaugggcaauagccgcggcaacacauggagucgaaaacacaagacucuguccgucucucaagacgaguuuugggcuuucagcuaugaugaaauggccaaguacgaccucccugcauccaucaauuuuauuuuaaacaaaaccgggcaggaacagguguauuacguaggacauucacaggguacaaccaucggcuucauagccuuuagucaaaucccagagcuggcuaagcguauuaaaauguucuuugcacuugggcccguugccagcguggcuuucugcacuucuccuauggccaaguugggaagacugccagaucaccuaaucaaagaccucuuuggcgauaaggaguuccugccccaguccgcguuccuuaaguggcuggguacacacgucuguacccaugugauuuugaaagagcucugcgggaaucugugcuuuuuacuguguggauucaacgaaaggaaucucaacaugucacggguggacgucuauacgacucacagcccugcaggcaccaguguucagaauaugcuucauuggucucaggccgugaaguuucaaaaauuccaggcuuuugauuggggcuccagcgccaagaacuacuuccacuacaaccagucguauccaccgacauacaauguaaaagacaugcuggugcccacugcagucuggucugggggacacgacugguuggcugauguguaugacguuaacauccuacugacccagauaacaaaucucguguuucaugaguccauuccugaaugggagcaccuggauuucaucuggggucuugacgccccauggcgccuguacaacaagauuaucaauuugaugagaaaauaucaauga

SEQ ID NO: 58463 - RNA, 1500 nt, Artificial Sequence
  derived and/or modified sequence opt3 from LIPC__Homo_sapiens__XP_005254429
auggacaccagcccccugugcuucuccauccuccuugugcuguguauuuuuauacagucuucagccuugggccaaaguuuaaagccugagccauucgggagaagggcucaggcagucgaaacaaacaaaacucugcacgagaugaagacgcgguuucuacucuucggagaaaccaaucaggguugccagauccgcauuaaccauccggauacacugcaagaguguggcuuuaauagcucccuuccccugguuaugaucauucacggguggucuguggacggaguauuggaaaacuggaucuggcagaugguggccgcgcucaaaucgcagccugcucagccagucaaugugggccugguugauuggauaacucuggcccaugaccacuacaccaucgcagugcgaaacacacgucucgucgguaaggagguggccgcuuuacugagauggcuugaggaaucaguacaauugagcaggagucauguucaccugauuggguauucccuaggagcacacgugucuggcuucgccggcagcuccaucgggggaacccauaaaauuggucggaucacuggccucgaugcugccgggccccuguuugagggaucagcgccuaguaaucgccuuagcccagacgaugcaaacuucgucgacgccauacacacauuuaccagagaacauaugggccugucuguggguauuaagcagcccaucgggcacuacgauuucuauccuaauggaggcuccuuucagccaggcugccacuucuuggagcucuacaggcauauugcucagcacggguuuaacgccaucacgcaaacuaucaaguguucacaugagcggagcgugcaccuguucauugacaguuuacugcaugcaggaacccagucuauggcuuauccgugcggugauaugaacuccuucagccagggccucugucuuucgugcaaaaaggggcgcuguaauacacugggauaccacguccgacaagaacccagaucuaaauccaagagguuguuucuaguuacucgggcccagucaccuuucaaaguguaucacuaccaguuuaagauacaguucaucaaucaaaccgagacaccaauucagaccacguuuacuaugagucugcucggcacaaaggagaaaaugcagaagauccccauaacccuggguaaagggauugcgagcaacaagacuuacuccuuccuuaucacacuggacguagauaucggcgaauugauuaugaucaaauuuaagugggaaaauucugccgugugggcaaacgucugggacaccgugcagacgauuauaccuuggagcaccggaccacgucauucaggccucguucugaaaacaauccgcgugaaggcuggggagacucaacagagaaugaccuucugcagugagaacacagacgauuuacugcuaaggcccacucaggaaaagauuuuugucaaaugugagaucaaguccaaaaccagcaagcggaaaauccgauga

SEQ ID NO: 58464 - RNA, 3231 nt, Artificial Sequence
  derived and/or modified sequence opt3 from LIPE__Homo_sapiens__NP_005348
auggagcccggcagcaaguccgugucuagaucagacuggcagccugaaccacaccaaaggccgaucacaccccuggagccugggccagagaaaacacccauugcccagccugaaaguaagacucuccagggaagcaacacgcagcaaaaaccagcuuccaaucagcggccccuuacccagcaggaaaccccugcacaacaugaugccgagucucagaaggagccacgcgcgcagcagaaaucggcuucacaagaagaguuccuggccccgcagaagcccgcaccucagcaaagcccauacauacagcgagucuuguuaacucagcaggaagccgcuagucaacagggucccggccuggggaaggaguccaucacccagcaggagccugcacuacgucaaagacacguugcccagccaggacccggcccgggugaaccucccccagcucagcaggaggccgaaucuaccccugcggcacaagccaaacccggggcuaagagggagccaagcgcccccacagaauccacuucacaggagacaccugagcagagugacaaacagaccacgccagugcaaggagcaaagagcaaacagggcucucucacugaacugggcuuucuuaccaagcugcaggaguuguccauucaacggucagcucucgaauggaaggcccugagcgaguggguaacagauagugaaucugaguccgacguggggagcucgucugauacugacuccccggcgaccaugggagguauggucgcccagggcgugaaacugggguucaagggaaaaucaggcuauaagguuaugagugguuacagcgggacaucuccccaugagaaaaccuccgcacgcaaccacagacauuaucaggauacggcuagcaggcucauccacaauauggacuuacggacuaugacacagucacuggugacccuugccgaagauaacauugcauuuuucaguucccaaggaccuggcgagacugcccagcgcuugagcggcgucuuugcaggggugcgagaacaggcccugggacuagagccagcucucgguagacugcuuggcguagcgcaccuguucgacuuggaucccgaaaccccugcaaauggguacaggucucucguucauacagcccggugcugucuggcucacuuacugcauaagucacguuauguggccaguaaccgcagaagcaucuuuuucaggacgucccacaaucucgcagagcuugaggccuaccuggcugccuugacccagcuacgggcacuggucuauuacgcgcaacgacuccuggugacaaaccgcccaggagugcuguuuuucgaaggcgacgagggucuuacugcugacuuuuugagagaauacgucacccuccacaaagggugcuucuauggaaggugucugggcuuucaguucacacccgccauacggccguucuuacagacuaucucuauuggccugguuucguuuggggagcauuacaagcgcaaugagaccggacuaagcguggcagccuccucacucuucacaagugguagauuugcuaucgauccugaacugaggggcgccgaguucgaacguauuacccagaaccuugacguacacuuuuggaaggcauucuggaauaucacugagauggaaguguugucuagccuggcuaacauggccuccgcgacgguccgggugucacgacuccugagccuuccacccgaggccuuugagaugccucugacagcugaucccaccuugacuguuaccauaucuccaccucucgcacauacagggcccggaccagugcuggucagauuaauuuccuaugaccugagggaaggccaagauagugaggaacuaagcucucucaucaaauccaauggucagcgcucacuggagcuuuggccgcggccucagcaagcccccagaaguaggagcuugauugugcacuuccaugggggcggauuuguagcucagaccucgcgcucccacgaaccauaccugaagucuugggcccaggagcucggcgcacccaucaucagcauugacuauucacuggcgccugaggccccauucccccgagcuuuagaagagugcuuuuucgccuacuguugggcaauaaaacacugcgcucugcuugggaguacuggagaacggaucuguuuggccggugauuccgcaggcgggaaccucugcuuuacaguugcccugcgugcugcggccuauggagugagagucccugacggcauuauggcagcuuacccggccacgaugcuacagccagccgcuucucccagcaggcugcucucccugauggauccucuuuugccacugucaguguuaagcaagugugucagugcauacgccggugcgaaaaccgaggaccauucuaauuccgaucaaaaggcucucgggaugaugggccuggugcgccgggacacugcccuucuguugagagauuucaggcucggagcaagcucguggcugaacucauuccuagaacugucuggccgaaagagucagaaaauguccgagcccaucgccgagccuaugcgccggagcguuucugaagcugcacucgcccagccgcaggggccccugggaacagacagccuuaagaacuugacccugagagacuuaucccucaggggcaauucagagacaaguagcgauacuccagaaaugucucuguccgcggagacccuuucaccuaguacgcccagcgacgugaacuuucugcuaccaccugaggaugcuggugaagaggccgaagcuaaaaaugagcucucccccauggaccgugggcugggaguacgcgccgcuuucccagaaggcuuucacccgcggagaucuucgcaaggugccacccagaugccuuuguauagcucacccauagucaagaacccauucaugaguccccuguuagcaccugauuccaugcucaaaucucugccacccgugcauauuguugcuugcgcccuugacccuaugcuggaugacagcgugauguuggcgaggcgacuccggaaucugggccagccggucacacuacgcgugguagaggaucugccacacggguuucuuacucucgccgcacuguguagagagaccaggcaggcugccgaauugugcguggagcggauccgacugguuuuaacacccccugcuggagcaggccccuccggggaaacuggagccgccggcgucgacggugggugcggaggcagacacuga

SEQ ID NO: 58465 - RNA, 1098 nt, Artificial Sequence
  derived and/or modified sequence opt3 from LIPF__Homo_sapiens__NP_001185757
auguggcugcuccuuaccauggccagccugaucuccguguugggcacaacucacggguuauucggaaagcugcaucccgguucuccugaggucacgaugaacauuucacagaugauaaccuacuggggcuauccaaaugaagaguacgaaguugugacagaggacggguauauccuagaaguaaacaggauuccguacggcaaaaagaauaguggaaacacugaugcugguuaugacguguggcucgggaauagcagaggaaacaccugggcacggcgcaaucuguacuauucccccgauucugucgaguuuugggccuucucguuugacgagauggcgaaauacgaucuuccugcuacaaucgacuucauugugaagaaaaccggccaaaagcagcugcacuacguuggccauucacaggggacuacaaucggauuuauagccuucagcaccaacccaaguuuggcaaagcgaaucaaaacguuuuaugcccucgcucccguggcaacugucaaguacaccaaaucccugauuaauaagcugcguuucgugccucagucucucuuuaaauucaucuuuggugauaagauuuucuauccacacaacuuuuucgaccaauucuuagccacagaaguaugcagcagagagaugcugaaucuuuuguguuccaacgcucuguuuaucauaugcggcuucgauucaaagaauuuuaacaccaguaggcuagacguuuaccucagccauaaucccgccgggacuucugugcagaacauguuccacuggacacaggcggucaaauccggaaaguuucaggcauaugauuggggcucaccugugcaaaaccggaugcacuacgaccagagccagccaccguauuacaaugugaccgccaugaacguccccauugcuguuuggaauggugggaaagaucugcuugccgacccucaggacgugggacuguugcucccaaagcugcccaacuuaaucuaccauaaagaaauuccuuucuauaaucaccuggauuuuaucugggcaauggacgcuccacaagagguauacaacgauaucgugaguaugauuucugaggacaagaaauga

SEQ ID NO: 58466 - RNA, 1503 nt, Artificial Sequence
  derived and/or modified sequence opt3 from LIPG__Homo_sapiens__NP_006024
augagcaacuccgugccccugcucugcuucuggucucuuuguuacugcuuugccgcuggcucaccugucccauucgggccggagggaagacuggaagacaaguugcacaaacccaaggcaacccagacagagguuaaaccuagugugagguuuaauuuacggacuagcaaggauccagaacaugaggguuguuaucuguccguaggccacucucaaccccuagaagacugcucguucaacaugacggccaaaaccuuuuucaucauucauggguggacaaugucaggaauauuugagaauuggcuccacaagcuggugagcgcgcuucauacucgcgagaaggaugcuaacgucgugguuguggacuggcugccuuuggcccaccagcucuacaccgaugcagucaauaacacacgagugguaggccacaguaucgcccguaugcuggacuggcugcaggaaaaagaugacuucucccucgguaauguucauuuaauuggguauucucugggagcucacguggcaggcuacgccggcaacuuugucaaggggaccgugggaagaaucacuggucuugauccagcuggccccauguucgagggggccgacauucauaaaagguugagcccugaugacgcggauuuuguggacguccugcacacauauacccgguccuucggacuaucaaucggcauacagaugccaguuggucacaucgacauuuacccgaaugggggagauuuucaacccggcuguggccucaacgacgugcuggggaguaucgcauauggaacgauuacugaaguagugaagugcgagcaugagcgcgccguccaccuuuucguggauagccugguuaaucaggacaaaccuucuuucgcuuuucaguguaccgauuccaacagauucaagaaggguaucugcuugucauguaggaaaaaucggugcaacagcauaggcuacaaugccaagaaaaugcgcaacaagcgaaacaguaaaauguaccucaagacaagagcagggaugccauuuaggguguaucauuaccagaugaaaauucacgucuucucuuauaagaauaugggagaaaucgagcccacuuuuuacgugacccuguauggcacaaacgcugacucccaaaccuuaccucuggaaauuguagagcggaucgaacagaaugccacgaacacuuuccucguuuacacagaggaggaucuuggugaccuguugaagauccagcuaaccugggaaggggcgagccagucgugguauaaucuguggaaagaguuucguucuuaccucucccaaccacgcaaccccggcagagaacugaauauuaggcggauacgagugaagucaggagagacucagcgcaaacuuacauucuguaccgaagauccggagaacacgaguaucagcccuggcagagagcugugguuuaggaagugccgggacggguggcgcaugaaaaaugaaaccucccccacagucgaguugccauga

SEQ ID NO: 58467 - RNA, 1356 nt, Artificial Sequence
  derived and/or modified sequence opt3 from LIPH__Homo_sapiens__NP_640341
augcugagauucuaccucuuuaucagccuucugugcuuguccaggucugacgccgaggaaaccugucccucauucacacgguuaaguuuucacagcgcuguggucggcacugggcugaacguucgccuaaugcucuauacgcgaaagaaucugaccugcgcacagacaauuaacuccucugccuucggaaaucuuaacgugacuaaaaagaccacauuuauaguacaugguuuccguccuaccggcucgccaccgguguggauggaugaccuggucaaaggguugcucucaguggaggauaugaauguuguggucguggacuggaacagaggagcgacuacacugaucuacacccacgcuagcaguaagacgaggaaaguagccaugguucugaaggaauuuauugaucaaaugcucgcagagggcgccuccuuagacgauaucuauaugauuggugugucucugggggcucauaucagcggauucgucggcgaaauguacgacggcuggcuugggcggauaacuggauuggaucccgcagguccucuguuuaauggcaagccacaccaggaccgccuagaucccuccgacgcccaguucguggaugugauccauucagacaccgacgcucucggguauaaagagccucugggaaacauugauuuuuacccaaauggcggucuugaccagcccggguguccuaagacaauccugggaggcuuccaauauuuuaaaugcgaucaccagagaagugucuacuuguaccucagcucucugagggaguccuguacuauuaccgccuauccaugcgacucauaccaggauuaucggaacggcaaguguguuagcugcgggacaagucagaaagaaucuuguccguuacugggauacuaugcggacaauuggaaggaucaccuccgcgguaaggaucccccuaugaccaaagcauucuucgacacggccgaggaauccccauuuugcauguaccauuauuucguggacaucauaacuuggaacaagaauguacgaagaggcgauauuacaaucaaacuuagggacaaggcugggaacaccacugagagcaaaauuaaucacgagcccacaaccuuucaaaaguaccaucaggugucgcuguuggcccgguucaaccaggaccuagauaaagucgcagcuaucucucugauguuuuccacgggaucacucaucggcccucguuacaagcugcgcauucuuagaaugaagcugaggaguuuggcccacccagaacggccccagcucugucgauaugaccugguguuaauggagaacguugaaaccguguuccaaccgauacugugcccugagcuacagcucuga

SEQ ID NO: 58468 - RNA, 1383 nt, Artificial Sequence
  derived and/or modified sequence opt3 from LIPI__Homo_sapiens__NP_001289927
augagaguguacaucuuccugugccucauguguugggucaggagcgacaacaagcggcccugccuugaguuuucccagcugucuguuaaagauucauuccgcgacuuguuuauuccucgaauagaaaccaucuuaaugauguauacacguaauaaccugaauugugccgagccacuauucgaacaaaacaauagucucaacgugaauuuuaacacucagaagaaaacgguauggcugauucacggcuacagaccgguggggagcaucccccuuuggcugcagaauuucgucaggauuuugcucaacgaggaagauaugaaugugaucguuguggacuggucccggggagcuaccacauuuauauauaaccgcgcagucaagaauacuagaaaaguggccguaucucugucgguucauaucaagaaccugcucaagcacggugcgucauuagauaauuuccauuuuauuggcgugagccugggggcucacaucaguggauucgucggcaaaauuuuucauggucagcuugggaggaucaccggauuggacccugccggcccacgguucucccgcaagcccccuuacucucgacuggauuauacagacgcaaaauuuguggaugugauacacagcgacuccaacggccuagggauucaagagccacucggacacaucgauuucuaccccaacgguggcaauaagcagccugggugcccaaaaucaauuuucaguggaauccaguuuaucaaguguaaccaucagagagccguccaccuguucauggcuagccuugagaccaauugcaacuuuauuucuuucccguguagguccuauaaggacuacaaaacuucacugugcguugauugugacugcuuuaaggaaaagagcuguccccgguugggcuaccaagcaaaacucuucaaaggugugcugaaggagcguauggaagggcgcccuuuaagaacaaccguauuucuggacacgaguggaacuuauccauucugcaccuacuauuuugugcucucuauaaucguccccgauaaaacaaugauggacggcuccuucagcuuuaaacuucugaaucaguugggcaugauugaggagccuaggcuauacgaaaagaacaagccauucuauaagcugcaggaggugaaaauccucgcccaguuuuacaaugauuucguuaacauaucgucuauugggcugacuuauuuccaauccucaaaucuucagugcaguaccuguacauacaagauccagagccugauguugaaaucccucaccuaccccgaacggccgccucugugccgauauaacaucguguuaaaggaccgcgaggaagucuuucugaaucccaacacguguacuccaaagaauacauga

SEQ ID NO: 58469 - RNA, 1197 nt, Artificial Sequence
  derived and/or modified sequence opt3 from LIPN__Homo_sapiens__NP_001095939
augauguggcugcuccuuaccacaacuugccugaucuguggcacguugaacgccgggggauucuuagaccuggagaaugaagugaaccccgaggucuggaugaauaccagcgaaauuauaaucuacaacgguuauccuuccgaggaauacgagguuacaacugaggauggcuauauucuacucgugaauagaaucccauacgggaggacccacgcucggucuacaggaccgcgccccguaguguauaugcagcaugcacuguuugccgacaacgcguacuggcuugaaaauuaugcuaacggcucacuggguuucuugcucgccgaugcaggguacgacgucuggaugggaaauagucgaggcaacaccuggagccguagacacaagacucuguccgagacagaugaaaaauuuugggccuucucuuuugacgagauggcuaaguacgaucugccuggcgugauugacuucaucguuaauaaaaccgggcaagagaagcucuauuuuauaggacauucguuagguacgacuaucggcuucguggcauuuucaaccaugccagaacuggcccagaggauuaaaaugaacuucgcucuugggcccacaaucagcuuuaaguacccuacuggaauuuucacccgguuuuucuugcugccaaauaguaucauaaaggccgucuucggcacaaaaggguuuuuccuagaggauaagaaaaccaagauugcguccacgaaaaucugcaacaauaagauucucuggcugaucuguucugaauuuaugagccuuugggcagguuccaacaagaaaaacaugaaucagucacgcauggacguguauaugagucacgcccccacuggaagcucuguacauaacauccugcacauuaagcaguuguaccacuccgaugaguucagagcuuaugacuggggcaaugaugccgacaacaugaaacauuacaaucaaucacacccuccaauauaugaccucacagcaaugaagguuccgaccgcuaucugggccggcgggcaugaugugcuggucacuccccaggacguggcgaggauuuuaccucagaucaaaagccugcacuacuuuaagcuccuuccagauuggaaccacuucgacuuuguguggggacuggaugcuccccagcggauguacagugaaauaauugcauugaugaaagccuauucuuga

SEQ ID NO: 58470 - RNA, 1122 nt, Artificial Sequence
  derived and/or modified sequence opt3 from LIPT1__Homo_sapiens__NP_057013
augcugauccccuucagcaugaagaacugcuuucagcuccuuuguaauugccaagugccugccgcuggcuucaaaaagaccgucaaaaacgggcugauuuugcaguccauaucuaaugacguuuaccagaacuuagcaguggaggauuggauccacgaccauaugaaucuggaaggaaagccaauucuauuuuucuggcagaacucaccgaguguagugaucgguagacaccaaaaucccuggcaggaguguaaccucaaucugaugagggaagagggcauuaaacuugcccggcgccgaagcgggggaggcacagucuaucaugauauggguaacaucaaucugacguuuuucacuaccaagaagaaauacgaccguauggaaaacuugaagcucauagugagagcgcugaaugcuguucagccucagcuggaugugcaagccacaaaaagguuugaccucuuacuggaugggcaguucaagaucuccggaacugcaucuaaaauuggccggaccacagccuaucaccauugcacccuuuuguguucgacugacggcacauuucugucaagccuacucaagaguccauaccaggggauccgcuccaacgcuaccgcaucuauucccagccuggucaagaaucuucuggagaaagauccuacguugacuugcgaggugcucaugaacgccguagcuaccgaauaugccgcguaccaccagaucgacaaccacauacaucugauuaauccaacagaugagacuuuauuccccggaaucaacuccaaggcaaaagaacugcaaaccugggaguggauuuaugguaagacaccuaaauuuucaaucaauaccaguuuccacguucucuacgagcagagccaucuugaaaucaagguguuuauugacaucaaaaacggcagaauagagauuuguaauaucgaagccccagaucacuggcugccguuggagauaagggacaagcuaaacucuucccugauugggucaaaguucugccccacggaaacuacaaugcucaccaauauccugcuucggacuuguccucaggaccacaaacugaacagcaaguggaauaucuugugcgagaaaauuaagggaaucauguga

SEQ ID NO: 58471 - RNA, 696 nt, Artificial Sequence
  derived and/or modified sequence opt3 from LIPT2__Homo_sapiens__NP_001138341
augagacagcccgccgugaggcugguccggcucggccgcguuccuuacgcugagcuucugggguugcaagaccgaugguuacguagacugcaggcagaaccaggaaucgaggccccgagcgguaccgaagcgggcgcucuacuccugugcgagcccgccgggccuguguauacagcaggacuuaggggcggucugacuccagaagagacggcccgguugcgcgcucucggggcagagguaagagugaccggaaggggcggccuggccacauuccacgggcccggacagcugcucugucauccugucuuagaucugcggcgccuugguuugcgacugagaaugcacguggcuucccuagaagccugcgcgguuaggcucugugagcugcagggccuucaagacgcacgggcccguccacccccuuacacugggguguggcuggaugaccgcaagauuugcgcuauaggagucagauguggcaggcauaucaccucucacgguuuggcccucaacugcucaacagaucugaccugguuugaacauauugugccauguggguuaguaggaacuggcguuacaagucugagcaaagagcuccagcggcacgugaccgucgaggaagugaugccgcccuuccuuguggcauuuaaggagaucuauaaaugcacgcugauuuccgaagacucuccuaauuga

SEQ ID NO: 58472 - RNA, 459 nt, Artificial Sequence
  derived and/or modified sequence opt3 from LITAF__Homo_sapiens__NP_001129945
augagcgugcccggcccuuaccaggccgcuaccgggccauccucugcaccgucagcgcccccuaguuaugaggaaacagucgccguuaacagcuacuauccaacucccccugcuccaaugcccggaccuacgaccggucuggugacaggcccagacgggaagggaaugaauccgcccuccuacuauacucaaccugccccaauccccaacaauaacccuauuaccguacagacaguguacguccagcacccaauaaccuuccucgauagacccauccagaugugcuguccgucuugcaauaaaaugauugugucgcaacuuucauauaacgcaggcgcccugacuugguugagcugugguaguuuaugccugcuagggcaggaguguuccggaacaaucguugcucucaggucuuuugaccugcuuggcagcugcaauccucccuccucagcaaguuga

SEQ ID NO: 58473 - RNA, 849 nt, Artificial Sequence
  derived and/or modified sequence opt3 from LIX1__Homo_sapiens__NP_694966
auggacagaacccuggagagccucaggcacaucauugcccaggugcuuccccaucgggauccugcucuggucuucaaggacuugaacguuguguccauguuacaagaauuuugggagucuaaacagcagcagaaggcagccuucccaucagaaggcguaguggucuacgagagucugccggcgcccgggccuccauuugugagcuauguuacacuacccggagguuccugcuucggcaauuuucaauguugccucucucgcgcugaagcccgacgugaugcagccaaaguggcucugauaaacucgcuuuucaaugagcugccuucaagaaggaucacuaaggaguuuauuauggaaagcguccaggaggcaguggccaguacguccgggaccuuggacgaugcugacgauccaucuacaagcguaggagccuaccacuauaugcucgaauccaacaugggcaaaacuaugcuggaguuccaggagcugaugaccaucuuucagcucuuacauuggaaugguucacugaaggcgcuucgggaaacaaaguguagucgccaagagguuauuagcuacuauucucaguacuccuuggacgagaaaaugagaucacacauggcacuggauuggaucaugaaggaaagggacagccccgggauagugagucaggaacuacggauggcccuccgccagcuggaggaggcucgaaaagccggacaagaacuuagauucuauaaggagaaaaaggaaauccugucuuuggcacucacccagauuugcuccgauccugacacuagcucgccaucugaugaccagcuguccuuaacagcucuguguggcuaccauuga

SEQ ID NO: 58474 - RNA, 3195 nt, Artificial Sequence
  derived and/or modified sequence opt3 from LLGL1__Homo_sapiens__NP_004131
augaugaaguucagauuuaggcggcagggcgccgacccccaacgcgagaaacugaagcaggaacucuucgcuuuuaacaaaaccguggagcacggguucccuaaucagccaagcgcacuugccuuugauccggaacugcgaaucauggcgauuggaacacguuccggugcugucaagauauacggcgcccccgggguugaguucacuggauugcauagagacgcagccacggugacccagaugcacuuuuuaacaggccaagguaggcugcuaucucuccuggaugacucaagucuucaucugugggaaaucguacaccauaacgggugcgcucacuuggaggaggcacucagcuuccagcugccuucccggccaggauuugauggcgccucugcuccccugucgcucacucgcgugaccgucguguuacugguugccgcgggcgacauugcagcccuugggacagaaggaucaagcguguucuuuuuggaugucaccacucugacacuacucgagggucagacccuggcuccuggcgaagugcuuagaaguguaccagacgauuauaggugugggaaagcccugggacccguugaguccuugcagggccaccuccgggacccuacgaagauccugauugguuacucucgcggguuacuggugaucuggaaucaagcaagccagugcgucgaucauauauuccucggaaaccagcagcuugagucccuguguuggggccgagacucaaguacuguggugagcucucacuccgauggcucauaugcugucuggagcguugacgccgggaguuuuccaaccuugcaaccgacaguggcgacuacccccuacggaccuuucccaugcaaggccaucaauaaaauucuauggagaaacugugaaucugguggccauuucaucaucuuuuccgggggaaugcccagggcaagcuauggcgaccggcacugcguaucggugcugcgugcugagacacucgucacccuggauuucacgucucgcauuauagacuuuuucacugugcacuccacaagaccugaagaugaguuugacgauccacaggcccuugcuguucuguuggaagaggagcucgugguccuggacuuacagacccccgguuggccggccgugccugcacccuaccuggccccacuacauucaagugcuauuacuuguagcgcgcacguagcauccguuccugccaagcucugggcuaggaucgugucugccggggaacaacagagcccccagccagucucaagugcacuguccuggcccauuacaggcggacggaaucuugcccaggagccuagccaacgaggcuugcugcucaccgggcaugaagauggaacggugcgcuucugggacgcuucuggugucgcccugagaccacuuuauaaacugucaaccgcaggcuuguuucagacagauugcgagcacgcggacagucucgcucaggccgcagaagaugacuggccgcccuucaggaaggugggguguuuugacccuuacagcgaugacccacggcugggaguucagaaaguggccuuaugcaaguacacugcucaaaugguagucgccggcaccgcaggucaggugcugguucuagagcucuccgaugugcccgucgagcaggcugugucuguagccaucaucgaccugcuucaggaucgcgaaggguucacauggaagggccaugagagauugucgccuaggacuggaccacugcccuggccggcgggcuuucaaccucgugugcucguucagugucugccacccgccgcugucaccgcagugacauuacacaccgaauggagccugguggccuucgggacuucccacggauuuggucuuuucgacuaucagcggaaaucaccugucuuggcucgaugcacgcuccaucccaacgauagucuggccauggagggcccacuaucuagaguuaagagccugaaaaagucccucaggcagucauuccgccggauuagaaaaagcagggugucugggaagaaacgcgcagcgaaugccuccaguaagcugcaagaagcuaacgcccagcuugcagagcaggcuugcccucacgacguggagaugacacccguacaacgacggauagaaccacguagcgccgaugacucuuuguccggagucgugagaugucuguacuuugcagauaccuucuuaagggacggcgcccaucacgguccgacuaugugggcugggaccaauucaggcaguguuuuugcguaugcccucgaggugccugcagcugccgucggaggcgaaaagcgccccgagcaggccguggaggcuguucuggggaaagaagugcagcuuaugcaccgggcaccaguagucgccaucgcggugcuggauggaagaggcaggcccuugccugagccauacgaagcuagccgagaccucgcccaggcacccgacaugcaaggugggcaugccgugcugauugcuucggaggaacaguucaaggucuuuacacuaccuaaaguuuccgcaaagaccaaauucaagcugacugcccacgagggaugccgcgugcggaagguagcgcucgcuacauuugccucuguggcaugugaggauuaugccgaaacgugccuggcuugucuuaccaacuugggcgacguccauguguucagcguuccgggucugagaccacaggugcacuacucaugcaucaggaaagaggauauaaguggcauugccuccugugucuuuacucgucaugggcagggauucuauuuaaucucucccagcgaauuugagcgcuucucccucucagcacggaauaucacagaaccucugugcagccuugacauuaacuggccaagagaugcuacccaagccaguuacaggauccgagagucucccaagcugucccaggcgaauggcacaccuagcauucuacucgccccgcagucgcuggacgggucacccgauccagcacacucuaugggaccugacacucccgagccaccugaagcugccuugagucccauguccauagauagcgcuaccucugcagacacgacccuggauacaacuggcgacgugaccguugaggaugugaaagacuuuuuagguagcuccgaagagucagaaaagaaccuccggaaccuggccgaggacgaggcccacgcuugugcgauccuuauuaaauga

SEQ ID NO: 58475 - RNA, 1071 nt, Artificial Sequence
  derived and/or modified sequence opt3 from LLGL2__Homo_sapiens__NP_001015002
augagaagguuccugcggcccggccacgacccugugcgcgagcgacucaagcgugaucuuuuucaguucaacaaaaccgucgaacauggguuuccacaccaaccgagcgcccugggauacucccccucuuugagaaucuuagcuauugguacaaggucaggcgcaauaaagcuguauggggccccuggaguugaguucaugggccuacaucaggaaaauaacgcggugacucagauccaccuccugccaggucagugccaacuuguaacgcuguuggacgauaauagucuccaucuguggagccugaaagugaagggcggagcuuccgagcuccaggaagacgagucuuuuaccuuacgggggcccccuggcgccgcaccaucggccacacagauuacugucgugcugccccacucaagcugugagcuuuuguaccuggggaccgaaaguggaaacguuuucgugguccagcuaccugcuuuucgcgcacucgaggauagaacaaucuccucugacgccgugcugcaaaggcuuccagaagaggcucggcaccgccgaguauucgagaugguugaagcccugcaggagcauccgagagaucccaaucagauuuugaucgguuauagcaggggccucguggucauaugggaccugcaggggucccggguguuauaccacuuucugucaagucaacagcucgaaaacaucugguggcagcgugauggacgccuucuggugagcugccauucugacggcuccuauugucaauggccugucucaagcgaggcgcagcagccagaacccuugagaagucuaguuccuuacgguccauuccccugcaaagcaauuaccaggauccuguggcucacuacacggcaggggcugccguuuaccauuuuccaaggaggcaugccucgagccucuuauggcgaucgccacuguaucuccgugauacacgacgggcagcagacggcuuuugauuucacuagcagaguaauuggauucaccgugcuuacagaggccgaccccgcagcuucgaggcgggccucuggugucggcgcgcagggguga

SEQ ID NO: 58476 - RNA, 1533 nt, Artificial Sequence
  derived and/or modified sequence opt3 from LMAN1__Homo_sapiens__NP_005561
auggccggcagcagacagagggggcugcgggcucgcgugcgaccccucuucugcgcacuucuguuguccuuaggacguuuugucagaggugacggcguugggggagauccugccguggcgcugccacacaggcgguucgaguacaaguauucuuuuaaaggcccgcaucuaguacaaucagacgguaccgugcccuucugggcucacgccgggaacgcaaucccuaguagcgaucagauucgcgucgccccaucccucaagucucagagaggaucgguguggacaaaaacuaaggcugcauuugaaaauugggagguugaagugacguucagggucaccggccggggccgcauaggggccgacggacuggcuaucugguacgccgagaaccagggucuugaaggccccguguuugggucagcggaucuguggaauggaguaggcauuuucuuugacagcuucgauaacgacgguaaaaagaauaacccugcaaucguuauuaucgggaauaacggacaaauacauuaugaucaccagaaugacggcgccagucaggcuuuggccuccugucagcgagauuuuagaaacaagccauaccccgugagggcaaaaaucacauauuaccaaaauacucucaccgucaugauuaacaauggcuucacaccugacaagaacgauuaugaguuuugcgcuaaaguggagaauaugaucauuccagcccaggggcauuucggaaucucugcggccaccgguggccuggcagacgaccacgaugugcugagcuuccucacuuuucaguuaacagaaccggggaaggagcccccuaccccagacaaagaaauauccgagaaggagaaggaaaaauaccaggaggaguucgaacacuuucaacaggaacuggauaagaaaaaggaggaguuccagaaaggacaucccgaccuucaaggccagccugcugaagagauuuuugaaucagucggugaucgggaguugcgucagguuuucgaagggcagaaccgcauccaccuggagauuaagcaacuaaacagacagcucgacaugauccuggaugagcagaggcgguacgugaguagccuuacggaagagaucucuaaacgaggcgccggaaugccaggccagcaugggcaaauuacucagcaggaacuggacaccguagugaagacacagcacgagauauugcgccaagucaaugaaaugaagaacuccaugucagagacugugagacucguuagcggaaugcagcaccccgguagugcuggcgggguguaugagaccacacagcauuuuaucgauauuaaagaacaucugcacaucgucaagagggacauagauaauuuagugcagcggaacaugccgucuaaugagaaaccuaagugucccgaacugccaccuuuccccuccugccucagcaccguacacuuuauuaucuucguugugguccaaacggugcuuuuuaucggauacauuauguaucgcucgcagcaggaggccgcagccaaaaaguucuuuuga

SEQ ID NO: 58477 - RNA, 1581 nt, Artificial Sequence
  derived and/or modified sequence opt3 from LMAN1L__Homo_sapiens__NP_068591
augcccgccgugagcggcccugggccacuguucugccuccuucuguuguuacuggacccgcacucccccgagaccggauguccuccacuaagaagguuugaauacaagcucucuuucaaagguccccggcuggcacuuccuggcgcugggaucccauuuuggucacaucacggagaugccauucugggcuuggaggaaguccgccucacacccaguaugcgaaaccguagcggugcgguuugguccagagcuucugugccuuucucggccugggagguagaagugcagaugagggucacugggcugggacggcgcggcgcacaaggcauggccgugugguauacgagagggaggggacauguugguucagugcugggcgggcucgcuagcugggacggaauaggcaucuuuuucgauaguccagcagaggacacccaggauuccccggccauucgggucuuagcuucugacggucacauccccagcgagcagccuggggauggagccucccagggccugggcucaugccauugggacuuucgcaaucgaccacaccccuucagagcgaggauuacauacugggggcaacggcuucguaugaguuugaacagcggacugacuccuucugauccaggugaauuuuguguggacguaggcccccuacuccugguucccgggggauucuuuggcguguccgcagccaccgguacacuugcugaugaccacgauguccugucauucuugaccuuuagccucagugagccuucucccgaagugccaccucagcccuuccuggagaugcagcaguuacgccuggccagacaacucgaggggcuuugggcaaggcugggcuugggaacucgggaagacgugacaccaaaguccgacagcgaggcucagggcgaaggggagcgacuauucgaucuggaagagacccucggacgccauagaaggauccugcaggcccuucggggucugucgaaacaguuggcgcaagccgagcgccaguggaagaaacagcucggcccgccugggcaagcaagaccagacggaggcugggcucuggaugccucuugccagauaccguccacgcccggucgugggggccacuuaucaaugagucugaauaaggacagcgcuaaggucggagcccuacuccauggccaguggacucugcuucaggcauugcaagaaaugagggaugccgcuguucggauggcggcagaggcccagguguccuaucugccuguagggaucgaacaccacuuucucgagcuggaccauauucuuggacuguugcaggaggaacuccgagguccagcuaaagccgcagccaaggcucccagaccuccaggccagcccccgagggccucuagcugucugcaaccugggaucuucuuauuuuaccugcuaauucagaccgugggauucuuuggcuauguccacuuccgccaggagcucaacaaaucacugcaggaaugccuuaguacagguuccuugccacuggggcccgcaccucauacuccccgggcgcucggcauccugagaaggcaaccauuaccugcuagcaugcccgccuga

SEQ ID NO: 58478 - RNA, 1080 nt, Artificial Sequence
  derived and/or modified sequence opt3 from LMAN2L__Homo_sapiens__NP_001135764
auggccgcuacccugggcccccucgggagcuggcagcaauggagaaggugccuuuccgcacgggacggaucucgcaugcuguuguuacugcuacuccuggguucaggccaggggccucaacaggugggagccggccagacauucgaguaccuuaagcgagaacacagucugagcaaaccauaucagggugucgggacuggauccucuucguuguggaaccucaugggcaaugcgaugguuaugacgcaguacauccgucugaccccggauaugcagucaaagcaaggcgcucuguggaacagagugcccuguuuucucagggacugggaguuacagguacauuucaaaauucacgggcagggaaagaaaaaucugcauggugauggccuugccauaugguauacaaaggaccggaugcagccugggccaguguuuggaaacauggauaaguucgucggcuuggguguguuuguugacacuuaccccaaugaagagaaacaacaggaagcacagaagcgcagauauagcccuggggugcaaagggucuucccauacaucagugccauggugaacaauggaucccugucuuaugaucacgagcgggacggccgccccaccgagcuaggcgggugcacagcuauuguacgaaaccuccauuacgauaccuuucugguuaucagauacgugaaaaggcaccuuacuauuaugauggacaucgauggaaagcacgaauggcgggacuguauagaggucccuggugugcgucugccacgcggcuauuacuucgggacaagcuccaucaccggagauuugucagacaaucaugacgugauuagucucaaacuguuugaauuaacggucgagagaacuccggaggaagagaagcugcacagggauguuuuccuccccagcguggacaacaugaaacuuccugaaaugaccgcaccacugcccccuuugucuggccuagcccuguuucucaucguauucuuuucccugguguucucagucuucgcuauugugaucgguauaauucuuuauaauaaguggcaggagcagagccggaagcgauuuuacuga

SEQ ID NO: 58479 - RNA, 1473 nt, Artificial Sequence
  derived and/or modified sequence opt3 from LMBR1__Homo_sapiens__NP_071903
auggagggccaggacgaagugagcgccagagagcaacacuuccauucccaggucagggaaucuaccaucugcuuucuguuguucgcuauucuuuacguugugucauauuuuauaaucacacgguacaagcgcaaaagugaugagcaggaagacgaggaugcaauuguaaaccgaaucagccuguucuuguccacuuuuacguuagccgugucugcgggggcuguccugcuacuccccuucucgauuaucucaaaugagauacugcuuagcuuuccucagaacuauuacauccaauggcugaauggaaguuugauucacggucucuggaaccuggccucccuguucucuaaucucuguuuauuugugcugaugccauucgcauuuuucuuucuugaaagcgagggcuucgccggguugaagaaaggaauccgugcuaggauucuggaaacccuaguuaugcuccugcuucuggcauugcucauccugggcauagugugggucgccuccgcuuuaauugacaacgaugccgcgucaauggagagucuguaugaccucugggaguucuaccuuccguaucuguacagcugcaucucuuugauggguugucuacugcuccugcuuugcacacccguggggcuguccagaauguuuacuguaaugggacaguugcucguuaagccuaccauucuggaagauuuagacgagcagaucuacaucauuacacuggaagaggaagcacuacagcggcgccucaauggccugucaagcaguguggaguauaacauaauggagcuugaacaagaguuggaaaaugucaaaacccugaagacuaagcucgagagaaggaaaaaggccucugcuugggaacggaaccugguguacccagccgugaugguccuucuguugaucgagacauccauuagcguucuccugguggcauguaauaucuuaugccugcuaguagaugagaccgcuaugcccaaaggcacgcgcgggccuggaauagguaacgccucgcucucuacuuucggcuuugugggggcggcccuggaaauuauccuuaucuucuauuugauggucuccucagugguuggauuuuacagucugcgauucuuuggcaauuucaccccaaagaaagacgauacaacuaugaccaagauuaucgguaacugugugagcauucucguccuguccucugcauuacccgugaugagcagaacacuggggauaaccagguuugaccuuuugggagauuucggccgguuuaauuggcucggcaacuucuauaucguacugucauacaaccuacuguuugcuauuguuacgacucucugccuggugcguaaguucacaagugccguccgcgaggaacuuuucaaagcucucgggcugcauaaguuacaccucccuaauaccuccagagacagcgagacugccaaaccaucugugaacggacaucagaaggcacuguga

SEQ ID NO: 58480 - RNA, 1623 nt, Artificial Sequence
  derived and/or modified sequence opt3 from LMBRD1__Homo_sapiens__NP_060838
auggccaccagcggcgcugcauccgccgagcuggugaucggguggugcauuuucggacuccuucuguuggcgauauuagcuuuuuguuggaucuacgucagaaaguaucagucuaggcgggaaucagagguugugaguacaauuacugccaucuucagccuggcaauugcccuaaucacguccgcucuccugcccguagacauauuucuugugucuuacaugaaaaaccaaaaugguaccuucaaggauugggcaaacgccaaugucucgcgccagaucgaagacacagugcuguauggcuacuauacuuuguacucaguuauucucuuuugcguguucuuuuggaucccuuucgucuauuuuuacuacgaggaaaaagaugacgaugacaccagcaaguguacacagauuaaaaccgcucugaaguauacucugggguucgugguaaucugcgcccucuuacugcuuguuggagcguuugugccauugaacgucccgaauaacaagaauaguacagagugggagaaagugaagucccuguucgaggaacuaggcucuagccacggucucgcagcccuguccuuuucaauaaguagccuuacccugauugggauguuggcugccaucacguacacugcauauggaaugucugcucucccccugaacuuaauuaaaggcacccgauccgccgcguacgaacgucuggagaauacagaggauaucgaagagguggaacagcauauccaaacuauuaagucaaaaagcaaggacggcagaccucucccagccagggauaagcgggcacuuaaacaguucgaggaacgccugagaaccuugaagaaaagggagcggcaccuagaguucauagaaaacaguugguggacaaaguuuuguggggcucugcgcccccucaaaaucgucuggggaauuuucuuuauccugguugcccuucuguucgugauaucuuuguuucucuccaaucuggacaaggcuuuacauagcgccgguauugauucgggcuucaucaucuuuggggcaaaccugucuaauccucuaaacaugcuccugccacuuuugcagaccguauucccccuggacuauauucucaucacgauuauaaucauguacuuuauuuucacuuccauggccggaauccgaaauaucggcauuugguuuuucuggauaagacuguauaaaaucaggcggggucguacacgcccucaggcgcuucuguuuuugugcaugauucuccuguuaaucgugcugcacaccucauacaugauuuacagucuagcuccacaauaugucauguacgggagccagaacuaucucaucgagacuaacauaacauccgauaaucauaagggaaacucuacccugagcgugccgaagagaugugacgcagacgcccccgaagaucagugcacgguuaccaggacauaccuuuucuugcacaaauucugguuuuucucagcugccuauuacuuuggcaauugggcauuccugggcguguuucucaucgggcugauugucaguuguugcaaggguaaaaaguccgugaucgagggaguagacgaagauagcgacauuucugaugacgagccuucaguuuauagugccuga

SEQ ID NO: 58481 - RNA, 2088 nt, Artificial Sequence
  derived and/or modified sequence opt3 from LMBRD2__Homo_sapiens__NP_001007528
augagcggcgccgcucuggggcucgagaucguguucgucuuuuuccuugcacuguuuuuguuacacagauacggagacuucaagaaacagcauaggcugguuauuauagguacccuacucgccugguaucugugcuuucuuaucguguucauucugcccuuggauguauccacaacuaucuacaaccgguguaagcacgcggcugccaauucuucaccuccagaaaacaguaauauuacgggccucuaugcaaccgccaacccggugcccagccaacauccuugcuuuaaaccaugguccuacauccccgacgggauaaugccuaucuucuggcgcgucguguauuggacaucucaguuucugacuuggauucugcucccauucaugcagucguacgcucgaucaggaggcuuuagcaucaccgguaagauuaaaacagcauuaaucgagaaugccauauauuacgggaccuaccugcuuauuuucggagcauuuuugaucuauguugccgugaacccccaucugcaccuagaauggaaucagcuccaaacuauuggcaucgcggcagccaacacauggggccuguuccuucuggucuugcuccugggguacggauuaguggagaucccucguaguuauuggaauggugcuaagagaggcuaccugcucaugaagaccuauuucaaagccgcaaaacuuaugacggaaaaagcugaugccgaggagaaccuggaagacgcgauggaggaaguaaggaagguuaaugaguccauuaaauacaaccacccauugcggaaguguguggauacuauacuaaagaaaugcccgaccgaguaucaggaaaagauggggcgcaauauggacgauuacgaggacuuugaugaaaaacacucuaucuaccccagcgagaagucccuggucaaacuccauaaacaggugauuuauucagugcagagacacaggcggacacaaguccaguggcagauccugcuugaacaggccuucuaccuggaggacguugcuaagaacgagaccagugcuacccaucaauuugugcacacauuccagagcccugaaccagagaaucgcuuuauacaguauuucuacaaccccaccuuugaaugguauugggaguguuugcuccgaccuugguucuacaagauucuggccguaguguuaucuaucuuuuccgucaucgugguuuggucagaaugcacguucuuuagcacuacaccagugcugagucuauucgcugucuuuauucaacucgccgagaagaccuauaacuacaucuacauugagauagcauguuuccugucuaucuucuuucuuuccauuugcguguauagcacuguauucagaaucaggguuuuuaauuacuauuacuuggccucgcaccaucagacagaugcuuauucuuuacucuucuccggaaugcuguuuugucggcuuacucccccgcugugcuugaacuuccucggccugacgcacauggacucaaguaucagccauaaaaauacccagccuacagcguacacuuccauuauggguucuaugaaggugcugagcuuuauagcagauggguucuauaucuacuaccccaugcuggucgugauucuauguaucgccaccuauuuuucacucggaacacguugccugaaccuuuugggcuuccagcaauuuaugggcgacgacgauaugaccagugaccuggucaaugaagggaaagagcucauucgcaaggaaaagagaaagaggcagcggcaggaggaaggagagaaccgacgcagagaguggaaggaaagguacggucacaaucgggaggauuccacucgcaacagaaauauccauacagacccaaaagaaagcaacuucucugaugugaauaccaacaggucagcuuuuaaguauacucgugccaauaaccggacggagcgagacagaauagagcuguuacaggaugcagaaccucuggacuucaaugccgagacauucaccgaugacccccuugaaagugagagcggcagguaccaaccagggggacgcuauuuguccaugucucggucggauaucuuuaacgacguuuga

SEQ ID NO: 58482 - RNA, 879 nt, Artificial Sequence
  derived and/or modified sequence opt3 from LMCD1__Homo_sapiens__NP_001265162
auggacagcaaguacuccacccugacagccagagugaaaggcggggauggaaucaggauuuauaagcggaaccgcaugauaaugacuaaucccaucgcuacggguaaagacccuaccuucgauacaauuacuuacgagugggcaccaccgggcgucacccagaagcucgggcuucaauauauggaacugauccccaaagagaagcagccuguuacaggaaccgaaggcgccuuuuaccgacguagacaguugaugcaccaguuaccaauuuaugaccaagaucccucuaggugccggggucugcuagagaacgaacucaagcugauggaggaguucgugaaacaguacaagucagaagcgcuugggguaggagagguggcucugccuggccagggcggguugccaaaagaagagggaaagcagcaagagaaacccgaaggugccgagacuacagcagccaccacgaauggcagucucagcgacccuuccaaggaagucgaguaugugugugaacugugcaagggggcugcaccaccggauucucccguuguguacucggaccgcgccggauacaacaaacaguggcauccuacuuguuuugucugcgcuaaguguucagagccacugguggaucucaucuauuucuggaaagacggcgcccccuggugcgguagacacuacugugagagcuuaaggccucggugcagugggugugaugaaauaaucuuugcggaggacuaucagcgcguagaagaucuggcauggcaucgaaagcacuucguuugcgagggaugugaacagcuuuuguccggcagagccuacauugugaccaaaggccaacugcuaugcccaacaugcucuaagagcaaaagguccuga

SEQ ID NO: 58483 - RNA, 1704 nt, Artificial Sequence
  derived and/or modified sequence opt3 from LMF1__Homo_sapiens__NP_073610
augagacccgacagcccuaccauggccgcuccagcagagucccugaggcggcgcaagacaggcuacucugauccggaacccgagucaccuccagcccccgggcgaggaccugcggguaguccagcucaccuccauacuggcacguucuggcuuacccguaucgugcuguugaaagccuuagcauuugucuauuucguugccuuucugguggcuuuccaccagaacaagcaacuaauuggggacagaggacuccugcccugcaggguauuucuuaaaaauuuccagcaguacuuucaggaucggacaagcugggaaguguucuccuauaugccuacuauacugugguugauggacuggucugauaugaacucgaaucucgaccugcuggcacucuuaggccuggguaucagcucauuuguccuuauuaccgggugugccaacauguugcugauggcugcccuauggggacucuacaugagucuggugaauguuggccaugugugguauuccuucggcugggagucucaacuucuggaaacaggguuuuugggaaucuuccucugcccacuguggaccuuaagccgccugccgcagcacacucccacauccagaauuguccucugggguuuuagguggcuuaucuuccggauaaugcugggcgcgggguugaucaagauucgcggagaucgauguuggagagaccuaaccugcauggauuuccauuacgagacgcagccuaugccaaaccccguggcauauuaccugcaccacucaccuuggugguuucauagguucgagacucucaguaaucacuuuaucgaacugcuuguaccauucuuucuguucuugggccggcgugccuguauuauccaugguguucuccagauacuguuucaagcuguguuaauugucagcgggaaccugucuuuccuaaauuggcucaccauggugcccucccuggccugcuuugacgaugcaacacuuggauucuuguuuccgucaggcccuggcagccugaaagaccgcgugcuccagaugcagagagauaucaggggagcucggcccgagccacgauucgggagugucguucgcagagccgcgaacgugucucuggguguacuucuggccugguuguccgugccugucgugcucaaucuguuaagcucgaggcagguuaugaacacucacuuuaauucucugcacauugugaacaccuacggcgcauucggguccaucacaaaggaacgggcugaggucauccuacaaggaaccgccucaaguaaugcuagcgcccccgacgcaaugugggaggacuaugaguucaaguguaaaccaggcgaucccucccgcagaccuugccucauuucuccauaccauuauaggcuggacuggcuuaugugguuugccgcuuuccagacguacgaacacaacgauuggauaauccauuuggcggguaagcugcucgcaagcgacgccgaagcucugucauuacuggcccacaacccguuugcagggcgucccccuccacggugggugcgaggcgagcauuauagauacaaauucaguaggcccggaggccgccacgccgcugaagggaagugguggguacggaaaagaauuggagccuauuuuccuccacuuuccuuggaggagcucaggcccuacuuccgcgaucgagguuggccgcugccuggcccacuauga

SEQ ID NO: 58484 - RNA, 2079 nt, Artificial Sequence
  derived and/or modified sequence opt3 from LMLN__Homo_sapiens__NP_001129521
auggugaccacacugggccccaagauggccgcugaguggggagggggugucggcuacagcggguccggaccuggcagaucuagguggcgguggucagguaguguuugggugcgcagcguacuccuucuguuagggggauugcgagcauccgccacuucuacgccagugucgcugggcucaagcccgcccugccgucaccaugucccuagugacaccgaagugaucaacaaaguucaccuaaaggcgaaucauguggucaaaagagauguggacgagcaccucaggauuaagacaguauaugauaaauccguugaggaacugcuuccagaaaagaagaaccuggugaaaaauaaguuguucccccaggcuauaucuuaccucgagaaaacuuuucaaguccggcgcccugccggcaccauccugcugagcagacagugugcaacaaaccaguaucucaggaaggagaaugacccacaucgguacugcaccggggaaugugccgcucacacuaaaugcggacccgugauugugccugaggaacacuuacagcaaugucgcgucuaucgagguggcaaguggccacauggggcaguuggagugccggaucaggagggcaucuccgacgccgauuucguacuguacgugggugcucuugccacagagagaugcucacacgaaaacauuaucaguuaugcggcauacugucagcaggaggccaauauggacaggcccauagcuggguacgccaacuugugcccuaauaugaucagcacccaaccacaggaauuugucggaaugcugucuacggugaagcaugagguuauucacgcacuaggcuucuccgcuggccucuuugccuucuaucacgauaaagacgggaacccccugacuucacgguuugcggauggacuuccuccauucaauuacagccuggguuuguaucaguggagugacaaggugguccguaaaguggaacgccucugggauguaagagacaacaagaucguuaggcauaccguguaccuguuagucacaccccggguggucgaggaggcccgaaaacacuuugacuguccggugcuggaaggcauggagcucgaaaaucaagggggaguuggcacugagcuuaaccauugggaaaagcgccuguuggagaaugaggcaaugaccgguucucacacacagaacagagugcuauccaggauuacccuggcucucauggaagauacggggugguauaaagccaacuacagcauggcugagaagcuggacuggggccggggaaugggcugcgauuucguacgcaagucguguaaauuuuggaucgaccagcagagacaaaagaggcagaugcuuucuccuuauugcgauacucugcguuccaaucccuugcagcucacaugccggcaggaccaacgagccgucgcaguguguaaccugcagaaauucccaaagccuuuaccccaggaauaccaguacuuugaugagcugucagggauaccagccgaagaccuacccuauuacggagguaguguugagauugcugauuauugcccuuucagccaagaguucuccuggcaucucucuggcgaauaccagagaagcucagacuguaggauccuggagaaucagccagaaauuuuuaaaaacuauggggcggagaaguacggaccgcacagugugugccuuauccagaaguccgcauucgucauggagaaaugugaacgcaaguugagcuaucccgauuggggcucugguugcuaccaagugucauguaguccucaggggcugaaaguaugggugcaggacaccagcuaccucugcucccgggccggccagguucugccagucucuauccaaaugaauggauggauucacgacggcaaccuucugugucccucgugcugggauuuuugugaguugugcccuccagaaacugaucccccggcuacaaaucucaccagagcccugccuuuagaccugugcagcuguuccucaagucuaguggugacgcucuggcugcuuuuggggaaccuguucccacuccuggcaggauuuuuacugugcauauggcauuga

SEQ ID NO: 58485 - RNA, 1725 nt, Artificial Sequence
  derived and/or modified sequence opt3 from LMNA__Homo_sapiens__NP_001244303
augggcaacagcgaggggugcaauaccaagaaagaaggagaccugaucgccgcucaggcaagacucaaggaucuugaggcccuguugaacuccaaagaagcggcuuuaucuacagcccugucagagaagaggacucuagaaggugagcuccacgaccugcggggccaaguggcaaaacuugaggccgcucugggggaagcaaagaagcaguugcaggaugagaugcuccgccgagucgacgccgaaaaucgucugcagacgaugaaagaggagcuggauuuccaaaagaacauuuacagugaggaacucagagaaaccaaaaggcggcaugagacacgcuuaguugaaauagacaauggaaagcagagagaguuugagagcaggcuggcugaugcccuucaggaauugcgggcgcagcacgaggaccaaguggaacaguauaaaaaggagcuggaaaagacuuacuccgcaaaacuagauaacgcccgccagucugcugagcgaaauucgaaccucguaggcgccgcacaugaggaacugcagcaaucaagaaucaggauugacagccuuagugcucagcugucccaguugcaaaagcagcucgccgcgaaagaggccaagcugcgggauuuagaagacucucuggcacgugagcgcgauaccagcagaaggcuccuugcugaaaaagagcgggagauggccgaaaugcgagcucgcaugcagcagcaacuggacgaguaucaggaauugcuagacaucaagcuggcccucgauauggagauucacgcauacagaaaacugcuugagggugaagaggaaaggcugcgguugucccccucaccuacaagucagcgcagcagagggagggccucuucccauucaagccagacccaaggaggcggcagugugacuaagaagcguaaacucgagucuacagaaucccggagcucguucucucagcacgcucgaaccuccgggagagucgcgguggaggagguugacgaagagggaaaguuugugaggcugcgcaauaaaucaaacgaagaucagaguauggguaauuggcagaucaagcggcaaaacggcgacgauccauuacugacguauagauucccgcccaaauuuacucuaaaggcagggcaggucgugaccauaugggccgcuggagccggcgcaacacacagcccuccaacugaccucguauggaaggcccagaauaccugggguugugggaacucccugaggacagcucuuaucaauucuaccggagaggaaguugccaugcgcaaauuggugcgaagcgucacggugguggaggaugacgaggaugaagacggcgaugaccugcuccaucaccaucacggcucacacugcaguuccagcggggaccccgcagaguacaaccugcggucucguacuguccuuuguggaacaugcggucagccugcggauaaggcuucagccaguggcagcggggcacaaguuggaggcccaauuuccucugguucgagcgccuccucagugaccguaacuagaaguuauaggucugucgggggcagcggaggcggguccuucggagacaaccuggugacacgcucauacuugcucgguaauagcucuccccggacccaguccccucagaacuguaguaucauucaagaaaugggcaugagaugggagguggaagaggggaggcgaaaaguuagccugucuugcuuaccauga

SEQ ID NO: 58486 - RNA, 1761 nt, Artificial Sequence
  derived and/or modified sequence opt3 from LMNB1__Homo_sapiens__NP_005564
auggccaccgcuacacccgugccuccaagaaugggcagcagggcagggggaccgacuacgccccuguccccuacccggcucucucgccuucaggagaaggaagaacugcgagaauugaacgaccguuuagccgucuacaucgauaaaguuagaucacuggagacagaaaauagugcgcuacaacuccaggugacugagagggaggaaguacggggucgcgagcugaccggccuuaaggcucuguaugaaacagaguuggccgacgcaagaagggcccucgaugacaccgcucgggagcgcgcaaaacugcagauugaacuggggaagugcaaagccgagcacgaucagcucuuacugaacuacgcuaagaaggaaagcgaccuuaauggagcccaaauaaaauugcgagaguaugaagcggcacugaacuccaaggaugccgcucuagccacugcacucggcgacaaaaagucucuggagggugaucuugaggaccugaaagaucagaucgcucaguuggaagccucgcucgcggccgcaaagaagcagcuggcugacgagacauuacugaaaguggaucucgaaaauagaugucaaucacuuaccgaggaccuggaguucaggaaguccauguacgaggaggaaauuaacgagacgcggcguaaacaugaaacucgcuuggucgagguggacagugggagacagaucgaauaugaguacaagcuagcccaggcucugcacgagaugagggaacagcaugaugcccaaguucggcucuauaaagaggaacuggagcagaccuaccacgcaaaacuugagaaugcccgacuguccucugaaaugaacacaagcacugugaauagcgcucgcgaggaauugauggagucaagaaugaggauugaaagucucagcucucagcuguccaacuuacaaaaagagucacgggcgugccuggagcgcauccaggaacuagaggaccuccuggcaaaggaaaaggauaauagcagaaggaugcuuaccgacaaagagcgugaaauggccgagauacgggaucagaugcagcaacaguugaacgacuacgagcagcugcucgaugucaagcuggcucuugacauggaaaucagugccuaucgaaaacuguuggagggagaagaggaaagacucaagcugucuccaucccccagcucgagggugacaguaucucgcgcauccucaagucggagcguuagaaccacgaggggcaaacgcaagcgaguggaugucgaggaguccgaagccucuagcucagugaguauuucccauagcgcuucugccacuggcaauguguguaucgaggaaauugacgucgaugggaaguuuauccgguuaaagaacacaucagagcaggaccaaccuaugggagguugggagaugauacguaagauuggcgacaccaguguuagcuacaaauauacuuccagauacgugcugaaggcagggcagacaguaaccaucugggcggcuaaugccggagugacggcaucuccacccaccgaucuaauuuggaaaaaccagaacucguggggcacaggugaagacgucaaggugauccucaagaauagccagggggaggaaguugcccaaagguccacuguguucaaaaccacaaucccugaggaagaggaggaagaggaagaggcugccggagucgugguagaagaggagcuguuucaccagcagggcacuccacgcgcaucaaaccggaguugcgcuauuauguga

SEQ ID NO: 58487 - RNA, 1863 nt, Artificial Sequence
  derived and/or modified sequence opt3 from LMNB2__Homo_sapiens__NP_116126
augagcccucccuccccaggcagaaggcgggagcagcgccgaccgcgugccgcugcaaccauggccacaccccugccugggagagcgggagguccagcuacuccccucucuccuacgaggcuuucacggcugcaagaaaaggaggaauugcgcgaguuaaacgacagacuggcccacuacaucgauagggugcgggcacuagaacucgagaaugaccgccugcuucugaaaauuagugagaaggaagaggucaccacacgagaaguuagcggcauaaaagccuuguaugaguccgagcucgcugaugcaagaagggugcuggacgaaacugcccgggagcgugcucgccugcagaucgaaauugggaagcucagagccgaguuagaugaaguaaacaaaucugcgaagaagagggagggagagcugaccguggcacagggccgggucaaagaccuugaaucguuguuccaucgaucagagguggaacuggccgcugcccuaagcgauaagcgcggucucgagagugacguugcagaacugagagcucagcuugccaaagcggaggaugggcacgccguggcaaagaaacaacuggagaaggaaacauugaugagggucgaccucgagaaucggugccagucccugcaggaagaguuagauuuucgcaagucuguguucgaagaggagguaagagaaaccaggcgucggcaugagcgaagacugguugaaguggacagcuccaggcagcaagaguacgauuuuaaaauggcucaggcccucgaggaacuucgcucacagcacgacgagcagguccggcuguauaaguuggaacuagagcaaacuuaccaggcuaaacuggacagugccaagcucagcucugaucagaacgacaaagcagccuccgcugcgagagaagaacugaaggaggcaaggaugcgccuugaaucacugagcuaucaauugaguggacuccagaaacaggccucugcugccgaggaucgaauccgggaacuggaggaagcaauggccggcgagcgugacaaguucagaaagauguuagaugcuaaagagcaggaaaugacagagaugagggacgugaugcaacagcagcuggccgaauaccaggagcuacucgaugugaagcuggcacuugacauggaaauuaaugcguaucgcaaauugcuggagggcgaggaggagcggcucaagcuguccccaagccccucgucuagagucaccguuuccagggcuacgucaaguagcuccgggucucuuagcgccacuggacgacugggucgcucaaaacggaagagauuggaaguggaggagccucucggcagugggccauccguacugggaaccggcacaggugggagcggaggcuuucauuuagcacaacaggccucugcuucaggcagugugagcaucgaagagauagaucuggaagggaaguucguccagcucaaaaacaauuccgacaaggaucagucucuaggaaacuggaggaucaaacgucaagugcuggagggugaagagauugccuacaaguuuacuccgaaauacauccuucgcgcaggccagaugguuaccgugugggcugccggggcgggagucgcccacucgcccccuagcacauugguguggaagggccaguccucaugggguaccggggagaguuuccggacgguacugguuaaugcugacggcgaagagguggcaaugagaacugucaagaaaucuagcgugaugagggaaaacgagaauggagaagaggaggaagaggaagccgaguuuggcgaagaggaccucuuccaccagcaaggggauccacgaacaaccucccggggauguuaugucauguga

SEQ ID NO: 58488 - RNA, 978 nt, Artificial Sequence
  derived and/or modified sequence opt3 from LMNTD1__Homo_sapiens__NP_001139199
augcagcaacccgugagagccggcgacaucggggucagcaggguucagacccaccauaacgcuuccccuuucucugugccaaagaaacaggaugagucaccgaugauuggagacggugaagauuacuuucugagucucuucggcgacagcaagaaacuuacagcacacuccaauuauacucagaagacgcugaaauacuuuucuaugauauuggaggaaguagggcaauucaccucgagcucauuaggagauguggagaucgccgaagucaacgugaagggccuguuuguuaagcuaauuaauaguucccucgacaaagagauggcgaucggugaucauauucugcagcagaacgugaaugggcagacaaucucucuuuaucgguuccugcccaacauagucaugcaagcuaauagcacugugaccguaugggccgcagccuccgaggcuaagcaccagccuccaucagacuuuuuguggaaagaacaggauaaguuccgcgcaagucccgacugcaucacaauucucuguaaaccuaacggacaggccaucgcuugguacaccccaauucauuggaagcaagccugggagaagcuggaugcggacguugaauuuaaucgaugcagcguggucucucccacuuuccguaaaagaguguuucaguggacagcauccaccgccacgaucacuaaggagaaacaggaucaaccuaagaaagacauaucaaacuaucagguggagcaggcucagguccugcucaagagggaaaaagagauuccaccgaccguuuuccccaaucggagcccuuggugucaaaacccauacgugagugcccaccccuauugcccuuuaaucgaaccacacaauacaucuacugcaggcggccgccuggacagacagcccaggacccgguccacacgcccgaaccgagcuagcgggucgaagaagaaaaagaccucugagucccagaaacaguga

SEQ ID NO: 58489 - RNA, 468 nt, Artificial Sequence
  derived and/or modified sequence opt3 from LMO1__Homo_sapiens__NP_001257357
auggugcuggaccaggaggauggcguccccaugcucagcguucaaccuaaggggaaacagaagggaugcgccgguuguaacagaaaaaucaaggacagguaccuucugaaggcuuuggauaaauauuggcacgaagacugcuuaaagugugcaugcugugauugccggcugggcgaggugggguccacccuauacacaaaagccaaucucauucugugucgccgagacuaucuucgucuguucggaacuacgggcaacugcgcggcuuguucuaaguugauaccagccuuugaaaugguaaugagagcaagggauaauguguaccaucucgacugcuucgccugucagcugugcaaccagcgguuuugcgucggugauaaauucuuucugaagaauaacaugauccucugucaaauggacuaugaggaagggcaguuaaauggaaccuucgagucacaggugcaguga

SEQ ID NO: 58490 - RNA, 477 nt, Artificial Sequence
  derived and/or modified sequence opt3 from LMO2__Homo_sapiens__NP_001135787
augagcuccgccaucgagagaaagucucuggaccccucagaggaaccuguggaugaaguccuccagauuccaccgagucuucugaccugcggcgggugucaacagaacauaggagacagguacuucuugaaagcuaucgaucaguauuggcacgaggacugcuuaagcugugaucugugcgguugucggcuaggcgaaguugggcgccgacucuacuauaagcugggacguaaacuuugcagaagggacuaccugcgguuguuuggccaggauggucucugugcauccugcgacaagcgcauuagagccuaugagaugacaaugagggugaaagauaagguauaccaucuggaguguuucaagugcgcggcuugucaaaaacacuuuugcgugggggaccgguaucugcucaucaauucugauauugucugcgaacaggacaucuacgaguggacuaagauaaacggaaugaucuga

SEQ ID NO: 58491 - RNA, 438 nt, Artificial Sequence
  derived and/or modified sequence opt3 from LMO3__Homo_sapiens__NP_001001395
augcugagcgugcagcccgacaccaagccuaaaggcugcgccggguguaacagaaagaucaaagauagguaccuccuuaaggcucuggacaaauauuggcacgaggauugcuugaagugugcaugcugugacugccgguuaggagaagucgguuccacacuguacacuaaggccaaucuaauucucugucgccgagauuaucugcgucuuuucggcguuacggggaacugcgcggcuuguucuaaacugauaccagccuuugagauggugaugagagcaaaggacaauguauaccauuuggauugcuucgccugucaacucugcaaccagagguuuugcgugggagacaaauucuuucugaagaauaacaugauccugugucagaccgauuaugaagagggccucaugaaagaagguuacgcuccgcagguccgguga

SEQ ID NO: 58492 - RNA, 4050 nt, Artificial Sequence
  derived and/or modified sequence opt3 from LMO7__Homo_sapiens__NP_005349
augaagaaaaucagaauuugccacauauucaccuuuuacagcuggauguccuaugacgugcuguuccagaggacagagcucggcgcccuugaaaucuggcggcaacugauuugugcucaugucugcaucuguguugggugguuguacuuacgcgaucgagugugcucuaagaaagacauuauccugcguacugagcagaacucaggaagaacgauacuaaucaaggcaguaaccgagaaaaauuuugagacaaaggauuucagggccagucucgaaaacggugugcugcuuugugaccugauuaauaaguugaaacccggcgucaucaagaaaauuaaccggcucagcacuccuaucgcggggcuggauaauauaaacguguuucugaaggcuugcgagcagauuggacucaaagaggcccaguuauuccacccaggcgaccugcaagaucuuuccaaucgcguuaccgugaagcaggaagagacagacagaagggucaagaacguguugaucacccuguauuggcuaggucggaaagcacagucuaauccguacuauaacgggccccaucucaaucugaaggccuuugaaaaccuucugggacaggcuuugacuaaagcacucgaggauucgucauuccugaagcgcagcggccgagacaguggcuacggggauauuugguguccugagagaggagaauuuuuagccccacccaggcaccauaaacgggaggacuccuucgaaucucuggauagccucgguucccguucacuuacaaguugcagcucugacaucacccugcgcggcgggagagagggauuugaauccgacacggauucagaguucacuuuuaagaugcaagacuauaauaaagaugacaugagcuacaggcggaucagugcuguagagccuaagaccgccuugccauucaaccgauuccuacccaauaagucucgccagccuuccuacguuccagcgccgcugaggaaaaagaaacccgauaagcacgaagacaacagacggagcugggcaucgccuguguauacagaggccgauggcacuuuuucucgccucuuccagaaaauuuacggugaaaacggguccaagucaaugagugacgucagcgcugaggaugugcagaaucugagacaacuuagguaugaagagaugcagaagauaaaaucccagcugaaggagcaagaccagaaauggcaggaugacuuggccaaguggaaagaccgucggaagucuuacaccagcgaucuccagaagaaaaaggaggaacgagaagagaucgaaaaacaagcacuggagaagucaaaaagaaguuccaagacauuuaaggagauguuacaggacagggaaagccagaaccagaaaucuaccgugccaucacgccggagaauguauaguuucgaugacguccuggaggaaggaaagaggcccccuacgaugacuguuagcgaggcuuccuaccaaucugagcgcguggaagagaaaggcgccacauauccaucggaaauucccaaggaggauagcaccacuuuugcgaaacgagaagaccggguaacaaccgagauccagcuaccgucccagucaccuguggaggaacagagucccgccucucucagcucccugcguucaagaagcacgcaaauggagucuaccagggucuccgcaagucuuccacgcagcuaccggaagacagauacugugagauugaccucuguugugacaccuaggcccuucggcucccagacucgagggauaucaagucugccacgcagcuacaccauggacgaugcuuggaaauauaauggagacgucgaagauauuaagcggacacccaacaaugugguaucgaccccugccccauccccggacgcuucucagcucgccagcucacugaguucccagaaggagguugcagccacugaagaggaugugacgagacuucccucuccuacaagcccauuuuccucacugagccaagaccaggcugcgaccaguaaagcaacuuugucuuccaccagcggucucgaccugaugucggagucaggcgaaggggagaucucuccccagagggaagucagucguucccaagaucaguucagcgacaugcgcaucucuauuaaccagacaccuggaaagagcuuagauuuuggcuucaccaucaaaugggacauuccagguauauuuguggccuccgucgaggcugggucacccgccgaguucagucagcugcaaguggaugacgaaaucauugcaaucaauaacacuaaguuuagcuacaaugauucuaaagagugggaagaggccauggcuaaggcccaggaaacaggccaccuaguuauggacgugcggagauauggaaaggcaggcuccccggagacgaaauggaucgaugcgaccucagggauuuacaacagugaaaagagcuccaaucucucuguaacuacagacuucucggaaagccugcagucauccaacauagagaguaaagaaaucaauggcauucaugaugagucuaacgcuuucgaaagcaaggccuccgagucaaucucucuuaaaaauuugaagaggcgaagccaguuuuucgagcaagguaguuccgacagcgucgugccugaucugccaguucccaccauuucugcaccuucacggugggugugggaccaggaagaggaacgcaagagacaggagagguggcagaaagaacaagaccggcuccugcaggagaaguaucagcgagagcaagaaaaauuaagagaggaauggcagcgcgccaagcaggaggcugaaagggagaacuccaaauaccuggaugaggaacuuauggucuugaguagcaacucgaugucucucacaacucgugagcccucccuggccaccugggaagcaacguggagcgagggcucaaagaguucugaccgggaggggaccagagcuggagaagaggaaaggcgccagccacaagaggaagugguacacgaggaucagggcaagaaaccucaggaccagcuagugaucgagcgagaaagaaagugggagcaacagcugcaggaggaacaggaacaaaaacggcuccaggccgaggcggaggaacagaagaggcccgccgaggaacagaaacgccaagcugagauagaacgugagacauccguuagaaucuaucaguaccggaggccagucgauagcuacgacauuccgaagacugaggaagcaucaagugguuuucugccuggggaucgcaauaaaagccgauccaccacagagcuugacgauuauucuacuaacaagaauggcaacaauaaguacuuggaccagaucggaaacaugaccagcucccaaagacggagcaaaaaggaacaggugcccucuggcgccgagcuggagaggcagcagauuuuacaagaaaugcgcaaaagaacgccacuccauaaugauaacaguuggaucaggcagcggucggcuagcgugaauaaggagcccgucucccugccugggauaaugcgucgcggagaaucucuugacaaccuggacucaccacgaagcaauuccuggagacagcccccuugguugaaccagccgacagguuucuaugccaguucuagcguucaagauuuuucaaggccacccccucagcucguguccaccaguaaucgggcauacaugcgcaacccaucaucuuccgugcccccuccgucagcgggcagcguaaaaacuucgacaaccggggucgccacuacccagucucccacaccaagaagucacuccccuagcgcuucacaguccggaucucaacugaggaaucggagcgugaguggcaagcgaauuuguuccuauugcaacaacauccuagguaagggggccgcaaugauuaucgagagccugggccucuguuaccaucugcacugcuucaaaugcguugcuugugaaugcgaccuuggaggaucuucaaguggggccgaggugagaauacgcaaucaccaguuguauuguaacgauugcuaccugagguuuaaguccggacggcccacggcaauguga

SEQ ID NO: 58493 - RNA, 1803 nt, Artificial Sequence
  derived and/or modified sequence opt3 from LMOD1__Homo_sapiens__NP_036266
augagcagaguggccaaguacaggcggcaggucuccgaggaccccgauaucgacucucugcucgaaacccuuucaccugaggaaauggaggaacuggagaaagaguuggauguuguggacccagauggcaguguaccggugggguuacgccaacgaaaccagacagaaaagcagagcacuggagucuauaaucgugaggcuaugcugaacuucugcgaaaaagagacgaagaaacuaaugcagagagagauguccauggacgaaucuaagcaaguggagaccaagacagaugcaaagaauggugaagagaggggccgggacgccucgaagaaagcgcucgggccccgcagagauucagaccugggaaaggaaccuaaaaggggcggucuuaaaaagagcuuuagucgggaucgcgacgaggcugggggaaaauccggcgagaagccaaaagaagagaagauuauacgaggcaucgauaaagggagaguuagggccgcaguggacaagaaagaagccggaaaggacggucggggcgaggaacgugcugucgcaacuaagaaagaggaggaaaagaaagggucugaucgcaacaccggacugagcagagacaaggauaaaaagagggaggaaaugaaggagguggccaaaaaggaagacgaugagaaaguaaagggcgagcggcgaaauacagacacccgcaaagaaggugagaagaugaagagagcugggggaaacacugauaugaaaaaggaagacgagaaaguuaagaggggcacaggcaauaccgauacgaaaaaggacgaugagaaggugaaaaagaacgaacccuugcacgagaaagaagccaaggacgacuccaaaacuaagaccccugagaaacagacaccaucagggcccacuaagccuagugaaggaccagcgaaggucgaggaggaagcagccccgagcauuuucgaugagccccucgaacgggugaaaaauaacgacccugagaugaccgaagugaaugucaacaauucugauuguaucacaaacgagauucugguucgcuuuaccgaggcucuggaguucaauacggugguaaagcucuuugccuuagcaaacacuagagcugacgaucauguggccuucgcgaucgccauaaugcugaaagcaaacaagacaaucaccucccuuaauuuggacucaaaccacauuacugguaaaggcauccuggcuauuuuuagggcccuacuccagaauaacacacugaccgaacuucguuuccauaaucagcggcacaucugcgggggaaagacggaaauggagauagcuaagcuguugaaagaaaacaccacacuccugaaguuaggcuaccauuuugagcuggccgguccacgaaugacugucaccaaucuccuuagcagaaacauggauaaacaaaggcagaagcgccugcaggagcagcggcaagcacaggaagccaaaggggagaagaaggacuugcuagaagugcccaaagcuggcgcgguugcaaagggaaguccuaaaccaucuccccagccguccccuaagcccagcccuaaaaauucgccaaagaagggcggggcccccgcugccccacccccuccaccgcccccucuggcaccaccccucauuauggagaaccugaaaaauucucuuuccccugccacacaaagaaagaugggagauaaagugcugccagcucaggagaagaacucaagggaccaguugcucgccgcaauccgcaguagcaaucugaaacaguuaaagaaagucgaagugcccaagcugcuacaauga

SEQ ID NO: 58494 - RNA, 1683 nt, Artificial Sequence
  derived and/or modified sequence opt3 from LMOD3__Homo_sapiens__NP_001291347
augagcgagcacuccagaaacucugaccaggaggaacugcucgaugaagagaucaaugaagacgagauucuugccaaccugucagcugaggaauugaaggaguuacaaagugaaauggaggugauggcacccgauccuagccugccagucggcaugauacagaaagaccagaccgauaagccgcccacagggaauuucaaccauaaaucccuaguugacuacauguauugggagaaggccucuaggcggaugcucgaagaggaacgcgugccuguaacuuuugugaaaucggaggaaaagacgcaggaggagcacgaagagaucgaaaagcgaaauaaaaacauggcgcaauaccugaaggagaaacuuaauaacgaaauugucgcuaauaagcgugagucaaaaggaagcaguaacauccaggagaccgaugaagaggacgaagaggaagaggaugacgaugacgaugacgagggugaagacgauggcgaggaauccgaggagacaaauagagaagaggaagggaaggccaaggagcagauuaggaacugcgaaaauaacugucagcaagugacugacaaagcauucaaggagcagcgggaucgcccagaggcccaggaacagucugagaaaaagaucagcaaacuggaccccaagaaauuggcucucgauaccuccuuucugaagguuucaacaagaccuaguggaaaucaaaccgaccuggauggcagccucaggcgggugcgcaagaacgacccagauaugaaagaauuaaaccugaauaacauagagaauauccccaaggaaaugcuuuuggacuucgucaacgcaaugaaaaagaauaaacauauuaagacuuuuucucuggccaacgugggugcugaugagaauguagccuucgcgcuagcaaacaugcuccgagagaauagauccaucacaacccugaacauugaaucaaauuuuaucacggggaagggaauaguugccauuaugaggugccuucaguucaacgagacucugaccgaauugcgguuucacaaucagcgucauaugcucggccaccacgcugagauggaaaucgcccgccuguuaaaagcaaacaauacacugcucaagaugggcuaucauuucgagcuuccugggccaagaaugguggucacuaaccuguugaccaggaaccaagacaaacagcggcagaagcgacaggaggaacaaaaacagcagcagcuaaaggagcaaaagaaacugauugcuaugcucgaaaauggacugggucuuccgcccggcaugugggagcugcucgggggaccuaagccagacagccgcaugcaggaguuuuuccagcccccuccacccagaccgccuaacccccagaaugugccauuuagucaaaggucugaaaugaugaaaaagccuucccaggcccccaaauaccggacagauccagacagcuuccgcguggucaaguugaagagaauccagaggaaaucgcguaugcccgaggcgcgggaaccuccagagaagaccaaccugaaagauguuaucaagacguuaaaaccggugccccgaaauagaccuccaccccugguagaaauuacuccuagggaccagcuacucaacgauauacgccacucuuccguggccuaucugaagccaguccaacuucccaaagaguuggcauga

SEQ ID NO: 58495 - RNA, 4512 nt, Artificial Sequence
  derived and/or modified sequence opt3 from LMTK2__Homo_sapiens__NP_055731
augcccggcccuccagcccugagaaggcggcuccuucuguuguuacuggugcuacucaucgcugggagcgcaggagccgcgccgcugccccagaccggugcuggcgaggccccuccagcagccgaagucuccucuucauucguuauucuuugcguguguagucugauaaucuugauuguacucaucgcuaacugcgugagcuguugcaaggaccccgagauugauuuuaaagaguucgaagacaauuuugaugacgaaaucgauuucacaccuccagcagaggacacucccuccguccagucuccugccgagguguuuacgcugucgguuccaaacauaucacugccggcucccagccaguuccagccuaguguggaagggcucaagucccaggucgcccgccacucuuuaaauuacauccaagagauuggaaacggcugguuugguaaagugcugcuuggggaaaucuauaccggaacaagcguagcgcgaguuauugugaaggaguugaaagcauccgccaauccaaaggagcaggauacuuuccugaagaacggcgaacccuacuauauccuacagcauccuaauauacuccagugugucggccaaugcguggaggcuauuccauaccugcuuguguuugaguucugugaccugggggauuugaaagccuaucuccguucagaacaggaacacaugagaggagacagucagaccaugcuguuacagaggauggcaugcgaggucgcugccggucuggcggccaugcauaagcuccacuuucuucauagcgaucuggcauugcggaacuguuuccuaacaucugaccugaauguuaaagugggcgauuacgggaucggauuuucccgcuauaaggaggacuacauugaaaccgacgauaaaaagguauucccccucagauggacugcuccggagcuggugacaucauuccaagacaggcuucugaccgccgaucagacgaaguacagcaacaucuggaguuugggcgucacucucugggaacuguuugacaaugcugcccagccuuauucuaacuuauccaaucuggaugugcuaaaccaaguuauccgggagcgcgacaccaaacuccccaagccacagcuggaacagccuuacagcgaucgaugguaugaggugcuucaguucugcugguugucgcccgagaaaagaccagcagccgaagacguccacaggcugcucacauaccugcggcuucaaucucagcgugauuccgagguggacuuugaacagcaguggaaugcucugaagcccaacacuaacucacgcgauaguagcaauaacgcggcauucccuauuuuggaccacuuugccagagacaggcucggucgggagauggaagagguacugaccguuacagagaccucccaaggguuaucuuucgaauaugugugggaggcugccaaacaugaucacuuugacgaacgaagccgcggacaucuggaugagggccuaucauacacgaguauauucuauccagucgagguguuugaauccagccucucugacccgggccccgggaagcaggaugacucaggacaggaugucccucugagagugccagguguugugcccguauucgacgcacacaaucuuagugucggcagcgauuacuacauccaguuggaggaaaaauccgggucuaaccuggagcucgacuauccuccagcccuguuaacuacagauauggacaaucccgaaaggaccggaccggagcugucgcaacuuacugcuuugcggagcguggagcucgaagaguccucaacagaugaagacuuuuuccagaguucuaccgacccuaaggauagcucccugccaggcgaccuacacguuacgucaggucccgagagcccuuuuaacaauauuuucaacgauguggacaagucugaagaucugcccucccaucagaaaaucuucgaccucauggagcugaaugggguccaggccgauuuuaagccagcaacccuuaguagcucuuuggacaacccuaaagaguccgugauaacaggccacuucgaaaaggagaaaccccgcaagauuuuugauucagaaccacuguguuuaagugacaaucucaugcaucaagauaacuucgacccgcugaauguacaggagcuuagcgaaaacuuucuguucuugcaggagaagaaucuccugaaaggaucgcuauccucuaaggagcacaucaacgaucugcaaacugaacucaaaaacgcgggcuuuaccgaggcuaugcuggaaacaagcugcagaaauucacuugacacugaguugcaguucgccgagaacaagccugggcugaguuuacuccaggaaaauguguccaccaaaggagacgauacagacguuaugcugaccggugauacucuuucuacgagccugcaguccucacccgagguccaagugccacccaccagcuuugaaacagaggaaacuccuaggcgugugccacccgacagucuaccuacccagggcgagacacagccgaccugccucgaugucaucguuccagaggacugucugcaucaggauauuucucccgacgcagugacugugccuguagaaaucuuguccacagaugcccggacgcacagccuggacaaccgaucgcaagauucaccaggggagucugaagagaccuuaagacucacugaaagugacuccguccuggcugacgauauucuugccagcagggugucuguuggaagcucccugcccgaguugggccaggagcuccacaauaagccuuucucagaagaccaucacagucaucgccggcuggagaagaaccuagaagcaguggagacacugaaucagcuuaacagcaaagaugcugccaaggaagcgggucucgucucugcccuguccucagacaguaccagccaggauuccuugcuggaggacucuuuaucggcuccguuucccgcaagcgagccaucacucgaaacaccugauucccuggagaguguggacguucacgaagcccuucuggauucuuuggggagccacacuccccaaaaacucgugccaccugacaagcccgcugauuccggcuacgagaccgagaaucuggaaucaccagaguggacgcuacauccggccccugaaggaaccgcagacucugagcccgcgacaacuggcgaugggggacacagcggucugccacccaacccuguaauagucaucagugacgccggcgacgggcauagaggaaccgaagugacaccagagacuuucaccgcuggcucccaggguagcuauagggauucugccuacuuuucagacaaugauuccgagcccgaaaaacgcagugaggaagugccugggacgagcccgucggcacuuguccucguucaggagcaaccacugcccgaaccuguguugcccgagcagucuccagcugcccaggacuccugcuuagaggcacgaaagagccagccugaugaaucaugucugagugcccuccacaacucuuccgaccuggagcuucgggcuacacccgaaccagcgcaaaccggcguaccucaacaggugcauccgacugaggaugaagccagcucacccuggaguguccugaaugcagaguugagcuccggagacgauuucgagacacaggacgaucguccaugcacccuagcuucuacuggcaccaacacaaaugaacugcucgccuauacgaacagcgcccuggacaagucccuuucaucucacagugaggggccuaaauuaaaggaacccgauauugagggaaaauaccugggcaagcucggugugucggggauguuggaccugagcgaggacggaauggaugcugacgaagaggaugaaaacuccgacgauucugacgaggaucucagagcauucaaucugcacucacuuagcuccgaaagugaggacgagaccgaacauccaguuccuaucauccugucuaacgaggauggcaggcacuugcgcagccuacugaaacccacugccgcgaaugcuccggacccacucccugaagauuggaagaaagagaagaaggccgugacauuuuucgacgacgucaccguguauuuauuugaucaggaaacacccacuaaagagcuggguccauguggcggggaggcaugcggacccgaccuuucaggcccugccccggcuuccgggagucccuaccugagccgguguauuaacucugaauccucaaccgaugaggaaggaggcgguuucgagugggacgaugacuuuagcccagauccuuucaugucgaagacgacaucuaaucucuugaguuccaaacccagccugcagaccucaaaguacuuuuccccuccacccccugcaagaucuacugaacagagcuggccacauagugcccccuauuccagguucagcauaucuccggcgaacaucgcuucauuuagucucacccaccugacagacuccgauauugagcaagggggaagcucugaggacggcgaaaaagauuga

SEQ ID NO: 58496 - RNA, 4470 nt, Artificial Sequence
  derived and/or modified sequence opt3 from LMTK3__Homo_sapiens__NP_001073903
augagacaggugcuguggcucugcaacgucuguguuaccgccagggagacacggcaccaucuucaucugcccgcuaucuuggacaagaugccugcaccaggcgccuuaauucugcuagcggcugugagcgccuccgggugccucgcaucuccggcccaccccgauggauucgcucugggucgcgcaccucuugccccacccuacgcuguagugcugauaucauguaguggcuugcucgccuuuaucuuccugcugcucacuugcuuauguugcaaacgaggggacgucggauuuaaggaguucgaaaauccugaaggcgaggauuguagcggugaauauacgccacccgcggaggagaccuccucuucgcaaucacugccugacguguacauucuuccauuggcagaaguuagccugccgaugcccgccccucagccaagucacuccgauaugacaacuccccuagggcucucucgucagcaucugagcuaucuucaggagaucggauccggcugguuuggcaaagugauucugggggaaaucuucucagacuacaccccugcucaagucgugguaaaggaguugagagccagugcaggaccacucgagcagaggaaauuuauaagcgaagcucagcccuaucggucucugcagcacccgaacguuuuacaaugccugggucucuguguggagacacuuccuuuccuguugaucauggaauuuugccagcuaggcgaucugaagcgcuaccucagagcccagaggcccccagaggggcuguccccugaacuucccccacgggaccugcgcaccuugcagcgaaugggacucgagauugcgagaggccuggcccacuuacauucacacaauuauguccauagcgaucuggcacuaaggaacugucuccugacuuccgaccuuacagugcggaucggugauuacggguuggcucacucuaauuacaaggaggacuauuaccugacccccgaacgucucuggauuccucugcgcugggccgcuccagagcuucugggagaauugcacggcacguucaugguggucgaucaauccagagagagcaacaucuggucgcucggcguuacucugugggaauuauuugaguucggggcccagccguauaggcaucugucugacgaggaagugcuagcauuuguagugcggcagcaacacgucaaacucgcccgaccccgccugaaacuuccuuacgcugacuauugguacgauauauugcaguccugcuggagaccacccgcgcagaggccuucagcaagugaccugcagcuccaacugaccuauuuacugagcgagcggccaccccgcccgccuccacccccucccccaccuagagauggacccuucccauggccguggccucccgcccauuccgcuccaaggcccgguacacuuucuagcccuuucccauugcucgacggcuuucccggggccgauccugacgaugugcugacuguuaccgaaucaagucguggacuaaaucuggagugccucugggaaaaggcacggcgaggcgccgguagagggggcggagcuccggccuggcagccagcauccgcgcccccugcuccacacgccaaccccagcaauccuuucuacgaggcacugucuacaccgucagugcuucccgucauuagugccaggagcccauccgugucuucggaguacuauauccgcuuggaggaacauggcagcccucccgaaccacuguuuccuaacgacugggaucccuuagacccagggguaccggcuccucaggccccacaggcaccauccgagguuccccaacucgugucagagaccugggcuaguccucuguucccagcgccccggccuuuuccggcccagucuagcgccuccggaucauuccuucugagcgguugggauccagaaggcagaggggcuggagagacguuggcaggcgaccccgccgaaguccucggugagagggggacugcuccuuggguggaagaggaggaagaggaagaggaagggucuucccccggagaggacaguagcucucugggcgggggaccaucccgccgagguccucuacccuguccacugugcucacgggagggcgccuguaguugccucccucuggaacguggggaugcagucgcgggauggggcggucacccggcccuuggguguccccacccaccugaggacgauagcucguugagagcugaaaggggcucccuggccgacuuacccauggcacccccugcuucugcacccccggaguuucucgauccacugaugggagccgccgcuccucaguaccccggccgcgggccacccccugcgccgcccccaccucccccuccaccccgggccccugcagacccagcugccagccccgauccgccuucagccguggcuaguccaggauccggccuuucuagccccgguccuaagccaggggacuccggauaugaaacagagacccccuucucaccggagggcgcauuuccugguggcggggccgcggaagaggaaggaguucccagaccaagggcuccucccgagccacccgauccuggcgccccacgaccgcccccugacccagggccccugccucuaccaggaccccgcgagaaaccuacuuucgugguacaggucagcacagaacaacuccugaugaguuugcgggaggaugugaccagaaaucuguuaggcgaaaagggugcaacggccagggagaccgggccgcguaaggcuggacgcggcccagguaaccgggaaaaaguucccggccucaauagagacccuacagugcuggggaacggaaagcaggcacccucucuuucccugccagucaauggcgugacuguauuggagaacggggaucagagggccccuggaauugaggaaaaagcggcugagaacggcgcccucgguagccccgaacgagaggaaaaggugcuggagaauggggagcuaaccccaccgcggcgcgaagagaaagcacuggaaaacggagagcuuagaucgccugaagccggcgagaagguucucgucaaugguggccugacacccccaaaaucagaggacaaggugucugaaaacgggggauugagguuuccccggaauacugagcgaccuccagaaaccggccccuggagagcuccugggccgugggagaagacaccagagaguuggggacccgccccuaccaucggcgaaccagcacccgagacuucccuggaacgcgcuccugcccccagcgcgguggucucuagcaggaacgguggggagacggccccaggaccguuaggcccugcacccaaaaauggcacacucgaaccagggaccgagcgucgggcuccugagacuggaggugcccccagagcuccaggcgcagggaggcuggaccuuggauccggcggucgcgccccuguugggaccggaacagcccccggcggcgggccgggaucagguguggaugcuaaggcgggcuggguggacaacacccgaccacagccucccccacccccucugccgccacccccugaagcacaacccagacgguuggagccagccccucccagggcucgcccagaaguagccccugagggggaaccgggagcacccgauagucgugccggcggugacacugcucucagcggggauggagacccaccuaaacccgagagaaagggcccagagaugccucggcuguuccuagaucugggacccccgcagggcaauucugaacagaucaaagcgaggcuuucccgccucucacuggccuugccaccuuuaacacugacgcccuuuccaggccccgguccucgaagacccccaugggagggcgcagacgcuggggccgcaggaggcgaagccgguggggcuggagccccuggcccggcggaggaagauggcgaggacgaggaugaagacgaggaagaggaugaggaagcagccgcucccggggccgcugcaggaccacgggguccuggcagggcccgcgcugcccccgucccagugguugugaguagcgcagacgcggacgccgcuagaccucucagggggcugcuuaagaguccccggggagccgaugagccggaagacucugagcuggaacguaagcgcaaaauggucucguuccauggcgaugugaccguuuacuuguucgaccaagagacuccuacaaacgagcuaagcgugcaggcaccacccgaaggugauaccgacccuucaacaccacccgcuccuccaacucccccgcacccugccacccccggggauggauuuccauccaaugacaguggcuucggcgggucuuuugagugggcagaagauuucccccugcucccuccacccggaccuccacugugcuuuagccgauucuccguaucaccggcccuugagacgcccgguccuccagcuagagcgcccgacgccaggccugcaggcccagucgaaaacuga

SEQ ID NO: 58497 - RNA, 1149 nt, Artificial Sequence
  derived and/or modified sequence opt3 from LMX1A__Homo_sapiens__NP_001167540
augcuggacggccucaagauggaggaaaacuuccagagcgccaucgauaccuccgcuucuuuuucaagucuucuggggagagcagugagccccaaauccgucugcgagggaugucagaggguuauuuuggaccgguucuuacugcgccuaaaugauucuuuuuggcacgaacagugcgugcagugugccucgugcaaggagccucucgaaacaacuuguuucuaccgagacaaaaagcuguauugcaaauacgauuaugagaaacuuuuugcgguaaagugugguggcugcuucgaggcuauagccccaaacgaauuugugaugcgugcacagaagucagucuaccaucugagcuguuucugcuguugcgugugcgagagacaauugcagaagggggacgaauuuguucucaaagagggacagcugcuguguaagggcgauuaugagaaagaaagggagcucuuaagucugguguccccggccgcuucugacagcgguaaguccgaugacgaagagucacuuugcaagagugcacacggggccggaaaaggcacggcugaagagggcaaggaucauaaacggcccaagcgcccuagaaccaucuugacaacucagcaaaggcgggccuucaaagcgagcuuugaggucucuuccaagccaugucgcaaagugcgagaaacccuggcagccgagacagggcuaucaguaagaguugugcaggucugguuccagaaucagagggcuaagaugaagaaacucgcccggcgucaacagcagcaacagcaggaccagcaaaacacccagcgccugagcagugcacagacuaauggagguggcucugcugggauggaaggaauuaugaaccccuacacagcccuuccuaccccacagcaacuguuggcgaucgagcaguccguguauagcucggaucccuuuagacagggccucacgccuccacagaugccgggugaccacaugcaucccuacggggccgaaccucuguuccacgacuuagauucugacgauacuucccugucaaaucucggagacugcuuccuugcaaccagugaggcuggcccacugcaaagcagggugggcaaccccauugaucacuuguacuccaugcaaaauucuuauuuuacaagcuga

SEQ ID NO: 58498 - RNA, 1221 nt, Artificial Sequence
  derived and/or modified sequence opt3 from LMX1B__Homo_sapiens__NP_001167617
auggacaucgccaccggccccgagagccuggaaagaugcuucccuagggggcagacagauugugcuaagaugcucgacggaauuaaaauggaggaacacgcacuucggccagguccggccacucugggcguguuguuaggguccgauugcccccauccugcggucugugagggaugccaacgcccaauaucugaccgauuucugaugcguguuaacgaaucaaguuggcacgaggagugucuacagugcgcugccugucagcaggcacucacgaccagcugcuacuucagagauaggaagcuguauuguaaacaagacuaccagcagcuuuuugccgcuaagugcuccggcuguauggaaaagaucgcacccacagaguucgugaugcgggcccuggaaugcguauaucauuuggguugcuuuuguugcugugugugcgagcgccagcucagaaaaggggaugaguucguccugaaggaaggacaacugcucuguaaaggcgacuacgagaaggaaaaagauuuacugucuucggugucaccugacgagagcgauaguguuaaguccgaagacgaggauggcgacaugaaaccagcuaaggggcagggaucucagagcaaggguuccggcgacgaugggaaagaccccaggcggccuaagcgcccacgaacuauucuuaccacacagcaaagaagggccuuuaaagcgucauucgaggugaguagcaagccgugccggaaaguccgugaaaccuuggcagccgagacuggacugucugugcgcguaguucaggugugguuucagaaucaaagagcuaagaugaaaaagcuagccaggcggcaccagcagcagcaagaacagcagaacucccagcgacucggccaaggugagcccgggccuggacagggccugggccaggaaguccuuucaagccgcauggaggggaugauggcaaguuauacaccacuggcucccccucagcaacagaucguggccauggagcagucuccauacggauccagcgaucccuuccagcaagguuugaccccgccucagaugcccggcaaugacucgauuuuucaugauaucgacucugauacgucccucacuucacugagugacuguuucuuagggagcuccgaugugggaucucugcaggcgagagucggcaacccaauagacaggcucuauagcaugcaaucaaguuacuuugccuccuga

SEQ ID NO: 58499 - RNA, 3078 nt, Artificial Sequence
  derived and/or modified sequence opt3 from LNPEP__Homo_sapiens__NP_005566
auggagcccuucaccaacgacagacugcagcucccuaggaauaugaucgaaaacagcauguuugaggaagaaccagauguggucgaccuugccaaggaaccgugccugcaccccuuggagccugaugagguugaauacgagccacggggcucccgcuuacuggugcgagggcuaggagaacaugagauggaggaagacgaggaagauuaugagucuucagcuaaacuccuggguaugaguuucaugaaucguagcuccggccuuagaaacucugcaacaggguacaggcaaucgcccgacggagccuguucaguaccuagcgcgcggacuaugguggucugcgcuuuugugauuguuguggccgucagugugauaaugguaaucuaucuguugccacgcuguacguucaccaaggaaggcugccacaaaaagaaucaguccauuggucucauccagcccuuugcaacaaacgggaaacuguucccuugggcccagauuagacugccaacugcuguugugccgcucagguacgaguuaucucugcaucccaaucuuaccagcaugacauuucggggauccgucaccaucucagugcaagcauugcaagugacuuggaacauaauccugcacaguacaggccauaauauuagccgcgucaccuucaugucugccguuuccucacaggagaagcaggcugaaauccuagaguaugccuaccacggccaaauugcgaucguggcaccugaagcccuccuggcugggcacaacuauacgcuuaagauagaguacagcgccaauauuaguucuuccuacuauggauuuuacgguuucagcuauacugaugaaucgaacgagaaaaaguacuuugcagcuacccaguucgagccacuggccgcgcgaucugccuuucccuguuucgacgaaccugcauucaaagcuacauuuaucauuaagaucaucagagaugagcaguauacugccuuguccaauaugcccaaaaagucaaguguagugcucgacgauggccugguccaggacgaguucagcgaguccgugaagaugucuaccuacuuaguugcuuuuauugugggggaaaugaaaaaccugagccaagaugucaauggaacacucgugucaauauaugccguaccagagaagaucggccagguucauuacgcacuugagaccacggugaaacuguuggaguucuuucagaacuacuucgaaauucaauauccgcuaaagaaacuggaccucgucgccaucccugacuuugaagcuggugcgauggagaacugggggcugcuuacuuucagggaggaaacacuguuguacgauaguaauaccuccagcauggcagaccggaagcucgugacuaaaauaauugcccacgagcuggcucaucagugguuuggaaacuuagucacaaugaagugguggaaugaucuguggcuaaacgaaggcuucgccaccuuuauggaguauuucucucucgaaaagaucuuuaaagagcugucaaguuacgaggacuuccuugaugcacguuucaagacgaugaaaaaggacagcuugaacuccucucaccccaucucgagcuccgugcagucaagugaacagauugaggaaauguuugauucucugagcuauuucaaaggcuccucacuccugcuuaugcugaagaccuacuugagcgaggacguuuuucaacacgccgugguacucuaucugcauaaucacucuuacgcuuccauccagagugaugacuuaugggauagcuucaaugaagucacaaaccagacucuggacgugaagcgcaugaugaaaaccuggacacuacagaagggguuuccacucguuacugugcagaaaaagggaaaagagcuguucauucagcaggagagauuuuuccuuaauaugaagccugaaauacagcccucugacaccuccuacuuguggcauaucccacugucauaugucacagaggguaggaacuacaguaaguaucaaagcgugucgcuccuggauaaaaaguccggcguaauuaauuuaaccgaagaggugcuguggguuaaagucaacaucaauaugaacggguacuauaucgugcacuacgccgacgaugacugggaagcacuuauucaucaguugaagauaaaucccuaugugcucucugauaaagaccgggcgaaccugaucaacaauauuuuugagcuagcuggacugggcaaggucccucucaagcgagccuucgaucugaucaacuaccuugguaaugagaaccacacugcaccaauuacggaagccuuguuucagacagaccugaucuacaauuuacucgagaaacugggguauauggaucuugcuagccgccugguuaccagaguguucaaguugcuccagaaccaaauacagcagcaaacuuggaccgacgaaggcacaccgucaaugagggagcugcggagugcccuacuggaguuugcaugcacccacaaucucggaaacuguuccacuacagcuaugaaacuguucgaugacuggauggccucuaauggcacgcagagccuucccaccgaugugaugacuacaguauucaaggucggggcgaaaaccgacaagggaugguccuuuuugcuggguaaauacaucucaauuggcagcgaagccgagaagaacaagaucuuagaagcucucgcaaguucugaggacgugcgcaaacuguauuggcuuaugaaguccagccugaauggggauaacuucagaacacagaaacuaucguuuauuaucaggacuguuggacgucauuucccuggccaccuccuggccugggacuuugugaaggaaaauuggaacaaauugguccagaaguucccacuggguucauacaccauacaaaauauuguggcugggucuacguauuuauuuaguaccaagacacaucucuccgagguucaggccuucuuugagaaccagagcgaagcaacuuuccggcugcgaugcgugcaggaggcgcuugaaguaauccaacugaacauucaguggauggagaaaaauuugaagucucucaccugguggcuguga

SEQ ID NO: 58500 - RNA, 1899 nt, Artificial Sequence
  derived and/or modified sequence opt3 from LNX1__Homo_sapiens__NP_116011
augaaggcccugcuccuucugguguugcccugguuaagcccugcuaacuacaucgacaaugucggcaaccugcacuuccuauauuccgagcucugcaaaggggcaucucauuacggacugaccaaggauagaaaaaggcggucacaggacgguuguccagauggcugcgccagucuuacagcgacugcuccgagccccgaaguuuccgccgcagccacgauuucucugaugaccgacgagccuggguuggauaauccagcuuaugugucgucagcagaagacggacaacccgccauaagcccuguagauaguggccgcuccaaccgaacacgugcuagaccauuugagaggucuacuauccggagccgcuccuucaagaaaauuaauagagcccucucagugcugaggcggaccaagagugguagcgcggucgcaaaccacgccgaccaggggcgcgaaaauucugagaacacaaccgcucccgagguguuuccucgacuguaccaucucaucccagauggagaaauuacuuccaucaagauaaauagaguugacccgucagagagcuuaaguaucaggcuggugggcggcucugaaacaccccuuguccacauuaucauucagcauaucuaucgggauggggugauagcccgugacggacgcuugcugccuggugauauuauccuaaaaguaaacggcauggacauuuccaauguuccacacaacuacgcagugagacuccugaggcagcccugucaaguccuuuggcugaccgugaugcgggagcagaaguuccgaagccgcaauaacgggcaggcuccugacgccuauagaccaagggaugacucguuucacgugaucuugaauaaaucuucccccgaggaacagcucggaaucaagcugguccggaaaguugaugagccgggcguguucauuuuuaacguauuagacggugggguggcguaccgccauggacaacuggaagagaacgauagaguccucgccauaaauggccacgaccuuagguacggcucaccugaaagugcagcucaucugauccaggccagcgagcgucgggugcacuugguugugucccgacaggucagacagaggucucccgauauuuuccaagaggcuggguggaacagcaauggaucauggaguccagguccuggcgaacgcuccaacacgcccaagccacuacaccccacuauaaccugccaugagaaggugguaaauauccagaaagacccuggggaaagccugggaaugacaguugccggcggugcaucucaccgggagugggaucucccaauuuaugugaucucagucgaaccugggggcgugaucaguagagacggaaggauuaagacuggcgauauccugcuuaacgucgacgggguggagcugaccgagguuagccgcuccgaagccguggcuuugcucaaacgaacaucuucgagcauuguacugaaggcguuagaggucaaagaauacgagccccaggaagacuguuccucaccggcagcccuggauaguaaucauaacauggcuccacccucugacuggagcccuuccugggugauguggcuagagcucccacggugccuguauaauuguaaggauauaguucuucguagaaacaccgccggaucauuggguuuuugcaucgugggcggguacgaggaauauaauggaaacaaacccuucuuuauuaagagcaucgucgagggcacgccggcauacaaugacgguaggauccgcuguggggauauucugcucgccgugaacggccggucuacuuccggaaugauacacgcuugccuggccagacuucugaaggaauugaaaggcaggaucacacucaccauuguaaguuggccugggacuuuccuguga

SEQ ID NO: 58501 - RNA, 2073 nt, Artificial Sequence
  derived and/or modified sequence opt3 from LNX2__Homo_sapiens__NP_699202
augggcaccacaagcgacgagaugguguccgucgaacagacuucuucaaguagccugaacccccucugcuucgagugugggcaacagcacuggacgagagaaaaucaucuuuacaacuaucagaaugagguugaugacgaucuggugugccacaucuguuugcagccuuuacugcaaccacuagacaccccgugcggacauacauuuuguuacaagugccucaggaacuuccugcaggaaaaagauuuuuguccccuugaccggaagcgccugcacuucaaauugugcaagaaauccucuauucucguacauaagcugcuggauaagcucuuagugcuguguccuuuuucgucagucugcaaagacgugaugcagcgaugugaucuugaggcccacuugaagaaucguugcccaggugcuagccacagaaggguugcacuggagcggcgcaaaacuagcagaacccaggccgaaauagagaacgaaaauggccccacacuacucgacccugcggggacccuguccccagaggcugauugccuuggaacuggcgccgugcccgucgagaggcaucugacaucugcaaguuuguccaccuggucagaagaaccuggucucgacaacccagccuucgaagagagugcuggggcagauacgacucaacagccgcugagcuuacccgaaggagagaucaccacaauugagauccaccggucuaauccuuauauucagcugggcaucuccauagugggcgggaacgaaacuccacucaucaauauuguaauccaggagguuuaccgcgacggagugauugcccgagacgguagacuucuggcuggcgaucaaaucuugcaggucaacaauuauaacauaucaaaugugagccauaacuacgccagggcggugcuaagucagcccuguaacacccugcaccucacaguccugcgggaacgucgcuuugggaauagagcacacaaccauucugacuccaauagcccuagggaggaaauuuuccaaguugcccuucacaagcgggauucgggagagcagcugggcaucaaauuggugcgacgcaccgacgagccagguguauuuauucucgaucuguuagaagggggacuggcugcccaggacggcagacuaucuuccaacgauagggugcucgcaaucaauggccaugaccugaaguaugggacgcccgagcuugcugcccagaucauucaagcgucaggagaacgggucaacuugacuauagcccgcccggguaagccucagcccggcaauacaaucagagaggcagggaaccacaguagcuccucucagcaucacaccccaccucccuacuacagcaggccaucaagucacaaagaucugacucagugcgugacaugucaagaaaagcauauuaccguuaaaaaggagccccacgagucccucggaaugacgguggcuggcggucgugggagcaaaucuggcgaacugccuaucuucgucaccucagugccaccgcauggaugccuugcccgggacggccgaauaaagagaggggauguacuguugaauauuaacggaaucgaccucacaaaucugagucacagcgaggcuguugccauguuaaaagcauccgccgcuucucccgcgguggcacugaaggcccuagaaguccagaucguggaggaggcuacucagaacgccgaggagcagccuucgaccuuuagcgaaaaugaguaugacgcauccuggucaccaaguugggucauguggcucggucugcccucuacacuucacagcugucaugauauuguguugaggcgcuccuaccugggcucauggggguucagcaucguuggaggcuaugaagagaaccacacuaaucaaccuuucuuuauuaagaccauagugcucgguacaccagccuacuaugacgggcggcugaaaugcggcgauaugaucguagcugucaacggauuaucuaccgugggcaugucccauagugcccugguucccaugcuuaaggagcagagaaacaaagugacuuugacggucauuuguuggccggggagccucguguga

SEQ ID NO: 58502 - RNA, 1755 nt, Artificial Sequence
  derived and/or modified sequence opt3 from LOC100288966__Homo_sapiens__NP_001244291
augguggccgaggucugcagcaugcccaccgcuuccacaguuaagaaaccuuucgaccugagaucuaagaugggcaaauggugucaccauagguuuccaugcugucgggggucaggaaagaguaacauggguacuagcggcgaucacgacgauuccuucaugaaaaugcuccgcucuaagauggggaagugcugucgacauugcuuuccguguugccguggaucgggcacgucaaauguggguaccagcggggaccacgaaaacaguuucaugaaaaugcuuagauccaagaugggaaaaugguguugccauuguuuucccugcugcaggggcucuagcaaguccaauguaggcgcauggggagauuacgaccacucagccuucauggagccucgguaucacgugcgcagagaagaucuggacaaauugcauagggcggcuuggugggggaaggucccacggaaggauuuaaucgugaugcugcgcgacacagauaugaacaaacgagacaaggagaaaagaacugcccuacaccucgcaagugccaaugguaacagcgaaguugugcagcugcuucuggauaggcggugucaauugaauguccucgacaacaagaaacguaccgcucugauuaaggcaauacagugccaggaggacgagugugugcugaugcucuuagaacauggcgccgaucgcaauauccccgacgaguacgggaacacagcucugcacuaugccauuuacaaugaagauaaacuuauggcgaaggcauugcugcuauauggagccgacaucgagucuaagaacaaaugcggccucaccccucugcuucuggguguacacgagcagaagcaacagguugugaaauuuuugauuaagaaaaaggcuaaucucaacguccuggauagauacgggaggacugccuuaauccuggcaguguguugcggauccgcuucaauagugaaucuccuucuggaacagaacgucgacguuagcagucaggauuugucuggccaaacagcccgggaguaugcgguguccagccaucaccauguaaucugugaacuacugucggacuacaaggagaaacagaugcucaagauuucuuccgaaaacucaaauccagagcaggaucugaaacuuaccagugaggaagagagccagcgacugaagguguccgaaaacucucaacccgagaaaaugagccaggaaccugagaucaauaaggacugcgaucgcgaggucgaagaggaaauuaagaaacacggcucaaacccagugggguugccggagaaucucacgaacggagccagugcagguaauggcgacgacgggcugaucccccagagaaggucccggaagccugaaaaccaacaguucccagauacugagaaugaggaauaccauagcgacgagcagaacgauacccgcaaacaguuaucugaagaacaaaauacaggaauaucacaggacgagauucugacuaacaagcagaaacagaucgaaguugcugagcaaaagaugaauagugaacuaagccucucccacaagaaagaggaagaucugcuuagagagaacucuguguugcaggaggaaauugccguccugaggcucgagcuggacgaaaccaagcaccagaaucagcuucgugagaacaaaauccuggaagagaucgagucggugaaggagaaaacagauaaguugcuccgggcuaugcaacugaacgaggaagccuuaaccaaaacgaauauuuga

SEQ ID NO: 58503 - RNA, 1650 nt, Artificial Sequence
  derived and/or modified sequence opt3 from LOC101060321__Homo_sapiens__NP_001278391
auggacguggucgagguugccggcagcuggugggcucaggaaagagaggauaucauuaugaaguacgaaaaagggcacagggcaggacugcccgaggacaaggguccuaaaccauuccgguccuauaacaauaacguggaucaucucggcauaguacacgaaaccgagcuuccgccccugacagcccgcgaggcgaagcaaauccgacgugaaauuucuagaaaaucaaaguggguggacauguugggggauugggagaaguacaaaaguagcaggaaguuaaucgaccgggcuuauaaaggaaugccuaugaauauucgcggcccaaugugguccguccugcuaaacaucgaagagaugaagcucaaaaaucccgguagauaccagauaaugaaggagaaggggaaaaggucuucggaacauauccagcggauugaucgcgacaucucaggaacucugcgaaagcacauguuuuucagagauagguauggcacgaaacagcgggagcuucugcauauuuugcucgccuacgaagaguauaacccugaagugggcuacugccgugaccugagccacaucgcagcccuguuucucuuauaccugccagaggaggaugcuuucugggcacuuguucaauugcuggccagugaacgccacucccuacagggguuucauucucccaauggagguaccgugcagggccuccaggaccaacaggagcacgucguggcuacaagccagccuaagacuauggggcaucaggauaaaaaggaccuguguggacaaugcuccccacuuggcugucugauaagaauuuugaucgacgguauuucacucgggcugaccuuaaggcugugggauguauaucucguugaaggagagcaggcccuuaugccgaucacacggaucgcguucaaagugcagcaaaagcgacugaccaagacuucccgcugcggccccugggcaagauuuuguaacagguucgucgacacaugggcccgggaugaagacaccguguugaaacaccuacgcgcuagcaugaagaaacugacgagaaagcagggcgaucucccuccacccgccaaaccugagcaggggucuuccgcaucaaggccagugcccgcuagccguggagguaagacucugugcaagggcgaccggcaggccccgccugggcccccagcgcgauuuccuagacccauuuggagugccucuccacccagggcaccucgcuccagcaccccauguccgggaggcgcuguccgggaggauacauaccccguugguacucaaggggugccuucgccagcccuugcucagggcggaccccagggcucuuggagauuccugcaguggaauaguaugccuagguugccaaccgaccucgauguagaagggcccugguuucgccacuaugacuuccgacaaucaugcugggugcgggccauaagucaggaggaucagcuggcaccguguuggcaggccgaacauccugcugagcgugucagaagcgcguuugcagccccauccacagacucugaccaaggaacccccuucagggcucgcgaugaacagcagugcgccccuacgagcggucccuguuuaugcggccugcaccuagagucaagucaguucccaccuggguuuuga

SEQ ID NO: 58504 - RNA, 453 nt, Artificial Sequence
  derived and/or modified sequence opt3 from LOC102723475__Homo_sapiens__XP_006724009
auggccuaccuggaggugugccucggcagccuuuccuguucuucagggacccugaugcccagaaugaucuugaguaacacaacugcugucacgccuuucuuaaccaagcuguggcaggaaacaguucaacagggagguaauaugagcggccuagcaaggcgguccccacgcucuggggacggaaaacucgaggcccuguaugugcuuaugguacugggcuuuuucggguuuuucacuuuggguauuaugcucucguacauacgaucaaagaaacuggaacacagcaacgauccguuuaauguguauaucgagaguaacgcguggcaggaaaaggacaaggcuuacguccaggcccgugugcuggaguccuauagaucuugcuacguuguggagaaucaucucgcaauugaacaacccaacacccacuuaccugagacaaaaccaagccccuga

SEQ ID NO: 58505 - RNA, 1551 nt, Artificial Sequence
  derived and/or modified sequence opt3 from LOC102723996__Homo_sapiens__XP_006723962
augagacugggcagccccgggcuccuuuuccuguuguuuuccucuuuaagggccgacacccaggagaaggaagugcgggcuauggucggaucagauguugagcugaguugcgcauguccugaagguagccgcuucgaccuaaacgauguguacguauauuggcaaacauccgagucuaaaacuguggucacguaccacaucccacaaaauucgucacucgaaaacguggacagccgauaucguaauagagcccugaugaguccggcgggcaugcuuaggggugauuuuucccugcgguuguucaacguuacaccccaggacgagcagaaguuucauugccucgugcugucucagagccugggauuccaggagguccucuccguggaaguaaccuuacacguugcugccaauuuuucagugccugucgugagugcaccacauagccccucucaggaugagcugacuuucaccuguacauccauuaacggcuacccucgcccaaauguguauuggauaaacaaaaccgacaauucacuuuuggaucaggcccugcaaaacgacacugucuuucuaaauaugagaggucucuacgauguugugagcguacugaggaucgcucggacacccagugugaacauugggugcuguaucgaaaauguccuucugcagcagaacuugaccgugggaucucagacgggcaaugacauuggcgagcgcgauaagaucacugagaacccuguuuccaccggggagaaaaacgcagccacauggagcauacucgcugugcugugcuuacuggucgugguagccguugcgaucggaugggugugucgagacagaugccuccaacacucguaugcaggggccugggcugucucuccagaaacugaacuuaccggcgaguucgccgugggguccucaagguuuuggggagcacagggccggcuggguugucaguugaguuuccgugucagcaagaauuuucaaaaggcugaagugccgugccuagagcagcuccuguuccuggagacacagcgcucccccagauggugugccaggcauuuccuucagccuccacuggggaugggauggcaccccggcguucacuuugugaccuugcggugggacuucccuaacaugcaucgaucucgcgaaacgagcgcgagacucccaaggucacccguaccgaguccugaucaaggcguccagggagggucccggcaccgcagacccgccccaauggguugcccugagugggugcaggcacccgcuccaagccccaggggcguuucucgugccgggccuggaacuggcgcucagccaccguggggugugcaagggggcucacggcaucgaagacccgccccuaugggaugcccagaauggguccaggcacccgccccuaguccaaggggcgugugucgcgcugggcccggaacaggugcgcagccgcuguggggcguacggagcggguccggacacagacaguuacugucuguggcagccaccccugcugcccuaguuugcccaucgguccccggcgcaacuuga

SEQ ID NO: 58506 - RNA, 399 nt, Artificial Sequence
  derived and/or modified sequence opt3 from LOC102724127__Homo_sapiens__XP_011544335
augagagccagccccugcaucucccagccugcugcaucuuggcacccaaggccgucagcccugcggcccaccgcgggcagugggccugacacacgcacuccaggaacgguggaggaugguagcgcucccuguccugccuuccgauccccagcagucucucccugcggcgaggaaccuuguugcuuucaaauuucgccagccgaagagacccucgaacuugggcgucugguuucaccgggaaacugugacacauugagccccagagcugcaggcuucuacgccugccaugugaggaguuuaauaccuugucgguccacuaagggucgcuggccacugaccgcuucugccgcggggcuaagcagacacgcacagugcggacccucccucggccugggcuga

SEQ ID NO: 58507 - RNA, 1656 nt, Artificial Sequence
  derived and/or modified sequence opt3 from LOC102724560__Homo_sapiens__XP_011544402
augcccagcgagaccccucaggccgaagugggcccaacagggugcccgcacagauccggaccccauucugcuaaggguucacuggagaaaggcaguccugaagacaaggaggcaaaagaaccacucuggaucaggcccgaugccccuagccgguguacuuggcaacuugggcgcccagcguccgagucuccccaccaucacacggcuccugccaagucgccaaaaauucugccggacauauugaagaagaucggagauacccccaugguccgaauuaacaaaaucggcaagaaauucgguuuaaagugcgagcugcuagcaaaaugugaauuuuucaaugccgggggaucaguuaaggaccguauuagccucagaaugaucgaggaugcugaaagggacggcacacugaagccuggcgauacuauaaucgagccaaccagugggaacacaggaauuggucuugcacuggccgcugccgugcggggcuaccgcugcaucauuguaaugcccgagaaaauguccucugaaaagguggacgucuugagagcgcucggggcagagaucgugaggaccccuacuaaugcccgguuugauagcccagaaucccauguuggaguggcuuggcgccugaaaaacgagauacccaauucacacauucuggaccaguaucgaaacgccaguaauccgcucgcacacuacgauacaaccgcugacgaaaucuuacagcagugugauggcaagcuggacaugcuugucgccagcguggguacugggggaacgauuaccggcaucgcgagaaaauugaaggagaaaugcccuggcuguaggaucauugggguagaccccgagggaucuauacuggccgaaccagaggaacuaaaccaaacagagcagacuaccuaugaaguugaggguaucggcuacgauuucauuccuacagugcucgaccggaccgucguggauaagugguuuaaguccaaugacgaggaagcauucacguuugcucguaugcugaucgcccaggaggggcuucugugcggaggcucagcugguagcacuguggccgucgcaguuaaagccgcucaggaauugcaagaggggcagcgcugugugguaauacuccccgauagugugagaaacuauaugacaaaguuccugucugacagguggauguuacagaaaggcuuucugaaggaagaggaucucaccgagaaaaagccauggugguggcaucuucggguccaggaacugggauuguccgcgccccuaacugugcugccuacaauuaccugcggccacacgaucgagauccuccgagaaaagggguucgaccaagcaccaguuguggaugaggccggagucauucuggguauggugacccuuggcaauaugcugagcucguugcucgcugggaaaguacagccgucugaccagguuggaaaggugaucuacaaacaauuuaagcagauucgccugacagauacuuuaggcagacugucccauauacuagagauggaccacuucgcccucgucgugcacgaacagauccaguaucauucaaccgguaaaaguagccaaaggcagauggucuuuggggugguuacagcaauugaccugcuuaacuucguggccgcucaggagcgggaucagaaguga

SEQ ID NO: 58508 - RNA, 663 nt, Artificial Sequence
  derived and/or modified sequence opt3 from LOC102724770__Homo_sapiens__XP_006724997
auggagagauacgccggcgcucuggaagagguggcagacggggccaggcagcaagaacggcacuaucagcuccuuagcgcgcugcaguccuuggucaaggaguuacccucuucauuccagcaacgccugaguuacaccacacuaagcgaucucgcucuggcccuucuggacggaacuguuuuugaaaucgugcaggguuugcucgagauucagcaucugacggagaaaucccuguauaaccagcgacuccguuuacaaaaugaacacagaguacugaggcaggcacuucggcagaagcaucaggaggcccaacaggcuugccgcccucacaacuugccagugcugcaggcagcccaacagagagaacuagaggcugucgagcauaggauacgggaggaacagcgcgccauggaucagaaaaucgugcucgaacuggaccgaaagguugcggaucaacagucuacccuugagaaagcaggcguggccggguucuacgucacaacuaauccgcaggaacugauguugcagaugaaccuccuggaguuaauuagaaagcugcaacagaggggauguugggcuggcaaggccgcacucggucuugggggacccuggcagcugccugcugcccagugcgaccaaaaaggcucgccagugcccccuuga

SEQ ID NO: 58509 - RNA, 2292 nt, Artificial Sequence
  derived and/or modified sequence opt3 from LOC102725016__Homo_sapiens__XP_006725712
augcacggcgccugcagcaugagaagguuccauccccugcucgcucuugcagggacccacugugccugcucccauuuucggucuucacgcacagcgacuccuccaugggcugccccgcugaagaucuugaacgcagagcgagcccgugcugugagacccccucagccauuacccaggccucaccggagucgcagcgcaccacccaaaccuccagccaaggcuccgagagccgcgggaagggcauggcuggccgcugccucuccccgggacgauauugucgcaaugacgcgccgauccgacguuaaugcuggugcccuagugugggaaagaggcaggcgggcgcguuucgaggccgcacucucgucagcugggcgcaccgccccuccacccagaagcccuaggccagcuaguccccgguccucucgaggagccggcccgguaccuugugcagcucccccacaacgcgccgugcuggcgagcccuagauccgucaggggugggcccaaaccacccggacggggcggcgcacgcgccucagggggagcugccgguccugcaccagccaugccgcccggcaaggugcuucagccuguucugaaaaugaagguggaugaauuguuucucuacuggcugagugaggcuagcacacagagaaugcugcaggacugccucaggcguauaaaggccccagggcgggaucaacccacuccuggagacggcgaacagccaggugcauggcccaccgcgccguuagcugccccucgaccaucugggcuggagcccccuggaacacccggcccaggcccugcacuucccuugggggccgcuuccucaccaagaaacgccccgcaugucaggggaacccgccggagcgcagguacuagagugguacagacaaggaaagaggaaccucugcccccagcuaccagucagucuauccccacguucuauuuuccucgcggccgaccacaagauuccguuaauguggacgccgucauuagcaagaucgagucgacuuucgcgcgguuuccccacgaacgugccaccauggaugacauggggcuaguggcuaaagcauguggaugcccucucuacuggaagggcccgcuguucuauggugccgggggcgagagaacaggaucuguguccguccacaaauuuguugcuauguggaggaagauucuucagaacugucaugaugacgccgcaaaguucgugcaccuguugaugucaccaggcugcaauuaccucguacaggaggauuuugugcccuuccugcaggacgucgugaacacucauccuggguuaaguuuucugaaagaagcgagcgaguuccacucccgcuauaucaccacaguuauacaacggaucuucuacgccgugaauagaucuuggagcggaaggauuaccugugcugaacuccgacgcucaaguuuucuucagaacgucgcccuguuggaggaagaggcagacaucaaucagcuaacggaguucuuuuccuaugaacacuucuacgugauuuacugcaaguuuugggagcuggauacugaccaugaucuccugaucgacgcugaugaccuugcccggcacaacgaucaugcacugagcacaaaaaugauagacagaauuuucucuggugccguaaccaggggccguaagguucaaaaagaagggaagaucucauaugcugauuuugugugguucuugauuagugaggaagacaaaaagacuccaacaagcaucgaguacugguuucgcuguauggaucucgacggagacggcgcgcuguccauguucgaguuagaauauuuuuacgaggaacagugccggagacuggauucuauggccaucgaggcacuacccuuccaggacugccucugucagaugcuggaucuugucaagccuaggaccgaagguaaaauuacguugcaagaccugaagcgaugcaaacucgcuaauguguuuuucgauaccuucuuuaacauagagaaguaucuggaccacgagcagaaagaacagaucucgcuucugcgggauggggacagcggcggaccggaguuguccgauugggaaaaguacgccgccgaggaguaugacauucucgucgcugaagagacagugggcgaacccugggaggauggguucgaagcagagcugucaccaguugagcagaaguuaagugcccugcgcucuccucuagcgcaaagacccuuuuucgaagcuccaagcccucucggagccguggaccuguacgaguacgcauguggugaugaagaccuugagcccuuguga

SEQ ID NO: 58510 - RNA, 1899 nt, Artificial Sequence
  derived and/or modified sequence opt3 from LOC102725035__Homo_sapiens__XP_006726376
augacccccgcccugacagcucuccuuugccugggcuugagcuuagggccuagaacuagggugcaggcaggaccauucccgaagcccacgcugugggccgagccugguuccgucaucucuuggggcucaccaguuaccauuuggugucaagggagucuagaagcgcaggaguaccggcucgacaaagaaggaagccccgagccucuggaucgcaacaauccacuugaacccaagaacaaagcucgauuuuccauaccuucuaugacagagcaccaugccggccguuauagaugccacuacuauucgucagcagguuggagcgagccaagugacccgcuggaauuggugaugacuggguucuacaauaagcccacccucuccgcccugccuucuccaguaguggcuagcggaggcaacaugacacugagguguggcucccagaaaggguaucaucacuuuguccucaugaaggagggagaacaucaguuaccccggacccuggauucacaacagcuucacagugguggcuuccaggcauuguuuccuguggggccaguuaaucccagccaccgcuggagauucacuugcuacuauuacuacaugaacacaccucagguguggucucauccguccgacccccuggagauccuaccaucaggagucagcaggaagccuagucuccugacccuucaaggccccgugcuggccccaggucagucuuugacgcuccaguguggguccgauguaggauaugaccgguuuguucuguacaaagagggcgaacgcgauuucuuacagcgacccggccaacagccucaggcugggcugagccaagccaauuuuacucucggaccagugucgccgucucacgguggccaguauagaugcuacggggcgcauaaccuuuccucagaguggagugcacccagcgacccucugaauauuuugauggccggacagaucuaugauaccgucucccuaucugcucagccaggccccacaguggccagcggugaaaacgugacucugcucugucaaucaugguggcaguucgacaccuuucugcuuacaaaggagggggcagcucacccuccacugagguugcggaguauguacggcgcccacaaauaucaggcggaguuccccauguccccggucaccagcgcccaugcaggaacguaccguugcuacggcucuuauucaaguaauccucaccuccugagcuuuccauccgaacccuuagagcugaugguuucugggcauucgggagguagcucccuaccucccacuggcccaccuucaacacccgggcucggacgcuaccuggaagugcuuauuggcguaaguguggcuuucgucuugcuccuguuccugcuucuguuuuugcuccugagaaggcagcggcacucuaagcaucgaaccagcgaucaacgcaaaacugacuuccagagaccagccggugcugccgagacagaaccgaaggauaggggguuacugcggcgcuccuccccugcagccgacgugcaggaggaaaaccuauaugcugcgguuaaggacacccagagcgaggauagaguggagcucgacucucaacagucaccccacgaugaagacccacaggcagucacguacgcccccgugaaacacaguagcccuaggcgugagauggcuucuccacccuccucacugaguggcgaauuucuugauaccaaggaccggcagguagaggaagaucgacaaauggacacagaggccgcagccagcgaggcuucgcaggauguuacuuaugcccaguugcauucccugacccucagaaggaaagcaacagaaccuccgccaucucaagagggagaacccccugcggagccaagcaucuacgcuacucuggccauacacuga

SEQ ID NO: 58511 - RNA, 9861 nt, Artificial Sequence
  derived and/or modified sequence opt3 from LOC400499__Homo_sapiens__XP_006721060
augaccgccugcacuggcagcgcugggccccaucugccugugggaacuagauacacguaucacuucuccaccaacacaucuacuucacuccaggacguccuuguugaggguaguggccugggguugcagggauuagcagugcuggauguauugggccucugucagauggcccuguggcuucaggacuuucaggugaccagcauccugggugcgaaggucgaauugcucaaggaguccgaaucucugucggcuacucuggggaggaauccacuccgguucauuuuacacucaggacgcguggcccaucugugcccgcaccccaccgagccucgauggguucuuaacgugaagcgugcagucuugagccugcuacaaggccauccaggcgcccacagucccaaaacuuuugaugaaguggacauacucgggagauguccuacaaccuaccagcaccauggagauuggcugcacaagacgaaagaccuugcuaggugcucccugcggcgcgguagaucuagcuugcauucccaggcacucccaggcguagcccccgggcugacuucaagguuaaccuguguucagaguuuccgggcuggagugcugcgcgaggccagcugcacagagcucgauucugcgggcccucuuccagcaaaggccuccgcuguccaaaugcgaacucugagcucauugagucuacugcacgaaaugccgcaggaccccgccgguaccgauccugacgauagagacgaugaggacaugacaccaucuucccuccuguaugaaugggaggagacccccagccaggcaaugguggcuacggccgcgacucuugugaggcggcuguguuuggcccagacaaccucgcucgaagcaauggaccuguuuuuaacucuggucucucaacuacaggggcucuccggaggcgagcugauggaacuuuggcaguacucaaguuucaagugccgugauaauggccaaccuuugcuggacgcucucccaagcugugggacagagcacugcguuggacugaugaaagaacuuaucgccuccgcugccguggaggcagaugagguagaagccuggcugucuagcuuggcuuuucucccccagccgaccgacgcgauggugcauaugcuguuaccucugcuacagacgccccgcgcaucaccaggugccuuccucggcauuagugcucugguccacaaccuuugugccuccuuggaugggccuugcggacagcugcccggcguggguagccucguuagaauccugggggacgcauuaggcgagaauugcaccauucaagaaccaucugaugacgauaagcugcagcuuguguugaaagccgucggaaacgcuggccucgccgcaauggcgcugacacccacucuaucagcuugugccagucugaggagcuccaccccugagauccggcucggggcaauacaggccuuucgacgcgugccaugcucugcugacagaucgguacugagcaggcuuuaucaguccuuggaagaggaugccgagauccggauuaaugcauaccuggcuuuaaugcgcuguccgucagaagagguuuucgcccaagugagaaggacacaggcgggagaacucaguacucaggucgguucuuuuguguggagccauauccugcagcuucuggagacccacgaccccuugaagcgugcccuccgggacacacugccugaagauauucuaucccaagaguuccauccagagauguggaaacacucaagcuauucugacgucaccuuucgauccgugaguggcagccugggggcuaaccucgaaggaacucugcuuuucucucccgcauccuucuugccuagaucagccacgguuaaucugacaauccacaccaugggcagggcuuuuaacuuacucgagcugggucuucgccuggaaaaugccgaggagauagcacaucggcuauucgggagaaagaguuuuuggggccaggaagauggaagggagccagaacccgaggaaccgccuggcccagagcccgggccugcgccccagccagccagcccugagugccccggagaccgcgaucgacggaugcguuaccuccagcaaaaggugacuagaaggcgcggugcucggcaggcccugagaugugaauugucgguaaaacuguuaggccaggagcucuccuucgucaacugcggggcaaccggaucucacgugaaucauuggccacugaaccuugcugaacuggccauuaaguugaugaaaggccaagagguucagaugaauaggcgacucagccuggcagcccaggagcugguguuuccgacagucucaggucugccugcucgccuuacccucaacgcgagugccgcaaucuccauucgggugagagggacuacagacuuccagcaaaggucugauuuuagcguaaacggcuacgugaagcccuccgcucuguugcagaucucagcccagaugggaacggccggcauccuggggcaggcuggauuacguuggguuaccagcguccgcagugcagccucucucgacggcgguauucaagugcagaaagggcgggugcugaagguccaccuuaauacuccagaggaggcgguugaacuguuguccuucagcucgcagcucuaucugauaacaagagauggagugaggucacuacgacacgugcccggcccuucugagguacagaguuguaccggugaagaggucuccuacacauggggcuggcggcugugcacuggggugaccuggccaguucccggacaaccuuaucuucucagccugccgguguuugcugccgucacguugcagaaacgcgacccaggcuuaagacaguaccugcucgaagcagccuauacccugcaaccccagaaggggucuugguucccucaggaggcuacagcacauguguuuaugggaacuccaggcagcgagguucuuagggauguggguguagacauguccuacucacugccccagaacaaguuccgguugaaacuacugcacccuaagaaaaagaucgaacucgaugggaaaauggaggcccugggaagugcgcauaccggccaccuugaauuaguccuggacgaccgagauguguauuacauuaaggguuggagcgaccuccaaccggcuaugggcggggaggccgagagauuucaggcacaguuggaagugaagcuggucacaggaggcucucccguuguguucacugggaaucucacccgccagguaggauccaaacuggccuucucagcuagucuuagccaucuguuguccgaucaagccaacgugacggcacuacuggagaggaaggaagagaauggccgucgggucgcugcccucggugcggaauuauuugugccagggcugguuggacuuagagcccugggccucuugcagcagaggggucagcuguggacaaacucucuccgcauccaauacucgcugcuuggccaggcaaaacaggcugcccacgaguguagcaccucacagaagcuacgagcugacuccgggagugauggagcauauagacuggaguugcggcacgaauuacauugcacucaaauacuggccuucucucacaaagugcagcucuggcaugaggaagacagcggccaccuucacucccagcuggaggucucauacgggaagcacugggauaaaaauucuaacaaaaggcaucugcgcgugagccaaacauuuaagaaugacaguggaccugcccucuccaaccauuucauggaauuuguucuacaggugcccgagcgucaggucgauuguagaguacagcuguaucaccuaagccugcggcucccauacguggagucuucaucccaucuuaaaguucaauauaauggcaggccucuguucguggcuggugggcaguggaaggacaccagucgcgcgacuuuauggaaaugggaaggagcauugaaccuggauagccccuggcucauggucucggccgcucaccgacuguacuggccacacagagccguguuucaggcaguacuugagcugacccucggcaaggccuggacauugaaggaccugguggucucuguuggcugccggucccaggggccgaauagggaaggaaaaauucaaguguauacggcugcgaccacuuacuuacgcgugagcacagucaccgugcuagcccagucacuguuccauaguuggucugagcucgaauccgcauggaacgcugccguucagggugagauccacgcagagaauagcagagauaggaagauccuuaacugcuggcugaaaggcccucagcaagaauugaaccugacagccgcuuaccggcaucucgaguggccccguaagacucagguaucacugaccgccgugcgcauuggggcgcagggacaaccacgaggccuucagcucgaaggugagcuggaggaauugagacaggacaggacgcuguaucggaaacgcggggcauuacuacugagacacccccuccaucuuccuaucccacagagucuguugcugcaagagacauuuaccgccgacaggcggcaccagcgauacagccucgaaacuagagucgugcugaauggacgcgaggaaacccuucagacaaugguuuuaggcugucaggcuggccaccccuaugugugcgccgggcugaugcauccuuacgauggaaaggucauuccgaggaacacugaggguugucucgugaccuggaaucaacacacagcuaaaaaccgggagguagaagcaacguugaagguccaucguaaggugguucugcaccuaaaaggccugcaccaugacagaucccagcacggggagauaaggcauucucucgcccuugaucuggcucacagcuaucaguuguccuucccacaggcccugucacucgacggaggcaucauuuuucgccaaucuccccaggguaccuucaauuuugggauggaugcacgggcggccgugaaccauaaugucacaagucaggcuucggugcagcugaacggaagcgacuccgauuucgccuucuuuuuccaauuacgacacccucacggccccacauuuccaccuaauuuccagguucaggcagcugccggcagauacagggugcgcucucuuaacgggucacugagcguccaaauguccggacgggaacucgugcuacuggagguagacgcaagucaggauaccagacguucuagcagggguuggggcgugucaguuuugcugcaucaggccguccucuccgcuccccgggcggugcgccuucagcugagugccaagaucacuccagcacgaaucugguuguuuagcaaagcucugcucgaccaaaauacagcccaguuacugcuuaaggccucugaagaguggagagggggaaggauucugaccuuccagucccagacgcggcacacuguggcaggcugggcugccaugccucgccuacucacccugacagguagauugaaacaaaaggagacccugcaggaagggacucucucagucacagcggauagcgcuguacuuggauuucuguuaagggaccagcaugagaaggccggcaacggcaccucggugcgaucuguuacaugcgugcuggcacagaauaguucccaagccuugccgggggaacuccagcugaaaggacggcuacaggcucaaacucguaaccuuagagcacaggccagcauacgcgcgcacgcugccucacuggcacucgguggcgccuguuccugggggcccaggcacggacagcuggcuggcgguccaacccauaauaucucuacguugagcgacgccgggcugccuagugaggcaggaaugcuccuuucccugacacacgucgcuagcaacugcucugcccgguuagcgcuguggaacgccggcgcacaguuggauggcgcuauugggcucgaagacgugacccccgagucaaguggacugcaacuacaugccucccuuagacacacucauaccaugccaagccugaagcacuggggucucccuuucucucuggauggccacgggcauuuucagucgguuggacgcucauuggcagcuggcuuaacagugauccuggacggugagcagcucagggccgcccuugaacgaaaagcggaagggggccggcagggacugguccuaggccugcaccaugggcucagcggauugcaagguacucugcccucccagcuugaagugaauuguaguggcgaugcuucuccgacccagcugcucggguggugcagaggagacauugcaggccagccauuagagguaagcguggauauccacaacgguuccucaggguucgagcauaguggcaggauacugaugggaccuacguuuuugaauuauucuguuagcuguuacuaccacgacggccaccuggaacucuccgggcgcucauggcauaacagcgaggcccuucugugggcuggauuccccggugaagccugccuaucugcagagcugcaaauccacgaaacacagacccaggcccgugucgcucuccauggcggggauuccggagugaguauggacuuggcggcccugguggcacggccaagaaggggcccccuucaacuggucgcuagcgccucgcacacuguuccugcauuacagcgccucggucugccguucacaaaucaguugguguuucaggggcugugggaggccgaggaaauguccucuucacuccaacuuaccugugauagccaggcuacucugguacuagacgugcgaggccagaaccaggccgucaguaaggagcuacucuucuccggacggcacagauugcccuuucuguuaggccuuugcccaucuagcgcgucagcauccgccaaacugcauuauaguaagggggaagugcaaagcauguucgcucucggaguugaggaaaggcacuuucauauuucuacacgccagguggccgcaaaggcuggccugaauaacuucaucaaauuggagcagaccuuucugcagcucucagcccuuccuagagagcuguuccuacaaacggcuuacgaacgggcccacgguacuaggguccugcgucagguaguguuaugggaugggcaggagguugcacucaccggaucccugagcggccccuuuccuaagccaacacgaaauuugucucuucagguggaacugacccauccccucccucugccauugccccgccacugcagucugagacuaucguccgagcaccucgguggcagccaucgggacgggcuugucgugggaugggacggcagggaucaaguccuggugucaucuagcuuauggcuggggaaauccgaacucgcggcccgccuggcuuuggcccacccguucaaccuuccuuggagacaggcagaggcuaguggacuggccgagucacggggcgguaggcagucucgacaaguucagcucacauggaaucgugggcagccagcaacucugcagcuaaccugggccgacgggagcuuggcgcauuccacggcuugggauggcugucuggccgcaagucccggucaacuccaggaaacauggggccuuaacagccugcaggccugcggggcuuuuacucagaccccugccguguucguagagcaauuaaauguguccuggggacagcacagaaugcgccagaaccugacauaugaacggcacuggccaucucagcccgacaagauuaucauggaggcaacccucgagcauguccugggcgcuucauguacuaggcagagcuuuuggggagaaguucagaccgauuacgccagaugguugcgccacucgcuucaucugggacucugcgaccugccgcgggcgcuauuaguggucggcgagcacacacugggucaagggggauugcuccugaggucccgaugucaucuuggccuggcuccugaucccgaccacggccuccaccugaguuugacgcuucaaaaucauucuagaccacggagcgccgauuucucaggggcacuggaacuaaggggauccaaagcccagcgcgugggucuccugggccguguaucuacaaguaccagccaguccuuagugagacuggaggggucaguugacaaccgagaagagaaggugagguugagcgucuuccgggcuccuucuugccuccaggcaaguguggcccacgaggaaggaggccgcgaggaauccgucgugcugagagcgugugcccaugguaggacagcugaggcagaaguucuuuuucgggaugggcgccaacccagccagccacugggaagacucaccuugcaggccgcuaaccagucacugcuucuggccgcacgaggcugccaaggcggguuacuaggacacguagagucuaggauagcugccguggguucccagguccaggcgcggcucgaggaaaaggugcagggccugggggccucgguucgucgcuuccaacagcuggugcagcccgcaggaacuuuggacggcgucgcuggucuccugcuucagcugagccaagccgggagagaggcaaugcaggccaguggaugggcuguggccacauuaugggcgaggucucaggcucucacccaacaucugccuuuguaucuugaauggcugcagguaggccuagagcagcuccgggaggaacuggaguggccacuggcaacguugaaagaugccuaccucgaagugacucugagaccgcuugaggaaguuuggcgcgagcgagcugaggaagccaugaggcggcugcaggcauggguccccggcaugccugggaagggagguccaagacccauucgugccgcuuuaggcgcgaugaaaggggcccucgagcuggcagcccaacagaugcuauccugggcugaagcaacauuuagccgcgccuugaagaggcuguguaaaccucuucucgaccuguauucacugagugcucggaauagauccgugguggucauguugccacuucuccccgccggagacgagccucuggauguugcgcgagugaccagcuacuuaauggaagagaagcugcuaaggccgcuccgcgagcugucuggcgcaaacguauuggccgaauacuauuggcugcggagaaggcuucucgcugguccaugggaguaccacgcccugguggcaggggcucagcacgucgugaccuucgacggacgcguuugggauuuaucaacucagugcggcagcauccuguuggcccaagacuuugcgcauaauacauucucccucacccugucucguacaggcagugggcuuacugcccuguuuguggaacuaaaccacaaaacgcucauucuguaucccucguugcaggcuuaccggcuguauaauagcucccuuccuggagauucaugucccgaccucaagcugcauccagcaaccacaagaaaggaugucucucgaaucgaguuagccagcgaagacggugugaguguauccugcgauguuccuacuggccugugcucauugacccucgggcuguggcagcacggaauaucugcuggccuucuggguacaaacgacaaugaggcagggaacgagcuaaugcuccccgauggaagcauggccaggucccuggaagaguugagucuggcuuggcaagugggcggcgacugucgcgccaccgaaaaaccacaacaggagcaggcaugcccggggcaacuuccugccuguugggcguucuuugaaggaccccacagcucuuuacgggacugcuucagagucguggauccaacucccuuucugucacucugugugcaggucccuugcgguacgcaggagcugcagccagcuuguaaucuagccgcagccuacauccauuugugcgcuaggggcuucguuccccuggccccuccgccacaaugugcacccuga

SEQ ID NO: 58512 - RNA, 1251 nt, Artificial Sequence
  derived and/or modified sequence opt3 from LOC400927-CSNK1E__Homo_sapiens__NP_001276841
auggagcugagagugggcaacaaguacaggcucgggcggaaaaucggaagcgguuccuucggcgacauuuaucuuggggccaauauagcuucuggagaagaggucgcaaucaagcuggaaugcguuaaaaccaagcacccccaguugcauauugagucaaaauuuuacaagaugaugcaaggcgguguggggaucccuaguauuaagugguguggagccgaaggcgauuauaacguaauggugauggaguuacugggcccaagccuagaggaccucuucaauuuuugcucccgcaaauucucucugaagacaguccuucuguuggcggaucagaugaucucgcgaauagaauacauccacagcaaaaacuuuauucaucgugacgugaagccggauaauuuccucauggggcuggguaaaaagggaaaccugguuuauaucauugacuuuggccucgcuaagaaauacagagaugccaggacucaccagcauauccccuaucgggagaauaagaacuuaacggggaccgcacgcuacgccagcauaaauacacaccugggaauugaacagaguagaagggacgaucuugaguccuugggcuacgugcugauguauuucaaccuagguucucucccuuggcaagggcugaaagcugcaacuaagcggcagaaauacgagcgcaucagcgaaaagaaaauguccaccccaauugagguccuuuguaagggauaucccucagaauuuaguacauaccugaauuucugccgaucauugagauuugacgauaagccugacuauucuuaccucaggcagcuguuccggaacuuauuucaccgucagggcuucuccuaugauuacguguucgacuggaauaugcugaaauuuggcgccgcucgcaacccagaggacguagauagagaaaggcgggagcaugagcgagaggaacgcauggggcaacucagaggaucagccaccagggcgcuucccccugguccaccgacuggcgcaacagccaaucggcugcgcagcgcugccgaacccguugcaaguaccccugcuucuagaauccagccagccgggaacacgucccccagggcgaucagccguguggaccgggagcgaaaggucucgaugagauugcacaggggagccccugcaaacgugucuuccucagaucuaacuggccgccaggaagugagucggauuccagcuagccagaccuccguccccuucgaccaucuggguaaauga

SEQ ID NO: 58513 - RNA, 2583 nt, Artificial Sequence
  derived and/or modified sequence opt3 from LOC645177__Homo_sapiens__XP_011519208
auggccagccccagaaaggugaccgagaaaaggcacaacccugucgaauccaucugccggaagauucgcgcuauacauaaacgagaggcaaucucuaauccaauucagcaaaucauuaaguaccagucaaguagcuucgacuccccgcagacaaacacuaaaaaguauuuugaagagguucugcguaagaugacggccgcgugugugcccaccccuggcucucacuggucgucaagcgaagagguagaugcuuucaucaguuccccacagauaaucucucccagaacaccuagcacuucccaucucucaaguccagagaccgccacauacagcgugauucuuaccucuuccgaaaaugucucaaaacccaagagccaaaguaacaaaaauuauacuucucugaugucccagaucaggaaggcagaguuuuucagcaacaaagacuugaauaacuacugcucggaaaauaacuuuucuacauuaacccuggauuucgacuccacguuugugcagucacuaaaguguuucgauccucaggacaguguugugaagaaacucagccugaaugaggauggguggaagcaagaggccgacgauggaaaagaagacgucauuuauuccaucaaccgggcuugcaaggaggaagcacuuacuucuauauuuaaugccugugauauuaaacgcaaggguagcgugggcguagcuaaaaucauuaacuuccugagacagaccacaucacagaauagugaggacuccggguuggaacagcucuggaacaugcuggauccagagaagagggacccgcacguugaccuggagacuuuucaagccaugaugaaggauuggauggcguacugcggaaacaccugggaaggcgugaaucaucggcucagcucuaucaucgacgauucagucugugagcaggacgguauuaaaagugaugggacaaugaagaugagcaccgacauaacggauuccacuuuaggaucuuucgaagcacugggcggcgagacaucgaaaggggugcuugaagugagcgacuugaucgccuaugucgcugaucugcacuuuaacaagcgcaaacuagaggaggaaaauaacaaguucaagcucgcccuggagacccuugaagagacuaauucccagcugucagaagacugcacagaguugcgacuccaaguuaaaagugcacaccaggcuauuaugagaaccaaccuguuaaaggaggaacuggaggaacucaaacuuucuaugaaugccagcgaggagcagaaguccaugaucguggcgcagucaaaacaacuggaaacggagaacagggccuugauacuaaagauucggauccugcaggaagagaauuucaagaacaucauggauauugaccgucucgaaaagaagaucgaggaccugagcaaaaccgagacagaacaucagguaucuacuucccagauucuuaugcaacugcacaccuacgagaauacauugcucaacaaggauacuagccugcagaaaaagggauuauacauagaagaguugaagaguaccaucauugaauaugguucuaucaucgagaaucuacgcggcgagaaauccaagcucgcacaugaacugcagcaccuucagcaagcucugauuacaaacgggauacagcugaaugugaacggagaguguaacucaaucauuagugaaggcgagaaaagccuccacuacgaacugacccuugcccagucggcugagaauacugagacggaaagacagcauaacgucaucaaucuguccucuuuggacgccaugauggaucaagagaugcuccuguuacugagggaacccgcacagaaggccguggaguuuacagcuacccuacagaaacuccacgaggaaauuagcaagaucgcgacucugauagagaacucacggcgauggguuaccaauccugaaaucacagugaaagagaagugggaggaacaacuuaccgaguucaacaauauuauggaagagaaguuggaccugugcauccucaugcugaacauuuuagguaaucauaaagaaagucuggauaaggaguuugcaaaacuuaucgaaauauugaagcgcuucagacaggaguauuuuuacuucaggaaagaguuucucgcccggaacccaacuuccgggcagaagcagcuggaagcuauuaagcaacuacaggaggacgccgucaaucaggaaggaauccugcgcaaaagacuccaggagacaucucaaaggcuggaagauguggaggagcagggcaaggaccgugaucgggaagcacacacggccagcgagaaagcuaccucccuuuugcauaagcuggaagaggccauuucagagcagcgaaacuuacagacuaucaauacagaacucagcaacaccugucaagcacugcagcagaaaacaagaaaacuuaagaaugcgcugaguuuggacucuuucacugcuguacccacccucgaguccacgccuuuuagcggcguugccaaccaaauacacacccugugcgaaaggccaacauauggggaggugaaagauggagcacuagacgucaagcgccagcacaaauga

SEQ ID NO: 58514 - RNA, 2688 nt, Artificial Sequence
  derived and/or modified sequence opt3 from LONP1__Homo_sapiens__NP_001263408
auggccgcuagcaccggcuacgugagacuguggggagcagccaggugcuggguccuccggcgccccaugcuugcggcugccgggggucgaguuccuacagcagccggcgcuuggcuguugcgugggccagugaucacugcauuaacgccgaugaccauucccgacguauucccucaccuuccacuaauagccaucacaagaaaccccguguuuccuagguucauuaagaucauugaggucaaaaauaagaaacucguggaacugcuucggcgcaagguuagacuggcucagccauaugugggagucuuuuugaaaagggaugacuccaacgagucugaugugguagaaucacucgacgagaucuaccauacuggcaccuucgcccaaauacacgaaaugcaggaucugggugacaagcugcggaugaucguuauggggcaucgccgagugcacauuaguagacagcucgaggucgagcccgaggaaccugaagcggagaauaagcauaaaccaaggcguaagagcaaacggggaaagaaagaggcagaagaugaguuauccgcccgccacccggcugaacuggccauggagcccacaccugaacuuccagcagagguguugaugguggaggucgaaaacguugugcacgaggacuuucagguaaccgaagaggugaaggcucugacugccgaaaucgucaagacaauuagagauaucauagcgcuaaauccccucuauagggagucugugcugcaaaugaugcaggccggccagcggguuguggacaacccuauuuaccuuucggauaugggcgcagcucugaccggggccgagucacaugaauugcaggacguccucgaggaaacgaauaucccaaaacgacuguauaaggcuuuaagccugcucaaaaaggaguucgaacuuaguaaacugcaacagcgcuugggaagagagguggaggaaaagauuaaacagacucacaggaaguaccuacugcaggagcaacucaagaucaucaaaaaggaacugggucuugagaaagaugacaaggacgccauugaggaaaaauuucgggagcgccugaaggaauugguaguucccaagcaugugauggaugucguggacgaggaacucuccaaacugggcuuacuggauaaccacucuagcgaguucaaugucaccagaaacuaucuagacuggcucacauccauaccgugggggaaguacucaaaugagaaccuggaucuugcaagggcccaggcuguguuggaagaggaccacuacggaauggaagauguuaaaaagcguauccuggaguuuauugcggugagucagcuccggggcagcacucaagguaaaauccuguguuucuaugggccucccggaguaggcaagaccucuauagcacgauccauugccagagcucuuaauagggaauacuuucgcuucucagucggcgggaugacagacguggccgagaucaagggacaucggagaaccuauguuggugcaaugccaggcaaaaucauucagugccugaagaaaacgaagacugagaacccuuugauccucauugaugaaguggacaaaauagggaggggauaccagggcgaucccagcagugcccuguuagagcugcuagacccagaacagaaugcuaacuuucucgaccacuaucuggauguccccguggaccuuucuaagguauuguucaucuguacagccaacgugaccgauacuauuccugagccacugcgcgaccgaauggaaaugaucaauguuuccgguuacgucgcacaagagaagcucgcgaucgcugagcgguaucuggugccgcaggcccgugcauuaugcgggcuggaugaaagcaaagccaagcugucgucugacguguugacacuccugauuaaacaguacuguagagaguccggcgucaggaaccuacagaagcaaguugaaaaagugcugcgcaagucagcuuacaaaauagugaguggagaggccgagagcguagaagucacccccgagaaucuccaggauuucgugggcaagccuguuuuuacgguggaacggauguaugacgucaccccacccggggugguuaugggacuggcauggacagcuauggguggcuccacucuuuucguggagaccucuuugagaaggccucaggauaaggacgccaaaggggauaaggacggaagccuggaaguaacaggccaguuaggugaggucaugaaagagucagcgcgaaucgccuacacuuuugcucgcgcauuccucaugcaacaugccccagcuaacgauuaucuggugaccagucacauucaucuucacgugcccgaaggggccacaccgaaggacggcccuuccgcaggaugcaccaucgucacugcgcuguugagccucgccaugggccggccaguuagacagaaucuggcuaugacgggggaggugucucuaacaggaaaaauucugcccguagguggcaucaaggaaaagaccauagccgcaaaaagggcuggggugacuuguaucguccucccugccgagaacaagaaagacuuuuacgaucuggcagccuucauuaccgaaggacuugaggugcacuuuguugagcauuaucgugaaaucuucgacauugcuuuucccgaugagcaggcggaagccuuggcaguggagcgcuga

SEQ ID NO: 58515 - RNA, 2322 nt, Artificial Sequence
  derived and/or modified sequence opt3 from LONRF1__Homo_sapiens__NP_689484
augagcucccccgccguggcuagaaccucuccuggcgggucaagggagauggcaccagccccgcagggacggggucgcuucugggaagucggcgggggaaguggccaccgacuggagcgugcggcugccgaaagcgagagaugggaacuccuucugaggcggggugaguuguuagcacuagggggacaucugaagggcgcccucgaggcuuuugcagccgcucugcgcagaggcgcccccgcgaggccugaaugccuuggggcacugguugacuguuugguguucaacuaccggcuccgccacggacuggguugguccgccgcuccaguagccggcgcagaugggggagcuggcggucugcuccgaugcuuaggguguagaggauuucugucugagcccgugacagucccuugcggccauucguauuguaggcggugccuucgucgcgaauugagagccaggugucggcugugccgagaccgccuaccacccgcgacugccucagcaacggaugcugagggcaccgccccuagaccaccgccccucgcugccgcaaucgccgcuagcgacuucaggacaagugugguucugaaucaccuugcggagaaaugguuuccugggcaacgggaacgcgcaagagccgcuggaaggcugggugaguugcuccaucagggccguuaccgggaagcccuggcagccgcuugugaggccuuacgagcagaaccauccgaucugauugugaagauauauagagcggagucuuacgcugggcuccaggaguucaaagccgcaaucgaagaccuuaacgccguccuguuucaguugcccgauuggccugagguguauuucaggaagggaaaaguacuaugcgacgcuggcuuucugggugaugcccuccaacuguuccuucagugucuggcauuggacgaagauuuugcuccagccaagcuccagguucagaagauucugugcgacuuacugcuacccgagaaucucaaagaagggcugaaggagagcuccuggucaagucuuccgugcacuaaaaaccgcccuuucgauuuucacagcgugauggaggaaucucaauccuugaaugagcccucaccaaagcagagcgaagagaucccugaagucaccagugagcccgugaaaggcucucugaaccgggcgcaguccgcccagagcauuaauucgacagagaugccagcuagagaagacugucucaagagggugucuuccgagcccguccugucaguucaagaaaagggagugcuucugaaacgcaaguugagucuccuggagcaggacguaaucgugaacgaggauggccgaaauaaauuaaagaaacagggggaaaccccuaacgaggucugcauguucagccuggcauacggagacauaccagaagaacuaaucgauguguccgacuucgaauguucucucugcaugcggcuguuuuucgagccgguuacuacacccuguggucacagcuuuugcaagaauugucuugagcguugcuuggaucaugccccuuauuguccacugugcaaagaaucacucaaggaguaccuggcugacagaagguacugugugacccaauuacuggaggagcuuauugucaaguauuugcccgaugaacucagugagcgcaaaaagaucuacgacgaggaaacggccgagcugucccaccuaacuaaaaacgugccuauuuucguaugcaccauggcauauccaacaguucccugcccgcugcauguguuugaaccucgguacagacucaugaucaggcgaagcauacagacuggcaccaagcaguucgggaugugugucucugauacacaaaauucauuugcggacuauggaugcaugcugcagauucgcaacgugcacuuccuuccagauggccggagugucguggacaccguuggugggaaaagauuuaggguguugaagcguggcaugaaggacggauacuguacggccgauaucgaguaucuggaagacguaaaagucgagaaugaggaugaaauuaagaacuuacgcgagcuccacgaccugguguacagccaggcuugcuccugguuccagaaccuucgggauagauuuaggucucagauccugcaacauuucggcucgaugcccgaacgagaggagaauuugcaggccgcaccuaacgggcccgcuugguguugguggcuccuggccguucuaccaguggacccucgguaccagcugagcguccucuccaugaaaucacugaaggaacgccuuacuaaaauccagcacauuuugacauauuuuaguagagaucaaucuaaguga

SEQ ID NO: 58516 - RNA, 939 nt, Artificial Sequence
  derived and/or modified sequence opt3 from LOR__Homo_sapiens__NP_000418
augagcuaccagaagaaacaacccaccccucagccaccgguggacugcgucaagacauccggcgggggagguggcgggggaggcucuggugggggaggcuguggcuucuuugggggagguggcucagggggaggcaguagcgguuccgggugcggauauucuggcggcgggggauacucggguggcggguguggaggcgguucaagcgggggcggaggcgggggagguaucggcgggugcggaggcgguagugggggcuccguuaaauauucuggaggcgggggaagcuccgguggcgggucaggauguuucaguagcggcggugggggcucuggaugcuuuuccucaggcgggggaggcagcaguggugggggaucuggcuguuucuccagcgguggcgggggaucgucuggcgggggauccggcugcuuuucaaguggugggggaggcuucagcggucaggccgugcagugucaauccuacggcgggguaucuagcggaggcucaagugggggaggcuccgguugcuuuagcucugggggaggcgguggcucaguguguggguauaguggaggcgggagcggaugcggcgguggguccucuggaggcucgggcagcggguacgucuccucacaacaggugacucagacgaguugcgcuccccagccuucuuauggagguggcagcuccgggggaggcgguucagggggaagcggcuguuucucuuccggcgggggagguggcaguagcgggugcggaggcgguucuuccgggauuggaucaggcuguauaaucaguggcgggggaagcguuugcgguggcgggucguccggaggcggugggggaggcucuagcgugggcgggucaggaagugguaagggcgucccaauuugucaccagacccagcagaaacaagcacccacauggccuuccaaguga

SEQ ID NO: 58517 - RNA, 3345 nt, Artificial Sequence
  derived and/or modified sequence opt3 from LOXHD1__Homo_sapiens__NP_001138944
augaacaaugagaucaccuacuauuuccccugccagagauggcuggccguggaagaggacgauggccaacucagcagggaacuucugccugucgacgaguccuacguuuugccacagucugaagaggggcggggagguggcgauaacaauccguuagacaaccuggcucuagagcagaaggauaaaucaacaacuuuuagugugacgauuaagaccggggugaaaaagaaugcaggaacagacgccaacguauucauaacucucuuuggcacccaggaugacacagguaugacccugcuuaaaagcuccaagacuaauucugauaaguucgaacgcgacucgaucgagauuuuuacagucgaaacccuggauuugggggaccucuggaaagugcgacugggacacgauaacacgggcaaggcgcccggcugguucguugacuggguggaggucgacgcuccuucacuggggaaauguaugacuuuuccaugcggacguuggcucgccaagaaugaggaugacgguagcaucauuagagauuuauuccaugcagaacugcaaaccaggcuuuauacacccuuugugccuuacgagaucacuuuguauaccagugacguauucgccgcuggcacagaugcaaacauauuuaucauuaucuacgggugugacgccguuugcacccagcagaaauaucuguguacgaauaagcgggaacagaagcaauucuuugagcgcaaauccgcuucuagauucauuguggaacuagaggaugucggagagaucauagaaaagauuaggaucggccacaacaauacugguaugaacccaggguggcauugcagccacguggacauucggcgccuccugcccgauaaagacggagccgagacacuuaccuucccuugugaucgauggcuggcgacuuccgaagacgacaagaaaacaaucagagaguuggugccauacgauaucuuuaccgaaaaguacaugaaagacggcucacucaggcaggucuauaaggagguugaggaaccgcuggauauuguguuauacaguguacagauauucacgggcaauauccccggggcaggaaccgacgccaagguguauauuacaaucuacggugaucugggcgacacuggggagcgguaucucggaaaaagcgaaaaccguaccaacaaguuugagcgcggcacagcugauacuuucauaauugaagccgcagaccuuggugucaucuacaaaaucaagcugagacaugauaauucuaaauggugcgcugacugguauguggagaagguugagauuuggaacgauaccaaugaagacgaguuuuuguuccuaugugggagguggcugucccucaagaaagaagauggccggcuggagcgauuauuuuacgagaaggaauacacaggagaccgcucaagcaacugcaguucuccugccgacuucugggagaucgcgcuguccagcaaaauggccgauguggacauuucgaccgucacuggcccaauggcagauuaugugcaggaagggcccauaaucccuuacuauguaucuguuacgacaggaaagcacaaagacgcugccaccgauuccagagcuuuuauuuucuugaucggugaggacgaugaaaggucaaagcggaucuggcucgacuacccacgcggcaagagaggguuuaguaggggaagcguggaggaguucuaugucgccggccuggauguggguauuaucaaaaagauagaauuagggcacgacggcgcaucccccgagucuuguuggcuggucgaggaacuaugccucgccgugccgacucaaggaaccaaauacaugcugaauugcaacuguuggcuugcuaaggaucguggcgacgggauuacaagccggguuuuugauuugcuggacgcgauggugguaaauaucggagucaaagugcucuaugaaaugaccguuuggacuggugacguggucggcgggggaacagauucaaacauuuucaugacgcuguacggcaucaaugguaguaccgaggagaugcagcuugacaagaagaaagcacgauucgaaagagagcagaacgauacuuuuauaauggaaauccuggacauugccccuuucacaaagaugaggauccgcauugauggguugggcucccggcccgagugguuucucgaaagaauccugcuuaaaaauaugaacaccggagaccugacaauguucuacuauggcgauuggcuaagccaaaggaaggggaaaaagacucucgugugcgagaugugugcuguaauagacgaggaagagaugauggaauggaccucuuacacgguggccguuaaaaccucagauauucugggagcaggcacagacgccaaugucuuuaucauuaucuucggugagaacggggauaguggaacucuugcuuugaagcagagcgccaauuggaacaaguuugagcgcaacaauaccgacacauucaacuuuccagacaugcugucccucggccaucugugcaaauuacgaguguggcacgauaauaaggguauauucccuggcuggcaucugucuuauguggacgucaaagauaacucgcgggacgaaacuuuucacuuccagugugauugcuggcuuagcaaguccgagggggacggacagaccguucgugauuuugcaugugcgaauaacaaaaucugcgacgaauuggaggaaacgacauacgagauugugaucgagaccggcaaugggggagaaacuagagagaacguguggcucauucuggaaggcaggaagaaucgcucaaaggaguuccuaauggaaaacaguucucggcaaagagcuuucaggaaagguacaaccgauacuuuugaguucgacagcaucuaucugggggauauagccucccucuguguaggacaccuggcacgagaggaccgcuuuauucccaagcgggaacuugccuggcaugucaaaaccaucacaaucacggagauggaauacggcaauguguauuucuuuaacugcgauuguuugauuccacugaagagaaaaaggaaguacuucaagguuuuugaggugaccaaaacuacagaaucauucgcuagcaagguccagucuuuagugcccguuaaauacgaggugaucguaaccacagguuaugagccuggcgccgggacugacgcaaaugucuuugugaccauuuucggagcuaacggcgacacggggaagcgugaacucaaacagaagaugcgcaaucuguuugagcggggauccacagauagauucuuccuugaaacccuggaguugguggucacuaggcucggccuggccgcggagugcgguuga

SEQ ID NO: 58518 - RNA, 1254 nt, Artificial Sequence
  derived and/or modified sequence opt3 from LOX__Homo_sapiens__NP_002308
augagauucgccuggaccgugcugcuccuuggcccccugcaguugugcgcuuuaguccacugugcaccuccagccgcggggcaacagcagccgcccagggagccuccagcugcccccggagcauggcggcagcaaauccagugggaaaacaauggucagguuuuuagccugcuaucccucggcucucaguaccaaccucagcgccgacgugacccaggggccgcugugcccggagcagccaacgcuucagcccagcagccuagaacaccaauucugcuuauaagggauaaucggacugcggcagcccgcacgagaaccgcuggcaguagcgguguaacagccgggaggccgcggcccacugcacgccauugguuccaagcuggauauuccaccucucgagccagagaggcgggcgccucgagggcagaaaaccagacagcuccuggcgaggugccagcccugucaaauuugcggcccccuagccgugucgacgggauggugggagaugacccauacaaccccuauaaguacagugaugacaauccguauuacaacuauuacgauaccuacgaacgcccuagacccgguggcagguaucggccaggguacggaacuggcuauuuucaguacggucucccugaccugguugcugaucccuauuacauccaagccuccacauaugugcagaaaaugucuauguacaaucugcgaugcgcagccgaggagaacugucucgcuagcaccgcguaccgcgcagacgucagagauuaugaccacaggguguuacugcgguucccacagcgcguaaagaaucaggggacguccgauuuucuucccucaagaccuagguacaguugggaauggcauagcugccaccaacauuaucacucuauggacgaguucucccacuacgacuugcuggaugccaacacucagcgucggguugcugaaggacauaaagccucauuuugucuagaggacaccagcugcgauuauggcuaccaccgaagauucgcauguacagcccauacucagggccucaguccagggugcuaugacaccuacggagcugauauugacugucaguggaucgauauuacagacgugaagccggguaauuacauccugaaagucucugugaaccccuccuaucuugugccugagagcgauuacaccaauaacgucguuaggugcgacauacgcuauacgggccaccacgccuacgcaucgggguguacuaucucuccauauuga

SEQ ID NO: 58519 - RNA, 1725 nt, Artificial Sequence
  derived and/or modified sequence opt3 from LOXL1__Homo_sapiens__NP_005567
auggcccuggcuagaggcagcaggcagcucggggcacuuguguggggagccugccugugugucuugguucacggucaacaggcgcagcccggccagggguccgacccugcucgguggcgccaauuaauccagugggagaacaauggacagguguacucucugcuaaacucaggcagugaauauguaccagccgguccgcagcgaagcgaguccucuucgcgugugcuccuggcaggggcuccccaagcccagcagagaaggucacauggaagcccucggcgcagacaggcaccaagucuuccccugccuggcagggucggcuccgauaccgugcgggggcaagcccgccacccauucggauuuggucagguucccgacaauuggcgagaaguggcugucggcgauucuacagggauggccagagcgaggacuagcgugucccagcaacggcauggaggcucagcaaguagcguaucugccuccgcuuucgccucaacguaccgucagcagccuagcuauccacagcaauuuccguacccccaggcaccuuucguuagucaguaugagaacuacgacccagcuucucgcaccuaugaucaggguuuuguguacuacagacccgccgggggaggcgucggcgcgggggccgcagcuguggccuccgcuggagugauuuauccuuaccaaccaagggcccgguaugaagaguacgguggcggggaggaauugcccgaguauccgccucagggauucuaccccgcaccagaacgaccuuauguucccccacccccuccaccgcccgacggccucgaucgcagauacagccacucgcuguacucugaggguacaccuggguuugagcaggccuauccagaccccggcccugaagcugcgcaggcacauggaggcgauccaaggcuggggugguaucccccguacgccaauccuccacccgaggcuuacggaccuccccgggcccucgaaccaccuuauuuacccguccgcuccucagacacuccaccgccugguggcgagagaaacggggcacaacagggaaggcugagugugggcagcguauaccgucccaaucagaacggucgggggcuuccagauuuggugcccgacccuaauuauguccaggccuccaccuacgugcaacgagcucaccuguacucucuaagaugcgccgcagaagagaagugucucgcgagcacagcuuaugccccagaggcaaccgauuacgacguuagggugcugcuucgcuucccccagcgggucaaaaaccagggcacugccgacuuucugccuaauagaccgaggcacacaugggaauggcauucaugccaccaacauuaucacaguauggaugaguucucccacuacgacuugcucgaugcugccaccggaaagaaaguggcagaaggccauaaggcuagcuuuugucuggaggacucuacgugcgauuucgggaacuuaaaacgcuaugccuguacuucacacacccagggacugaguccagguugcuacgacacauauaaugcggauauagacugucaguggaucgauauuacugacguacagcccggcaacuacauccucaagguucaugugaauccuaaguacauuguccuugaaagcgauuuuaccaacaacgugguccgaugcaauauccacuauacagggcgguacguguccgccaccaacuguaaaauaguucaaucuuga

SEQ ID NO: 58520 - RNA, 2325 nt, Artificial Sequence
  derived and/or modified sequence opt3 from LOXL2__Homo_sapiens__NP_002309
auggagagaccccugugcagccaccucuguuccugccuugccaugcuggcuuuguuaucuccucugucacuagcacaguacgacaguuggccacauuauccggaauacuuccaacagcccgccccugaguaucaccagccacaggcgcccgcuaacguggccaagauccaacucaggcuggcaggccagaaacggaagcauagcgaagggcgcgucgagguuuacuaugauggacagugggguaccgugugugacgaugacuuuuccauucacgccgcucauguagugugccgagaacuuggcuacgucgaggcaaaaucuuggacagccucgucaagcuaugggaagggagagggcccuauauggcuggauaauuugcacuguacugguaacgaagcuacgcucgccgcgugcaccaguaauggguggggagugacagacuguaaacacacugaggauguuggcguggucugcuccgacaagcguaucccaggcuucaaguuugauaacucucugauuaaucagaucgaaaaccugaauauucaaguggaggacaucagaauaagggcaauccucagcaccuaccggaaacgcacacccguaauggagggguacguugaagugaaggagggaaaaaccuggaagcagauuugugauaaacauuggacugccaagaacuccagagucgugugcgguauguucggcuuuccuggggaaaggacauauaauaccaagguguacaaaauguucgcuucacggcgcaagcagcgauauuggccauuuaguauggacuguacgggaacugaggcccacaucagcucuugcaaauuaggcccgcaggucucccuggaucccaugaagaacguuaccugcgaaaauggucuuccugcagugguaucaugugugccagggcaagucuucagccccgacggaccuaguagauuuaggaaggcuuacaaaccagagcagcccuuggugcggcugcguggcggcgccuauauuggggagggacgcguugaagugcucaaaaacggugaguggggcacagucugcgacgauaagugggaccuagugucugcguccguaguuuguagagaacugggguucggaagcgccaaggaggcagugacuggcucgaggcuuggucaggggaucggcccgauacaucugaaugaaauucaaugcaccggaaacgagaaaucuaucauugauuguaaguuuaaugcugagucccagggcugcaaccacgaagaggacgccgggguccgguguaacaccccugcuaugggauugcagaaaaagcuccgacugaaugguggccgcaaccccuacgaagggagaguggaggucuuaguggaaaggaauggaucacugguuuggggcauggugugcggucagaacugggggaucguagaggccauggucgugugucggcaacucggccuuggauucgcaaguaaugccuuucaggagacaugguauuggcacggcgauguuaacagcaauaaaguggucauguccggggugaagugcucuggaacggaacugagcuuggcucauugucgccacgacggugaggauguagcgugcccacagggcggggugcaguacggagcaggcguugccugcucagaaacugcuccugaccuaguccugaacgccgagauggugcaacagacaaccuaccucgaggauagacccauguucaugcugcagugugcaauggaagagaauugccuuagugccuccgcugcccagacugacccaacaaccgguuauaggcgucuguugcgguucagcucucaaauccauaacaaugggcagucagauuuucgacccaagaacggcagacacgcauggauuuggcaugacugucacaggcacuaccauaguauggaaguguucacgcacuaugaccuccugaauuuaaacggaaccaaagucgcggagggccauaaggcuagcuuuugccuggaagauacagagugugagggggacauacagaaaaauuacgaaugcgccaacuucggagaucagggcaucacuauggguuguugggacauguaucgccacgauauugacugccaauggguugauaucaccgacgugccuccaggggauuaccuauuucaggugguaauaaacccgaauuucgaggucgcagaauccgacuauucuaacaauauuaugaagugucggucgagauacgauggacacaggaucuggauguacaacugccauaucggcgguagcuuuuccgaggaaacagagaaaaaguucgagcacuuuucaggccuccugaauaaccagcuuaguccccaauga

SEQ ID NO: 58521 - RNA, 1827 nt, Artificial Sequence
  derived and/or modified sequence opt3 from LOXL3__Homo_sapiens__NP_001276093
augagacccgugagcgucuggcagugguccccuuggggccugcuccuuugccuguuguguucuucaugcuuagggaguccaagcccguccaccggacccgagaagaaagccgguucucaaggccugagguuccggcuagcuggguuuccucgcaagccauacgaaggacgaguugagauccagcgugcaggcgaaugggguacaauuugugacgaugacuucacucuccaggccgcgcacauacugugcagagagcuuggguuuacggaagcuaccggauggacacauucggccaaauauggccccggcacugggaggaucuggcuggauaacuugucauguagcggaaccgagcagagugugacagagugcgcaucccgggguuggggcaauucugacuguacccacgaugaagacgccgggguaauuugcaaggaucaacgccucccuggauucagcgacuccaacgugaucgaggcuagagucaggcugaaaggcggugcacauccaggggaaggacggguggagguucugaaggccucaacuuggggcacagugugugaucgcaagugggaccuccacgcugccagugucgugugccgagaguuaggcuuugggagcgcgagagaagcacugucuggagccaggaugggucagggcaugggggcuauucaucuuuccgagguacgguguucaggacaggaauugagccuguggaaaugcccccacaagaauaucaccgccgaggauugcagucacucucaggacgcaggcguucguuguaaccuaccuuacacgggugcugaaacucgcauaagacucuccgggggcaggagccaacaugagggacggguggagguccagaucggcgggccaggaccgcugcgauggggucuuauuugcggcgaugacugggggacccuggaagccaugguggcgugucgccaguugggacucggcuaugccaaucacggucugcaggagacaugguacugggacucggggaacaucacugaaguggucaugucuggcguuagaugcaccggaacagaguuaucccuggaucaaugugcacaucacggcacccacauuacgugcaaaaggacugggacacgguucaccgcuggagugaucuguucagaaacugccagugaccuccuucugcauagcgcuuugguacaggagacagccuauauagaggaucgcccccuacacaugcuguacugcgcagccgaagagaauugucucgcuuccucugcgagaagcgcaaacuggccuuauggucauaggcgucugcuucgguuuucaagucagauucacaaucugggccgagccgacuucagaccaaaggcugggaggcauuccuggguguggcacgaaugccacggacauuaccacagcauggauaucuuuacccauuacgacauuuugacgcccaacggcaccaaagucgccgagggucacaaggcaucuuucugucucgaagauacagagugccaagaggacgugucaaagcgcuaugaaugcgccaauuuuggggagcagggcaucacuguuggauguugggaucuguaccggcacgacaucgauugccaguggauugacauaaccgacgugaaaccuggcaacuauaucuuacaggucgugauuaauccaaacuucgaaguagcugagagugauuuuacaaauaacgccaugaaguguaacugcaaauacgacgggcauagaaucuggguucacaauugucauauaggagaugcauucagcgaggaagcgaacaggcgcuucgagcgauaucccggccaaacuuccaaucagauuaucuga

SEQ ID NO: 58522 - RNA, 2271 nt, Artificial Sequence
  derived and/or modified sequence opt3 from LOXL4__Homo_sapiens__NP_115587
auggccuggagcccucccgcuacccuguuccucuuucuucuguuguuaggccagccaccgcccuccagaccucaaucucuggggacaacuaagcuaaggcucgugggaccagagucaaaacccgaagagggucggcuggaaguccuucaccagggccagugggggacgguuugcgacgauaacuucgcaauccaggaggccaccguggcgugucgccaacugggauuugaagcugccuugacaugggcacauagugccaaguacggccagggugaggggccuauuuggcucgacaauguacgaugcgugggaacugagagcucccuggaucaguguggcucuaacggcuggggagucucggacugcucacacagcgaagauguggggguuauaugucauccacguagacacagggguuaucugagugagaccguguccaaugcucucggcccccaggggcggcgcuuagaagaggucagacugaaaccuauccuugcaucugccaagcaacauagcccagugacagagggagcuguagaaguuaaauacgagggccacuggaggcaagugugcgaccaggguuggaccaugaacaauucccgggucgugugugggauguugggauucccgucagaagugcccgucgauagucacuauuaccgcaagguuugggaccugaagaugcgagauccuaaaagcagacuaaagucucucacuaacaaaaauuccuuuuggauucaucaggugacaugccugggcaccgagccacacauggccaacugucagguacagguggcgcccgcaaggggcaaacuucggccugccugcccagggggaaugcaugcugucgugucauguguugccgguccccacuuccguccgccuaagacgaagccccagcgcaagggcagcugggcagaggaaccaagagugaggcugcggaguggggcucaagucggagagggccgaguggaaguauugaugaaucgccagugggguacuguuugcgaccacagauggaaccucaucucugccuccguggucugcaggcagcugggguuuggcagcgcgcgggaggccuuauucggagcacgccugggccaggggcucggaccuauucaucuuucggaagugagauguagggguuaugagcguacccugucugauugccccgcuuuggaaggcucccaaaaugggugucagcacgagaacgacgccgcuguccggugcaaugugccaaacaugggauuucagaaucagguucgacuagccggcgguagaauccccgaggaagggcugcucgaggugcaaguagaagucaacggcgugccuagguggggaucaguuuguagugagaacuggggccugacagaagcaaugguggccugccgccagcuugggcugggauucgcuauacaugcguacaaagagacuugguuuuggagcgguaccccacgggcacaggaggucgugauguccggcguaagauguucugggacagaauuggcccuccagcaaugccagaggcacggaccggugcauuguagccacggcggugggcgcuuccuggcuggcguuucaugcauggauagugcccccgacuuagucaugaaugcacagcuggugcaggagaccgccuaucuagaagaccgaccucucucccaacuguacugugcucacgaggagaacugccuuagcaagucugccgaucauauggacuggccauacggauaucggcguuugcugagauuuucaacgcagaucuacaaucucggcaggacugauuuccgccccaaaacagggcgggacaguuggguguggcaccagugccauagacacuaucacagcauugaagucuucacccauuacgaucugcuuacucugaacggauccaagguugcagagggccacaaagcgucuuuuuguuuggaagacacaaauugcccuaccggucuccaaaggcgauaugcuugugccaacuucggggagcagggagugacggugggcugcugggauaccuaccgccaugacaucgauugucaguggguagacauuacagaugucgguccaggcaauuauaucuuucaggugauaguuaacccccacuacgaaguggcagagucggacuucagcaauaacaugcugcaaugccgguguaaguacgacgggcauagagucugguuacacaauugccacacuggaaacuccuauccggccaaugcugagcugucacuagaacaggagcagaggcuccguaacaaucugauuuga

SEQ ID NO: 58523 - RNA, 6123 nt, Artificial Sequence
  derived and/or modified sequence opt3 from LPA__Homo_sapiens__NP_005568
auggaacacaaggaagugguccugcuccuucuguuguucuuaaaaagcgccgcucccgagcagucccauguugugcaagacugcuaccacggcgaugggcagucuuaucgagggaccuacucaacuacuguaacggguaggaccugucaggcauggaguagcaugacaccucaucagcacaaccggacuaccgaaaauuauccaaacgccggccugaucaugaauuacugccgcaacccggacgcgguggcugcccccuauuguuacacacgagauccugggguccguugggaguauugcaaucuaacccaauguuccgacgcagaaggaacugccguggcuccacccacaguuaccccugugccaucucucgaggcacccucggagcaggccccuacggaacagcggccaggcguccaggagugcuaccaugguaacgggcaaucauacaggggaacuuauagcaccacagugacuggccggaccugucaggcuuggaguuccaugacaccgcacucucacagccgcacccccgaauacuauccuaaugccggccugauuaugaacuacugccgcaauccagaugcgguagcagcccccuauuguuacacgagggacccugggguucggugggaguauugcaaccuuacucaguguuccgaugcugagggaacagccguggcaccacccaccgucacuccggugccuucacuggaagcucccagugagcaggccccaacagaacaacgcccuggugugcaggagugcuaccauggcaaugggcagagcuaccgaggaaccuauucuacgaccgucacaggccgcacuugccaagcgugguccucaaugaccccacacagccauaguaggacaccagaauacuaucccaacgccgguuugauaaugaauuacugucggaacccugacgcaguugcugccccauauugcuacacucgugauccgggggugcgcugggaguauuguaaucucacccagugcucugacgcugagggaacagccguagcacccccuaccgugacuccaguccccucccuggaagccccuagcgagcaggcuccaacggaacagagacccggcgugcaagaguguuaccacggcaacgggcagucguacaggggaacauauucuaccacuguuaccggucggacaugccaggcgugguccucaaugaccccgcacagucauagccgaacuccugaauacuauccaaacgcaggccugaucaugaauuacugucgcaaccccgaugccguggcugccccuuauugcuacacaagagaccccggggucaggugggaguauuguaaucucacgcagugcuccgaugcagagggaaccgccguggcuccaccuacuguaacacccguuccaucuuuagaagccccgagcgagcaagcaccuaccgaacagcggcccggcgugcaggaguguuaccacgguaacgggcagucauaccgcggcacauauaguacuaccgucacgggaagaaccugccaagcgugguccagcaugacaccacauucucacucaaggacucccgaauacuauccuaaugcuggccugauuaugaacuacugccguaauccagacgccguggcagcccccuauuguuacacccgggacccugggguccgaugggaguauugcaaccuuacacaguguagugaugcugagggaacugccguggcaccgccaaccguuacgcccgugccuagcuuggaagcuccauccgagcaggcccccacagaacagagaccugguguacaagagugcuaccauggcaaugggcagucuuacaggggaaccuauucgacuacagucaccggccgcacuugucaggcguggagcuccaugaccccgcacucacacagucggacacccgaguacuauccaaacgccggucugaucaugaauuacugcagaaacccugacgcuguggcagcccccuauuguuacacgagggauccagggguucgcugggaauauugcaaucuaacccaauguucugacgcugagggcacugccguggcaccucccacagucaccccagugccgagccucgaagcgccuuccgagcaggcccccacagaacagcgaccaggaguacaggagugcuaccauggcaacgggcaaucauaccggggaacuuauagcaccacggugacaggucguaccugucaggcuuggucuuccaugacuccccacagucauagcagaaccccugaguacuauccaaaugccggccugauuaugaacuacugcaggaaccccgaugcaguugcugccccuuauugcuacacacgcgacccggggguccggugggaauauuguaaucuuacucagugcucugaugcagagggaaccgccguggcuccacccacagugacgccuguccccucccuggaagcgccaucagagcaggccccuaccgaacaaagacccggcguucaggaguguuaccacgguaacgggcagaguuacaggggcacuuauagcacaaccgugacuggacgaacaugccaggcauggucguccaugaccccacacucucauagccgcacgccugaguacuauccgaaugcuggcuugaucaugaacuacugucggaaucccgacccaguggccgccccuuauugcuacacuagagaucccucaguaaggugggaauauuguaaccucacccaaugcagugacgcugaggggacagcagucgccccaccuaccauaacucccaucccgucccuggaagcgccaucugagcaggcuccuacagaacagcgucccggagugcaagaguguuaccacggcaauggucagagcuaccaggggaccuauuuuauuacaguuacuggaagaaccugccaggccugguccucaaugacgccacauagccacagucggacacccgcauacuauccuaacgccggcuuaaucaagaauuacuguagaaacccggaucccguggcugcaccauggugcuauaccacugacccuucugucaggugggaguacugcaaucugacccgauguuccgacgccgaauggacagcguucgugcccccuaacguuauucucgcuccaagccuugaggccuuuuucgaacaagcacugacugaggagacccccggugugcaggauugcuauuaccauuacggccagucguaucgggggacguacucaacaaccguaacuggacgcacaugucaggccuggucuaguaugaccccucaccaacacuccagaacuccagaaaauuaucccaacgcuggcuugacaaggaauuacugccggaacccggacgccgagauccgaccuugguguuauaccauggauccaagcgucagaugggaauacugcaaccuaacgcagugucuggugacugagucuagcgugcucgcaacccugacagucguucccgacccuuccaccgaggcuucaagugaggaggccccaacagaacagagccccggggugcaggauugcuaucauggagacggccaaucuuaccgcgguuccuuuucaacuaccguaacggggaggacaugucagaguuggagcuccaugacuccgcacuggcaucagcguaccacagaguacuauccuaauggaggccuuacccggaacuacugcagaaaucccgaugcggaaauaucuccaugguguuauacuauggacccuaacgugaggugggaguacugcaaucugacccagugccccgucacagaaucgagcguguuggccacgucaacugcaguuuccgagcaagcuccaaccgagcagagucccacagugcaggauuguuaucacggugacggccaaucuuaccgcgggagcuucuccaccacugucacaggacgaaccugccagucauggucuagcaugacgccucauuggcaccagagaacuacagaauauuacccaaacggcgggcucacccggaauuacuguaggaacccggaugccgagauucgccccuggugcuauaccauggacccuagugugcguugggaauacuguaaucugacucagugcccaguuauggaguccacauuacugaccacacccacuguggucccuguaccaagcacggaacuacccucugaggaggcuccuaccgaaaacucaacaggagugcaagauuguuauagaggcgacggucaguccuaccgggggacucucaguaccacaaucaccggaaggacuugccagagcuggucgucuaugacgccgcacuggcaucgccggauuccacuguauuaccccaaugcaggccuuaccagaaacuauuguagaaauccugacgccgagaucaggcccuggugcuacacaauggauccauccguucgcugggaauacuguaacuugacuagaugcccugugaccgagagcucaguccugacaacccccacuguggccccaguaccgaguacagaggcuccuucugaacaggcgcccccagagaaaucccccgugguccaagacugcuaucacggugauggcaggagcuaccgggggaucucaaguacgaccguuacuggacguacaugucagagcugguccucuaugauuccucauuggcaccagcgcaccccagaaaauuaucccaacgcaggccucaccgagaacuacugccgaaauccugacagcgggaagcagccgugguguuauacaacugauccaugcgugagaugggaauacuguaaccugacgcaaugcuccgagaccgagucaggagugcuugaaacacccacugucgugccuguuccaucuauggaggcccacagugaagcugcccccaccgagcagacaccuguagugaggcaguguuaucauggcaauggucaaucguaccgggggaccuuuagcacuacggucacaggaagaaccugccaguccuggucuucaaugacuccccacagacaucagaggaccccagaaaacuacccgaaugacggccugacaaugaacuauugucggaauccugaugcagacacuggccccuggugcuucaccauggauccaagcauacgaugggaguacuguaacuugacaagaugcuccgacacggaggggaccgugguugccccucccacugugauccaggucccaagucucggaccucccucugaacaagauuguauguuugguaauggcaaaggguaucgcggaaagaaggcuacaaccgugacuggcacaccgugccaggagugggcggcccaggaaccacacaggcauagcaccuucauuccugguacgaacaaaugggcagggcuggagaagaauuacugccggaaccccgacggagauaucaauggcccaugguguuauaccaugaacccccguaaauuauuugacuacugcgacauaccucugugugcuucauccaguuucgauugcggcaagccgcagguagaacccaagaagugucccgggagcauugucggagguugcguggcccacccucacucuuggcccuggcaaguuucccuaagaacaagguuuggcaagcauuucugugggggaacucucaucucaccagagugggugcugaccgcagcccacugccuuaaaaagagcucgcgcccuucuaguuauaaagucaucuugggcgcucaucaggaggugaaucuggaaucccacguucaggagauugaagugagcagacucuuccuggagcccacacaggccgacaucgcguuacugaaacuuucacgaccagcagucauuacugauaaagugaugccugccuguuugccgucccccgacuacaugguaaccgcuagaacagagugcuacauaaccgguuggggagaaacucaaggaacguuuggcacaggccuccugaaggaggcccagcuacuggugaucgaaaacgagguuuguaaucacuauaaauacauuugcgcugaacaucucgcaagggggaccgauucuugccagggagacagcgguggcccacuggucuguuucgagaaggauaaguauauccuucagggggugacaaguuggggauugggcugcgcccgcccuaacaaacccgguguguacgcucgggucuccagauuuguaaccuggaucgaggggaugaugcguaacaauuga

SEQ ID NO: 58524 - RNA, 1095 nt, Artificial Sequence
  derived and/or modified sequence opt3 from LPAR1__Homo_sapiens__XP_005251839
auggccgcuaucagcaccuccauucccgugauaucucagccucaauucacagcaaugaacgagccacagugcuuuuacaaugaaucaaucgccuucuuuuauaacagaaguggcaagcaccuggcgacugaguggaauacggucagcaaacucguuauggggcuuggaauuaccguguguaucuucauuaugcuggcuaacuuguuaguaaugguggccaucuacgucaauaggcgguuucauuucccgauauauuaccugauggcaaaccuagccgcugcagacuuuuucgccggucucgcuuauuuuuaccugauguucaauacaggccccaacacucgccgacuuaccguguccacauggcuguugcgucaggggcucaucgauaccucucugacugccucgguugcgaaucugcucgcaauugccaucgaaagacacauuacaguguuuaggaugcaguuacauacccggaugucaaaccgcagagucgugguaguuaucguggucauauggacgauggcuauugugaugggagccaucccuagcgugggcuggaauugcauuugugacaucgagaacugcaguaauauggcaccacuguauuccgauucuuaccuugucuucugggcuaucuuuaacuugguuacuuucgugguaauggugguccuguacgcccacauuuucgguuaugugaggcaacggaccaugcgcaugagccgacauuccucagggcccagaaggaaucgggacacaaugaugagucuacucaagacuguugugauaguccugggagcguuuaucauuuguuggaccccuggccuugugcuguugcuccuggauguaugcuguccacagugcgacguuuuagccuacgaaaaauucuuucugcuccuugcagaguucaacagcgcuaugaaccccaucauauauucuuaccgugauaaggagauguccgccacauuucgccagauucuguguugccagagaucagaaaauccuaccggcccaacggaggggagcgacaggagugcuucuuccuugaaccacacuauccuagccggagugcacagcaaugaucauucggucguguga

SEQ ID NO: 58525 - RNA, 1056 nt, Artificial Sequence
  derived and/or modified sequence opt3 from LPAR2__Homo_sapiens__XP_011526723
auggugaucaugggccagugcuacuauaacgagaccauuggguucuuuuacaauaacagcggaaaggaacuguccucucacuggagacccaaagacgucguugugguagcccucggucuuacagugucaguccugguguuguuaacuaaucugcuaguuauagcugcaaucgccaguaacaggcgguuccaucagccuauuuauuaccuccugggcaaucuugcggcugccgaucuguuugcagggguggccuauuuguuccucauguuucacacgggaccacgcaccgcucgacugagccuggagggcugguuccuccgucaggguuuacuggacacaucccuuacugcaucugucgccaccuugcuggcuaucgccguggaaagacauaggucgguaauggcgguucagcuacacucacggcucccgcgcgggagaguggucaugcugauugugggagugugggucgcagcccuuggccugggcuugcuccccgcucauagcuggcacugucugugcgccuuagauagguguagucggauggcaccucugcucucccgcucuuaccuugcuguuugggcccugagcuccuugcuaguguuucugcucaugguagcgguguauacacgaaucuucuuuuacgucagaaggcgggugcagcguauggccgagcacguuucaugccauccacgcuacagagaaaccacucugagucuugugaagacagucgugauaauccugggggcauucguaguuuguuggacccccggacaaguggucuugcuccuggacgguuuaggcugcgagagcuguaacgugcuggcugucgagaaauauuuucuacuccuggccgaagcuaauucucuugugaacgccgcaguuuacuccugcagggaugccgagaugcggcgaacguuccgcagauugcuguguugcgcuugucucaggcagucaacucgggaaagcgugcacuauaccaguucugcgcaagggggagcauccacacgcauuaugcugccugagaauggccauccacuuauggacagcacucuguga

SEQ ID NO: 58526 - RNA, 1062 nt, Artificial Sequence
  derived and/or modified sequence opt3 from LPAR3__Homo_sapiens__XP_011539451
augaacgagugccacuacgacaagcauauggauuucuuuuauaauagaagcaacaccgacacaguggaugacuggacuggcacgaaacuggucaucguucucuguguggggaccuucuuuugccuuuucauauuuuucuccaauucucugguaauugccgcugugaucaagaacaggaaauuucacuuccccuuuuacuauuuguuagcaaaucuggccgcggcugauuucuuugccggaauugcauacgucuuccuaauguuuaacacagguccugugucaaagacucucaccguuaaucggugguuccugcgccagggccuucuggacaguagcuugacagccucccucaccaaccugcuggugaucgcugucgaacgacauaugucuauuaugcguaugagagugcacucgaaucucacuaaaaagaggguaacauuacugauccuuuugguuugggcaauagccaucuucaugggggcugugccaacccugggauggaacugucuaugcaauauuucagccuguagcagucucgcgccgaucuauucccggucuuaccuggucuuuuggacggugagcaaccuuauggcauuccugauuaugguggucguuuauuugcgcaucuacguguacguaaagagaaaaacuaaugugcucucaccccauaccuccggcaguauaagcaggcggcgcacaccuaugaagcugaugaaaacugucaugaccguguuaggugccuuuguugugugcuggacaccagggcuggucgugcuccuucuggauggauugaacugucgacaaugcggcguacagcacguuaagagaugguuccuacugcucgcucugcuuaauucuguggucaaccccauuaucuauuccuacaaagacgaggauauguauggcaccaugaagaagaugauuuguugcuuuucacaggaaaacccugagaggcggccaagccguauccccaguacggugcugucucgcuccgacacugggagccaguacaucgaagauucgauuucucaaggagccgucuguaauaaauccacaucauga

SEQ ID NO: 58527 - RNA, 1035 nt, Artificial Sequence
  derived and/or modified sequence opt3 from LPAR6__Homo_sapiens__NP_001155970
auggugagcgucaacuccucucacugcuucuacaaugacucauuuaaguauacccuguacggcuguauguucaguaugguuuuugugcucgggcuuaucagcaacugcguagccauuuauauauucaucugugugcugaaagucagaaaugagacaacuacguacaugauuaacuuggcuauguccgauuuacuguuuguguucacccuacccuuuaggaucuucuauuuuacaacucggaauuggccuuucggagaccuccugugcaagauuucuguuaugcuguuuuacaccaacauguaugguucgauccuuuucuugacauguauaucaguggaucgcuuucucgcaaucgucuacccauucaaaagcaagacccugcgaacuaaacguaaugccaagauugugugcacaggcguauggcugaccguuaucgggggaagugcgccggcuguguucguccaguccacgcauucucaaggcaacaaugccagcgaagcauguuuugagaacuuccccgaagccacuuggaagaccuaccucuccagaauugugaucuuuauagagauuguggguuucuuuaucccuuuaauucugaaugucacaugcucaaguaugguucuuaaaacuuugaccaagccagugacacugagcaggucuaaaaucaacaagaccaaaguacuaaagaugaucuucgugcaccucauuauauuuuguuucugcuuuguccccuauaauaucaaccugauucuuuacucccuggugcggacgcagacuuucguuaauuguucaguggucgcugcagugcgcacaauguauccuaucaccuugugcauagccguaagcaacugcuguuuugacccaauuguuuacuauuucacaagugauacuauccagaacucuaucaagaugaaaaauugguccgugagaaggagcgacuuucgguucucggaaguccauggggcugagaacuucauucagcacaaucuccaaacccugaagucuaaaaucuuugauaacgaguccgccgcguga

SEQ ID NO: 58528 - RNA, 1605 nt, Artificial Sequence
  derived and/or modified sequence opt3 from LPCAT1__Homo_sapiens__NP_079106
augagacugaggggcugcgggccccgggccgcuccugcaagcuccgccggagcgucugacgcucgccuccuugccccaccgggucgaaaccccuucgugcacgagcugcguuugucagcauuacagaaggcccaagucgcucugaugacccuaacacucuuuccuguuagacugcuuguggcagccgcuaugaugcuguuggccuggccacucgcgcugguagcaagucugggcagcgccgaaaaagagcccgaacagccuccagcucucuggaggaagguggucgauuucuuacugaaagccaucaugcggacuaugugguuugcagggggauuccaucgcguggcuguuaagggcagacaggcccuucccacggaggcggccauuuugacccuggcaccucacuccucuuacuuugacgcuauaccagugacaaugacuaugucgucaaucgucaugaaagccgaaagcagggauauuccgaucugggguacccuaauucaguauauccggcccguguucguaagucgcuccgaccaagauucucgaagaaagacaguugaggagauaaagaggcgggcucagagcaaugggaaauggccucagaucaugauuuuuccagaaggaaccuguacuaaccguacaugccucaucaccuucaagcccggcgccuuuauuccuggcgcaccagugcagcccgucgugcugcgcuacccgaauaaacuugacacgaucacuuggaccuggcaagggccuggagcccuggagauauuguggcucacacugugucaguuccauaaccagguggaaauugaguuuuuacccgucuauuccccaucagaggaagagaagagaaauccugcucuguacgcgaguaacguuaggcgggugauggcagaagcccucgguguaagcgugacugauuauaccuucgaggacugccagcuugcucuggccgaaggccaauugcgacuacccgcagauacaugucugcucgaguuugcccgccuggucagagggcuuggacugaaaccagagaaguuggaaaaggaccucgauagguacucugagcgggcucgcaugaaaggcggugaaaagaucgggauugccgaguucgcagcgucccuggaagugcccguuucagacuuacuggaggauauguucagccuauuugacgagaguggaucuggcgaaguggaccucagagagugcgucguggcucuguccguaguuuguaggccugcccguacccuugauacgauccaguuggcauucaaaauguauggcgcccaggaagacgggagcgugggagagggugaucugucgugcauccucaagacugcucugggcgucgccgaacuuacagugaccgaccuguuucgggcaauugaucaagaggagaaagggaagauaacuuucgcugacuuucaccgauucgccgaaauguacccagcguuugccgaggaauacuuguauccggaucagacacauuucgagucuugugcugagaccucccccgcaccuaucccaaauggauuuugcgccgacuucucacccgaaaacagugaugcuggcagaaaaccugucaggaagaagcucgacuga

SEQ ID NO: 58529 - RNA, 1635 nt, Artificial Sequence
  derived and/or modified sequence opt3 from LPCAT2__Homo_sapiens__NP_060309
augagcagaugcgcccaggcugcagagguggccgcgaccguccccggcgcugggguuggaaacgugggucugaggccuccaaugguaccgcggcaagccuccuucuuucccccuccagugcccaauccuuucguccagcagacacagaucggcucugcacgccgagugcaaauuguucuccuugggauaauccuguugccaauucguguguuacuggucgcccuaauccuccugcuugcuuggcccuuugcagccauuucaacuguguguugcccugaaaagcugacgcacccaaucaccggauggagaaggaaaauaacacagacugcuuugaaguuccucggccgggccauguuuuucaguauggguuuuaucguagcgguuaaagggaagauugcaagcccgcuggaggcccccguguucgucgcugccccucauuccaccuuuuucgacggaaucgcaugugugguggcuggccugccaucuauggucucgcgcaacgaaaaugcccagguuccccucauuggcagauuacugagggcggugcagccuguacuugugucacgggucgauccagacagccgcaaaaacacaaucaaugagauaauuaagcgaaccacaagugggggagaauggccccaaaucuugguguuuccggaggguacuugcaccaacagauccugucugauuacguucaagccuggcgccuuuauccccgggguuccagugcagccuguccuacucagguaccccaauaaacuggauacugugaccuggacauggcagggauauacuuucauccagcuuugcaugcugaccuucugucaauuguuuacaaagguagagguugaguucaugccagugcagguccccaacgacgaagagaaaaaugauccugugcucuuugcaaacaagguccggaaucugauggcugaagccuuaggcauuccagugaccgaccacacguacgaggauugccgucugaugauaucugcuggucagcucacucuuccgauggaagccgggcugguugaguucacaaaaaucagccgcaaguugaagcuagacugggauggagugagaaaacaucuggacgaauaugcauccauugccucaaguagcaagggcggcaggaucgggauagaggaauuugcuaaauaccucaagcugcccguaucugauguccuucggcaacuguucgcguuguuugaccgaaaccacgauggauccauugacuuccgcgaguaugugaucggucucgcaguucuguguaauccuucaaacaccgaggaaaucauucagguggccuuuaaauuauucgacgucgaugaggacggcuacaucacugaagaggaauuuagcacaauucugcaggcuagucuaggggugccagaucucgacguaucuggacuguucaaggagauagcccagggcgauuccaucagcuaugaggaauuuaaaucguucgcacuuaagcaucccgaguacgccaagauuuucaccacguacuuggaccugcaaaccugccacguguuuucucucccuaaagaaguucagacaacuccauccaccgcuucaaauaaggucagucccgagaaacacgaagagagcacauccgauaagaaagacgauuga

SEQ ID NO: 58530 - RNA, 1464 nt, Artificial Sequence
  derived and/or modified sequence opt3 from LPCAT3__Homo_sapiens__NP_005759
auggccagcuccgcugagggcgacgaagggaccguggucgcacuggccggaguucuccagucugguuuccaagagcuuucacugaacaaguuggcgacaaguuuaggcgcuagcgaacaggcccugagacuaaucauuuccauauuucucggguaccccuucgcacuguuuuauaggcacuaccuuuucuauaaagagacuuaccugauccauuuguuucacacguucaccggacucucuauugccuauuuuaauuucggcaaccagcuguaccauucgcugcucugcaucguguuacaguuucugauucuucgguugaugggucgcacaaucacugcuguacugaccacauucuguuuucaaauggcauaucuacucgccggguacuacuauaccgcuacuggaaauuacgauauaaaguggacaaugccucacugcgugcugacccuuaaacugaucggcuuggccgucgacuauuucgauggcgggaaggaccagaacucacucagcagugaacagcagaaauacgcgauucgaggagugccaucccuguuagagguugcagguuuuucuuauuucuacggcgccuuccugguggggccgcaauuuagcaugaaucauuauaugaagcucguccagggagagcuuaucgauauucccggcaagaucccuaacuccauaauuccagcucugaaacguuugucacuaggucuguucuaccucgugggguacacgcugcuuaguccccacaucacugaagacuaucuguugaccgaggauuacgacaaucacccuuuuugguucagauguauguauaugcucauuuggggaaaguuuguacuguacaaauauguuacaugcugguuagugacugaaggcgucuguauccugaccggccuaggguucaacggauuugaggagaaggguaaagccaagugggaugcaugcgcuaauaugaagguguggcuguucgaaacaaacccaagguuuaccggcacgaucgccagcuucaauauuaacacuaaugcguggguggcccgguacauauuuaaacgccucaaguuccuugggaacaaagaguugucucagggacugucccuccuguuucuugcacuguggcauggcuugcacucagguuaucucgucuguuuccagauggaguuccugaucguuauuguggaaagacaagcugccagguuaauccaggaaagccccacacugaguaagcuagcugccauaaccguacuccagccuuuuuacuaccuggugcaacagacuauucauuggcuuuucaugggguauucuaugacagcauuuugcuuguucaccugggacaaauggcugaaggucuacaaauccaucuauuuucucggccacaucuucuuucugagcuuacuguucauucuuccauacauccacaaggccauggugccgcggaaggagaaauugaagaaaauggaguga

SEQ ID NO: 58531 - RNA, 1575 nt, Artificial Sequence
  derived and/or modified sequence opt3 from LPCAT4__Homo_sapiens__NP_705841
augagccagggcucccccggggacugggccccucuggauccaaccccgggacccccugcuucuccaaaccccuucgugcacgagcuccaucuuucaagacugcaaagggucaaguuuugcuuguuaggugcacugcuagccccuauccggguucuccuggcguucauugugcuuuuucuguuguggccauucgcuuggcuccagguagccggccugagugaagaacagcugcaggaacccauaacaggguggcgcaaaacugugugucacaauggaguccucggcuuaagccgacugcuuuucuucuugcuggguuuucuacguaucagagugagggggcaacgggcaucccgccuccaggccccuguucugguggcugcaccacauucuacguucuuugacccgauuguccuucugcccugcgauuugccuaaggugguaucgagagccgagaaccucucaguuccagugaucggagcucuguuaagguucaaucaggccauucuggucagccggcacgaccccgcgagucgccgaagagugguggaagaggucaggcggcgugcaaccuccggcggcaaauggccucagguucucuuuuucccagaggggacauguucuaacaagaaagcccuucugaaguuuaagcccggagcuuucaucgccggugugccgguacaaccuguguugauacgcuaccccaauagccuagauacuaccuccugggcauggagaggcccagggguccugaaagugcucuggcugacagcuucacagccuugcaguaucguugacguggaauuucuucccgucuaucauccaagccccgaggaaucuagggauccuacccuguacgccaacaaugugcagcggguaauggcgcaggccuugggcauuccagcaacugagugugaguuuguuggcucccucccggugaucgucgugggucgacugaaggucgcuuuagaaccccaacugugggagcuagggaaagugcuccgcaaggccggacugucagcuggcuauguugacgccggcgcagaaccugggagaagcaggaugauuagucaggaggaguucgcccggcagcuucaauugucugauccacagacaguggcuggagcguuugguuacuuccagcaggacaccaaaggccugguagauuuucgcgacgucgcacucgcccuggcugcccuugaugggggaagaucccuggaggaguugacgaggcucgcauucgaacuguuugccgaggaacaagcugagggccccaaccguuuacuguauaaggacgguuucagcacuauccuacaccuccugcuugggucgccucacccagccgcaaccgcguugcaugcugaacugugccaggccggaucuucccagggacucucacugugucaguuucaaaauuucaguuuacacgacccccuguacggcaaacuuuuuagcacauauuugcggccgccucauacuucccgagggaccucucagacaccaaacgcaagcucacccggaaauccuaccgcccucgcuaacgguacggugcaggcccccaagcagaagggcgauuga

SEQ ID NO: 58532 - RNA, 1113 nt, Artificial Sequence
  derived and/or modified sequence opt3 from LPGAT1__Homo_sapiens__NP_055688
auggccaucacccuggaggaagcucccuggcucggcuggcuucuggugaaggcauugaugagauucgccuuuauggucguuaacaauuuaguggcgauuccuagcuacauaugcuauguaaucauucugcagccacuaagggugcucgacuccaaacgguucugguacaucgaggggauuauguauaaguggcugcuuggaauggucgcuucuugggguugguacgccggcuauacagugauggaauggggagaggauaucaaagcaguuucaaaggacgaagccgugaugcuggucaaccaccaagcuacuggggauguguguacguugaugaugugccuccaggacaaaggccugguaguugcacagaugauguggcugauggaucauauauuuaaguacaccaauuucgguaucgugagucucguccacggggacuuuuucauucgccagggacgaagcuaucgugaucaacaguuacugcuuuugaagaaacaucuggagaacaauuacagauccagggaccggaaguggaucgugcuauuuccggagggcggcuuccuccgcaaaagaagggaaacaucucaggccuuugcuaagaaaaacaaucugcccuuccuuacuaacgugacccugccucggucgggggccacaaagauuaucuugaaugcgcucgucgcacagcaaaagaacggaucaccagccgguggcgaugcuaaagagcuggacagcaagaguaaaggguuacaguggauaauugauaccacuaucgccuaccccaaggcagaaccuauugacauccagacauggauccugggauaucgcaaaccaaccguuacgcacgugcauuaccgaauuuuucccauaaaggauguaccucucgagacugacgaccuuaccacauggcuguaucagagauucguggagaaagaagauuugcuaucccacuuuuacgagacuggcgcuuucccaccgucuaagggucacaaggaagccgucagcagggagaugacccuguccaaucucuggaucuuccugauucaaucauuugcguuccuuaguggguauaugugguacaacaucauacaguauuuuuaccauugucuguucuga

SEQ ID NO: 58533 - RNA, 2691 nt, Artificial Sequence
  derived and/or modified sequence opt3 from LPIN1__Homo_sapiens__NP_001248356
augagcagagugcagaccaugaacuacgucggccaacuggccgggcagguuuucgugacaguaaaggagcucuauaaaggacuuaaucccgcuacucuguccgguugcaucgacauuauagugaucaggcagccuaacggcaauuugcaguguucuccauuucacguccgguucgggaagaugggaguguuacgcucacgagaaaaaguuguggauauugagaucaacggcgaaagugucgaccugcauaugaagcuaggugauaauggggaggcauuuuucgugcaagaaacggacaacgaucaggagguaauuccgaugcaccucgccaccagccccauccuguccgagggagcgucucguauggaaugccagcuuaaaagaggcucgguugacaggaugcggggccuggauccuucaacaccagcucaggugauagcccccagcgagacuccuaguuccucuagcgucgugaagaagcgcagaaaaaggcggcgcaagucccaauuggacucacucaaacgagaugacaauaugaacaccagugaagaugaggacauguuuccaaucgagaugagcucugaugaagcaauggagcugcuggaauccucaagaacacuccccaaugacauuccuccauuccaggacgauaucccggaggaaaacuuaagccuggccgugauuuacccccagagugcuucuuauccuaauuccgacagggaguggagcccaacccccucgccuucugggucccggccaucaacucccaagagugauagcgagcuugucuccaaaucuacagaacguaccggacagaagaacccggagauguuguggcuguggggugaacuaccucaagcagccaagagcucaaguccccauaaaaugaaggaguccagcccacucucuucacgcaaaaucugugacaagagucacuuucaggcuauacauagcgaauccucugauacguucucggaccagagcccuacucugguuggcggggcccuucuggaucaaaauaaaccccagaccgagaugcaguuugugaacgaggaagacuuggagacacucggagcggcagccccacuguuacccaugauugaagaacugaagccuccauccgcuucaguagugcagacugccaauaaaaccgauaguccgucuagaaagagggacaagcggagccgacaccucggcgcagauggugucuaccuugacgaccugacagauauggaccccgaaguggcugccuuguauuucccuaaaaacggggauccauccggacuagcgaagcacgccucagacaacggcgcacgcagcgcuaaucaaucuccccaguccguuggcaguagcgggguggauucuggagucgaguccaccucagacggucugagagaucucccuaguaucgccauuagccugugcggcgggcuuucggaccauagggagaucacgaaagaugcuuuucuggaacaggccguguccuaccagcaauucguagacaacccagcaaucauugaugaccccaauuugguugugaagauaggaucuaaauauuacaacuggacuacagccgcuccgcuccuguuagcgaugcaggcauuucagaagccucugccaaaggccaccgucgagagcaucaugcgggauaaaaugcccaagaaaggcggucgcuggugguucucauggagagggaggaauacuacaauuaaggaagagaguaaaccugagcagugucuagcuggcaaggcccacuccaccggagaacaacccccacagcucucucuggcaacgcgugugaagcaugagagcuccucaagcgacgaggagcgggccgcugccaaaccuaguaacgcaggccaccuucccuugcugccaaaugucucuuacaagaaaacccuccgacugacauccgaacagcuuaagagccugaaauugaagaacgggccgaaugacgugguuuucucggugacuacccaguaucaaggaacaugcagaugugaggguacuaucuaccucuggaacugggaugacaagguaauaauuucagauaucgacggcaccaucacaaggucugauacccuggggcacauuuuaccuacucugggaaaagacuggacgcaucagggcaucgcgaagcuauaucacaaagucagucagaaugguuacaaguuucucuauugcuccgcucgcgccauugggauggcagauaugacacggggcuaccugcauugggugaacgagagaggaaccguucuuccccaaggcccauugcugcucagccccucuagccuguucuccgccuuacacagggaagugauagagaaaaagccugaaaaauuuaagguccagugucugacugacaucaagaaucuuuucuuuccaaacaccgagcccuucuaugcugccuuugggaaucgcccugcagauguguacucauacaaacagguaggagugaguuugaaccgaauuuucacaguuaacccgaagggugaacucguccaggagcaugcuaaaaccaauaucagcucuuaugugcggcugugcgagguggucgaccacguuuuuccacuacugaagcguucccacucaagugauuuccccuguagcgacacuuuuuccaacuucacauuuuggagagaaccucucccacccuucgagaaucaagauauccauucugccucggcguga

SEQ ID NO: 58534 - RNA, 2691 nt, Artificial Sequence
  derived and/or modified sequence opt3 from LPIN2__Homo_sapiens__NP_055461
augaacuacgugggccagcuggccgggcaagucaucguuaccgugaaggagcucuauaaaggaauuaaucaggcuacacuuagcgguugcauagacguaaucgugguccagcagcaagauggcuccuaccaguguucucccuuccacgugagauuugggaagcugggaguuuugaggucaaaagaaaaggugauugacaucgagauuaacggcagugcagucgauuuacauaugaaacugggugacaauggggaagccuucuuuguggaggaaacugaggaggaauaugagaagcuaccugcguaccucgcuacgagcccaaucccgaccgaagaucaguucuuuaaggacauagauacaccccugguaaaauccggaggcgacgagacuccuucucagucgucagauaucagccacguucuugagaccgaaacaauuuucaccccaaguuccgugaagaaaaagaaacggcgccgaaagaaguauaaacaagacucuaagaaagaggaacaggccgcaagcgccgcugcagaggauacuugcgacgucggcguguccucagaugacgacaagggggcccaggcugcccguggaaguagcaacgcgucucugaaagaagaggaguguaaggaacccuugcucuuucauuccggugaucacuacccucugucagacggcgauuggagcccacuggagacaaccuauccccagacggcaugcccuaaaagugacucugaacucgaggugaagccagccgaauccuuacugagaagcgagucgcauauggaguggacuuggggcggauucccggaaucuaccaaggucuccaaaagggagcggucagaucaccacccccgcacagcuacuaucaccccuagugaaaauacacauuuuagaguuauuccaagcgaggacaaccuuaucuccgaaguggagaaggaugccucuauggaggacaccguauguacgauagugaaacccaagccuagggcauugggcacucaaaugagcgauccaacaucagucgcugaacugcuagagcccccgcucgaaaguacccagauuuccagcaugcuggacgccgaucaccuuccuaaugcggcccuggcagaggcucccucugagucaaaaccagccgcuaagguggacaguccuagcaagaaaaaggguguucauaaacggucccagcaccaagggcccgacgauaucuacuuggacgaucucaagggacuggaaccagagguggccgcauuauacuuccccaaaucugaaucggagccuggcagccgccaguggccagaauccgacacucugucaggcagucagucuccgcagagcgucggguccgccgcugcggauucaggaacagagugccucagcgacucugcaauggaucuucccgacgugacccuguccuugugugguggccuaagugagaacggggaaauuagcaaggagaaguuuauggaacacaucaucacguaucaugaguucgccgaaaauccuggacugauugauaacccaaaucucguaauacgaaucuacaacagauauuacaauugggcucuggccgcacccaugauucuuucucugcaaguuuuucagaaauccuugccuaaggccaccguggagucaugggucaaagacaagaugccaaagaagagugggagguggugguucuggcggaagcgugagagcaugacaaaacagcuccccgaaucgaaggaggguaaauccgaagcuccgccugccucugaucugccaagcucaaguaaggagcccgcaggggcgcgcccugcugaaaacgacuccucuagcgaugagggcucccaggaguuagaagagucaaucacuguggaccccauaccaaccgaaccucugagccacggaaguacaacuucuuauaaaaagucccuaagacucagcucggaccaaauugccaaacugaaacuucaugauggccccaaugacgucguguucucaaucaccacacaguaccaggggaccuguaggugcgcaggaacuaucuauuuguggaacuggaacgauaagauuaucauuucugacauagaugguacgaucacaaaaagugacgcccugggccagauucucccacaacuggggaaggauuggacccaccagggaaucgcuaaacuuuaccauuccaucaaugagaacggcuacaaguuucuguauugcagcgcccgggcaauugguauggcugacaugacucgaggguacuugcacuggguuaaugauaaaggcaccauacucccgcgcggaccucugauguuaucucccagcucccuguucucagccuuucacagagaggugaucgaaaagaagccagagaaauucaagauugaaugucuaaacgacaucaaaaaucucuuugcgcccaguaagcagccuuucuaugccgcuuuuggcaacaggccaaaugauguauacgcauauacacaggucggggugcccgacugccggauuuucaccguuaacccuaaaggagagcugauccaagaacgcacuaaggguaauaagagcucuuaccauagacuuuccgaguugguggagcacgucuuuccgcugcucucaaaagaacagaacagugccuucccaugccccgaguuuagcuccuucuguuauuggagggauccuauaccagaaguggaccuggacgauuuaucuuga

SEQ ID NO: 58535 - RNA, 1428 nt, Artificial Sequence
  derived and/or modified sequence opt3 from LPL__Homo_sapiens__NP_000228
auggagagcaaggcccugcucgugcuuacccuggcugucugguugcaguccuuaacagcaucuagaggcgggguugccgcggcugaccaaaggcgggauuucaucgacauugaaucaaaauuugcccugcgcacucccgaggauacggcagaagauaccugccaccuaauaccuggaguggccgagaguguagcuacaugucauuucaaccacagcuccaagacuuuuauggugauccaugguuggaccgucacaggcauguacgaaucuugggugccaaaacucguugcagcccuguauaagcgagagccggacucgaaugugauugucguggacuggcuuucacgugcucaggagcacuaccccguaagcgccggguauaccaaacugguuggacaggauguggcgagauucaucaacuggauggaagaggaauuuaauuacccuuuggacaacguccaucuccugggcuauagucugggugcacacgccgcugggauugccggaucccucacuaauaagaaggugaacaggaucacaggcuuagauccagcaggccccaauuucgaguacgcugaggccccuucucggcugagcccagacgaugcggacuuuguggauguccuucacaccuucacgcgcgggucccccggaagaucaauagguauccagaaaccuguuggccauguggacauuuauccaaacgggggaacuuuucaaccgggcugcaauaucggugaagccauuaggguaaucgcagagcggggguugggagacguggaucagcuggucaaguguagucacgaacgcagcauacaucuauucauugacucucuccugaacgaggaaaaucccuccaaggcuuaccgaugcucaagcaaagaggccuuugagaaaggccuuugucugaguugcagaaagaacagguguaauaacuugggcuacgaaaucaauaaggugcgggcuaaacguucuuccaagauguaucucaaaacccgcagccagaugccuuacaagguuuuccacuaucaggugaaaauucacuuuucggggacagagucugaaacucauaccaaccaagccuucgagaucucccuguacggaacagucgcagaaucagagaacaucccauucaccuuacccgaggugaguacgaauaagacuuauagcuuucugauuuacacagaaguagauauaggugagcuccuuaugcugaaauugaaguggaaguccgacucuuauuucagcuggucagauugguggaguuccccuggcuuugccauccagaaaauuagaguuaaggcuggggaaacccagaaaaaggugaucuucugcagcagggagaaagucucucaccuacagaagggaaaggcgccagcaguguuugucaaaugucaugacaagucacugaacaaaaagaguggcuga

SEQ ID NO: 58536 - RNA, 1890 nt, Artificial Sequence
  derived and/or modified sequence opt3 from LPO__Homo_sapiens__NP_001153574
augagagugcugcuccaccuucccgcccuguuggcuagcuuaauccugcuacaggcagccgcguccaccacaagggacccuucucucgaucugacuucacuuagucuggaggucggcugcggggcuccagccccgguugugcggugugaccccugcagcccuuaccgcacgauuaccggagauuguaacaaucgacguaagccagcauugggugccgcuaacagagcacucgccagguggcugcccgcugaauaugaggacggccugucccucccuuucggguggacaccaggaaaaacucggaauggcuuucccuuaccucuggcccgcgaaguaucuaacaagauaguggguuaccuuaaugaggaaggggucuuggaucaaaacagaucgcugcuauucaugcaguggggacagaucguggaccaugaucucgacuuugcgccagauaccgagcugggcucaagcgaguauaguaaagcacagugcgacgaauacuguauucaaggcgauaauugcuucccgaucauguuucccccuaacgacccaaaggccgggacacagggaaaauguaugcccuucuuuagggcugguuucguuugcccuaccccacccuauaagucccuugcccgggagcagauuaaugcacugacuucuuuucuugaugcuagcuucguguacuccucagaaccgagucucgccagccgccugcgaaacuuaucuuccccucugggccucauggcggucaaucaggaggugucagaccacgggcuucccuaucugccauacgacagcaagaaaccuagucccugugaguuuaucaacacaaccgccagaguaccaugcuucuuggcaggagauucuagggcuuccgaacauauacuacuggccacgagccacacucucuuucugcgggagcauaaucgucuugcucgcgaacugaagagauugaacccccaaugggacggcgagaaacucuaccaggaagccaggaagauccugggugcauucguucagauuaucaccuuccgggauuauuuaccuauucugcuaggggaccacaugcagaaauggaucccaccguaccaaggauauucggagucuguggauccccgaauauccaaugucuuuacauucgccuuucgcuucggccaccucgaggugccuucaaguauguuuagacuggacgaaaacuaccagccauggggccccgagccugaacuuccauugcauacucuguucuuuaacaccuggaggauggugaaggaugggggaauugacccccucguccggggucugcuugcuaagaaaagcaagcugaugaaacagaauaagaugaugacaggcgaguugcgcaacaaacucuuccaaccgacccacagaauccauggguuugaucuggcggcaauuaauacgcagaggugucgugaccacggacagccuggcuauaacuccuggcgggccuucugcgauuuaucucagccacaaacucuggaggaacuaaauacaguucucaagagcaaaaugcuggcuaagaaguuguugggucuguacgggacccccgacaacaucgacaucuggauuggcgccauagcagagccucucguggaacgaggaagaguaggcccccuguuagccugccugcuugggaaacaguuucagcagaucagggauggagaccgcuucuggugggagaauccagguguguuuacuaacgaacaaaaggauucauugcagaaaaugaguuucucccggcucgucugugacaauacaagaauuaccaaggugccuagggaucccuucugggcuaacagcuauccauacgacuuuguugauugcucugccaucgacaaacuggaucuaucaccgugggcaagugugaagaauuga

SEQ ID NO: 58537 - RNA, 1839 nt, Artificial Sequence
  derived and/or modified sequence opt3 from LPP__Homo_sapiens__NP_001161143
augagccaccccuccuggcugccuccaaagucuaccggcgagccgcucgggcaugugcccgccagaauggaaacaacucacucauucggaaacccuaguaucagcgucuccacgcagcaaccacccaaaaaguuugcuccuguuguggcaccaaaacccaaguacaauccuuauaaacagccagguggcgagggggacuuccuuccgcccccuccacccccucuggaugacucuucggccuugccaucaauuagcggaaacuuucccccgccucccccauuagaugaagaggcguucaagguacagggcaauccuggugggaagacccuggaagagaggcggaguucccuagacgcugagauagauucucucacaagcauccuggccgaccuugaaugcuccucacccuacaaaccacgacccccucagaguagcacuggaucuaccgcauccccaccggugucaacacccgucaccggccauaagcgcauggugauuccuaaccaaccaccccugacugccaccaaaaagagcacauugaaaccucagccagcuccccaggcaggcccgaucccuguugccccaauugggacgcucaagccccagccucaacccgugccagcuaguuauacuaccgccucuacauccagccguccuacuuuuaauguccaggugaagucggcgcagcccucuccacacuacauggcagccccguccucaggacagaucuaugguaguggcccucaaggguacaacacccagcccguaccaguuagcggacagugucccccuccauccacaagaggcgguauggauuaugcuuacauacccccuccggggcugcaaccagagcccggauacggcuaugccccuaaucagggcagguacuaugaaggguacuaugcagcuggaccagguuacggcgggcggaacgacucugaucccaccuauggacagcagggccauccuaauacguggaaacgcgagccggguuacacucccccaggggccggcaaccaaaauccucccggaauguacccagugacaggcccuaagaaaaccuauaucacugaccccgucagcgcgccaugcgccccgccucugcagcccaaagggggacacucaggucagcucggcccaaguuccguggcacccagcuucagaccugaggaugaauuagagcaccugacaaagaagaugcuuuacgacauggaaaacccacccgcugaugaguauuuugggaggugugcccggugcggagaaaauguggucggcgaggguaccggguguacggcuauggaccagguuuuccauguggacugcuuuaccuguauuaucugcaacaauaaauugcgcggccaaccuuucuacgccguagagaagaaggcauauugugaaccgugcuacauuaacacacuggagcaguguaacgugugcucuaaaccaaucauggaacgaauacuaagagccacuggaaaggcuuaucacccccauugcuuuaccugugucaugugccacaggucacucgauggcauuccuuucacaguggacgcagggggacugauccacuguauugaggauuuucauaaaaaguucgcgccccggugcaguguuuguaaagaaccaaucaugccugcccccggucaggaggagacugugcguaucgucgcucuugaccgcgauuuccacgugcauugcuacagaugugaagacugcggcgggcuguugagcgagggagauaaucagggcuguuacccacucgacggucacauucugugcaagaccuguaacuccgccaggauacggguauuaacagcaaaggccucuaccgaucuguga

SEQ ID NO: 58538 - RNA, 1284 nt, Artificial Sequence
  derived and/or modified sequence opt3 from LPPR2__Homo_sapiens__NP_001164106
auggccggcgggagaccccaccugaagaggagcuucuccaucauuccuugcuuuguguucgucgagggauuuuucuguuacgacucuaccuaugcuaaaccauacccgggucccgaagcagccucacggguuccuccagcgcucguguaugcucuuguaacagccggccccacucugacgauauuguuaggggagcuggcacgcgccuuuuucccugcuccacccagugcagugccugucaucggagaaagcaccauuguguccggcgccugcugucgauuuucuccaccgguucguagauuagugagguuccucggugucuacucguuugggcuguucacaacuaccaucuuugcuaacgccggacaggugguaacaggcaaucccaccccucauuuccuuucaguuugccggccaaacuauacugcgcugggcuguuugcccccuagcccagaucgccccgggccggacagauuugugacagaucaaggagcaugcgccgguaguccuucccucgucgcugccgcaaggcgggcuuuccccuguaaggacgccgcgcugugcgccuacgcagugaccuauacggcuauguacgugacucuggucuuccgcguuaaaggcucucgacucgugaagccaagccuaugucuggcccuuuugugcccugcuuuucugguagggguggucagaguggccgaguacaggaaucacugguccgauguucuagcaggauuccucaccggcgccgcuauugcgacauuucuggugacuugugucgugcauaacuuccagucacggcccccaaguggucgucgccuuagccccugggaagaccuggggcaggcaccuaccauggauucuccauuggagaaacucuccguagcccaggagccggaaguuugcagaccccacucaaccccugcuaggcugacaccaagcaagagucaaaauugcgcccggcgaggacauuuaauccccucuuguguguccagccgcgccccugcaaugugcucgucuccaagaguccccaggccgcggcugcgcuccgagccuacgccacucccccuuccucugcccuugccagcuccuacucccucacagggcccaaguccgagcuccccuggccccgggggaccagguggcgggggaggcagagguaggaagcuacugcuccccacaccucugcuucgugaccuguauaccuugucugggcucuacccaagccccuuucaccgggauaacuucucaccuuaucuguuugccagucgagaccacuuacuguga

SEQ ID NO: 58539 - RNA, 1965 nt, Artificial Sequence
  derived and/or modified sequence opt3 from LPPR4__Homo_sapiens__XP_011540800
augcccuacaucgagccuacccaggaagccauuccauuccugaugcuccuuagccuggcuuuugcaggcccggccauaacaaucauggugggggagggaauuuuguauugcuguuuauccaagagaaggaacggugucggccuggaacccaauaucaacgcgggaggaugcaauuucaacucuuuucuacggcgcgcuguucgauucgugggcguacacguguuuggucucuguucaacugcccugauuacggacaucauacaacuuaguaccggguaccaggcaccuuauuuccugacagucugcaaaccaaauuacacuagcuugaacguguccuguaaggaaaauucuuauaucguugaggauauuugcucgggaucagaccucaccgugaucaacagcggccguaaaaguuuucccucccagcaugccacacuggcugcauucgccgcugucuacgugucuauguauuuuaauagcacccugacugauuccucaaagcucuuaaaaccucugcuuguauucacauuuauuaucuguggcauaauuugcggguugaccagaaucacgcaguacaagaaccacccaguugacguguacuguggauuccugauugguggcgggaucgcccuauaucucggacuguacgcggucggcaauuuucuucccagugaugagagcauguuccaacauagggacgcacugcggucuuugacugaucucaaccaggacccuaaucgccuguuauccgccaagaacgguucaagcagugaugggaucgcucacaccgaggggauucugaauagaaaccauagggacgccucuucccucacaaaccuuaaacgggcaaaugcugauguggaaauaaucacuccacgcagcccgaugggcaaggagaacauggugaccuucucgaauacacugccccgagccaacaccccuucugucgaagacccaguuagaaggaaugcguccauucacgccucaauggauagugcacggagcaaacaguugcuaacgcaguggaagaacaaaaaugagucccguaagcugucucuccaagugaucgagcccgaaccuggccagagcccaccccgcucaauagagaugagaaguuccagcgaaccgucuaggguaggggugaacggagaccaccaugguccuggcaaucaguaucugaagauucagcccggggcugucccaggaugcaacaauucaaugccuggcgguccccgggugaguauccaaagccgaccaggguccucucagcuuguucacauccccgaggaaacucaggagaacauuucgacaagcccuaaauccucaagugcccgcgcuaaguggcugaaagccgcagagaagaccguggccuguaauagaucuaacagccaaccaaggaucaugcaggucauugcuauguccaaacagcagggcguguugcaaucaagcccgaagaauacugaaggaucuacaguauccugcaccggcaguauacgguacaaaacgcucaccgaccaugagcccagcgggaucguucgcguggaagcgcacccugagaacaacagaccaauuauccagauccccucuacagaaggagaggguuccggcucauggaaguggaaggcaccugagaaagggagucugaggcagacuuaugaauuaaaugaucugaaccgugacagcgagucgugcgaaucccuaaaggauucuuuuggaagcggcgaccggaaacgaucaaauauugauaguaacgagcaccaucaccaugguauaaccacaaucagagucacuccaguggaaggguccgagauuggcucugagacccucagcaucuccucaagcagggacaguacacugcgccggaagggaaauauuauccuuauacccgaaagaucuaacuccccggagaauaccaggaacaucuucuacaaaggcacuagcccuacgcgcgccuauaaggauuga

SEQ ID NO: 58540 - RNA, 1176 nt, Artificial Sequence
  derived and/or modified sequence opt3 from LPXN__Homo_sapiens__NP_001137467
augagcacccugcucaucuccucuucagacgcccuucuggaggaauuggagagaaguacauuacaggauagcgacgaauacuccaaccccgcuccucugccacuagaucaacacucuaggaaggagacuaaucucgacgaaacgucggagauucugucaauacaggauaacaccagcccgcuucccgcacagcugguguauacaacuaauauccaggaguugaacgucuacagugaagcccaagagccuaaagaauccccacccccuucuaagaccagcgcggcugcccagcucgacgagcugauggcacaucugacagagaugcaggccaaaguugcugugcgggcagaugccggcaagaaacaccucccagacaagcaggaucauaaggcuuccuuagacucaaugcugggcggacuugaacaagaguugcaggaucuggguauugccaccguacccaaaggccacugcgcgaguugucagaagccuaucgcagggaaagugauucaugcccuaggacagagcuggcacccagaacacuucgucugcacucauuguaaggaggaaaucgggucuuccccguuuuucgagcgcucaggucucgcuuauugccccaaugacuaccaccaacuguuuagcccucgaugugccuauugcgcagcuccaauacuugauaaagugcugacagccaugaaccagaccuggcaucccgagcacuucuuuuguagucacugcggggaaguuuucggagcggagggcuuucaugaaaaggacaagaaaccuuacugucguaaggacuucuuggccauguuuucuccaaaaugcggcggguguaauagacccgugcucgagaacuaucuguccgcaauggauacggucuggcacccggaaugcuucgugugcggagacuguuuuacuagcuucucgaccgguuccuuuuucgaguuagauggcaggccuuucugcgagcugcauuaccaccaucggcgcgggacacucugucacggaugcggccagcccaucacugguagauguauuucugcuaugggguacaaguuucacccagaacauuucguaugcgccuuuugucuuacccaacugucaaaaggaaucuucagggagcagaaugacaagacauauugccagccuuguuuuaacaaauuguucccccuauga

SEQ ID NO: 58541 - RNA, 693 nt, Artificial Sequence
  derived and/or modified sequence opt3 from LRAT__Homo_sapiens__NP_001288574
augaagaaccccaugcuggagguggucagccuccuucuggaaaaauuguuacugaucuccaauuucacccuauuuucuucaggcgccgcuggggaggacaagggaagaaacaguuucuacgaaacaagcuccuuucacaggggugauguucucgaggugccucggacucaucugacgcacuauggcauuuaccuuggggacaaucgcguagcacauaugaugccagauauacuguuggcccucaccgacgauaugggacgaacacagaaaguggucucuaacaagcgucugauccugggcgugauuguuaaaguggcgucgaucagagucgacacuguggaagauuucgcuuauggugccaauauucucguaaaccacuuagacgagucacugcaaaagaaggcacuuuugaaugaggaaguugccaggcgggcugagaaacugcuaggguuuaccccguacagccuccuguggaacaauugcgaacauuucgugacauauugucgcuacggaacccccaucaguccucaguccgauaaguuuugcgagacugucaaaauaaucauuagagaccagaggucugugcuugcaagcgccgugcugggcuuggcuuccaucgucuguacaggccucguuucauauaccacgcugccagccauuuucauccccuuuuucuuauggauggcgggguga

SEQ ID NO: 58542 - RNA, 8592 nt, Artificial Sequence
  derived and/or modified sequence opt3 from LRBA__Homo_sapiens__NP_006717
auggccagcgaggacaacagagugcccuccccuccaccgaccggcgaugacgggggagguggcgggagggaagagacacccacugaaggaggcgcucugucucucaagccuggucuuccaauccgggggauucgcaugaaauucgcaguccugacgggauugguugaggugggcgaaguaucaaaucgagauauaguggagaccgucuuuaacuuacuggugggcgggcaguucgaccuagagaugaauuuuaucauucaagaaggagagaguaucaacugcaugguugaucuccuggaaaagugugacauuacaugccaggccgagguguggagcauguucacugcgauccuuaaaaaguccauacguaaucugcaggucuguaccgagguggguuugguagaaaaaguucucggcaagaucgagaagguggauaacaugauugcugaccugcuggucgauaugcucgggguguuagccucuuacaaucugacagugagagaacuuaaauuguuuuucucgaagcugcagggagacaaaggcagguggcccccucacgcagguaagcuacucucaguccugaaacauaugccacaaaaguaugggcccgaugccuuuuucaacuuuccuggaaagagcgcugcagccaucgcucuuccaccgauugccaaauggcccuaccagaauggcuucaccuuucacacuuggcugcggauggacccuguuaacaauaucaacguggauaaggacaaaccauauuuguacugcuuccgcacaaguaagggccucggguauuccgcgcauuuuguaggagguugucugauagugaccucuauuaaaagcaagggcaaaggguuccagcacugcgucaaguucgacuuuaagccccagaaaugguacauggugacgaucguucauauuuauaauagauggaagaacuccgaguuaagguguuacgugaauggagaacuggcaucauacggcgagaucacuugguucgucaacaccagugauacauuugacaaaugcuuccucgguagcucugagacugccgaugcuaaccggguguuuugugggcaaaugaccgccguauaucuuuucuccgaagcacugaaugcugcccagaucuuugcgauuuaccaguugggccuaggauauaagggcacauucaaauuuaaggccgagucagaccuguuccucgcagaacaccacaagcugcuucuguacgaugggaaauugagcagugcuauagccuuuaccuauaacccucgcgcuacggacgcccagcucugccuggagucuuccccaaaggauaaucccagcaucuucguucauucgccgcacgcauuaaugcugcaagacgugaaagccguccuaacucauucuauucaguccgcuaugcacucaaucggaggugugcagguccucuuuccucuguucgcgcaacuugauuaccgacaguauuugagugacgaaauagaucugacaauuuguagcacccuccuggcauucaucauggagcuucugaagaacuccaucgccaugcaggagcagauguuggcuugcaaaggcuuucucgugauuggguacucucuggaaaagagcucaaagagucacguuuccagagccguguuagagcugugccuagcauucagcaaauaccucucuaaucugcaaaacggaaugccccuuuugaagcagcugugugaccauguacuccugaauccagccaucuggauucacacuccugcuaaaguccaguuaaugcuguauacauaccuuucaaccgaauuuauaggcacggugaacaucuauaauaccauuaggcggguugguacaguguugcucaucaugcauacucugaaguacuauuacugggccgucaacccccaggaccguagugggaucaccccaaaaggccuagauggaccccgcccuaaucaaaaggagaugcugagccucagagcauuccugcuuauguuuauuaagcaguuggugaugaaagacuccggcguaaaggaagaugagcugcaggcgauauuaaacuaucuccugacaaugcacgaggacgauaaucuuauggacgugcugcaguugcucguugcucugaugucugaacauccaaacucgaugaucccggccuucgaucaaaggaaugggcuacgggucauuuacaaacugcucgcaagcaaguccgagggaauccgagugcaggcccugaaagcuauggguuacuuucuuaagcacuuggcccccaaacgcaaggcagaagugaugcugggccacggguuauucucacuccuggcugagagacuuaugcugcagacuaaccuaauuaccaugacaaccuauaacguccucuuugagauccugauagaacagaucggaacucaaguuauucauaagcagcacccugacccagauaguucugugaaaauccagaauccccaaauuuugaaggugaucgccacgcuguuaaggaacagcccucagugcccagaguccauggaaguacggcgcgcguuccucucagacaugauaaaacuguuuaauaacagcagagagaauaggcguucucuucugcaguguuccgucuggcaggaauggauguugagucucugcuacuucaaccccaagaauagcgaugagcaaaaaauuacagagaugguguaugccaucuuucggauucugcuauaccaugcuguuaaguaugaauggggcgguuggcgagugugggucgacacccugucuaucacucacuccaaggugaccuucgagauacacaaagaaaaccuugcaaauaucuucagagagcagcaggggaagguugaugaagagauuggccucuguucaaguacaagcgugcaggccgcuucgggaaucaggcgcgacauuaacguauccgucggcucucaacagccggacaccaaagauagcccugugugcccacauuuuacuacaaaugggaacgagaauucaaguaucgaaaagacguccucucuggagagcgccuccaacauagaauugcagaccacuaauacaucauacgaggaaaugaaagcagagcaggagaaccaagaacugcccgacgagggaaccuuagaagagacacucacuaacgagacccggaaugcggaugaccuggaagugagcagugauauuaucgaggccgucgcuaucucuuccaacagcuucauuacgaccggcaaggacucgaugacaguuucagaagugacugccucuaucaguuccccuagcgaggaagaugcaucugagaugcccgaguuucuugacaagagcauuguagaagaggaagaggaugacgauuauguggaacugaaagucgaggguuccccaaccgaggaagcuaauuugccuacagagcuccaggacaacucacugagucccgccgcaagcgaagccggggagaagcuagauauguucggaaaugacgacaaacugauauuucaggaaggcaagccagugacugagaaacaaaccgauacggagacacaggacucuaaggauuccgguauccagaccaugacugcuucaggcaguagcgcgauguccccggaaacaaccguuucucagauugccguggagucggaccuugggcaaaugcucgaagagggaaagaaagcaacuaaccugaccagagagacaaaguugaucaaugauugucacggcagcgucucagaagcuuccagugagcagaaaauugccaaguuagacgugucuaacguugccacggauaccgaaaggcuggagcucaaagcuagcccuaauguggaagcaccccagccacaucgccacguccuggagaucucccgacagcaugagcaacccgggcagggaauagccccugacgcgguaaacggccagcggcgugauucaagaucuacuguguucaggaucccagaauuuaauuggagccagaugcaccaacgccuucugacagacuugcuauucaguauugagaccgauauccagauguggcggucccacagcacaaagacuguuauggacuuugugaacucuucagacaaugucauuuucgugcauaacaccauccaccugauaucccagguaauggauaauauggugauggcuugcggugggauucucccccugcuuagugccgcaacgagcgccacacaugaauuagagaacaucgaaccuacccagggacugucgaucgaggcuucugucacuuuucuccaaagauugauuucccugguugacgugcucauauucgcaagcucacugggcuucaccgagaucgaagccgagaaaaguaugucuuccgguggcauucuuaggcagugucugcgauuggugugcgcggucgcugugcgcaacugucuagaaugccagcaacacagccagcugaagacacggggggauaaggcccucaaaccgaugcauucauuaaucccacugggaaagagugcagccaaaagccccguugacauuguaacuggcgggaucuccccugugagagaucuugacaggcugcuccaggauauggacauaaaucguuugcgcgcugucguguuucgggauaucgaggacucuaagcaggcccaauuccuggcacucgcuguuguguacuuuauuagcguccugaugguguccaaauacagagauauccuugaaccacagaacgagaggcacucacagucuugcaccgagacaggaagugaaaaugagaacguaucgcuaagcgaaauuacgcccgccgcguucuccacccugacuacagccucugucgaggagucagaaagcaccuccagugcacgacggcgcgacucuggcaucggugaggaaacugcuacaggguugggaagccacguggagguuaccccucauacggccccgcccggcgugucagcugguccagaugcaauauccgaagucuuaaguacucugagccucgaggugaauaagucuccugagaccaagaacgacagaggcaaugaccuggauacaaaagccacccccuccguuucagugagcaagaacgucaaugugaaagacauucuuaggucgcugguaaacaucccagccgauggggugacuguugacccugcucucuugcccccagcgugucugggagcacuaggcgaucugucugucgaacagccggugcaauuucggaguuucgaccgauccgugaucgucgccgcuaagaaaagcgccguaucaccuuccacauuuaauaccucuauucccacaaacgcagugagcguugugaguuccgucgauagcgcccaggcuucugacauggggggagagucaccaggcaguagauccagcaaugcgaagcuccccucugugccuacuguugauucggugucacaggacccagucagcaacauguccaucaccgaacgccuugagcacgcccuggaaaaggcagcucccuuauugagggagauauucguggauuuugccccuuuccugagucguacgcuccuggguucucaugggcaggagcuucugauugaaggaacaagccucguaugcaugaaauccucaaguucugugguugaguuggucaugcuguuauguagccaagaauggcagaauuccauccagaagaacgcaggccuagccuuuauugagcuggugaaugaaggccggcuccuuucacaaaccaugaaagaccaccuggugagagucgcuaacgaggccgaguucaucuugagcaggcagcgcgcggaagauauacaccgacaugcagaguuugaaucucugugcgcccaguauuccgcugacaagagagaggacgagaaaaugugugaucaccucauucgggccgcuaaguacagggaccauguuacugcaacccagcugauccaaaagaucauuaacauccuuacagauaaacacggggccuggggaaauagugcugugagccgcccgcucgaauucuggcgucuggacuauugggaggaugacuugagacggaggcgccgauucguaagaaacccacuggguucgacucaucccgaagccaccuuaaagacggcaguggagcacgucugcauuuuuaaacuacgggaaaauuccaaggcgacagaugaggacauacuggccaaaggcaagcagucuaucaggucacaggcucucgggaaccagaauagcgagaacgaaauucuucuggagggagaugacgauaccuugaguuccguggacgaaaaggaccuggagaaucucgccggcccuguuucucugagcacucccgcacaacuuguggcuccaucagucguagugaaagguacauuauccguuaccaguagcgaacuguacuucgagguggaugaggaagacccuaacuuuaagaaaaucgaucccaagauccucgccuauacugagggguugcacggaaaauggcuguucacagaaauucgcucuauauuuucaagaagguaccuacugcagaauaccgcacucgagaucuucauggccaaccgggucgcugugauguuuaauuucccagacccugcgacggucaagaaagugguuaacuaucuuccgcgugugggcguaggcacuuccuuugggcugccccagacccgccgaauuagcuuggccucuccaagacagcuguucaaggcaaguaauaugacacaaagguggcagcaucgggaaaucucgaacuuugaguaccucauguuccugaauaccauugcuggacgcuccuacaacgauuuaaaccaguauccuguguuucccugggucaucacaaauuacgagagcgaagagcuugaccugacucucccaaccaacuucagagaucuaucaaagccuauaggugcccugaaucccaaaagggccgcauucuuugcugaacgguaugagucuugggaggacgaucagguuccgaaguuccacuacggcacgcauuauagcacagccuccuuuguguuggcguggcugcuccgaaucgaaccauucacuaccuacuuucuuaaccugcaagggggaaaauucgaccacgcugauagaacauuuaguucaauuucucgcgccuggaggaauagccagcgggacaccuccgauaucaaggaguugauuccugaauucuauuaccugcccgagauguuugucaacuucaauaacuacaaucucggcgugauggacgacgguacuguagugagugauguugaauuaccacccugggcaaaaaccagcgaggaguuugugcacaucaaccgucuggcccuugaauccgaguucgucucuugucagcugcaucaauggauagaccuaauuuuuggguauaagcagcagggaccugaagcugugagagcacucaaugucuucuacuaucugacauacgagggcgccgugaacuugaauucaaucacggauccgguucugagggaagcgguagaggcucagauucgcagcuucggccaaacucccucgcagcuccuuaucgagccacacccuccccggggguccgccaugcaggugaguccucugauguuuaccgacaaggcacagcaagaugucauaaugguguuaaaauucccaucuaacagccccguuacacauguggccgcuaauacccagccuggacuggccacuccagcagucaucacagugaccgcuaaccgauuguuugccguaaacaaguggcacaaucuccccgcgcaucagggugccgugcaggaccaaccguaucagcugccuguugaaauugauccacuaaucgcaucaaacacgggcaugcacagaaggcagauuacugaccuucuggaucaauccauccagguccacucucagugcuucgugauaacaagugacaaucgcuacauucucguguguggguuuugggauaaaagcuuccgggucuauuccaccgacaccggaagacugauccagguuguguuuggccauugggacguagugacuugcuuggcucguucagagagcuacaucggugggaacuguuacauucugucuggaaguagggaugccacacuccuucugugguauuggaauggcaagugcuccggcaucggggacaaccccggaagcgaaaccgcagcuccucgggccauauuaacaggucacgauuacgaggucacuugcgccgcggugugugcugaacugggcuugguucucucagggucucaagagggaccaugccugauucauuccaugaauggcgaccuacuucgcacgcuggagggucccgaaaacugucucaaaccgaagcugauccaggcaucgcgagaggggcacugcgugauuuucuaugaaaauggauuguuuuguaccuucagcgucaacggcaaguuacaggccacaauggagacugaugacaauaucagagcuauacagcugaguagggauggccaauaccuccuuaccgggggagaccggggugugguaguugugcgccaggucucugaucugaaacagcuauuugccuauccuggcugcgacgcagggaucagagccauggcucuguccuacgaucagagguguauuaucagcggaauggcgucaggcaguauugugcucuucuauaacgacuuuaaucgauggcaccaugaguaccaaacacgguacuga

SEQ ID NO: 58543 - RNA, 2292 nt, Artificial Sequence
  derived and/or modified sequence opt3 from LRCH1__Homo_sapiens__NP_001157683
auggccacccccggcagcgagccucagccauucgugccggcucuguccgucgcaacacuccacccccuucaucacccucaucaccaucaccaccaucaccaacaucacgggggaacuggugccccaggcggggcgggaggcggugggggaggcucuggcggguuuaaccugcccuugaauagaggauuagaaagggcucuggaggaagccgcaaacucagguggccuaaaucucagugcccggaagcugaaagaguucccucgcacggcugcaccagggcacgaccuuagcgauaccguucaggccgaccuguccaagaaccgauugguggaaguacccauggagcucugccauuuugugucucuggagauccugaaucucuaccacaacuguauucgugucauaccugaagcuaucgugaauuuacagaugcugacauaucuuaacuugucgagaaaucagcugucagcccuaccagcgugccucuguggacugccgcuuaaaguucugauugcaagcaacaauaaguugggcagucuccccgaggaaaucggucaacugaaacaguuaauggagcuggauguguccugcaacgagauuacugcccucccucagcagaucgggcaacuuaagucucugagggaauugaauguccggcgcaacuaccuaaaggugcugccacaggagcucguagaccugccccuuguuaaauucgauuuuagcuguaauaaggugcuggucauaccuaucugcuucagagaaaugaaacagcuccagguguugcuguuagagaacaacccacugcaaucacccccggcucagauuuguaccaagggaaaagugcauaucuuuaaguaucuauccauucaggccugccaaaucaagacagcagacagucucuaccugcacaccauggaaaggccucaucuucaccagcacgucgaggauggcaaaaaggacagcgauucuggcguuggguccgacaauggagauaaacgguugucagcuacugagcccagcgacgaagauacagugagucugaacguaccaaugucuaauauaauggaggaggaacagauuaucaaggaagacuccugucaucgccucagcccugugaaaggugaguuccaccaggaguuucaacccgaaccaucgcugcuuggcgacucuaccaacuccggggaggaacgagaucaguucacggacagagccgauggacugcauucagaguuuaugaauuauaaggcgagggccgaagacugcgaggaguugcuccggauugaagaggauguccacuggcagacugaaggcaucaucaguagcuccaaagaccaggauauggacauugcaaugauagagcaacugcgugaggcuguggauuuacugcaggaccccaacggucuaucuaccgauaucacagaacgcagcguucucaaucuguacccuauggggucagccgaggcucuugaauugcaggacagugcccugaacggccagauucaacucgagacuuccccagugugugaaguccagagcgaccugaccuuacagucuaauggaucacaguauaguccgaacgagaucagagagaauagccccgcaguguccccuacaaccaacucuacggccccauucggccugaagcccaggucggauccugcucuuauauugccacccauuagcuuuaauacucucacacaagcgcagaccugggacuccucaaguuacucuguaccgagcgaaggggauuccgacaacguuuuccugcggccucagcgaaaucuagagucaaucgauccacaauucacuauccgcagaaagauggaacagaugagggaggaaaaagagcugguggagcagcuccgggaaagcauugagaugcgccugaaggucucucuucacgaagacuugggagcagcccugauggaugguguggucuuaugccaucucgugaaccacaucagacccagguccguugcuaguauucaugugccuagccccgccguaccaaaacugucuauggcaaagugccgucggaacgucgagaauuuucuugaagccugucgaaaacugggcgugccugaggcugacuugugcucccccugugauauacuccagcuggacuucagacacaucaggaagacaguugauacccuacuggcccucggggagaaggcaccaccgccuacgucagcgcugcgcagucgggaccuuauuggauuuugcuuggugcauauccuguucaucgucuuaguguacauuaccuaucacuggaacgcucucagcgccuga

SEQ ID NO: 58544 - RNA, 2052 nt, Artificial Sequence
  derived and/or modified sequence opt3 from LRCH4__Homo_sapiens__NP_002310
auggccgcugcaguggccgcgccccuggcugccggcggggaggaagcagccgcuaccacaagcgucccuggauccccaggucucccgggcagaaggucugcagagcgggcccuugaagaggcuguugccacugggacgcugaacuugucaaaucgccgauuaaagcacuucccccguggagcggcaagaaguuacgaccugagcgauaucacccaggccgaccuauccaggaaccgguuuccugaagugccagaggcugccugccaacucguaucucuggagggccuuucgcuguaucauaauuguuugcgcugccucaaccccgcacuggguaaucugacagcucucacuuacuuaaaccugucaagaaaucagcuuagcuugcugccuccauauauuugucagcuaccccucagggugcugauagucaguaacaauaaacuuggggcccugccuccagauaucggaaccuugggcucccuccggcagcuggacgugucuagcaacgaauuacaaucccugccgucagagcucugcggccuuaguagccugcgcgauuugaauguucgaagaaaccagcuaucuacacugcccgaagaacucggggaccugccucuugugaggcuggauuucuccuguaaucgggucucacguauuccagugagcuuuugccgcuugagacaccuccagguaauccuguuagacaguaacccccugcagucuccuccagcgcaaguuugucuaaagggaaaacuccauauuuucaaguaccuguccaccgaggccggucagaggggcagcgcacuuggggauuuggcucccucgcggccgccuucuuuuucccccugcccagccgaagaccuguucccuggacaccgauaugauggcggucucgacucaggguuucauaguguggauagcggauccaaacgcuggucuggcaaugagagcacugacgaguucucagagcugaguuuuagaaucuccgaacuugcuagggagccccggggcccacgcgagagaaaggaagacgggagcgccgauggagaccccguccagauagauuucaucgacucucacgugccuggugaggaugaagagaggggcacaguggaggaacagcguccaccggagcugucacccggggcaggagaccgggaacgagccccuaguagcagaagggaggaaccagcuggcgaggaacgccggagacccgauaccuugcaacucuggcaggagagggagcgccgacagcaacagcaguccggugcguggggcgcaccucggaaggacucucuguuaaaaccagggcugcgugccgucguuggaggcgcugccgcagugucgacgcaggccaugcacaacgggagccccaaguccucagcuagucaagccggagcagcggcuggucagggcgccccggcacccgccccagcuucucaggaaccccuaccuauugccgggcccgcaacugcuccagccccuagaccccucggaagcauccagaggccaaacuccuuucuguuccgcucaagcucucaauccggcagugguccgagcucuccugauuccguacuucggcccagaagguacccacaggugcccgacgagaaagauuugaugacccagcugcgacagguccucgaaucacgccugcaacggccuuuaccagaggaccuggcggaggcccuugcuaguggggugauuuugugucagcucgcaaaucagcugagacccaggagcguuccuuuuauccaugugccgucgccagccguccccaagcuauccgcucugaaagcccguaagaacguggaaucuuuccucgaggcaugccgcaagaugggcguaccugaagcggaccuguguagcccaucagaucuuuugcagggaacagcccggggccugagaacugcuuuagaggccguuaaaagggucgggggaaaggcacucccuccucuguggccgcccaguggucuuggcggguucgugguguuuuaugucgugcugauguugcuccuguacguuaccuacacacgacuacugggauccuga

SEQ ID NO: 58545 - RNA, 2370 nt, Artificial Sequence
  derived and/or modified sequence opt3 from LRFN2__Homo_sapiens__NP_065788
auggagacccugcucggcgggcuucuggccuucggaauggcuuuugcaguggucgacgccugccccaaguacuguguuugccagaacuugagcgaauccuuagguacacuguguccuucuaaaggccuacucuucgugccaccggauaucgacagaaggacuguagagcugcggcuugggggaaauuuuauuauacacaucucacgccaagauuucgcgaacaugacgggccugguggacuugacccucagucgaaauacaauuagccauauccagcccuuuuccuuccuggaucuggaaucucuccguucguuacaccuggacucaaacagacuuccuagcuugggugaggauacucugagggggcuagucaaucuccagcaucugauugugaacaauaaccagcuuggaggcaucgcugacgaagccuuugaggauuuccuguugacccucgaggaccuggauuuaaguuauaauaaccugcacggccucccaugggacuccguucggcgcauggugaaucuucaucaacugucuuuggaucacaaccuacuggaccacauagcagaagggacauuugccgaccuccagaagcuggcuagacuugaucugaccagcaauagguugcagaaacucccuccugacccaaucuucgcacggucccaggccucagcucugacugccacacccuuugcgccuccauuaaguuucagcuuuggagguaacccgcugcauugcaauugugagcuacucuggcugcgccgacuugaaagagaugacgauuuggagaccugcggcucucccgggggacugaagggcagguacuucuggcacguccgggaggaagaguucgugugugaaccuccacucauuacgcaacauacucacaaacugcuuguacuggagggucaggcagccaccuugaagugcaaggcuaucggggaccccuccccucucauucacuggguugccccagaugaccgucuggugggaaacucaagccgcacagcagucuaugauaacggcacuuuagacaucuuuauaaccacaagucaggauucuggcgcuuucaccuguauugccgcgaaugccgcaggggaagcuacggccaugguggagguguccaucguccagcugccccaucuaagcaacucgacuucuagaacagcuccgccuaaauccaggcucucagacauuaccggaaguagcaagacuucccgggguggcgggggaucuggcgguggggagcccccaaaaagcccucccgaacgagccguucuggugucagagguaacaaccacgagugcacuugugaagugguccgucagcaaaucugccccacgcgugaagauguaccaauugcaguauaauugcucagacgaugaaguucugaucuacagaaugauccccgcuaguaacaaggcguuuguggucaauaaccucgugagcggcaccggauaugaccuguguguauuagcaaugugggaugacacagccacuacccugacagcuacuaauauuguuggcugcgcccaguucuuuaccaaagcagauuacccucaaugccaguccaugcacucucagauacuugggggaacaaugaucuuggugauugguggcaucauagucgccacccuccugguguucauugucauccuaauggugagguacaagguuuguaaccaugaggcuccaucgaaaauggccgcagcggugagcaauguauauucccagacuaacggggcucaaccgcccccuccaucaagugcccccgcaggagccccuccacagggacccccgaaggucgugguucggaaugaacugcucgacuuuacggcuucucuggcccgcgcaagcgauuccucaucuagcuccagucuugguagcggggaggcugccggcuugggcagagcgccuuggaggaucccacccucugccccucgucccaaaccaucccuggaccgguuaaugggcgcuuucgcaucacucgaucugaagagucagcgaaaagaggaacuucuggacagcagaacacccgccgggaggggagcugguaccucggcccgcggccaccauuccgaucgggagcccuugcucgggccaccggcagcgagagccaggucucugcuaccucugccccucgaaggaaaggcuaagcgcagccacucauuugacaugggcgauuucgccgcagcugccgccggugggguggucccaggcggauacagucccccucgaaaaguguccaacauuuggacuaagcggucucugagcguaaauggcaugcuuuugccauuugaggaauccgaccuggugggggcacguggaaccuucggcucaagcgaguggguuauggagaguacagucuga

SEQ ID NO: 58546 - RNA, 2160 nt, Artificial Sequence
  derived and/or modified sequence opt3 from LRFN5__Homo_sapiens__NP_689660
auggagaagauccuguucuaccucuuucuuauuggcauagccgugaaagcucagaucugccccaagagaugugucugccaaauucugagcccuaacuuggcaaccuuaugugccaaaaaggggcugcuauucguuccaccgaauaucgacaggcggacaguggaacuccgccuggcggauaacuuuguaacuaauauuaaacgaaaggacuucgcuaacaugacgucccuuguggaucugaccuugucucguaauacaaucucauuuauaacuccccacgccuucgcagaccucagaaaccugagggcccugcaucucaauaguaaccgguuaaccaagaucacaaaugauauguuuagcggacuguccaaccuucaccauuugauucugaauaacaaucagcuaacccucaucucuucgacugcuuucgacgaugucuuugcacuggaggaacuugaccugucauauaacaauuuggagacaauuccuugggaugccguggaaaagaugguuagccuccacacccugaguuuagaccauaacaugaucgauaacauaccaaaggguacguucucccaccuucacaaaaugacucgccucgacgugaccucuaauaagcugcagaaacugcccccugauccauuguuucagagagcucaaguccuagccacaagcggcauuaucucccccucaacuuucgcgcugaguuuugggggaaacccucuccauugcaauugugagcugcuuuggcugaggcgguugagccgcgaggacgaccucgaaaccugcgcaucuccaccgcuguuaacaggccgauacuucugguccauucccgaggaagaguuccugugugagccuccacuaaucaccagacacacgcaugaaaugagggugcucgagggucagcgggccacucugcguugcaaggcucgcggggaucccgaaccugccauccacuggauuucaccagagggaaaguugauaagcaacgcaacaagaaguuugguauaugacaauggcacccuggauauccucauuacuacaguuaaagacaccggcgcuuuuacguguaucgccucuaaccccgcgggggaagccacccagauaguggaucugcacauuaucaaacuuccgcaucugcuuaauuccacaaaccacauccaugagccugaccccggaagcucggauauuucuacuuccaccaaaucagguaguaauacaagcuccucuaacggcgacacuaagcucagccaggauaaaaucgucguggcagaggcuaccucaaguacagcccuguuaaaguucaauuuucaaaggaacauuccagggauacggauguuccagauccaguacaauggaaccuaugacgauacucugguguaccgaaugauuccucccacguccaaaacauuucuagucaacaaucucgcugccggcaccauguaugaccugugcguucuugcaaucuacgacgaugguaucacuagcuugaccgccacacgcgugguaggguguauucaguucaccacugaacaagacuacgugagaugccacuuuaugcagucucaguuccugggaggcacaaugauaaucauuaucggcgggauuaucgucgcuucagugcucguuuuuauaaucauucugaugaucagguauaaggugugcaacaacaauggacaacauaaggucacgaaagugaguaacguauacagccagaccaauggugcgcagauucagggcuguuccguuacuuuaccacaaucugugucgaagcaggcagucgggcacgaggaaaacgcccagugcuguaaagcuacaagcgauaaugugauccaguccucagagaccugcaguucucaagacagcuccacaacuaccucagcccugcccccuagcuggacgucuuccaccagugucagccagaagcagaaacggaagacaggaacuaagccaucuaccgaaccgcagaacgaggcagugacaaauguugagucccaaaacacuaaucgcaacaauucaaccgcccuucaguuggcuaguagacccccugauagcgugacggaaggcccaacaucgaaaagggcccacauaaagcccaacgcacuccugaccaauguagaccagauuguccaggagacucaacgucuagaacugaucuga

SEQ ID NO: 58547 - RNA, 1044 nt, Artificial Sequence
  derived and/or modified sequence opt3 from LRG1__Homo_sapiens__NP_443204
augagcuccuggucuagacagaggcccaagucaccuggcgggauccaaccacacgugagucggacccuguuccuccuucuguuguuagccgcuagcgcauggggagucacacuguccccgaaagacugccagguuuuucgcucugaucaugguucgucaauuagcugucagcccccugccgagauaccaggcuaccuacccgcggacacugugcaccucgcuguagaguucuuuaaccugacgcaucuuccugccaaucuguugcagggggcaaguaagcuccaagaacugcaccuguccucuaacggacucgaauccuuaagcccagaguuccugcgacccgugccucagcuucgugucuuggaucugaccagaaaugcccuaacaggccucccaccgggucuguuucaggcuucagcaacucuugacacccugguguugaaagaaaaccagcucgagguucuggaggugaguugguuacaugggcugaaggcccucggacaccuugaucugagcggcaauagguugcggaaacuacccccuggccugcucgcuaacuucacacugcuucgcacccuggacuugggggaaaaucaacucgagacucugccacccgauuuacugagaggaccucuacagcucgaaaggcugcaccuugaggguaacaaguugcagguccugggcaaggaccuccugcuuccacagcccgaucugcgguauuuguuucucaaugggaacaaacuggcccgcguggcggcaggagccuuccaaggcuuacgacagcuggacaugcuagaucucucuaauaacucccuggcuucaguaccggagggucuuugggccagcuuggggcagccuaauugggacaugagagauggauuugacaucaguggcaaccccuggauuugcgaccaaaaucugucugaucucuacagguggcugcaggcacagaaggacaaaauguucucccagaacgauacacggugugcuggcccagaagccguuaaggggcaaaccuuacuggcgguggccaaaagccaguga

SEQ ID NO: 58548 - RNA, 2478 nt, Artificial Sequence
  derived and/or modified sequence opt3 from LRGUK__Homo_sapiens__NP_653249
auggccaccagcgagagagcucugcucaggacacgggcagccucccuucugcgcggcuuggggcgaucucguacuggagcgagaucauuacaguucagggcugaaaaggagcggcaacccugcuggaguuuuccuaugggucagaaaacgaagggcagcuccaacaucgccucuucguaccugcuacagcagcucaugcaccgcuaucaagaacuggacucagauggggacgaggaucagggagaaggcgaggcagguagcgaggaaaguuccgagucugaaaugcuuaaucuggaggaggaguucgacgggguguugagagaggaagccgucgcuaaagcacuccaucaccugggaaggagcggcuccggcaccgagcagguuuaccugaaccucacauuaucaggguguaaucugauugaugugaguauacuuugcggauauguacauuugcagaagcuggaccuaagcgccaacaaaaucgaagaucucucuuguguguccugcaugccauaccugcuugagcugaaugcuucacaaaacaauuugacuaccuuuuucaacuuuaagccgcccaagaaucucaaaaaggccgacuucagccacaaccagauuagugagaucugugaucugucugcguaucaugcauuaacaaaacugauucucgacgguaaugaaaucgaggaaauauccggccuugagaugugcaacaaucugauccacuugagccuagccaacaauaagauuaccacuaucaacgggcugaacaaacucccuauuaagauccugugucuuucgaauaaccagauagaaaugauuacaggacuggaggauuugaaggcucuccagaaucuggacuuaucucacaaccaaaucuccucacugcagggccuagagaaucaugaucuccuggaagucauuaaccuugaggacaauaaaaucgccgaauugcgggagaucgaauacauuaagaaccugccaauacuccgcgugcugaaucuucuggagaaccccauccaggagaaaagugaauauugguuuuucguuauuuuuauguugcuccgacugaccgaguuagaccaaaagaaaaucaagguggaagagaaagucagcgcagugaauaaguacgauccuccacccgagguaguugcugcccaggaccaccugacgcauguggucaacuccgugaugcagccucagagaauauucgauucuacucuaccaagccucgacgcgccguaccccaugcugauucuugccgguccugaagcaugcgggaagagggaguuggcucaccggcugugucgucaauuuucaaccuauuuccgcuacggagccugccacacaacuagaccacccuauuuuggcgaaggcgauaggguggacuaccauuucaucagucaggaugucuucgacgagaugguuaauauggggaaauuuauccucaccuucuccuauggaaaccacaaguacggucugaaucgggauacaguggaaggcauugcucgagacggguuagccagcuguauccauauggagauugagggaguacgcucucugaaauauucauacuuugaaccuagauacauacuuguggucccaaugaacaaggagaaauaugaaggcuacuugaggcggaagggucucuucagucgcgcagagaucgaauuugccgugagcagaguugaucuguauauuaagaucaaccagaauuuccccggguacuuugacgaggugaucaacgcugacgaucuagacgucgcguaucagaaacugucccaacucauuagggaguaccugggccuuaccgaagaaccggcaaagucuuuggccacgacugcugaugugaaaacaucgcaccugaagccugaagcccaucccaccaaauauauaagcuccaauaugggagacuucuuacacucaacugaucguaacuaccucaucaaguuuugggcaaagcugagugccaaaaagacaccagcugagcgggacucuauucaccgacagcaugaagccgcaagacaggcgcuuaugggcaggauccgcccugaucacacccuguuguuccagcgggggcccguaccagcuccccucacgagcggacugcauuacuauaccacacuagaggagcuguggaaauccuuugaccucugcgaagauuacuucaagccuccauuugguccguaucccgagaaaucaggcaaggacagccugguuucuaugaagugcucccuuuucagauucuguccuuggaguaaagaauugccauuucaacccccugaggggagcauuucuucccaccugggaucaggcgccagugauagcgagacugaagagaccaggaaggcauuaccaauccagucguucucccacgaaaaagagucucaucagcaccgccagcauagcgugcccgucauaucacgaccggguaguaaugugaagccuacacucccacccaucccucaagggcggcguuga

SEQ ID NO: 58549 - RNA, 2229 nt, Artificial Sequence
  derived and/or modified sequence opt3 from LRIF1__Homo_sapiens__XP_011540070
auguaccaggugguccaaaccaucggcagcgacgggaagaaccugcuccagcuucugcccauuccuaaauccucuggaaauuugauaccauuaguucagucaagugugaugagcgaugcccugaaggguaacacaggcaaaccgguacaggugacuuuccaaacgcagaucuccucuucgucaaccagcgcuaguguccagcuacccauuuuucagccugcauccucuagcaauuauuuccucacaagaacuguggacaccuccgagaaggggaggguuacaucagugggaaccggcaacuuuaguagcucugucuccaaagugcaaucacacgguguaaagaucgaugggcugacuaugcagacauucgccguuccacccagcacccagaaggacaguucuuuuauuguggucaauacgcagucccuuccugugacugugaaaagcccaguccugcccucgggacaucacuugcaaaucccugcgcaugcugaaguuaagucugugccagccuccucacucccgcccaguguacagcagaaaauacuggcaaccgccacaacuagcaccuccggcaugguggaggcuucucaaaugccuacagucaucuacgugagcccaguuaacaccgugaagaaugucgugacgaaaaacuuccagaauauuuaucccaagccuguaacugaaaucgcaaagccaguuauucugaacacaacccagauccccaaaaauguggccacugagacacagcucaagggcgggcaacacucacaggcugccccggucaaauggauauuucaggauaacuuacagccuuucacccccagucuggugccagucaaguccagcaauaacguggcgucuaaaauucuuaagacguuuguugaccggaaaaauuugggagauaacaccaucaacaugccuccccugucaacaauugacccaagugguacucgcagcaagaauaugcccaucaaggauaacgcauuggugauguucaauggcaaaguauaccuccuggccaagaaagggaccgacguccuuccuucccaaaucgaucagcagaacucugugucgccagacacaccgguucgaaaggauacucugcagaccgugagcuccucacccgucacagaaauuagucgugaggugguaaauauaguguuggcuaaaucuaagagcucccaaauggagaccaagucacucagcaacacucagcuggccucuauggcaaauuuaagagcugaaaagaacaagguugagaaaccuuccccaaguacgacaaauccccauaugaaccagagcucuaauuaucugaagcaguccaaaacccucuuuacuaacccuaucuucccagucggauuuucaaccggccacaaugcccccaggaaggugacagcggugauuuacgcccggaaggguaguguccuucaaagcaucgagaaaauaucguccucuguugacgcaaccacugugacaagccagcagugcguguuccgcgaccaagaaccgaagauucacaacgagauggcuucaacgagugauaaaggggcccagggaagaaaugacaagaaagauucccagggcaggucuaacaaggcucugcaucuaaagagcgacgccgaguucaaaaagaucuuuggccuaaccaaagaucugcggguaugucucacucgcaucccugaccaccugacauccggggaaggauucgauucauuuagcagucuugucaagucugguaccuauaaagaaacagaguucauggugaaggaaggcgagcgaaaacagcaaaacuuugacaagaagagaaaagcaaagacuaauaaaaagauggaucauauuaaaaagaggaagaccgagaacgccuacaaugcuaucauuaacggggaagcgaauguuacgggaucccagcuguugagcucgauacucccaaccucagacgugucucagcacaacauccugacaagucacuccaaaacucggcaggagaagcguaccgaaauggaguacuauacacaugaaaaacaagagaagggcacuuuaaauagcaacgcagccuacgagcagucucacuucuuuaauaaaaacuauaccgaagauauuuuccccgucacgccucccgagcuggaagagacaauccgcgacgaaaagaucagaaggcuaaaacaggugcuccgggagaaagaggcugcccuggaagagaugcgaaagaaaaugcaucagaaguga

SEQ ID NO: 58550 - RNA, 3282 nt, Artificial Sequence
  derived and/or modified sequence opt3 from LRIG1__Homo_sapiens__NP_056356
auggccagacccgugaggggcgggcugggagcuccucggcgcagcccaugccuccuucuguugugguuacugcuacuccgacuggagccggucaccgcagccgcggguccccgugcuccuugugccgcagccugcacaugugcuggcgacucccuugauugcgggggaagaggccuggcagccuugccaggugaccuccccucuuggacuaggucacugaaccugaguuacaauaagcucagcgaaaucgauccugcuggguucgaggacuuaccaaaccugcaggaaguuuaucuuaauaacaaugaguugacggccgugcccucccugggagcggcaucuucgcacguagugucacuauuucuccaacauaacaaaauucggagcgucgaaggcagucagcugaaggccuaccuuucccuggagguguuggaucucucucugaauaacauaaccgagguucgcaauacauguuucccucacggcccaccgaucaaagaauuaaaccuggcugggaauagaauuggaacucucgagcuuggugccuuugacggccugagcagguccuugcuaacccugcggcucucaaagaaccgcaucacacagcugcccgugcgagcauucaaacuuccuagacugacccaguuggaucucaauaggaaccggauucgucugaucgaaggguuaacuuuucaaggacugaauagucuagagguccucaagcugcagcgcaacaacauaagcaagcuaacagacggcgcuuucugggguuugucuaaaaugcaugugcugcaccucgaguauaauucccugguagaaguuaacucagggagccuuuacggacugaccgccuugcaucagcuccaccugaguaauaacucuaucgcgaggauucacagaaagggcugguccuuuugccagaaauuacaugagcuggugcuuagcuucaauaaccucacgcggcuggaugaagagucgcuugccgaauugucuucccugucaguccuccgacugagucacaauagcaucucccauauugcagagggcgcuuuuaagggguuacgcucucugagagugcuugacuuggaucacaacgagaucagcggaacuauagaagacaccucaggugccuucaguggccucgauucccugagcaaacuaacacuguuugggaauaagauuaagucuguggcuaaaagggccuucucaggacucgagggccuggaacaccuuaacuugggugggaaugcaauccggaguguccaauuugacgccuucguuaagaugaaaaaccugaaggaguuacauauuagcuccgacucuuuccucugugauugccagcugaaauggcuuccacccuggcugaucggccgcauguugcaggcuuuugugacugcgaccugugcacacccugaaucgcucaagggacagagcaucuucuccguaccacccgagucauuugugugcgacgauuuccugaaaccgcaaauuauaacacagccugagaccacgauggccauggucggcaaggacaucagauuuacuuguagugcugccucuagcuccucaagccccaugacauucgcauggaagaaagauaaugaagugcuaaccaacgccgacauggagaauuuuguucaugugcacgcucaggauggggaagucauggaguauacuacaauucugcaucucaggcaagugaccuucggacacgaaggucguuaccagugcguaaucacgaaccacuuuggcucuaccuauucccauaaggcccggcugacaguuaacgugcuuccaaguuucacuaaaaccccucacgacauaacaauucgaacuaccacaauggcaagauuggagugcgcggcuaccgggcaucccaauccacagaucgccuggcagaaggauggaggcacugacuuucccgcagccagggagcgccggaugcacgucaugccugaugacgacguguucuuuaucacggaugucaaaauugacgaugcugguguguacagcuguacagcccaaaacucugcaggguccaucucagcuaaugccacccugacuguuuuagaaaccccaagucucgugguaccgcuggaggacagagucgugagcguuggcgaaacaguggcgcuucagugcaaggccaccggaaaucccccuccaaggauuacuugguucaagggcgaucgcccccugucgcuaacagagcgacaccaucucacgccugacaaccagcuguuggucgugcagaacguaguggcugaggaugcagggcgguacaccugugaaauguccaauacucugggaacagagcgugcccacucucaauuaagcguucucccagcugccgguugcagaaaagacggcaccacagucgggauauucacuaucgcaguggugucaaguauuguccugaccucccuuguuuggguguguaucaucuaucagacgaggaagaaaucugaagaguacagcgugaccaacacagaugaaacuguagugcccccggacgucccuuccuaucugucaagccagggaaccuugagugaucgccaggagacaguugugcggacugagggcgguccacaagcgaaugggcauauugaaucuaacggcgucugccccagagacgccucccacuuuccugagcccgauacccauagcguggcuuguaggcagccaaagcucugcgccggaucggcauaccacaaagaaccuuggaaggcuauggagaaggccgaaggcacgcccgggccacacaaaauggagcauggaggccgaguuguguguucagacugcaauacagagguagacuguuauucucgcggucaggcauuccacccgcagccugucagucgggauuccgcccaacccagcgcuccaaacgggcccgaaccuggaggcucugaccaggagcauagcccacaccaucagugcuccagaaccgcggccgguucaugccccgaaugucaaggcagucuguacccuagcaaucacgauaggaugcuaacugcagugaagaaaaagccgauggcuucucuggacgggaaaggagauuccucauggacacuugcccgucucuaucacccagacaguaccgagcugcagcccgccagcuccuugacuucuggcucgccugaacgcgcugaggcacaguaccuguuagugagcaacgggcaucucccaaaggccugcgaugcgucacccgaguccaccccucugacaggacagcuuccgggcaagcaacgggucccccuguugcucgcuccaaaaaguuga

SEQ ID NO: 58551 - RNA, 3180 nt, Artificial Sequence
  derived and/or modified sequence opt3 from LRIG3__Homo_sapiens__NP_001129523
augguggacguccugcuccuuuucagccugugcuuguuauuucacaucuccagacccgaucugucucauaacaggcuaucauucauuaaggccaguagcaugucccaccuccagucucugcgggagguuaaacuuaauaacaaugaacuggagaccauaccuaacuugggcccagugucggcuaauaucacacuccugucacuggcagggaaccgcauuguagaaauccucccggagcauuuaaaggaauuucaaagccuggagacucuugacuugaguuccaauaacauuucugagcugcagacggccuuccccgcgcuacagcucaaauaccuguaucuuaauagcaaccgagugaccuccauggaaccuggauacuuugauaaucuggcuaacacauugcucguccugaaguuaaaucguaacagaaucucagccauaccacccaaaauguucaagcugccucagcuccaacaccuugagcugaauaggaacaagaucaaaaacguggacgguuugacuuuucagggccuaggggcacugaagagucucaaaaugcagcggaauggaguuaccaagcugauggauggcgccuucuggggucuuagcaacauggaaauucugcaguuggaccauaauaaccucacagagaucaccaaaggguggcuguauggauuacugaugcuacaagagcuccaccugucucagaaugcuauuaaccgcaucuccccagaugcaugggaauuuugucagaaacuuucagaguuggaccugacuuucaaucaccucagcagacuggaugacaguucuuuucuuggccuguccuugcucaacacacugcauauaggcaauaacagggugagcuacauugccgauugcgcuuuccggggguuaucgucucugaagacccuagaccucaagaauaacgaaaucuccuggacgauugaggauaugaauggagccuuuucaggucuggacaaacuucgccgauugauccugcagggcaacagaaucaggaguauuacuaagaaggcguucaccgggcucgacgcacuggaacacuuagaucugagcgacaaugccauaaugucccuucaaggaaacgcuuucucucagaugaaaaaguugcagcaacuccaucugaacacaagcucacuacugugugauugccagcucaaauggcugccccagugggucgccgagaauaacuuucagaguuucgugaaugcauccugugcucacccucaacuuuugaagggccggagcaucuuugccguaucuccagacgguuucguuugcgaugacuuuccgaagccccagauuacugugcagccugagacccagucagcgaucaaagggaguaaccugagcuucauauguuccgccgcaucuucgagcgauuccccaaugacauuugcuuggaagaaagacaaugaauuacuccacgaugccgagauggaaaacuaugcucaucugcgugcccaaggaggcgaggucauggaauacaccacgauucuucgccugagagagguggaguucgcaucagaaggcaaguaucagugcgugaucaguaaucacuuugggucuagcuacuccgucaaagccaaguugacuguuaacaugcuccccucauucacaaagaccccuauggaccugacuaucagggcuggagcgauggcacggcuagagugugccgcugugggucauccagcaccccagauugccuggcagaaagauggcgggacagacuuuccggccgcucgagaacgcagaaugcacguaaugccugaggacgauguguucuuuaucgucgacgugaagauugaagauauaggaguuuacagcugcaccgcccaaaauucugcaggcuccaucagugcgaacgcuacgcugaccgugcucgagacacccagcuuccugaggccacuuuuggaccggacugucaccaaaggugagacagccgugcugcaguguauugcagggggcucuccucccccaaaguuaaauuggacuaaagaugacucaccccucguaguuaccgaacgccauuucuuugccgcuggaaaccagcugcuuaucaucguggauuccgacgucagugaugccggcaaguauacaugcgagaugagcaauacccuggggacugaaagaggaaacgugaggcuaucggucauuccuacgccaacaugcgacuccccgcagaugaccgcacccucucucgaugacgaugguugggcuacugugggcguugugauaaucgccguagucuguugcgugguugggaccagccuggugugggucgugauuaucuaccacacacgucggcgaaaugaggacuguucaauuaccaacacugacgagacaaacuugccugcggauaucccaaguuaucuguccucucaaggaacguuagccgacagacaggauggcuacguaagcuccgaaucagguagccaccaucaguucgugaccaguucuggggcuggcuuuuuccucccccaacacgacuccagcggaacuugccauauagauaauucgucagaggcagacguugaagccgcuacagaucuguuucuuuguccuuuccugggcucuaccgggccaauguauuugaagggaaacgucuacgguagugaccccuuugagacauaucacacuggcugcuccccggauccuaggaccgugcucauggaccacuacgaaccaagcuacaucaaaaagaaagaguguuaucccugcucucauccuagcgaggaauccugugagcgcucauucaguaauauuagcuggcccucucacgugcggaagcugcuaaacacguccuacucacauaaugaagggccaggaaugaaaaaccugugccuuaauaagaguagccucgauuuuuccgccaacccugagcccgcaucugucgcgucgagcaauucauucaugggcaccuuugguaaggcccugagaaggccacacuuggacgcuuauuccaguuucgggcagccgucugauugucagccucgcgccuuuuaccugaaagcacauagcucccccgacuuagacucaggcucugaagaggauggaaaggagcgaacagacuuccaggaagagaaccacaucugcacuuucaaacaaacccucgaaaauuaucggacaccaaacuuucagagcuacgaucuggacacuuga

SEQ ID NO: 58552 - RNA, 1872 nt, Artificial Sequence
  derived and/or modified sequence opt3 from LRIT1__Homo_sapiens__NP_056428
augagaguggcccugggcaugcucuggcuucuggcuuuggcauggcccccucaggccaggggguucugcccaagccaauguuccugcucuuuacacaucaugggagacgguucaaaggcgcggaccgucguuuguaacgauccggacaugacacugcccccugcuaguauuccacccgauacuagccgccuacgacucgagcguacggccauaagaagggugccuggcgaagcauuucggccacuggggcgccuugagcagcugugguugcccuacaaugcccucuccgaacugaacgcucugaugcucagaggauuaaggcggcugcgcgagcuucgauugccuggcaauagacuggcagccuucccaugggcugcccuaagggacgcgccgaaacuccggcugcuugaucugcaggcaaaccguuugucugccguacccgcugaagccgcacgcuuucucgagaaucugaccuucuuagaccugucgucaaaccagcucaugagacuuccucaagagcugaucgugagcugggcucauuuggaaacagguauuuuuccacccgggcaccauccuaggcggguccuaggacugcaggauaauccaugggccugcgacugucgacucuaugaucuggugcaccuucuggacggcugggcgcccaacuuggccuucaucgagacugaacuccgcugcgcaaguccgagaucccuggcuggcguugccuuuucucaguuagagcugaggaagugucaggggccugagcuacaucccggaguggcuagcauucggucccuccuggguggcaccgcccuuuugcgcugcggggcaacaggagucccaggcccugaaaugucauggagaagggccaauggucguccccugaacgggaccgugcaccaagagguaaguagcgauggaacuucuuggacacuccugggccuuccagcuguuucccaccuggacucaggcgauuacaucugucaggcgaaaaauuucuugggggcaagcgaaaccgugauaagucucaucgucacggagcccccuacuucuaccgaacauuccggaagcccaggugcccugugggcucggacaggcgggggaggcgaggccgcagccuauaacaauaaguuaguggcucgacacgugccgcagauucccaaaccugccguccuggcaacugguccaucgguucccucuaccaaggaggaacuaacacucgagcauuuucagauggacgcgcugggggaacuuuccgacggcagagcuggaccuucagaggccaggauggugcgcaguguaaagguggucggcgauaccuaccacagcguguccuugguuuggaaagcaccacaagccaagaacacgacugcuuucucugugcuguaugccgucuuugggcagcacagcaugcggagagugaucguacagcccggaaaaacaaggguuaccauuacuggucuccugccgaagacaaaauacguggcaugcgucugugugcaaggcuuagucccucgcaaggaacagugcgugaucuucucaaccaaugagguuguggacgcugagaacacgcagcagcugauaaacguagucgugauuaguguugccaucgugauugcgcuuccauugacccuccuggucugcuguuccgcccuacaaaagcgaugccggaaauguuuuaauaaggauagcacagaagcuacugugaccuauguaaaccuggagcgucucggguacucugaagacggacuggaggaacuuucaagacauagugugagcgaggcagauagguugcuguccgcccggucuucgguugacuuccaggcuuucggcgucaaaggugggcgcagaaucaaugaguacuuuugcuga

SEQ ID NO: 58553 - RNA, 2040 nt, Artificial Sequence
  derived and/or modified sequence opt3 from LRIT3__Homo_sapiens__NP_940908
augcaccuguucgccugccucuguaucgugcuuagcuuucuggagggcgucgggugcuugugucccucccagugcaccugugacuaccauggaagaaacgaugguucuggcucaagguuaguucugugcaaugacauggauaugaacgaacuaccuacaaaucucccaguggacacuguaaagcugcggauugagaaaacggugauacgccgaaucagugcugaagcauucuauuaccuugucgagcugcaauauuugugggugaccuacaacagcguugccuccauugauccgucuucguuuuauaaucucaagcagcugcacgaacugcgucucgacgggaacucauuagcggcuuuccccugggccagccugcuugauaugccuuugcugagaacacuagaccuccauaauaacaaaaucaccagugugccaaaugaggcacugagguaccuuaagaaccuggccuauuuggaucucuccucuaaucggcugacuacauuacccccugacuuucuggagagcuggacccaccucgucuccacuccaucaggagugcuugaucugagucccagccgcauuaucuugggccuacaggacaacccuugguucugugauugccauauaucuaaaaugaucgaacuguccaagguaguugacccagcuauugugcuccuggacccgcuuaugacauguucagagcccgaaagacugaccgguaucuuguuucagagggcagagcucgagcacugccugaagccuagcgucaugacgagugccacuaaaauuaugucugcuuuaggguccaaugugcugcuacggugugaugccaccggauucccaacaccccaaaucacuuggacccgcagcgacucgucuccugugaacuacacagucauacaggaauccccagaggaaggcguucgauggucaauuaugagucucaccggcaucagcuccaaggaugcgggggacuacaaaugcaaggccaaaaaucuggcaggaaugucugaggcugugguaacggugacuguccuugguauuacaaccacucccaucccgccugauacaagcgaaagaaccggcgaccaccccgagugggaugugcagccagggucaggaaggaguacguccguuagcucugccucaaguuauuuguggagcuccucuuuuucgccuaccagcuccuucucagcaaguacacugucucccccaagcacugcuuccuuuucacucagccccuucucuuccaguaccgugagcucuacaacuacccuguccacaucaaucagugccagcaccacuauggcgaacaagcggucguuucagcuucaucaaggcgguaagcguaaccugaaagucgccaagaauggguccaaauugccuccagcaucuacgagcaagaaagaggaacucgcucuguuagaccagacaaugcugaccgagacuaacgccgcuauugaaaaucuacgcgugguaucagagaccaaggaaaguguuacacucaccuggaacaugauaaauacuacacacaacuccgccgugacgguccuguacucuaaauauggaggcaaggaucuuuugcugcucaaugcagacagcuccaagaaccaggugaccaucgauggccuggagcccgggggacaguacauggccugcgucuguccgaaaggugugccuccacaaaaggaccagugcauuacuuucucaacagagagaguugaaggcgacgauagccaguggaguuuacugcuugugguaaccucuacagcuugugucgugaucuugccccucauaugcuuccugcuauauaaaguuuguaagcugcaaugcaaauccgagccuuuuugggaagacgaucucgcgaaggagacuuacauucaguucgaaacccuguuuccaaggagccagucggugggggagcuuuggacgcggucacaucgagacgauucugagaaguugcuguuauguagucgcuccagcgucgaaucucaggugaccuucaaaagcgagggauccagacccgaauauuacugcuga

SEQ ID NO: 58554 - RNA, 1500 nt, Artificial Sequence
  derived and/or modified sequence opt3 from LRMP__Homo_sapiens__NP_006143
augaacgacgaucccagcauggaggaaaauggcguggagagagucugcccugaaucccugcuccagucuagggaguacucaagucuuccacugccgcggcacaccagcuccacagacgggacuaucacgucuucggaucccggauuggaaauuuuaaacauggccucaugugaccuggaucgcaauagccuaugcaagaaagaggaggacacccgaagugcuuccccuacaauagaagcacaagguacuucuccagcccaugauaacaucgcguuccaggacagcaccuccaaggauaaaacaauucucaaucuggaggcuaaggaagaacccgagaccaucgaggagcacaaaaaggaacaugccucaggcgacaguguugugagcccucuuccaguaacuacagugaagucugucaaccugcgucaguccgagaauaccucagcaaacgaaaaagagguggaggccgaauuuuugagacucagccugggguucaagugugauugguuuacgcuggagaaaaggguuaagcucgaggaacggagucgcgacuuagcugaagagaaucugaaaaaggagauuacuaacugccuuaaguugcuggaaucucuaacaccccucugugaggaugacaaucaggcacaagaaaucaucaaaaagcuggagaaauccauaaaguuccuuagccagugcgccgcuagaguggccucgagggcggaaaugcugggagcaauuaaccaggagucucgggucuccaaagccguggagguaaugauccagcacguugaaaauuugaagcgcauguaugcuaaagagcaugccgaacucgaggagcugaagcaaguguuacugcagaacgaacgaucauuuaauccucucgaggacgaugacgauugucagauuaagaaaagaagugcaagccuuaacuccaagccaucuagccugaggcgggucaccaucgcuucauugccgcguaacauaggcaaugccgguaugguggcggggauggaaaacaaugaccgcuucaguagaagguccagcucuuggcggauucuaggaucaaaacagagugagcaccgacccagccugccucgcuuuaucuccacuuacucuugggccgaugcagaagaggagaagugcgaacucaaaaccaaggacgauucggagccaagcggcgaagagacaguggaaagaaccaggaagcccucccugucagagaaaaagaacaauccuaguaaaugggacgucucuagcguuuaugauacgauugcuuccugggccacuaaccuuaagucaagcauccggaaagcuaauaaggcccugugguugucuaucgcauucauugugcucuuugccgcucugauguccuucuuaacaggccaacuguuucagaagaguguagacgcggcaccaacccagcaagaggauagcuggacuucucuagaacacauacucuggcccuucacacgccugagacauaacgggccgccucccguguga

SEQ ID NO: 58555 - RNA, 2142 nt, Artificial Sequence
  derived and/or modified sequence opt3 from LRP10__Homo_sapiens__NP_054764
augcugcucgccacccuucuguuguuacugcuaggcggggcucucgcacaccccgacagaaucauuuucccuaaccaugccugcgaggauccaccggcggugcugcuugaaguccagggaacacugcaaaggcccuugguucgggacagccgcacuuccccugcuaauuguacguggcucauacuggguucuaaggagcagaccgugacaauccgauuucagaaacugcaccucgccugcggcucagaacguuuaacucugagaaguccacuucagcccuugauuagccugugugaggcaccuccaucuccccuacaacucccugggggaaacguaaccaucacauacuccuaugccggcgcuagggcaccaaugggucagggguuccugcuuucguacucacaggauuggcugaugugcuugcaggaagaguuucaaugucucaaucaucggugcgugagcgccguccagcgcugugacggaguggaugcuugcggcgacggcagugaugaggccggguguuccucugacccguuccccggacugaccccuagaccaguucccagcuuaccuugcaacgugacucuggaagauuuuuauggugucuucuccucaccaggcuacacacaccucgcgagugugagccauccccagucuugucacuggcuucuggacccgcacgaugggaggcgguuggcaguacgcuuuaccgcccuagaccugggauucggcgaugcuguucauguguaugacgguccugggcccccagaguccucacgacuccugagaagccuuacgcacuuuaguaauggaaaggccgucacuguggaaacccugucuggccaggcaguggucuccuaccauacaguugcuuggagcaacggcaggggguucaaugccacuuaucacgugcggggauacugcuugccuugggaccgucccugcggucucggcucggggcugggagcgggcgaggguuuaggggagcgcuguuacucugaagcccaaagaugcgauggcuccugggacugugcagauggaaccgacgaggaagauugcccaggcugucccccugggcacuuuccaugcggagcugccgguacaucaggcgcuaccgccuguuaucugccggcagacaggugcaacuaccagacguucugugccgauggggcugacgagcggcgaugccgccauugucagcccggaaauuuuagaugcagggaugaaaaaugcguauaugagacuugggugugugacggccaaccugauugcgcggacgguagugacgagugggauuguagcuacguccuaccacggaaggugauuacagcagccguuaucgggucccucgugugcggccugcuuuuggucauagcucugggauguaccugcaaacucuaugccauccgcacucaggaauacucuauuuucgcaccccugagcagaauggaggccgaaaucgugcagcagcaagcuccuccaucauauggccagcuuauugcccagggggcaauacccccgguagaggacuucccuacagaaaacccaaaugauaacaguguucugggaaauuugaggucccuccugcagaucuuacgucaagacaugacccccgguggcgggccuggagcgcggcgaagacagaggggccgccugaugcggaggcuagugagacgccuccgacgguggggucugcuuccccguacgaacaccccagcuagagccagcgaggcaaggucucaggucacaccuucagccgcucccuuggaggcccuggaugggggcacuggaccagcacgcgaaggcggggcugugggaggccaggacggugagcaagccccgccucuccccauuaaggcgccacugcccagugccagcaccuccccugcuccaacaacuguccccgaagcaccugggccguuaccaucucugccccuugagccuucguugcucagcggagugguucaggcccugcggggcagacuacugccaucccucggucccccuggcccgaccaggucacccccagggccucacacagcugugcuggcccuugaagaugaggacgauguauugcugguccccuuagcagagccaggaguguggguugcggaagccgaggacgaaccucuccugaccuga

SEQ ID NO: 58556 - RNA, 2523 nt, Artificial Sequence
  derived and/or modified sequence opt3 from LRP12__Homo_sapiens__NP_001129175
auggccugcagauggagcaccaaggagucccccagguggcggucugcucugcuccuucuguucuuggcaggcguguacgccuguggggaaacaccugagcagauccgcgcgccaucaggaauuauaacuagcccggguuggcccagcgaauauccugcuaaaaucaacugcuccugguuuauucgagccaauccaggcgagaucauuacgaucucuuuccaagacuuugauauacaggggucgcguagauguaacuuagacuggcugaccaucgaaacauacaagaauauugagucauauagggcaugcggaagcacuauucccccuccauacaucaguucccaggaucacaucuggauacgguuccauucugacgauaacauuagccgcaaaggcuuuagacuagccuauuucuccgguaagucagaggaacccaauugugcuugcgaccaguuuaggugugggaacggaaaaugcaucccugaggcauggaaguguaauaacauggaugaaugcggcgacaguagcgaugaggagauuugugccaaggaagcuaauccaccgaccgccgcggcauuccaacccugcgccuacaaccaguuucagugccucucucgguucacaaaagucuauaccugucugccugagucccuuaagugcgacggcaauaucgauugucuggacuugggggaugaaaucgacugcgacguuccaacuuguggacaguggcucaaauacuuuuacgguacauucaacucacccaauuauccugauuuuuacccacccggcagcaacugcaccuggcugauugacacgggggaucaccgcaaggugauacugcgauucacugacuucaaacucgauggaaccggcuauggugacuacguaaagaucuaugauggguuagaggaaaauccgcauaagcugcuuagaguguugacagcuuuugacagucacgccccucugacugucgugucuuccagcggacaaauuaggguucauuucugugcagauaaagugaacgcugcccggggcuuuaacgcgaccuaccaggucgacggcuucugccuacccugggagaucccaugugggggaaauugggguugcuauacagagcagcagcguugugauggcuacuggcacugcccuaacgggcgcgacgaaaccaauugcacgaugugucaaaaggaggaauuucccugcucgagaaacggaguguguuacccaaggucugaccggugcaauuaucagaaccacugucccaauggcuccgaugagaaaaacugcuucuuuugucagccugguaauuuccauugcaagaacaaucgauguguauuugaaucauggguuugcgacagucaagaugacuguggggauggcagcgacgaggagaacugcccagugauagucccgacucgcgugauuacagccgcagugaucggaucccucaucugcggccugcuucuggucauugcuuugggguguaccugcaaacucuacucucugagaauguucgaaaggcggagcuuugagacucaguuaucacgcguugaagccgagcugcucagaagggaagcucccccuaguuauggacagcuuaucgcccagggucugauuccacccguggaggauuucccuguauguuccccaaaucaagcaagcguguuggagaaccuacgucuggccguccggucucagcucggcuuuacaucagugcgacugcccauggcugggagaaguagcaauauauggaacaggaucuucaacuucgcgcgcucccggcacucuggaucgcuugcacugguuagcgccgacggcgaugaaguggucccgucccagucaaccaguagagagccugaaaggaaucauacgcaccgcucuuuguuuagcguggaguccgacgauaccgacacagagaacgaacgacgggauauggcuggugccucagggggcguagcagccccacucccccagaagguuccucccacuaccgcuguggaggccacagucggagcaugcgcgaguucuuccacucaaaguacccguggcgggcacgcugacaauggaagagacgugacaagcgucgaaccaccuucugugucccccgccaggcaucagcugaccucagcauuaagucgcaugacucagggucugcgguggguuagauucacgcuaggcaggagcucgucccucucucagaaccaaagcccacugcgacagcuugauaauggggugucaggacgcgaggacgaugacgauguagaaauguugauuccgaucagugacggcuccucugauuuugacgucaacgauuguagccggccucugcucgaccuggccuccgaucagggucaggggcuuagacaacccuacaaugcuacaaacccaggcgugaggcccucaaaucgugacggaccuugcgagcgcuguggcaucguucacaccgcccagauuccagauacuugccuggaggugaccuugaaaaacgaaacaagcgacgacgaggcacuccuguuauguuga

SEQ ID NO: 58557 - RNA, 13800 nt, Artificial Sequence
  derived and/or modified sequence opt3 from LRP1B__Homo_sapiens__NP_061027
augagcgaguuccugcucgcccuucugaccuuguccggcuuacugcccaucgcuagagugcugacagucggggcagacagggaucagcaacucugcgacccuggggaauuucugugccacgaucauguuacuugcgugucucagucauggcuuugugacggugauccagacugcccggaugacagugaugaaagccuggacacgugucccgaagaaguagaaauuaagugcccuuugaaccacauagccugucucggcaccaauaaaugcgugcaucugucccagcuguguaacgggguccucgauugcccagacggauacgaugaaggcgugcacugucaggaauuacugucuaauugccaacagcuuaacugccaguacaaguguacaaugguuagaaauucgacucgcugcuacugugaagacgguuucgagaucaccgaagacgggcgaucaugcaaagaucaggacgagugugcgguguauggaacaugcagccaaaccugucguaacacucauggcaguuacacaugcuccugugucgagggcuauuugaugcagcccgauaauagaucuugcaaggcuaaaauugaaccuaccgacaggccacccauccugcuaauugccaacuuugagacgaucgaaguguucuaccucaaugggagcaagauggcaacucuguccucaguaaacggaaaugagauacacacccuugauuuuaucuauaacgaagacaugauuuguuggaucgagagucgggagagcucuaaucagcugaagugcauucagaucacaaaagccgguggcuugacugaugaauggaccauaaacauucuccaauccuuccacaauguucagcagauggcuaucgacuggcugacacgcaacuuauacuuuguggaucaugucggggacagaauuuucgugugcaacucaaauggaagcgugugugucacccugaucgaucucgagcuucacaacccuaaggcaaucgccguugacccaauugcuggcaaacuguuuuucacggacuacgguaauguggccaagguagaaaggugcgauauggacgggaugaaccggacucgcauaaucgauaguaaaacagagcaaccggcggcauuggcccuagaccuggugaauaagcucgucuauuggguggaucuguaccuugacuauguuggaguggucgauuaccagggcaagaaccgacauaccgugauucagggcagacagguaaggcaccuguaugggaucacuguuuuugaagacuacuuguaugcuacaaauucugauaacuacaauauagugcggauuaaccguuucaauggaaccgacauccacucccucaucaaaauugagaacgccugggguauccgcauuuaccaaaagagaacgcagcccaccgucaggagccaugcaugugagguggauccuuauggcaugccagggggaugcucgcacauaugucuguuaucuuccucauacaaaacacggacuugccgaugucgcaccggcuuuaaucuggguagugacgggagaagcugcaagaggcccaaaaacgaacuauuccucuucuauggcaagggacggccuggcaucguccgcgggauggaucugaauacaaaaauugcugacgaguacaugaucccaaucgaaaaccuugugaaccccagagccuuggacuuucaugcggagacuaauuauauuuacuucgccgauaccacauccuuucugauaggaaggcagaagaucgacgguaccgaacgugagacuauucucaaggaugaccuggauaacguugagggcaucgcaguggacuggauugggaauaaccuuuauuggacgaaugauggacaccggaaaacaaucaacguagcucgacuggaaaaggccucucagagcagaaaaaccuugcucgagggcgaaaugucacauccgagggguauagucguggacccuguuaauggguggauguacuggacugauugggaggaggacgaaaucgaugacagugugggccgcauugagaaggcuuggauggauggauucaaccggcaaaucuuugucaccuccaaaaugcuguggcccaauggcuuaacacuggacuuccacaccaacacucuauacuggugugacgccuauuacgaucacauugaaaagguguuucucaaugggacacauagaaagaucguauauagcggaagggagcugaaccacccauucggucuuucucaucacggcaauuacguguuuuggacggacuauaugaacgggucaauauuccaguuggaucugauuaccagugaaguuacucuccugcgccacgagcgaccucccuuauuuggacugcagaucuacgacccacggaaacagcaaggcgauaauaugugccgugucaacaacgguggguguagcacacuuugcuuggcaauucccggcggaagagugugcgccugugcugacaaucagcuccuggaugagaacggcaccacaugcacuuucaauccuggggaagcgcuaccacauaucuguaaggcaggagaguuuaggugcaaaaaccgccacuguauacaggcccgguggaagugcgacggcgaugacgauugucuggacgguuccgacgaagauucugugaauugcuucaaccauucguguccggacgaucaguucaaaugccaaaauaacagauguauccccaagagguggcucugcgacggggcuaaugauugcggaagcaacgaggacgaauccaaucagaccuguacggcccgaaccugccaggucgaucaauuuucauguggcaacggucgcugcauuccucgggcauggcugugugacagagaggaugacugcggcgaucagacagacgagauggccaguugugaguucccaacuugcgagccccuuacccaguuuguuuguaagucugggaggugcaucagcuccaaauggcacugugauucagacgacgauugcggagacggcagcgaugaaguggggugcgugcauucuuguuucgacaaucaguuucguugcuccaguggacgcuguauuccuggccacugggcuugcgauggugacaacgauuguggggacuucagcgaugaggcccaaaucaauugcacaaaggaagagauacacucuccagcaggauguaacggcaacgaguuucagugccaucccgacgguaauuguguaccggauuuguggcggugcgacggcgaaaaagauugugaggacggguccgacgaaaagggaugcaacggcacuauuagacugugcgaucacaaaaccaaguucucauguuggaguacggggaggugcaucaauaaggcgugggucugugacggagauaucgacugcgaggaucagagcgacgaggaugacugugauucguuuuuaugcggcccuccaaaacaucccugugcuaacgacacauccgugugccuccagccugaaaagcuguguaaugguaaaaaggauugccccgacgggucugacgagggauaucuuugugaugaaugcagccugaacaauggcgguuguucaaaccacugcaguguugugccaggccgagggauugucugcuccuguccugagggauugcaacucaauaaagacaacaagaccugcgaaaucguggauuacuguucuaaucaucugaaaugcagccagguuugugagcagcacaagcacacugugaagugcuccuguuacgagggcuggaaacuagacguagauggggaaucaugcacaagcgucgaccccuucgaggccuuuauuauauucaguauccggcaugaaauucgcagaaucgaucugcacaagagggacuauucucuccuggugccaggacuucggaacaccauugcauuggauuuucauuucaaucagucccuguuauacuggacugacguggucgaggaucgaaucuauagaggcaaacucagcgaaucgggugggguuucagccauagaggugguaguggagcacggacuggcuaccccggaaggccuuacagucgacuggaucgccggcaacauuuacuggaucgauucuaaucuggaccaaauugagguggcaaagcuagacgggagucuccgcacgacccugaucgcuggagccauggaacacccuagggcgauagccuuggauccccguuaugguauucuguucuggacugacugggaugcuaacuuuccacggaucgaguccgcaagcaugucuggcgccgggagaaaaacaaucuacaaggacaugaagaccggagcuuggcccaauggcuuaacaguugaucauuucgagaagaggauuguguggacugacgcccgcagcgaugcaauauauuccgcgcucuacgacgguaccaacaugaucgagauuauccgagggcacgaguaccugucacauccuuuugccgucagucuuuauggaagcgaaguguacuggacggauuggagaacaaacacccugucuaaggcuaauaaauggacuggccagaacguuuccgugauucagaagaccucagcccaaccauucgacuugcagaucuaucaccccagucggcagccucaggcaccgaauccaugugcugccaacgauggcaaagggcccugcagccauaugugucucauaaaucacaacagguccgcagccugcgcuugcccucaccugaugaagcuaucuucggacaagaaaacauguuacgagaugaagaaauuucugcuuuaugcgcgccguagcgaaaucagaggagucgacauugauaauccauacuucaacuuuaucacugccuucaccguacccgacauugaugacgugacaguuaucgauuuugacgcaucagaggagcggcucuauuggacggauauaaagacccaaacuauuaaaagggcuuucaucaaugguacaggccuggaaaccgugaucucccgcgacauucagaguauccgaggguuggccgucgauugggugucuagaaaccuguacuggauaagcuccgaguuugacgaaacucagauuaauguagcccgguuagauggaucacucaagacaucuaucauucauggcaucgacaagccucagugccuggcugcacacccggugagggguaaacuuuacuggaccgaugggaacacgauaaauauggccaacauggacggaagcaauaguaagauucuguuccaaaaccagaaagagcccgucggcuuguccaucgacuauguugaaaacaagcucuacuggaucagcucuggcaaugggacuauuaaccgcuguaaucuggauggagguaaccuagaggugaucgagucaaugaaagaagaacugaccaaggcgacagcucuuaccauuauggacaaaaagcucuggugggccgaucagaaucuggcacaguugggcacuugcuccaagagagacgggaggaacccaacaauauuacggaauaaaaccaguggagugguccauaugaagguguaugauaaagaagcccaacagggcagcaacucgugucagcugaauaacggugggugcucucagcucugucugccuacauccgagacuacccguacgugcauguguacaguuggauacuaucuucaaaagaaucgcaugagcugccagggcaucgaaucauuccugauguacaguguacacgagggcauucgagggauccccuuggagccaucugacaaaauggaugcucuaaugccuaucuccggaaccagcuuugcaguggguauugacuuccacgccgaaaacgauacuauauauuggaccgacaugggcuuuaauaagaucucaagagcgaagagggaucagacauggaaagaggacauuaucacuaacgggcugggacgggucgaaggcauugcuguggauuggaucgccgguaauauauacuggaccgaccauggguucaaccucaucgagguugcacgccugaacggaaguuuuagauacgugauuaucagccaaggccuugaccagcccagguccauugccguccacccagaaaagggcuuacuguucuggacggagugggggcagaugccguguaucggaaaagcucggcucgaugguucugagaaggugguauuggucagcaugggcauagccuggccuaaugggauuuccaucgacuaugaagagaacaaacuguacuggugcgaugcacgaacagacaagauugaaagaaucgaucucgagaccggaggcaaucgcgagauggugcugucagguucuaacguugacauguuuaguguggcugucuucggggccuauauauacuggucggauagggcgcaugccaauggcagcgugcggcguggacacaagaacgacgcaacugaaacaaucaccaugagaacuggccuugggguuaaucugaaagaggugaagauuuuuaacaggguccgcgaaaaaggaacaaaugugugcgcucgggauaacgguggcuguaagcaguugugccuauaucgaggaaauuccagaaggaccugugccugcgcucauggauaccuggcagaggacggcguaacgugucuccgccacgaagguuauuuacuguacucugggcggacuauccuuaaaucaauucaccugagcgaugagaccaaccucaauucccccaucagaccauacgagaacccccguuauuucaagaaugugauagccuuggccuuugacuacaaccaaaggcggaagggcacaaaccgcauuuucuauagugacgcucauuuuggaaauauccagcugaucaaagauaacugggaagaccgacagguuauugucgagaaugugggcucuguggaagggcucgcguaccacagagcaugggauacccuguauuggacaagcucaacuaccuccaguaucacgaggcauacagucgaccagacucggccuggagccuucgaucgcgaggcuguaauaaccaugagcgaagacgaucacccacacgugcuugcccuagacgagugccaaaaccugauguucuggacaaauuggaacgagcagcaucccucuauuaugagauccaccuugacugguaagaaugcacagguuguggucucaaccgauaucuuaacaccuaacggccugacgauugacuacagggccgaaaaacucuauuuuagcgaugggucgcugggaaagaucgagcgaugugaauacgacggcucucagcggcacgugauaguuaaaagugguccggggacuuuccuuucccuggcuguguacgauaauuauaucuuuuggagcgacuggggccguagagcgauucuccgcucaaacaaguacaccggaggcgacacaaagaucuugagguccgauauuccacaucaacccauggggaucauugccgucgcaaaugacaccaacucuugcgagcugagcccuugugcucuacugaauggaggcugccacgaucucugucuucugacucccaacggucgggugaauugcaguugcagaggggaccgcaucuuauuggaagauaacagguguguaacuaaaaacuccagcugcaaugccuauucugaguucgaguguggaaacggcgaaugcauagacuaccagcugaccugugaugguauuccacauugcaaggacaaaucagaugagaagcuccuguauugugaaaaucgaaguugccggagaggcuuuaaaccuuguuacaacaggcgcugcaucccccacgggaaacuuugugacggagagaaugauugcggcgacaacuccgaugagcuggacugcaaagugagcacgugugcaacuguugaguuccguugcgccgacgggacauguaucccacggucugcuagaugcaaucagaacauugauugugccgacgcgucggaugagaagaauugcaacaauaccgacuguacccacuuuuauaagcucggagucaaaacuacaggcuucauaaggugcaacucaaccagcuugugugugcugccuacauggaucugcgaugguuccaaugacuguggggauuacagugacgaauuaaagugcccggugcaaaacaaacauaagugcgaggaaaauuacuuuucuugucccagcggacgcugcauucuaaacacuuggaucugugauggccagaaagacugcgaggauggucgagacgaguuccacugugacuccucaugcaguuggaaccaguuugcauguucugcccagaagugcauuagcaagcauuggaucugugauggcgaagacgauugcggggacggacuggaugaguccgacucaauauguggcgcuaucacgugcgccgcugauauguucagcugccaagggucucgggcaugugucccaagacacuggcucugcgacggagaaagggauuguccugacggcuccgaugagcuuaguaccgccgguugcgcucccaauaacacaugugacgaaaaugccuuuaugugccauaacaaaguuuguauuccaaagcaguucgugugcgaucacgacgacgauuguggggacggaagcgaugagucgccucagugcggcuaucgccaguguggcacugaggaguucuccugcgcagacgggagaugccuguugaauacccaauggcagugugauggagacuuugauugccccgaccacucugaugaggcgccgcugaacccaaaauguaagucagccgaacagagcugcaauaguuccuucuuuauguguaaaaacggucggugcaucccuucuggcgggcucugugacaauaaggaugacugcggagauggcagcgacgagaggaacugucauauuaaugaaugccugucaaagaaaguauccgguuguagucaggacugccaagaucuucccgugagcuacaagugcaaauguuggccaggguuccagcucaaggacgauggaaaaacaugcgucgacaucgaugaguguucuucaggcuuucccugcucccagcaguguauaaacaccuauggcacuuacaagugccuguguacggacggguaugagauucaaccugauaauccgaacggaugcaagagcuugucugacgaagaacccuuccugaucuuagcugaucaccaugaaauccguaaaauuaguaccgacgguucgaauuacacacuacugaagcagggccucaacaacgugauagccaucgauuuugacuaucgagaggaguucauuuacuggaucgacuccagccgcccaaaugggucaagaauuaaccggaugugucuuaauggaucugauaucaaaguugugcacaacacugcagucccuaaugcucuggccguagacuggauaggcaagaacuuguacuggagcgauaccgagaaaaggaucauugagguguccaagcugaauggucucuaucccacaauccugguuaguaaacgccuuaaguuuccuagagacuuaucacuggauccacaggcaggguaccucuauuggauugacugcugugaauacccccacaucggacgggugggcauggauggcaccaaccaaucugucgugauugagacuaagauaagcaggccuauggccuugacaaucgacuaugucaaucgacgucuguacugggcugaugaaaaccauauugaguucuccaauauggacgggagucacagacauaaagugccaaaccaggauauccccggaguuaucgcgcuaacgcuguuugaggacuauauuuacuggaccgaugguaagacuaaaagccucucccgcgcccacaagacaucuggcgcagaccggcuuucacugauauacagcuggcaugcuaucaccgacauucagguguaucacucguacaggcagccggauguauccaaacacuugugcaugaucaauaacgggggaugcagucaucugugucuccuggccccuggcaagacccacacaugcgccuguccaacuaauuucuauuuagcagcugacaacagaacgugccuuucuaacuguaccgccagccaauuucgcugcaagacagauaaauguauucccuucugguggaagugcgacacuguggaugacuguggugaugggucagacgaaccugaugacugcccagaguuccggugucagcccggaagguuucagugcggcaccggccugugcgcgcucccggcuuucaucugugauggggaaaaugacugcggagauaacuccgacgagcuaaauugugacacacaugucugccugucuggucaguuuaaauguaccaagaaccaaaaaugcauaccuguuaauuugcgauguaacggccaggaugacugcggggaugaagaggacgagagagauugucccgaaaauaguugcagcccagacuacuuccaguguaagacuacgaagcacugcaucuccaaacugugggugugcgaugaggacccugauugugccgacgcaucagaugaagccaacugcgacaagaaaacauguggaccccacgaguuucagugcaagaauaacaauuguauuccagaccauuggcggugcgauagccaaaacgacuguucugauaauagugacgaagagaacugcaaaccccagaccuguacucucaaggauuuccuuugcgcuaauggcgacugugucuccagcagguuuuggugcgauggugacuucgauugugcagacgggucagaugagcgcaacugcgaaaccucuugcuccaaggaccaguuucguuguucgaauggacaaugcaucccugccaaauggaagugugauggccacgaggacugcaaauauggcgaagacgaaaagagcugugagccagcgaguccgacauguucuuccagagaauacauuugugcuagcgaugggugcaucucagccagucugaaauguaacggagaguaugacugcgcagaugguuccgacgaaauggauugugugacugagugcaaggaagaccaguuccgaugcaaaaacaaggcccauuguauacccauuaggugguugugcgauggcauccacgacuguguagaugggagcgacgaggagaauugcgaacggggaggcaacauuugucgcgcugaugaguuucugugcaauaacucucucuguaaguuacauuucugggugugcgacggugaagacgauuguggggacaauucagaugaggccccugacaugugcguuaaauuucuguguccaagcaccagaccccacaggugccggaacaaucgcaucugccuucaguccgaacagauguguaacggaauagaugagugcggcgacaauucugaugaggaccacuguggcgggaagcugacauacaaagcaagaccuugcaagaaagaugaguucgcuuguaguaacaagaagugcaucccaauggaccuacaaugugaucgacucgacgauugcggagacgguucggacgagcagggcuguaggauugcccccacggaauauaccugcgaggauaaugugaacccuuguggggacgaugcguauugcaaucagaucaaaacuagcgucuucugccgguguaagccgggauuucagcguaacaugaaaaaucgccaaugcgaagaccugaacgaguguuugguguucggcacaugcucccaucaguguauuaacgucgaggguucauacaagugcgugugugaucagaauuuucaggaaagaaacaauaccugcaucgccgaggggucugaagaccaaguucuguauauagcaaacgauacugacauucucggcuucaucuacccauuuaauuauagcggagaucaccagcagaucagucauauugagcacaacuccaggaucacaggcauggacguauacuaucaacgggauaugauaauuuggucaacccaguucaaucccgggggaaucuuuuacaaacggauucauggucgcgagaagcgacaggcuaacucuggccuuaucuguccugaguucaagaggccccgggacauagccguggauugggucgcagggaauaucuacuggacggaccacagcagaaugcacugguuuuccuauuacaccacacauuggacaagucugcguuauagcauuaacgugggacaguuaaauggcccaaacugcacccgccuguugacaaauauggcuggugagccuuacgccaucgccguuaaccccaaaagggggaugauguauuggacuguggucggcgaccacucucauauugaagaggcggcuauggauggaacccuccggagaauccuggugcaaaagaaucuacagcgaccaacaggccuugcaguagacuacuucucagaaaggauuuacugggccgauuuugagcuguccaucauagggagcgugcucuaugacggaaguaacucuguugucuccgugucgagcaaacagggucuguugcacccgcaccgcaucgauauuuucgaggacuacaucuauggcgcugggccuaagaacggaguguuucggguccagaaauucggccaugguucaguugaauaccuggcccucaauauugauaagaccaagggcgugcuuauaucccacagauauaaacaacuggacuuacccaacccaugucuggauuuggcaugcgaguuccucugccugcuaaaucccucuggggccacuuguguaugcccugaaggaaaguaccuuaucaacggcacguguaaugacgauagucugcucgacgacagcugcaaacugacaugugagaacgggggaaggugcauuuugaaugaaaagggcgauuuacgcugucauugcuggccaucauauuccggugagcguugugaggugaaccacugcagcaauuacugucagaacgggggaaccugcguccccucugugcugggccggccuacuugcaguugugcucucgguuuuaccggcccgaauugcgggaaaacaguuugugaagacuucugccagaacggaggcacguguaucgugaccgcggggaaucagccauacugccauugucaacccgaguauacuggagauagaugccaguacuaugucugucaccacuacugcgugaacuccgaaagcuguacaauuggcgacgaugguucaguagagugcguuugcccuacccgauaugaagggccaaagugugagguggacaagugcgucaggugucauggaggccacugcaucauaaauaaagauucugaggacaucuuuuguaacugcacuaacgguaagauugccucgagcugucagcuuugcgauggcuacuguuauaaugggggaacaugccagcuggaccccgaaaccaacgugccugugugucuaugcuccacaaauuggaguggcacucaaugcgagcgccccgcaccaaaaucuucaaagagcgaucauaucuccacccggaguauugcuaucauagucccgcugguucucuuggugacgcugauuaccacacuuguaaucgggcuggugcucuguaaaagaaagaggcgcacuaaaaccaucagacggcagccuauuauaaacggaggcaucaaugucgaaauugguaaccccucuuacaauauguacgagguggaccacgaucacaacgacgggggauuacuggacccaggcuucaugaucgauccuacaaaggcccgauauauuggcgggggacccagcgcauuuaaguugccacauacugccccucccaucuaccuaaauuccgaccucaaagguccgcuuaccgcuggcccaacgaacuauucaaauccuguuuacgccaagcuguauauggaugggcagaacugcaggaauagccuaggaucuguggacgagcguaaagaacugcuccccaagaaaauagagaucggcauuagagaaacagucgcguga

SEQ ID NO: 58558 - RNA, 13635 nt, Artificial Sequence
  derived and/or modified sequence opt3 from LRP1__Homo_sapiens__NP_002323
augcugacucccccucuccuucuguuguuaccacugcuaagcgcccucguggcugcagccaucgacgcgccgaagaccugcucccccaagcaguucgcuugucgcgaucaaauuaccugcauuucuaagggcuggaggugugacggggaacgggauugcccugacggcucagaugaagccccagaaaucuguccccagaguaaagcacagcgcugccagccuaaugaacacaauugucuggguacggagcuuugcgucccaaugagccgacuguguaacggcguucaagacugcauggauggguccgacgaaggaccccauugucgugaguugcagggcaauugcucucgccucgguugccagcaccauugugugccuacccuggaugggccaacgugcuacuguaacucgucauuucagcugcaagccgacggaaagacuugcaaagauuucgacgaguguagcguauauggcacauguagucagcucuguacaaauaccgauggcuccuuuauuugcggguguguggaaggauacuuacugcagccggacaacaggucuugcaaggcuaagaaugagcccgucgaccggccuccagugcuuuugaucgcaaacagccagaauauucuggccacuuaucuauccggugcucaaguuucaacaaucacccccacgaguacucgccagaccacagccauggauuucagcuacgcgaacgaaacuguguguuggguccacgugggcgacucugcagcccagacccaacucaaaugcgcuagaaugccugggcugaagggauuuguagaugagcauacaauaaauaucucccuuucacugcaccacguugagcagauggccauugacugguugaccggcaacuucuauuuuguggaugacaucgaugacaggauuuucgucugcaaucggaacggugauacgugugugacucuccuggacuuagaacuguacaauccaaaagggaucgcacucgaucccgcuaugggaaagguguuuuucacagacuauggccagauaccgaaagucgagcgcugcgacauggauggccagaaccgaaccaaacuuguugacagcaagauuguguuuccucaugggaucacucuggauuugguaaguaggcuuguguacugggccgacgcguaccuggauuauauugaagucguggacuacgagggaaaagguaggcaaacaaucauccagggcauucucauagaacaccuguaugggcuuaccguuuucgagaacuaccuguaugccacaaauucugauaacgcaaaugcucagcagaagaccuccgugauccgggucaaccguuuuaauagcacagaguaccaagugguaacucgcguugacaaaggaggcgccuugcauauuuaucaccagagaaggcagccccgggugcgaucgcacgcuugugaaaacgaucaguacgguaagccagggggcugcucugacaucugucuccuggccaauucccauaaagcaagaaccugcagauguaggucaggauucaguuuaggcagcgaugggaaguccugcaaaaagccugagcacgaacuguuccuagucuacggaaagggucggcccggcauaauucgcgggauggacaugggagccaaagugccagaugagcauaugauccccaucgaaaaccucaugaauccuagagcucuggacuuucacgcggagacaggcuucauuuauuuugcagacacuaccucuuaccuuaucgguaggcaaaagauugaugggacagagcgugaaaccauauugaaagacggcauccauaacgucgagggaguggccguugauuggaugggcgacaaucuguauuggacugaugacgggccaaagaaaacgauuagcguggcucggcucgaaaaggccgcacagacacgaaagacccugaucgagggaaaaaugacucacccgagagccaucguagucgauccccuuaacgguuggauguacuggaccgacugggaagaggauccuaaggacucaaggcgcggccggcuggagagagcuuggauggaugggagucacagggacauuuucgugacauccaaaaccguuuuguggccaaauggacucagccuggauauacccgccggccgcuuauauuggguggacgcauuuuacgaccgaaucgaaacuauucugcuaaacgguacagaucggaagaucgucuaugaggggccugaacucaaucaugcguucggccugugucaccauggaaacuaccuauuuuggacggaguaccguucuggcucaguguauagauuggagagagggguaggaggcgcuccacccaccgugacucugcuccgcagugaacggccgccuauuuucgagaucagaauguacgacgcccagcagcaacagguugguacaaacaaaugcagggucaauaacgggggauguagcucccugugcuuagcaaccccaggcucucgacagugcgccugugcugaagaucaagugcuggacgccgauggugugacaugccuugcaaaucccucguaugucccucccccacagugucagccuggcgaguuugcuugcgccaacagccgcuguauacaggaacgguggaagugcgacggggauaaugacuguuuggauaacuccgacgaggcgcccgcccucugccaccaacacacuuguccaucagauagauucaagugcgagaauaacagguguaucccgaaucguuggcugugcgacggagacaacgauugcggcaauagugaagacgagucuaacgcuaccuguagcgcacgcacgugcccucccaaucaguuuuccugugccucagggcggugcauuccaaucagcuggaccugugaucuagacgaugacugcggagauagaucugacgaauccgcuaguugugccuaccccacaugcuucccucugacucaguuuaccuguaacaauggaaggugcauuaacaucaacuggcgaugugauaaugacaacgauugcggugacaauagcgaugaggcagggugcucucauuccuguucaaguacacaguucaaaugcaacagcggacgguguauaccagaacacuggacuugcgacggcgacaaugauuguggugacuauucggaugagacccaugcgaacugcacgaaucaagccacaagacccccuggcgggugucacaccgacgaguuccagugcagacucgauggacuguguauuccgcuuagguggcggugcgacggcgauacugacuguauggauuccucugacgaaaagagcugcgaggggguuacacaugugugcgauccaucagugaaauuuggauguaaggacagugcucgaugcaucuccaaagccuggguaugugauggcgacaacgacugcgaagauaauucugacgaggaaaacugugagagcuuggcaugcagacccccuucccacccaugugcuaauaacaccucagucugccugcccccugauaaguuaugugacgguaaugaugacugcggggauggaagcgacgagggcgaacucugugaucagugcagucugaacaaugguggcuguucucacaacugcuccguggccccgggggagggaauuguuugcagcuguccccuuggcauggaacuggggccagacaaccauacuugccagauccaaucguacugugcaaagcacuugaaaugcucacagaagugugaucagaauaaauucucugugaagugcaguuguuaugagggauggguccucgagccugacggcgaauccugccgcagccuggaccccuuuaaaccauucauaaucuuuucuaacaggcaugagauucgucggaucgaucuacacaagggugacuacagcgugcugguuccugggcucagaaauaccauugcccuggauuuccaucuuucccaaucagcuuuguacuggacagacgugguagaagauaaaaucuauaggggaaagcuguuagacaacggcgcgcucacgaguuuugaggucgugauacaguacggccuggccacccccgaagggcuugcaguggauuggauugcuggaaauaucuauugggucgagagcaaccuggaccagaucgagguugccaagcuagaugguacucuccgcacaacccuguuggccggcgacauugaacacccacgagcuaucgcacuggauccgagagacgggauuuuauucuggacagauugggacgccucucucccucggauagaggcggcuuccaugucaggagccggcaggcgcacugugcaccgugaaaccgguagugggggauggcccaauggccugacgguagacuaccuugagaaaagaauccuguggauugaugcacggagcgacgccaucuauuccgcuagguacgauggcucugggcauauggaaguguugcgcggacacgaguuucucucgcauccauucgcagucacacuguaugguggcgagguguacuggaccgacuggcgaacuaacacccuagccaaggcgaauaaauggacagggcacaacguuacugugguccagagaaccaauacacaacccuuugaucuacagguguaccacccuagccggcagccaauggcucccaacccuugugaagccaauggaggccaggguccgugcucacaucuuugucucauuaacuauaauaggacgguuuccugcgcaugcccacaccugaugaaguugcauaaagacaacaccacuuguuacgaguucaagaaguuucuguuauaugcccgccaaauggaaaucagagggguggaucucgacgcucccuacuauaauuacauaaucaguuucacagucccugauauugacaacguaaccgugcuggauuaugacgccagggagcagcggguuuacuggucugacgugcguacucaggcaaucaaacgcgcuuucauuaacggaacaggcgucgaaaccgugguaagcgccgaucuucccaaugcgcacggccuggccguggacugggucucccgaaacuuguuuuggacgucauacgauacuaauaagaaacagaucaacguugcaagacucgacgggucuuucaagaaugcuguggugcaaggacuggagcagccacauggucuagucgugcacccucugaggggcaaacuuuauuggaccgauggggacaacauaagcauggccaauauggauggaaguaaccggacacuccuguuuuccggccagaagggucccguuggguuggcuauugacuucccagagagcaaguuauacuggaucucuucaggaaaucacaccaucaaccgcugcaaucuggauggcuccggccucgaaguaauugacgcaaugagaagucagcuggggaaagccacugcccuugcuauaaugggagauaagcuguggugggcggaccaagugagcgagaaaauggguacauguucgaaggcagauggcucuggguccgucguguugaggaacagcaccacccugguuaugcauaugaaaguguaugacgaaucaauccagcuggaccacaagggaacuaauccuugcagugucaacaauggcgauuguucucagcucugccugccgaccuccgagacgacacggagcuguaugugcaccgccgguuacucacuucgaagugggcaacaggcuugugagggagugggcagcuuuuuacuguauuccguacaugaaggcauuagagggaucccccucgacccaaacgauaagucugacgccuuggucccugugagcggaacuucccuggcaguugguauugauuuccacgccgagaacgacaccaucuacuggguggauaugggccucucaacaauaucucgcgcuaaaagggaccagacuuggcgggaagaugucgugaccaaugggaucggacguguugagggcauugcgguggacuggaucgccgguaacauuuauuggacggaucagggguuugacgucaucgaaguggcaagacugaauggcaguuucagguacguagugauaucgcaaggacuugauaagccccgcgcuauuacaguucacccagagaaaggcuaccuguuuuggaccgagugggggcaguauccucggaucgaacgaagcagauuggacggaacugagagggucgugcuagugaacgucuccaucucuuggcccaaugguauuucaguagacuaccaggauggcaagcuguauuggugcgacgcccgcacagauaaaaucgaacggauagaccucgagaccggggaaaacagagaggugguuuuaagcuccaauaacauggauauguucagugugucugucuuugaggacuucauuuacuggagcgaucguacucaugcaaauggaucaaucaagaggggcuccaaagacaacgccacagauagugugccgcugcggaccgguauugggguucagcuuaaggacaucaagguguucaaucgcgaucgacaaaaaggcacgaacgucugugcuguggccaauggaggcugccagcagcugugccucuauagagggaggggacagcgggcgugugcaugcgcccacgguauguuggcugaagacggcgccagcugucgcgaguacgcuggguaucugcucuacucugaaagaacuauacugaaguccauucaucuuucagacgagaggaaccuaaaugcaccaguacaaccuuuugaagaucccgagcacaugaaaaacgugaucgcccuggcuuucgacuaccgagccggaaccagcccaggcacacccaaccggaucuuuuucucggauauucauuuugguaauauccagcagauuaacgacgaugggucucguagaauaaccaucguugagaaugucggcaguguggaaggauuggcauaucaccgcggcugggacacauuauacuggacuuccuauaccacgagcacaauuacuaggcacaccguggaucaaacacggccuggggcguucgagagagaaaccgucaucacuaugucaggagacgaucauccgcgcgccuuuguucuggacgagugccagaaccucauguucuggaccaauuggaacgagcagcaccccuccaucaugagggcugcccugucuggcgcaaaugugcuuacacugauugaaaaggauauacgaacgccaaacggucucgcuaucgaccaucgggccgagaaauuguacuuuagcgaugcaacucuggacaagauugaaagaugugaguaugacgggagucacagguacguaauccuaaaguccgaaccugugcaccccuucggacuggccgucuauggcgagcauauauuuuggaccgauugggugcgccgugcuguucagcgggcgaauaaacacguggguagcaacaugaagcuccuuagagucgacaucccucaacagccaaugggcauaaucgccguagcaaaugauacaaacucuugcgagcugucacccuguaggauuaauaacgggggaugccaggacuuauguuugcugacccaucagggccacgugaauugcaguugucgcgggggacgaauccuccaagaugaccugacuugccgggcuguuaacuccagcugcagagcccaggaugaguucgagugugccaacggcgaaugcauuaauuuuucucuuacaugugacggugugccucauugcaaagauaagucggacgagaaaccaucauacuguaacagcaggcgcugcaagaagaccuucagacaguguuccaaugggcggugcgucaguaacaugcugugguguaauggagcagaugacugcggcgaugguucugacgaaauccccuguaacaaaacggcuugcggcgugggggaguucaggugccgugacggaacuuguauaggcaauagcucccgaugcaaccaguuugucgauugugaggacgccucagaugaaaugaauugcagugcgacagacuguucuagcuacuuccgccucggggugaagggaguuuuguuucaaccgugcgagagaaccucccuguguuaugcuccuucaugggugugcgauggcgccaacgacuguggugauuacagcgacgaacgggauugcccagggguaaaaaggccccgcuguccuuuaaauuauuucgcaugcccaucuggaagaugcauucccauguccuggaccugugacaaggaggaugacugcgaacacggcgaggacgagacucacuguaacaaauuuugcagugaagcccaguucgagugucagaaucaucggugcaucagcaagcaguggcuaugugauggcucggacgauugcggggacggauccgaugaagcugcacacugugaggguaagacaugcggcccgucuucauuuagcuguccugggacccaugugugcguccccgagagguggcugugcgacggagauaaagacugugccgauggcgcggacgaaaguauugcugccgguugccucuacaacuccacaugugaugaccgagaguucaugugccaaaaucgucaguguaucccaaagcacuuuguuugcgaucaugacagagacugugcagaugggucugacgaaagcccugagugcgaauaucccacuuguggaccaucagaguuccgcugcgccaacggccggugucuuuccaguaggcagugggagugcgauggcgaaaacgacugccacgaucaaagcgacgaggcucccaaaaauccucacuguacgucucaggaacauaagugcaacgccucaucccaguuucuguguagcucugggagaugcguggcagaggcuuugcuguguaauggacaggaugacugcggugauaguucggacgaacgcggcugucacauaaacgagugccucucccggaaacugagcggguguucacaagauugcgaggaccuuaagaucggauucaaguguaggugccgaccaggcuuuagacucaaagaugacggucggaccugcgccgacgucgaugaauguucuacaacuuucccgugcagccagagguguauuaauacccauggguccuacaagugccuguguguggagggauaugcgccccgcggcggcgacccucacaguugcaaagccguaacagaugaagaaccauucuugaucuuugcaaaccguuacuaccugagaaaguuaaaucuagacgggucaaacuauacccugcucaaacagggacuuaauaacgcuguggcccuggauuucgacuaccgagaacagaugauuuauuggacugauguuacgacccaagguucuaugaucaggcggaugcacuugaauggcagcaacgugcagguccugcaucgcacagggcucuccaaucccgacggacuggcaguggauugggucggcgguaaccuuuacuggugugacaaggggagagauacuauagaggugaguaaauuaaauggagcuuauaggaccguucugguaagcuccggccuccgggagccucgcgccuugguggucgacgugcagaacggcuaccuguauuggacagacuggggagaucacucucuaauugggagaaucgguauggacggcucaagccgaucgguuaucguggauaccaagauuacuuggccaaacgggcugacacucgacuacgucacggaaaggaucuacugggccgaugcgcgggaggacuauauagaauuugcuucccuugauggaaguaaucgucaugugguacugucucaggacauuccccacaucuucgcauugacccuguuugaggauuacguguauuggacugacugggagacaaagagcauuaaccgcgcccauaaaaccaccggcacaaauaagacucuccugaucucaacguuacacagaccuauggaucuucacguuuuccaugcucugaggcaaccggacgucccaaaccaccccugcaaagugaauaacgguggguguuccaaucucugccuacugucuccuggaggcggccauaagugugccugccccaccaacuuuuacuuggggagugauggacggacaugcgugagcaauuguacugcaucccaguucgucugcaaaaacgacaaguguauaccauuuugguggaagugcgacaccgaagaugacuguggugaucacucagacgagccucccgauugcccagaguucaaauguagaccgggccaguuucaaugcagcacagggaucuguaccaauccugccuucauuugcgacggagauaacgacugucaggauaauucugacgaggcuaacugcgauauccacguuugccugcccagucaguuuaaguguacuaauacgaaccgcugcauuccaggcaucuuccgauguaacggucaggacaauugcggggauggagaagacgagagggacugucccgaggugacaugcgcgccuaaccaauuccaguguuccauuaccaaacggugcaucccaagaguaugggugugugaucgugacaaugauugcgucgacggcagcgaugaacccgccaacuguacucagaugaccugcggcguggacgaguuucgcugcaaggauucagggagguguauaccugcacgguggaaaugcgacggagaagaugacuguggugauggcucugacgagccgaaggaagagugcgacgagagaacaugugaaccauaucaguuccgaugcaagaauaacagguguguucccgggcgcuggcaaugcgauuacgacaaugauuguggagacaacuccgaugaggaaucgugcacuccucggccauguagcgagagugaauuuucuugcgcuaauggcagauguauugccgguagguggaaaugcgacggggaucaugacugcgcagauggcuccgacgagaaggauuguacaccccgcugcgacauggaucaguuccaguguaaaagcggacacugcaucccucuccguuggcggugugacgccgacgcugauugcauggacggcucagaugaggaagccugugggacaggagugagaacgugcccccuugacgaguuucaguguaacaauacccugugcaagccauuggcguggaaaugugauggugaagacgauugcggcgacaacagugaugagaauccggaggaaugcgcacgauucgucuguccucccaacaggccauuucgcugcaagaaugaccgggugugucuguggaucgggagacaaugcgauggaacugacaacuguggcgacgguacagaugaggaagacugcgagccucccaccgcccauacuacacacuguaaggauaaaaaggaguuccucugcaggaaccagcgcuguuuauccagcucucugagaugcaauauguuugacgauuguggggacggcucagaugaggaggacugcagcauugauccaaaacuuaccuccugcgcuacgaacgccucuauauguggagacgaagcacggugcguacgaaccgagaaggcugccuauugugcuugcaggaguggcuuccauacaguuccugggcagcccggaugucaagauaucaaugaaugccugcguuuugguacuuguucgcagcuaugcaacaauaccaaaggcgggcaccucuguagcugcgccagaaacuucaugaagacacacaauacuuguaaagcagagggauccgaauaccaggugcuguacauugcggacgauaacgagauccggucauuguuuccgggccauccacacucugccuaugagcaggcuuuccaaggugacgaaagcguccgcauugacgccauggaugugcaugugaaggcaggcagggucuacuggaccaauuggcacacagggaccaucaguuaucgaucccugccucccgcugccccacccacuacgucaaacagacaucggcgccagauagacaggggaguuacacaccucaauaucucuggccuuaagaugccuagagggauugcaaucgauuggguggccggaaacguauacuggaccgacagcggccgggaugugauugaggucgcgcagaugaaaggugaaaaucguaagacucugaucuccgggaugauagacgagccgcacgcuauugugguugauccauuacgcggaaccauguauuggagugacuggggcaaccaucccaaaaucgaaacagccgcaauggaugguacgcugagggagaccuuggugcaggacaauauccaauggccuacuggccucgccgucgauuaccacaacgagcgacuguauugggcugacgccaagcuaagcgugauugggucuauaagacuuaauggaacagaucccaucguagcagcugacucaaaacggggccugucccauccauucagcauugacguuuuugaagauuacaucuacggggugaccuauauuaacaacagggucuucaagauccacaaguuuggacacaguccucucgugaaucugacuggcgguuugucucaugccuccgacguugugcuguaccaccagcauaaacagcccgaggucacaaacccaugcgaucgcaagaaaugcgaauggcucugucuucugucgccuagcgggccggugugcaccugucccaauggaaagagauuagacaacggcacaugcguaccagugccuucacccacuccaccucccgaugcgccgcggccagguaccuguaaucugcagugcuucaacggcggguccugcuuuuugaaugcuaggcgccaaccuaaaugccgaugucagcccagauauacgggagacaagugcgagcucgaucaguguugggagcacugccguaacggcgggaccugcgccgcaucuccaaguggaaugcccacaugucggugcccuacuggcuucaccggucccaaguguacacagcaagucugcgccggguacugugcuaauaacagcacuugcaccguuaaucagggaaaccagccacaauguaggugccugccuggcuuucuaggcgaccgcugucaguauagacagugcucaggguacugugaaaauuucggaacgugccagauggcagccgaugguucccggcaauguaggugcacagcguauuuugagggcagccgaugcgaagugaacaaauguucuagaugccuugagggggccugugucgugaauaagcagaguggagacguaaccugcaacuguacugauggccgcguggcuccguccugccugacauguguuggucauugcagcaacgggggaucauguaccaugaacucuaaaaugaugcccgaaugccagugcccaccucacaugacuggcccccggugugaggagcacguguucucgcagcaacagccaggccauauagcaagcauccucauuccucuguuguuacugcuccuucugguccuaguggccgggguugucuuuugguacaagaggcgugugcagggagcuaaagguuuccagcaccaaagaaugaccaacggcgccaugaauguggaaaucgggaaccccacauacaagauguaugagggaggcgaaccggacgacguaggugggcugcucgaugcagacuuugcuuuggauccugacaagccaacgaauuucaccaaccccgucuacgccacucuguauaugggaggccauggcucccgccacagucuugcgucuacagaugagaaaagggaacugcucgggcggggaccugaggacgagauuggugauccauuagccuga

SEQ ID NO: 58559 - RNA, 1044 nt, Artificial Sequence
  derived and/or modified sequence opt3 from LRP2BP__Homo_sapiens__NP_060879
augaagcugaccagcgagaaacuccccaagaacccuuucuacgccuccgugucucaguaugcugccaaaaaucaaaaguuuuuccaguggaaaaaggaaaagacagacuacacucacgcaaaccuugucgauaaagcgcugcaguuguuaaaggagagaauccugaaaggcgacacgcuagcuuauuuucucagggggcagcuguacuucgaagagggaugguaugaagaggcccuugagcaauuugaagagauuaaggaaaaagaucaucaggcaaccuaccagcuggguguuauguauuacgacggcuuggggacaacucucgaugccgagaagggaguggacuacaugaagaaaauacuggauucaccaugcccgaaggcucggcaccugaaauucgcagccgcuuauaaucucggccgcgccuacuaugaggguaaggggguaaaacgaaguaacgaagaggcggaacguuuauggcugaucgcagccgacaauggaaaccccaaggcuagcgugaaagcccaguccaugcuuggcuuguacuauucuaccaaggagccuaaggaacuggagaaagcauuuuacuggcauucggaggcuuguggcaaugggaaccuagaaucacaaggagcccucggucugauguaucuuuacggccaggggauuagacaggauacagaggcggcccugcagugcuugagggaagcagcugagcggggaaaugucuacgcccaaggcaaccucguggaauauuacuauaagaugaaauucuuuaccaaguguguugcuuucagcaaacgcaucgccgacuacgaugaggugcacgacauuccaaugaucgcacaggucacugauugccugcccgaguuuauagguagagggauggccauggcuaguuucuaucaugcgagguguuuacagcugggacucggcaucacacgggacgaaaccacggcaaagcacuacuauuccaaggccugccgccuuaauccugcucuggccgacgaguugcacucucuacugauucgacaaagaaucuga

SEQ ID NO: 58560 - RNA, 13968 nt, Artificial Sequence
  derived and/or modified sequence opt3 from LRP2__Homo_sapiens__NP_004516
auggaccgaggcccagccgcuguggcaugcacccugcuccuugcccuggucgcguguuuggcuccugccagcgggcaggagugcgauuccgcacacuucagguguggaucuggucauugcaucccagccgacuggcggugugauggcacaaaggacugcucagaugacgcugaugaaauugggugugcaguugugacuugccaacagggauacuuuaagugucagagugagggccagugcaucccgaacagcugggugugugaccaagaucaggacugcgaugacgguuccgaugaacgccaggacugcucucagucgacguguucaagccaccaaauaaccugcaguaaugggcaguguauucccuccgaguaucgaugcgaccaugugcgugauuguccugacggagccgaugaaaacgacugccaguacccaacaugugagcaguuaacuugcgauaauggcgcuuguuauaacaccucucaaaagugcgacuggaaagucgauuguagagacagcuccgaugagaucaauugcacagaaauuugccugcacaacgaguucucauguggcaauggggaaugcauccccagggccuacgugugugaccaugauaacgacugccaggacggaagugaugagcacgcguguaauuauccuaccugcgguggcuaccaguuuacuuguccaagcgggcggugcauauaucaaaacuggguuugugacggagaggaugacugcaaggauaauggcgacgaagaugguugugagucugggccccacgacgugcauaaaugcuccccucgcgaauggucaugcccagagagcggaagauguaucaguauuuacaaggucugcgauggcauccuugacuguccgggcagggaagaugagaacaauacaucuaccgggaaguacugcuccaugacgcucuguagcgcacugaacugccaguaucagugucacgagacucccuacggaggugccugcuucuguccuccaggcuauauuaucaaucauaacgacucgcggaccugcguggaauuugaugacugucagauaugggggauuugcgaccaaaaaugcgagucucgccccggacgacaccuuugucacugcgaagagggcuacauccuggaaagaggucaguauuguaaggcuaacgauuccuucggggaggccucaauuaucuuuaguaauggcagggacuugcucaucggagauauucauggccggagcuuccguauacugguagagucccagaaccgcgggguugcagugggagucgcuuuucacuaccaucugcagagaguguucuggacagacacugugcaaaauaaagucuuuucuguugauaucaacggucucaauauucaggaaguguuaaacguaagcguggagaccccugaaaaucuggccgucgacugggugaacaauaagaucuaucuuguugagacaaaagugaacaggauagauauggucaauuuggacggcucauaccgggugacccugauuacggaaaaccuagggcacccacgaggaaucgcgguagaucccacuguuggcuaccucuucuuuagugacugggagucccugagcggugagccgaaacuugaacgcgccuucauggaugggucuaauagaaaggaccuggugaaaacaaaguugggcuggccugcaggagucacccucgauaugaucucaaaaaggguguauugggucgacagucgguucgacuacauugagacugugacauaugauggcauccagcgcaagaccguugugcaugggggaagccugauuccccacccauuugguguauccuuauucgaaggccaggucuuuuucacggacuggaccaaaauggcugugcugaaggccaacaaauuuacagagacuaauccucaaguuuacuaucaggcuucucucagacccuacggggugaccgucuaucacucgcuuaggcagccauacgccacaaaccccugcaaggauaacaauggaggcugugaacaggugugcguacugagccaucguacugacaacgaugguuugggguuccgguguaagugcaccuuuggcuuccaacuagacacagaugaacgacacuguauagcagugcagaauuuucugaucuucuccucacagguugccauuagaggaaucccuuuuacccucaguacucaagaggacgucauggugccagugucuggcaacccgagcuucuuugucgggaucgauuucgacgcucaggauuccacgauuuucuuuucagacaugagcaaacauaugauauucaagcagaaaaucgacggaacaggcagggaaauucuggcggcaaaucgcguugagaacguggaaucucuugccuuugauuggaucuccaagaaucuguacuggaccgacagucacuauaaaagcauuucugugaugcgguuggcugauaagacuagaaggaccguaguccaguaccucaacaauccccgcuccgugguugugcacccuuucgccgguuaucuguuuuucacagacugguuucgaccagcaaagaucaugcgggccuggucagaugggagucauuuacugcccgucauaaacaccacucuaggauggccuaauggccucgcuaucgacugggccgcaagccgucuguacuggguggaugcguauuucgacaaaauugagcacucgacauuugauggucuugacagaaggcgcuugggccauaucgagcaaaugacgcacccauucgggcuggcuauuuuuggagaacaucucuucuuuaccgauuggcggcugggcgccaucauaagaguuaggaaggcagacgggggagagaugacugugauucgauccggcaucgccuacauucuucaccugaaaucuuaugauguaaacauccagacagguagcaaugcuugcaaccagcccacccacccgaauggggacuguucacauuucugcuucccugucccaaacuuucagcgcgugugcggaugucccuacggcaugcgguuggccaguaaccaccucacaugcgaaggugacccuacuaaugagcccccaaccgaacaauguggccuguucuccuuuccuugcaagaacgggagaugugugcccaauuacuauuuaugcgauggagucgacgauugucaugacaacucugaugagcagcugugcggcacgcuaaauaacaccuguagcuccucagcauucacaugcgggcacggagaguguauaccagcucauuggaggugcgacaaacguaaugauugcguugacggcagcgaugaacacaacuguccgacucacgccccugcgaguugccucgacacccaguacacaugugauaaucaucagugcaucucuaagaacugggugugugacacugauaaugacugcggugacggguccgaugagaagaacuguaauagcaccgaaacgugccaacccucgcaguuuaacuguccaaaucaccgcugcauugaccugucauucguaugugauggagacaaagauugcguggacggcucugaugaggucgguugugugcuuaacugcacagccagucaguuuaagugcgcuuccggcgacaaauguaucgggguuaccaaccggugcgauggaguguucgacuguagcgauaauucugacgaagcaggcugccccacuagaccuccagggaugugucauagcgacgaguuucaaugccaggaggauggaauuuguauccccaacuucugggaaugcgacggccacccugauuguuuguaugguuccgacgagcacaaugccugcgucccgaagacauguccaucaaguuacuuucauugcgauaacgggaauugcauacacagggcuuggcugugugaccgagauaacgacugcggagauaugagcgacgaaaaagauugucccacccagccuuuccggugcccaucuuggcaguggcaaugucucggccauaauauuugcgugaaccuguccguugugugugacggcaucuucgauugccccaaugggacugacgagucaccuuuauguaacggaaauaguugcagcgacuuuaacgguggcuguacccacgagugcguccaggaaccguucggggccaagugccuguguccccuuggauuuuugcucgcaaaugauuccaagacaugcgaggacaucgaugaaugugacauucugggcucuugcucgcagcauuguuauaacaugcgcgguagcuucagaugcucaugugauacgggguacaugcuagaguccgacggaaggaccugcaaaguaacugcgagugaaucucugcuccugcuuguggccagccagaauaagaucauugcugauuccguuacaucacaagugcacaacauauauucuuuggucgagaauggcagcuacaucguggccguagacuuugauaguauuuccggccggaucuucuggagcgacgcaacccaggggaaaacauggucugcuuuucagaacggaacugaucgaagaguggucuucgacucauccauuauccugaccgagacgauagccaucgacuggguuggucgcaacuuauacuggacagauuaugcacucgaaaccauugaggugaguaagaucgacggcagccacaggacugugcugauuucgaaaaaucuuaccaacccacgugggcuggccuuggauccucggaugaaugaacaucuccuguuuuggucugacuggggacaccaucccagaaucgagagggcuuccauggauggcagcaugcgcacagucauagugcaggacaagauuuucuggccauguggucuaacuaucgauuacccuaaccgacugcucuauuuuauggacucauaccuggauuauauggacuucugcgauuacaaugggcaccacagacggcaaguuaucgcgagugaccuuauuauaaggcaucccuaugccuugacccuguuugaagauucuguauacuggacagaccgcgcaacgcguagagugaugcgggcuaacaaauggcacggaggcaaucaguccgucgugauguacaacauccaguggccauuaggcauuguugccgugcauccgagcaagcagccuaauucagucaaccccugugccuucaguaggugcagccaccucugccugcuuuccucucaagggccacauuucuauagcugugugugccccuccggauggucacugucuccugaccuacucaauugucugcgcgaugaccagccauuuuugaucaccguacgacagcacauuaucuucgguauaagucugaaccccgaggucaagucgaaugaugcuauggugccuaucgcaggcauucaaaacggguuagacguugaguuugaugacgccgaacaguacaucuauuggguggagaauccgggagaaauucacagagucaaaacugauggcacaaaccggaccguguucgcgagcaucuccaugguugguccaucuaugaaccucgcucuggacuggauaucaaggaaucuuuacagcacuaacccccgcacacaguccauugaggugcugaccuugcauggggauaucagauauaggaagacgcucaucgccaaugacggaacugcacugggcgucggcuuuccuauugggaucaccguggaucccgcccggggaaaacuauacuggagugaccaggguacagauucuggcguaccagcuaagauagcaagcgccaacauggacgggaccucagugaaaacucuguucacaggaaaucuugaacaccucgagugcguuacccuggacauugaggaacaaaaguuguauugggcggucacaggccguggugugaucgagcgcgggaacguggauggaacugaccgaaugauucugguccaucaguuaucccacccuuggggcaucgcuguacacgauaguuuucucuacuacaccgacgaacaguaugaggugauagagagaguugauaaggccacgggcgcaaauaaaauugugcugagggacaacguccccaaucuucgggggcugcaaguguaccaucgcagaaacgccgcugaaagcucuaauggauguuccaacaauaugaacgccugccagcagaucuguuugccaguuccugguggccucuucucaugcgcaugugcuacaggguuuaagcugaauccggauaacaggagcugcucgcccuauaacucuuucaucguggucaguaugcuauccgccauucggggauuuagccuggagcuuucagaccacuccgaaaccauggugccaguagcgggccagggucgaaaugcccuccauguggauguugacgucucuagcggguucaucuacuggugugauuuuaguuccagcguggcaucugacaacgcuauuagacgcauaaaaccugacggcucaagucugaugaauaucgugacucacggaauuggcgagaacggggucaggggaaucgccguugauuggguggcugguaauuuguauuucaccaacgcauucguauccgaaacauuaaucgaggugcugcggauuaauacuaccuaccguagaguccuccugaaggugacgguugacaugcccaggcauauaguggucgaucccaagaaccgcuaucuauucugggccgacuacggccagcggccuaagaucgagaggagcuuccuggauugcacaaauagaaccguauuggugucugaagggauuguuacucccagaggacuagccguggaccgcucggauggcuacgucuauuggguggacgauucacuggacaucauugcucggaucagaauaaacggugagaauagcgaagucauccguuacggguccagguauccgacaccauacggcauuaccguguuugagaacaguaucauuuggguugaucggaaucucaagaaaaucuuccaagcgucuaaggaaccugagaacacugagcccccaacagugauacgcgacaauauuaacuggcugcgagauguaaccaucuuugacaaacaggugcagcccagaagcccugcagaagucaacaauaacccgugccuugagaauaacggaggcuguucccacuuaugcuucgcccugcccgggcuccacacgccaaagugugacugcgcuuuuggaacuuugcaaucagaugguaaaaauugugccauuaguaccgaaaacuuccugaucuuugcacucucuaauagccugaggucccuucaucuggacccugagaaccacucacccccuuuccagacaauaaauguugaacggaccgugaugagcuuggauuaugacucugucuccgaucgcaucuacuuuacacagaaccuagccaguggcguggggcagauuagcuaugcuacucugucguccggaauccauaccccaacgguaauugcgucuggcaucgguacagccgacgggauagcauucgauuggauuacuagaaggaucuacuacucagacuaucucaaucaaaugaucaacagcauggcugaggauggcaguaaucgaaccgugauugcccggguucccaagccucgugcaaucguguuagacccaugccagggauaccuguauugggccgauugggacacacacgcuaagauagagagagccacccuuggcgggaacuuucgcguccccauuguaaauuccucucuggucaugccgagcggacucacuuuggauuacgaagaggaccugcucuauuggguggacgcgucacugcagaggaucgaacgguccacccuuacaggcguugauagagagguaauugugaacgcagccguccaugcuuucggucuaacgcuguacgggcaguauaucuacuggacugacuuguacacccaacgcauauauagggccaacaaauacgauggaaguggccagaucgcuaugacaaccaauuuacugagccagccucgagguauuaacacugugguuaagaaucagaaacaacaguguaacaauccaugcgagcaguucaacggcggguguucucacaucugcgcacccggaccuaauggcgccgaaugucagugcccacacgaggggaacugguaucucgcuaauaaccggaagcauugcauuguggacaauggagaaagauguggcgccucauccuuuacaugcagcaacgguagguguaucucugaggaauggaaaugcgauaaugacaacgauuguggggacggaagugaugagauggagucggucugcgcacugcacaccuguucccccacggcguucacuugcgccaauggccgcugugugcaauacagcuaucguugcgacuacuauaacgauuguggugacggcucagacgaagcugggugccuuuuucgggauugcaacgccacaaccgaguucauguguaauaacagaaggugcauuccgcgcgaauuuaucuguaauggaguagacaacugccaugauaauaacaccucugacgagaagaauuguccugaucgaacuugccagagcggcuacacaaaaugucacaacuccaauauaugcauuccccggguguaccugugugacggggauaacgacugcggagauaauagugacgaaaacccaaccuauuguacaacucacacgugcucaucuagcgaguuccagugcgcauccggcagauguaucccucaacauugguacugcgaucaggagaccgacuguuuugaugcuagugacgaacccgccagcugcggucacuccgagaggacaugucucgcagacgaguucaagugcgaugggggacgcuguaucccaucugaguggauuugcgacggcgauaaugacuguggcgauaugucagacgaagauaagagacaucagugccagaaccaaaauuguagcgacucggaguuuuugugcguuaacgaucggcccccugacaggcguugcauaccacaguccugggucugugauggggacguggauugcacugacggauaugacgagaaccagaauuguacccgacgcacaugcagugaaaacgaguucaccugugguuacggccugugcaucccgaaaauuuuuagaugugaucggcacaaugacugcggggauuauucugacgaaaggggaugucuauaccagacuugccaacagaaccaguucacgugucagaauggccgcugcaucagcaagaccuuugugugcgaugaggacaacgauuguggugacgggucagaugagcugaugcaucucugccacacacccgaaccuacuuguccaccccacgaguucaaaugcgacaauggaagauguauugaaaugaugaaacuuugcaaccaucuggaugacuguuuagacaauuccgaugagaaaggcugcggcaucaacgaaugucacgacccuucuauaagugggugcgaucauaauuguaccgacacauugaccagcuucuauugcuccugccggccaggauacaagcugaugucagauaagaggacuugugucgacaucgaugagugcacagagaugcccuuuguuuguagccaaaaaugcgaaaacgugauugguucuuacaucuguaagugcgccccuggcuaucuccgagagccggacgggaaaacgugucgucagaauaguaacauugaaccauaccugaucuucuccaauagauauuaccuucgcaaccugaccauagauggauauuuuuacagccucauuuuggagggccuggacaacguaguggcuuuagauuucgaccgggucgaaaagaggcuauauuggaucgauacucagagacaagugaucgagcgcauguuucugaauaaaacaaacaaggagaccauuauaaaucaccggcuccccgcggccgaaucacuugcaguugacugggugucuaggaagcuguacugguuggacgcucgacuggauggucucuucgucuccgaccugaacgggggacacagacggaugcuugcccagcauugcguggaugccaauaacaccuuuuguuucgacaauccuaggggccucgcacugcacccccaguacggcuauuuguacugggcugauugggggcaucgcgccuauaucggacguguagguauggacggcacaaacaaaucgguuauuaucagcacuaagcuggaguggccaaaugggauuacgaucgauuacaccaacgacuuacuauauugggcggaugcucaccugggauacauagaauauagugaccucgagggccaucacagacacacaguguacgauggugcccuuccucaucccuuugcaaucacuauuuucgaagacaccaucuacuggacagauuggaauacccgaacugucgagaaagggaacaaguaugacggaucuaauaggcagacgcuggugaacacaacccaccggccauuugacauucauguguaccacccguaucgccaaccuaucgucuccaaucccugcggcacuaacaauggcggguguagccauuugugccugauuaaaccaggagguaagggcuuuaccugcgagugucccgaugacuuuagaacacuccagcugucagggaguacuuacugcaugccuauguguuccagcacccaguuccuuugcgccaacaacgaaaaguguauaccaaucugguggaaaugcgauggacagaaggacuguucugauggcucagacgaguuagcucugugcccccaaagguucugucggcucggucaguuucagugcagcgaugggaauuguacauccccucagacguugugcaacgcacaccaaaauuguccggacggaucugaugaagaccgccugcuaugcgagaaccaccauugcgauaguaaugaguggcagugugccaacaaaagaugcauuccagaaucguggcagugugacaccuucaaugacugcgaggauaacagcgacgaagauuccucacacugugcgucucgaacuugcaggcccggccaauuucggugugcuaauggccguugcaucccucaggccuggaagugugacguugauaacgacugcggggaucauagcgacgagccaaucgaagaguguaugaguuccgcacaccugugcgauaauuucacagaguuuucaugcaaaaccaacuaucgcuguauucccaagugggccgugugcaauggaguagacgauuguagagacaacucugaugaacaggguugcgaggaaaggacuugucacccugugggcgacuuccggugcaagaaucaucacuguauaccccucagauggcagugcgacgggcaaaacgauuguggagacaacagcgaugaggaaaauugcgcuccacgcgaguguacagaguccgaauuucgaugcgucaaccagcagugcaucccgaguagguggauuugugaccauuacaaugauugcggcgacaacagcgaugagcgggacugugaaaugagaaccugccacccugaguacuuccaguguacgucuggucauugcgugcacucagaacuuaaaugugauggguccgccgacugccuggaugcaagcgacgaggcugacugucccacccguuuuccagauggagccuauugccaagcgacaauguucgaguguaagaaucacguuugcaucccucccuacuggaaaugcgacggcgaugacgauuguggcgacgggagugaugaagaguugcaucugugccucgacgugccauguaacucuccuaaucgcuuuaggugcgauaacaaucgguguauuuauucccacgaagucugcaacggaguggacgauuguggugacggcacugaugagaccgaggaacauugcagaaagcccacaccgaaaccauguacugaguacgaauauaagugcgggaauggacacuguaucccucacgacaacguaugcgacgaugccgacgauugcggcgacuggucggaugagcuggguuguaauaaagggaaggaacgaaccugcgcagagaacauaugugagcagaauugcacacaguuaaacgaaggcggauucaucuguagcugcaccgcuggcuuugagacuaacguuuucgacaggacgucaugucuugauauuaaugaaugcgagcaguucgggacauguccccaacauugccgcaacaccaagggauccuacgaaugugugugcgccgacgguuuuacuucuaugagugaucggccaggcaaaagaugcgcagcugaggggagcucaccccugcuccuacugccugacaaugucaggauccgcaaguauaacuuguccagcgagcguuucucugaauaccugcaggaugaggaauacauucaggccguggacuaugauugggacccgaaagacaucggacucaguguuguguacuauaccguccggggcgaggguuccagauuuggggccauaaagcgagcguacauuccaaauuucgaaagcggcaggaacaaucuugugcaggagguagaucugaaauugaaguaugugaugcaacccgacggaaucgcugucgauuggguuggccgccacauuuacuggucagacgugaagaacaaacggaucgaggucgcaaagcuggaugggagauauaggaaauggcucauaucuacagacuuagaucagccugccgcuaucgccgugaaucccaagcugggacuuauguuuuggacggacugggguaaagaaccaaagauugagucggcauggaugaacggcgaagaucgcaauauccugguauucgaggaccuaggguggccuaccggacucagcauugauuaccugaacaaugacagaaucuacugguccgacuuuaaggaggaugugauagaaacuauuaaauaugacggcacagaucggcgaguuaucgccaaggaggcuaugaaccccuacaguuuggacaucuucgaagaucagcuguauuggauuucuaaagagaagggugaaguguggaaacaaaauaaguuuggccaggggaagaaagagaagacccucgucgugaacccauggcuuacucagguuaggaucuuccaucagcugcguuacaacaaaucagucccuaauuuauguaagcaaauaugcagccaccuguguuugcucagaccgggaggcuauuccugcgcguguccccaggggaguucuuuuauugagggaagcacaaccgaaugcgacgccgcaaucgagcugccaauuaaccuaccucccccaugucggugcaugcauggcgguaauuguuacuucgaugaaacagaccuuccuaaaugcaagugucccuccggguauacuggaaaauacugcgagauggcuuucucaaagggcaucagcccggguaccacggccguggcagugcugcucaccauacuguugaucguagucauuggcgcccuggcuaucgccggguuuuuccacuaccgcaggacaggaucucuccuuccagcgcugccuaaguuacccucccugaguucauuggugaaaccaagcgaaaacggcaaugggguuacuuuucgaucgggagcagaucucaacauggacauuggcguguccgguuucgggcccgagaccgccaucgauagaucuauggcuaugagugaggacuuugucauggaaaugggaaagcagccuauuaucuucgagaaucccauguauagcgcccgggauucagcagugaaaguugugcagccaauacaaguaacagucuccgaaaacguggacaauaagaacuacggcucuccuaucaauccgagcgagauugugcccgaaacuaacccaaccaguccugcugccgacgguacgcagguuacaaaauggaaucuguuuaagcgcaaguccaaacagaccacuaacuucgagaaucccaucuaugcucagauggagaacgaacaaaaggagagcgucgccgcaacaccaccucccucuccgucacuaccugcgaaaccaaagcccccuuccaggagagauccaacccccacuuacagcgccaccgaagacacauuuaaagauacggcuaaccuugugaaggaggacagugagguauga

SEQ ID NO: 58561 - RNA, 5718 nt, Artificial Sequence
  derived and/or modified sequence opt3 from LRP4__Homo_sapiens__NP_002325
augagaaggcaguggggcgcccugcuccuuggggcucuguugugcgcacacggauuagccagcucccccgagugugcgugcggucggucucauuucaccugugcugugucagcccugggcgaaugcacauguaucccugcacaauggcagugcgacggggauaacgacuguggagaucacagugacgaggauggcugcauucuaccaacuuguagcccgcucgacuuucauugcgauaaugguaaguguauacgccgauccugggucugcgacggggauaacgacugcgaagaugacucugaugagcaggacugucccccucgugaaugcgaggaggacgaauucccaugucagaauggauacugcaucagaucgcuguggcacugugauggcgacaacgauugcggcgacaauucagaugagcaaugugacaugaggaaaugcagcgauaaggaauuucgguguagugacggguccugcauugccgagcauugguauugugauggagacacggauugcaaagacgguucugacgaggaaaacugccccagcgcuguuccugcaccacccuguaaucuugaggaauuccagugcgccuacggccgcuguauccuggauauuuaucacugcgacggggaugacgauuguggagacugguccgaugagucagacugcaguagccaccagccuuguagaucuggcgaauuuaugugcgauuccgguuuguguaucaacgcuggguggaggugcgacggagaugccgacugugaugaccagucagacgagcggaauugcaccacaagcaugugcacugcggagcaauuccgcugucauaguggccgaugcgugagacucucuuggaggugugauggcgaagacgauugcgcagacaacuccgaugaggaaaauugugagaacaccgggagcccacagugcgcccuggaccaguuucuguguuggaauggacggugcauaggucagcguaagcucuguaacggcguaaaugauugcggggacaacucggaugaaucuccgcaacagaacugucgccccagaacaggagaggagaauugcaacgugaauaacggcgguugcgcucagaaaugucaaauggucaggggggccgugcagugcaccugucacacuggcuaccgguuaacagaagacggacauaccugccaggauguuaaugagugugcagaagagggcuauugcucccagggguguacgaacucagaaggagcuuuccaaugcuggugugagacugguuacgagcugcgaccugaccgcagaaguugcaaggcccuuggcccagaacccguguugcuguuugcgaauaggaucgauauucggcagguccuaccucaccgcagcgaguauacccuccugcuuaacaaucuggaaaacgccaucgcauuggacuuccaccauagaagggagcucguguuuugguccgacguaacacuggaucguauuuuacgggcuaaucugaacgggucuaauguugaggaaguggucagcacuggacucgagucaccaggcggucuugccguggacugggugcacgauaagcuguacuggaccgacagugggacaucccgaaucgaagucgcuaacuuggauggcgcccauagaaaaguucuacuguggcagaaucucgagaagcccagggcaauagcccugcacccgauggaaggaaccauuuacuggacggacuggggcaacacuccucgcaucgaggcuagcucuauggaugggucaggacggagaauuaucgcggacacacaucuuuucuggcccaacggucugaccaucgauuaugcaggcaggcgcauguacuggguggacgccaaacaccacguaauugagcgagcuaauuuggaugggagucaucggaaggccgugauaagccagggacucccacacccuuuugcaaucacugucuucgaagacucccuguauuggacagacuggcauaccaaaucuauuaacucggccaauaaguucacgggcaagaaccaagagaucauacguaauaaauuacacuuucccauggauauucacacccugcauccacagagacagcccgcugguaagaacagguguggggacaauaacggcggaugcacacaccuaugccucccuagcggccagaauuacacuugugccugcccaaccggguuccgcaaaaucuccucacaugcaugugcgcaaagucuggauaaguuucuuuuguucgcucggagaauggacaucaggcgaauuucuuuugauacagaagaccugagcgaugacgugaucccgcucgccgauguucgcuccgcaguggcccuggacugggauucacgggacgaucacgucuauuggacugacgugagcaccgacacaauuucuagagcuaaaugggauggaaccggccaggagguaguuguggacacuucccuugaaagucccgccggucuggcaauagauugggucacgaacaaguuguacuggacagacgcugggaccgauaggaucgagguggccaauacugacggaagcaugcguaccguccucauuugggagaaccuggaucgcccucgggacaucgugguugaaccaaugggcgguuauauguacuggacagauuggggcgcgucucccaaaaucgagagagccgggauggacgcuuccggaaggcaggugauuauaucaaguaauuuaaccuggccuaacggccuggcaaucgauuacgggagccagcgacuauauugggccgacgcuggaaugaagacuauugaauucgccggccucgaugguucgaagcggaaaguacugaucgggucccaacuuccacaucccuuuggauugacacuguacggcgagcgcauuuauuggacggacuggcagaccaagucuauccagagcgcagacagacucacuggucuggauagggaaacauuacaagagaaucuggagaaccuuauggacauacacgucuuccaccggcgaagaccgccugugucaaccccaugcgcgauggaaaacggcggguguagucauuugugccuccgcucccccaauccuucuggauuuagcuguacaugccccacuggcaucaaccugcuauccgaugggaaaaccuguucaccaggaaugaauagcuuccugauuuuugccaggcguaucgacauucggaugguuagucucgauaucccuuacuucgcugacguggucgugcccauaaacauuacgaugaagaauaccaucgccauuggcguagauccacaggaggguaaaguguauuggucugacuccacacugcacagaaucagcagggcaaaccuugaugggucgcagcaugaagacauaaucacuaccggauugcagacaacugauggccuggcuguugacgccauuggucgcaaggucuacuggaccgacacgggcacaaaucgaaucgagguggggaacuuagauggaucaaugagaaaggugcucgucuggcaaaaucuggacucuccgcgggcaauuguucuuuaucacgagaugggcuuuauguacuggaccgauuggggggaaaacgccaaacuggagaggaguggaauggacggcuccgaucgcgcuguguugaucaauaacaaucucgguuggccuaacgggcugacuguggacaaggcgagcucucagcuacugugggccgaugcacauacagaacguauagaggcugccgaccucaauggagccaacagacacacccugguaagccccguccagcacccauacggccuuacuuugcuggauuccuauauuuacuggaccgacuggcagacacggucaauccauagggcugauaaaggcacggggaguaacgugaucuuaguucgcagcaaucuccccggacugauggacaugcaagcaguggaucgagcccagccucuugguuucaacaagugcggcucuagaaaugggggauguucccaccugugccuaccacggcccucaggcuucaguugcgcguguccuaccgguauucagcucaaaggggacggaaagacuugcgacccgagcccagaaacauaucuguuguuuuccucuaggggcucgauccgcagaauuagccuggauaccucagaccauacagauguccacgugcccguuccugaguuaaacaaugugauaucccucgacuacgauaguguagacggcaaggucuauuacacugauguguuccuggacgugaucaggcgggcugaucuuaacgggucuaauauggagaccgucauuggacguggucugaaaacgacagacggcuuggccguugauuggguggcacgcaaccucuauuggaccgacacugggcgaaauaccaucgaagccagcagacuggacggauccuguaggaagguacuaauuaacaauucacuggaugagccacgggcuaucgcaguguuuccccgcaaaggcuaccuuuucuggacagacuggggucacauagccaagaucgaaagagcgaaccucgaugggucugagaggaaaguccugauuaauacugacuugggauggccuaacggccugaccuuagauuacgacacacggcgaaucuauuggguggaugcucaucucgacagaauugaaagcgccgaucugaauggcaagcuucgccagguucuggugagucacgucucccauccguuugcauugacgcaacaggacagguggaucuacuggaccgauuggcagacuaagagcauacaacggguggacaaauauucugggcguaacaaggagacaguucucgccaauguggagggacugauggauauuaucgucguaucaccccagagacagaccgguacuaacgcuugcggcgugaacaaugggggauguacacaccuaugcuucgccagggcauccgacuuuguuugugcuugcccagacgaaccugauagucgccccuguagccuggugccaggccuugucccucccgccccacgggcgaccgguaugucggagaaaucuccggugcucccuaacacgcccccaacuacccuguacuccagcacaacccgaacuagaacaucauuggaagagguagaagggaggugcagugagcgcgacgcccgguuaggacugugugcaagaucuaaugaugcugugcccgccgcuccuggcgagggccuccauaucuccuaugcaauugggggacugcuuagcauacuguugauccuagucguuauugccgcccugaugcucuaccgucacaagaaaucaaaguucaccgacccagguaugggcaaccugacauauaguaaucccagcuacaggacuuccacccaggaagugaaaaucgaggcuauuccuaagccggcgauguacaaccaacuuugcuauaagaaagaagggggaccagaucacaauuacacgaaggagaaaaucaagauaguggagggcaucuguuuacugucuggugacgaugcagaaugggacgaucucaaacaguugcggagcucccgcgggggacugcuccgagaccaugucugcaugaagacagauaccgugucaauucaggccucuaguggcucgcuggacgauacugagaccgaacagcuucugcaagaggaacagagcgagugcuccucuguucacacagcugccacucccgagagaaggggcucauugccugacaccggguggaagcaugaacggaaacuaagcuccgagagucagguauga

SEQ ID NO: 58562 - RNA, 4848 nt, Artificial Sequence
  derived and/or modified sequence opt3 from LRP5__Homo_sapiens__NP_002326
auggaggccgcucccccuggcccaccguggccccugcuccuucuguuguuacugcuacucgcacugugcggguguccugccccagcggcugccagcccccuucuguuguucgcaaacagaagggacgugcggcucgucgaugccggagguguuaagcuggaauccaccaucgugguaucuggccuggaggacgcugcagccguggauuuucaguucucaaaaggggcugucuacuggacagacgugagugaagaggccauuaagcaaacuuaucucaaucagacgggagcggcaguucagaacguggucauaagcggcuuaguguccccugauggucuggccugcgacuggguagggaaaaaguuguacuggaccgauucugaaacaaaucgcaucgagguugcuaaccuuaauggaacuucgcgaaaagugcuguuuuggcaggaccuagaucaaccacgugccauugcacucgaccccgcucacggcuauauguacuggaccgauuggggcgagacaccuagaaucgaaagggccgggauggacggaucaacccggaagauuaucgucgauagcgacauauauuggccaaacggucugacuaucgaccuugaggaacagaagcuguacugggcggaugccaaauugaguuucauucaucgcgcaaaucucgacggcuccuuuagacagaaggugguggaggggucucugacacacccguucgcuuuaacccugagcggagauacgcucuauuggacugacuggcagaccagguccauccaugccuguaacaaacggacaggcgguaagcgcaaagagauucuuucagcucuguacagucccauggauauccaagucuugagccaggaacgacagcccuuuuuccacacuagaugcgaggaagacaaugggggauguucucaucuaugccugcucuccccaucagagcccuuuuacaccugugccugcccuacaggcguucagcugcaagauaacggcaggaccuguaaggcaggggccgaagaggugcuucuguuggcucggcguacggaccuccgcagaauaagccuggauacuccagacuucacagauauuguauuacagguggacgacaucaggcacgcgauugcaaucgauuaugacccccuggagggauacgucuauuggaccgaugacgaagugcgggccauccgacgcgcuuaccuagaugguaguggcgcccagacucucguuaauacagagauuaacgacccggaugggauagcaguggacugggucgccagaaaucuguauuggaccgauacgggaaccgacaggaucgaagugacacggcuuaacggcacuucucgcaagauuuugguauccgaggaucuggacgaaccuagagcuaucgcccuccaccccguuaugggucugauguacuggaccgauuggggcgagaauccaaaaauagagugcgcaaaccuugacgggcaagaaaggcgugugcuggucaacgcgagcuugggauggccuaauggccucgcucuggacuuacaggaggggaagcuguauuggggagaugccaaaacagacaagauugaagugaucaacgucgaugguacuaaacggcgaacccuacucgaggacaagcugccccauaucuuuggcuucacacuuuugggggauuuuauuuacuggaccgacuggcagagaaggucgaucgaacgcgugcacaaaguuaaggcaucucgggaugugauuauagaccagcugccagaucucaugggacugaaggccguaaaugucgcuaaagugguuggcacuaaccccugugccgacagaaauggugggugcucccauuuaugcuucuucacgccucacgcaacaagguguggcugcccaaucggacuggagcuuuugucagauaugaagaccuguauugugccggaggcuuuucucgucuucaccagucgcgccgcgauccaccgaaucagccuggaaacuaacaauaacgacguggccauuccccuaacaggcguaaaagaggcuuccgcacuggauuuugacgugucuaauaaccauauauacuggaccgacguuagccucaagacuaucucacgggccuucaugaaugggaguuccgucgaacacgugguggaguuuggacuggauuauccugaggguauggcugucgacuggaugggcaaaaaccuuuacugggccgauacagggacgaaucguauugaaguugcaagauuggacggacaauuccgccaggugcugguguggagggauuuagacaacccacggagccucgcgcuggaucccaccaagggcuauaucuacuggacugaguggggugggaagccuagaauuguaagggccuuuauggacggcacaaauugcaugacccuugucgauaaagugggacgagcuaacgaccugacaaucgauuaugccgaccagcgcuuguacuggacugaccucgauaccaacaugauagaaucuucaaauaugcugggccaggagcggguugugaucgcagacgaucuaccacaucccuucgggcugacgcaauauagugacuacauuuacuggaccgauuggaaccuccacagcaucgaaagagcugacaagacauccggaaggaaucguacucugauucagggccaucuugauuuugucauggacaucuugguguuccacucuucgcgccaggauggucugaacgacuguaugcacaauaacgggcagugcggacaauuaugucucgccauaccgggcggucaucggugcggcugugcaagccacuauacccuggauccuuccucaagaaauugcaguccacccacaacuuuucuucuguucucucagaaaagcgccauuuccaggaugaucccugacgaucagcauucacccgaccuaauucucccacugcacggguugcgaaacguuaaggcuaucgacuacgauccucuggacaaauuuauauauuggguggauggacggcagaauaucaagcgcgcgaaggacgauggcacccaacccuucguauuaacgagccucucucaggggcagaacccagacagacaaccgcacgaucuguccauugacaucuacaguaggacacuuuucuggaccugugaggccacuaauacaauuaacguccaucggcugagcggagaggcaaugggcgugguguugcgaggugauagagacaaaccucgcgcuaucgucguuaaugccgaaaggggguaucucuacuuuaccaacaugcaggaucgugccgcuaagauagagcgggcagcccuggacggaacugaaagagaggugcuauucaccacaggccugauuaggcccguagcgcuuguggucgauaauacgcucgguaaacuguuuuggguggacgcugacuugaagcgcaucgaaucuugcgaucuguccggcgccaaccgauuaacccucgaggacgcaaacaucguucagccacuggggcuuacuauucugggaaaacacuuguauuggaucgauagacagcaacagaugauugagcggguggaaaagacaaccggcgacaagaggacacgcauacaggggcgugucgcccaucucacuggaauccacgcuguggaggaaguuucacuggaggaguucagugcacaucccugcgccagagauaauggcgguuguagccacauuugcaucgcgaaaggggacggaaccccucgguguucgugcccagugcaccuaguccugcuucagaaccuccugacguguggcgaacccccuacaugcuccccggaucaauuugcuugugccaccggugagauugacugcaucccaggcgcauggaggugugauggguuccccgaaugcgacgaucagucugacgaggaaggauguccuguaugcagcgccgcucaguuuccaugcgcccgcggccaguguguggacuugcgauuaagaugcgauggggaggcagacugucaagaucggucagacgaggcugauugcgacgccauaugucugcccaaucaguucaggugcgcgaguggacaguguguucucaucaagcaacagugcgauuccuuuccugacuguauugauggcucugacgaacugaugugcgagaucacuaaaccgcccagcgaugacuccccagcccauucaagcgcaauugguccugugaucgggauaauucuuagucuguucgucaugggaggcguguacuuuguaugucagcgcguggucugccagagauacgcuggcgccaacgggcccuucccacacgaauauguuucuggaaccccucaugugcccuugaauuuuaucgcuccagguggcucccaacacgggccguucacaggaaucgcaugcggcaagagcaugaugucgucagugucucuaaugggugggaggggaggcgucccucuguacgaucggaaccaugugacuggcgccaguuccagcucuagcuccucaaccaaagccacacucuaucccccaauucugaaucccccuccaagucccgcuacggacccuagccuuuacaacauggacauguucuauucuuccaauauaccggcgaccgcacguccauaccgccccuauaucauucgagggauggccccucccacuacaccauguucaaccgauguuugcgacagugauuacagcgcuuccagauggaaggccucuaaauacuauuuagaccugaacucggauagcgacccuuacccuccaccuccgacuccccacucacaguaucucuccgcagaggauaguuguccaccuucucccgccacagaaaggagcuacuuucacuuguucccaccucccccguccccaugcaccgacucaucuuga

SEQ ID NO: 58563 - RNA, 4842 nt, Artificial Sequence
  derived and/or modified sequence opt3 from LRP6__Homo_sapiens__NP_002327
augggcgccgugcugagaagccuccuugcuugcuccuucuguguccuguugagggcagcccccuuacugcuauacgcgaaccggcgcgaccuccgacugguugaugcuaccaaugggaaggagaacgccacaaucgugguaggaggucuugaagacgcagccgcuguggauuuugucuucucucacggccugauuuauuggucagacgugagugaggaagcaauaaaacguacugaguuuaauaagacggaaagcguucagaacguggucguguccggguugcucucuccugauggacuggccugcgacuggcugggcgagaaacucuacuggaccgauucggagacaaauagaaucgaaguaucaaacuuagacgguagccugaggaagguucuuuucuggcaagaguuggaucagccacgggcuauugcccuggacccgaguuccggguuuauguauuggacugauuggggagaagugcccaaaaucgagcgcgcgggcauggacggcucuagcagauucauuaucauaaauuccgagaucuacuggccuaacgggcuaacccucgauuaugaagaacagaagcuguacugggcagacgccaaacuuaauuuuauucauaaaucaaaccuggacggaacaaauaggcaggcugucgugaaggguaguuugccacaccccuucgcccucacccuguuugaagauaucuuauauuggacugacuggagcacacauucuauucuggcauguaacaaauacaccggcgaggggcuccgggaaauccacuccgauauauucucaccuauggacauucaugcuuuuagccaacagcgccagccaaaugccacgaaccccugcggaaucgauaauggcgguuguagucaccuuugccugaugucuccugugaagccauucuaccagugugcgugcccgacuggggucaaauugcuagagaacggaaagaccuguaaggacggcgccacagagcugcuccugcuugcacgaagaacugaucugaggcggauuuccuuggacacccccgauuuuacagacaucguucuccaacuggaagauauccgucacgcuauugccauagacuaugacccuguggagggcuacaucuauuggaccgaugacgaaguacgcgcuauuagaaggagcuucaucgaugggucgggaucucaguucguggucacggcccagauagcacauccagacgguauugccguggauuggguugcucggaacuuauacuggacugacacaggcaccgaucgaaucgaggugacucgccugaaugggacaaugagaaaaauccuaauuuccgaagaccucgaggagcccagggcgaucguccuggauccuauggugggauauauguacuggaccgacuggggcgaaauuccaaagauagagcgggcagcccuugaugguucagaccgcguaguuuuggugaacacgagucugggguggcccaauggccucgcucuggauuaugacgaaggaaaaaucuacuggggcgacgccaagaccgauaaaauugaggucaugaacacagacgggacuggaagaagggugcuugucgaagauaagaucccgcacaucuuugguuucacccuguugggcgacuacguguauuggacagauuggcagcgucggagcauugagcgaguucauaaaagauccgcagagagggaagugauaaucgaccaacucccugaucugaugggguuaaaggccacuaauguacaccgcgucauuggaucuaaccccugcgcugaggaaaauggcgguuguagccaccugugccuauaccggccacaggggcucagaugcgccuguccuaucggcuuugagcugauuucagacaugaagaccugcaucgugcccgaggcauuccuuuuguuuaguaggcgcgcggauauacgacggaucucccuggaaacaaacaauaacaauguugcuauuccacucaccggagugaaagaggccagcgcacuggacuucgaugucacugacaaccguaucuauuggacggauauuucuuuaaagacaaucucaagagccuuuaugaauggcagugcucuggaacaugugguagaguucgggcuugacuaccccgaaggaauggccguggacugguuggguaaaaaccucuauugggcagauaccggcacuaauaggauagagguuagcaagcuggacgggcagcaccgccaaguccuaguguggaaagaucuggacuccccucgggcucucgcccuggauccagcggagggauuuauguacuggaccgaauggggcgguaagccgaagauugacagagccgcuauggaugggucugagaggacaacccuugugcccaacgucggccgagcaaacggauugacuaucgacuaugccaaacgccggcuguacuggacagauuuagacacgaaucucauugaaucgagcaacaugcugggccuuaauagagagguuaucgcugaugaccugccucauccauucggguugacccaguaccaggacuauauauacuggacugauugguccaggcguucaaucgaacgcgccaacaagacaaguggacagaaucggaccauuauccaaggccaccucgacuaugugauggauauucugguguuucauucuagcagacaguccgguuggaacgagugugcaucaagcaaugggcacugcucucaccuaugucuggcgguacccgucggaggcuucgugugcgguuguccugcccauuacucccucaacgcugacaauaggacaugcagugccccaacuaccuuucugcuuuucagccagaaaucugcaaucaaccgaaugguuauagaugagcagcaaucccccgacauuaucuugccgauccacucacugcggaaugugcgcgcuauugauuaugacccuuuagauaagcagcucuacuggaucgacaguagacagaacaugauuaggaaagcccaggaagauggcagccaaggguucacggucgugguuucguccgugccaucucagaaucuggagauacagcccuaugaccuuagcaucgauauuuacucacgguacaucuauuggaccugugaagcaacaaacguaauuaaugucacucgacuggacggaagaagugugggcgugguccuaaagggggagcaggaccgcccuagggccguugugguaaaccccgaaaagggauacauguauuuuaccaaccuccaagagcguuccccaaaaaucgagcgggcugcgcuggauggcacagaaagagagguguuguucuuuucuggucugagcaagccuauagccuuagcacucgacuccaggcuggggaaacuuuucugggcugauucagaccugcgccgaaucgaaagcagugauuugucuggagccaauagaauuguccucgaggacuccaacauccugcagcccgugggccuaacuguuuuugagaauuggcuguacuggauugauaagcagcaacagaugaucgaaaagauagacaugaccggucgggagggcaggacgaaggugcaggcccgcauugcucagcuuagcgauauccaugcagucaaggaacucaaccugcaagaguaucgucagcacccaugcgcccaggacaaugggggauguucgcacaucugcuuggugaaaggcgaugggacaaccagaugcucauguccgaugcaucugguuuuacuccaggacgaacugucuugcggagagccucccacuuguaguccacaacaguucacaugcuuuaccggcgagauugauuguauacccguggcguggcggugcgacgguuucacugaaugugaggaccacuccgaugaacuuaacugcccugucuguagcgagucucaguuucagugcgcuagcgggcaauguaucgacggagcccugaggugcaauggcgaugcaaacugccaggacaaguccgaugagaaaaauugugagguauugugccucauugaccaguuccgcugugccaacggucaaugcaucggcaagcauaaaaagugugaucacaauguggacugcucagauaaaagugacgagcuggauuguuacccaaccgaagaacccgcuccucaggcaacaaacacgguugggagcgugauuggagucaucgugaccauauuuguaucuggcacuguguauuucaucugccagcgaaugcuauguccgagaaugaagggggacggagaaacaaugaccaaugacuacgucguucauggcccagccuccgugccccuggguuacgugccucacccaucaagucuuagcgggucccuccccggaaugucucggggcaagucgaugauuagcucacuguccaucaugggcgggaguucuggaccuccguaugauagggcgcacgucacaggugcuagcuccucaucuagcaguuccacuaaaggcaccuacuuucccgccauuuugaacccaccucccagcccagcaacggagcgcucucauuauacaauggaguucggguacucauccaauaguccuagcacccacagaucguauucuuacaggcccuauuccuaccggcauuucgccccaccgacuaccccuugcagcacagacgugugugauucagacuacgcucccagucgucgcaugacuucuguugccaccgcaaagggauauacauccgauuuaaacuacgacagcgagccaguacccccuccacccacgccucgaucacaguaucugagugcugaggaaaacuacgagagcugcccgccaucccccuauaccgaaagaucuuacagccaccaucucuauccucccccaccuucccccugcacugauucaucuuga

SEQ ID NO: 58564 - RNA, 1074 nt, Artificial Sequence
  derived and/or modified sequence opt3 from LRPAP1__Homo_sapiens__NP_002328
auggcccccagaagggugcggagcuuccugcgcggccucccugcacuucuguuguuacugcuauuucucgggccauggccggcugccucccacggagguaaguacucucgagagaaaaaccagcccaagccuucaccaaaacgugaaaguggcgaggaguucagaauggagaagcugaaucaacuuugggaaaaagcgcagaggcugcauuugcccccuguccggcucgcugagcugcacgccgaccugaagauccaggagcgcgaugaacucgcauggaagaaauuaaagcuggacgggcuugaugaggacggagaaaaagaggccagauugauuaggaaccugaauguuauacuagcuaaguauggccucgaugguaaaaaggacgcacgccaggugaccagcaacucccugucugggacacaagaggauggacuugacgauccacggcuggaaaaguuguggcauaaagccaagacuucgggcaaauuuucaggcgaggaacucgacaagcuguggcgagaguucuuacaccauaaagaaaagguacacgaguacaaugugcugcucgagacgcuuagcagaaccgaagagauccacgaaaacgucauuagucccuccgaucugucugacaucaaagggagcguguugcauuccaggcacacagagcuaaaggaaaagcugcggucaauuaaucagggacucgaucgucugcgcagaguuagucaucaggguuauagcacugaggcugaguuugaagaaccuagggugaucgaccuuugggaccuggcccagucugcgaacuugaccgauaaagaacucgaggcauuccgggaggaacugaagcacuuugaggccaaaauagaaaagcacaaucauuaccaaaaacaguuagagaucgcucacgaaaagcugcgacaugccgaguccgucggcgacggggagcgcgugucaagaagcagggaaaagcacgcacuacucgagggacggacaaaagaacugggcuauaccguaaagaaacaucuucaggauuugaguggucgcauuucuagagcuaggcacaacgagcuguga

SEQ ID NO: 58565 - RNA, 4185 nt, Artificial Sequence
  derived and/or modified sequence opt3 from LRPPRC__Homo_sapiens__NP_573566
auggccgcucugcucagaagcgcaagguggcuucugcgggccggcgcggcuccccgcuugccuuuaucccugcgacuacucccagggggaccgggucgucugcacgccgcaucuuaccuucccgccgcuagagcaggcccuguggccgggggacuguugucaccagcuaggcucuaugccaucgcggcaaaggagaaagacauucaggaagagaguaccuucagcucccggaagauaucuaaccaauuugauugggcccugaugcgccuggaccucucggucagaaggacaggccggauccccaaaaaguuacugcagaaaguuuucaaugauacuugccgcucaggugggcuuggaggcagccaugcuuugcugcuacuccgaaguuguggcucccugcuuccugaacugaaguuggaggaaagaacggaguuugcccacaggauuugggacacccuccagaagcugggggcaguguacgauguaucucauuauaacgcuuuacugaaaguguaccuccagaaugaguauaaguucagcccaacagacuuucuugccaaaauggaagaggcgaacauccaacccaaucgggucacuuaccagcgucugauugccuccuauugcaacgugggagauaucgaaggugcaucaaagauauugggcuucaugaaaaccaaggaccuaccuguuacagaggcuguguuuagugcccuggucaccgggcacgcucgcgccggagauauggagaaugcagaaaacauccucacugugaugagagacgccggcauugagccagguccggauacauaccuggcgcuucugaaugcuuacgcagaaaagggggacaucgaucauguaaaacagaccuuggagaagguugaaaagagcgagcuccaccugauggacagggacuuacugcagauuaucuucucuuuuuccaaggccggauauccccaauacgugucagagauacuagaaaaagucacgugugagcggcgauauauuccugaugcuaugaaccucauccugcuuuuggugacugaaaagcuggaggacguggcccuccagauucugcuugcaugcccagucagcaaagaagauggccccaguguuuucggcagcuuuuuccugcagcacugugugaccaugaauacaccuguagagaaguugacugacuacugcaagaaacucaaggaggugcagaugcauuccuuuccacugcaauucaccuuacacugugcccugcuagcuaacaaaacagaucucgccaaggcacugaugaaagcggucaaggaagagggguuccccauccgcccgcauuauuuuuggccucuuuuggugggaagaaggaaggaaaagaauguucaggguaucauugagauacugaagggcaugcaggaacucggggugcaccccgaccaagagaccuacacggauuaugucaucccaugcuucgacagcgugaacucggcucgggccauucugcaggagaauggauguuuaucugauuccgacauguuuucacaggcaggccugcgcagugaagccgcuaacgguaaccuugauuucguauugagcuuucucaaauccaauacucugccuaucucucuacagagcauaagaucaagucugcuccugggguucaggcguuccaugaacauuaaucuuuggagcgagaucacagaauugcuguacaaggacggccgguacugccaagagccccgaggaccaaccgaggccguuggcuacuuuuuauauaaccucaucgacucuaugucagauagugaagugcaggcaaaagaggaacaccugagacaguauuuccaucagcuugagaagaugaaugucaagauucccgaaaacaucuacagggggauucgcaaucuguuggagagcuaucacgugccugagcucauaaaagacgcucaucugcuagucgaauccaagaaccuggauuuucagaaaacugugcaacucacaucuucggagcuggaaagcacccuugagacguugaaggccgaaaaucagccaauccgggacguucugaaacaguuaauucucgugcuguguuccgaggagaacaugcaaaaggcgcuugaacugaaggccaaauacgagucagauaugguaaccggagguuaugcugcacuaaucaaucucugcugcagacacgacaaggucgaagaugcccugaacuugaaagaggaguucgacaggcuggauaguucugcuguguuagacacaggcaaguacguugggcucgugcgcguccuggccaaacauggaaaacuucaggaugcaaucaauauucugaaagaaaugaaggagaaggacguguugauaaaagauacuaccgcgcucagcuuuuuccacaugcugaacggcgccgcucuacgaggugaaaucgagacaguaaagcagcugcacgaagccauugugacucuugggcucgcagagccguccaccaauaucucauuuccccugguuacaguccauuuggagaaaggcgaccugagcaccgcuuuagaaguggccauugacuguuacgagaaguauaaagugcucccucggauccacgauguccugugcaaacuuguugaaaagggagagacugaccugauacagaaagcaauggauuucgugucucaagaacagggcgagauggugauguuguacgaccucuucuuugccuuccugcagacggggaacuauaaggaggcuaaaaagaucauugaaacaccaggaauccgugcgagauccgccaggcuacaaugguuuugugaucgcugcguagcaaacaaucaggucgagacccuggaaaaacuuguggagcucacucagaagcuguucgaaugugaccgggaucagauguacuauaacuuguuaaagcuguacaaaauuaauggugacuggcaaagagcugaugccguuuggaacaagauccaggaggagaaugugauacccagggagaaaacccuccgacugcuugccgaaauucugcgcgaaggcaaccaggaggucccuuuugacgugccagaauugugguaugaggaugagaagcauagucuaaauucuucuuccgcuucaacaaccgaacccgacuuccagaaagauauccugauugcaugccggcucaaccaaaagaagggggccuacgacaucuuucugaaugcgaaagagcagaacauaguuuucaaugcugaaacuuacaguaaccuuaucaaguuacugaugagcgaggacuauuuuacacaggccauggaggugaaagcauucgccgaaacgcacauuaagggauuuacccucaaugaugcugcaaacucgagauugaucauuacucagguaaggcgugacuaccugaaagaggccgucacaacccucaagacagugcuggaucaacagcagacuccgucccgccuugcggugacccgggucauccaagcucuggccaugaaaggcgacguugaaaauauagaggugguacagaagauguugaacggucuagaagauucuauugggcugagcaagaugguguucaucaacaauaucgcacucgcccagauuaaaaacaauaacaucgacgcugccauugagaauauagagaacauguuaacgucagaaaauaaggucaucgagccucaguauuuuggccuggcauaccuuuucagaaaagugauugaggaacaacuggaaccagcuguugagaagaucaguauuauggccgagaggcucgcgaaccaguucgccaucuauaaacccgugaccgacuuuuucuugcagcuggucgaugcaggaaagguggaugacgcucgagcccuccugcagcgguguggcgcuauagcagaacaaacaccuauccuucuacuguuuuuguuacgcaauuccagaaagcaggggaaagccucuacuguuaagagcgugcuggagcucauucccgaacugaacgagaaagaagaggccuacaauucccuuaugaagucauaugucagcgagaaagauguaaccagugcuaaggcgcuguacgaacaccucacagcaaagaacacuaaauuggacgaccuguuccuaaagagguacgccucucugcucaaauaugcuggagagccagugccuuuuaucgaacccccagaguccuucgaguuuuacgcccagcagcuucggaagcugcgagaaaauagcucguga

SEQ ID NO: 58566 - RNA, 1245 nt, Artificial Sequence
  derived and/or modified sequence opt3 from LRR1__Homo_sapiens__NP_689542
augaagcugcacugcgagguggaagucaucagcagacaucuccccgcccuuggccugaggaaccgggggaaaggaguucgcgcuguguuguccuuaugucagcaaaccucucgaucacagccuccaguacgugcauuccugcuaauuaguacacucaaggacaaaagagguacuagguacgagcugcgggaaaauauagagcaguuuuucacgaaguuuguggaugaaggcaaagccaccguccgccuuaaggagccgcccguggacaucugccugagcaaggcgauuuccucuucguugaaaggguuccucucagcuaugagacuggcccacaggggauguaacguugauacaccugugagcacucugaccccagucaagacaagugaguuugaaaauuucaaaaccaagauggugaucacuuccaaaaaggacuauccccucucuaagaacuuuccuuacagcuuagagcaucugcagacauccuauugcggccuuguacggguugauaugcgcauguugugucugaaaucacuacgaaagcucgaccugagucacaaucauauuaaaaagcugccagcaaccaucggugaucuuauacacuugcaagaacucaaccugaaugacaaccacuuagagagcuucucuguggcccugugccauuccacgcuccagaaaucacuuagaagccuggauuugaguaagaauaaaaucaaggcucuacccguccaguuuugucagcugcaagagcucaagaaccugaaacuugacgauaaugaacugauucaguucccuugcaagaucgggcaguugauuaaccucagguuucugucugcagcccggaauaaauuaccauuccugccguccgaguuucguaaccuaagccucgaauaccuggaccuuuucggaaauacuuucgagcagcccaagguguugccugugaucaaacugcaagcuccacucacccugcuugaaucgucugcccgcacaauacugcacaacaggauucccuauggcucccauaucauuccuuuucacuugugucaggaucucgacacugcgaagaucugcgucuguggcagauucugccugaacucauuuauccaggggaccacaaccaugaauuuacacaguguugcacauacggugguacugguggacaaccuaggagguacugaggccccaauuauaagcuacuucugcucccucggcuguuaugucaauucuagcgauaugcugaaguga

SEQ ID NO: 58567 - RNA, 1764 nt, Artificial Sequence
  derived and/or modified sequence opt3 from LRRC15__Homo_sapiens__NP_001128529
augccccuggacaaggccaugccucucaaacacuaccuucuguuguuagugggcugccaggcuuggggagcagggcuggccuaucaugguuguccaagcgagugcaccuguuccagagcgucucaagucgaaugcacaggcgcuaggaucguugccgugccgacuccccuaccuuggaacgcaaugucacuccagauucugaauacgcacauaaccgagcuuaacgaaaguccauuccugaauaucagcgccuugauugcucuccggaucgagaagaacgaacugucccgcauuacacccggggcauuucgaaaucugggaucucuccguuacuuaucgcuggccaacaauaaacuucagguauugccuaucggccuguuccagggucuagauucacucgagagccugcuucugaguuccaaccaauugcuccagauacagccagcucauuuuucucaguguagcaaucugaaggaguuacaacugcacgggaaccaucucgaauauauccccgacggagccuucgaucaccuugugggccugacuaaauugaaucuaggcaagaacucccugacccacauuucaccuagagucuuucagcaucucgggaaucuccaggugcuuaggcuguacgagaaccgguugacagacaucccaaugggaaccuucgauggucucguuaaucugcaggaauuagcgcugcaacagaaccagauuggccuacucaguccggggcuguuucacaacaaucauaaccuucaacgcuuguaucugagcaauaaccacaucucucagcugcccccuuccguguucaugcagcugccacagcuuaauagacugacuuuguuuggaaacucacucaaggagcugagccccggcauauucgguccuaugccaaauuuaagggagcuguggcuauacgacaaccacauuaguucucuccccgauaaugucuuuuccaaccugcggcaacuucagguguugauccugagccgcaaucagauuucguucaucucuccgggggcauuuaacggacucacagaacugcgagaguuaucccugcauaccaaugcccuucaggacuuggauggcaacguauucagaaugcucgcuaaucugcaaaacaucucacuacagaacaauaggcugcggcagcucccuggcaacauuuucgccaauguuaacgggcugauggcaauacagcuucaaaauaaccaguuggaaaaucugcccuuaggaaucuuugaccaccucgguaaacugugcgagcuucgucuguaugauaacccauggcgcugugacagugauauuuugccucucagaaauuggcugcuacugaaccagcccaggcucggcacggacacugugccagucugcuucagccccgcuaaugugcgggggcagucccugaucauaauuaacgugaaugucgccguuccuucugugcauguaccagaagugccgagcuaccccgagaccccuugguacccagacacacccucauauccugauacuaccagugucuccagcacaaccgagcuuacgucuccaguggaagacuacacugauuugacaaccauccaaguuacugacgaucgaucaguguggggaaugacacaggcgcagaguggccuggccaucgcagcuauugucaucgguauuguggccuuagcuuguagccucgccgcaugcguaggguguugcugcuguaagaaacgcucccaagccguucugaugcagaugaaggcucccaacgagugcuga

SEQ ID NO: 58568 - RNA, 4098 nt, Artificial Sequence
  derived and/or modified sequence opt3 from LRRC16A__Homo_sapiens__NP_001167448
augaccgaggaaagcuccgacgugcccagagagcugaucgaaucuauuaaggaugucauaggcaggaaaaucaagauuucaguuaaaaagaaagugaagcucgagguaaagggggacaaaguggaaaacaagguccuugugcugacaaguugccgggccuucuugguuacugcucgcaucccuacgaaauuagagcugaccuuuagcuaccuagagauucacggaguggucuguuccaagucugcacagaugaucguggaaacagagaaaugcucgauaucaaugaagauggccagcccagaagauguaagugagguucucgcgcauaucgguacuugucugcgaaagauuuucccgggccuuucccccgugcguaucaugaaaaaggucucuauggagccuagcgaaagacuggcuuccuugcaagcccucugggacucacagaccguggcagagcaggggccaugcggaggcuuuagucagauguaugccugugugugcgauuggcuggguuucagcuacagggaagagguccaaugggacguugauacaauuuaucugacccaggacacucgggaacucaauuuacaggauuuuucucaccuggaccaucgcgaucuuauccccauaauugcugcauuggaguacaaccagugguucacaaaacuguccucaaaggaccuaaaacucagcaccgaugugugugagcaaauccugagaguagugaguaggucuaaucggcuugaagaacuggucuuggaaaacgccgggcuccgcacggacuuugcucagaagcuggccuccgcguuagcacacaauccuaacagcggacugcauacuauuaaucucgccggcaacccacuugaggaccgaggcgugucgucucuguccauccaguucgcuaaauugcccaaggggcuaaagcaccugaaucucucaaaaaccagucugagcccuaagggaguuaacucccuuucucagagccugucagccaauccauugacagcaaguacucucgugcaccuggauuuauccgguaacguccugagaggcgacgaucuaagccauauguauaauuuucucgcucaaccgaacgccaucgugcaccuggaccuuucuaauaccgaaugcucauuggauaugguauguggggcgcugcucaggggaugccugcaguaccuugccguucugaacuugagucggacaguguucagccaucguaaaggcaaggaggugcccccuuccuuuaaacaguucuuuucuucgagccucgcacugaugcacauuaacuuauccgguaccaagcugucaccagagccccuaaaggcucuccugcuuggguuggccuguaaucacaaccugaaaggagucagucucgaccugucuaauugcgaauuacgcagcggcggcgcucaaguccuggaggggugcauagccgaaauccauaacauuacgucccuugauaucucagacaauggauuggagagcgaucucucuacucugauaguguggcuauccaagaacagaaguauucagcaccuggcacucgguaaaaauuucaacaauaugaaaagcaagaaccugacaccuguucuugacaauuuggugcagaugauccaggaugaagagucuccacugcaauccuuaucacucgccgacaguaagcugaagaccgagguaacuaucauuaucaacgcucuuggcagcaauacaucgcugaccaaagucgacauuuccgggaacggaaugggcgauaugggugcgaagauguuggcaaaagcccuccagauaaauacgaagcugaggaccgugaucugggacaaaaacaacauuacagcucagggguuccaggauaucgccguugcaauggaaaagaauuauacucuacgguuuaugcccaucccgauguacgacgccucucaagcucugaagaccaacccugagaaaacagaagaugcccuccagaagauugagaauuaccugcuucgaaaccaugagacucgcaaauauuugcaggaacaggcauacagacugcaacagggcauagugaccagcacaacccagcagaugaucgacaggauuugugucaaggugcaagaucacuuaaauucacuccggaacugcggaggcgacgcgauccaggaggaucugaaaagugcugaacgccuuaugagagacgccaaaaauuccaagacucugcuacccaaccucuaucauguagggggagcaucuugggccggugcuagcggccuguuguccucaccaauucaggagacgcuggaaagcauggccggggaggugacaaggguugucgaugagcaauuaaaggcacuccuggaaaguaugguggacgcugccgagaaucuuuguccuaacgugaugaagaaagcgcacauccgucaggaucugauacacgccucuaccgaaaagaucuccauuccccggacuuucgucaaaaauguuuugcucgagcagagcggaaucgacauucugaacaagaucucggaagugaaacuaaccguggcuucauuucugucugaccgaauaguagaugagauucuugacgcacucagucauugccaccauaagcuggccgaucacuucuccagaaggggcaagacauugccacagcaagagagccuggaaaucgaguuagcugaagagaaacccgucaagcgcucuauuaucaccguggaggagcucacugagauagaacggcuggaggaccuugauacauguaugaugacgccuaaaagcaagagaaaauccauccacucaaggaugcugcgcccaguuagucgagccuuugaaauggaguucgacuuggauaaggcacucgaggaagugccgauucauaucgaggaucccccuuuuccaagccugcggcaggaaaagcguucuuccgguuucauuucagagcuacccagugaagaggggaaaaagcuggagcacuuuaccaaacuuagaccuaagaggaauaaaaagcagcagccaacucaagcggccgucugcgcugccaacaucgugagccaggacggcgaacagaauggacucaugggccgcguugacgaggggguggaugaguucuuuacaaagaaaguaaccaagauggacuccaaaaaguggucuacacggggaucggaaagccaugaacugaacgaggguggcgaugagaaaaagaaaagagacucaaggaaguccaguggguucuugaacuuaauaaagucucgaagcaaauccgaacggcccccgacuauucugaugaccgaggaaccuucaucuccaaagggagcaguccgcagcccucccguggacugucccagaaaagauacgaaggcugccgagcacaauggcaacagugaaaggaucgaggagaucaaaaccccagacuccuuugaagagagccagggugaagagauugggaagguggagcguucugauucaaaguccaguccucaagcaggccgccgguacggaguccagguuaugggcagcgggcuccuggccgaaaugaaagcuaagcaggagaaaagagcggccugcgcacaaaagaaacuuggaaaugacgcugugucgcaggauucuuccagccccgcccugucaggcguagaaaggagugacggugggggagccggcuugccagagaaccgauucggucuaggcacaccggaaaagaauacuaaggcugagccuaaagcagaggccgggucucggucccgcagcucaaguagcacccccacauccccaaagccccugcuccagucuccuaaaccaagccuggcggcuagacccgugaucccucagaagccgaggacugccucccggccagaugacauucccgauucaccuucuaguccaaaagucgcacuuuuacccccugugcugaagaagguuccgucggacaaagaacgagauggacaaagcucuccccagccauccccuagaaccuucucacaggaggugagccgcagguccuggggccagcaagcccaggaauaucaggagcagaagcaacguaguucuagcaaagacgggcaucagggaucaaaguccaacgacaguggcgaagaggcugagaaagaauuuauauucgucuga

SEQ ID NO: 58569 - RNA, 4119 nt, Artificial Sequence
  derived and/or modified sequence opt3 from LRRC16B__Homo_sapiens__NP_612369
auggccaagcccagcguggagcugaccagagaacuccaggacuccaucaggcggugccuuucucaaggcgcuguccugcagcagcaccauguuaaauuggagacaaagccuaaaaaguucgaagaucgcguguuagcacugacuucauggcgacuacaccucuuucugcuuaaaguaccagccaagguggagaguagcuucaacguccuggaaauucgugcguuuaauacguugucccagaaccaaauacucguggagaccgagagagggaugguuucuaugaggcugccgucggcugaaucaguggaccaggucacacggcaugugagcagugcccuguccaagguaugucccggaccugguugccucauccgcagaggcaaugcagauacuccagaggggcccagggacaccucuccuaacagcgaaacauccaccucaacuacacacaguguuuguggaggcuucagcgagaccuacgccgcuuuaugcgauuauaauggucugcauugucgggaggaagugcagugggacgucgauacgauuuaccacgcagaggacaaccgcgaauuuaaucuuuuggauuucucucaccuggagucccgagaccuagcccucaugguggcugcccuggcguauaaccagugguuuacuaaacuuuacugcaaggaucugagauuggggucagaagugcucgagcaaguccugcauaccuuaagcaaaaguggaucucuggaggaacucguucuugacaaugcaggccugaagacagauuucgugcagaaauuggccggcguauuuggggagaacggauccugugugcuacacgcucugacucucagccauaauccaaucgaagacaaggguuuccugucgcuuucucagcagcuguugugcuuucccuccggccucaccaagcuguguuuagccaaaacagcaauuucaccuagggggcugcaagcucuaggacagaccuucggcgccaacccagcguuugccaguagccuccgguaucuggaccuuuccaagaauccggguuugcuggcaacggaugaggcuaacgcccucuacucuuuccuggcucagcccaaugcccuuguccaccuggacuugagcgggacugauugcgugaucgaccuccuguuaggagcacugcuacacggcuguugcucacaucucacauaucugaaccuugcccguaacaguugcucccaccgcaaaggcagagaagcuccuccagcguucaagcaauuuuucagcucugcauacaccuugucacauguuaaucugagugccacuaaacucccccuggaggcuuuaagggcccugcuucagggguugagccucaacucccaccugucugaucuacaucuggaccucucgagcugugagcugcgguccgcaggagcccaggcccuucaggaacaauugggugcugugacaugcgucggcucacuggauuuaagugacaauggguuugauucugaccuccugacccuugugccugcacugggaaagaacaagagcuugaaacaccucuuccugggcaagaauuuuaacguaaaagcgaagacgcuagaggaaauacugcacaaacucguucagcugauccaggaggaagauuguucccuucagucauugagcguggcugacucucgacugaaguuacgcaccuccauucucaucaaugcccuggguaguaacacaugccuugcaaaagucgaccugagcgggaauggcauggaggauauuggagccaagaugcuaucuaaggcucuccaaaucaacuccucacugagaacuauauugugggacaggaauaacaccagugcccugggcuucuuagauauugcacgggcucucgagagcaaucauacacugcgcuuuaugucguucccaguguccgacaucucucaggccuacagaagcgcgcccgaaaggacugaggaugucuggcagaaaauucaguggugucuugugcguaacaaucacucacaaaccugcccgcaggaacaggccuuucggcugcagcaaggguugguuacaaguuccgcugagcagaugcuccagcgacuguguggaagagugcaagaggaaguaagggcacuacgccugugcccucuugagcccguccaggacgaacuccuguaugcccgggauuugaucaaggacgcuaaaaacucuagagcccuguuccccagcuuauacgagcucggucaugugcuggcaaacgauggcccuguuaggcagcgccuugaauccguggcgucagaggucagcaaggccguggacaaagagcugcagguaaucuuggaaaguauggugucucucacccaagagcugugucccguugcuaugcgagucgccgaagggcacaauaagaugcuauccaacguggcagagcgggugacugucccacguaauuuuauuagaggagcucugcuugaacaggccggccaggauauacagaacaagcucgacgagguuaaacugagcguggugacguauuugacaucgucaaucguagaugagauuuuacaagaacuguaccacucucauaagagucucgcaaggcaccugacccagcuucgcacucuguccgacccaccugguugcccagggcagggccaggacuugagcucucggggaagaggcaggaaucaugaucacgaggaaaccacagacgaugagcuagggaccaacaucgacacuauggccauuaaaaagcaaaaacgaugucgcaagauacggccggucagcgcuuucaucuccggaucaccccaggauauggaaagucagcuggguaaucucggcaucccuccagggugguuuagcggacugggcgguucucaacccacagcguccgggucaugggagggccuuagugaguuaccuacgcauggauauaagcugagacaccagacccagggcaggccacgucccccgcgcacuacaccuccagggcccggacggccuagcaugcccgccccaggcaccagacaggaaaacgguauggcaacaaggcucgacgagggguuggaagauuucuucucccgacgggugcuggaggagucuucgagcuacccucgcacucucagaaccguuaggcccggacugucagaagcuccacuuccgccucugcagaaaaagcggcgaagaggcuuguuucacuuccgcaggccccguuccuuuaaaggugaccggggcccagggagucccacgaccggacuacugcucccuccacccccuccgccacccccuacacaagagucuccacccagcccugauccgcccuccuuaggcaauaacucaucuccaugcuggagcccugaagaggaaaguucccugcuucccggguucggaggcgguagagggccuagcuuuaggcgcaagaugggaacugagggcucugagccaggugaaggcgggcccgccccaggaaccgcccagcagccgcgagugcauggcgucgcucugccugggcucgagagagcaaaaggauggucauucgacggcaagcgggaaggucccgggccagaucaagagggauccacacaggccuggcagaaaaggcgcaguagcgacgaugcgggccccgguucguggaagccuccacccccuccgcagucuacuaagccauccuuuagcgcuaugcguagagccgaagcaaccuggcacauugccgaggagucagcucccaaucauaguugccaaucuccuucccccgcaagccaggacggcgaagaggaaaaagaggggacguuguucccagaacggacacugccugccaggaacgcgaagcuccaggaccccgcucuggccccauggccuccgaaacccguggcaguuccacgcggacgacagccuccccaagagccaggcgugagagaggaagccgaggcuggggaugccgcaccuggaguaaauaagccccggcuuaggcuaucaagucagcaggaccaagaggaaccggagguccagggcccaccugaucccggucgcagaaccgcuccacugaaacccaagaggacucggcgugcccagagcugugacaaguuggaaccugaucgccgaagaccgcccgacccaacagggaccuccgagccuggaacugauuga

SEQ ID NO: 58570 - RNA, 942 nt, Artificial Sequence
  derived and/or modified sequence opt3 from LRRC17__Homo_sapiens__NP_005815
augagaguggucaccaucguuauucugcucugcuucuguaaggccgcugagcuuaggaaagcaagccccggcuccgugcggucucgcguaaaccacgggcgagccggagguggccguagagggucaaauccugugaagagguacgcgccaggacugccgugcgacgucuauacauacuugcaugaaaaauauuuagauugucaggagcggaagcugguguacguucuacccggcuggccucaagaccuccugcacaugcuucuggcucgcaacaaaauaagaacuuugaagaauaacauguuuaguaaguucaaaaagcucaaaagccuggaucugcagcagaaugaaaucuccaagauugagucugaagccuuuuucggucucaacaaauuaacgacccugcuuuugcagcauaaucaaaucaaggugcugacagaggaggucuuuauuuauacuccacuacucucguaccugaggcuuuaugacaaccccuggcacugcaccugugaaaucgagacacugauaucaauguugcagaucccucggaaucgcaaccucgggaauuacgcaaagugcgaaagcccacaggagcagaaaaacaagaaacugcgacaaauuaagagugagcaguuauguaaugaagaggaaaaagagcagcuggaucccaagccucagguguccggaagaccaccgguaaucaaacccgaaguugacucuaccuucugccauaacuacguguuuccuauucaaacucucgauuguaagaggaaggagcuuaaaaaggucccaaauaacauacccccugacaucgugaaacuggauuugagcuauaacaagauuaaucagcuacggccaaaagaguucgaagacgugcacgagcugaagaagcucaaccuguccucaaauggcaucgaauuuauugaucccggcagucuucguuga

SEQ ID NO: 58571 - RNA, 786 nt, Artificial Sequence
  derived and/or modified sequence opt3 from LRRC18__Homo_sapiens__XP_011538131
auggugaagggcgagaaagggccgaaggguaaaaagaucacccugaaagucgccagaaacugcauuaagauaacauucgacggaaagaaaaggcucgaucuuagcaagaugggcaucacuacguuuccuaaauguauucugcgguuguccgacauggaugaauuagaccugucucgcaaucuaauccgaaagauuccagauucaaucaguaaauuccagaaccuccguuggcuggaccuucacagcaauuacauagauaagcugccggaguccaucgggcaaaugaccucuuugcucuaucugaacguuucgaauaacagacugacaucaaauggacuccccguggaauuaaagcagcugaaaaacauuagggcuguaaaucuuggcuugaaccaucuggacagcgugccuacuacccuaggugcacucaaggagcugcacgaagucgggcuucaugauaaucuguugaacaauaucccagugaguauuuccaaacuccccaagcugaaaaaguuaaacaucaaacggaauccuuuuccaaagcccggagagucugagauauucauugacagcauccgcagacuggaaaaccucuacguuguggaggaaaaggaucuuugcgccgcgugucugaggaaaugccagaacgcucgggacaauuugaaccgcauuaagaauauggccacaaccacuccucgaaaaacaaucuuuccaaaccuaaucucccccaauucaauggcaaaggauaguugggaggacuggagaauuaggcugaccagcucuuga

SEQ ID NO: 58572 - RNA, 1575 nt, Artificial Sequence
  derived and/or modified sequence opt3 from LRRC1__Homo_sapiens__NP_060684
auguuccacugcaucccccuguggagauguaacaggcauguggagagcauugacaagcggcacugcucccucgucuacguuccugaagagauauaucgcuacgcccgaucucuugaggaacuguuguuagaugcuaaucagcugcgugaacuaccagagcaauuuuuccagcucgugaaacugagaaaacuuggccugucagacaacgagauccagagguugccgcccgaaauugcaaauuuuaugcagcucguagagcuggaugugagucggaacgaaaucccugagauuccagagagcaucuccuucuguaaggcccugcaagucgcggacuuuucugggaauccccucacccgcuuaccugaaucguucccagagcugcagaaccuuacaugcuugucagugaaugauauaagccugcagagucuacccgaaaacaucggaaaucucuauaaccuggcuucccuugagcugagagaaaauuugcucacuuaccugccugacucuuuaacgcagcugaggcggcucgaggagcuugaucuggguaacaaugaaauuuauaacuugccagagagcaucggcgcccuacugcaucucaaggaccuguggcuugaugggaaucaacuguccgaauugccgcaggagauuggaaaccucaaaaaccuguuaugucuggacguuucagaaaaucgccuagagcgacuccccgaggaaaucaguggccugaccagccuuacagauuuggugauaucucagaaccugcucgagacuauuccugacgguaucgggaagcugaagaaacuuuccauucugaaggucgaucagaauagauugacccaacucccagaagcagugggagagugcgaaucacugacagaguuaguacugaccgagaaccagcuacucacucugcccaaaagcaucggcaaacuuaagaaguugaguaaucugaacgccgacaggaauaagcucguuucucugccuaaagaaaucggcggguguugcuccuuaacaguguuuuguguccgggacaaccgucugacccgcauuccagcugaggugagccaggcaacggaacuucacguguuggaugucgccggaaauagacuccugcaucuaccccugucgcucacugcucugaaacuuaaggccuuguggcugucugacaaccaaucccagccguuacucaccuuccagacagauacugacuacaccacaggugagaagauacugaccugcguucuucugccucaguugcccucagagccaacgugucaagaaaaucucccuaggugcggcgcgcuggagaaccuagugaaugauguaagugacgaagcauggaacgagcgggccgugaaucgagucagcgcuauccgcuuuguggaagaugagaaagacgaggaagauaacgagacuagaacacugcucaggcgggccacuccccacccaggggaacugaagcacaugaaaaagaccguugagaaccuucgcaaugacaugaacgcagcuaagggauuggauuccaauaaaaacgaagugaaucaugccauugacagagucacaaccucuguguga

SEQ ID NO: 58573 - RNA, 555 nt, Artificial Sequence
  derived and/or modified sequence opt3 from LRRC20__Homo_sapiens__NP_001265141
augcugaagaaaaugggcgaggccguggcuagagucgcaaggaagguuaacgaaaccguggagagcggguccgacacacucgaucuugccgaaugcaaacugguaucuuuccccaucggaauuuacaagguguugcggaaugucucaggucagauacacuuaaucacucuggcgaacaaugagcuaaaaagucucacgagcaaguuuaugaccacauucucccaacugcgcgaacuucaucuggagggcaacuuuuugcaccgacucccuucugaggugucggcucugcagcaucugaaggccauugaccucucacguaaucaguuccaggauuuuccagaacaauuaacugcacugccggcccuugagaccaucaacuuggaagagaaugagauuguugacgugcccgucgaaaaacuggcugcaaugccugcccuaagaagcaucaaccucagguucaauccacugaacgcugaggugcggguaauagcgcccccucuuaucaaguuugauaugcugaugaguccagaaggggcccgcgcacccuugccuuga

SEQ ID NO: 58574 - RNA, 1005 nt, Artificial Sequence
  derived and/or modified sequence opt3 from LRRC26__Homo_sapiens__NP_001013675
augagaggccccagcugguccaggccucggccacugcuccuucuguuguuacugcuaucuccguggcccgugugggcccaggucucagcuaccgcaaguccuagcgggucccucggagccccagacugccccgagguuuguacaugcgugccugguggccuggcgucuuguucggcucuuucacugccagccguacccccuggguugagccuccgccugcgagcacugcucuuagaucacaaccgugugagagcccugccaccgggagcuuucgcaggcgccggugcccuucaaagguuggaccugcgggaaaaugggcuacauaguguccacgugcgcgcuuuuuggggacucggcgcgcugcagcuucuggauuuguccgcaaaccagcucgaggcccuggcucccggcacuuucgccccuuuaagagcacugaggaaucucucucuugcugggaaccggcuggcccgcuuggaaccagcggcccuaggagcacugccccuccugcgaagccuuucccugcaggacaaugaguuggcugcccucgcuccuggucuguuaggcagacugccagcccuagaugcacuccaucugagggggaaccccuggggaugcggcugugcccuucggccguugugcgcuuggcugcgucgccacccucuccccgcgucagaagcagagacgguucuguguguguggccagguagacuuacccugaguccuuugacagccuuuagcgacgcugccuucucucauugcgcacaaccccucgcccugagggauuuagcugucguguacacucuggggccagccuccuuucuaguaucacucgcaagcugucuggcgcuuggaaguggcuugaccgcuugccgggcccgacgcagaaggcugcggacagcagcccucagacccccucgcccaccggaccccaauccugauccagacccccacggcugugcuucuccugccgauccagggucccccgcagcugccgcgcaggccuga

SEQ ID NO: 58575 - RNA, 906 nt, Artificial Sequence
  derived and/or modified sequence opt3 from LRRC30__Homo_sapiens__NP_001099051
augggcgccagacagagcagggcuuccucuaaggacaaagggcccaagcggaugcuguucaccggacgccgacaaaaauuuucaccuugggaugacgcacuccuuaguggucgugauccaagaagccuguugaagaggggcaugcaccauguguccuucucuuuagucacacgggggaugacugacaucccggauuuucuguggggacuaucggagguucagaaacucaaccugucacacaaucagcuucgcgugcugcccccugaaguaggcaaguugacgagaauugugguccucaaccugugcgguaauaggcucaagagccugccacgggaggugaguuuacugcagugucuuaaaguuuuguucgugaacaugaauugccugaccgaaguccccgccgagcuaucccucugucgcaagcuggaagugcuuucucugagccauaacugcuugucccaacucccugcguguuuugcugaccugucacgauuaagaaaacugaaucucaguaacaauuucuuugcccacauaccaaugugcguauucagccuuaaggagcugaucuuuuugcauguugggucuaacaggcuagagaauauugcagaauccauccagcaccuggccucacuccagauuuucaucgcugagggaaacaauauacacagcuuuccccggagucugugucuugugacaucucuggaauugcucaaccugaauaacaacgauauccagacuuuaccuuccgagcugcaucuacucugccgucugguccgcauugcauggaauccaauggacaaaggccuucacaucagccauaacccguugucgaagccccugccugagcucguggaaggcgggcuggagaugcuuuucggauaccugaaggauaaaaagcacaccuga

SEQ ID NO: 58576 - RNA, 1989 nt, Artificial Sequence
  derived and/or modified sequence opt3 from LRRC32__Homo_sapiens__XP_005273959
augagaccccagauccugcuccuucuggccuuguuaacccugggccuagcugcacaacaccaggacaaggugccuugcaaaauggucgauaagaaaguuagcugucaggugcucgggcugcuucagguaccauccgugcugccgcccgacacagagacuuuggaucucucuggaaaccaacugaggucaauucuggccaguccucucgguuucuacacggcguuacggcaucuggaccuuagcaccaaugaaauauccuuuuugcagccaggcgcuuuccaggcccugacacaccuagagcaucucucucuggcacacaaccgccuugccauggcuacugcacugucggccgggggauugggcccccucccucgagucaccucacuggauuuaagcgguaauagucuguauuccgggcuccuugaacgucuguugggagaggcuccaucucuacauacacugagccucgccgaaaacucccugaccagacuuacuaggcacacauuucgggacaugcccgcgcuggagcaguuggaucuccacucaaaugugcugauggacaucgaggauggcgcauucgaaggcuuaccucgccugacccaucuaaaccucaguagaaauagccugacgugcauuucugacuuuucccuucaacaguugaggguucuggaucucucauguaacagcaucgaggccuuccagacugcuagucagccacaagccgaauuucagcugaccuggcuugaccugcgggagaauaaguugcuccacuucccggaucuggcagcuuuaccccgccugauuuaccuaaaccucucuaauaaccugauccgacuuccuacagggccaccccaggacuccaaaggaauacaugccccuagcgaggguuggucggcguugccacugucugcccccuccggcaaugcaucagggagaccgcucagucaacuguuaaaccuggaccuuagcuauaaugaaaucgaguugauuccugauuccuuucucgaacaccugacuucucuaugcuuccugaaccucagcaggaacugucugcggaccuuugaggcucgucgccuuggaucauugcccugccugauguuacucgaccugagucacaaugcccuugaaacacuggaguugggcgcuagagcccucgguucccugaggacccuacugcuccaggggaacgcacugcgggaucuuccaccuuacacguucgccaauuuggcuagccugcagcgauuaaaccuccagggaaaucgcgugucucccuguggcggcccagacgagcccgggccuucaggaugcgucgcguuuagugguaucacuagccugagaucccuuucucugguggauaacgaaauugagcuacucagggcaggcgccuuccugcauacaccauugaccgaacuggacuuaucgagcaauccggggcucgagguagcuacuggagcccugggcggucuugaagcaucccuggagguuuuggcccuccaagggaacggccugauggugcuacaggucgaucugcccuguuucaucugccuuaagcggcucaaucuggcugagaaccgcuugucacacuuaccugccuggacacaggcagugaguuuagaagugcucgaccugagaaauaacucuuuuagccuucugccaggauccgcgaugggcggguuggagaccucacucaggcgucuguaucuacagggaaauccccugagcuguugcgguaacggcuggcuugcugcccaacuccaucaggggcgggucgauguugacgcaacgcaggaucugauaugccgauucucuucccaggaagaggugaguuugagccacguaagaccugaagacugugagaagggaggccugaaaaauauuaaccugaucauuauccucaccuuuauccuggugucugccauucuucugacaacuuuggcugccugcuguugcgucaggcgccaaaaguucaaccagcaguacaaagcauga

SEQ ID NO: 58577 - RNA, 5103 nt, Artificial Sequence
  derived and/or modified sequence opt3 from LRRC37A__Homo_sapiens__NP_055649
augagcuccgcccagugccccgcucuggugugugucaugucuagacucagguucuggggcccuuggccacuucugauguggcaauuguuauggcugcuaguuaaggaggcacagccgcucgaaugggugaaagacccccugcagcuuaccucaaacccucuggggccacccgagaguuggagcucccacucuucgcauuuuccucgggaaucaccacacgcccccacauugccugcggauccaugggacuucgaucaucucggaccgagcgcuaguuccgagaugcccgccccuccacaggaaucuacugagaaucugguacccuuucuggacacgugggauagcgccggugaacaaccucucgaaccagagcaguucuuagcaucccagcaggaccugaaggauaaacuuucaccccaagaacgcuugccggugaguccuaagaaacugaagaaggaccccgcucagcgauggagccuagcagagaucauuggcauaacccgucagcucucuacaccacagucccaaaaacagacucugcagaacgaguacucaagcaccgauacaccuuaucccgggagucuuccacccgaacugagagucaagucugacgagccuccaggaccguccgaacaagugggccccagccaguuucacuuggagccugaaacccagaauccagagacucucgaggauauccagucgucuucccugcaacaggaagcccccgcucaguuaccucagcugcucgaggaggaaccaucaaguaugcaacaggaagcccccgcgcuuccgccugagagcuccauggagucucugacauugccaaaccaugaaguuagcgugcagcccccuggugaggaccaggcauacuaucaccuacccaauauuaccgucaaaccagccgauguggaaguaacgaucacuucagagccuaccaacgaaacagagaguucccaagcucagcaggagacucccauucaguucccagaagagguugaaccgagcgccacccaacaggaggcaccuaucgagcccccagugcccccuauggaacacgagcugucuauaucagaacagcaacagccaguccagcccagugagagcccuagggaaguggaguccucuccgacacagcaagagaccccagggcagcccccugaacaucacgaggugacggucucgccacccggacaucaccagacucaccaucucgcuagcccuuccguuucagugaagccgcccgacguacagcugacaaucgccgcggaaccaagugccgaggugggcaccucucuuguccaccaagaagcaacuacacggcugagcggcuccgggaaugacguggagccucccgcuauucagcauggagguccaccuuugcuccccgagucaagcgaagaggccggcccacuggcuguucagcaggaaaccucuuuucaauccccggagccuaucaacaaugaaaaccccaguccaacgcagcaggaggccgcagccgagcacccccaaaccgcugaagagggggaaagcucuuuaacacaucaggaggcgccugcacagacuccagaguuccccaauguggucguggcccagccuccggaacacucccaccugacccaagcuacaguacagccacuagaucucggauuuacuauuacccccgagucaaaaacagaaguugagcugaguccuaccaugaaggaaacucccacgcagccaccuaagaaaguggucccccagcuucgcguguaccaaggcgucacaaacccaaccccuggucaggaccaggcccagcauccggugagccccucgguuacugugcaauugcuggaucucgggcugaccaucacaccagagccuaccacugagguaggacacuccacacccccaaagagaacgauagucucuccuaaacaucccgaagugacccuuccgcacccagaccagguucagacucagcacagccaucugacaagggcaaccgugcaaccuuuggaucucggcuucacaauuacucccaagucaaugaccgaggucgaaccaaguacggcccugaugaccacagcucccccuccgggccaccccgaggugacuuuaccaccuuccgacaaagggcaggcccagcauucucaccugacccaagcaacaguacagccccuagaucucgaacugacuaucaccacgaagccuacaaccgaggugaaaccaagccccacuacagaggaaaccuccacucagccuccagaccuuggauuggcgauuauccccgagccgaccacagaaacgggucauucaaccgcucuggagaagacuacagccccucggccagaucgcguucagacccuccaccgaagccugacagaagucacuggacccccuaccgaguuagagccagcacaagacagucuggugcagucugaauccuauacgcagaauaaggcccuuacagcucccgaggaacacaaagccagcaccucgacuaacaucugcgaguuguguaccugcggggaugagaugcucucauguauugaccugaauccggaacagagacuaaggcaagugccuguccccgagccaaacacacauaacggaacuuuuaccauacugaauuuccagggcaacuacaucucuuauauugacgguaauguuuggaaggcauacaguuggacagaaaaacucauccugcgggagaacaaucuuacggaauugcacaaggauuccuuugaggggcuguuaagccuccaguaccuggaccuuucuugcaacaaaauacagagcauugagcgucauaccuucgaaccucugcccuucuugaaguuuaucaaucucuccuguaacgugaucacugagcugucauucggcacauuucaggcuuggcacggaaugcaguuccuacauaagcugauucucaaucacaacccacugaccacuguggaagaucccuaucuuuuuaaauugccugcccugaaguacuuagacaugggcacaacccucguaccacugacgacucuuaaaaauauccugaugaugaccgucgagcuagaaaagcucauucugccgagucacauggcgugcuguuugugccaguucaaaaacagcauagaggccguguguaagacaguuaagcugcauugcaauucugcuugcuuaaccaacacuacacacugucccgaggaagcauccguggggaauccugagggagccuuuaugaaaguccuccaagcucgcaagaacuauaccucaacagaacugaucguggagccagaggaacccagugauagcuccgguauuaaccuuucuggcuucgggucggagcagcuggacacuaaugaugaaagcgacuuuaucucaaccuuguccuacauccucccuuauuucagugccguuaaccuggaugugaaaucucuacugcuuccauuuauuaagcuccccacgacaggaaauagccuggcaaaaauacagaccguaggccagaacagacaaagggucaagcggguguugauggguccucgauccauccagaagcgccauuucaaagagguggggagacagucaauuaggcgggaacagggcgcgcaagccucugucgagaaugcugccgaggaaaagcgccugacuagcccggcaccaagagagguugaacagccccacacccagcagggaccugagaaauuagcuggcaacgccguguacacaaagcccaguuuuacucaagaacacaaagcagccguauccgugcucaagccauucagcaaagggaccccuucuacgucaucccccgcuaaggcgcugccacaggucagggaccguaguaaggaucuuacacaugccaucagcauucuggagucggcaaaagcucgggugaccaauacuaagacaucuaaaccgaucguucacgcccgaaagaaauauagauuccauaagaccaggucccacgugacucaucgcacaaccaaggucaaaaagagcccuaaagugcggaagaaaucauacuugaguagacucaugcuggccaacaggcuacccuuuucugcugcaaagucccugauaaauagcccaucacagggagccuucaguagccuuggugaccucagcccccaagagaacccuuuucuggaaguuucugcguugagcgagcacuucaucgaaaagaauaacacgaaacacacuaccgcucgcaaugccuuugaggaaaacgauuucauggagaauacaaacaugccagagggcaccauuuccgaaaacacaaauuacaaccaucccccugaggcagacucagccgggacugcuuuuaauuuaggaccgaccgugaagcaaacggaaacaaaaugggaguauaacaaugucggcacugaccugucuccagaacccaagaguuucaacuacccucuccugucgagcccaggugaucaguuugagauccagcuuacccaacagcugcaguccuugauucccaauaacaauguacgacggcuaaucgcacacgugauacguacacugaaaauggacugcucuggggcccauguucaggugaccugugcgaagcucauuucaagaacuggccaccugaugaaacuuuuaagcggacaacaggaggucaaggcuuccaagaucgaaugggauaccgaccaguggaaaauugagaacuauaucaaugaaaguacagaggcccagucugagcaaaaggagaaaucccuggagcucaagaaagaagugccuggcuacggguauacggauaaguugauacuggcacucaucguaacuggcauucugaccauccuuauuauccuguucugcuugauagugauuuguugccacaggcgcucacuacaggaggacgaagagggcuuuucccgggguaucuucagauuucugcccuggaggggguguaguagccgacgcgagucucaggauggacucuccucauucggccagccauuaugguucaaggaccuguacaaaccgcuuagcgccacacggaucaacaaucaugcuuggaagcugcacaaaaagucgucuaacgaagauaaaauucucaauagagacccuggugauagugaggcccccaccgaagaggaagaguccgaggcauugccauga

SEQ ID NO: 58578 - RNA, 2844 nt, Artificial Sequence
  derived and/or modified sequence opt3 from LRRC37B__Homo_sapiens__NP_443120
augagcuggcugagauucuggggccccuggccucuccuuaccuggcagcuguuguccuuacuggugaaggaggcccaaccacuggucuggguuaaagacccgcuccagcugacaucuaacccccuugggccuccagaacccuggucaaguaggagcucccaccuaccuugggagucuccacaugcucccgcaccuccagccgcgccgggagauuuugacuacuugggucccucggcuucaagccagaugagugcccucccucaggaaccaacugagaaucuggcacccuuccugaaggaacucgauuccgccggcgaguuaccucuggggccagagcccuuucuugcugcacaccaagacuugaacgauaaacggacgccggaggaacgccugccugaagugguaccccuacucaaucgagaccagaaccaggcccuggugcagcuuccacgucugaaguggguccaaaccacagauuuggacagagcugccggacaucaggcggaugagauccucgugccucuggacucuaaaguuagcaggcccacuaaguucguggucuccccaaagaauuuaaagaaggaucuggcagagcgguggucacuccccgaaauugugggcauaccucaccagcuuaguaaaccacagcgccaaaagcagacccugccggacgauuauuugagcauggacacacuauaccccgguucucugccuccagagcucagaguaaacgccgacgaacccccugggccacccgagcagguuggacugucccaauuucaucuugaaccgaaaucacagaauccugagacccuggaggauauccagagcaguucuuugcaggaagaggcuccagcccaacuccugcaguuaccccaggaaguggagccuuccacucagcaagaagcacccgcucugccaccugagagcucgauggagucucuagcccagacaccccucaaccacgaagucaccgugcagccaccgggcgaggaccaggcgcacuauaaucugccuaaguucacggugaagcccgccgaugucgaaguuacuaugaccuccgagccaaagaacgaaacagagucaacucaagcacagcaggaggcucccauucagccuccagaagaggccgaacccaguagcaccgcucuuaggacaaccgacccuccgccagagcaucccgaggugacguugccuccauccgauaagggccaagcccagcacucucaucugacugaagcaacaguacagccccucgaccuggagcuuagcaucaccacugaaccuacaaccgaggugaaaccgucacccacgaccgaagagacaagugcccaaccaccugaucccgggcuggcuauuacuccagagccuaccacagaaaucggacacuccacugcguuggagaagacccgggcaccccacccagaccagguccagacacuccaucgcagccugaccgaagugacugguccgccuacgaaauuagagucuucacaggauagucugguucaaagcgaaacagcccccgaggagcagaaggcuuccaccucuacuaauauaugcgaacuauguaccugcggcgacgagacacucucguguguggggcugagcccaaaacagcgacuuagacagguccccgugccugaaccagauaccuacaacggaaucuuuacuacauugaauuuccaaggcaacuauauuuccuaccuggacgguaauguauggaaggccuauucauggacggagaagcucauccugagugaaaacuacuuaaccgagcugcccaaagacucuuuugaggggcuuuuguaccuccaguaucuggaucuaagcugcaacaagauuagguacaucgaacggcagacuuucgagucccugccuuuucuccaguauauaaaucugggauguaaccuuauuacaaaauugucacugggcaccuuccaagcauggcacggcaugcaguuuuuacauaaucucauccugaaccguaauccgcuuacaacuguugaagacccauaccuguucgaguugcccgcccucaaguaucuggauauggggaccacgcacauuacccuaacaacucugaaaaacauccucaccaugacaguggagcuggaaaaacuuaucuugccuagccauauggcuugcugucugugccaguucaaaaauucuauugaggccgucuguaaaacugugaaguuacacugcaacaccgcaugucucacaaauuccauacacugccccgaagaggcgagugucggaaacccagaaggugcuuuuaugaaaaugcugcaagcccgcaagcagcauaugagcacgcagcuuaccaucgagucugaggcaccuuccgacucaaguggcauuaaucugagcggguucggaggcgaucagcuagaaauccaacucacugagcagcugagaucguugauacccaacgaagacgugaggaaauuuaugucccacguuauucggacacugaagauggagugcucugaaacccaugugcaggguagcugugccaaguuaaugcuccgaacugggcugcuuaugaaacuguugucagagcagcaagaggcuaaggcccucaauguagaaugggauaccgaccagcagaaaacaaacuacaucaaugagaacauggaacagaacgagcaaaaggaacagaaaaguuccgagcugaugaaggaggucccaggcgaugacuauaagaauaaacuaaucuucgcaauuucugugacgguuauccugauuauacuuaucauuaucuuuugccucaucgaagugaacagccacaagcgcgcuuccgagaaauacaaggauaauccuucaauuagcggagccuga

SEQ ID NO: 58579 - RNA, 1008 nt, Artificial Sequence
  derived and/or modified sequence opt3 from LRRC39__Homo_sapiens__XP_011538980
augaccgagaacguggucugcacaggcgccguuaaugcugugaaggaaguaugggagaaaagaaucaagaaacugaacgaagaccucaagagggagaaagaauuucagcacaaacuugugcggauuugggaggagcgcgucagccugacuaaguugcgagaaaaggugacgcgugaggaugggagaguuauauuaaagaucgaaaaagaggaguggaagacccugcccuccucucuacucaaacugaaucaacuucaggaauggcagcugcauaggacaggauugcucaagauuccugaguucaucggucgguuccagaaccugauugugcuggaccucucacgcaauacuaucagugaaauaccaccgggcaucggguuacugaccagacuucaagaguugauucugagcuacaacaagaucaaaacaguccccaaggaacuauccaauugugcaucucucgagaaacuggagcuugccgugaacagggauauuugcgaccugccucaggaauugucgaaucuccugaaguuaacccaccuggaucucucaaugaacgacuuuacuacaaucccacuugcgguacugaauaugcccgcuuuggaguggcuagauaugggaagcaacaaacuggaacagcucccugacaccauagagcggaugcagaaucugcauacgcuuuggcugcaacgcaacgaaauuacuuguuugccacagaccaucaguaauaugaagaaccucggcacacugguuuuauccaacaauaaacugcaggauauucccgugugcauggaggagauggccaaccuacgauucgucaauuuuagagacaacccucucaagcugaaggugucucuuccaccgagcgaagguacugaugaggaagaggaaagggaguuguucgggcugcaguuuaugcacaccuauauccaagagucccggcgucgcgcagaccaucaggugaauggaucaacaacccuccccaucaguauuaacacggauggcuga

SEQ ID NO: 58580 - RNA, 2061 nt, Artificial Sequence
  derived and/or modified sequence opt3 from LRRC49__Homo_sapiens__NP_060161
augauccccggcaaguacagaagcguguccgggagggccgcuaacaaugucaacugcggacugcaccucguuauucagaccucuucacuuccugagaaaaauaagguggaguucaaacugaacaaggacacaaguagcuuuccaggucgguuguuacaacaugaucuggagcgcaauuauuccucucgacagggcgaccacauaaaccuaguaucgucaagccucaguuccuucccgauccugcagcguucuagcgaagagaaaauucuuuacuccgauagacugucauuggaaaggcagaagcucacugugugucccaucauuaauggggaggaccaucugcggcugcucaacuuucaacacaauuucaucacgcgcauacagaacaucaguaauuuacagaagcugauuagccuugauuuguaugacaaccagaucgaggaaauuucuggacuguccacccuaagaugccucaggguccugcuucugggcaaaaaucggaucaagaaaauaucaaacuuggagaaucucaagagccuggauguguuagaccugcaugguaaccaaauuacaaaaaucgaaaacauuaaucaccucugugagcuucgcguucugaacuuggcacgaaauuuucuaagucacguggauaaccugaaugggcucgacucucugacugagcuuaaccugagacauaaucagaucaccuucgucagggauguggacaacuugccuugccuccagcaccuguuuuuauccuucaauaacaucagcucguuugauucuguauccugucuggccgacucaaguagccuauccgacauuacauucgauggaaauccaauagcgcaggaaucuugguacaagcauaccguucuccaaaacaugaugcagcugcggcagcuugacaugaagcguaucacugaggaagaacgcagaauggcuagcguguuggccaaaaaggaagaggagaaaaagagggaaucacacaaacaaagucugcucaaggagaaaaagcggcugacaauuaauaacgucgcacgacagugggaucuucagcagcaacgcguggccaauaucgcuaccaacgaagacagaaaggauuccgacagcccccaggauccuugccagauagacggcucuacgcugucagcauuuccagaggaaacuggccccuuggauagugggcucaacaaugcccugcagggauuaagcgugauugacaccuaucuggucgagguugauggugacacacuaucccucuacggcucuggggcucuggagucgcuugacaggaacuggagcgugcaaacugccggaaugaucaccacaguauccuucaccuuuaucgaguucgaugaaauugugcaggucuugccuaaacugaagaucaaauucccaaauucacuccaccugaaguuuaaagaaacgaacuuagugaugcugcagcaguucaaugcgcuugcacaauugcggcgcauugaccagcucacuauagauccgcagggcaaccccguugugaauuuuacacuguggaaguauuacguccuauucagacugagucauuuuucuaugcagaagaucaacgguaccgaggugacucaaaaugacaugauuauggccgaacgucucuucgggauccuggcucacguagccagcuccgagcuuccucaguacagguugaucucaauucugggagaugcacggaaaaagcaguuucgauauuuacucgagagcaaaggcaagaaaccaggcauaaucaacgaagagaauaacgacucuaagagacugguuggggaaaauacaaacagggcuacccuuaauuacacgacccgcgauuucuauaacgagaagcuggaggaaauuaaagagaagaaaaaguuuuguaaaacauacaucgaagacuuggugaaggaggccacugaaauuaacaugaagaaugaggcgcuccaaaaacuguggccccagauguucaucgagcuaguccgggaugccgugauagaaaucagaaacaaaaauuccuauaugaagcugugccuccagcagauuaccgaccaaaaguga

SEQ ID NO: 58581 - RNA, 2142 nt, Artificial Sequence
  derived and/or modified sequence opt3 from LRRC4B__Homo_sapiens__XP_011525822
auggccagagcuaggggcagccccugcccuccacugccgcccgggcggauguccuggccucacggagcacuccuuuuccugugguuguuuucuccacccuuaggugccggcgggggaggcguggcggucaccucagcugccggugggggaaguccuccagcaacaagcugucccguugccugcuccuguucuaaccaggcuucgcgcgugaucugcacucgacgugaccuggcagagguaccugccucaauuccagugaauacgagauaccuaaaccuccaagaaaauggcauacaggucaucaggaccgauacauucaagcaucugcggcaccuugagauucugcaguugagcaaaaaccucgugcgcaagaucgaaguuggcgcuuuuaaugggcugccgagucugaacacucucgaguuauucgacaauagacugaccacagugcccacccaggccuuugaauaucuuuccaaauugagggagcuguggcuacggaacaauccuauugagucuaucccaagcuacgcguucaaccgcguccccucccuccgaagacuggaucuuggagaacugaagagguuggaguauauaucagaagcagccuuugagggucucgugaaucugcgguacuuaaaccugggcauguguaaucucaaagacaucccuaaccuuacugcucugguacguuuggaggaacuagagcugagugggaaucgccucgaucugauuagaccaggcagcuuccaaggacuuacaucucugaggaaguuguggcucaugcaugcccagguugcaaccaucgaacggaacgcuuuugacgaucugaaguccuuagaggaacugaaccuaucacacaauaaccucaugagccugccccaugaccuuuucacgccguugcaccgacuggagcgcgugcaccucaaucauaacccuuggcacugcaauugugauguccuguggcuuaguugguggcugaaagagacugugcccucuaacaccacaugcugugccagaugccaugcgccagccgguuugaaggggagguauauuggagaacucgaccagucccacuuuacuuguuacgcaccugugaucgucgagcccccaaccgaucugaauguuacagaaggcauggcugccgaguuaaaaugccggaccggcacgagcaugacuucggugaacuggcugacacccaaugggacccuaaugacucacggaucuuaucgcguaagaauauccgugcuccaugacgguacacugaacuucaccaaugucacggugcaggauaccggccaauacacaugcaugguuacuaacucagcugggaauaccacagccagugcaacucuuaacgugagcgccgucgacccuguggcugcgggaggcaccgguuccgggggcggaggcccagggggaucugguggcguagggggaggcagcgguggguacacauauuuuaccacuguuacgguggaaacauuggagacccagccgggcgaggaagcacugcagcccaggggaacugagaaggaaccuccaggccccaccacagacggggucuggggagguggccguccuggggaugccgcuggaccagccucaaguuccaccacugcacccgccccgcggagcucucgaccuacagagaaggcuuucacggugccaauuaccgacgucacugaaaaugcccucaaagaucuggacgaugugaugaagacaaccaaaaucauuaucggcuguuucguugcaaucacauuuauggcggcugugauguuaguagccuucuacaagcugagaaaacagcaccaacuucauaagcaccauggucccacuaggaccgucgagauuauaaacguggaggacgaauugccugcagccucagcuguuaguguggccgcagcugccgcggucgccagcgggggcggagugggcggggauucccaccucgcucugcccgcacuagagcgcgaccaccugaaccaucaccauuauguagccgcugccuuuaaagcacacuacucuucgaauccaagcggaggcgguugcgggggaaagggcccucccggucucaacuccauccacgaaccacugcuuuucaaaucaggcaguaaggagaaugugcaggagacgcagauuuga

SEQ ID NO: 58582 - RNA, 1923 nt, Artificial Sequence
  derived and/or modified sequence opt3 from LRRC4C__Homo_sapiens__NP_001245348
augcugaacaagaugacccuccacccccagcaaaucaugauuggcccuagauucaauagggcccuuuuugacccacuguugguggucuuacuggcucuacagcuccugguuguggcagggcuuguacgggcccagacaugcccgagcguguguuccugcucuaaccaguucucaaaagucauaugugugcgcaagaaucugcgagagguucccgauggaaucaguacuaacacgcguuugcucaaucugcaugaaaaccaaauucagaucauuaaagugaauagcuuuaagcaccugagacaucucgagaucuuacagcuguccaggaaccacauacggaccaucgaaauuggugcguucaauggccuugcuaacuugaauacacuggagcuauuugacaaccgccucacuaccaucccuaauggggccuucgucuaccugucuaaacuuaaggaacugugguugagaaacaauccaauugagucgauccccucauaugcauuuaacaggauaccuagccuccggcgccuggauuuaggagagcugaagcgacucaguuacauuuccgaaggcgccuucgagggucuuucuaaccugagauauuugaaucuagcuaugugcaaccugagggaaaucccaaaucucacaccccugauuaaacuugacgagcuggauuugagcgggaaccaucucuccgcaauccggccuggaucauuucagggccugaugcacuuacaaaagcuguggaugauccagagucagauucaggugauagagcguaaugccuucgacaaccuacaaagccucguagaaaucaaucuggcucacaacaaucuuaccuugcugccacaugaucucuuuacuccgcugcaccaucuugagcgcauucaucugcaccacaaccccuggaauuguaacugcgacaucuuguggcucucuugguggauaaaagauauggccccuuccaauacagcguguugcgcaagauguaacaccccacccaaucugaagggcagguacauuggggaauuagaccagaacuauuucacgugcuacgccccuguuaucguggagccacccgcugaucugaacgucacugaaggaauggccgcagagcuaaaaugucgggcuucaaccagccucacaagugugucuuggaucacuccgaaugguaccgugaugacacacggcgccuauaagguccgaauugcgguucuguccgacgggacccuuaacuuuacgaaugugacuguacaggauacaggaauguauaccugcauggugagcaacucggucggcaauacuacagccucugcaaccuugaacgugacggcugccaccacaacuccuuucuccuacuucucaaccguuacaguggagacuauggaacccagucaagacgaggcucgcaccacagacaauaacgucgguccaaccccugugguagauugggaaacuacgaauguuacaaccagccugacuccccaguccaccagaucuacagagaagaccuuuacuaucccagugacagacauuaacagcgggauacccggaaucgaugaagucaugaaaacgaccaagauuaucaucggcugcuucguggccauuacucucauggcagccgucaugcuggugauauuuuacaaaaugaggaagcagcaucaccggcagaaucaucacgcuccuacacgcaccguugagaucauuaacguggacgaugagaucacaggcgacacuccaauggaaucacacuuaccgaugcccgcgauugagcaugaacaccugaaucauuacaacaguuauaaauccccuuucaaucacaccacgaccguaaacacaaucaacagcauacacucuucaguccaugagccacuuuugaucagaaugaauaguaaggauaacgugcaagaaacucagauuuga

SEQ ID NO: 58583 - RNA, 1962 nt, Artificial Sequence
  derived and/or modified sequence opt3 from LRRC4__Homo_sapiens__XP_011514763
augaagcugcucuggcaagugaccguccaccaucacacauggaacgccauccuucugcccuucguuuacuugacugcucagguguggauuuuaugcgcagccauagcggcugccgcaagcgccggcccucagaauuguccauccguaugcucuuguucaaaccaguuuaguaaaguggucugcacgagaagggggcugagcgaggugccgcagggaauccccuccaauacccgguaucuaaaccucauggaaaauaacauucaaaugauccaggcugacacauuccgccaucugcaccaucuugagguucugcaguugggucgaaauucuauucgucagaucgaagugggcgcauuuaacgggcucgccucgcugaauacucuggagcuuuucgauaacugguuaaccgucauaccuucaggagcuuuugaauaccugagcaagcucagagaguuguggcugaggaauaacccaaucgagaguauucccuccuaugccuucaaucgggugccuucucuaaugcgccucgaccugggcgaacuuaaaaagcuggaguacaucagcgaaggugcguuugagggguuguucaaccucaaauaucugaauuuaggaauguguaacauuaaggauaugccaaaccugacaccccucguaggccuugaggaacuggagauguccggcaaucacuuuccugaaaucagaccagggucauuccacggauugaguagccuaaagaaacuguggguuaugaacucucaagugucccucauagagaggaaugcauuugacggucuggccucacuugucgaacugaacuuggcucauaauaaccucagcagucugccgcacgauuuauucacuccccugcgguaccuaguggagcuccaucugcaccacaauccuuggaacugcgacugugauauucuuugguuggccugguggcugcgcgaguauaucccaacuaauucuacaugcuguggccgaugccaugcacccaugcacaugagagggagguaccucguggaagucgaccaggcuuccuuucaguguagcgccccuuucauuauggaugcgccacgggaccugaacaucucggagggacguauggccgaacuuaagugccgcacgcccccgaugucuuccguuaaauggcuguugccuaauggcaccgugcucucacaugcaaguagacaccccaggaucagcguacugaacgaugguacuuuaaauuucucccaugugcugcuaucugacaccggggucuacacaugcauggugacuaacguugcuggaaauagcaacgccucagcuuaucucaacgugaguaccgccgagcugaauacauccaacuacagcuuuuucaccacggucacuguggaaacaaccgagauuucuccagaggauacuacacggaaguauaaaccuguacccaccacgucaaccggcuaccagccagcauauacaaccaguaccacaguucuuauacaaacuacccgagugcccaagcaggucgccgugccugcuacagacaccacugacaagaugcagacgagcuuggaugaagucaugaaaacaaccaagaucauuaucggcuguuuuguggcgguuacucugcucgcagccgcuaugcugauaguguucuacaaauuacgcaagagacaccaacagagguccaccguaacagccgcacggaccgucgagauuauccagguggacgaagauaucccagccgcuacuucugccgcagcgacagcugccccgucggggguuagcggagagggugcagugguccugcccacgauucacgaccauaucaauuauaacaccuacaaaccugcccacggcgcucauuggacugaaaauucccuugggaacucauugcacccaacagugaccacaauuagugagcccuacauaauccagacucacaccaaggauaaaguacaagagacgcagauuuga

SEQ ID NO: 58584 - RNA, 942 nt, Artificial Sequence
  derived and/or modified sequence opt3 from LRRC52__Homo_sapiens__NP_001005214
augagccuggccuccggccccgggccuggauggcuccuuuucucuuuugguaugggccuggugucagggaguaagugcccaaacaauuguuugugccaggcucaagaggucaucuguaccggaaaacaguuaacagaauacccgcuggacauuccccuaaacacuagaaggcuguuccucaaugagaaccggauaacgagccuuccugcaaugcaccugggcuugcucuccgaucugguuuaucuggacugccagaauaaccgcauccgagaagugauggauuacaccuuuauugguguauucaagcucaucuauuuagaccugucuucgaauaaccuuacaucaauuagcccauuuacuuucaguguguuguccaaucugguccagcuaaacaucgccaauaacccccaucuccugucucuucacaaauuuaccuucgcgaauacaaccagccugcguuacuuggaucucagaaacacugggcugcaaacauuagacuccgcugcccuguaucaucucaccacgcuugagacucuguuuuugucaggaaauccuuggaaguguaacugcaguuuccuagauuuugcaauauuccugaucguguuucacauggacccaagcgaugaccucaacgccaccuguguugaacccacagagcugacuggcuggccuauuaccagggugggcaauccacuucgguacaugugcaucacacaucuggaucacaaagacuauauuuucuugcuccugaucggguucuguauauuugcugcaggaaccgucgccgcuugguuaacgggugugugcgccguacuguaccagaacacucgccacaagucuuccgaggaagaugaggacgaagcgggcacaagaguugaggugucaaggcggauuuuccagacccagacuagcaguguccaagaguuuccgcagcuaaucuga

SEQ ID NO: 58585 - RNA, 924 nt, Artificial Sequence
  derived and/or modified sequence opt3 from LRRC59__Homo_sapiens__NP_060979
augaccaaggccggcagcaaagggggaaaccugagagacaagcucgaugguaaugagcuugaccuguccuugucugauuuaaacgaagugcccgucaaagagcuggcugcacuaccuaaggccacaauccucgaccugucaugcaauaaacuuacuacgcugccaagugauuucuguggcuugacccaccucguuaagcuggaccugagcaagaacaaacuccagcaauuaccggcggauuuugggaggcuggugaaucuucagcauuuggaccugcuaaacaauaagcucguaacacugcccguguccuucgcucagcuuaaaaaccugaagugguuggaucucaaagacaauccucuggauccagucuuagccaagguggcaggagacugccuggaugaaaagcaguguaaacaaugcgccaacaagguucuccagcacaugaaagcugugcaggcagaccaggagcgggaacgccaacgacgucuugaggucgagagagaagccgagaagaaaagggaagcuaagcagcgggccaaagaggcgcaggagcgcgaacugagaaagagggagaaggcagaagagaaagaacggcgccgaaaggaguacgacgccuugaaagcugccaagagagagcaggagaaaaagcccaagaaagaagcaaaucaagcuccuaagucuaaaucgggcucaaggccacggaagcccccuccacguaaacauacucgcagcugggccgugcuaaagcugcuccugcuucuguugcucuuugguguagccgggggacugguugcguguagagugaccgaauuacagcagcaaccgcugugcacaagugucaacaccauuuaugauaaugcagugcagggccuaaggcggcacgagauacuccagugggugcugcagacugacucccaacaguga

SEQ ID NO: 58586 - RNA, 780 nt, Artificial Sequence
  derived and/or modified sequence opt3 from LRRC61__Homo_sapiens__XP_011514822
auggaucccccugccgagaagccaggcgaagcugggggacugcagaucaccccgcaacuccuuaaaagcagaacaggugaguucucccuggaaucuauuuuguuacugaagcuaaggggccucgggcuggcagaccuuggaugccugggcgaguguuugggucucgaauggcuggaccugucagggaacgcccucacucacuuaggaccccuggcgagucuucggcaguuggcugugcugaaugucagcaacaaucgccuaacgggccucgagccucuggcaaccugcgagaaccuucagucccugaaugccgccggcaacuugcucgcuacaccagggcagcugcaauguuuagcaggacugcccugccucgaauaccuucgacugcgugauccuuuggccagacuaucuaauccacugugugcuaaccccucguauugggccgcgguuagggagcuccugccuggucuuaaagugauagacggcgaacggguaaucgggcgcggaucagaguuuuaccagcugugcagagauuuggacagcagucucaggccauccucuagcccgggcccccgggcaacugaggcccagccuuggguggaaccagguuauugggaguccuggcccucacgcaguagcucuauucuggaagaggcuugucgacaguuccaagauaccuuacaggaaugcugggaccuggauagacaggccuccgacucacuagcacaggcugagcaaguccucagcagugccgggccuacaucuuccuuuguguucuga

SEQ ID NO: 58587 - RNA, 1764 nt, Artificial Sequence
  derived and/or modified sequence opt3 from LRRC63__Homo_sapiens__NP_001269389
augcagaagcccccucugcuccuuagaaggccacugccgcccaaauucaccaaguugagcuuacacgagaaaaagacacauacugccaaaacgggcaagaucgaaucccugcacguggcuuuuaccgaggacgaaacaacuucuauuaagauggaucggacccgcuucccugacguccuacgaaaccaaucacucacaccaauaaauauccagaacauuuuucuggaucauugcguucaggagcgugugaccgcaaucaguagcccccagaaauccacuaagcacguaagagaacaaauuccugacacagccaccgggucuaucuucuuuccacauuguaauucggcgucaacgaggauauucggaaaacagacuaacaagauggagagcagucggaaauuuaagaccaugaaggauguguacacagagaaacgccuugaaaauauccugauuuuguccucuaaguucagcaaacccaaguccacuccugguucagucaucgcucagaaacucgagaagaugcacccaaaacaccagccgcugcccgaaaguccuggcuauaccuaccaacauauuagcagagaccugucugccacagugccaucacccccuccaaugaccguuuccaugaagcccgaggggcaguggccggagcacuuuaagagcacggcaacucucacauuaagggugaccgaguucccuggauuugucagucugcccacuccagugcuuccucggaaaccccaucgccagucuguaaucgagacauugguuaccgaaaacggcaauauagaguccgugccaaagcagauucccccucgaccaccggaaggucugacgaaaaccgagaagaucgagagcgaaauucacgucgugagaggggagggauucaaaacaguggccgcuacuagguaugaaaccaucacagcaaugacuaaccuagccaucgucaauugccaaguuuacggccggaacgcucucaaucugaagggcuuuuucauucuuaacugucccgaucugaccccuuuggccuuccagcucauauaucugaauuuaucguuuaacgaccugcacuacuucccaacagagauccucugccuuaagaaucugcagauuuugaaacuacguaacaaccccaucaaggaaauaccuucugagauucaacagcuggaguuucuccgcaucuucaccaucgcguuuaaucugauuacugugcuuccaaucgggcuguucuccuugucauaucucgaagaacuggauguaaguuacaacgaauuaacguuuauucccaaugagauacagaaacugagaagccuagaaaagcucacaguggacggaaacgagcuguccuucuuuccgcaugguauccuuaaauugaaucugaccaagauucaguucgagaacaauuuuacucacccuuguuucuggagggauaacuaccucaauaacccacaacagcugacccagaucaucucucuuuuuauuguccagaauaagcugcauaaauucuaugacaagauacccguggaaguucaaaaauugcucaagugcacaagccggugugaguggugccacggcccuaaauucggggaaggauuucgagugauccgcucaugugauauuuucggcgcaagucagcugcccgucauguuuuacgugugcuccccaagcuguuauagaaggaucaaggagucuucauucguauuagacgguaguccuagccggcgcauugcccuggacguugagcuauccaaggaacucuga

SEQ ID NO: 58588 - RNA, 1044 nt, Artificial Sequence
  derived and/or modified sequence opt3 from LRRC69__Homo_sapiens__NP_001123362
augaccgagagacugcucaucaaggcccuuagcggcgggaaaaacacaaagauuauaacucugaaugguaaaaagaugacgaaaaugcccuccgcuuugggaaaguuaccuggccugaagacccuagugcuccagaacaaucugaucccaaaagucugcccggaacuuuguaaccugacacaauugacuacccucaaucuggggaacaaucugcucgaggaaguucccgaggaaaugaaguacuuaacaucucugaaaaaccuucacuugucaggaaauaggauuugccgguucgcaccuggcgccugugacggucugcagaaccuaauccuccugaaucuuaacaauaaccaucugacccaguugccacaggaggugagucgccucaagagccugacuuauauguccauuaauuacaaccaauuagcgucuaucccccgagagcugugcuuucucgaaaaccuuguagagcugcaguugaauuauaaccagcuaauauguaucccugaagagauuaaauuccugaagaagcuccagaaacugcuucuggcucguaauaacaucgggguguugccagaggaacucugcgaucugaagaaauuaaggauucuggacaucgccggaaauauaauucaaaucuuucccucgggcuuccaggaucuaaagcucagagaguuuuacugugaaggcaacccucuguuccuucagcagccagucauuucaacacaacaggagaauguguggagcuugcaggaaaucaccagucgguuuguuaugaaccaacuggcagagaauaacccguuccucauggacgauaucgagcgcuauccccaggugagauccaugauuucucaggggaaaacgugcgccauauguggacaguacuuuaucacugucuggcuggaaugcgugagguucguaccuccacccaaggacuggaaaauuagcaagaaucuuaagcugguuccuuugcaagugcucaucuguuccuauaaaugcuuuacccagcgggauccaaaccuguucgguauagcucaggucuga

SEQ ID NO: 58589 - RNA, 1401 nt, Artificial Sequence
  derived and/or modified sequence opt3 from LRRC6__Homo_sapiens__NP_036604
augggcuggaucaccgaggaccugauuagaaggaacgccgaacacaaugauugcgugauauucagccucgaggaacuuucccugcaucagcaagagaucgaacgguuggagcacauugacaaguggugucgcgauuuaaaaauccuguaccuacagaacaaucucauugggaagaucgagaacgucucuaaacugaagaaacuugaauaucugaauuuggcucucaacaauauagagaagaucgaaaaccuggagggaugcgaggaacuggcaaagcucgacuuaacaguuaauuuuauuggugagcugucaaguaucaaaaaccuucagcauaauauucacuugaaggaacuguuccuaaugggcaaccccugugccagcuuugaucauuaccgagaguucgugguagcgacucucccucagcugaaauggcuugacgggaaggaaaucgagccauccgagcguauaaaagcucugcaagauuauucugugauugaaccgcagaucagagagcaggaaaaggaccacugcuugaagagggccaaacucaaggaggaagcacagcggaaacaccaagaggaggauaagaaugaagacaaacgcucgaacgccggauuugauggcagaugguacacggacauuaaugcuacccugagcucauuagagaguaaggaucaucugcaggcacccgacacagaagaacacaacacuaaaaagcucgacaacuccgaagaugaccuugaguucuggaauaagccuugucuguuuaccccagagucuagguuggaaacacuacggcauauggagaaacagcgcaagaaacaggaaaagcugagcgagaaaaagaagaaagucaagcccccucgaacccucaucacugaggaugguaaagcccugaacgugaaugaaccaaagaucgacuucucccuuaaagauaacgagaagcaaauuauacuggacuuggcuguuuauagauacauggauacaucacucaucgacguggauguccagcccaccuaugugaggguaaugauuaaggggaaaccuuuucagcugguuuuaccagccgaagugaagccggacaguagcucugcgaaacggucccaaacgacuggacaccuggucaucugcaugcccaaggugggcgaggugauaaccggcgggcagcgugcauucaaaucaaugaagacaacuagcgaucgcaguagagaacagaccaauacaaggucuaagcacauggagaaacuagaggucgacccuuccaagcauagcuuuccagacguuaccaacauugugcaggagaaaaagcacacgccccggcgacgcccugagccaaaaaucauccccucggaagaggauccgacuuucgaagacaauccugagguacccccacucauuuga

SEQ ID NO: 58590 - RNA, 1467 nt, Artificial Sequence
  derived and/or modified sequence opt3 from LRRC74A__Homo_sapiens__NP_919263
augcacauccaguuccccagcaagccuacccugccaagagccugcugggagggcaggauuacagcuggguccccgggaaugcccccugacgaaauagagaucgaaccagugcggcaaucuucagauaaaaugcucuacugugaggcagaaagucccccuacugucgagaagguuaaaccagcccgcgagaacagcgaaacggaccuugagauugaagaugacgagaaguuuuucaccacaggucagaaagagcuguauuuggaagcgugcaaguuaaugggcgugguacccguguccuacuuuauccgaaauauggaggaaucuuaugucaaccugaaucaucacgggcuaggaccucguggcacuaaggcuauugccaucgcacucgugucgaacauggccguuaccaaacuggagcuugaagauaauuguauaauggaggagggugugcugucauuggucgaaaugcuccaggagaacuacuaucugcaggaaaugaauaucagcaacaaucaucuggggcucgagggagcuagaauuaucagugacuucuuugaaaggaacuccucuagcauuugguccuuagagcugucaggcaaugauuucaaggaggacagugcagcccuuuugugccaagcucugagcacaaacuaccagaucaaaaagcuagaucucucucacaaucaguuuuccgacgugggcggggaacaucugggacagaugcuugccauaaacguaggucugaccucauuggaucucagcuggaauaacuuccacacucggggcgcgguugcacuguguaacggguuacgcggaaaugugacacugaccaaacucgaccuuaguaugaacggcuuugguaaugaggucgcccuggcuuugggggaagugcuaagacugaacaggugccucguguaucuggauauuggaggcaaugacaucggcaacgagggggccucuaagauuuccaagggacuugaaagcaaugagucgcugcgggucuugaaacucuuccugaacccaaucaauauggacggugcaaucuuacugauucuagcuauaaagcgcaacccgaaaucucgaauggaggaacucgauaucuccaauguucuggugucagagcaauuuaugaagacgcuugacggcguauacgccgugcacccccaguuggaugucguguucaaagcgguucaggggcugaguccuaagaaaacuauuuuucuccugaccaacccaaugaaacuuauccagagcuacgccgaccaacauaagauaacaauuguggauuucuucaagucccugaaucccacuggaaccaugaagaugucugucgacgaauuucagaaagugaugaucgagcagaacaagguaccuuugaaucaauaucagguuagagaggugaucaaaaagcucgaugaaaagacaggcauggucaacuucagcuuucugaacaccaugaaaccauga

SEQ ID NO: 58591 - RNA, 4944 nt, Artificial Sequence
  derived and/or modified sequence opt3 from LRRC7__Homo_sapiens__XP_011540138
auguggauggagaaccugaucagaggcaggaaucccccucaguaccaacggagcccaugcaaggaagugcgcgccgcucuccgaaaacguccggaggaagaacuucagugucuggaaaugaccacaaagagaaaaauuauagggagguugguccccugccgguguuuccgcggagaggaggaaaucauuuccguuuuagacuauucucacugcucacugcaacaggugccuaaggagguauuuaacuucgaaagaacucuagaggagcucuaccuggaugcaaaucagaucgaagaacuuccaaaacagcuguuuaacugucaggccuugaggaagcucaguauucccgacaaugaucugagcaaccugccuacgaccaucgcgucccucgugaauuuaaaggaacuggacauaucuaaaaacgguguccaggaguucccagaaaauaucaagugcuguaaaugccuuacaauuaucgaggcuucggugaaccccauuucaaaguugccugauggcuuuacucaacugcuaaaucucacccagcuguaucuuaacgacgccuuccuggaguuuuugccagcaaauuucgggcggcucguuaaacugcgcaucuuagaacugcgagagaaccaucucaagacacuucccaagagcaugcacaaacuggcccaguuggaaagacuagaucugggaaauaacgaguuuggcgaacuccccgaggugcuggaccagauacaaaaccuuagggagcuguggauggauaauaacgcuuugcagguccucccugguaguauugggaagcugaaaauguuaguguaccuggacauguccaagaaucggaucgaaaccguagauauggacauuucuggaugugaggcacuagaagaucuccugcuuagcuccaacauguugcagcaacugccagacucaaucggccuccugaaaaagcugacuacacuuaaaguugacgauaaucaguugaccaugcuccccaacacgaucggcaaucugaguuuacuggaggaguucgacugcagcuguaacgagcuagagucucucccuuccacuauuggguaucugcauucacuucguaccuuggccguggaugaaaauuuucugccagagcucccccgcgaaauaggaagcugcaagaacgucacagugaugagucugagaucuaauaaguuagaguuccugccggaggaaaucggucagaugcagaaacuuaggguguugaaccucuccgacaaucggcugaagaaccuaccuuuuagcuucacuaaacugaaggagcucgcugcccuguggcuuucggauaaucaaucuaaagcguugauuccccugcagaccgaagcacacccagagacaaagcagcgagucuuaaccaacuacauguucccucagcaaccccgcggcgacgaagauuuucaguccgacucagauaguuucaacccaacgcucugggaggagcagagacagcaaaggaugacuguugccuuugaguucgaggacaagaaagaagaugacgagaaugcugggaaggugaaagaccugagcugccaggcccccugggaacggggacagcgcggcaucacacuucagccugcaagacuguccggugauuguugcaccccaugggcuaggugugaccaacagauacaggauaugccgguaccccaaaacgacccucaguuggccugggggugcauuucuggacuccagcaggagcguagcauguguacuccacugcccguggcggcccaaucaacaacccuaccuagucuguccggccggcaggucgagaucaaucucaagcgauauccaacgcccuacccggaagaucugaaaaacauggucaagagcguucagaaucuugugggcaagccuucucauggggucagaguggagaacucaaauccaaccgcaaacacagaacagacuguaaaagagaaguacgaacacaaauggcccguugcuccuaaggagaucaccguggaggacaguuuuguccaccccgccaaugaaaugaggauuggagaguugcauccaagccuggcugaaacaccuuuauaucccccaaaacucgugcugcuugguaaggauaagaaagaguccacugacgagucugaagucgauaagacccacugccugaacaauucggugagcuccggcacauacucagacuauaguccgucucaagccagcuccgggucaagcaacacccgcguuaaagugggaucucuacagacuacggcaaaggaugccguacauaauucccucuggggcaaccggaucgcuccuaguuucccccagccacuggacagcaaacccuugcugucucagagagaggcggucccuccagguaauauuccccaaaggccugaucgcuuaccgauguccgacacauuuaccgacaacuggacugaugggucacacuacgacaacaccggcuucguggcagaagagacaaccgccgaaaaugcuaacaguaauccacuccugagcucgaagucccgaucuacuagcucacacggacggcguccccuuauaagacaggauaggaucguuggcgugccucuggaguuggagcagaguacacaucgccacacgccagaaaccgaggugcccccuuccaacccguggcaaaauuggacucggacacccucuccauuugaagacagaaccgccuucccuagcaaacucgagacaacucccaccacguccccacugccugaaaggaaggagcauauuaaggagucaaccgaaauccccagcccauuuaguccgggggugccuugggaguaucacgauucuaaccccaaucgaucccuaagcaacguauucucgcagauccauugucgcccagaaucaucuaaaggagugauuaguauauccaagagcacagagcggcugucuccccuuaugaaagacaucaagagcaauaaauuuaagaagucccagucaauugaugaaaucgacauugguacuuacaaaguuuauaacaucccucucgagaauuacgcaaguggcagcgaucaccuggggucucacgagagaccagacaagauguugggacccgaacauggcauguccucaaugaguaggagccaguccgucccuaugcuggaugacgagauguuaaccuacgguucuucgaaagggccgcaacagcagaaggccagcaugacuaaaaagguguaucaguucgaucaaucauucaacccacagggcuccguggaagucaaggcugagaaacguauacccccucccuuucagcacaauccagaguacguucagcaagccaguaagaacaucgcaaaagaccucauuucuccucgcgcguaucggggauacccgccaauggaacagauguucagcuuuucccagccuucagugaaugaggacgcugugguaaacgcccaguucgcaucucaaggcgccagagcuggguuucugaggcgagccgauagccuugucagugcaacagaaauggcuauguuccggcgcgugaacgagccgcaugaacugcccccaaccgacagauauggaaggccucccuaccgggguggcuuggaucgacaguccagcguuacggugacagagucucaguuucucaagagaaaugggcgcuaugaggacgaacacccaucauaccaagaggucaaagcccaggcgggauccuucccugugaagaaccugacccagaggcguccccuaagugcccggagcuacucgacugaaucuuauggcgcuucccagacaagaccgguuagcgcaaggccaaccauggccgcucugcuugagaagaucccuucagauuacaaucucgguaacuauggggacaaacccagugauaauucugaccugaagacucgcccaacccccgugaaaggcgaagaguccugcggaaagaugccugccgauuggcgacaacaguuguuaagacacauugaggcacggaggcuggaccgcaacgcggccuacaaacauaauacaguaaaccucggcaugcugccguaugggggaaucagcgcuaugcacgccggccguucaaugacgcuuaaucugcagaccaagaguaaauuugaucaucaggaauugccccuacaaaagacuccaagccagcaguccaacauacuggacaauggucaggaggacgucucuccuagcgggcaauggaaccccuacccucucggaagacgggaugugccacccgacacaauuaccaagaaagcaggcucccacauccagacacugauggguucacagucucuucaacauaggagucgcgaacagcagccuuaugagggcaauauuaacaaggugacuauccagcaauuccagucgccauuacccauacagaucccgagcucccaggcuacccgagggccucaaccaggaagaugucugauucagacgaaaggccagcggucuauggauggguaccccgaacaguuuugcgucaggaucgagaagaauccuggacucggcuucucaauuagcggugggaucuccggacaaggcaacccauuuaaacccagugacaaggguauauucguuacacgcgugcagccggauggcccugccucuaauuugcugcagcccggggacaagauucuccaggcaaacggacacagcuucguacacauggagcaugaaaaagccgugcugcuucugaagucauuucaaaacaccgucgauuuggugauccagcuauucccacugagaggccucuuauuugggcugaauguugagaaagcguccggaagugaaaagaaacuuaucacuguggacccucacuacagcuggguccuguaucuccagaccuguuugcugacaaagguguacacucccaagucuaugugcggcaccuccgagguuauucauaaacaagcucagaggucaaagaaacucgagagcccacacggucaugugccccgguga

SEQ ID NO: 58592 - RNA, 2433 nt, Artificial Sequence
  derived and/or modified sequence opt3 from LRRC8A__Homo_sapiens__NP_062540
augauccccgugaccgagcugagauacuucgccgacacacagccugcuuauaggauucucaagccauggugggaugucuuuacugacuacauaagcaucguuaugcuuaugauugcaguguucggcgggacgcugcaaguaacccaggauaaaaugaucugcuugccguguaagugggugacaaaagacuccugcaacgauucuuuucggggaugggccgcgcccgguccugaaccaacuuaucccaauucaaccauuuuaccuacaccagacaccggccccacugggaucaaguacgaucuggaccgccaccaguauaacuacgucgaugcuguguguuaugagaaucgacuacauugguucgccaaauacuuuccuuaccucguucugcuucacacacugauauucuuggcaugcaguaacuuuugguucaaguuuccacguaccagcuccaagcucgaacauuucgugucuauccugcugaaauguuuugacucgccguggacgacuagagcccucucagagaccgucguggaagagagcgaucccaagccugcuuucaguaaaaugaauggauccauggacaagaaaucuagcacaguauccgaggauguugaagcaacugugccaauguuacagaggaccaagucacggauugagcaaggcaucgucgaccgcagugaaacaggugugcuggacaagaaagagggggagcaggccaaggcucuuuuugaaaaagugaagaaauucagaacccacgucgaggaaggagauauuguuuauagguuguacaugcggcagacgaucauaaaggugauuaaauucauccugauuaucugcuauacuguauacuaugugcauaacaucaaguuugacgucgauuguacaguggacauugagagccuaaccggcuaccgcacuuaucgaugcgcccacccccucgcgacacuguucaagauacuugcaucuuuuuacaucucccugguuauuuucuacggcuugaucuguauguauacccucugguggaugcugagaaggucacugaaaaaguacagcuuugaaaguauacgggaggagucuuccuauagcgauauuccugacgugaaaaaugauuucgccuuuaugcugcaccucaucgaccaguacgauccacuuuauucgaagcguuucgcugucuuucugucugaaguguccgagaacaaauugcgccaacuaaaucugaacaaugaauggacgcucgacaagcugagacagaggcuuaccaagaacgcccaggauaaacuggaguugcaucucuucaugcugucagggauccccgacacaguauuugacuuaguugaacuggaggugcuaaagcucgagcugauuccggaugucacuaucccucccaguauugcacagcuuaccggauugaaagaacuguggcucuaccacacagcugccaagauagaggcgccagcccuggcauuccuucgggaaaaucugcgagcuuugcauaucaaauuuacugacauuaaggagaucccucucuggaucuauagccugaagaccuuagaagaguuacaccuaacagguaaccucuccgccgagaauaaccgcuacauugugauagauggccugagagaacuuaaaagguugaagguccugcggcucaaaucuaaccugagcaaguuaccccaagugguuaccgacguggggguacaucugcagaaacuuucaaucaauaacgagggaacuaaguugauuguccucaauagucugaagaaaauggcuaaccuaacggaacuggagcucauccgcugcgaucuggagaggauuccacacuccaucuucagccuucacaauuugcaggaaauagaccugaaggauaacaauuuaaaaacaaucgaggaaauuaucucuuuccaacaucuccacagacugaccugucuuaagcugugguacaaccauauugccuauauccccauacagauuggcaauuugacuaaccucgagcgucuguaccuaaaucggaacaaaaucgaaaagauuccuacccagcuguuuuauugccgaaaacucagauaccuggaccuuucacacaauaacuugacauuccugccagcagauaucgguuuacuccagaaucugcaaaaccuugccauaaccgcuaacaggaucgagacucugccgcccgagcuauuucagugccgcaagcuccgggcgcugcacuuggggaauaacgugcugcagaguuuaccuagcagaguuggagaacucacaaaucugacgcagauugagcuuaggggcaaccgccuggaauguuugccaguggagcucggcgaaugcccccugcuaaagcgauccgggcuggucguggaggaggaccuuuucaauacccucccuccagaaguaaaagagcggcuguggcgugcagauaaggaacaagccuga

SEQ ID NO: 58593 - RNA, 2412 nt, Artificial Sequence
  derived and/or modified sequence opt3 from LRRC8C__Homo_sapiens__XP_011540584
augauccccgugaccgaguucagacaguuuagcgaacaacagccugccuucaggguccugaagccauggugggacguuuuuacagauuaccucuccguggcuaugcuuaugauuggcguauucgggugcacucuccaggugaugcaggacaaaauaaucuguuugccgaagcggguccaacccgcacagaaccacucuucauuaaguaaugugagccaggccguugcguccacgaccccucugccacccccuaaaccaucucccgcuaacccuauuacaguggagaugaagggacuaaaaacugaucucgaccugcagcaauauucguuuaucaaucagaugugcuacgaacgcgcccuucauugguaugcaaaguacuucccauaucuggucuugauucacacccucguguuuaugcuguguucaaacuucugguuuaaguucccggguagcaguuccaaaaucgagcauuuuauaucuauccugggcaagugcuucgauagccccuggacaacccgagcccucuccgaaguaucaggggaggacagugaggaaaaagauaaucguaagaacaauaugaacagaagcaauacuauucagucuggaccugaggacuccuuaguuaacucacagagccugaaaaguaucccagaaaaguuuguggucgauaagucuacagcuggcgcacuugacaaaaaggagggugagcaagccaaagcucuguucgaaaaggugaaaaaguucaggcugcacguggaggaaggggauauucuauacgccauguauguccggcagaccguucucaaagugaucaaguuucugauaauuaucgcguacaauuccgcacuuguaagcaaggugcaguucacggucgacuguaacguggauauucaagacaugacuggauacaaaaauuuuucgugcaaccauaccauggcccaccuguucucuaaguuguccuuuuguuaucucugcuucguuucaaucuacggccugacauguuuauauacucuguacuggcucuuuuaucgcagucuuagagaguacagcuucgaauaugugaggcaggagaccggcaucgacgauauucccgacgucaaaaaugauuuugcuuucaugcugcacaugauagaccaguacgauccuuuguacuccaagcgguuugccguguuccuaucugagguaagcgaaaacaaacugaagcagcucaaccugaauaacgaguggacaccagacaaacuucgccaaaaacugcagaccaaugcacauaaccgauuggaacucccccugaucauguuaucagggcugccggauacgguuuuugagauuacugaacuacagagucucaagcuggagaucauaaagaaugugaugauuccugcuacaaucgcccagcuugacaacuugcaagagcugucccuccaccagugcagcgucaagauccauucugcggcccugucauuccuuaaagaaaaucugaagguguugagugucaaguucgaugacaugagagagcugcccccauggauguauggacugaggaacuuagaagaguuguaccuaguggguagccucucccacgauauuucucggaauguuacccuggaaucgcuucgugacuugaaaagccugaagauccucuccauuaaaucaaacgugaguaagauaccucaggcaguagucgacgugucuagccaucugcagaaaauguguauccacaaugauggcacuaaguuaguuaugcugaacaaucuuaagaaaaugacaaacuugaccgagcucgagcuggugcacugcgaccuagaacgcauuccccaugcugucuuuucccugcucucacugcaagagcuugauuugaaggaaaauaaccugaaaagcaucgaggagaucgugucuuuccagcacuuaagaaagcucacgguacugaaacuuuggcauaacuccauuaccuauauaccagaacacaucaagaaacugacaaguuuggagaggcucagcuuuucucacaauaagauugaagugcugcccucccaucuauuccugugcaacaagauccgguaccucgaccugucauauaaugauauucgauuuaucccuccagagauagggguucuucagaguuugcaguacuucagcaucacuuguaacaaagucgaaucgcugccggacgaguuauauuuuugcaagaaacucaagacccugaaaauuggaaagaacucccuuucugugcugagccccaagaucggcaaucuacucuuccugucauacuuggaugugaaagguaaucacuuugagauucugccuccagaauuaggggacugucgcgcccucaagagagcuggacuggucguugaggaugcccuuuucgaaacacugcccagugacgugagggagcaaaugaaaacugaauga

SEQ ID NO: 58594 - RNA, 3099 nt, Artificial Sequence
  derived and/or modified sequence opt3 from LRRCC1__Homo_sapiens__NP_208325
auggaggccgcugcagccguggucgcggcugaagccgagguugaaaacgaggacggcgauagcuccugcggggacguguguuucauggauaagggacugcagucuaucucagaacucagucuugacagcacccugcacgcaguaaauuugcauugcaacaauauuuccaaaauagaggccaucgaucacauuuggaacuuacaacaucuggaccuaucuucgaaucagaucucaagaauugagggucucaacacacugacuaaacuuuguacgcugaauuugagcugcaaccucaucaccaaaguggaaggccuggaggaacugauaaaucucacaagguuaaacgucaguuacaaucacaucgaugaccuguccgggcuuauucccuugcauggaaucaagcacaaacugcgguauauugaucuacacucuaaccgcaucgacagcauacaucaccuccugcaguguauggugggccuucauuuucugacuaauuugauucucgagaaggauggugacgauaacccuguuugccgacugccaggguaccgugcugugaucuuacagacccugccgcaacucaggauucuugacuguaagaauaucuucggagagcccgucaaccugacagaaaucaacuccucacaguugcagugccuagagggccugcucgacaaucuggugaguagcgauucuccucuuaacauuuccgaagacgagauaaucgauagaaugccaguaauuaccgcacccaucgacgaacugguuccuuuggagcaguuugccucaacuccaagcgaugcugugcucacaaguuucaugucugucugucaauccagcgagcccgaaaagaauaaccacgagaaugaccugcagaacgaaauaaaguuacagaaacuggaugaccagauucuacaacuccugaaugagaccucgaacucuaucgauaaugugcuugaaaaggacccucggccaaaacgcgauacggacaucacuuccgagucagacuauggcaacagaaaggagugcaauaggaaggugccgcggcgcaguaaaauucccuacgaugccaagaccauccagacaauuaaacaccauaacaagaauuauaacagcuuugucuccuguaaucgaaaaaugaagccuccauacuugaaagaacuguauguuucuagcucacucgcgaacugccccaugcugcaggagagugaaaagccuaagacugagauaaucaaaguggaccaaucccacagcgaagauaacaccuaccagucucuuguagagcagcuggaccaggagagagaaaagagguggcgggcagagcaagccgaaaauaaauugauggauuacauugacgagcuccauaagcacgcuaacgagaaagaagauauccauucacuggccuuacugacaaccgaccgucuaaaggagaucauuuuccgcgaaagaaauaguaaggggcagcucgaggugaugguccacaaacugcagaacgaaauaaagaaacuuacgguggaguugaugaaggcaaaagaucagcaagaggaccaccugaagcaucucaggacucuggaaaagacauuagagaaaauggaacggcagaagcgacagcagcaagcugcccagauccgccugauucaggagguugaacuuaaagcgagcgccgcagauagagagaucuauuugcucaggaccucccugcaccgggagcgcgaacaggcucaacagcuacaucagcugcucgcccugaaggagcaagaacacagaaaagagcuugaaacuagggaguuuuucacagacgcugauuuucaggacgccuuggcaaaggagauugccaaggaagagaaaaagcacgaacagaugaucaaagaguaccaggagaagauagacgugcugucucaacaguauauggauuuagaaaaugaguuccguaucgcucucaccgucgaagcgcggcgauuucaggacgugaaagauggauucgagaacguagcaacggaacuggccaagucgaaacaugcucuuauuugggcccagagaaaggagaaugagagcuccucacugaucaaggacuugaccugcaugguuaaagaacaaaagacaaaacucgcagaggugaguaagcugaaacaggaaacugccgcuaaccuacagaaucagauuaacacccuggagauccucauagaagaugacaagcaaaagucuauucagaucgagcugcuuaaacacgagaagguccaguugauuagcgaacuggccgcaaaagaguccuuaaucuuuggucucaggacagaacgcaagguguggggccaugagcuggcgcaacaggggucaagccuugcucagaaucggggaaaacuggaagcccagauagagucucuauccagagagaacgaaugucucaggaagacuaaugagagugauagcgacgcacugcgcaucaagugcaaaauuaucgaugaccaaaccgaaacaauucgaaaguugaaagauugucugcaggagaaggacgagcacaucaaacgguuacaggaaaagauaaccgagauugaaaagugcacucaggagcaacucgaugaaaaaucuucccagcuggacgagguccuugagaagcuggaacgucauaacgagagaaaagaaaaguugaaacagcagcucaagggcaaagagguggaacuggaggagaucaggaaggccuacucaacgcuaaaucgcaaguggcacgacaaaggugaacugcuuugucaccucgagacacaaguuaaggaagugaaagagaaguucgaaaacaaagagaagaagcugaaagcugagcgggauaagaguaucgaauugcagaaaaacgccauggagaagcugcauagcauggacgaugcauucaaaagacagguagacgcuauugucgaagcccaccaggcggagaucgcccaauuagcuaaugagaagcagaagugcauugauucggcaaaccucaaagugcaucagauagaaaaggagaugagggaacugcuugaggaaaccuguaaaaauaagaaaacuauggaggccaagaucaagcaacuggcuuuugccuugaacgagauucagcaggacauguga

SEQ ID NO: 58595 - RNA, 1923 nt, Artificial Sequence
  derived and/or modified sequence opt3 from LRRFIP1__Homo_sapiens__NP_001131022
auggacaugggcacccaggggagcggaagaaagaggcugcccaaccgggagcgccucacagccgaagaugacgcucuuaaucaaaucgcacgagaggccgaagcgcgucuggcugccaaaagagcagccagggcugaggcacgggaaauucgcaugaaggaguuggagagacagcagaaagaaauauaccaggugcaaaagaaauauuacgguuuagauacuaaguggggcgacaucgagcaguggauggaagauuccgagagguauucucggcgcucacgaagaaacacgagugccagcgacgaggaugaaaggauguccgucgggucucggggaucgcugcguucacagccugaccuagaguacggcgguccauaugcuuggaccaauggguacgauggagaacucuauggcagccagagucugaaccgcagauccggcaggccgucuugccuuuacagcgccgcgcggcccuccgggucauaccgagcaaguguucuggacgagggaucuuucgguggcacacgcagagggucuacuuccggaucaagggccccuagcgaauauaguggccacuugaauagcuccagccgggcuucgucucgcgccuccucagcaagagcuaguccagugguagaggagaggcccgaaaaggauuuuaccgagaaagguagccguaacaugccugggcucuccgccgcgacacuggccucucugggaggcaccagcucacggcgaggcaguggggacacuuccauuagcaucgauacagaagcaucuauuagagagaucaaggaacucaaugaguuaaaagaccaaauacaggacguggagggaaaguacaugcagggucugaaagaaaugaaggauucacuugcugaggucgaagagaaguauaaaaaggccauggugaguaacgcucaguuggacaaugagaaaaccaacuucauguaccaaguugauacgcugaaggacaugcuacucgagcuggaggaacagcuugccgagagcaggcgccaguaugaagagaaaaauaaggaguuugaacgggagaaacaugcacacuccauccugcaauuccaguuugccgaagugaaggaggcuuugaagcagagagaagagaugcucgaggaaauuaggcagcugcaacagaaacaggcgucuucgauccgcgagauuagcgauuuacaggaaacuaucgaguggaaggacaaaaagauaggcgcacuggaacgacaaaaagaguucuuugauuccguccggucagagcgugacgaucucagagaagaggugguaaugcuuaaggaagaacugaagaaacaugggauuaucuugaacagugaaauugccaccaauggagagacaucugacacucuaaacaauguuggcuaccaggguccaaccaagaugacaaaagaggaacugaacgcucucaagagcaccggggauggcacgcuggacaucaggcuuaaaaagcugguggacgagcgcgaauguuugcucgagcagaucaagaaacugaagggacaguuagaggaacggcagaaaauuggcaagcuggauaaccuaagauccgaggacgauguccucgaaaaugggacugacaugcacgugauggaucugcaaagggacgccaaccgacagauaucagaucuuaaauucaaguuggcaaagagcgagcaggaaaucacagcccuggagcaaaaugugauucgccucgagucucaggucucccgguauaaaagugcugccgaaaacgcagagaagaucgaagacgagcugaaagcggaaaagagaaaacuucagagggagcugcguagcgcuuuggauaagaccgaggaacucgagguuucuaauggacaucuggugaaacgcuuagaaaagaugaaggccaaccgguccgcacugcuaucacaacaguga

SEQ ID NO: 58596 - RNA, 1275 nt, Artificial Sequence
  derived and/or modified sequence opt3 from LRRFIP2__Homo_sapiens__NP_001127841
augggcacccccgccagcgggagaaagaggacaccugugaaagaccgguucuccgcugaggaugaagcacugucuaacaucgcccgcgaggcggaagcucgacucgccgcaaagcgugccgcuagagcagaggccagggacauucggaugcgcgaacuugagagacagcaaaaagagcuggaugaaaagucagacaaacaguacgcugagaauuauacuaggccaaguagccggaacuccgccucugcgacgaccccguugucgggaaauucaagccgccgagguaguggcgauacauccucuuuaauagaccccgauacuagccuguccgaacuaagagacaucuacgaucucaaggaccagauucaggaugucgaggggagguauaugcaaggacugaaggagcuuaaagaaucacugagugagguugaagagaaguacaaaaaggcaauggugagcaacgcccaguuggacaaugagaaaaacaaucucaucuaucagguagauacccugaaggacgugauugaggagcaggaagaacaaauggcugaauuuuaccgggagaacgaagagaagucuaaagagcuggaacgucagaagcacaugugcuccguccuccagcauaaaauggaggaauuaaaggagggccugcgccagagagacgaacuuaucgagaaacacgguuuggugauaaucccugaugggacaccaaauggagacguuucacaugagcccguggccggcgcaauuaccgucgugagccaagaagcugcccagguacuggagagugcgggcgaagggccucuagauguuaggcuccggaagcuggccggagagaaagaggaacuucugucucagauccgaaaguugaagcuccaacuggaggaagaacgccagaaauguuccagaaacgacgguacugugggcgauuuagcagggcugcagaauggaagcgaccuccaguucauugaaaugcaaagggaugcuaaccggcagaucucggaguauaaguuuaaacuuucuaaggccgagcaggacauaacaacccuggaacaguccauuucacgcuuggagggccaaguccuaagauacaaaacggcugccgaaaaugcagagaagguggaagaugagcugaaggccgagaaaaggaagcuccagcgugaacugcggacugcucuugacaaaaucgaggaaauggagaugaccaacagucaccuggcgaagcgauuggagaaaaugaaggcaaauagaacagcccuccuggcucagcaguga

SEQ ID NO: 58597 - RNA, 6048 nt, Artificial Sequence
  derived and/or modified sequence opt3 from LRRK1__Homo_sapiens__XP_011520315
auggccggcaugagccagcggcccccuuccauguacuggugcguggggccagaggaaucugcugucuguccggagagggccauggaaacccugaacggagccggugacacaggcgggaagcccucaacucggggaggcgauccugcggcucgcagucgacguacggaggguaucagagccgcauauaggagaggggaccgcggaggcgccagagaucuccuugaagaggcuugcgaccaaugugcaagccagcuggagaagggccaguuguuauccauuccagccgcuuacggggaucuggaaaugguuagguaucuacucucuaagcggcugguggagcuucccaccgaaccuacagacgauaauccagccguaguggcggcauacuucggacacacugccgucgugcaggagcuguuggagucgcuccccgguccuugcucaccacaacgccugcugaacuggaugcucgcuuuagccugucagcgaggccaccuggggguugugaaacuuuugguccugacccacggagcagacccggaaagcuaugcugugagaaagaaugaguuucccguaauaguuaggcuaccucucuacgccgcgaucaaaaguggcaacgaagauauugccaucuuccugcuucggcacggugcauauuuuugcuccuacauucuguuggacucuccagaucccagcaagcaccuccugcguaaguacuucaucgaggcuuccccuuuaccaucaaguuaucccgggaaaacagcccugcgcgugaaguggagccaucucagacuuccgugggucgaccuggauugguugauagacaucucuugucagauuaccgaacuagaccuguccgcuaauugccucgccacucugccuucagugauccccuggggacuuauuaaccugaggaaauugaaucucagcgauaaccaccugggcgaguuaccaggcgugcagaguucugacgagaucauauguucccggcugcuagaaauugauaucagcucgaauaagcucucucaucugccucccggguuucuucauuuguccaaacugcaaaagcucacagcaucaaagaacugccuggagaaacuuuucgaagaggaaaaugccaccaacuggauuggacugcgaaaguugcaggagcucgacaucagugauaauaaacugacggaguuaccagcucuguuucuacacagcuucaagucccucaacucucugaaugucagccgcaacaaccuuaaaguuuuucccgacccuugggcguguccauugaagugcugcaaagcaucaagaaaugcccuggaaugucucccggauaagauggcuguguucuggaagaaccaucugaaagacguagauuuuagugagaaugccuuaaaggaagugccccugggucuuuuccaguuggacgcacucauguuucugaggcuacagggcaaccaacuggccgcucucccuccacaggagaaauggacuugccggcagcugaagacccuugauuugucccgcaaucaacuggggaaaaacgaagacggauuaaagacaaagagaaucgccuucuucacuaccaggggccgucagcggagcgguacagaggcagcgucuguccucgaguuucccgcuuuccugucagaaagucuugaggugcuguguuugaaugacaaccaccucgauaccguuccuccaagcgugugccugcuaaaaucccugucugaacucuaccuggggaauaaccccggccuucgagaguugccgccugagcugggacaguuaggcaaucucuggcagcuggacacggaagaucuuacuauuucgaacgucccagccgagauacaaaaggaagggcccaaagcaaugcugagcuaucuaagagcccagcucaggaaggcugagaaauguaagcugaugaagaugaucauugugggaccuccccgccaggguaaauccacauugcuggaaaucuuacagaccggccgggccccacaaguaguucacggggaggcaacuauaagaacaaccaagugggagcuccagaggccugcuggaucacgcgccaaaguggaaagugucgaguuuaaugugugggacauuggcggucccgcgucuauggccacggucaaccagugcuucuuuaccgauaaggcucuguacgugguuguguggaaucuugcacugggggaagaggccguagcuaacuugcaguucuggcuccugaacaucgaagccaaagcaccaaaugcggucgugcuaguugugggcacacaucuggaccuuaucgaggccaaguuucgagucgagcggauugcuacucuccgugccuaugugcuggcauuguguagaagcccguccggaucaagggcuaccggcuucccugauaucacauuuaagcaucugcacgaaauuagcugcaaaucuuuagaggggcaagaaggacuccgccagcugauauuccacguaacuuguuccaugaaggacguggguaguaccaucggcugccagcggcuugccgggagacugauucccaggagcuacuugucucuccaggaggcaguucuggccgaacaacagcgacgcucccgggaugacgauguccaguaucuaacagacagacaacuggagcagcuuguggagcagaccccagauaacgacaucaaagacuacgaagaucuccagucagcuaucaguuuucugauugagacuggaacguuguuacacuuccccgacacaagccacggccugaggaaucucuacuuucuggauccuauauggcuuucggaaugucugcaacguaucuucaacauuaaggguucccgcucuguggcgaaaaauggggucauccgggccgaggacuugagaaugcuacugguuggcaccggauucacucagcagaccgaggaacaguauuuucaauuccucgcaaaguuugagauugcucugccaguggccaacgauagcuaccuuuuaccccaucugcucccuucaaaaccgggcuuggacacacaugggaugaggcacccaaccgccaauacuauccagcgaguguucaagaugaguuuuguacccgucggauucuggcagcgguuuauagcucgcaugcugaucucccucgcagaaauggaucugcagcuuuucgagaacaagaaaaauacaaagucuagaaacaggaaagugacgauuuauagcuuuaccggcaaucaacggaaccgaugcuccacuuucagaguuaagcgcaaucagacaaucuacuggcaggaaggucuguuggugaccuuugacgggggauaucuaucagucgagagcagugaugugaacuggaaaaagaagaaaucuggcgguaugaagauuguuugccaauccgaggugagggacuucagcgccauggcguuuaucacagaucauguaaauucgcugauagaccagugguucccugcucucacugccaccgaaucagauggcacgccauuaauggagcaguacguccccuguccugugugcgaaaccgcaugggcccagcacacagacccgucugagaaaagugaagacgugcaauauuucgauauggaggacuguguccugacugcuauugagcgugauuuuaucuccugcccccggcacccagaccuuccuguuccccugcaggaacucgugccagaguuguucaugaccgauuuuccugcaagacuguuccucgaaaacagcaagcuggagcauucugaagacgaggggagcguacuuggacagggcggguccggaacagugauuuacagggcccgcuaccagggccaacccgucgcggugaaacgauuucacaucaagaaguucaaaaacuuugcuaauguuccagccgauacuaugcuaagacaucugcgggcaaccgacgccaugaagaacuucucagaguuuaggcaggaagcuaguauguugcacgccuuacagcauccguguauaguggcacugaucgguauuagcauccacccucucugcuucgcucuggagcuugcaccccugucuucccucaauacggucuugucagaaaacgcgcgcgauaguagcuuuauuccacuggggcacaugcuaacacagaaaaucgccuaucaaauagcauccggacuggcuuaccuccauaagaaaaauauuaucuucugugaccuuaagucugauaacauccugguguggucguuagacguuaaggagcacauuaauaucaaauugagcgacuauggcauuucacgucaguccuuccaugagggugcccugggcguggaagggacccccggauaccaggcuccugagauaagaccacggaucgucuaugaugaaaagguagacauguuuaguuacggcauggugcucuaugagcugcuuucugggcagaggcccgcacugggacaccaucaacuccagauugccaaaaaguugagcaaaggcauccgcccuguucugggucagccggaagaggugcaauuccgaagauuacaggcccuaaugauggagugcugggauacuaagccagaaaaacggccccuggcucucuccgucgugucacagaugaaggacccuacauuugcgaccuucauguacgagcuuuguugcgggaagcagacugcauuuuucucuagccaaggacaggaauacaccguaguguuuugggauggcaaagaggaaaguaggaacuauacagucguuaauacggagaagggucugauggaggugcagcgcauguguugccccggcaugaaaguguccugccaguugcaaguccagagaagccuguggaccgccacugaagaccagaagauuuacaucuauacacucaaagggauguguccacugaacaccccucagcaagcucuugauacacccgccgugguuacuugcuuccucgcaguaccagugauaaagaaaaauucuuaccuggucuuggccggacuggcugacggcuuaguggcgguuuuuccuguggucagggggaccccgaaagauucauguuccuaucuaugcagucacacggccaaccggagcaaguucucgaucgcagacgaggaugcucgucagaaucccuacccagugaaagccauggaaguagucaacucuggauccgaggugugguauagcaauggcccuggucugcucguuauugacugugcaucacuugaaaucugccgccgacuggagcccuacauggccccaaguauggugacaucugucguguguuccagcgaggggagaggagaagagguuguguggugcuuggaugacaaggcuaacucacuggucauguaccacaguaccacuuaucagcucugugccagguacuuuugcggcgugccuagcccccugcgggacauguucccgguacgcccacuugauaccgaaccucccgcggcaucccauacagccaacccaaaagugcccgagggcgacucuauugcugauguuagcaucauguauuccgaggaauuagggacucaaauacugauucaccaggagucacucaccgacuacuguucuaugaguucguauagcuccucuccuccgagacaggccgcuaggucacccagcuccuugccaaguucuccugcaagcucauccaguguccccuuuagcacagauugcgaagacucugauaugcugcauacgccuggagccgcuuccgaccggucagagcacgaucuaaccccaauggacggugaaacuuucagccagcaucugcaagccgugaagauccucgcagugcgagaucuuaucuggguccccagacgcggcggggacguaauugugauaggacuggagaaggauucgggcgcgcagaggggucggguuaucgccguguugaaagcucgugagcugacaccucaugggguccucguggacgccgcaguuguggcuaaggacaccgucgugugcacuuucgaaaaugagaacacagaauggugucuggccguauggagaggauggggcgcaagggaguuugauauuuucuaccagucuuaugaagaguuaggccgccuugaggccugcacccggaaacgaagauga

SEQ ID NO: 58598 - RNA, 7584 nt, Artificial Sequence
  derived and/or modified sequence opt3 from LRRK2__Homo_sapiens__NP_940980
auggccagcggcuccugccaggggugugaggaagacgaggaaacccugaagaaacucaucgugagacuuaacaauguccaagagggaaagcagauugaaacacugguucagauauuggaggauuuacugguguucacuuacucugagcacgcuucaaaacuauuucaggguaagaacauccauguaccccuccugauugugcuugacaguuauaugagggucgcaagcgugcaacagguuggcuggucccuguugugcaaacucaucgaaguguguccugggacgaugcagucucugaugggaccacaggaugucggcaaugacugggaggugcuggguguacaccaacucauuuuaaagaugcugaccguucauaacgccucggugaaucuuucagucaucggguugaagacacuggaucuacuccugacuagcggaaaaauaacccuucugaucuuggacgaagagagugauauuuucaugcucaucuuugacgcgaugcacuccuucccggcuaacgaugaggugcagaagcugggcugcaaagccuuacaugugcuguuugaacgggucucugaggaacagcucacagaguucguugaaaauaaggacuacaugauucuucugagcgcauugaccaacuuuaaagaugaggaggaaaucgugcuacacguacugcacugucuccauucccuggccauacccugcaauaacguggagguccuuaugucaggcaaugugcgcuguuauaacauuguuguggaagcuaugaaggcauucccuaugagugagcgaauccaggaagucagcugcugucuguugcaccgucucacucuggggaauuuuuucaacauuuuagugcugaaugagguacaugaguuuguugugaaggccguccaacaguacccagaaaacgcugcccuacagaucucugcgcucuccugccuggcacuuuugacagagaccaucuuccugaaccaagaccucgaagagaaaaaugaaaaccaggagaaugaugacgagggagaagaggacaagcuguuuuggcuugaagccuguuauaaagcucugacguggcacagaaagaacaaacacgugcaggaggccgcaugcugggcuuugaauaaccuccugauguaccagaauucauuacaugagaagauuggugaugaagacggccacuuccccgcccauagggaggucaugcugagcaugcuaaugcacaguucuuccaaagaaguguuccaagcgagcgccaacgcacucucgacucugcuugagcagaauguuaacuuucggaagauauugcugucuaaggggauccaucucaaugugcuggaauuaaugcagaaacacauucacuccccugagguagcugagucaggaugcaagaugcugaaccaucuuuucgaaggcaguaauaccagcuuggauaucauggccgcugucgugccaaaaauacucacaguuaugaagcgccacgagacuucccugcccgugcagcuagaagcccugagagcaauucuccauuuuaucgucccugguaugccagaggaaucuagggaggacaccgaguuccaccacaaacugaacauggugaagaagcaauguuuuaaaaaugauauccauaagcuuguauuggccgcucugaaccgguucauugggaacccgggaauccagaaaugcggcuuaaaggugauuagcucaauaguucacuuucccgacgcgcucgaaaugcugagucuugagggcgcaauggauuccguccugcauacauugcagauguauccugacgaucaggaaauccaaugucucgggcugagccuaauuggauaccugaucaccaaaaagaauguguucaucgguacgggccaccuccuggccaagauucuugugucuucauuguaccgcuuuaaagacgucgcugagauacagacuaagggguuccagacaauccuggccauuuuaaaacucagugcaagcuuuuccaagcugcuuguucaucacucuuucgaucuggugaucuuucaccagaugucgagcaacauuauggaacaaaaagaccagcaguuccuaaaucucugcuguaagugcuucgccaagguggcuauggacgauuaucugaaaaacguaauguuggagcgagccugugaccaaaauaacuccaucauggucgagugccuguuacuccugggagcagaugcgaaucaggcuaaggaaggcucaagucuuauaugucaggugugcgagaaagaaucuagcccaaagcugguugaguugcuccugaacuccgguucaagagagcaggacgugaggaaagcccuaaccaucagcauugggaagggcgauucucaaaucauuucccugcuucuccggcgucuggcauuggacgucgccaauaacaguaucugucugggaggcuuuugcauagggaaaguggaacccagcugguuaggaccucucuucccagauaagacuucuaaucugcgcaagcagacaaacauugcuuccacccuugccagaaugguuaucagguaccagaugaaaucagcaguggaggaagguacggcuaguggcagcgacgggaauuuuucggaggauguacuguccaaguucgacgaauggaccuuuauucccgauucuagcauggacucagucuucgcccagagugaugacuuggacuccgagggaucugagggcagcuuucucgugaaaaagaaauccaacucaaucagcgugggugaauucuaucgggaugcgguccugcaacgaugcaguccgaaucuacagcgccauucuaacucccuggggccuauauuugaccacgaggaucuucucaagagaaagaggaaaauccugagcucggacgauucauugcggucuaguaaguuacagucccauaugcgccacagcgacucuauuagcucccuggccucagaaagagaguacaucacaagucucgaucugagcgcuaacgaacuuagggacauugaugcacugucucagaaauguugcaucuccguucauuuggagcaccuagagaagcuggaacuccaccaaaaugcccugacuucauucccccagcagcuuugugagaccuuaaaaagucugacacaucucgacuugcacagcaacaaguuuacuuccuucccaucuuaucugcucaagaugucgugcauagcuaaucuggaugugagccguaacgacauuggcccuucaguagugcuugaucccaccgucaaauguccaacacugaagcaauuuaauuuguccuacaaccagcuaaguuucgugcccgaaaaucugaccgacguuguggagaaacucgaacaguuaauccuggagggaaacaagaucucuggcauuugcagcccucuucggcugaaagagcucaagaucuugaaucuguccaagaaccauauuucaucucucagcgaaaauuuccuggaggccuguccaaaagucgaaaguuuuuccgcacgaaugaacuuccuugcggccaugccguuucuacccccuagcaugacuauacugaaguugucucagaauaaauucucaugcaucccagaggcuauuuuaaaccugccccaccucagaucccuggacaugaguagcaaugauauccaauaucuuccugggccagcccacuggaagucgcugaaccucagggaguugcuguuuucucauaaccagauuuccauccuagaccugagcgaaaaagcauaccucuggucacgcguggagaagcuucaccugagucauaauaaauuaaaggaaauacccccggagaucggauguuuggaaaaccugacgucucucgauguuuccuacaaucuggagcuucggagcuucccuaacgagauggguaagcugucaaaaauuugggaccucccauuggaugaacugcacuuaaauuuugacuucaagcauaucggcugcaaagcuaaggauauuaucagauuucuacagcagaggcugaaaaaggccgugcccuauaaccgcaugaagcucaugauagucgggaauacaggaaguggcaaaaccacucuucugcaacaguugaugaagaccaaaaagagcgaccuggguaugcaguccgcaacaguagggauugaugugaaagacuggccuauccagauccgagauaagcggaagcgugaccucguucugaacgugugggacuucgccggcagagaggaauuuuacucuacccacccccacuucaugacucaaagggcucuuuaucucgcggucuacgaucugagcaaaggacaggccgagguggacgcaaugaagccaugguuguucaauauuaaagcucgcgccuccucaucuccuguaauacuggugggcacacauuuagaugucagugacgaaaagcagcggaaagccuguaugucgaagaucacgaaggagcuacugaacaaaagaggguuucccgcuauuagggauuaucacuucguuaaugcaaccgaggaaagcgacgcccucgcgaagcuucgaaaaacuaucauuaacgagucccugaauuuuaagauccgcgaucaguugguggugggacaacugauaccagacugcuacgucgaacucgagaaaaucauucugucugaacggaagaacgugccgaucgaguucccuguuauugauagaaagaggcuuuuacagcugguacgugagaaucagcuccaauuggacgaaaacgagcugccccaugcugugcacuuucuaaaugaaucaggcguccugcuccacuuccaggauccagcccuucagcugagcgacuuguauuuuguggagcccaaauggcugugcaagaucauggcacagauacucacaguuaaaguggaggguuguccuaagcauccaaaagggauuaucucccgccgggaugucgaaaaguuccugaguaaaaagagaaaguuucccaaaaacuacaugucucaauacuucaaguuacuugagaaauuucagaucgcccugccuauuggagaagaguaucuccuagugccgagcucacuguccgaccacaggccaguaaucgaauugccccauugcgagaacagugagauaauuauccgacuguacgaaaugccuuauuucccaaugggcuuuuggagccggcucauuaaucgccuucuggagaucucucccuacauguuguccgguagagaaagggcucugcggccuaaccgaauguauuggagacagggcauauaccucaauuggucaccggaggcauauuguuuagucgggagcgaagugcuggacaaccaccccgagucguuccuuaagauuaccguuccaucuugccgcaaaggauguauccugcuaggccagguggucgaucauaucgacagucucauggaggaaugguucccugggcuguuggagauugauaucugcggagaaggcgagacacugcucaagaagugggcccuuuacuccuuuaaugacggugaagagcaccaaaaaauucuguuagaugaccugaugaagaaagcggaggaaggggauuugcucgugaaccccgaccagccaaggcugacuauaccuaucagccagauugcucccgaucuaauccuugccgaccugccacguaauaucaugcucaacaaugaugagcuggaauucgagcaggcaccggaguuuuugcugggagacggcucauucgguuccguuuaccgggccgcuuaugaaggcgaggaaguggccgucaagauuuuuaacaaacacaccucucucagacuucugaggcaagaguuagugguacugugucauuugcaccauccuagccucauaagucugcuagcagcugggauccgcccccgaaugcuugugauggaacuggccuccaagggaagccucgauagacuguugcagcaggacaaggcgucuuuaacgcggacccugcaacacaggauugcccuccacguugcagacggccuucgcuaccugcauucagcuaugaucauuuaucgugaucuaaaaccacacaauguccugcucuucacauuguaccccaacgccgcuaucauagcaaagaucgccgacuaugggauugcccaguacugcuguagaaugggaaucaaaacuagugagggcaccccugguuuucgggcuccagagguggcgagggggaaugugauuuauaaccagcaggcagaugucuacuccuucggacugcuucuguacgacauccucacaacuggcggucgcauaguagaaggcuuaaaguuucccaaugaguucgaugaacuggagauucaagggaaauugccugacccggugaaggaauauggaugcgccccauggcccaugguugagaagcugaucaaacagugucucaaggagaacccucaggaacgacccaccagcgcucagguguuugauauucuuaacucugccgagcuggucugccuaacgagacggauccugcucccaaaaaaugugauaguugaaugcaugguggcaacacaucacaacucgaggaaugccucaaucugguugggcugugggcauaccgaccgcggacaacugagcuuccuugaucugaacacugagggcuacacauccgaagaggucgcugacaguagaauuuuaugccucgcgcuggugcacuugccuguagagaaggaaucuuggaucgugagcgguacccaguccgggacucugcucguuauuaauaccgaggauggaaaaaagaggcacacacuugaaaaaaugacggacucagucaccugucuguauugcaacaguuuuucuaagcagagcaagcagaaaaauuuccuacuggugggcacugccgacggcaagcucgcaaucuucgaggauaaaacagugaaguugaaaggggcugccccccugaagauauuaaacauuggaaaugucuccaccccacuuaugugucugucagagagcacaaacucuacugaacggaauguuaugugggguggcugcgggaccaagaucuuuuccuucaguaacgacuuuacgauccaaaaacucauugagacacguaccagccagcuguucucguacgcagccuuuuccgauucuaauaucauaacugugguaguggacaccgcuuuguauauugccaagcagaacucaccugucguggaaguuugggauaaaaagacagagaaacuguguggacucaucgacugcgugcauuuccuucgcgaagucaugguaaaggagaauaaggagagcaaacacaagaugaguuacuccggccgagugaaaacucugugucuacagaagaacaccgcgcuguggauugguacagggggaggccauaucuuacuccuggauuugucuacgagaaggcuuauacggguuaucuauaacuuuugcaauagcgugcgcgucaugaugaccgcacaacugggcucacucaaaaacgugaugcuggucuugggguacaauagaaagaacacugaaggaacacagaagcagaaagagauucaauccugucugaccgugugggacaucaaucuaccgcacgaaguucagaaccucgagaagcauauugaagugaggaaagagcuugccgagaagaugcggcgaacuaguguagaauga

SEQ ID NO: 58599 - RNA, 2151 nt, Artificial Sequence
  derived and/or modified sequence opt3 from LRRN1__Homo_sapiens__NP_065924
auggccagaaugagcuucgugaucgcugcaugccagcugguccucggccuucugaugaccuccuugacagagucuucaauucaaaacagugaauguccccaguuaugcguuugugagauaaggccuugguuuacuccacagagcacguaccgggaagccaccacaguggacugcaaugaucugcgccuaacucgaaucccguccaaccucucuucggacacccagguacugcuucugcaaucaaauaacauugcgaagacaguggaugaguugcagcagcuuuucaaucugaccgaacuggacuuuagccagaacaauuucacuaacaucaaagaggucgggcucgcuaauuuaacacaacugaccacgcuucacuuggaggaaaaccagauuacugagaugaccgauuauugucugcaggaccuaaguaaucuccaggaacuguacaucaaccauaaucaaauauccacaaucucugcccacgcauuugccggacuuaagaaccuguugcgucuccaucugaauagcaacaaauuaaaggugauugauuccagaugguucgacucaacucccaaccuggagauccucaugauuggugagaauccuguuaucggcauacuugauaugaacuuuaaaccacuggcuaauuugaggagucuagugcuggcagggauguaucucaccgacauucccggaaacgcccuggucggccuugauagccuggaaucuuuguccuucuacgacaauaagcucgugaagguaccucagcuggcuuuacagaaaguuccaaaccugaaguuucuagaucucaauaaaaaccccauccacaagauucaagagggugacuucaaaaauaugcugcggcuuaaggaauuggggaucaacaauaugggagagcuggugucagucgaccgcuaugcccucgauaaccugccugaacuuacaaagcuggaggcgaccaauaacccaaaauugagcuacauccauagacucgcauuuaggagugugccggcccuggagucuuuaaugcugaauaacaacgcucuaaaugccauuuaucagaagacgguggaaucccuccccaaccugcgggagauaagcauccacucgaauccucuucgcugcgacugugucauucacuggaucaacucuaauaaaacuaacauacgauucauggaaccauuguccauguuuugcgcaaugcccccugaguacaagggccaucagguuaaagaagugcugauucaggauucaagugagcaaugucucccaaugaucagccacgacuccuuccccaauagacugaacguagauaucggcacaaccguguucuuagacugcagggcuauggccgagccggaaccugagauuuacugggucacucccaucgggaauaagauuacaguggaaacccugucugauaaauauaagcucagcucagagggaacguuggaaauaaguaacauccagauugaggacuccggucgguacaccuguguugcgcagaaugugcagggcgccgauacacgugucgcaacuaucaaggugaacgggacccuccuggacggaacacaaguacuaaaaaucuauguuaagcagacugagagccauucuauucuggugucauggaaagucaauaguaacgugaugaccagcaaucucaagugguccucugcuacaaugaaaauagauaacccacacaucaccuacacugcccgcgucccuguggacguucacgaauauaaccugacgcaucuucagcccucgacagacuacgaggugugcuugaccguaagcaauauucaccagcaaacucagaaguccugcgucaacgugaccacaaagaaugcugccuuugcaguugauaucucagaccaggaaaccaguacugcccuggcugcggugaugggcucuauguucgcagucauuagcuuagccuccaucgcuguguauuuugccaaaagauucaagaggaaaaacuaccaucacucacucaagaaauacaugcagaagacaagcucuauaccacugaaugagcuuuaucccccucugaucaacuugugggagggugauuccgaaaaggacaaagaugggagugcagacacgaagccaacccaaguagauacuagccggucuuacuauaugugguga

SEQ ID NO: 58600 - RNA, 2142 nt, Artificial Sequence
  derived and/or modified sequence opt3 from LRRN2__Homo_sapiens__NP_006329
augagacugcucguggcuccccuucuguuggcuugggucgcaggcgccaccgcggcuguuccugugguaccauggcacgugccgugucccccucagugcgccugccaaaucaggccaugguacacaccccggagcuccuaucgcgaggcaacuacggucgacuguaacgauuuauuccugaccgccgugccuccagcucuacccgcagggacacagacucuccugcuucagucuaauucaauuguucgaguggaccagagugaacugggauacuuggccaaccucaccgagcuggaucugagccaaaauuccuuuucugacgcucgugauugcgacuuccaugcccucccucaguuacugucgcuucacuuggaagagaaccagcugacaagacuagaagaucauucauuugcgggucucgcaagccugcaggagcuuuaucugaaucacaaccaauuguacaggauagccccacgggcuuucaguggccucuccaaucuguuacgccugcaucucaacucuaaucuucugagagccaucgacucuaggugguuugagauguugccgaaccuagaaauucugaugaucgggggaaauaaggucgaugcaauucucgacaugaacuuccggccccuggcuaaucuucgcucccugguguuggccggcaugaaccuccgagagaucucagauuaugcgcuggaagguuuacagagucuggagagccuaucuuuuuacgacaaucagcucgccagaguaccuaggcgggcacuggagcagguuccagggcuuaaauucuuggaucugaacaagaacccccuccaacgugugggaccuggcgacuuugcuaauaugcugcaccuuaaagaacugggcuugaacaauauggaggaacucgucuccauagacaaguucgcccuggugaacuuaccagagcugaccaaacuagauaucacuaauaacccccgccucucauuuauucacccgagagcuuuccaucaccucccucagauggaaacacuuauguugaauaacaaugcccugagcgcacuccaucagcaaaccguggagagucugcccaacuuacaggaggucgggcugcacggaaauccaaucaggugugacugcguuauucggugggccaacgcuacggguacucgagugcgcuuuaucgaaccucagucuacccuuugugcggagcccccagauuugcagagacuccccguaagggaagugccuuuccgggagaugacagaccacugccugccacuaauauccccgcgcagcuuucccccuucgcugcaagucgcaucuggcgaauccauggugcuccauuguagagcccuggcugagccagagcccgaaauuuauuggguuacuccugccgggcuuagguugaccccagcacacgccggacgucgguaccgaguguaccccgagggcacacuggaauuaagaagggucaccgcugaggaagccggucucuauacgugcguggcacagaaucugguaggggcggauacuaagacaguuucaguggucgugggacgcgcccuucugcagccgggccgggacgagggccagggguuggagcucagaguccaagaaacccauccuuaccacauccugcuaaguugggugacuccacccaacacaguuagcaccaaucugacgugguccucugccagcucacucaggggacagggugcaaccgcccuggcucgccuuccucgaggcacacauaguuauaacauuacucgguugcugcaggccaccgaguacugggcauguuuacagguggcuuucgccgaugcgcacacacaacucgccugcguaugggcucguacuaaggaagcaaccuccugccacagagcccugggggacaggcccggacuuaucgcuauccuggcccuagcaguccuccuguuggcggccggccuggcugcccauuuagguacagggcagccacgcaaaggcgugggaggccggagaccucugcccccagcaugggcuuucuggggguggagcgccccgucuguuaggguggucucagcaccucuggugcuucccuggaacccaggacgaaagcugccccgcaguagcgagggugagaccuugcucccuccacugucccagaauagcuga

SEQ ID NO: 58601 - RNA, 2127 nt, Artificial Sequence
  derived and/or modified sequence opt3 from LRRN3__Homo_sapiens__NP_001093128
augaaggacaugccccugagaauccacgugcuccuuggccuggccauuaccacauugguccaggcuguugauaaaaagguggacugcccuagguuauguacuugcgagauacggccaugguucacgccgcgcagcaucuacauggaagcauccaccguagauuguaacgaccuggggcuacucacauuucccgcccgacugccugcgaauacucaaauucuucuguugcagaccaacaauaucgcuaaaauugaguauucuacagauuucccagugaaccucaccggacuggaccugucacagaauaaccucaguagcgucacuaauaucaacgugaagaaaaugccccaguuacuguccguuuaccuugaagagaauaaguugacagaacugccugagaagugccuaucugagcucucgaaccugcaagaacuuuauauaaaucauaaccuguugucaaccaucagcccaggugccuuuauuggccuccacaaucuguuacgucugcaucucaacaguaauagacuucagaugaucaacuccaaaugguucgaugcacugcccaacuuggagauucuaaugaucggggaaaauccuauaauuaggaucaaggacaugaacuuuaaaccacugauuaaucuccggucucuggugaucgccggaaucaaccuuacggagauuccggauaaugcucuggucggcuuggagaaccucgaaagcauauccuucuacgacaaucgccugaucaaggugccccacguagcauuacagaaaguugugaaccugaaguuucuagaucucaauaagaacccuauuaauagaaucaggcggggugacuucucaaacaugcugcaucuuaaagaguuggggauaaauaacaugccagaacugauuaguaucgauagccucgccgucgacaaucugcccgaccuucgcaagaucgaggcuacuaacaacccucgacugucuuauauucacccaaaugccuuuuucagauugcccaaacucgaaucccugauguuaaacucaaaugcgcugagcgcacuauaccacggaaccaucgagagucucccgaaccugaaggagauuucuauacauuccaauccuaucaggugugauugcgugauucgguggaugaacaugaauaaaacaaacauccguuuuauggaacccgacagccuuuucuguguggauccaccugaguuucagggccaaaauguccgccagguucacuucagagacaugauggaaaucugcuugccccugauugccccagagucguuccccucuaaccucaauguggaagcuggcuccuauguaucauuucauuguagggccacugcagagccucagccagagauauacuggaucaccccgagugggcagaagcuguuacccaacacacugaccgauaaauucuacgugcacagcgaaggaacgcuugacauuaauggugucacuccuaaggagggcggguuguauacaugcaucgcuaccaaccucgugggagccgaucugaaguccguuaugauuaaaguggacggcucuuuuccacaagauaauaacgguagccuaaacaucaagauacgggacauccaggccaauucaguccuggugaguuggaaagcguccagcaagauucucaaaucuucaguaaaguggacugcauucguuaagacagaaaacagucacgcugcccagagcgcucgaauccccuccgaugugaaagucuacaaucugacccaucuuaacccuucuacggaguauaagauuuguaucgacauaccaaccauuuaccagaaaaaucgcaagaaaugcgugaacgucacaacuaagggguugcaccccgaccaaaaggaauaugagaaaaauaacaccacaacucugauggccugcuuaggaggccuccugggcaucauuggggugaucugucuuauaucgugccugagcccggagaugaauugugauggaggucauuccuacguuagaaacuauuugcagaagccuaccuuugcacucggcgaacuguacccaccccuaaucaaucugugggaggccgggaaagaaaagucaacaagucucaaagugaaggcuaccguaauuggacugccuacuaacaugucuuga

SEQ ID NO: 58602 - RNA, 2223 nt, Artificial Sequence
  derived and/or modified sequence opt3 from LRRN4__Homo_sapiens__NP_689824
augagacagacccugccccuccuucuguugacaguguuaaggccuagcugggccgacccaccgcaagagaaggucccccuguuccggguuacucagcagggcccuuggggguccucuggaucaaacgcuacggauaguccaugcgaaggucuacccgcagccgacgcgaccgcucucacacuggccaaucgcaaccuugagcgacugccuggcuguuugccacguacucucagaagccuggaugcaucccacaaucugcucagggccuuaucuaccucggaacuggggcaucuugagcaguugcaagugcugacacuacggcacaaccgcaucgcugcacucagauggggacccggcgguccugccgggcugcauacccuugaccugucauacaaucaguuggcugcccucccaccgugcacuggacccgcgcugagcaguuuaagggcacuggcccucgcuggcaacccucuucgggcccugcagccacgcgcauuugcuuguuuccccgccuugcagcuacugaaucucuccugcacagcgcugggccgaggggcccaaggagguauugcagaagcugccuuugcuggcgaggauggggccccucuuguaacccuggagguguuggaccucucuggaacguuccuggaaagagucgagagcggcuggauaagggauuuaccaaaacugacuucccuauaucuccggaagaugccccgucugaccacacuugaaggugacaucuuuaaaaugacuccgaacuugcagcagcuggauugucaggacuccccugcacucgccaguguggcuacccacauuuuccaagauacaccccaucugcagguucuucuguuucagaauugcaacuugagcucuuucccaccuuggacccucgacuccucacaagugcugagcaucaauuuauuugggaacccccugacguguaguugcgaucuaucuuggcuccugacugacgcgaagcgcacaguccuuuccagagcagccgacaccaugugugcuccagccgcaggaagcucgggccccuucucugccuccuugucacugagucagcucccuggcgugugccagagcgaucaguccacuacacugggggcuucucacccaccguguuuuaauaggagcaccuacgcccaaggaacgaccguagcacccucagcggcuccugccacacggccagccggugaccagcagaguguuuccaaagcacccaacgugggcagccgaacuauugcugccuggccucacucugaugcacgcgaggggaccgcuccaucaacaacuaauagugucgccggacauagcaacuccucuguguuccccagagcggccucgaccacaaggacccagcaccggggcgagcaugcuccggaauuagugcuggagccugacaucagcgcagccuccacuccacuugcuucaaaguugcucggucccuuuccuacgaguugggaucgcucuauaagcucaccccaaccagggcagagaacacacgccaccccucaggcacccaacccaucacugagcgaaggcgagaucccgguccuacugcucgacgauuauucugaagaggaggaaggaaggaaggaggaaguuggcacuccucaccaggacgugcccugcgauuaccauccaugcaaacaucugcaaacccccugugcggagcuucagcgucgguggcgaugcagauguccuggguuguccggagaagacacaauuccagaucccccuaggcugcaggguguaaccgagacuacagacacgagugccuuagugcacuggugcgcuccgaauagcgucgugcacggcuaucagauccgcuacucugccgaggggugggcaggaaaccaauccguugugggcgucauuuaugcuaccgcccggcagcauccacucuacggucugucacccgggacuacauacagaguguguguacuugcagccaauagggcuggccugagucagccucgcagcucgggauggcgauccccaugcgcggccuucaccacaaagcccucuuucgcauugcuccugagcggccuaugugcugccucagggcugcuccuggccaguacuguugugcuuuccgcuugcuugugucggcguggacaaacccuggguuuacagagaugcgacacgcaccucgucgcauauaaaaacccugccuuugaugacuacccgcugggccuucagaccgugucuuga

SEQ ID NO: 58603 - RNA, 1569 nt, Artificial Sequence
  derived and/or modified sequence opt3 from LRRTM1__Homo_sapiens__NP_849161
auggacuuccugcuccuuggccugugcuuguacugguuacugagaaggcccagcggggugguccuaugucuccugggagccugcuuucagaugcuuccugcugcaccauccgguuguccgcaacugugccggugugagggccgcuugcucuauugcgaagcccugaaccugaccgaggcgccccacaaucucucuggguuacugggacuuucauugcgauacaacagucugagcgaacuacgugcuggccaguucacaggucucaugcagcugacuuggcuuuaucuggaucauaaucacaucuguuccguucagggggacgccuuucaaaaguugagaagggugaaagagcucacgcugucuucgaaccagauuacccaguuaccuaauacaacuuuccggccaaugcccaaccugcgcucaguagaucucagcuacaauaaguuacaggcacuggccccugacuuguuucauggacuaagaaaacugaccacacuccacaugagggcuaacgcaauacaauucgugccaguccggaucuuucaggauugccgcagucugaaguuccuugacauuggcuauaaucagcugaaauccuuggcccgaaacucuuuugcuggccucuucaagcugaccgaauuacaucuggagcacaaugaucuagugaagguuaacuuugcccacuuccccagacucaucagccugcauucccuuuguuugaggcggaauaaaguggcgauugucgugucaagucuggacuggguauggaaccucgagaagauggaucugagcgggaaugaaaucgaguacauggaaccucacguuuuugagacugugccacaucuucagucucugcaauuggacuccaaccgucucacauauauagagccgcgcauccugaacucauggaaaagccuuaccaguauuacgcuggcaggaaaucuaugggauugcgguagaaacgucugugcccucgcuucuuggcugaauaacuuccagggcagguacgacgggaaucuucagugcgccucccccgaauacgcacaaggagaggauguguuggacgcuguguaugccuuccaccugugcgaagacggcgcggagccuacuagcggucaccuccugucggccgucaccaaccggucugauuuagggccacccgcauccucagcuacaacucuggccgacggaggcgaaggccagcaugaugggaccuuugagccugcuacaguugcccuuccaggaggugagcacgcagaaaaugccgugcagauccauaagguagugaccggcacgauggcuuugauuuucaguuuucucaucgucgugcugguucuauacgugagcuggaaauguuuccccgcgucccugcgacagcuccgccaaugcuuugucacucagagaaggaagcagaagcagaaacaaacaaugcaccagauggcagccaugucugcucaggaguauuacguggacuauaagccgaaccauauagaaggggcccugguaauuaucaaugaguacggaagcuguaccugccaccagcaaccugcacgggaaugugagguuuga

SEQ ID NO: 58604 - RNA, 1551 nt, Artificial Sequence
  derived and/or modified sequence opt3 from LRRTM2__Homo_sapiens__NP_056379
augggccugcacuucaaguggccccucggggccccuaugcuugcugcaaucuacgccaugagcauggugcugaaaauguugccagcguuaggaauggcuugcccgcccaaguguagaugcgagaaacugcuauuuuauugugacucccaggguuuccauucugucccuaacgccaccgauaagggcucacucgggcugagucuuaggcacaaucauauuacagaacuggagcgggaccaauuugccagcuucucccaguugacuuggcuccaccuggaucauaaccagauaucuacgguuaaagaagacgcauuucagggacuguacaagcucaaggaguuaauccugucgucaaauaaaauuuucuaucuuccaaacaccacauuuacucaauugaucaaucugcagaaccuagaucucagcuucaaucagcugaguucccuucaccccgaacuguuuuacggcuugcgcaagcuccagacccugcacuuacgaucuaacagccugcguacaauuccugugagacucuucugggacugcaggucccuugaguuucuggauuugucaaccaaucggcuacgcagucuggcuagaaacgguuucgcagggcucaucaaacugagggagcuucaucuggaacacaaucaauugacuaagauaaacuuugcccauuuccuccggcugagcucuuuacacacacuguuccuacaguggaauaaaaucuccaaccucaccuguggaauggaguggacguggggcacucuggaaaaacuugacuugaccggcaaugagauuaaggcuaucgaucugacaguauuugagacuaugccaaaccucaagauucugcuuauggacaacaauaagcugaacucauuggauagcaaaauccucaauagucugcgcucuuuaaccacaguggggcuguccggaaaccuaugggaaugcagcgcccgaauaugugcgcucgcaucguggcuggguucuuuccagggcagaugggagcacuccauucuuugccauucacccgaccacacccagggggaagauaucuuggacgccguccauggauuucaacuguguuggaaucucaguacgacugugacaguuauggcuaccacuuauagggacccuacaaccgaguacacgaagcggauuagcuccucuagcuaucacgugggcgauaaagaaaucccaaccacagccgguaucgcagucacuaccgaggagcauuucccggaacccgacaacgcuauuuuuacacagcgugugauaacugggaccauggcccuguuauucucauuuuucuuuaucauuuucaucguauuuauaagucgcaagugcuguccuccaacacugagaaggauucggcagugcuccaugguucaaaaucaccgacagcuucgcagccagaccagauugcacaugucuaacaugucagaucagggacccuacaaugaguacgaaccuacucaugagggcccauucaucaucauuaacggcuaugggcaaugcaaaugucagcagcuccccuacaaggaaugcgagguguga

SEQ ID NO: 58605 - RNA, 1746 nt, Artificial Sequence
  derived and/or modified sequence opt3 from LRRTM3__Homo_sapiens__NP_821079
augggcuucaacgugaucagacugcucagcggguccgccgucgcucuuguuauugcacccaccgugcuguugacaauguuaucuucagccgagaggggaugcccuaaggguugucggugcgaaggcaaaaugguauacugugagagucagaagcugcaagaaauaccaagcuccaucucugcggggugccuaggacucucgcugcgcuauaauucacuucagaaacugaaguacaaccaguuuaaaggcuugaaucagcucacuuggcuguaucuggaccacaaccauauuagcaauaucgaugagaacgcuuucaaugguauucgacgucucaaggaauuaauccugaguuccaacagaauaucuuacuuucuuaauaacacguucaggccggugaccaauuugcggaaccuggaccuaagcuauaaucaacuccacucccuggggucagagcaguuucgcggacuuagaaagcuguugagucuccaucugaggagcaacucuuuacggacaauccccguccgcauuuuccaggauugucgaaaucuggagcuccuugaccugggcuacaacagaaucagguccuuggcccggaacguguuugcaggcaugauucgucuaaaagaacugcaccucgagcauaaucaguucucaaagcugaaccuugcccuguuuccucgcuugguuagccuccaaaaucuguauuuacaguggaacaaaaucagugugauagggcagacuaugucuuggaccugguccagccugcagagacuagaucucucgggaaaugaaauugaggcuuucucugguccauccgucuuucaaugcgugcccaaccugcagaggcuuaauuuggacucaaacaagcugacauucaucggccaggagauucucgauaguuggaucagccugaaugacaucucccuugcagggaacauuugggaauguucucggaauauaugcagccugguaaacugguugaaaucauuuaagggacuccgagagaauaccaucauuugugccaguccuaaggaacugcaaggcguuaacgugaucgaugcugucaaaaauuacuccauaugcgguaagagcacuacagagcgcuucgacuuagccagagcgcugccaaaacccaccuucaagccuaaacuaccaaggccgaagcacgaaucuaaacccccucucccacccacggugggggcaacugagccuggaccagagaccgaugccgacgcugaacacauuucauuucauaagaucaucgccggcaguguggcacuguuccuuagcgucuugguuauucugcucgugaucuacguauccuggaagcgguaucccgcuucuaugaaacagcugcagcagcgcucguuaaugagaaggcaccguaagaaaaagcggcaaagccugaaacagaugacaccguccacucaggaguuuuacguggauuauaagccuaccaacacagaaaccucagagaugcuuuugaacggcacggggcccuguacuuacaauaagaguggaucucgagaaugcgagauuccacucagcaugaacgucuccacauuccuggccuaugaccagccuaccauaucauacugcggugugcaucacgagcuacugagccacaaaucuuuugaaacuaaugcgcaagaggacacaauggaaacccaucucgagacggaacuggaucuuuccaccaucacaacugccggcagaauuagugaccacaagcagcaguuggcauga

SEQ ID NO: 58606 - RNA, 1773 nt, Artificial Sequence
  derived and/or modified sequence opt3 from LRRTM4__Homo_sapiens__NP_001128217
augggcuuccaccugaucacccagcucaaggggaugagcgugguccuuguucuguugcccacauuacugcuagugaugcucacuggagcccaaagagcuugcccuaaaaacuguaggugcgacgguaagauuguauacugugagucccaugcauuugccgauauaccagaaaauaucucuggcgggucacagggacugagucuucgguucaacagcauucagaaacugaaguccaaucaguuugcgggcuugaaccaacucaucuggcuguaucuggaccacaauuacauuucuucgguggaugaggacgcuuuccaggguauccgccgacucaaagaauuaauacugucaagcaacaagaucacguaucuucauaauaagaccuuucacccgguccccaacuugcguaaucuggaucuaaguuacaacaaacuccagacacugcaguccgagcaauucaaggggcuuagaaaacugauuaucuugcaucucaggucuaauagccugaagacugugccuauucggguuuuucaggacugccgcaacuuagauuuccuggaccucggauauaauagacuuaggucccugucacggaacgccuuugcaggcuugcuaaaacugaaggaacuccaccuggagcacaaucaguucaguaagaucaacuuugcccauuucccacgccuuuuuaaccugcgaagcauauacuugcaguggaauagaauuaggucuaucucccaaggccucaccuggacauggucaagccugcacaacuuagaucugagugggaaugacauucagggaaucgagcccgguaccuucaaaugucuaccuaaccuccagaagcugaaucuugauucuaacaaauugacuaauaucucccaagaaacagugaacgcuuggauuagccugauaucgaucacccucucuggcaauaugugggagugcucccggucaauuuguccacuguucuauuggcuuaagaacuuuaaagggaauaaggaaaguacgaugaucugcgcaggacccaaacauauacagggcgagaaggucagcgacgccguggagacuuacaacauuuguuccgaaguacagguugugaauaccgagcguucucaccuggucccucagacaccacaaaagccguugaucaucccccgcccuacuauuuucaaaccagaugugacccagagcacauuugaaacccccucaccuaguccagguuuccagauccccggggcugagcaggaauacgagcacguguccuuucauaagauuauagccggaagcgucgcacucuuccugucuguugcgaugaucuuacuggugauuuauguaucauggaaaagauacccggccaguaugaagcaacuacagcagcacagccucaugaaaaggcggcgaaagaaggcucgcgaguccgaaagacagaugaacucuccucugcaagaguauuacguggacuauaaacccacuaauucggaaacgauggacaucagcgucaacggcuccggcccaugcacauacaccaucucagggaguagggagugugaaaugccucaucacaugaagccccuuccauauuacucuuacgaucagcccgugauuggauauugccaggcccaucagccuuugcacguuacuaaagguuacgagacagugagcccagagcaagacgaauccccgggccuggagcucgggcgggaucacucauuuauagcaaccaucgcucgcagcgccgcgcccgccauuuaucuggaaagaaucgcaaacuga

SEQ ID NO: 58607 - RNA, 2091 nt, Artificial Sequence
  derived and/or modified sequence opt3 from LRSAM1__Homo_sapiens__NP_001177652
augccccuguucuuuagaaagaggaaaccuagcgaggaagcccggaagcgccucgaguaccagaugugccuugcuaaagaagcaggcgccgacgauauccuggacauuuccaagugugaguugucugaaauaccauucggggcguuugcuaccugcaaaguguuacaaaagaagguccugaucguucacacaaaccaucuaacuucacuccugccgaaaaguuguagccuucuguccuuggccacgauuaaggugcucgaucugcacgacaaucagcugaccgcacuccccgaugacuuaggacagcugacagcccuucagguauugaacguggagcgaaaucaacugaugcagcuaccucguucuaucgguaaccucacucagcugcagacccuuaaugucaaagauaacaagcugaaagaguugccagacacagugggcgaacucagaucgcugaggaccuuaaauauuucagggaacgagauccaacggcugccccagaugcucgcucauguucgcacucuugaaaugcugagcuuggaugcaagugccaugguguauccuccaagagaggucugcggagcuggcacagccgcgauacuacaguuccuguguaaggaguccggucucgaauacuaucccccuucucaguaccugcuuccaauccuggagcaagacgggauugaaaauagcagggauuccccggacggacccaccgaucgguuuucacgcgaggaauuggaguggcagaaccgauucagugacuaugagaagagaaaagaacagaagaugcucgagaaacuggaauuugagaggcgguuagaacugggccaacgugagcacacgcagcuacuccagcagucuagcucccaaaaggacgagauccugcagacugugaaagaggaacagucacgccuugaacagggcuugagcgagcaucaaagacaccugaaugcagaaaggcagcggcuccaggagcagcugaagcaaaccgagcagaacauuaguucucgaauccagaaacuucugcaggauaaucaacgccagaagaaguccagcgaaauauugaaaucgcucgagaacgaaagaauuaggauggagcagcugaugucuaucacacaagaggaaacugaguccuuacggcgcagagacguagccucagcuaugcagcagaugcugaccgaaaguugcaagaauaggcuaauucagauggccuacgagagccaacgucagaaccucguucagcaggcauguuccucuauggcugaaauggaugagcgguuccaacagauccugagcuggcagcagauggaccaaaacaaagccaucucacagauucuucaggagagugcgaugcaaaaggccgcauuugaagccuugcaagugaaaaaggaucugaugcaccgacagauaagaucccaggagaugaucagcgaacagaggugggcccucucuucacuguuacagcagcugcuuaaggagaaacagcaacgcgaagaggaguugcgggaaauucucacagagcuggaagcuaagagugagaccagacaggaaaauuauuggcuaauccaguaccagaggcugcucaaccaaaaaccucugagccuuaaguugcaggaggaggggauggaacgccagcuggucgccuuacucgaggaacuguccgcagagcauuaccuuccaauauucgcccaccaucgacugucuuuggaccuccugucgcagaugagccccggagaucuagcuaaaguggguguguccgaggcgggccugcaacacgaaauucuccggcguguccaggagcugcuugacgcagccagaauccagccugaauugaagccacccaugggggagguugugacgccgacugcuccucaagaacccccagagucaguaaggccuagugcucccccagcagagcuggaagugcaggccucugagugcgucguguguuuagaacgcgaggcucagaugaucuuucucaauugcggacacguuuguugcugccagcaauguugccagccccugcggacauguccucuuugcagacaggauauugcccagaggcugcgaaucuaucauagcuccuga

SEQ ID NO: 58608 - RNA, 810 nt, Artificial Sequence
  derived and/or modified sequence opt3 from LRTM1__Homo_sapiens__NP_001291318
augacccugaaccucagcaauaacucccuuucuaaucuggcccccggcgcuuuccacggguugcagcauuuacaagugcugaaccuaacacaaaauucacuccugagucuugagagcagacuguuucacuccuugccucagcucagggaacuggaccugucuucgaacaauaucucacaucucccaacuagcuuaggagagacgugggaaaaccugaccauucuugcaguccagcagaaucaguugcagcagcuggaucgggcccuacucgagaguaugccguccguucgccugcuucuguugaaggacaaccucuggaaaugcaauugucaccuguuaggucugaagcucuggcuugaaaaauucguguacaagggcgggcugacagauggaauaaucugcgagucucccgacacuuggaaaggcaaggauuugcuacguauuccucaugagcuguaucaaccauguccccucccugcgccagaccccguaagcucccaggcucaguggccugguucagcccacggggugguccugcgaccaccggaaaaccacaaugcaggagagagagaacuucuggagugcgaguugaagcccaaaccuaggccagccaaccuccggcaugcuaucgcaaccgugauuaucacaggcguuguguguggcauagucugccugaugauguuagccgcugccaucuacggguguaccuaugcggcaauuacugcccaguaccacggagguccccuggcucaaacaaaugauccuggcaagguggaagagaaagaacgcuuugacaguagcccagccuga

SEQ ID NO: 58609 - RNA, 477 nt, Artificial Sequence
  derived and/or modified sequence opt3 from LRTOMT__Homo_sapiens__NP_001138779
augaacaagagagacuacaugaauaccagcgugcaggagcccccucuggauuauuccuucaggucuauccacgucauucaagaccucguuaacgaggaaccacggacaggccuucgcccgcugaaacgaucaaagagugggaaaagccuuacucaguccuuauggcugaauaacaaugugcuaaacgaucuccgugacuuuaaucagguagccucucagcugcuugaacaucccgagaaccuggcuuggauagauuugucguucaaugaccucacgucaaucgauccugugcugaccacauuuuucaaccugagcguccucuacuuacacggaaauaguauucaaagacugggugaagugaacaaguuggcaguuuugccaaggcugcggucccuaacucuccauggcaaucccauggaggaggaaaaaggguaucgcgugccuggaucugucgagaugccacacagacccccuuga

SEQ ID NO: 58610 - RNA, 1017 nt, Artificial Sequence
  derived and/or modified sequence opt3 from LSAMP__Homo_sapiens__NP_002329
auggugagaaggguccagcccgaccggaagcaacugccucucguucuucugcgcuuguuaugccugcuaccaaccggccucccggugcgaagcguagauuucaaccgugggacagacaauaucacugugagacagggagauacggccauucugaggugugucguggaggacaaaaacuccaagguugcuuggcuuaaucggucugguauaaucuuugcaggccacgauaaauggucacuggacccccgcguggaauuggagaagagacauagucucgaauacagccugaggauucagaaagucgauguguaugacgagggguccuauaccugcucuguacagacacaacacgaaccuaagacuucgcagguuuaccugaucgugcaggucccacccaagauuucaaacaucagcagugaugugaccgugaaugagggauccaacgucacacucguuuguauggccaauggccggccugagccagugauaaccuggcgccauuuaacucccacaggucgagaguucgaaggggaagaggaguaccuggaaauccuuggaauuaccagagagcagucuggcaaauaugaaugcaaggcggcuaacgagguaagcuccgccgacgugaaacaagucaaggugacgguuaauuacccuccaacuaucaccgaaucaaaaaguaacgaggcaacaacuggcaggcaggccagcuugaagugugaggcuucugcagugccggcccccgauuuugaaugguaucgggacgauacccguauuaauuccgcuaacgggcuggagaucaagucaacagaaggacagagcagucuaaccgucacgaaugugacugaggaacacuacgguaacuacacaugcguagccgcgaauaaacucggcguuaccaacgcaucucuggugcuuuuccgcccuggguccgucagaggaauaaacggcagcauuucgcuggccgugccauuguggcuccuggcugccucuuuacugugucuccuuuccaagugcuga

SEQ ID NO: 58611 - RNA, 1083 nt, Artificial Sequence
  derived and/or modified sequence opt3 from LSM11__Homo_sapiens__NP_775762
auggaggaaagagagaggggcgcccggagcgcuggggcaggaucccccgcccgcccuccaucuccgcgacuggacgugucaagugauagcuucgacccccuccuugcgcuguacgcuccucguuugccacccaucccuuauccaaacgcccccugcuuuaauaacgucgcagaauacgaguccuucuuaagaaccgguguuaggggcgggggacggggccgcgguagagccaggggagcugcagccgggucuggcgugccugcugccccaggcccgucggggcggacacgccgaagacccgaugcgccugcaccagaccccgaaaggauucagcggcugcgucgccuaaugguagccaaggaggagggagauggugcugccggcgcagggagaaggggaccuggccggucacgaaaagcuccacgcaaugugcucacuagaaugccccugcacgaagguagcccgcuuggggagcugcauagguguauacgggaaggagucaaggugaacguucacauccgcacguuuaaaggcuugagaggcgugugcaccggguuccucgucgccuuugacaaguucuggaauauggcgcugacagauguggacgagacuuauaggaaaccuguacugggaaaggccuacgagcgugauaguucccucaccuuaacacggcuguuugaccgacuuaaguugcaagauucuagcaaaaaggaagcagacuccaaaucagcuguugaggauaguacccugagcagauauucucagacuuccacauggaagcuagccucagugugggguagggcugacaccggccgcgggagccauaaacggaguagaucuguccccuccagccuccaggccucggcaagggaagagucucgcuccgaacugucaggacgaacgacucggaccgacggcaguagcgugggugggacauucucccgugccacuacccuuucuagaggccagagcaggaagaagaaacgcaagccaaaaguggauuaccaacaggucuuuacacggcacauuaaccagaucuucauuagaggagagaauguucuguuggugcaucucgcucaguga

SEQ ID NO: 58612 - RNA, 402 nt, Artificial Sequence
  derived and/or modified sequence opt3 from LSM1__Homo_sapiens__NP_055277
augaacuacaugcccggcaccgccagccugaucgaggacauugauaagaaacaccucgugcuucugagagacgggaggacauugauaggauucuuacgguccaucgaucaguuugcuaaucugguccuacaucaaacuguugaacgcauucacguggguaagaaauauggcgacaucccucgagggauuuucguagugcguggagagaacgucgugcuccugggcgaaaucgaucuugagaaggaaucugacacgccacugcagcagguuucaauagaggagaucuuggaggaacagagaguggaacaacagaccaaacucgaggcagagaagcugaagguccaggcccugaaagauaggggucucaguauuccgcgggcggacacauuagaugaauacuga

SEQ ID NO: 58613 - RNA, 288 nt, Artificial Sequence
  derived and/or modified sequence opt3 from LSM2__Homo_sapiens__NP_067000
augcuguucuacagcuuuuucaagucccucgugggcaaagacgucguuguggagcuuaagaacgaucugucuaucugcgggaccuugcacucaguagaccaguauuuaaauauuaaacugacagauauaagugugacugaccccgaaaaguacccucauaugcuaagcgucaaaaacuguuuuaucagaggauccgugguuagguaugugcaacucccagccgaugaggucgacacgcagcugcuucaggaugcugcacggaaggaagcccugcagcaaaagcaguga

SEQ ID NO: 58614 - RNA, 309 nt, Artificial Sequence
  derived and/or modified sequence opt3 from LSM3__Homo_sapiens__NP_055278
auggccgacgauguggaccagcaacagaccacaaacacugucgaggaaccccuggaucucaucagacuuagccuggacgagaggauuuacguuaagaugcggaaugaucgcgaauugcgaggccguuuacacgcuuaugaccagcaucugaacaugauacuaggggauguggaggaaacgguaaccacaaucgagauugacgaggaaacuuacgaggaaaucuauaaauccaccaagagaaauauuccuaugcuguucgugaggggagauggugucgugcucguugcaccaccgcuucgggugggcuga

SEQ ID NO: 58615 - RNA, 420 nt, Artificial Sequence
  derived and/or modified sequence opt3 from LSM4__Homo_sapiens__NP_036453
augcugccccucagccuucugaagaccgcccagaaccacccuauguugguggagcugaaaaauggcgaaacauacaacgggcauuuagucuccugcgacaauuggaugaacaucaaucuaagagagguuauuuguacuucuagggauggagacaaguucuggcggaugccagaaugcuauauacgcgguucaacgaucaaauaccuccggauuccggaugagaucauugacauggugaaggaagagguaguggcuaaaggccgugggagaggaggccugcaacagcagaagcagcaaaaggguagggggaugggaggcgcaggccgaggggucuuuggaggucgcggcagagggggaauccccggcaccgguagggggcagccugagaaaaagccaggacggcaggccggcaaacaguga

SEQ ID NO: 58616 - RNA, 276 nt, Artificial Sequence
  derived and/or modified sequence opt3 from LSM5__Homo_sapiens__NP_036454
auggccgcuaacgcaaccacaaaucccagccagcugcucccucuugagcugguggacaagugcaucggcuccaggauucacauagucaugaaaucugauaaggaaaucguugggacuuuguuaggauucgacgauuuugugaacaugguacuggaggacgugacggaguucgaaauuaccccagaagguagacggaucacaaaacuagaucaaauucuccugaauggcaacaauaucacuaugcuuguccccgggggagagggcccggagguguga

SEQ ID NO: 58617 - RNA, 243 nt, Artificial Sequence
  derived and/or modified sequence opt3 from LSM6__Homo_sapiens__NP_009011
augagccugagaaagcagacccccuccgacuuccucaaacaaaucauuggcaggccuguggucguuaaacuuaacucugggguggauuaccggggaguacuggccugcuuggacgguuauaugaauauagcuuuagagcagacagaagaguacgugaacggccagcugaagaauaaguauggggaugcauuuauccgcggaaacaauguccuauacauuucaacucagaaacgacguauguga

SEQ ID NO: 58618 - RNA, 312 nt, Artificial Sequence
  derived and/or modified sequence opt3 from LSM7__Homo_sapiens__NP_057283
auggccgacaaggagaaaaagaaaaaggaaagcauccuggaucucuccaaauacauugacaagaccauaagagugaaguuccagggcgggagggaggcuucuggaauccuuaaagguuuugauccccuguugaacuuaguccuggacggcacaauugaauauaugcgggauccugacgaucaauacaagcuaacugaggacacgcgccagcucgggcugguugugugccgaggaaccucaguagugcuuaucuguccacaggauggcauggaagcaauuccgaaucccuucauccagcaacaggacgccuga

SEQ ID NO: 58619 - RNA, 834 nt, Artificial Sequence
  derived and/or modified sequence opt3 from LSP1__Homo_sapiens__NP_001013273
augcugcucagccuuaagcccuccgaggccccugaacuggacgaggaugaaggcuucggggacuggucucagagaccagagcaaaggcagcagcacgaaggagcucagggugcauuggauucaggcgagccgccccaaugccggaguccugagggggaacaggaggaccgcccaggauuacaugccuacgaaaaagaggauagcgacgaggugcaccuggaagaacuaucccucucuaaggaaggccccgguccugaggauaccguccaggacaaccugggggcggcuggagccgaagaggagcaggaggagcaucaaaaaugucagcagccacgaacacccucgccucuuguucuggaaggcacuaucgagcagucaagcccaccguugagucccacgaccaagcucauugaucguacagaaucccugaauagaucuauagagaaaagcaacuccgugaagaagucacaaccugaccugccaaucaguaaaauugaucaguggcucgagcaguauacucaagcaaucgaaaccgccggcaggacacccaaguuagcucggcaggcaagcauugagcugccuucuauggccguagcuuccaccaaaucacgcugggaaacuggggaggugcaggcccagagcgcggcaaagacaccaaguugcaaagacaucgucgccggagauaugucuaagaagucccuuugggaacaaaaagguggcagcaagaccucgucuacgauaaaauccacucccucagggaagagauacaaauuuguggcuaccggacacggcaaguaugagaaaguuuugguggagggugggccggccccuuga

SEQ ID NO: 58620 - RNA, 1890 nt, Artificial Sequence
  derived and/or modified sequence opt3 from LSR__Homo_sapiens__NP_001247418
augcagcaagacggccugggggugggaaccagaaacgguagcggcaaggggagguccguccaccccucuuggccuuggugcgccccacggccgcuccgcuacuucggacgagaugcucgugcaagaagggcccagacagcggcuauggcccuucuggcaggcgguuugucacggggguuaggaagucaucccgccgcugcaggccgcgacgccguuguguuuguauggcugcuacucagcacuugguguacggcuccugccagagcgauccaggugaccgucuccaauccauaucacgugguuauucuguuccagcccgugacacuuccuugcacuuaccaaaugaccucuacaccaacccagcccauagucaucuggaaauauaagucguuuuguagggaucggauugcagacgccuucucacccgcuagcguggauaaccagcugaaugcccaguuggcagcuggcaacccaggguacaauccguauguagagugccaagacaguguucgcacugugcgagucguggccacaaaacagggaaacgcggugacccucggugauuacuaucagggcagaaggaucacgauuacugggaaugccgaccugaccuuugaucagacagcauggggagacuccggcgucuacuacuguucuguugugagcgcucaagaucugcaggguaacaaugaagccuaugcugagcucaucguauuagacuggcuguucguggucgugguuugccuugccgcauuuuugauauuccugcuacucgggaucuguuggugccaguguugcccccauacuuguugcugcuacgugcgguguccuugcuguccagauaagugcuguugccccgaagcccuguaugcugcgggaaaagcagccaccuccggcgucccuucaauuuacgcuccaaguacauaugcccaccuuagccccgcaaagaccccgccucccccagccaugaucccuaugggccccgcuuacaacggguauccaggagguuaccccggcgacguggaccguucuuccucagccgggggacaaggcagcuacguaccucuguugcgcgauacggacaguucuguugcauccgugagaagcgguuauaggauucaggcgucgcagcaggaugacucuaugcggguccucuacuauauggagaaggaacuggcuaauuuugauccaucccgaccggggcccccuucaggccgcguggagagagccaugagugaggucacuagcuuacaugaagacgauuggaggucccggccaucucgcggacccgcacugacaccuaucagagacgaggaauggggcgggcacagcccaaggucaccccguggaugggaucaagagccggcccgggagcaggcugguggcggguggcgagccagaaggccucgcgcacggaguguggacgcucucgaugaccuuaccccacccuccacugccgaaagcggaucuagaucaccuacaaguaacggcgguaggagccgcgcguacaugcccccacgaucccggucucgugacgaucuguaugaccaggaugacucgagagauuucccuaggagccgcgacccccacuacgaugacuuucgguccagagagaggccaccggccgauccucgaucacaucaccaucgcacccgggaccccagagauaaugggaguaggucuggcgacuugccauaugauggacgucuacuggaagaggcuguucgcaaaaagggcagcgaggaacggagaaggccccacaaagaggaagaggaagaggcauacuacccuccagccccuccuccguauuccgaaacggacucacaggcuagccgagagcggcgccucaagaaaaaccuggcccuuucuagagagucccuggugguauga

SEQ ID NO: 58621 - RNA, 2199 nt, Artificial Sequence
  derived and/or modified sequence opt3 from LSS__Homo_sapiens__NP_001001438
augaccgagggcacaugccugagaaggcgcgggggacccuacaagacugaaccugccacggaccucggucgguggcgacuuaacugugagcguggcagacagaccuggacauaucugcaagaugaaagggcugggcgggagcagacuggauuggaagcauacgccuuaggccuggacaccaaaaauuauuucaaggaucuaccaaaagcgcacacagcuuuugagggugcccucaacgggaugaccuucuacgugggacugcaggcagaggacggccauuggacuggcgauuaugggggaccgcuuuuucuguugcccggucuccugaucacaugccacgucgcccgcauuccucugccagcuggcuacagagaagagauaguuagguaucuccggagcgugcaguuacccgacgggggauggggccugcauaucgaagauaaguccaccguauucgguacggcacuuaauuacgugucuuugcgcauucugggggucggaccugacgauccagaccuagugcgagccagaaacauccuccacaaaaagggcggcgcuguugccauucccucaugggggaaguuuuggcuggcggugcuuaaugucuacaguugggagggacugaacacuuuguucccugagauguggcucuuuccagauugggcaccggcccaucccagcacccuguggugucacugcaggcaaguguauuuaccuauguccuacuguuaugcuguacggcugucugccgcagaagacccacucguucagucgcuucgucaggagcuguacguggaagauuucgcuucaaucgacugguuggcccagcgcaauaacgucgcgcccgacgagcuauauacaccucacagcuggcugcucagagugguguacgcccugcuuaaucuguaugaacaucaccauagugcacacuugaggcaacgggcuguccagaaacucuacgagcacauaguugccgaugaccgauuuacuaaguccaucucuauugguccaaucagcaaaaccauuaacaugcuggugcgcugguacguagauggccccgcuuccacagccuuccaggagcaugugucaagaaucccggacuauuuauggauggggcuggauggaaugaagaugcagggcaccaaugguagucaaauaugggacacggcauuugccauucaggcucuacucgaagcagggggccaccauaggccugaguucagcucuugccugcagaaagcgcacgaauuucuucgguugucccaaguccccgauaacccaccugacuaccagaaguauuaccgccagaugagaaagggaggcuucucauucagcacucuggauuguggguggaucgugagugacugcacagccgaggcucucaaagccguucugcuucugcaggaaaaguguccccaugugaccgagcacauuccaagggagcguuugugcgaugcagucgccgugcuccugaauaugcggaaccccgacggagguuuugcuacuuaugaaacaaaacgaggcgggcacuuacuggagcuacucaauccuucugaaguauucggagacaucaugaucgauuacaccuauguugaguguacguccgccgugaugcaagcacugaaguacuuucauaaaagauucccagaacacagggcggcugagauucgcgagacccuuacacagggcuuggaauuuugccggagacagcagagggccgacgguagcugggaggggucguggggcgucugcuucacuuacggaaccugguuuggccuggaagcauucgccuguauggggcaaacauaucgcgauggaacugcuugcgccgaggugucucgagcaugugacuuucuccugucccggcagauggcugaugguggcuggggagaggacuucgaaucaugcgaggaacguagauacuuacagagugcccagagccaaauacauaacaccuguugggcgaugauggggcugauggccgucaggcacccggauaucgaggcucaggaacgcggcgugcggugccuuuuggagaagcagcuccccaacggugacuggccucaggagaauauugcagggguuuuuaacaaauccugugccaucucuuauacaagcuacagaaauauauucccaauuugggcucugggcagguuuucacaacuauaucccgaacgagcccuggcaggacacccuuga

SEQ ID NO: 58622 - RNA, 201 nt, Artificial Sequence
  derived and/or modified sequence opt3 from LST1__Homo_sapiens__NP_995309
augcugagcagaaacgacgauaucugcauuuacggcgggcucggacuugguggccuguuguuacuggccgugguccuacucuccgcuugucugugcuggcuucacaggcgggcacccucuguucuggugccugggccaggauugcuccgcgccggcaccccgcuguguauaucagcggaggcugccagugcacagcaauga

SEQ ID NO: 58623 - RNA, 1836 nt, Artificial Sequence
  derived and/or modified sequence opt3 from LTA4H__Homo_sapiens__NP_000886
augcccgagaucguggauaccugcagccuggccuccccugcuucugucuguagaacaaagcaccuccaucuuaggugcucaguugacuucacucggcgcacgcugaccggcacagcagccuugacugugcagagucaagaagacaacuuacgaagccugguacuagauaccaaagaccucacaauugagaagguggucauaaaugggcaggaagugaaauacgcgcugggagagcgucaguccuauaaggguucuccaauggaaaucucgcuuccgauugcucugucaaagaaccaggagaucguuauugagaucagcuuugaaaccagucccaaguccucugccuugcaauggcucacuccugagcagacaagcggcaaggaacacccauaccuguucucccagugucaggcaauacauugcagagccauccugcccugucaagauaccccuucagugaaacucacguauacugcugaggucagugugccaaaggaguuaguagcacugaugagcgccauuagggacggggaaacccccgauccugaggacccaucucggaaaaucuacaaguuuauucagaaaguuccgauccccugcuaucuuauagcuuugguggucggagcccuggaaucccgccagauuggcccuagaacacuuguguggucagagaaggaacagguggagaaaagcgcguacgaguucagugaaacugagucuaugcucaaaaucgcagaagaucugggugggccauaugucuggggacaauacgaccuucugguuuugcccccuuccuuuccauacggcggcauggagaaucccugucucaccuucgugacaccgacccuguuagccggggauaagagccugucgaacguaauugcucacgaaaucucucauuccuggacgggaaaucucgugacuaacaaaacaugggaccacuuuuggcuuaaugagggucacaccgucuaucuggagaggcauaucugcggccgguuguucggggaaaaguuucgccacuucaacgcccuaggaggcuggggugagcugcaaaauucagugaaaacuuuuggggaaacacauccuuucaccaagcucguuguggaucugacggacauugaccccgaugucgcauacaguagcgugccauaugagaaaggauuugcucuacuguucuacuuggaacagcuccugggcggcccugagauauucuuaggguuucugaaggccuauguagagaaguucuccuacaaaucuaucaccacagacgauuggaaggacuuucuauauagcuacuucaaagauaagguugacgugcucaaccaggucgauuggaaugcguggcuguacucacccggacuuccacccauuaaaccuaacuaugacaugacuuugaccaaugccuguaucgcacugagucagcgauggauaacagcuaaggaagaugaccucaacuccuuuaaugccacugaucugaaggaccuuagcucucaccagcugaacgaguucuuggcucagacccuccaaagagccccacugccguuaggucacauuaaaaggaugcaggaaguguacaacuuuaaugcaaucaacaauucagagauccgguuccguuggcugcgccuaugcauucagaguaagugggaggacgccaucccccucgcucugaaaauggcgacagaacagggcagaaugaaguuuaccaggccucuuuucaaagauuuggcagccuuugacaagagccaugaucaagcuguccggacuuaucaggagcacaaggccuccaugcauccagugacggcaaugcugguugggaaagaccucaagguggauuga

SEQ ID NO: 58624 - RNA, 618 nt, Artificial Sequence
  derived and/or modified sequence opt3 from LTA__Homo_sapiens__XP_011512920
augacacccccugagagacuguuccucccaagggugugcggcaccacucuucaccuguuguuacuggggcuacuccugguccuucugccgggagcccaggguuugcccggcguugggcucacgccuagcgcugcacaaaccgcccggcagcauccaaagaugcaccuggcgcauuccacacugaaacccgcugcccaccucaucggagacccuucuaagcagaacucauuacuguggcgcgcaaauacugaucgagccuuucuucaggacggcuucaguuugagcaacaauucccugcuagugccaaccucugguauuuacuuuguauauucgcaaguggucuucucagggaaggcuuacagccccaaagcaacaaguuccccucucuaucuggcccaugaagugcagcuguuuucuagccaguacccauuccacguuccgcuuuuguccucacagaaaaugguguaucccggacuccaagagccuuggcugcacaguauguaccauggcgcugccuuucaguuaacccagggcgaucagcugagcacucacacagacgggauaccacaucucguccuuucucccuccaccguguucuuuggagcguucgcacuguga

SEQ ID NO: 58625 - RNA, 1077 nt, Artificial Sequence
  derived and/or modified sequence opt3 from LTB4R2__Homo_sapiens__NP_062813
augagcgugugcuacagacccccuggcaacgagacccugcucuccuggaagaccucuagggccacugggacggcuuuccuucuguuggcagccuuacugggacuaccagguaauggcuuugucguuuggucacucgcgggguggcggccggcucgcggacgaccccuggccgcaacccuugugcugcacuuggcccucgcugacggcgcaguacugcugcucacaccuuuauucguggccuuucugacucgucaggcuuggccacuuggucaagccggguguaaagcggucuauuacgugugcgcauugaguauguaugccagcguucugcuaaccggacuccugucccuucagagaugucuggcugugacaaggcccuucuuggccccucggcuccgcucuccagcacuggcuagaagguuacugcucgccgucuggcuugcggcccuguugcuagcagugcccgcugccguauaccggcaucuguggcgcgaucgaguuugccagcucugucacccuucgccagugcaugcugccgcacaccugucacuugaaacccugacugccuuugucuugccguucggccucaugcugggcugcuauagcgugacauuagcuagacugagaggggcgcgguggggaaguggucgucauggcgcacgcguggggaggcuagucuccgccaucguucucgcuuuuggacugcuuugggcccccuaccacgcagugaacuugcugcaggccguagcugcccucgcaccuccagagggcgcgcuggcuaaacuugguggggccggacaagcagccagggcuggcaccacggcccuggcauucuuuucuagcuccgugaaucccgucuuguauguguucacugcuggcgaccuccugccucgggccgggccacgauuuuuaacccgccuguucgaaggaucaggugaggcgagaggcgggggaaggagucgggaaggcacaauggagcuacgcacuacaccccagcucaagguugugggucaggggagaggcaacggagauccgggcgggggaauggagaaggacgguccugaaugggaucuguga

SEQ ID NO: 58626 - RNA, 1059 nt, Artificial Sequence
  derived and/or modified sequence opt3 from LTB4R__Homo_sapiens__NP_001137391
augaacaccacaagcuccgccgcucccccuucucugggcguggaguucaucucacuccuugcaauuauacuguugagugucgccuuagcgguugggcugccaggaaauagcuuugugguaugguccauccuaaagagaaugcagaaaaggucugugacugcucucaugguccugaaccuugcccuggcagacuuggccgugcuccugacggcuccguucuuucugcacuuccucgcacaagguaccuggucguuuggcuuagccgggugccggcugugucauuacguuugcggagugucaauguaugcuagcguccuuuugauuacagccaugagucuggaucgcucccuagcgguggcacgacccuucguaucucagaagcuccguacuaaagccauggcuagaaggguucuggccggcaucugggugcuuagcuuucuguuggcaaccccuguccucgcuuaccggacaguggugccauggaagaccaauaugucccuguguuucccccgcuauccuucagaaggucacagagccuuucauuuaauuuucgaggcggucacuggguuucugcucccauuccuugccguuguggcaaguuacagcgacaucggaaggcggcugcaggcucgccgauuuagaaggucucggcguacaggccgcuugguagugcuaauaauccugaccuucgccgcuuucuggcuccccuaucacgucgugaaccuggccgaagcaggcagagcccuugcugggcaggcggcaggacuggguuugguuggcaaaaggcucucccuggcccggaauguguuaauugcucuggccuuucuaucaagcagugucaacccugugcucuacgcaugcgccgggggaggccugcuucgaucugcugguguaggguucguugccaaguugcuggagggaacgggcuccgaagcaagcucgacucgcagaggcgggucucucggacaaaccgcgagguccgguccagcugcccuggagccgggccccucagagagucuuacagcaagcuccccucugaaguugaaugaacucaacuga

SEQ ID NO: 58627 - RNA, 735 nt, Artificial Sequence
  derived and/or modified sequence opt3 from LTB__Homo_sapiens__NP_002332
augggcgcccuggggcucgagggaagagguggcaggcuucaggggcggggaagccuguuguuagcuguggcaggcgccaccucccuggucacacuacuccuggcgguucccaucacugugcuugcuguacuggccuuggugccucaagaccagggugggcucgucacggaaaccgcagauccaggagcccaggcucagcaaggccugggcuuccagaagcugccggaggaggaacccgaaacagaccucucuccuggguuaccagcagcccaccugauuggagcuccccuuaaaggucagggcuuggggugggagacuaccaaggagcaggccuuucugacaucaggaacccaauucagugaugcggaaggccuagcacucccucaggacggucuguacuaucuuuacugccuggugggguaucgcggacgagccccacccggcggcggggauccucagggacguagcguuacuuugagauccucucucuacagggcugguggcgccuaugggccaggaacaccggagcuguuacuggaaggcgcagagaccgugacgcccguccucgacccugcucggcgccaggguuacgggccacuuugguauacuucggugggcuuuggaggccugguacaauugagaaggggagagcggguuuacgugaacauaucacaucccgauauggucgacuucgcccgcgggaaaaccuuuuucggugcggugauggugggcuga

SEQ ID NO: 58628 - RNA, 4188 nt, Artificial Sequence
  derived and/or modified sequence opt3 from LTBP1__Homo_sapiens__NP_000618
auggacaccaagcugaugugccuccuuuucuuuuucagccugcccccuuuguuaguguccaaccacacaggcagaaucaaagucguuuuuacuccaucuauuuguaaggugacgugcaccaaagggucaugucagaauaguugcgagaagggaaacacaacuacccugauaagcgaaaauggucaugccgcugauacacuaaccgcaacuaacuucaggguagugaucugucaccucccgugcaugaauggcgggcaauguuccucucgggacaaaugccagugucccccuaacuuuacaggaaagcugugccagauuccaguccauggcgccucggugcccaaacuuuaccagcacucacaacagccugguaaagcgcuggggacccauguuauccacagcacgcacacuuugccacucaccgugacaagucagcagggagucaaggugaaauuucccccuaauauuguaaacauccauguuaagcacccaccggaggcuuccgugcaaauacaucaggucucucgcaucgauggccccacuggccagaaaaccaaggaagcccagccugggcaaagccagguguccuaucagggacugccagugcaaaagacacagaccauucacucaacguacagucaccagcaggucaucccccauguuuauccuguggcagccaaaacucaacugggucgauguuuccaggagacaauuggcagccagugcgggaaggcucucccaggauuaucuaaacaggaagacugcuguggcaccguagguacuuccuggggguucaauaagugccaaaaaugucccaagaaaccgucauaccacggauauaaccagaugauggagugccugccuggcuacaagcgugugaauaacacauuuugucaggauaucaaugagugccagcuucaaggcgucugucccaacggggaaugcuugaauaccaugggaagcuauagauguacgugcaagauagguuucggcccagacccuaccuuuaguucuugugugcccgauccacccguuauuuccgaggaaaaagggccuugcuacaggcuggugagcucgggacggcagugcaugcauccacuaucuguccaccucacaaagcagcuguguugcuguuccgugggcaaagcaugggguccgcauugcgagaaguguccccuuccugggacugccgcuuucaaagagaucugcccaggcggaaugggcuacaccguaucagggguucaccgcagaaggcccauucaccaucacgugggaaaggguccugucuuugugaagccaaagaacacacagcccgucgccaagaguacucauccgccuccacugcccgcgaaagaggaaccuguggaagcauugaccuucagccgggagcacggccccgggguugccgaaccagagguggcuacagccccucccgagaaggaaaucccaucccucgaccaagagaaaaccaagcuggaaccgggacagccucaguuaucucccggcaucagcacuauucaucugcacccacaauuccccguagucauagagaagacgucaccuccagugcccguugaaguggcaccugaggcuaguacauccagcgccucucaggucaucgcgccgacccaggugacugagauuaacgaauguaccguaaauccagauaucugcggugccgggcacuguauaaaccuccccgugcgcuauacaugcauuuguuacgagggcuaucgauuuucagaacagcaaagaaaaugcguugacaucgaugagugcacccagguccagcaucuuuguagucagggaaggugcgaaaauacugagggcagcuuccuguguaucugcccugcaggguuuauggcuuccgaggaaggaacaaacuguauugacguggaugagugcuugcggccagacguguguggugaaggccacugcgucaauacgguuggggccuuccguugugaguacugcgacucuggauaucgcaugacccaaagagguaggugugaggauaucgacgaaugccuaaaccccucgacuugcccugaugagcagugugugaauagcccgggcuccuaccagugcgugcccuguacagaaggguuucggggcuggaacggacagugccuggacguagaugagugucucgaaccaaaugucugcgcuaacggcgacuguucaaaucuggaggggaguuauaugugcucuugucauaagggauacacccgaacaccugaucacaaacacugccgcgacauugaugagugucaacagggcaaccuuugcgugaauggucagugcaagaacacugaagggagcuucagauguaccugcggacaaggcuaccagcuguccgccgcaaaagaccagugugaggauauagacgaaugccagcauaggcacuugugugcccauggucaaugccggaauacggagggcucauuucaguguguuugcgaccagggguaucgcgcuagcggacucggcgaucacugugaagacaucaacgagugccuggaggauaagucugugugucagagaggggacugcauuaacaccgcgggauccuacgauugcacaugucccgacggcuuccaauuagaugacaauaagacuugccaggauaucaacgaaugugagcauccaggucugugcgggccucagggagaaugucuaaauaccgagggcaguuuucacugcgucugucagcaagguuucagcaucucugcagacggcaggacaugcgaagauauugacgagugugugaacaauacuguuugcgauucccacggguuuugugacaacaccgccggaucauuccguugccucuguuaucagggcuuucaggcuccccaggacgggcaaggaugcguggauguaaaugagugcgaacugcuuaguggcgucuguggugaggccuucugcgaaaacguggaggggagcuucuugugugugugcgcagacgagaaucaggaauacucgccaaugacgggacagugucggucccgaacaucuaccgaucuggacgucgauguugaccaaccgaaagaggaaaagaaagagugcuauuacaaccucaaugaugccagccugugugacaacgugcuugcuccuaauguaacuaagcaggaaugcuguugcacaucaggcgccgguuggggcgauaacugugagauauuucccugcccagugcuggggaccgcagaguucacugaaaugugccccaaaggaaagggcuuugucccugcgggggagaguuccucugaagcuggaggcgagaauuauaaagacgccgaugaaugucuccucuucggucaggagaucugcaagaacggguuuugucugaacaccagaccaggauacgagugcuacuguaagcagggcacauauuacgaccccgugaaauuacaaugcuucgauauggacgaaugucaggacccuagcuccugcauugauggccaguguguuaauacggaggggucauauaacugcuuuuguacccauccgauggugcuggacgcaagcgaaaagaggugcauccgcccagccgagaguaaugaacagauugaggagacugaugucuaccaagaccuaugcugggaacaccucucugaugaguauguguguucccggccccugguuggaaaacagacaaccuacacagaaugcuguugccuuuauggugaggcuuggggcaugcagugugccuugugcccucugaaggacagcgaugacuacgcacagcucuguaacauccccgugacugggagaaggcaaccauacggacgcgaugcucuggucgacuucucggagcaguauaccccugaagccgaucccuacuuuauacaggaccgauucuuaaauucauuugaggaacugcaagcggaggaaugcggcauccuuaacgguugugagaaugggcggugcguacgugugcaggagggauauacgugugacugcuucgauggcuaccauuuggacacagccaaaaugaccugcguugaugugaacgaaugugacgagcucaauaacagaaugucucugugcaagaaugcuaaguguauuaacacugauggcaguuauaaaugccuaugucugccaggguacgucccuuccgacaagccgaauuauugcacccccuugaacacagcacugaaucuugaaaaagauagcgacuuggaguga

SEQ ID NO: 58629 - RNA, 5466 nt, Artificial Sequence
  derived and/or modified sequence opt3 from LTBP2__Homo_sapiens__NP_000419
augagacccaggaccaaggcccggagcccuggccgcgcucugcgaaacccauggcguggguuccucccgcuuacacuggcauuguuugugggagccggucacgcgcagagagaccccgucggcagguacgagccugcugggggagaugccaaucgguuacgcagaccaggcgguuccuaucccgcagccgcugcagccaaaguuuacucucuguucagggaacaagacgcuccuguggccgggcuacagccaguagagcgggcgcagcccggauggggcucaccucgccgaccaacugaagcagaggccagaaggccgagucgggcucagcaaagccgucgcgugcagcccccugcccagacgagaagguccaccccacucggccagcaacagcccgcaccucggacacgagcugccccagcgcugccccgccuugggacuccgcagagaucuggagccgcaccucccaccccaccuaggggucggcugacaggccgcaacgucugcgggggacaguguugccccggcuggaccacugcuaauucgacaaaccauuguaucaagccagugugcgaacccccuugucaaaauagagguucaugcagcaggccacaguuguguguuugccguaguggguuucggggagcccgaugugaggaggugauuccggaugaagaguucgacccccagaacuccagacucgcuccuaggcgcugggccgaacggucuccaaaucugagaaggagcuccgcagccggcgagggcacccuggcucgcgcgcaacccccugcaccacagucacccccggccccucagaguccacccgcugggacgcucagcggauuaucucagacucacccuucccaacagcaugucggucugucacgaaccgugcggcuucaccccacagccacugcaagcagucaguugucuuccaacgcccugccaccuggccccgggcuagagcagcgugauggaacccaacaggcuguaccacucgaacauccgagcucgccuuggggccugaaucuuacagagaaaauaaagaaaaucaagauuguuuuuacccccacgaucugcaagcagacuugugccagaggucacugcgcaaacucuugcgaaaggggggacacaaccacucuguauucccagggcggacacggccaugauccaaaaucaggguuccgcauuuacuuuugucaaauccccugcuugaauggaggucgguguauaggcagagacgagugcugguguccugcgaacaguacagggaaguucugccaccucccaaucccccagccugauagggaaccgccaggacgaggcagccgcccccgggcucuguuagaggccccucugaaacaguccaccuuuacgcucccacuuucuaaucagcuggcaagcgugaaccccucauuggucaaggugcauauucaccacccuccggaggccagugugcaaauccaucaggucgcucagguuagaggugggguggaagaggcccuaguagaaaauuccguggagaccaggcccccaccuuggcugcccgcaagcccaggccacucucucugggacucaaacaacauuccugcucguaguggagaacccccacgcccgcugccucccgccgcgccacggcccagaggccuucuggggagguguuauuugaauacagucaacggacaaugcgccaauccucuccuggaguuaacuacccaggaggauuguugcgguagcgugggcgcuuucugggggguuacacugugugcaccaugccccccucgaccggccuccccagugaucgaaaacggacagcuagagugcccccagggcuacaaacggcucaaucugacucauugucaagacauaaacgaaugccuuaccuugggucuguguaaggaugcugagugcgucaauacacgcgggucuuaucucuguaccugcagaccuggccugaugcuugaccccucgaggagccgguguguguccgacaaggccauuucaaugcugcagggauugugcuaccgaagucucggcccagggacuuguacgcugccuuuagcacagagaaucacaaaacagauuugcuguugcucucgcguaggaaaggcguggggcagcgaaugcgagaaauguccccugccagguaccgaggccuuuagggaaaucugcccugcugggcacggauacacuuaugccuccucagauauccgucuaagcaugcggaaggcagaggaagaggagcucgcuagaccgcccagggaacaaggccagcgcucuuccggugcccugccaggcccugcagagcgacagccccuuagaguugugaccgacacaugguuggaagccgggaccauuccagauaaaggagacagucaggcuggccaagucacuacaagcgugacgcaugcgccugccugggucaccgggaacgcaacuacacccccgaugccagagcagggaauagcugaaauccaggaggagcaagugaccccuucuacagauguucuggugacucucuccacccccggcauugaccggugugccgccggugcuacgaauguaugcgggccaggaaccugugucaaccugcccgauggcuacaggugcguguguucaccugguuaucaguuacacccgagucaggcauacugcacagacgauaaugaaugucugcgcgaccccugcaagggcaaagggcguuguaucaacagaguuggaagcuauucgugcuucugcuacccaggcuauacucuugccaccuccggggcgacacaggagugucaagauauaaaugaaugcgagcagccuggaguguguucuggcggucagugcacuaacaccgaagggagcuaccacugugagugcgaccagggauacauuaugguccggaagggccauugucaagacaucaaugagugcaggcaccccgguacguguccugauggccgcugcgugaacucaccagggaguuauacauguuuggcuugcgaagagggauaccgaggccaguccgggucuugcguagacgugaacgaaugucucacccccggaguuugcgcccauggcaaguguacuaaucuggaggguagcuuuagaugcuccugugaacagggguaugaggucacaucagaugagaaaggaugccaggacguggaugaaugugcaagccgggccaguugcccuaccggccuaugucugaacacugagggcucuuucgcuugcuccgcaugugaaaauggguacugggugaacgaggacggaaccgccugcgaggaucucgacgaaugcgcguucccaggugucugucccagcggcguuugcacaaauacggcugggucguuuucauguaaggauugcgacggaggcuauaggccgucuccucugggugauaguugugaggacguggaugaaugcgaggacccacaauccagcugucuugggggagaaugcaaaaacaccgugggcucuuaccaguguuugugcccccagggcuuccagcuggccaaugggacuguaugugaggacgucaacgagugcaugggagaagagcacugugcaccucacggugaaugcuuaaauagccauggcuccuuuuucugccucugugccccaggguuugugucagcugagggaggcacaaguugccaagauguugacgaaugugccaccacagaucccugcgugggugggcacugugucaacacugagggaagcuucaauugccugugugagaccggcuuucagccgucuccugaauccggcgagugcguggacaucgaugaaugugaggacuauggggaucccguuugcggaacguggaagugugaaaacucaccagguaguuaccgcugcgugcuuggcugccagccuggguuccauauggcacccaauggagacuguauugauaucgacgagugcgcuaacgauacaauguguggcagccacgguuuuugcgacaauaccgauggguccuucagaugucugugcgaccaaggauuugagauuucuccaucgggcugggacuguguagaugucaacgaaugcgaguugaugcucgccguguguggcgcggcccugugcgaaaacguggaggggagcuuccuaugucugugcgcaucagaccucgaggaauacgaugcucaggagggacauugcaggccccggggugccggcgggcaguccaugagugaagcuccuacuggagaccacgcaccagccccgacccguauggauuguuauucuggccagaaaggucacgcccccugcagcuccguccuggggcgcaauacaacucaagcugaguguugcuguacccagggagcgucauggggcgacgcaugcgaucuuuguccuucugaagacagcgccgaguuuagugagauaugcccauccggcaagggguacauccccguugaaggagcuuggacauucggucagacgauguauaccgaugccgacgagugugugauuuucggcccuggguugugcccaaacggacgaugucugaauacuguacccggcuacgugugcuuaugcaacccugguuuucauuaugaugcaagccacaagaaaugugaagaccaugacgagugccaggaucucgccugugaaaauggggagugcgucaacacagagggcucuuuccacuguuuuugcucaccgccacugacccuugaccugucccaacagagauguaugaauaguacuagcucgacagaagaucuacccgaccaugauauccacauggacaucugcuggaagaaagugaccaacgauguuuguucugagccucucaggggacaccggacgacuuacaccgaaugcuguugccaggacggcgaggcuuggucccagcaaugcgcgcugugucccccacgcagcucagaaguguaugcccaguugugcaaugucgcaagaauugaggcugagagggaagccggggugcauuuccggccuggauacgaguacggucccggcccagaugaccugcacuauaguauauacgggccggauggagcaccuuuuuauaacuacuuaggccccgaagacacaguuccagagcccgccuucccuaauaccgcuggucauucugccgaucgaacuccaauccucgaguccccccugcagccuagcgaacuucaaccgcacuauguggcgucacacccagagcccccugcaggguuugaaggccugcaggccgaggaauguggaauuuugaacggcugcgagaaugggagauguguccgcguaagggagggauacacaugcgacuguuucgaagguuuucagcucgacgcugcccauauggcuugcguggauguuaacgagugugacgaucugaauggcccagcagugcuaugcguccacggguauugugaaaacaccgagggaaguuaccggugccauugcagccccggcuacguggccgaagcugguccuccccacuguacagccaaggaguga

SEQ ID NO: 58630 - RNA, 3912 nt, Artificial Sequence
  derived and/or modified sequence opt3 from LTBP3__Homo_sapiens__NP_001123616
augcccggcccuagaggggccgcuggaggucuggcaccagagaugaggggcgccggggcggcuggacuccuugcccuguuguuacugcuacuccugcuucuguugggccucggugggcggguggaaggaggcccggcaggcgagcgcggggccggagguggcggggcucuggcacgagaacguuucaaggucguuuuugcccccgugaucugcaaaagaaccugucugaagggacagugcagggacagcugucaacagggcuccaacaugacacucauuggugagaaugggcacucuacugauacguuaaccggaucaggcuuccggguaguggucugcccucugccauguaugaacggcgggcagugcaguagccgcaaucagugucuuugucccccugacuuuacaggaagauucugccaagugccagcugguggcgccgggggaggcacugguggguccggccccggauugucuaggaccggcgcgcugucgacaggggcacuaccuccacucgccccggaaggagauucaguugcuagcaaacaugccauauacgcagugcaggucaucgcugaucccccugguccaggcgaggggcccccugcccagcacgcggccuuucuggugccacuuggacccggccagauuagugcagagguacaagcuccgccucccguugugaacguccgggugcaucacccaccugaagccuccgugcagguccaucgcaucgagucuagcaaugcugaauccgccgcacccucacagcaccuguugccacaccccaagccuagucauccacgaccgcccacccagaaaccucucgguagaugcuuccaagacacucugccaaagcagcccugugggagcaacccuuuaccaggccugacaaagcaggaggacugcugcggaucuauuggcaccgccugggggcaauccaaaugucacaagugcccccagcuccaguauacgggaguucagaaaccggguccugugaggggcgagguaggggcugauuguccacaaggauacaagcggcuuaauucaacucauugccaggacaucaacgaaugugcgaugcccggcgugugccgucacggugauugucugaauaacccugggagcuaucgcugcgucugucccccaggccacaguuugggaccuucuagaacccagugcauagcagacaaacccgaggaaaagucccuauguuuuaggcuggugagcccagagcaucagugccaacacccgcucacaacucggcugacccgacagcuuugcuguugcucgguuggcaaggccuggggagcucgcugucagagaugcccuacagaugggaccgccgcauucaaagaaaucugucccgccggcaaggguuaccauauucugacgucucaccagacuuugacaauccaaggggaguccgacuuuucacucuuccugcauccagauggacccccuaaaccacagcaguuacccgagaguccuagccaggcuccgccacccgaagacaccgaggaagagaggggcgugacuacagacuccccugucucugaagaacggagcgugcaacagucacacccaaccgccacgaccacacccgcacgcccuuauccggagcugauuaguagacccuccccaccuacuaugaggugguuucuacccgaucucccaccuagccguucugcgguagaaaucgcucccacccagguuacagagacugacgaaugccggcugaaucaaaacauauguggucacggcgagugcgugccagggccgccugauuacucaugucauugcaaucccggauaucgaagucacccacagcauagauacugugucgacgugaacgaaugcgaggccgagcccugcggcccugggaggggaauuuguaugaauaccggcgguagcuacaacugccacuguaaccgcggguaucggcuucacgucggagcaggcgguagauccugcguggauuugaaugaaugugccaagccacaucugugcggcgacgggggauucuguaucaacuuucccggccacuacaaaugcaauuguuauccuggguacaggcucaaggcuucucgcccgccaguuugcgaggauauugacgaaugucgagaucccucgagcugcccugacggaaaaugcgagaacaagcccggcuccuucaaguguaucgccugccagccagguuaucggucacaagggggaggcgcaugucgugaugugaaugagugcgcugaagguaguccuuguucucccggcuggugcgagaaccugccagggagcuucagauguacaugcgcccagggauacgcgccugccccggacggcagguccugucuugacguagaugaaugcgaggcuggggacgucugugauaauggaaucugcucaaacacccccggcagcuuucagugccagugucugucugguuaucauuugucccgcgaccggagucacugcgaagauauugacgagugugauuucccagcagccugcauagggggagacuguaucaauacuaacggcagcuacagaugccucuguccucagggccauaggcugguugggggacgaaaaugccaagauauugacgaguguucucaggaucccuccuuaugccugccacacggugcuuguaagaaucuacagggcucauacgugugcgugugcgacgaaggguuuacgccuacacaggaucaacacggaugugaggaagucgagcagccccaucacaaaaaggaaugcuaucucaacuucgacgacaccguguuuugugauaguguacuggccacuaaugugacccagcaagagugcuguugcagccuuggcgcagguuggggagaccauugugagaucuacccgugcccaguuuauucguccgcggaguuccacucuuuguguccugaugggaaaggcuacacacaggacaacaauauagucaacuauggcauucccgcccaucgcgauaucgacgagugcaugcuguuugggagcgaaaucuguaaggagggaaagugcgugaacacccagccagguuacgaauguuauugcaaacagggcuucuacuacgaugggaaucuccuggagugcguggacgucgaugaguguuuagacgaaucaaacugccggaauggaguuugugagaacacuagaggcgguuauaggugcgcuuguacacccccugccgaauacaguccggcacaacgucagugccugucccccgaggagauggauguggacgaaugucaggauccagcugccugccgcccugggcggugugugaaucuucccggaucuuauagaugcgaguguaggccuccauggguacccggcccuagcggccgagacugccaguugccagaaucccccgcagagcgggccccggaacgcagagacgucugcuggucacaaaggggagaggaugggaugugugcugguccucucgcgggcccagcccugacguuugacgauugcuguugccggcaggggcgaggauggggcgcacaguguagacccugcccuccacgcggugcugggagccacugucccaccagucagucugaguccaacagcuucugggacacuucgccgcuacugcucggaaagccucccagggaugaagacucaucugaggaagauagugacgagugccguuguguguccggccggugcguuccaagaccuggcggggccgugugugaaugccccggagguuuucaacuggaugccagcagggcucgcugcgucgacauugaugagugucgagagcuuaaucagagaggcuugcugugcaaaucugaacggugugugaacacaagcggguccuucaggugcguuuguaaggcaggauuugcccgcucacguccacacggcgcgugcgugccccagagacggagguga

SEQ ID NO: 58631 - RNA, 4875 nt, Artificial Sequence
  derived and/or modified sequence opt3 from LTBP4__Homo_sapiens__NP_001036009
augcccagaccuggcaccagcgggaggcggccacugcuccuugugcuguuguuaccgcuguucgccgcugcaacauccgccgcgucucccucaccuaguccaagccaggucguugaggugcccggaguaccuucccgcccagcuucuguggccgucugccgauguugccccggucaaacuucgcguagaucaagguguauccgggcauuuugccgcgugagaagcugucagccuaagaaaugcgccggcccacagaggugucuaaacccgguucccgcugugccuaguccaucccccucuguccggaagcgccaggugagccucaauuggcaaccucugacgcuucaggaagcacgagcccuguugaaaagaaggcggccacgugggcccggaggccgcggucuccugagaaggcggccgccucagcgagcucccgccgggaaggcgccaguacugugcccucucauuugucacaacggaggcguuugcgugaaacccgaccgcuguuuaugcccacccgauuucgcaggcaaguuuugccagcugcauuccucaggggccagaccuccagcuccggccguccccggacuuaccaggaguguguacacaaugccuuuggcaaaucaccgggacgaugagcaugguguggcuagcauggucucuguucacguggaacauccacaagaggccuccguagugguccaccagguggaacgcguuucaggccccugggaggaggcggacgccgaagcaguggcuagagccgaggcugccgcaagggccgaagcugcggcaccuuauacuguccuggcccagagcgcuccacgugaggauggguacagugacgccucuggauucggcuauuguuuucgggagcuacgagguggggaaugcgcaagcccccucccgggacugagaacccaggagguguguugcaggggcgccggccuugcuuggggcguacacgauugucaacugugcagcgaacgcuugggaaacucggagcggguuucugccccugacgguccaugucccacaggcuucgaaagagugaauggguccugcgaggaugucgacgagugugcaaccggagggaggugccagcauggugaaugugcgaacacucgcgggggcuacacaugcgugugcccugauggauuucuccuggacucaagucgaagcuccuguauaucucagcacgucaucagcgaggcuaagggccccugcuuccggguguuacgugaugggggauguucacugccaauucucagaaauaucaccaaacaaauuugcuguugcaguaggguugguaaggccuggggccgcgggugucagcuuugcccucccuuuggauccgaaggcuuccgggagaucuguccagcagguccgggguaucauuacagcgccucugaccugagauauaacacgaggccuuugggccaggaacccccacgagugucacuaagucagccccgcacucugccugcuaccagccggccauccgccggauuucuccccacacacagacuggagccuaggccggagccacgucccgacccucgcccaggccccgaacuuccucugccgucuauacccgcauggacugggccagagaucccugaaucgggacccagcuccgguaugugccaacggaauccacagguauguggcccugggagaugcauuucaaggcccaguggauauaccugcgcuugugauucuggcuuccgauugagcccacaggguacacggugcaucgacgucgaugagugucgcagagugccgccucccugcgccccagggaggugugaaaacucccccggcucauuucggugcguuuguggaccuggcuuccgagcggggccaagagccgcugagugccucgacguggaugagugucaccgcgugcccccuccgugcgaccugggaaggugugaaaauaccccaggcagcuucuuaugcgucugccccgcagguuaccaggccgcuccucauggggccucuugucaagauguagacgagugcacgcagucccccggacuguguggccguggugcaugcaaaaaccuaccaggcaguuuucggugugugugcccugcgggguucagaggaagcgccugugaagaggauguugacgagugcgcucaggaacccccaccuuguggcccggggaggugcgauaauacugccggaucuuuucacugugcaugccccgcuggcuuccgcucccgagguccaggggccccuugccaggacgucgacgagugugcaagaucacccccaccuugcacauacggacggugugaaaacaccgagggcaguuuucaaugcgugugucccauggguuuccagccgaauacugccggcagcgaaugcgaggauguggacgagugugaaaaccaucucgcuugcccagggcaggagugugucaacucgccuggauccuuucagugcaggacaugucccucuggccaccaucugcaccgcgggcguugcaccgauguugacgaaugcagcucaggagcgccacccuguggcccucacggucauugcacgaauaccgaggggaguuucagauguuccugcgccccgggauaccgggcacccucuggcaggccagguccuugugcugaugugaacgaaugccuugagggcgacuuuuguuucccccacggggagugcuugaauacagauggauccuuugccuguacuugcgccccuggcuaucgcccagggccccgaggagcuuccugucuggacguggaugaaugcucagaggaagaccucugucaaagcggcauuugcaccaacacagaugguaguuucgagugcaucuguccuccagggcauagagcaggacccgaccuggccucuugccuugauguagacgaaugucgggagaggggcccggcgcugugcggcucccagcgcugugagaauagcccugggucguacagaugcgucagggacugugauccaggauaucacgcuggucccgaaggcacuugcgacgauguggacgagugucaggaauacgggccugagauaugcggagcccaacggugugagaacaccccaggcucauaucguugcacacccgcaugcgauccggguuaccagccuacccccgggggaggcugucaggacguugaugaaugccgcaaucgaucuuuuuguggcgcccacgcugugugccagaacuugccagggaguuuccaaugucucugcgaccagggauacgagggugcaagagauggcaggcauugugucgacgugaaugaaugcgagacucugcaggggguuuguggagccgcguuaugcgaaaacguggagggcuccuuccuguguguaugcccuaauagccccgaggaauuugauccaaugacgggucggugcgugcccccucgcacaucugcugggaccuucccaggaagccagccgcaagcccccgcauccccuguccuaccagccagacccccuccacccccucucccgaggcggccaucaacuccccgacagggcccugugggcagugggagacgcgaguguuauuuugacaccgcugcccccgaugcaugcgacaacauucuggcuaggaaugucacauggcaggaauguugcuguaccguuggagaggguuggggcagcgggugccggauccagcaauguccaggaacugaaacagccgaguaccagucucuuugcccucacggccgugguuauuuggcgcccuccggggaccugucacucagaagggauguggacgagugucagcuguuccgcgaucaaguaugcaagaguggagugugugucaacacggccccaggcuacagcugcuauugcuccaauggcuacuauuaccauacccagcgguuagaauguauugacaacgaugagugcgcagacgaggaaccggcuugugaagggggacgaugcgugaacacuguugguucuuaccacuguacaugcgagccuccccuggugcuugauggcucgcagagaaggugugucagcaaugagucacaguccuuggacgauaaccucggggugugcuggcaagaaguuggagccgaccugguguguagucauccacgccuagaucggcaggcuaccuauacagagugcuguugccuguacggcgaagcaugggguauggacugcgcccucugucccgcccaggacucugaugacuuugaggcucugugcaauguccuuagaccuccagcguauagcccgccucgucccgggggauucggcuugccauacgaguauggccccgaucuggggccuccauaccagggauuacccuaugguccugaacucuaucccccaccggcacugccuuacgaccccuacccaccucccccaggcccuuuugccaggcgggaggcucccuacggggccccgcgcuucgauaugccagacuuugaagaugacggaggcccuuauggugaguccgaagcacccgccccacccgggccuggcacucgauggccguacagaucaagggauacccggcgcucuuucccagagcccgaggaaccucccgagggaggcagcuaugcugggagucuugcggaaccauacgaggaacuggaggccgaggaauguggaaucuuggacgguugcacgaacggcagauguguaagggugccugagggguuuaccugccgauguuucgauggauaucggcucgacaugacacguauggcaugcguugauaucaaugaaugugacgaggcugaagccgcaagcccccugugcgugaacgccagaugucuaaauacugacggcuccuuucgcugcauuugcaggccagguuucgcuccuacccaccaaccgcaccauugugcccccgcgcggccaagagcauga

SEQ ID NO: 58632 - RNA, 1251 nt, Artificial Sequence
  derived and/or modified sequence opt3 from LTBR__Homo_sapiens__NP_001257916
auggaggccaccggcaucagccuggcuucccagcucaaggugcccccuuacgcaucugaaaaccaaacaugcagagaccaggagaaagaauauuacgagccacagcacaggauuuguugcucacgguguccgcccgggacuuaugucagugccaagugcagccgcauacgagauacgguuugugcgaccugcgcugaaaauuccuacaacgagcauuggaauuaucuuacaaucugucagcugugccguccuugugacccagugaugggauuggaggaaauugcccccugcacuucuaaaagaaagacccaauguaggugccagccugguauguucugcgcagccugggcuuuagaguguacacacugcgaacugcuaucggauuguccacccggcaccgaggcagagcucaaagacgaaguagggaagggaaacaaucauugcgugccuuguaaggccggccacuuucagaacacuucaagcccaagugcucggugccagccgcauacacgcugugagaaucaaggucuggucgaagccgcgcccgggaccgcacaguccgauacgacuugcaaaaacccucuugagccacugcccccugaaaugucuggaaccauguugaugcucgccgugcugcugccacucgcuuucuuuuuacugcuugccacaguuuucagcuguaucuggaagucccaccccucauugugcagaaaacugggcagucuacucaagaggcggccgcagggcgaggggccuaaucccguggcaggaagcugggagccaccuaaagcucaccccuacuuuccagaccugguccagccccuucugccuauuucuggugauguguccccaguaucaacuggcuugccggccgcgcccguucucgaagccggggugccucaacagcagagcccacuggacuuaacccgcgagccccaacuggaaccuggagagcagagucaggucgcacauggcacaaacgguauccacgugaccgggggaucuaugacgauaacuggcaauaucuauauuuacaacggcccagugcucgggggacccccggguccuggcgaucuuccagcuacacccgaaccucccuacccaaucccugaggagggggaccccggaccaccgggccuguccaccccucaucaggaagaugguaaggccuggcacuuggcugagacugaacacuguggggccacacccagcaaucgaggcccaagaaaccaauucauuacccaugacuga

SEQ ID NO: 58633 - RNA, 453 nt, Artificial Sequence
  derived and/or modified sequence opt3 from LTC4S__Homo_sapiens__NP_665874
augaaggacgagguggcccugcucgcugcagucacccuucugggcguuuuguuacaggccuacuucagccugcaagugaucuccgcgagaagggcuuuucggguaucucccccucuaacaacugggccaccggaauuugagcgcguguaucgagcccaggucaacugcucagaauacuuuccccucuuccuggcaacgcuuuggguggccggaauuuucuuccacgagggugcugcagcccuguguggcuugguuuaucucuuugcucgucugagauacuuccagggguaugccaggagugcgcagcugcggcucgcaccuuuauacgccagcgcucgcgcccuguggcuuuugguggcacuggcugcccuaggacuccuggcgcauuuucuuccagccgcacugagagcugccuugcucggcaggcugcggaccuuacugcccugggcuuga

SEQ ID NO: 58634 - RNA, 2001 nt, Artificial Sequence
  derived and/or modified sequence opt3 from LTF__Homo_sapiens__NP_001186078
augagaaaggugagggggcccccugucagcugcaucaaacgggacuccccaauucaguguauacaagccaucgcugagaaccgcgcagaugccguuacccuggacgggggauucauuuacgaagcgggucucgcuccguauaaacuucgacccguggccgcagagguauacggcacagaacgucagccuagaacucacuauuacgccguggcugucgugaagaagggcggaucuuuucagcugaaugaguugcagggcuuaaaaucaugccauacgggucugaggcggaccgcaggguggaacguuccaaucggaacacuacgccccuuccucaauuggacuggcccuccagaacccauugaggccgcuguggccagauuuuucagugcgagcugugucccuggcgcagauaaggggcaauuuccaaaccugugcaggcuuugugccggaaccggugagaauaagugcgcuuucuccucucaggaaccguauuuuucguacucaggcgccuucaaaugucugcgggacggggcaggagauguggcuuuuauccgcgagagcacaguauucgaagacuugagugaugaggccgagcgagacgaauaugagcuccugugccccgauaacaccagaaagccuguugacaaauuuaaggauugucaccuggcgagggugccaucccaugccgucguggcacggucugugaauggcaaagaagacgcuauauggaaccucuuacgucaggcccaggagaaguucgguaaggauaaaagccccaaguuucaacuguucggguccccuucaggacagaaagaccuuuuguucaaggacagugcuaucggcuuuagccgcgucccacccagaauugauucuggccuguaccuaggguccggauacuucacugccauccagaaucucaggaaaucagaagaggagguugcagcccggcgagcucgcgugguauggugcgcggugggugaacaggagcugagaaaguguaaccaauggagcggccuuagugaagggucugucacaugcuccagcgcaucgaccacggaggacugcauugcccugguguugaaaggagaagcugaugccaugucucucgacggcgguuauguuuacacugcagggaaguguggccuggugccggucuuagccgagaauuauaagucccagcagucaagugauccugaccccaacugcguggauaggccaguagagggauaccuggcuguugccgugguccggcgcagcgacaccucccucacauggaacucugugaaaggcaagaaaagcugucacacugcagucgauagaaccgcgggguggaauaucccuaugggacuucuguuuaaucaaacagguucaugcaaguucgacgaauauuuuagucaguccugugcucccggcagcgauccaaggucuaacuugugcgcccuauguauaggggacgagcagggagaaaacaaaugcgugcccaauucaaacgagcguuacuauggcuacaccggugcauuccggugucuggccgaaaaugcuggggacguugccuuugugaaggauguaacgguccuccagaacacugacggcaauaacaaugaggcaugggcuaaggaucugaaacuugccgacuucgcgcuguugugccucgauggaaagcgaaaaccugugacagaggccagaaguugucaucuggcuauggcaccaaaccacgccguugugagcaggauggacaaggucgaacgcuuaaaacaagugcugcuacaccagcaggcuaaguuuggccggaauggguccgauugcccggacaaguucugccucuuucagucugagaccaaaaaccugcuuuucaaugauaacacugaauguuuggccagacugcauggaaagacaaccuacgagaaauaucucgguccccaauacguagcaggcauuacgaaucugaagaaaugcucgaccagcccucuucuggaggcgugugaauuuuugaggaaguga

SEQ ID NO: 58635 - RNA, 2205 nt, Artificial Sequence
  derived and/or modified sequence opt3 from LTK__Homo_sapiens__NP_001129157
augggcugcugggggcagcugcucgugugguucggagccgcuggugcaauccuuuguagcucccccggcucucaagagaccuuucugagaucaaguccuuugccauuagccagcccgucccccagggacccuaaggucucugcgccacccucgauucuggaaccugcuucaccacuaaacagccccgggacagagggaaguugguuguucuccacuugcggcgccucuggucggcacgggccuacgcagacccagugugauggagcauacgccggcacaagcguugugguaacugugggcgcugcagggcagcugcgcggaguccaacuuuggcgagugccagguccgggccaguaucugauauccgccuacggggcugccggaggcaaaggugcgaagaaucauuugucacgugcacacgggguuuuugugagugccaucuucagccucggacugggcgaaucucuguauauucucgucggccagcagggggaggacgcuugccccggagguuccccugaaucacaauuagugugucugggcgagagcagagccguagaggaacaugcagcuauggaugggagugagggaguuccaggcucuaggcggugggccggugggggcggaggcgggggaggugcgaccuacguguuucgcgucagagccggcgaacuugagcccuugcugguggcagcugggggaggcgguagggccuaucuacggccucgcgaccgagggagaacacaggcuuccccagagaaacucgaaaacaggagcgaggcccccggcucgggaggccgugggggagcagccgguggcgaugcuucugaaaccgacaaucugugggcggauggggaggacggaguguccuucauccacccgucaagugaacuuuuucugcagccuuuggcagucacugagaaccauggcgagguugaaauucggcgccaccucaauugcagccacuguccccugagagauugccaguggcaagccgaguuacagcuggcugaaugucucugcccagaggguauggaacuugccguggacaacguaacauguauggaucugcauaagccucccgggccauuggugcuaauggucgcagugguugccaccuccacgcugucucuccugauggugugcggcguccuuauccugggaggcgcuuggcccgggccuguguuggccagcgcaacuaggugccaccggggauucccaucacaguguuacagugcgcaaacccucccggagcugugcuccccacaggacgaguuagauuuucugauggaagcucuaauaaucagcaaauuccgacaucagaauauuguacgcuguguuggccucucucugagagccacaccuaggcuuaucuugcuggagcucaugucagguggggacaugaagaguuuucugcggcacagccgcccacaccuuggacagcccuccccucuggugaugagagacuugcuccaacuggcacaggauauugcccagggcugccauuauuuagaagagaaccacuucauccauagggacauagcugcccguaauugucugcuaucuugcgcagguccaucgcgggucgcuaagauuggcgauuuugggauggcccgagacaucuacagagcgagcuacuauaggcgcggagaucgggcccuccugcccgugaaauggaugccgccugaggcuuuccuugaaggcauuuucacuuccaagaccgacucauggaguuuuggggucuugcugugggagaucuucucucucggauacaugccauaucccggcagaacaaaccaggaagugcuggauuuuguugugggugggggaaggauggacccuccccgcggcuguccagguccuguauaccgaaucaugacccaaugcuggcagcacgagcccgaauuacggcccagcuucgcauccauucuggagcgucuucaguauuguacgcaggauccggacguccucaauucacuccugccuauggagcuaggccccacuccagaagaggaagggacaagcggacugggcaacagaucucucgagugccugaggcccccucaaccacaggaacuuucccccgagaaauugaagaguuggggagggagcccucugggcccgugguuaucuuccggucucaaaccacugaagucacgcgggcuucagccccagaaucuguggaacccuaccuaccggaguuga

SEQ ID NO: 58636 - RNA, 1299 nt, Artificial Sequence
  derived and/or modified sequence opt3 from LUC7L3__Homo_sapiens__NP_057508
augaucagcgccgcucagcugcucgacgagcuuaugggcagagauaggaaccuggcacccgacgaaaagcgguccaaugugcgcugggaucacgagucugucugcaaauacuauuuguguggguucugcccugccgaauuauuuaccaacacacgaucagaccugggaccaugugagaagauucaugaugaaaaucuacguaaacaauacgagaagaguagcagauucaugaaaguugguuaugagagggacuuucuccgguaccugcagucccuucuggcggaaguggagcgcagaauaaggcggggccacgcucgcuuggcccucucucagaaccagcaaucgucaggggcagccggaccgacuggcaagaaugaagagaagauccagguacugacggauaaaauugacgugcugcuccagcagaucgaggaauuagguagcgaggggaaggucgaagaggcucaaggaaugaugaaacugguggaacagcuuaaggaggagcgagaauugcugagaaguaccacauccacuauugagucuuucgcagcccaggaaaaacagauggagguuugcgaaguguguggcgcuuuucuaaucgucggcgaugcccaaagcaggguggacgaucaucucauggggaagcagcacaugggauaugcgaagauaaaagcaaccguagaggagcugaaggaaaaacuucggaagcguacagaggaacccgaccgcgaugagagacugaaaaaggaaaaacaggagagggaggaacgggagaaggaacgagagcgcgagagagaagagagggaacggaagcgcagaagggaggaagaggagcgugaaaaagagcgggcccgagacagagaaaggcgcaagcgguccagaucaaggagucgccauagcucucgaaccuccgaccggcguugcucaagaagcagggaucacaaacgcagucggucuagagagaggcgacgcucccggagcagagacaggcgucgcucgcggucucacgauagauccgaaaggaagcaucgaucacggagucgcgacagaaggcggagcaaaucccgagauagaaagucuuacaagcaccgcagcaaaucaagggaccgugagcaagaucggaagaguaaagagaaggaaaagagagguuccgacgauaaaaagagcucuguuaaaucaggcaguagggagaagcagagcgaagacacuaacacagaguccaaagaaucugauaccaagaaugaggugaacgggacgucggaggacaucaaaagcgaaggagacacucaguccaauuga

SEQ ID NO: 58637 - RNA, 978 nt, Artificial Sequence
  derived and/or modified sequence opt3 from LUC7L__Homo_sapiens__NP_060502
augagcgcccaggcucaaaugagagcacugcucgaccagcuuaugggcaccgccagggauggggacgagacacggcagcgcgugaaguucacugaugaccgagucugcaaaucccaccuguuggauuguugcccccaugacaucuuagcgggaacgcguauggaucugggugaauguaccaagauucacgaccuagcucucagagccgauuacgagauagcaucuaaagaaagggaccuguuuuucgagcuugaugccauggaccaucuggaaucauuuaucgcugagugcgaucggcgcacagaguuggcaaagaaaagacucgccgaaacucaggaggaaauuagugcugagguuagcgccaaggcggagaaggugcacgaacugaacgaggaaaucggcaaacugcucgcaaaggccgagcaauuaggggcugaaggaaauguagacgagucccagaaaauucugauggagguggaaaaggucagggccaaaaagaaggaggcagaagaggaauaucggaacucuaugccugcuucgucauuccagcagcaaaaacuucgcgugugugagguuugcagcgccuacuugggccugcaugacaaugaucgaagacuagcggaccacuuuggugggaagcuccaccugggauucauccagauaagggagaaacuugaucagcugcggaagaccguggccgaaaaacaggagaagcguaaccaagaccgcuugagaaggcgggaggaacgagaacgcgaggagagacucaguaggcgguccggcucucgcacaagagauaggcgucggagccgauccagagacaggcgccggagaaggucacgcaguaccagccgagaacggcguaaacugucuagauccaggucacgcgaucggcauagaaggcaccgaagccgcagucggucucauuccagaggccacaggcgugcaagccgcgaccggucggcuaaguauaaguga

SEQ ID NO: 58638 - RNA, 1017 nt, Artificial Sequence
  derived and/or modified sequence opt3 from LUM__Homo_sapiens__NP_002336
augagccuguccgccuucacccucuuucuugcucugaucggcgggacaucuggacaguacuaugacuacgauuuccccuugucaauuuauggucaaaguagcccuaacugcgcaccagaguguaauugcccggaauccuaccccucugccauguauugugacgaguuaaagcugaaaucggugccuauggucccacccggcauaaaguaccuauaucucagaaacaaucagaucgaucacauugacgaaaaagcguuugagaacguuacugaucugcaguggcuuauccuggaccauaauuugcucgaaaacucaaagauuaaagggaggguguucagcaagcugaagcagcugaaaaagcuccacaucaaucauaacaauuuaacggagaguguaggaccucugccaaaaucccuugaggauuugcaacugacccacaacaagauaacaaaacuaggcucuuuugaaggucucgugaaucugacuuucauccaucuucagcacaaccggcugaaggaggacgcugucagcgccgcauuuaagggguugaaaucccucgaauaccuggauuuaucauucaaucagauugcccgccugcccaguggacucccugugagccuucugaccuuguaccuagacaacaauaagaucucuaacauuccagaugaguauuuuaaacgauucaacgcucugcaguaccuccgucugucccacaaugagcuugcagacucaggcaucccgggcaacagcuuuaauguuaguucucugguggaauuggaucucuccuauaacaagcugaaaaauauacccacagucaacgagaauuuagaaaacuacuaucuggaggugaaucaacuagaaaaguucgacauuaagagcuuuugcaaaauccucgggccucugucguacucuaagauuaaacaucuuagauuggacggaaacaggaucuccgagaccucacugccacccgauauguaugagugucuccggguagccaaugaaguuacucugaacuga

SEQ ID NO: 58639 - RNA, 687 nt, Artificial Sequence
  derived and/or modified sequence opt3 from LURAP1L__Homo_sapiens__NP_981948
auggaggacagcccccugccugaucucagagacaucgaacuuaagcugggcaggaaagugccagaguccuugguccggucuuuacgcggggaggaaccgguuccccgagaacgugauagagacccuugcggagguucaggcgggggaggcggugggggaggcggcuguaguagcuccucuucguacugcucauucccacccagccugaguuccucuagcuccucaaguccuaccagcgggucuccaaggggaucccacucaagcgcccuagagcggcucgagacaaagcugcaucuucugcgccaggaaauggugaacuugagagcuacugauguaaggcucaugcggcaacugcuggugauuaaugagaguauagaaucuaucaaauggaugauugaggagaaggcaacgaucaccucccgcgguagcucgcucucuggcuccuuauguucacugcuugaaagucagagcacauccuugcgagggucuuauaacagccugcacgacggaucagauggccuagacgguauuagugucggguccuaccucgauacucuggccgacgaugugcccggacaucagaccccuagcgaccuugaucaguuuucugacucaagucugaucgaggacagccaagcguugcacaaaagaccaaagcucgauuccgaauauuacugcuucggcuga

SEQ ID NO: 58640 - RNA, 942 nt, Artificial Sequence
  derived and/or modified sequence opt3 from LUZP4__Homo_sapiens__NP_057467
auggccagcuucagaaagcugacccucuccgagaaagugcccccuaaccacccaucuaggaagaaagucaauuuucuugacaugucacuggaugacaucauuauauacaaggaauuggagggcacaaacgcugaagaggagaaaaauaagcggcagaaccauaguaagaaagaaagcccgucccgccaacagucuaaggcacaccgacaucgucacagaaggggguauucgcggugccgcucaaauagcgaggaaggaaaccaugauaaaaagcccagucagaaaccuuccgguuucaagucuggccagcacccauuaaaugggcaaccccugaucgagcaggaaaaguguagcgacaacuacgaggcccaggcggagaaaaaucagggacaauccgaaggcaaccagcaccagucagaggguaauccugauaagagugaagagagccaggggcaaccagaagagaaccaucacucugagagauccaggaaucaucuagaacggucacucagccagagugaccgcucucagggacaacugaaacgacaccacccccaguaugagagaucccauggccaguacaagaggagccacggccagucggaacggucucaugggcacuccgagcguucacauggacacagugaacgcagccacggucauuccgagagaucucacggccauagcaaaaggucacggagucaaggggaucuuguugacacucaguccgaucugauugcuacgcagcgagacuugaucgccacccagaaggaucucauugcaacacaacgcgaccugaucgccacucagagagaucugauagugacccagagggaccucguagcuacagagcgggacuuaaucaaccagagcggacgcucucacggccaaucagaaagacaccagagguauaguaccgguaaaaauacuauuacaaccuga

SEQ ID NO: 58641 - RNA, 177 nt, Artificial Sequence
  derived and/or modified sequence opt3 from LUZP6__Homo_sapiens__NP_001122091
augaaaagcgugaucuccuacgcccuguaucagguccaaaccggcucucuccccguuuacucaagugugcuuacaaagagcccucugcaguugcagacuguaauuuauagauuaauagugcagauccaacaccugaacauuccauccucuucgucaacgcauagcaguccguucuga

SEQ ID NO: 58642 - RNA, 2973 nt, Artificial Sequence
  derived and/or modified sequence opt3 from LVRN__Homo_sapiens__NP_776161
auggggcccccuagcuccucuggcuucuacgugucaagagccgucgcucugcuccuugcaggacugguugccgcguuguuacuggcucuagccgugcucgcagcccuguauggucacugcgagaggguaccaccgagugaacuucccggccugcgggacuuggaggcugaaagcuccccuccacuccgccagaagcccaccccuacaccaaaacccucuucggcacgagagcuggccgugacuacgaccccuucaaacuggcguccaccggggcccugggaucaacugagacucccuccaugguuagucccccugcauuacgaccuugaauuguggccucagcugaggccagaugagcuacccgcuggaagccucccguuuacaggccgggugaauaucacuguucgcuguaccguggccacaaguagacugcuucugcacuccuuguuccaggacugcgagagggcggaaguccgggguccucucucucccgggaccggaaacgcaacugugggccgcguaccaguugaugacgugugguuugcccuggauacagaguauauggucuuagaacugagcgagccucucaagcccggcuccucauacgagcuucagcugaguuucagcggguuggugaaagaagaccuacgagagggacuguuucucaauguguauaccgaucaaggugaaagaagggcucugcuugccucucagcuggagccaacguucgcacgguacgucuuucccuguuucgacgaaccugcuuugaaggccacuuuuaacauuaccaugauacaucacccauccuauguugcgcucucaaauaugccgaaacugggccagagcgagaaggaggaugugaacgggaguaaguggacaguaacuaccuucucuacaacgccccauaugccuaccuacuuaguggccuuugucaucugcgacuacgaucacgugaaucguacugaacgcggaaaagagauuagaaucugggcaaggaaggacgcuauugccaacggcuccgcugacuucgcccugaauaucacagguccaauauuuagcuuccuagaagaucucuucaacaucucguauucucugcccaaaaccgacauuaucgcacuuccuuccuuugauaaucacgccauggagaacuggggguugaugauuuucgacgaaucaggacugcuccuggagccaaaggaucagcuuacugagaaaaagacacugaucaguuacguugugagccaugaaauaggccaccaaugguuuggcaauuuggucaccaugaacugguggaauaacauuuggcucaacgagggguucgcuuccuauuuugaguucgaagugaucaauuacuuuaaccccaagcugccgcggaaugaaauuuucuuuucuaacaucuuacauaauauccugcgagaggaccacgcgcuaguaacgcgcgcaguugccaugaaaguggagaacuucaagaccagcgaaauucaggagcucuuugauauauucacauauucaaaaggagcuaguauggccagaaugcuguccuguuuucuuaaugaacacuuguucgucagcgcacugaagucuuaccucaaaacuuucucauauaguaacgccgagcaggacgaucuguggaggcauuuucagauggcuaucgacgaucaaagcaccgugauuuuaccugccacaaucaagaauauaauggacuccuggacucaccagucugguuucccagucauuacccugaacgugucgacaggcguuaugaaacaggagcccuuuuaccuugaaaauaucaagaaccggaccuugcucacuagcaaugacacguggaucgugccuauucuguggaucaagaacgggacaacccaaccccuaguauggcuggaucaguccucaaaagucuucccagagaugcaagugagugacucugaucaugacuggguuauucucaaucugaacaugacuggauacuaucgcgugaacuacgauaaacuuggcuggaaaaaguugaaucagcagcuggaaaaagacccuaaggcaauacccgucauccacagauuacagcucauugaugacgcguuuagccuguccaagaacaauuauaucgagaucgaaaccgcucuugagcugacaaaauacuuggccgaggaagaugagauuauaguguggcauaccguacucgugaaccugguuacuagggaccuagucucagaagugaauaucuaugauauuuacagccugcucaagcguuaucugcuuaaacgguugaaccugaucuggaauauuuacucuacaaucauacgagagaacguguuagcacuccaggacgauuaccuggcccuuaucucccuggaaaagcuauucgucacggcuugcuggcucggucuggaggacuguuugcagcugaguaaagaguuauuugccaaguggguugaccacccagaaaaugagauuccguauccuaucaaggauguggugcucugcuacgggauugcacugggcagcgacaaagaaugggauauccuucugaacaccuauacuaauacaaccaacaaggaggaaaagauacaauuggcuuacgccaugucuuguuccaaggaccccuggauucucaauagauauauggaguacgcgaucucaacaaguccauucacuagcaacgagaccaauauuaucgaaguagucgccucguccgaggugggaagguauguugcuaaagauuuucuggugaacaacuggcaggcagucucuaagcgcuacggcacgcagagccuaauaaaucugaucuacaccauugggcggacagugacuaccgaccuucagaucguugaacuccaacaguucuuuucaaacaugcuggaggagcaccagagaauuagggugcaugccaauuugcagacaaucaagaacgaaaaucugaaaaacaagaaauuaagugcucgcauagccgcauggcuccgacggaauacuuga

SEQ ID NO: 58643 - RNA, 669 nt, Artificial Sequence
  derived and/or modified sequence opt3 from LXN__Homo_sapiens__NP_064554
auggagauucccccuaccaacuacccagccagcagagcugcacugguggcccagaauuauaucaacuaccaacagggcacaccgcacagggucuucgaaguucagaaggugaaacaggcguccauggaggacauacccgggcggggacauaaguaucaccucaaauuugcuguagaagagaucauucaaaaacaggugaaggucaauugcacugccgaagugcuuuacccuucuacgggucaggagaccgcaccagagguuaacuucacauuugaaggcgagacugggaagaaucccgaugaagaggacaacaccuucuaucagcgccugaagucaaugaaagagccuuuggaagcccaaaauaucccagauaacuuuggaaaugugagucccgagaugacauuaguccugcaucuagcuuggguggcauguggcuacauuaucuggcagaacagcaccgaagacacuugguauaagaugguaaaaauacagacaguuaaacaggugcaacgaaaugaugacuucaucgagcucgauuacaccauucugcuucacaacaucgccucccaggaaauuaucccuuggcagaugcaaguccuguggcauccacaguacgguacgaaggugaagcacaauucucguuugccgaaggaggugcagcucgaguga

SEQ ID NO: 58644 - RNA, 387 nt, Artificial Sequence
  derived and/or modified sequence opt3 from LY6D__Homo_sapiens__NP_003686
augagaaccgcccugcuccuucuggcugcauuggccguggcgacaggccccgcuuuaacucugaggugccacgucuguacgagcuccucuaacugcaagcauucaguuguguguccugccaguagccgguucugcaaaaccacaaauacuguagagccacuacgcgggaaccucgugaagaaagacugugcagaauccugcaccccgucuuacacacugcagggacaagucucgucagguaccagcaguacucaguguugccaggaggaucuuuguaaugaaaagcugcacaacgccgcucccacacgaaccgcauuggcccauuccgcucucucucugggccuggcccucagcuuacuggcggugauccuugcaccuuccuuguga

SEQ ID NO: 58645 - RNA, 396 nt, Artificial Sequence
  derived and/or modified sequence opt3 from LY6E__Homo_sapiens__NP_001120685
augaagaucuuccugcccgugcuccuugccgcucuguugggcgucgagagagcaagcuccuuaaugugcuuuucuugucugaaccagaaaucaaaucuauacugccucaagccuaccauuuguagugaccaagauaacuauugcguuacagugagcgccuccgcggggauaggaaaucugguaacuuucggucacucucuuucgaaaacguguucaccagcuugcccgauccccgaaggcgugaacgucgggguggccagcaugggaauuaguuguugccaguccuuucuguguaauuucucugcagccgacggcgguuugagggcuagcguuacccuccugggggcaggacugcucuuaucccugcuuccugccuugcugcgguuuggcccauga

SEQ ID NO: 58646 - RNA, 606 nt, Artificial Sequence
  derived and/or modified sequence opt3 from LY6G5B__Homo_sapiens__NP_067044
augaaggugcacaugcuggucggcguucucgugaugguaggguucaccgugggaaaaguccccgugccugacaucagaacaugccauuuuugucuuguugaggauccaagcguggguugcauuuccggcucugaaaaguguacuauaucaaguagcucccugugcauggucaucacgauuuacuaugacgugaaaguaagguucaucguucggggguguggacaguacauuucuuaucgcugccaagagaagcgaaacaccuacuuugccgaauauugguaccaggcucaguguugccaguaugauuacuguaauucguggucaagcccgcaauugcagaguuccuuacccgagccucacgaccguccacuggcacuaccccucucugauagccagauccagugguucuaccaagcccugaaccuuucccugccuuugccaaauuuucaugcgggcacagaacccgacggucucgauccuauggugacucugucacugaaccucggguuaaguuucgcugagcugagaaggauguauuuguuucuuaauagcucuggacugcuaguccucccacaggccggccugcuuaccccgcaccccuccuga

SEQ ID NO: 58647 - RNA, 453 nt, Artificial Sequence
  derived and/or modified sequence opt3 from LY6G5C__Homo_sapiens__NP_079538
augagauucauggccggccccgcugggagccagucccugggaccucucugcuuucacucuucaccacaagcacuuuacaccgugcuguugaucgucuuaguuaugaugagucugguguucgguaaguuuguaccggugaacugggagcccccucagccacuacccuucccuaaauaucucagguguuaccggugccugcuugaaacaaaggagcugggcuguuugcucgggagcgacauuugccugacuccagccggauccucuuguauaacgcugcauaaaaagaacucgucaggcagcgaugucauggugagugacugccgcuccaaagaacagaugucugauuguagcaauacccgaacaucccccguuucagguuuuuggaucuucagucaguauugcuuucucgacuucuguaaugauccucaaaaccguggguuauacacuccauga

SEQ ID NO: 58648 - RNA, 378 nt, Artificial Sequence
  derived and/or modified sequence opt3 from LY6G6C__Homo_sapiens__NP_079537
augaaggcccugaugcuccuuacccugagcguguuguuaugcugggucuccgcugacaucagaugucacucuugcuacaaaguucccgugcugggcuguguagauaggcagucaugccggcuagagccugggcaacagugucucacaacucaugcauaucugggaaagauguggguguucaguaaccuucgcugcgguacgccagaggaaccgugucaggaagccuuuaaucagaccaaccgaaaacugggcuugacauacaauacuaccugcuguaacaaggacaauugcaacagcgcggggccccguccuacaccagcucucggacuggucuuccugaccucccucgccggcuuaggucuguggcuuuugcacuga

SEQ ID NO: 58649 - RNA, 894 nt, Artificial Sequence
  derived and/or modified sequence opt3 from LY6G6F__Homo_sapiens__NP_001003693
auggccgugcuguuccuccuucuguuuuugugcggcacaccccaggcugcagacaacaugcaagccaucuacgucgcguuaggggaggcuguugaacugccuuguccaagcccgcccacccuacacggagaugagcaucucuccugguucugcucuccugccgcagguucauuuacuacgcugguggcccagguacaggugggcagaccagcucccgacccugggaagccaggaagggaaagucggcuucgccuguugggcaauuauagccucuggcuggaggguuccaaagaagaggaugcagggcgauacuggugugccguccugggacagcaccauaacuaucaaaauuggcguguguacgacguucucguguuaaagggcucucagcugucggcuagagccgcggauggcucacccugcaacguccuuuuguguagcgugguaccuaguaggcggauggacuccguuaccuggcaggaggggaaaggaccagugcgcgguagaguccagucuuucuggggcagcgaagcagcccugcuacucgugugcccgggggagggacuguccgaacccaggucacggcgcccucgaauuauaagaugucuuaugacacacaauaagggcgugaguuuuagccuggcugccucuaucgaugcauccccagcuuugugcgcccccucaacugguugggacaugccuuggauucucaugcuguuacugaccauggggcaaggagucguuauccucgcgcuuagcauugugcuguggaggcagcggguacguggcgccccaggccgcgaugcaaguaucccccaguucaaaccggagauacagguguaugagaacauccauuuggcuagacuagggccucccgcccacaagccaagguga

SEQ ID NO: 58650 - RNA, 498 nt, Artificial Sequence
  derived and/or modified sequence opt3 from LY6K__Homo_sapiens__NP_059997
auggcccugcucgcacuucuguugguggucgcuuuacccagaguuuggaccgacgccaaccugacagcgaggcagcgggauccugaggacagccaacgcacugaugaaggcgacaaucgaguguggugccacguaugugagcgugaaaacacguucgagugccagaauccaagaagguguaaguggaccgaaccguacugcgugaucgcugccgucaaaauuuuuccccgguucuuuaugguggcaaagcaguguuccgccgggugcgcugcaauggagcgcccuaaaccagaggaaaagagauuccuacucgaggaacccaugccauuuuucuaucugaaauguugcaagauaagguacuguaaccuugagggaccucccaucaauucuucaguuuuuaaggaguaugccgguaguaugggcgaaagcugcgggggacugugguuggcuauucuccugcugcucgccuccaucgcggcaggcuuaucucugucguga

SEQ ID NO: 58651 - RNA, 5622 nt, Artificial Sequence
  derived and/or modified sequence opt3 from LY75-CD302__Homo_sapiens__NP_001185688
augagaacaggcugggccacacccaggcggccugcugggcugcucaugcuucuguucugguuuuucgacuuggcagaaccaagcggacgcgccgcgaacgauccguuuacuaucgugcacgguaauacgggcaaaugcauuaaacccgucuacggguggauaguugcugacgauugugacgaaaccgaagauaaguuauggaaaugggugucccagcaucgacuguuccaccuacauucucaaaagugccucggacuggacaucacaaaaucaguaaacgaacuucguauguuuagcugugauagcuccgccaugcugugguggaagugcgaacaccauucuuuguauggcgcagccagauacaggcucgcucugaaggacggucacgggacugcaauuucgaaugccucagauguguggaaaaagggaggcagcgaagagagucugugugaccagccuuaucacgagaucuacacccgggauggcaacuccuaugggcgcccaugcgaguuccccuuucucauugacggaacauggcaucacgauuguaucuuagacgaggaccauucugguccuuggugcgcuaccacucugaauuacgaauaugauagaaaauggggcauaugucuuaagccagagaacgggugcgaggacaauugggagaaaaacgagcaguucggaagcuguuaccaguuuaauacacaaaccgccuuguccuggaaggaagcguacgucucaugccagaaccagggcgcagaucugcuaaguaucaauagcgccgcugagcucacguaucugaaggaaaaagaggguauugccaagaucuucuggauugggcuuaaccagcuguacucugcaaggggaugggagugguccgaccacaaacccuugaauuuucucaacugggauccugaccggccaucagcuccgacuaucggcggcagcaguugcgcccgcauggaugcggaaucugggcuguggcaauccuucagcugugaggcccaguuacccuaugugugccgaaagccucugaauaacaccguugaacucacagacguguggacuuacucggauaccagaugugacgcaggauggcuuccaaacaaugguuuuugcuaucuguuggucaacgagucuaauuccugggauaaagcucacgccaaguguaaggcuuucucaagugaccuaauaagcauucauucccuggccgacguggaaguaguugugacaaagcuccacaacgaggauaucaaggaggaagucuggauuggccugaaaaauaucaacauccccacccuuuuccaguggucugacgggacggaggugacucugacauacugggaugaaaaugagccuaacgugccauauaauaagacccccaacugcgucagcuacuugggagaacucggccaguggaaaguucaaucaugugaggagaagcugaaauacgugugcaagaggaagggugaaaaauuaaaugacgcaaguuccgauaagauguguccgccugacgagggguggaaacggcauggcgaaacuugcuauaagauuuacgaggaugagguacccuuuggaacaaacuguaaucugaccauaacgagccguuucgaacaggaguaucuaaacgaccucaugaaaaaguacgauaagucucugcgcaaauauuuuuggaccggccuuagagacguggauucaugcggggaauacaauugggccacagucggagguaggcggcgagcugugacuuucaguaacuggaacuuuuuggagccagcgagcccuggcgggugcguugcaauguccaccggaaagucugugggcaaaugggaagucaaggacugucgcucguucaaagcccugagcaucugcaagaagauguccgguccccucgggccagaggaggcuucacccaaaccugaugacccauguccggaaggcuggcagaguuuucccgccucucugagcugcuauaagguguuccacgcagagagaauuguaaggaaacggaauugggaagaggccgaacgcuuuugucaagcucuuggagcccaucuguccucauucagccacguugacgagaucaaggaguuuuugcacuuccucacagaucaguuuucuggccagcauuggcuguggauaggguuaaacaaaagauccccugaccugcagggaaguuggcaauggagcgauaggacuccagugucuaccauuaucaugcccaaugaguuccagcaggacuacgauauccgugacugcgcagcggucaagguguuccaccggccuuggcgaagagguuggcauuuuuacgaugacagggaguucauuuaucuacgcccauuugcuugugauacaaaacucgaaugggucugccagauccccaagggccggaccccgaagacuccugacugguacaacccagauagagccgggauucacggacccccucugauaaucgagggcuccgaauauugguucguggcagaccuucacuugaauuacgaggaggccguucuguauugugcuucaaaccauaguuuucucgccacgauuaccagcuucgugggucugaaagcaaucaagaauaaaaucgcuaacauuucgggggauggccaaaagugguggauaaggaucuccgaauggcccauugacgaccacuuuaccuacucucgcuauccauggcaucgauucccuguaacuuuuggagaggaaugcuuauacaugagcgccaaaaccuggcugaucgaucuuggcaagcccacagacuguucaaccaaguugccauucauuugcgagaaauacaaugucaguucccucgagaaguauucuccggauagcgcggccaaagugcagugcuccgaacaguggaucccuuuucagaacaaguguuuccugaaaauaaagcccguuucacuaacuuuuagccaagcuagugacacaugccacucuuacgggggaacgcugccauccgugcucagccagaucgagcaggauuucauuaccucgcugcuucccgacauggaagcaacuuuguggaucggccugcgguggacagccuaugagaagauuaauaaauggaccgauaaccgugaauuaacauacucaaauuuccauccucuccuggucucugguagacuuaggaucccagagaacuuuuucgaggaagagagucgcuaucacugugcucugauauugaaucuccagaagucccccuuuacugggaccuggaacuucacgagcugcucugaacggcacuuugugagccugugucaaaaauacuccgagguaaagucaagacagacccuacagaacgccagugaaacagugaaauaucugaauaaccucuacaagauuaucccuaagacucugaccuggcauagcgcaaaaagggagugccuuaagucuaauaugcaauugguuuccauuacagacccguaccagcaggcguuccugucaguccaggccuuacuccacaacaguagccuguggaucggacuguuuucccaagaugacgagcuuaauuucggcuggucugaugguaaacgacuacauuuuucgcgcugggcugaaacuaacggccagcucgaggacuguguggugcuggacaccgauggguucuggaagacggucgacugcaaugauaaccagccaggagccauauguuauuacagcggcaaugaaacagagaaagaaguuaagcccguggacucagugaaaugcccuuccccaguauugaacacccccuggaucccuuuucagaauuguugcuauaacuucauuaucacuaagaaucggcacauggcaacaacccaagaugagguccauacuaagugccagaaacugaacccgaagagucacauuuuaucuaucagagacgagaaagaaaauaacuucgugcucgagcagcugcuuuacuuuaacuauauggcuagcuggguuaugcuggggauaaccuacaggaauaaguccuugaugugguucgauaaaacaccccucucauauacgcacuggcgugccggacgcccaaccauuaagaacgaaaaguuucuggcaggccuaucuacugacgguuucugggauauccagacauuuaaagugaucgaggaggccgucuacuuccaucaacacagcauucuggcuuguaagaucgaaaugguggacuacaaagaggaauauaauaccacacuuccucaguuuaugcccuacgaggaugggauuuauaguguuauacagaagaaagugacuugguacgaagcgcucaacaugugcucccaaagcggaggccaucuggccucuguacacaaucagaacggucaguuguuccuggaggacaucgucaagcgggauggcuuuccauuauggguggggcucucaucccacgacggaagugagagcucguucgaauggucugacggcuccaccuuugauuauauuccuuggaaggggcagacgagccccggaaauugugugcugcuugacccaaaaggcacauggaagcaugagaaaugcaacucagucaaggauggugcaaucuguuacaaaccgaccaagaguaagaaacugucuagauugacuuauuccaguaggugcccugcugccaaggaaaaugggucacgauggauucaauacaaaggacacuguuacaagagugaccaggcccuccauagcuucuccgaggcuaaaaagcugugcucuaagcacgaucauagcgcaaccaucguuuccauaaaagacgaagaugagaacaaguuugugucacggcuaaugcgcgagaauaacaauaucacaaugagaguauggcugggccuuucucagcacaguguggaccagucguggagcuggcucgaugguuccgaagucacuuucgugaaaugggagaacaagucuaaaucaggcguugggagguguagcaugcugauugccuccaaugaaaccuggaagaaaguggagugcgaacacggauucggccgggucguguguaagguucccuuggacugcccaaguucuacauggauccaauuucaggauagcugcuauauuuucuuacaggaggcgaucaagguggagucaauagaagacguccgaaaccaguguacggaucauggggcugacaugauuuccauccacaaugaggaagagaacgccuuuauccuggacacccucaaaaagcaauggaaaggacccgaugacauucugcuuggcauguucuacgauacugacgaugcaaguuuuaagugguucgacaacagcaauaugacauuugauaaauggaccgaccaggaugacgaugaggaccugguagacacuugcgccuucuugcauauaaagacaggugaauggaagaaagggaacugugaggugucuuccguugaaggaacccuaugcaagacggcuaucccuuauaaaagaaaguaccugucagauaaucacauucucaucagcgcacuggugauugccucgacugucauccuuaccguguuaggcgcgauaaucugguuucuguauaaaaagcacucugacagucgcuucacaaccguauuuuccacugcuccacagagccccuacaacgaggauugugugcucgucguuggcgaagagaaugaguauccugugcaguucgacuga

SEQ ID NO: 58652 - RNA, 5169 nt, Artificial Sequence
  derived and/or modified sequence opt3 from LY75__Homo_sapiens__NP_002340
augagaacaggcugggccacacccaggcggccugcugggcugcucaugcuucuguucugguuuuucgacuuggcagaaccaagcggacgcgccgcgaacgauccguuuacuaucgugcacgguaauacgggcaaaugcauuaaacccgucuacggguggauaguugcugacgauugugacgaaaccgaagauaaguuauggaaaugggugucccagcaucgacuguuccaccuacauucucaaaagugccucggacuggacaucacaaaaucaguaaacgaacuucguauguuuagcugugauagcuccgccaugcugugguggaagugcgaacaccauucuuuguauggcgcagccagauacaggcucgcucugaaggacggucacgggacugcaauuucgaaugccucagauguguggaaaaagggaggcagcgaagagagucugugugaccagccuuaucacgagaucuacacccgggauggcaacuccuaugggcgcccaugcgaguuccccuuucucauugacggaacauggcaucacgauuguaucuuagacgaggaccauucugguccuuggugcgcuaccacucugaauuacgaauaugauagaaaauggggcauaugucuuaagccagagaacgggugcgaggacaauugggagaaaaacgagcaguucggaagcuguuaccaguuuaauacacaaaccgccuuguccuggaaggaagcguacgucucaugccagaaccagggcgcagaucugcuaaguaucaauagcgccgcugagcucacguaucugaaggaaaaagaggguauugccaagaucuucuggauugggcuuaaccagcuguacucugcaaggggaugggagugguccgaccacaaacccuugaauuuucucaacugggauccugaccggccaucagcuccgacuaucggcggcagcaguugcgcccgcauggaugcggaaucugggcuguggcaauccuucagcugugaggcccaguuacccuaugugugccgaaagccucugaauaacaccguugaacucacagacguguggacuuacucggauaccagaugugacgcaggauggcuuccaaacaaugguuuuugcuaucuguuggucaacgagucuaauuccugggauaaagcucacgccaaguguaaggcuuucucaagugaccuaauaagcauucauucccuggccgacguggaaguaguugugacaaagcuccacaacgaggauaucaaggaggaagucuggauuggccugaaaaauaucaacauccccacccuuuuccaguggucugacgggacggaggugacucugacauacugggaugaaaaugagccuaacgugccauauaauaagacccccaacugcgucagcuacuugggagaacucggccaguggaaaguucaaucaugugaggagaagcugaaauacgugugcaagaggaagggugaaaaauuaaaugacgcaaguuccgauaagauguguccgccugacgagggguggaaacggcauggcgaaacuugcuauaagauuuacgaggaugagguacccuuuggaacaaacuguaaucugaccauaacgagccguuucgaacaggaguaucuaaacgaccucaugaaaaaguacgauaagucucugcgcaaauauuuuuggaccggccuuagagacguggauucaugcggggaauacaauugggccacagucggagguaggcggcgagcugugacuuucaguaacuggaacuuuuuggagccagcgagcccuggcgggugcguugcaauguccaccggaaagucugugggcaaaugggaagucaaggacugucgcucguucaaagcccugagcaucugcaagaagauguccgguccccucgggccagaggaggcuucacccaaaccugaugacccauguccggaaggcuggcagaguuuucccgccucucugagcugcuauaagguguuccacgcagagagaauuguaaggaaacggaauugggaagaggccgaacgcuuuugucaagcucuuggagcccaucuguccucauucagccacguugacgagaucaaggaguuuuugcacuuccucacagaucaguuuucuggccagcauuggcuguggauaggguuaaacaaaagauccccugaccugcagggaaguuggcaauggagcgauaggacuccagugucuaccauuaucaugcccaaugaguuccagcaggacuacgauauccgugacugcgcagcggucaagguguuccaccggccuuggcgaagagguuggcauuuuuacgaugacagggaguucauuuaucuacgcccauuugcuugugauacaaaacucgaaugggucugccagauccccaagggccggaccccgaagacuccugacugguacaacccagauagagccgggauucacggacccccucugauaaucgagggcuccgaauauugguucguggcagaccuucacuugaauuacgaggaggccguucuguauugugcuucaaaccauaguuuucucgccacgauuaccagcuucgugggucugaaagcaaucaagaauaaaaucgcuaacauuucgggggauggccaaaagugguggauaaggaucuccgaauggcccauugacgaccacuuuaccuacucucgcuauccauggcaucgauucccuguaacuuuuggagaggaaugcuuauacaugagcgccaaaaccuggcugaucgaucuuggcaagcccacagacuguucaaccaaguugccauucauuugcgagaaauacaaugucaguucccucgagaaguauucuccggauagcgcggccaaagugcagugcuccgaacaguggaucccuuuucagaacaaguguuuccugaaaauaaagcccguuucacuaacuuuuagccaagcuagugacacaugccacucuuacgggggaacgcugccauccgugcucagccagaucgagcaggauuucauuaccucgcugcuucccgacauggaagcaacuuuguggaucggccugcgguggacagccuaugagaagauuaauaaauggaccgauaaccgugaauuaacauacucaaauuuccauccucuccuggucucugguagacuuaggaucccagagaacuuuuucgaggaagagagucgcuaucacugugcucugauauugaaucuccagaagucccccuuuacugggaccuggaacuucacgagcugcucugaacggcacuuugugagccugugucaaaaauacuccgagguaaagucaagacagacccuacagaacgccagugaaacagugaaauaucugaauaaccucuacaagauuaucccuaagacucugaccuggcauagcgcaaaaagggagugccuuaagucuaauaugcaauugguuuccauuacagacccguaccagcaggcguuccugucaguccaggccuuacuccacaacaguagccuguggaucggacuguuuucccaagaugacgagcuuaauuucggcuggucugaugguaaacgacuacauuuuucgcgcugggcugaaacuaacggccagcucgaggacuguguggugcuggacaccgauggguucuggaagacggucgacugcaaugauaaccagccaggagccauauguuauuacagcggcaaugaaacagagaaagaaguuaagcccguggacucagugaaaugcccuuccccaguauugaacacccccuggaucccuuuucagaauuguugcuauaacuucauuaucacuaagaaucggcacauggcaacaacccaagaugagguccauacuaagugccagaaacugaacccgaagagucacauuuuaucuaucagagacgagaaagaaaauaacuucgugcucgagcagcugcuuuacuuuaacuauauggcuagcuggguuaugcuggggauaaccuacaggaauaaguccuugaugugguucgauaaaacaccccucucauauacgcacuggcgugccggacgcccaaccauuaagaacgaaaaguuucuggcaggccuaucuacugacgguuucugggauauccagacauuuaaagugaucgaggaggccgucuacuuccaucaacacagcauucuggcuuguaagaucgaaaugguggacuacaaagaggaauauaauaccacacuuccucaguuuaugcccuacgaggaugggauuuauaguguuauacagaagaaagugacuugguacgaagcgcucaacaugugcucccaaagcggaggccaucuggccucuguacacaaucagaacggucaguuguuccuggaggacaucgucaagcgggauggcuuuccauuauggguggggcucucaucccacgacggaagugagagcucguucgaauggucugacggcuccaccuuugauuauauuccuuggaaggggcagacgagccccggaaauugugugcugcuugacccaaaaggcacauggaagcaugagaaaugcaacucagucaaggauggugcaaucuguuacaaaccgaccaagaguaagaaacugucuagauugacuuauuccaguaggugcccugcugccaaggaaaaugggucacgauggauucaauacaaaggacacuguuacaagagugaccaggcccuccauagcuucuccgaggcuaaaaagcugugcucuaagcacgaucauagcgcaaccaucguuuccauaaaagacgaagaugagaacaaguuugugucacggcuaaugcgcgagaauaacaauaucacaaugagaguauggcugggccuuucucagcacaguguggaccagucguggagcuggcucgaugguuccgaagucacuuucgugaaaugggagaacaagucuaaaucaggcguugggagguguagcaugcugauugccuccaaugaaaccuggaagaaaguggagugcgaacacggauucggccgggucguguguaagguucccuuggggccagacuauacagcgaucgcuauuaucguggccacguuaaguauacugguccucaugggaggccugauuugguuucuuuuccaacgacauagacugcacuuggcagguuuuucuagcguacgcuacgcccagggggugaacgaggaugagaucaugcuacccucauuccaugacuga

SEQ ID NO: 58653 - RNA, 489 nt, Artificial Sequence
  derived and/or modified sequence opt3 from LY86__Homo_sapiens__NP_004262
augaagggcuucaccgccacacuguuucucuggacucuuaucuuccccagcugcuccgggggagguggcgggaaggcuuggccuacgcacguggucuguucugacucaggacuggagguuuuguaccagaguugcgauccauuacaagacuuuggcuucagcguggaaaaauguuccaaacagcugaagucuaacauuaauauaagauuugguaucauucuaagggaggauaucaaagaacucuuccuggaccuugcacugaugucgcaggggucaagcguauugaacuuuaguuauccgauuugcgaggccgcgcuccccaaguucuccuuuuguggacggcgcaagggcgaacagaucuacuaugcuggcccugugaauaacccagaguucaccauaccccaaggggaguaccagguccugcuggaacucuauacagagaaacgaucuacuguggccugcgcaaaugccaccaucauguguagcuga

SEQ ID NO: 58654 - RNA, 393 nt, Artificial Sequence
  derived and/or modified sequence opt3 from LY96__Homo_sapiens__NP_001182726
augcugcccuuccucuuuuucagcacccucuuuuccucuaucuucacagaggcccagaagcaauacugggugugcaacucaagugacgcuagcauuuccuauacuuacuguggcagagaucugaaacaguuguauuuuaauuuauacauaacggucaacaccaugaaucugccuaagaggaaagaaguuaucugccgggggucugacgaugacuauucguucugucgcgcacuaaagggagagacagugaacacuaccauuucauuuagcuucaaagguaucaaguuuaguaagggcaaauacaagugcguaguggaagccauuuccgggucuccagaggaaaugcuuuucugucuggaguuugucauccuucaccagccgaauagcaacuga

SEQ ID NO: 58655 - RNA, 582 nt, Artificial Sequence
  derived and/or modified sequence opt3 from LY9__Homo_sapiens__NP_001028839
augguggcccccaagagccacaccgacgauugggcuccuggcccauucuccucuaaaccgcagagaucacaacugcagaucuuuaguagcguccuccagacaucccuucuguucuuguuaauggggcugagggcaucuggaaaggacucggcccccacuguugugucagguauucuaggcgggagcguaacgcucccucugaacauaaguguggauaccgagaucgaaaaugucauuuggaucggacccaaaaacgcgcuugcuuuugcccggccaaaggagaaugugacaauuaugguuaaauccuaccugggccgcuuggacaucacuaaguggucuuauagccucugcauauccaaccugacccugaaugaugcagguucauacaaggcccagaucaaccaacgaaauuucgaagugacaaccgaggaagaguuuacucucuucgucuaugcuccuuuuauugagaaauuaagugugcauguaaucgaaggggaccaccguacacugcuugagggaagcggcuuggaaucuauuaucuccacccuggcagagccaagaguuucagugagggagggcuga

SEQ ID NO: 58656 - RNA, 1056 nt, Artificial Sequence
  derived and/or modified sequence opt3 from LYL1__Homo_sapiens__XP_006722815
augaccggccuggacugggccguggggagcgucuucggaggucucggcuccgcuuuugagguuaucgugucuguaguggggucacagggaugcuacggcgguugucuucaaugggaaugggggagucugaagcaguuguggagcacauucagagauuccaacggcaaaaauaggcgggucauuuuagaggugucuacucccacgucgggaucaaugugcccuccacaggcacaggccgaaguuggcccgaccaugacagagaaggcggaaauggugugugcucccagcccugccccagcacccccuccaaaacccgccaguccugggccaccgcaagucgaggaggugggacaccgcgguggcuccucucccccucgacugccacccgggguaccuguuauaagccuaggacauucccguccacccggcguggcuaugccgacuaccgaacucgguacacugagaccuccccuucugcaguugucaacccucgggacugcaccaccuacacuggcccugcacuaucauccccacccauuucucaacagugucuacaucggacccgcuggcccuuucagcauuuuuccaucuuccagguuaaagcggcgcccgucacauugcgagcuggaccuugccgaaggccaccagccccagaaaguggcgagaaggguguucaccaauagccgggagcgcuggcgacaacagaacgucaauggggcauuugccgaguugagaaagcugcuaccuacgcacccacccgauaggaagcucaguaaaaacgaaguucugcggcuugcuaugaaguauaucggauuccuggugcguuugcuccgcgaccaggccgcagcucuggccgcggguccuacuccacccggcccgagaaaaaggccuguacaucgggugccagaugacggggcccgacgcggaucuggcagaagggcagaggcugccgcucggucccagcccgccccucccgcagauccagacgguagcccugggggcgccgcucgccccauuaagauggaacaaaccgcguuaucgccagaggucagauga

SEQ ID NO: 58657 - RNA, 1476 nt, Artificial Sequence
  derived and/or modified sequence opt3 from LYN__Homo_sapiens__NP_001104567
augggcugcaucaagagcaaagggaaggacucccugucugaugacggaguggaucucaaaacccagcccgucccugagucacaacuucugccaggucagagauuccagacaaaggacccggaagaacagggcgauauuguuguggccuuguaccccuaugacgggauacacccugaugacuuaaguuuuaaaaagggagaaaagaugaaaguacuggaggaacauggcgagugguggaaggcuaaaagccuacucacuaagaaagaggguuucaucccauccaacuacguggcaaagcugaauacgcuugaaaccgaggaaugguuuuucaaggauauuacaaggaaagacgccgagcggcaacuguuggcgcccgggaacucugcuggagccuuucucauccgcgagucggaaacucugaagggcucauucagccugaguguccgagauuuugacccugugcacggcgauguuauuaaacauuauaagauccguucccucgacaaugggggauacuauauaucuccaagaaucaccuuccccuguauuagcgacaugaucaaacacuaccagaagcaggcagaugguuuaugcaggcggcuggagaaagccuguauuuccccuaagccacagaagccgugggacaaagaugcuugggaaaucccccgcgagucaauaaaacuugugaagagauugggcgcagggcaauuuggagaagucuggaugggcuauuacaacaauaguacaaagguggccguaaaaacccugaagccugguacuaugagcguucaggcuuuccuagaggaggccaaccucaugaagacacugcagcaugacaaacuugugaggcuguacgcggucgugacccgggaggagccaauuuauaucauuacggaauacauggcaaaggggucuuugcucgauuuucugaaauccgacgagggaggcaagguguuacugcccaaacucaucgauuucucagcccagaucgcugaaggcauggccuauauugagcgcaagaauuacauacaccgagaccuuagagcagcuaacguccugguuagcgagaguuugaugugcaagaucgccgauuuugggcuagcgagggugauugaagacaaugaguauacugcccgggaaggagcaaaauucccuaucaaguggaccgcuccagaggccauaaacuucgguuguuuuacaauuaaaucugauguaugguccuucggcauccugcucuacgaaaucgugacuuaugggaagauucccuacccgggacguaccaaugcugacgucaugacagcccugagccaaggcuaccgcaugccuagaguggagaacugccccgacgagcuuuaugauaucaugaaaauguguuggaaggaaaaggcagaggaaaggccaaccuuugacuaccugcagucgguuuuggaugacuucuauacggccacugagggucaguaccaacagcagccuuga

SEQ ID NO: 58658 - RNA, 294 nt, Artificial Sequence
  derived and/or modified sequence opt3 from LYNX1__Homo_sapiens__NP_803253
augcagcugggcaccgggcuccuucuggccgcuguguugagcuuacaacuggcagccgcggaggcuaucuggugccaccaguguacaggauucgguggcugcucccaugggucuagaugucuaagggacucaacucacugcgucacgaccgccacacggguucucaguaacacugaagaucugccccuugugaccaagaugugucauauuggaugcccugacauaccaagccugggcuuggguccguacguauccaucgcauguugccagacaucucucuguaaucacgauuga

SEQ ID NO: 58659 - RNA, 426 nt, Artificial Sequence
  derived and/or modified sequence opt3 from LYPD1__Homo_sapiens__NP_653187
augugggugcugggcaucgccgcuaccuucugcgggcucuuucuucugcccggauucgcauugcagauucaauguuaccagugcgaggaauuucaguuaaacaaugacuguagcuccccugaguucauagucaacugcacaguuaaugugcaggauaugugucaaaaggaaguaauggagcagucugccgguaucauguauagaaaaucaugcgcgaguagcgcugccugucugauugcauccgccggcuaccagucuuuuugcucgccagggaagcuaaacucaguguguaucagcugcuguaauacuccgcucugcaacggacccaggccuaaaaagcggggcaguuccgcuucugcacugcgcccaggucuucgaacgaccauucuguucuugaaacucgcccuguuuagcgcucacugcuga

SEQ ID NO: 58660 - RNA, 378 nt, Artificial Sequence
  derived and/or modified sequence opt3 from LYPD2__Homo_sapiens__NP_991108
augagaggcaccaggcuggcccuccuugcucugguguuggcagccugcggggaguuagcgcccgcucugcgguguuacgucugcccugaaccaacaggaguuagcgacugugugacuaucgccacgugcaccacaaacgagacuauguguaagaccacacuauauucccgcgaaauuguauacccguuccagggugauucuaccgugacuaaaucaugcgcaaguaaguguaaacccagcgacgucgauggcauagggcaaacacucccuguguccugcuguaauaccgagcugugcaacguugacggagccccagcucuuaauucucugcacuguggcgcauugacgcuccugccccugcucucguuacgacuguga

SEQ ID NO: 58661 - RNA, 1041 nt, Artificial Sequence
  derived and/or modified sequence opt3 from LYPD3__Homo_sapiens__NP_055215
auggaccccgccagaaaggcuggcgcacaggccaugaucuggaccgcgggguggcugcuccuucuguuguuaaggggaggugcucaagcccuggagugcuacagcugugugcagaaagcagaugacggcugcuccccuaacaagaugaaaacagucaagugugccccagggguugaugugugcacugaagcuguaggagcaguggagacgauucacggccaguucucucuagccguccgggguugugggucaggacucccgggcaaaaaugaccgcggccuggaucuucaugggcuguuggcuuuuauacagcuccaacagugcgcccaggaccgauguaacgcgaagcugaaucugaccagucgugcacucgaucccgccggaaacgaaagcgcuuauccuccaaaugguguggagugcuacuccuguguuggcuuaucuagagaagccugccaggggacaucgcccccuguggucucauguuauaacgcaagcgaccacguguacaagggaugcuucgauggcaauguaacucugaccgcugccaacguuacagugagucuuccagucagggguugcgugcaagacgaguuuuguacccgggauggggugacuggacccggcuucacauuguccggcucuugcugucaggggagccgcugcaauuccgaccugagaaacaaaaccuauuuuucaccuaggaucccaccgcuaguccggcugcccccuccagagcccacgacuguugcgaguaccacaagcgugacuaccucuacauccgccccuguacgcccaaccucaacgacuaagcccaugccggcaccuacaagccagacuccccgacagggaguggaacaugaggcuaguagagaugaggaaccaaggcucaccgguggcgccgcugggcaccaagaccggucuaauuccggacaguacccugccaaaggcgguccccagcaaccacauaacaaggggugugucgcacccacagccggccuugcugcgcuguugcucgcaguggccgcuggaguucuguuauga

SEQ ID NO: 58662 - RNA, 636 nt, Artificial Sequence
  derived and/or modified sequence opt3 from LYPD4__Homo_sapiens__NP_001278348
augggcccccagcaccugagacucgugcaacuuuucugccuguugggggccaucagcaccuuaccuaggauguccuguggagcugguugcuacaagacacagaaaggcacugcacgcggggucguuggauuuaagggcuguucuucaaguagcuccuauccagcccagauuucuuaccuggugucgccgcccgguguaucaauagcgagcuauagucgggugugccgauccuaccuauguaacaaucucacgaaccuggagccuuucgucaaacuuaaggcuucuaccccaaaaagcaucacauccgccucaugcaguugucccacuugcgugggggaacauaugaaggacugucugccuaauuuuguuaccacaaacagcugcccauuggcagccucuaccuguuauuccucaacucucaaguuccaggcuggauuucugaauacaaccuuccugcucaugggcugcgcacgugagcacaaccaauuacuggccgauuuucaucacauuggcagcaucaaagugacggaaguccuuaauauuuuggagaagagucagaucgugggggcugccucuuccagacaggaccccgcguggggaguaguucugggucuacucuucgcauuuagggauuga

SEQ ID NO: 58663 - RNA, 756 nt, Artificial Sequence
  derived and/or modified sequence opt3 from LYPD5__Homo_sapiens__NP_001026919
auggccaugggcgugcccagagucauccugcucugccuuuucggggcugcacuguguuugaccggaagccaggccuuacagugcuacuccuuugagcacacauauuucgguccuuuugaccugagggcgaugaagcuaccaucuauuucauguccgcaugaaugcuucgaggcuauacucagucuggauacuggcuaccgggcccccguuacgcuugugcgcaaaggguguuggaccggaccuccagcaggccagacacagagcaacgccgacgcucugcccccugauuauuccguagugcgagguugcacuaccgacaaguguaaugcacacuugaugacacaugaugcccucccaaaccugucucaggcucccgacccuccaacccugucgggggccgaaugcuacgcguguaucggaguccaccaagaugacugcgcaauuggccguucaagaagggugcagugucaucaggaucagacugccugcuuucaaggcaaugggcggaugacaguuggaaacuucagcgugccggucuauaucagaaccugccaccgccccaguuguacgacugaggguaccacauccccuuggacugcuauugaccuccagggcucuugcugugaaggguacuuaugcaauaggaaaagcaugacccagccauuuacauccgccucagcaaccacgcccccucgggcucugcaagugcuugccuugcugcuaccaguacuccugcuuguuggacugagugcguga

SEQ ID NO: 58664 - RNA, 516 nt, Artificial Sequence
  derived and/or modified sequence opt3 from LYPD6__Homo_sapiens__NP_001182614
auggagcccggcccugcccuggcuuggcuccuucuguugagcuuacuggcagacugccuaaaggccgcgcaguccagagauuucaccgugaaagacaucauuuaccuccacccaucuacaacuccguaucccgggggauuuaaguguuucacgugcgaaaaagcugccgauaacuacgaguguaauaggugggcaccugacauauauugcccacgggaaacccgcuacuguuauacacaacauacuauggaggucaccgguaacucaaucaguguuacaaagcgaugcgugccccuggaagagugucuuagcaccggcugccgugauuccgagcacgaagggcauaaaguauguacuucuugcugugagggaaauauuugcaaccugccuuugccaagaaaugaaacagacgccaccuuugcuacgacuucgcccaucaaccagaccaauggccacccuaggugcaugucagugauugucagcugucucuggcuguggcugggucucauguuauga

SEQ ID NO: 58665 - RNA, 714 nt, Artificial Sequence
  derived and/or modified sequence opt3 from LYPD8__Homo_sapiens__NP_001078943
augaagggcauccugguggccgggauuaccgcuguccucguugcagccguggagagccuuuccugcguacaguguaacucuugggaaaaaucaugcgugaauaguauagcgagcgagugucccucccacgcuaacacaucuugcaucucgucaagcgccaguuccucucuggaaacuccugucagauuguaccaaaauauguucuguagcgcagagaacugcuccgaagagacgcauauuaccgccuuuacagugcacguuucagcugaggaacauuuccacuuugugagucaguguugccagggaaaggaguguagcaauacuucugacgcauuagauccaccgcugaaaaacgucuccucaaaugccgaaugccccgcuuguuaugagagcaacgguaccaguugcaggggcaagccuuggaaaugcuacgaggaggaacaguguguguuccuaguagccgaacucaagaaugacaucgagucuaagucccugguucuuaaagggugcagcaacgugucgaaugcgacaugucaauuucugucuggagaaaacaagaccuugggcggugucauuuuccggaaauuugagugcgcaaaugugaacucccucacuccaacaucagcccccaccacgagucauaauguggggagcaaggcuucccuguaucugcucgccuuagcaucucugcuuuugcgcggacugcuaccuuga

SEQ ID NO: 58666 - RNA, 645 nt, Artificial Sequence
  derived and/or modified sequence opt3 from LYPLA1__Homo_sapiens__NP_001266286
augugcggcaacaauaugagcacccccuugccugccaucgugccagcugcaagaaaggccacagcggcugucauuuuccuccacgggcuuggagacacuggucauggcugggccgaggcauuugccgggauaagguccucucacaucaaauacauuuguccgcaugcuuucgauaucauuggacugucacccgacagucaggaagaugagagcggcaucaagcaagcagccgaaaacauaaaagcucugaucgaccaggagguuaagaaugguauuccuuccaaccggaucauuuuagggggauuuucucagggcggcgcccugucgcuauauacggcgcucaccacacagcaaaaacuggcaggggugacugcccuuucaugcuggcugccauugcgcgcuagcuucccccagggaccuaucgguggcgccaaucgagauauaaguauucuccagugucacggggacugcgauccacugguaccccugauguuuggaucccucaccguggaaaaguuaaagacacuggucaacccugcaaaugugaccuucaaaacuuacgagggcaugaugcauucuagcugucagcaagagaugauggacguuaagcaguuuaucgauaaacuuuugccaccgauugacuga

SEQ ID NO: 58667 - RNA, 666 nt, Artificial Sequence
  derived and/or modified sequence opt3 from LYPLAL1__Homo_sapiens__NP_001287699
auggccgcugcaagcggcuccgugcugcagagaugcaucgucucucccgccgggaggcacucagcgagucucauuuuccuucauggaagcggugacuccggccaagggcugcggauguggauaaagcagguuuugaaccaggauuuaaccuuucagcacaucaaaauuaucuacccuacagcuccaccgcgcuucaagauuacuaaugacugucccgagcaucuggaaucuaucgaugugaugugccaaguacuaacggaccucauagaugaggaagugaaaucgggaaucaagaaaaaccgaauuuugaucggcgguuuuucaaugggaggguguauggccauucaccuugcauaucguaaucaucaggacgucgccggcguguucgcucugagcaguuuucugaacaaggcauccgccguuuaccaggcucuccagaagucuaauggcgugcugccugagcuguuccaaugccacgggaccgccgaugaacucgucuuacacagcugggcggaggagacaaacuccaugcugaaaucacuuggagugacuaccaaguuucauaguuucccaaauguauaucacgaauugagcaaaacagagcuggacauccuaaagcucuggauacugaccaaacuucccggugaaauggagaagcagaaguga

SEQ ID NO: 58668 - RNA, 369 nt, Artificial Sequence
  derived and/or modified sequence opt3 from LYRM1__Homo_sapiens__NP_001289765
augaccacagccacuagacaggaggugcugggccucuacaggagcaucuuccggcuugcucgcaaguggcaagcaacguccgggcagauggaagacaccauuaaagagaagcaguauauacugaacgaagcccgaacauuguuucguaaaaauaagaacuuaacugauaccgaccugaucaaacagugcauugaugaguguacagcgagaaucgaaauuggacuacacuacaagauccccuauccuaggccaauacaucucccgcccaugggucugaccccucuucggggccgcgggcugagaucucaagagaaguugaggaaacucucaaagccagucuaccugcggagucacgacgagguuagcuga

SEQ ID NO: 58669 - RNA, 393 nt, Artificial Sequence
  derived and/or modified sequence opt3 from LYRM4__Homo_sapiens__NP_001158312
auggccgcuagcuccagagcacaggugcugucucucuacagggccaugcuucgggagucaaagcgcuucagugcguauaacuaccgaaccuaugcuguccguagaaucagggacgccuuucgggaaaauaaaaacguuaaggaucccguggagauucaaacacugguaaauaaagcaaagcgcgacuugggcgugauaagaaggcagauggauagccacuccgucgcccaggcuggggugcauuggaacgacuuaucuucgcugcagccucuaccaccgugguucaaacaauuuucaugccucagccugcccaguuccugggauuaccggcgcacuccuccacgacuugcaaauuucuguauccugucuagagacguuauuagcuuguauuga

SEQ ID NO: 58670 - RNA, 315 nt, Artificial Sequence
  derived and/or modified sequence opt3 from LYRM7__Homo_sapiens__NP_859056
augggcagagccgugaagguccugcaacucuucaaaacccuucacaggacacggcagcagguuuuuaagaacgacgcucgcgcacuggaggccgcgcgaaucaaaauuaaugaagaguucaagaacaauaaaagcgaaacuuccucuaagaagauagaggaauugaugaaaaucgggucagauguggaguuacugcuacguacgaguguaauucagggaauccauaccgaccacaacacacucaagcuggugcccagaaaagaucuucuggucgagaaugugccuuacugcgacgcuccaacucagaagcaauga

SEQ ID NO: 58671 - RNA, 237 nt, Artificial Sequence
  derived and/or modified sequence opt3 from LYRM9__Homo_sapiens__NP_001070148
auggcuccccugccuggcgccgagcucgugagaaggccacuucagcuguaccgguauuuguuacgcugcugucaacagcugccgaccaaggggauccagcagcacuacaaacaugcaguccgacagagcuuccguguucacuccgacgaagauaaccccgagaggauucaacagauaaucaagagagccauugaagacgcggauuggaucaugaauaaauauaagaaacagaacuga

SEQ ID NO: 58672 - RNA, 11406 nt, Artificial Sequence
  derived and/or modified sequence opt3 from LYST__Homo_sapiens__NP_001288294
augagcaccgacuccaacucucuggccagagaguuccucacagaugugaauaggcuuugcaacgcugucguucagcggguggaagcacgcgaggaagaggaagaggagacucacauggccacgcugggccaauacuugguacaugggcgaggauuuuuacugcuaaccaagcucaauucaaucauugaccaggcgcugacaugucgugaagagcuucugacuuugcuccugagucugcuccccuuaguguggaaaauaccuguccaggaagagaaggcuaccgauuucaaccugccacuuagcgccgacaucauuuugacaaaagagaagaauuccucuucgcagagaucaacccaagaaaaacugcaccuagaggguagcgcacucaguucccaggugucugccaagguuaacguguuuaggaagagccggcgccagagaaaaaucacucauagguauuccguccgggaugcucgcaagacacagcugucaaccagugacagcgaagcaaauucugaugagaaaggcauugccaugaacaagcaccgaagaccgcaucuucugcaccacuucuugacguccuuucccaaacaagaccauccuaaggcuaagcucgauaggcuggccacuaaagaacagaccccacccgacgcgauggcauuagagaauucacgggagaucauaccucgucaggggagcaacacagauauccugagugaaccagccgcucucucugugauuuccaauaugaacaauagccccuucgaccuuugccacguacuguugucgcuacuggagaagguuuguaaauuugaugugacucucaaccauaauucuccucuggccgcauccgucgugccaacccuuacagaauuccuggcuggauuuggcgacugcuguucauugagugacaaccucgagagccgcguggucuccgccgguuggaccgaagagccgguugcgcugauccagagaauguuauucaggacggugcugcaccuacucucuguagaugugagcacugccgagaugaugcccgaaaaccugcggaagaaucuuacagaguugcugcgagcagcucucaaaauucgcaucugccuggaaaagcaaccugacccauuugcccccagacagaaaaagacccuucaggagguccaagaagauuucguguuuucaaaguacaggcaccgggcucuguugcucccugagcuguuagaggggguucugcagauacuaauuuguugccuccagagugccgcauccaacccauucuauuucagccaggccauggaccuggugcaagaauuuauccagcaucacggauucaaucuuuuugagacugcugucuugcagauggaauggcuggugcuccgcgauggcguacccccggaggcgucugagcaucugaaagcauuaauuaacucaguuaugaagaucaugaguacagugaaaaaggucaaaagcgaacagcugcaccauuccauguguaccagaaagaggcaccgucggugcgaguacucucacuucaugcaucaccaucgagaccuuucgggcuugcucgugagcgccuuuaagaaucaagucuccaaaaacccuuucgaagagacggcugauggggacguguauuaccccgaaagauguugcugcaucgccguuugugcacaccagugccugaggcuacugcagcaggccucacucaguucuaccugugugcaaauucugagcggaguacacaauauagguaucugcuguugcauggauccaaaguccgucauuaucccucuuuugcaugcuuuuaaacugcccgccuuaaagaacuuccagcagcacauacucaauauucugaacaaacuuauccuggaccaguugggcggggcagagaucucaccaaagauuaagaaagcggcuuguaauaucugcacaguggauagcgaccaacucgcccagcuggaggaaacucuacagggaaaccugugugacgcagagcucucuuccagucugagcucucccuccuaucgcuuucaaggcauucuuccuucaagugguagcgaagauuugcuguggaagugggacgccuuaaaagcuuaccagaauuucguuuuugaggaagaucggcuccauucgauacagaucgccaaccacauuugcaaucugauccagaaggggaacaucgugguccaauggaaacuuuacaacuauauuuucaauccagugcugcagagaggaguagagcuagcacaucacugucagcaccucuccgugaccucugcucagagccauguuugcucacaccauaaccaaugccugccgcaggacgucuugcagauauacgugaagacacugcccaucuuacucaagaguagggugauucgcgaucuguuucuuuccuguaauggcgucucucagaucauugagcugaacugcuugaauggcauccgaagccacucccucaaagccuucgaaacucugauaaucucacuaggggagcaacagaaggacgcgagcguuccugauauugacggaaucgauauugaacagaaagagcugaguucugugcauguggguaccuccuuccaccaccaacaggccuauagcgacucgccacagucacuuucuaaguuuuacgcuggccucaaagaagcauaucccaagcggcguaaaacaguaaaccaggauguccauaucaauaccauaaaccuguucuuguguguggccuuucugugcguuaguaaggaggcugaguccgacagagaaagcgccaaugauucugaggacacuagcggguacgacuccacggcaucagaaccuuuaagucacaugcucccauguauuagccuggagucucuugugcugcccuccccggagcauaugcaccaagcggccgauaucuggucaaugugcagguggauuuauauguugaguagcgucuuccagaagcaguuuuaccgccucggaggcuuccgggugugucacaaacugaucuuuaugauaauccagaagcuauucagaucccauaaagaagagcaagguaagaaagaaggggacacaucuguuaacgagaaucaggaucugaacaggauuucgcagccuaagcgaaccaugaaggaagaccuucucagccuggcuaucaaaucagauccaauucccuccgaguugggcaguuuaaagaaaucugccgacagccugggaaagcucgagcugcagcacaucuccucaauaaauguggaagagguaucugcaacugaagcugccccugaggaagcaaaacuuuuuaccagccaagagagugagacaucccugcagagcauucgcuugcuagaagcccugcucgcuaucugccugcauggcgcgcggaccucucagcagaagauggagcuugaauuacccaaccaaaaucugucagucgaguccauccucuucgaaaugagagaucacuugagucagagcaaggugauugagacucagcuggccaaaccacucuuugacgcacugcuuaggguggcucuggggaacuacucggccgauuucgagcauaacgacgccaugacagaaaagucucaccaauccgcugaggaauugagcucacagccuggagauuuuagugaggaggcagaagacucucaguguugcuccuucaaacuacuggucgaggaagaggguuaugaagccgauagcgagucaaaucccgaggacggcgaaacgcaggacgaugggguugaccucaagagugagaccgaaggauucagcgcguccucuagcccaaacgauuuacuggagaaucuuacucaaggcgaaaucauuuacccggagauauguaugcuggagcucaacuugcuguccgcuucaaaagccaagcucgacgugcuggcacacguauuugaaucuuuccuuaagaucauucgucagaaagagaagaauguguuucuacugaugcagcaggguacagucaaaaacuuguuagggggcuuccugaguauccucacccaagaugacucggauuuucaggccugccagcgcgugcugguugaccuucuggugagccucauguccucucggacaugcucagaagaguugacucugcuacugagaauuuuccucgaaaagagcccuuguaccaaaauccuucuguuaggaauauugaagaucauugaguccgauacgaccaugagucccucucaguaucugacauuuccacuccugcaugcucccaaucuuagcaacggcgucucaucccaaaaauacccugggauccugaauaguaaggcaaugggacucuugaggcgagcccgggugagccgcucuaagaaagaggcggacagagaauccuucccacacaggcuguuaucaagcuggcauauugcucccguucaccuaccucugcucggucagaacugcuggccgcaccuuucggagggcuuuucugugagucugugguucaaugucgaauguauccaugaggccgaguccacuaccgaaaaggggaaaaagauaaaaaagcggaacaagagcuugauucugccagauucauccuuugacggaacagagucugaccgacccgaaggcgcagaguauaucaauccuggugaaagacucaucgaggaggggugcauucacauaaucagccugggcaguaaagcccuuaugauucagguaugggcugauccacauaacgccacucucaucuuccgcguguguauggacuccaaugaugacaugaaggcaguucuguuggcucaaguggaaagccaggagaacauuuuccugcccucuaaauggcagcacuuaguccuaaccuaccugcagcaaccucagggaaagaggcguauccauggcaaaauaucaaucugggugagugggcagcggaagccggauguaacgcucgacuuuaugcuucccagaaagacaucccugagcucugauucgaacaaaaccuucugcaugauuggacacuguuugucaagccaggaagaguuucugcaacucgccggcaagugggaccuggguaaucuuuuacuguucaacggggcgaaagugggaucccaggaagccuuuuaucucuacgcaugcggcccaaaucacacuagugucaugccuuguaaguacgguaaacccguuaacgauuauucuaaguacaucaauaaggagauuuugaggugcgagcagauccgcgaacuguucaugacaaaaaaggacguggauauaggccuacugauugagagccucuccguggucuauaccacuuacuguccagcucaguauaccaucuacgaaccugugauccgacuuaaagggcaaaugaagacacagcugucacagagacccuuuaguucuaaagagguucagagcauuuugcuggaaccacaucaccucaagaaccugcaaccgacggaguauaagaccauccagggaauauuacaugagauuggcgggacuggaaucuucguauuucuuuucgcccggguggucgaacuguccucaugcgaggaaacacaggcucucgcacuaagggugauucugagcuugaucaaauacaaucaacagcgcguucacgagcuggagaacugcaauggccucucuaugauacaccaggugcuuauuaagcagaaauguaucgucgguuuuuacauccugaagaccuugcuggaagggugcuguggagaggacauuaucuauaugaacgaaaauggcgaguucaaacucgauguggacuccaacgccauuauacaagacguaaaguuacuggaagagcuucugcuagauuggaaaaucuggaguaaggccgagcagggugucugggaaacacuccuggcugcguuggaggugcugauucgugcagaccaucaccagcagauguuuaauaucaagcaacuccuuaaagcccagguugugcaucacuuccuguuaacuugccagguccugcaggaauacaaggagggccaauugaccccuaugcccagagaagugugucggagcuucguuaaaaucauugcugaggugcucgggucgccacccgaucuggagcuacuuacgauaaucuuuaacuuccugcucgccguccauccuccaacaaauaccuaugugugccacaaccccacuaauuuuuacuucucccugcacauugacggaaagaucuuucaggaaaaaguaaggucuauuauguauuugcgccauucaagcaguggcgggcgaucccugaugucuccuggauucauggugaucagcccgucaggcuuuaccgcauccccauacgagggugaaaacaguagcaacauaaucccccagcaaauggccgcucacaugcucagaucucggucacuuccugcguuccccacauccagccuguuaacucagucucagaagcugaccgggaguuugggauguucgauugauaggcuccagaauaucgccgacacauauguugcaacgcaauccaagaaacagaacagccugggcucaucugauacccuaaagaaagguaaggaggacgcuuuuauuagcuccugcgaaagugccaaaacugucugugagauggaggcagugcuuucagcccaggugucugucagcgauguaccaaagggcgugcugggguucccuguugugaaggcugaccauaaacagcucggagccgaaccccgcuccgaggaugacaguccaggcgaugaaagcugcccuagaaggccggacuaccugaagggguuggcguccuuucaacggucucacucaacaaucgcaagcuuaggacuggccuuccccucgcagaauggcuccgcugccgucggucguuggccaagucucguggaccgcaacaccgaugacugggagaauuuugcuuacucucuuggguaugagccuaacuacaaucgaacugcaagcgcccauucaguuacagaagauugucuggugcccauaugcugcggacuauaugagcugcucuccggcgucuugcugauucuuccagacgugcugcucgaagauguaauggacaaauuaauccaggcugauacccuguuggugcugguuaaccacccuucucccgccauucagcaaggcgucaucaagcuccuugacgcauacuucgcgagagccaguaaagagcagaaggauaaguuccugaaaaauaggggguuuagccuacuggcuaaccagcucuauuugcaccggggaacgcaagaacugcuugaguguuucauagagauguuuuucggucgccauaucggccuggacgaagaguuugauuuagaagacgugagaaauauggggcucuuccagaagugguccgugauuccgauccugggauugauugagacuucacuguacgacaacauccuccuucacaaugcccugcuacugcucuugcagauacugaacagcugcucuaaagucgcagauauguuacuugacaauggccugcucuauguucuguguaacaccguggcugccuugaacggucuggaaaagaauauuccaaugagugaguacaaacuccuugcaugcgauauccagcaacuguuuaucgccguaacaauucaugcuuguuccagcucagggucucaguacuucagggugaucgaggaccuaauagucaugcugggauauuuacagaacuccaagaauaaacggacccagaacauggcgguggcccuccaacugcgaguuuugcaggcagcuauggaauuuauuagaacuacagccaaucacgauucggagaaccuuaccgacagccugcagaguccuucugccccccaccaugcagugguccagaagcgcaaguccaucgcuggcccaaggaaauucccccucgcccaaacagaaagccuguugaugaagaugcggucaguagcgaaugaugagcugcacgugaugaugcagcguagaaugagucaggaaaacccuucccaggcuacugagaccgagcuagcccaaaggcuccagcgccuuacgguucuggcagugaaucggauuaucuaccaggaauuuaacagcgacauaaucgauauuuuacgaacaccggagaaugucacccaaucuaaaacuucaguguuccagaccgaaaucagcgaggagaacauucaucacgaacaguccucugucuuuaaucccuuccagaaggagaucuucacauaucugguggaaggcuuuaaaguuaguauugggucgagcaaggccuccggaucaaagcaacaguggacuaaaauccucuggucuugcaaggagaccuucagaaugcagcuggguagguugcuugugcauauacugagcccagcucacgcagcccaggaacgcaaacaaauuuuugagaucguacacgagccuaaccaucaggaaauccuccgggacugucugagucccucccuacagcacggcgcgaaguuggugcuguaccucucagagcuuauucauaaucaccagggggaacugacggaggaagaguuaggaacagcugagcugcucaugaacgcccugaaauugugcggccacaaguguauaccuccaucugcaagcaccaaggccgaucuuaucaaaaugauuaaggaagagcaaaaaaaguaugaaacugaggaaggugucaacaaagcugccuggcagaagacaguuaauaacaaucagcaaucccuguuccagagacucgacaguaagagcaaagauaucucuaagauugcagcugacaucacccaggccgugucacugucccaggggaacgagcguaaaaaggucauacaacauaucaggggaauguacaaaguggaccuaagcgcgagucggcacuggcaggaguuaauucagcagcugacucaugaucgcgccguaugguaugaccccaucuacuacccuacaucuuggcaauuggauccaaccgaaggccccaaucgagagagaaggcggcuccagcgcugcuaucugacgauuccgaacaaguaccuucugagagacaggcagaaauccgaagaugugguuaagccuccacucucguaucuguuugaggacaagacucacagcucauucuccucuaccgugaaagauaaggcagcuagugagagcauccgagucaaucggcguuguauaucaguggcccccuccagagaaacagcaggcgaguugcuucuggggaaaugcggaauguacuuugucgaagacaacgcuagcgauaccguggagucuaguucccuacagggugaacucgagccugccagcuucucauggacauaugaggaaauuaaggagguucauaaacgcugguggcaacugagggacaaugccguagaaaucuuuuuaacuaacggccggacccuguugcucgcguucgauaauacgaaggugagagacgacgucuaccacaacauccugacaaauaaccuuccaaaucugcucgaguaugggaacauuacugcuuugaccaaccugugguacacaggacagauaaccaauuuugaauaccuuacucaccugaacaagcaugcaggccgcucuuucaaugauuuaaugcaguaucccguguuuccguucauccuagccgacuacguuucggagacccucgaucugaacgaccuguugauuuauaggaaucucagcaaaccuaucgcugugcaguacaaggagaaagaagaucgauaugucgacacauacaaguaucuggaggaagaguaccggaaaggugccagagaagaugaccccaugccaccugugcaacccuaccacuaugggucccauuacaguaacucuggaacgguacuucacuuccuggugaggaugccacccuuuacuaagauguucuuagcauaucaggaucagucauuugacauuccugaucgcaccuuccauagcacaaauaccacuuggcgucucuccaguuuugagucuaugacagacguuaaggagcugaucccagaauucuuuuacuugccggaguuccuugucaaccgggaaggcuuugauuucggcgugagacaaaauggggagagggugaaccacgucaaucugcccccuugggcccgcaacgacccacgacuauuuauacucauccaccggcaggcucuggagagcgacuauguuucccagaauauuugccaguggaucgaucugguguucggauacaaacaaaaggguaaagcgucaguacaggccauuaacguguuucaucccgcaaccuauuucggcauggacgucagcgcuguggaagauccuguucagagaagggccuuggagacgaugaucaagacuuacgggcagacaccacgccaacucuuccacauggcacaugugucuagacccggagccaaacugaauauugaaggcgagcuuccugcugccgucggucuguuagugcaguuugcguuccgggaaaccagggagcagguaaaggagauaaccuacccguccccacucaguuggaucaaggggcugaaauggggagaauauguuggcucacccagcgcaccugugcccgucguguguuuuucgcagccacacggcgagcguuucgggucccuacaagccuugccuacucgagcuauuugcggacugucucgcaacuuuugucuucucaugacauacaguaaggaacagggugugagaagcaugaacucaaccgacauccagugguccgccauccugucuuggggcuaugcagauaauauucugcgguugaaaagcaagcaaagugagcccccagucaacuucauacaguccagccagcaguaccaaguuacaucuugcgcuugggugccggacucaugucagcuuuuuacuggguccaaaugcggaguaaucacggccuauaccaauagguucacaagcaguacuccuucugaaauugagauggagacccagauccaccucuacggccauacagaagagauuaccucacuguuuguguguaagcccuauuccaucuuaauaagcgucucgcgcgaugguacuugcaucauuugggaccugaacagacuauguuacgugcagucucucgcugggcacaagaguccaguuacggccguguccgcaagcgaaaccucaggcgauaucgcgacagucugcgacucugccggaggcgggagcgaucugcgguuguggacugugaauggagaccugguaggucauguucacuguagggagauuaucugcuccguggcuuucaguaaccaacccgaaggcgucucaauaaaugugauugccgggggacuugagaacggcaucguucgacucuggagcaccugggaucugaaaccugugcgugagauuacauuuccaaaguccaauaaacccaucauaucuuuaaccuucaguugugacggucaucaccuguacacugcaaacagcgacgggacagucaucgcuuggugcagaaaggaucagcagcgcuugaaacagccuauguuuuauuccuuccucucaucuuacgccgcaggcuga

SEQ ID NO: 58673 - RNA, 969 nt, Artificial Sequence
  derived and/or modified sequence opt3 from LYVE1__Homo_sapiens__NP_006682
auggccagaugcuucagccuggugcuccuucugaccuccaucuggacaacuagguuguuaguccagggcucucugcgggcugaggaacuaucaauucaaguuaguugucgcauaauggggaucacgcucgugagcaagaaagcaaaccagcagcugaauuuuaccgaggccaaggaagcgugccgacuucugggauugucccucgcugguaaagaccagguagagacagcccugaaggcaucuuucgaaacuuguucguacggcugggugggggauggauuugucgugauuucacguaucagccccaacccuaaaugcggcaagaaugguguuggggugcugauuuggaaggucccagugaguagacaauucgccgcuuauuguuacaacuccucugacaccuggacaaauagcugcaucccggagauaaucaccacuaaagaucccauuuuuaacacacagaccgcaacgcagacuaccgaguucaucguauccgacucaacauauaguguugccagcccuuacucuacuauuccagcucccaccacaaccccuccagcccccgcguccacgucaaucccuaggcggaagaaacucauaugugugacugaagucuuuauggagacaagcaccaugaguacugaaacagagccauucguggagaauaaggcagccuuuaaaaacgaagcugccggauucggcggcgugccgaccgcauuacugguccuugcuuugcuguuuuucggggccgcggccggacuagguuuuugcuauguuaagcgcuacgugaaggcauuccccuucacgaauaaaaaccagcaaaaggagaugauugaaaccaaaguagugaaggaggaaaaagcuaaugauucuaacccuaaugaggaguccaagaaaacagacaagaacccagaagagagcaagucgcccucuaaaacuaccgucagaugucucgaagccgagguguga

SEQ ID NO: 58674 - RNA, 447 nt, Artificial Sequence
  derived and/or modified sequence opt3 from LYZ__Homo_sapiens__NP_000230
augaaggcccugaucgugcucggccuuguccuguugagcguuaccgugcaggggaaaguauucgagagaugcgaauuagcuaggacacugaagcggcuaggaauggacgguuaccgcggcauuucccucgcaaacuggaugugucuggccaaaugggagucuggguauaauacucgagcgacgaacuacaaugcuggagaucguucaaccgacuauggcauauuucaaaucaacaguagauacuggugcaaugaugguaagacacccggggccgugaacgcaugucaccuuagcugcuccgcccuguugcaggacaauauugcugaugcagucgccugugcuaaaagggugguucgggacccucagggaauccgcgccuggguggcguggagaaacaggugccagaaucgggauguccgccaauaugugcagggcuguggcguauga

SEQ ID NO: 58675 - RNA, 585 nt, Artificial Sequence
  derived and/or modified sequence opt3 from LYZL1__Homo_sapiens__NP_115906
augcaggacgcuccccugagcugccucuccccuaccaaguggucuucagugaguagcgccgauuccacagagaaaucugcaucgggcgccgggacuagaaaccuuccauuccaauuuugucugaggcaggcguugcggaugaaggcugccggaaucuuaacgcugauugguugccuagucaccggcgcagaaucaaaaauauacacacgcuguaagcucgccaaaaucuucagccgagcugggcuggacaauuauuggggauuuagucuuggcaacuggauuugcauggcauacuaugaguccgguuacaauacuaccgcccagacaguucuggaugacgggucuaucgauuauggaauuuuccagaucaacagcuuugcuuggugucguagaggcaaguugaaggaaaauaaccacugccauguggccuguuccgcgcucauaaccgacgaucugacugacgcaaucauuugcgccaggaaaaucguaaaggagacacaaggcaugaauuacuggcagggguggaaaaagcacugugaaggacgggaucugucagaguggaaaaaggguugcgaggugaguuga

SEQ ID NO: 58676 - RNA, 585 nt, Artificial Sequence
  derived and/or modified sequence opt3 from LYZL2__Homo_sapiens__NP_898881
augcaggacgcuccccugagcugccucuccccuaccaaguggucuucagugaguagcgccgauuccacagagaaaucugcaucggccgcgggcacuagaaaccuuccauuccaauuuugucugaggcaggcuuugcggaugaaggccgcagggaucuuaacgcugauuggaugccuagucaccggugccgaaucaaaaauauacacacgcuguaagcucgcuaaaaucuucagccgagcaggccuggacaauuauuggggguuuagucuuggaaacuggauuugcauggccuacuaugaguccggcuacaauacuaccgcucagacaguucuggaugacgguucuaucgauuaugggauuuuccagaucaacagcuuugccuggugucguagaggaaaguugaaggaaaauaaccacugccauguggcguguuccgcacucguaaccgacgaucugacugacgccauaaucugcgcuaaaaagauugugaaagagacacaaggcaugaauuacuggcagggcuggaagaaacacugugaagggagggaucugucagacuggaagaaggauugcgaggucaguuga

SEQ ID NO: 58677 - RNA, 447 nt, Artificial Sequence
  derived and/or modified sequence opt3 from LYZL6__Homo_sapiens__NP_001186880
augaccaaggcccugcucaucuaccuugugagcuccuuccuggcuuugaaccaggcaucuuuaauuucaagaugcgaccuggcccaaguccuacagcucgaggaucuggacggcuuugaaggguauagucuuagcgauuggcuguguuuggcguucguugaguccaaauuuaauauaucuaagaucaacgaaaaugcugacggaucguucgauuacggucucuuucagauuaacucacacuauuggugcaaugacuacaaaagcuauagugagaaccugugucauguggauugccaggaccugcucaaucccaacuuacuggccggcauccacugugcaaagaggauuguauccggggcccggggaaugaauaacuggguggaauggcgccuucauugcucuggccgaccuuuguucuacuggcugacagguugucgucuaagauga

SEQ ID NO: 58678 - RNA, 849 nt, Artificial Sequence
  derived and/or modified sequence opt3 from LZTFL1__Homo_sapiens__NP_001263307
augagauucgccaggagcaagcggggccugcgccucaaaacaguggacuccugcuuucaggaucuuaaggagucucgacuggucgaagacacauucacuaucgaugagguuucagaaguguugaacggguuacaagcuguagugcacagugaggucgaaagcgagcugauuaauacggcauacaccaacgugcuacuccugcgucagcuuuuugcccaggcggagaaaugguaucugaaguugcagacagacauauccgaacucgagaauagagaacugcuggagcaaguugcugaguucgaaaaagccgagaucacuucuucgaacaagaagcccauucucgaugugaccaaaccuaaguuagcaccacugaaugaaggagguacagccgagcuuuugaacaaagaaauccugaggcuacaggaggagaaugaaaagcucaaaucacggcugaagaccauugagauccaggcuacuaacgcacuugacgaaaagagcaaacuggagaaggccuugcaggaucuccaacuggaccagggcaaucagaaagauuuuauaaaggcucaggacuuaaguaaccuggaaaauacagucgccgcgcucaaauccgaguuccaaaagacccuuaacgauaaaacggagaaucagaagucucuggaagagaacuuggcaacugccaagcaugaccuacugcgcgugcaggaacaacuccacauggcugagaaagaacuggagaagaaauuucagcagaccgccgcauacagaaauaugaaggagauccuuaccaaaaagaacgaucagauuaaggaccugaggaaacgguuggcucaauaugaaccggaggacuga

SEQ ID NO: 58679 - RNA, 2523 nt, Artificial Sequence
  derived and/or modified sequence opt3 from LZTR1__Homo_sapiens__NP_006758
auggccggccccgggagcaccggaggucagaucggcgcugcagcccuggccgggggagcuagauccaagguggccccuucugucgacuucgaucacucaugcagugacagcguugaguaccucacacuuaacuuuggcccauucgaaacugugcauagguggcggcgccugccgcccugugaugaguuuguaggugcacgacguuccaaacacacgguggucgccuauaaggacgcuauuuacguguucgggggagauaauggcaaaaccauguugaacgacuuacugagauuugauguuaaggacugcucuugguguagggcauucacaacuggcaccccuccagcgccccgguaucaucacucggcuguggucuacgggucaagcauguuuguguucggagguuauacaggcgauauauacaguaauuccaaccuaaagaauaagaacgaccucuuugaauauaaguucgccaccgggcaauggacugaguggaaaaucgaaggacgccugccuguagcgagaucugcacauggcgccacaguuuacagcgauaaacuuuggauuuuugcugguuacgacgggaaugccaggcugaacgauauguggaccaucggauugcaggaccgggagcucacgugcugggaggaaguggcacaguccggcgagauuccacccucauguugcaauuucccugucgcugugugucgcgacaaaauguuuguguucaguggccagagcggggccaagaucacuaacaaucuguuccaauuugaguucaaagauaagaccuggacacgaauaccaacugaacaucugcucagaggaucuccgcccccuccacagaggcgguauggucacaccauggucgcguuugaccgucacuuauacguuuucggcggggccgcagauaacacacugcccaaugagcuucacugcuaugacguggauuuucagaccugggaaguagugcagccuuccucagacagcgaggucggaggcgcugaagugccagagcgcgccugugcuagugaagagguucccacguugacuuacgaggaaagaguggguuucaagaaaucuagggaugucuuugggcuggacuucggcacaaccuccgccaagcaaccgacucagccugcaagcgagcuacccucgggacggcucuuucaugccgcugcggugaucucugaugcaauguauauuuucggcgggacaguagacaacaauauccgauccggagaaauguaccgcuuucaguucucaugcuauccaaaauguacccugcacgaggauuacgguagacuuugggaaaguaggcaguuuugcgacguugaguucgugcugggcgagaaggaagagugcguccaagggcacguggccauugucacggcucggagccgcugguugagaaggaaaaucacccaggcccgugaacggcucgcacagaagcuggagcaagaagccgcuccugugccccgagaggccccaggaguugcagcgggcggugcuagacccccuuuacugcauguggccauaagggaggcagaagcccgcccauucgagguacucaugcaguuucuuuacacagacaaaauuaaguauccgcggaaggggcacgucgaagaugugcuguugaucauggacguuuacaaacuagcucuguccuuccagcucuguagacuggagcagcuuugcaggcaauauauugaggccucuguggaucugcagaacgucuuggugguaugugaaagcgcagcucgccuccagcugucacaguuaaaggagcauugccugaacuuugugguuaaagaaagucacuucaaucaagucaucaugaugaaggaguuugaacgacuauccagcccccucaucguggagauugugcggcguaaacagcagccuccacccagaacuccucuggaccagccagucgauauaggcaccucucuuauccaagacaugaaggccuacuuggagggagcgggcgccgaguucugugauauuacacugcuccuggacgggcaucccaggccggcucacaaggcaauccuugccgcucgcucaaguuauuuugaagccauguuccggagcuuuaugccugaagauggacagguuaacauauccauuggugagauggugccaucuagacaggcauucgaaucgaugcugagguacaucuauuacggcgaggugaauaugcccccugaggacagcuuguaccucuuugcggcccccuauuacuauggguucuacaacaaucgacugcaggcuuauugcaaacaaaacuuagaaaugaauguaacuguccagaacgugcugcagauccuagaggccgcagauaagacccaagcucucgacaugaaacgccacugucugcauauuaucguucaccaguuuacaaagguguccaaacuuccaaccuugcggucacugagucagcagcuccuguuagauauuauagacucucuggccagccauaucuccgacaagcaaugcgcagaacuuggagccgauauuuga

SEQ ID NO: 58680 - RNA, 1791 nt, Artificial Sequence
  derived and/or modified sequence opt3 from LZTS1__Homo_sapiens__XP_011542689
augggcagcguguccucucugaucucagggcacaguuuccauagcaagcacugcagagccucccaguacaaacucaggaagucuucgcaucuuaaaaagcugaaccgguauucagacggauuguuacgcuuugguuucagccaagauaguggccacgggaaauccucuagcaagaugggaaaguccgaggacuuuuucuacauuaaagucucacagaaggcucgaggcagucaucaccccgauuauaccgcacugagcucuggugaccuagggggacaggccggcguugauuuugacccuuccacaccaccgaaacucaugcccuucucaaaucagcuggaaaugggcagcgagaagggggcggugcguccuacugcuuuuaaaccaguacuucccagaaguggagccauacugcacucuuccccugaaagcgcaucgcaucaauugcacccagcucccccugauaagccaaaggagcaggaacucaaaccgggucuguguucuggcgcccuguccgacucagggaggaacaguaugagcucccuccccacgcauucuaccagcucaaguuaccaguuagauccucuggugacaccagucggacccacuucccgguucggcgguagcgcacacaauaucacccaggggauugugcuucaagacucuaacaugaugucauugaaggcccugaguuuuagcgauggaggcuccaaacuaggccacucuaauaaggcugacaaagggccuucgugcguucgcagcccaaucuccacagaugaguguucaauucaggagcucgaacagaagcugcuugagagagaaggagcccugcagaaauugcaaaggaguuucgaggagaaggaacucgcgucuagccuggcauaugaggaacggccccgccgaugcagagacgaguuagaagguccggagccuaagggcgggaacaaacugaagcaggccucccagaaaucacaaagggcucaacaggugcuccaucuucagguccugcaguugcagcaggagaagcggcagcuacgucaagaacuggagagccucaugaaagaacaggaccugcuugagaccaagcugcgcucuuacgaaagagagaagacuuccuuuggacccgccuuggaggaaacacagugggaggugugucagaaaaguggcgaaaucagccuccugaagcaacaguuaaaagagucucagaccgaaguaaaugcaaaggcuuccgagauacugggucuaaaagcccagcucaaggauacgagggggaagcuggagggccuugaauugcggacucaagaccuggagggagcgcuccgaaccaaaggccuggaacuugagguuugcgagaacgaacugcagcgcaagaaaaaugaggccgaauugcucagagagaaggugaaccuguuagaacaggagcugcaagagcuaagggcacaggcugcccucgcucgggauauggggccaccuacauuccccgaagacgucccagcccugcagcgcgagcuugaaagauugagggcagagcugcgugaggaacggcagggacacgaucaaaugucaagugguuuucagcaugagcgacucguguggaaagaagagaaggaaaaggugauccaguaucagaaacaacugcagcagagcuacgucgccauguaccagagaaaucaaagguuagagaaggcucugcagcagcuugcgcgcggcgacucggcaggggaacccuuggagguugaucucgagggagccgacauuccuuaugaagauaucauugcuacugagaucuga

SEQ ID NO: 58681 - RNA, 576 nt, Artificial Sequence
  derived and/or modified sequence opt3 from M6PR__Homo_sapiens__NP_001193953
auguuccccuuuuacagcugcuggagaaccggccugcuccuucuguuguuagccguggcugucagggaguccuggcagacagaagagaagacuugugaccugguuggggaaaaaggaaaggagucugaaaaagagcuagcacucgugaagcggcugaaaccucuuuucaacaagucauuugagaguacgguaggucaaggcagcgauaccuauaucuacauuuuccgcgugugccgagaagccgggaaucacacauccggagcgggccugguccagauaaacaagucuaaugguaaagagacugugguugggcguuugaacgaaacccauaucuuuaauggaucgaacuggauuaugcucaucuauaagggcggcgacgaguacgauaaucacugugggaaagagcagagaagggcuguggucaugauuucaugcaaccggcauacacuggccgacggaugugauuucgugugccgcagcaagccaagaaauguaccggcagccuauagggguguuggcgacgaucagcugggggaagagagugaggaacgggacgaucaccucuuacccauguga

SEQ ID NO: 58682 - RNA, 2304 nt, Artificial Sequence
  derived and/or modified sequence opt3 from MAATS1__Homo_sapiens__NP_203528
augagccacgccgugaccaucgaggaaccccaggcucaaccucaggucucccagacaagauacagggagcggucucgcgcaggcucacauauuaguagcaaccgagccuaugacuuccuguacgauccacucuuuauaguuuccucugaaaaggaccacacucaggcgaauauccaagcuacgcuuauucguucgagacugaggaaagugccgcgguucaagaccauguuuucaaacuugauccauuauccccgcuacagcuuauauuggaguaaauccgauccuguaccacccuucauuucuagagaguggaaggggcacaaagaaaagcauagggaggcccugcggcagcuaacaacuaccgacgccagcuuucagaugccuaaggagguguacgaagauccagaggucacagguaaaaaucgcuauaaguacuucgaacgacccuuucucccuuucuuucagcaaaugccauucaacgugguuuacgcaguguccaaagcugagccguauaccuuucccccuacuucaacaaagcaccugaguaucccaagcaaaucuaccgucggaacgcagacugacuacagagaugcagacgugcagaccgaucccuauuccccugaguacguaguuugccaggacucaauaccagaacuucugacauuggccacucucaccuggggcagggggcugcccgcuggacaagccgagguggaaaugaucgagcgggcgcgugaaaagcgcgcaugggaggccagccugccggcucucagugauacaucucaguucgagaagagaaggaaaaugaugaaugaaauggagcggaaggaaugggccuuucgagagcaggaaauugagaaauuacaagagauccgccuggaaguccuuaaggaguugcugagaaaaagggaagagaaccagaaugaagugaacaugaagcaccuaaaugcacggugguccaaacuccaggagggcaaggaggcuaagauggccaaaauucagcgcacccaugugagcacgaucagaaagcuggucgguaaaaggaagaacauagaagggaaacuugagcgucggaauauuaucaaggacuauucggauuacgcgucucaaguuuauggaccucugucccgauugggcuguuuccccgacaacaauucagaagacuucgugguaaagaacuacuaccucaauacuuaugagggccugguggaguuagaaaguugccugccagauuuugucacacagccucagauuagagcccccaaaccaaaggugaucaccacuaaagcaggguuccucaagagggcugcccgccuugacuacgagcuggcugaaguucacaaagccuugcuagauaagaagaacaaagugcuggaggucaagaaacccccucgguuucuccagagaaacccaaucccgcaacccaggcugccuacaccaacccuugaaaugacgagcaaugaggaggaagagauggaaauggcagugauuuaucugcagaaguugcuccgcggacgaguaguucagaacaugauguucgaggguaaagaaaagcggcuggaguuaauacaggagcugcguaccugucaugcccuacaagaagacgagaagcucgugaaaaaggcugaaaaacaggucacacuggcgcuucagagacagaggaauuugcacgagcacaaggugucccuggucgaaaaccaucucgcaggccuggaggggcgcgcccuugcugauauguuugacuuccugucuaaagaguuggugcggcuccaagaagagagaaggauccacgccuuuguuaugcuggcagaacgacagcgccgggugagagaggccgaggaaagcggaaggcgucagguagagaagcaacgcuuacgggaagaggaugaaauuuucaaagaggucgugaagguucaucacucaacuaucaguuccuaccuggaggacauaauucuaaauaccgaagcuaacacagccgaggaacaggcaagagcggagaucgaaaagauggcugagaaaaucaaugauauugccuaugagauggaaagcaggcgaacuuaccuccagucugaggaaaucguggcagagcuggucuauucauuucuuauucccgaagugcagaaguacuucguaaaagagaaggugcggaacgcccaacgcaaacauauauuggcugcccaccagaucauucacaguuacaccgagagcaugguucagaagaagcugacagaaggcgagcaggacgaagcauccaaugcugccaugcuccuggagaaagagacccaaaacgaaaauaacucuuga

SEQ ID NO: 58683 - RNA, 1080 nt, Artificial Sequence
  derived and/or modified sequence opt3 from MAB21L1__Homo_sapiens__NP_005575
augaucgccgcucaggcaaagcugguguaccaccucaacaaguauuacaaugagaagugccaagccagaaaagcggcuauugccaagaccauaagggaagucuguaaaguugugagcgacguacuuaaggagguggaaguccaggagccccgguucaucuccucucugaacgaaauggauaaucgcuaugagggcuuggaggugauuucaccuacagaauuugagguuguguuauaccugaaccagaugggggucuucaauuuuguggacgauggaagucuaccagguugcgcaguacucaagcugagcgacggccgaaaacguuccaugucucuuuggguugaguucaucacugccucgggguaucugucagcuagaaagauuaggagccgguuucagacguugguggcacaagccgucgauaaauguaguuaccgcgacguggugaagauggucgcugauaccuccgaaguuaaacucagaaucagggaccgguaugugguacagauaacaccggccuucaagugcacuggaaucuggccccgcucugcggcacauuggccucugccacacauucccuggccuggcccaaaccgaguggccgaggucaaggcugaagguuuuaaucugcucagcaaagagugucauuccuuagccgggaagcagucaagugcagaaagcgaugcuugggugcugcaguucgccgaggcggaaaacagacuucaaaugggaggcugcaggaaaaaguguuugucuauccugaaaacccuacgggaccgucaccucgagcugcccggccagccucuuaauaacuaccauaugaagacacugguuuccuacgagugcgaaaaacacccacgcgagucagauugggacgaaagcuguuugggggauagacucaaugguauucuguuacagcugaucaguugccuccaguguaggcggugcccgcacuauuuucuucccaaccuggacuuguuccaaggaaagccucauucugcccuagagaaugcagcuaagcagaccuggcgacuggcccgcgaaauacucacuaacccaaaaucccuggagaaacuuuga

SEQ ID NO: 58684 - RNA, 1080 nt, Artificial Sequence
  derived and/or modified sequence opt3 from MAB21L2__Homo_sapiens__NP_006430
augaucgccgcucaggcaaagcugguguaccaacucaacaaauauuacaccgagagaugccaggccaggaaggcggcuauugccaaaacaauacgggaagucuguaagguugugagcgacguacuuaaagagguggaaguccaggagccccgcuucaucuccucucugucagaaauugaugcacgauaugagggcuuggaggugaucaguccuacugaauuugagguuguguuauaccugaaucagaugggggucuucaacuuuguggacgauggaagccuaccagguugcgccguacucaagcuguccgacggccguaagagaucuaugucgcuuuggguugaguucauuacggcuucaggguaucugagcgcaaggaaaauccggagucgcuuucaaaccuugguggcccaggcugucgauaaguguuccuacagagacguggugaaaaugauagccgauacaucugaagucaagcucaggauccgggagcgcuauguugugcagauuacuccggcguucaaaugcaccggaaucuggccccgaagcgcagcccaguggccuaugccacacauucccuggccuggcccaaauagaguagcugaagugaaggccgaggguuuuaaccugcuguccaaggaauguuacucacucacagggaaacaaaguagcgcagagucugacgcuugggucuuacaguucggagaagccgagaauaggcugcuuaugggcggcugccggaacaaguguuuguccgugcugaaaacccuacgugaucgccaucucgagcugcccgggcagccucuuaauaacuaccacaugaagacucuguugcucuaugaaugcgagaaacauccaagagaaacagacugggaugagucaugucugggagacagguuaaaugguauccugcuccagcuuauaagcugccugcaaugucggcgaugcccgcacuacuuuuugcccaaccuagaucuguuccagggcaagccucauagugcgcucgaaucugccgcaaaacagaccuggcgccuggcuagagagauucuuacgaauccaaagucccuggacaaguuguga

SEQ ID NO: 58685 - RNA, 1089 nt, Artificial Sequence
  derived and/or modified sequence opt3 from MAB21L3__Homo_sapiens__XP_011538928
augaaguaccugaccgugggcgaccucgaggauugccuucugaacaaagucgacuugagaaggcagcaaaucagccaggccguugaagaggugcagaagguagugcaccauuuaacaacuaauauuuccaaccaggauauacgguuccaagcuguccccuauucugacacguacaaugaaaacaucaaagugcuggcaccuucacaguuucuaguuaccgugccaauuaaggggcucgccggauaucgcgaggcgcgagaacagcacuggcguuacuauacacugcaggguacuagacuuccguguccccugagggauccugagggcuugcaacaguggcucgaggucgaacaguucaugaaaagucuguggcaguggcaugagaccgacgugaauaucgauggggacauuguaccagcuaagguucugcucguguuucggaaguuagucgaaaacgccgugcgcacaugccaccugagcggaaaagugucccuuuugggcaauagaucugcagucuggguugccguggagaccucggcuuaccaaguagagcuggaacuugugcccgcagucgagaucccuacuacauggucaaagaaagccagguggccacggugucuccagcgcuggcccagccaggaacgaguggagugcauaaagaguuucgguuuuaaccugcuugcuuguuccaauuaucauuggcaacugucuuucuugagagccgaacagguucuccuggagcaguuagaugaggacgggggaugcaggcggaaauguuuucaggugaugcgucaccugaaggaagauaucuggugcccuggcaaccgcccagucauuaccagccaccaucuccaaacggugcuuuucuggacuugugagaaguacccgcacuuuaaagacuggcagguauucuccaaggcguuucugagauugguuaggaaacuacauaagugcgugucacagcacuuccugaaacacuacuuuguccggaauaguaaccucuuccaguguaccaaucccacagaacuggauacuguggcacaaaagcuagccaccuuccugaaaaacccucagaucggcccacccuga

SEQ ID NO: 58686 - RNA, 2559 nt, Artificial Sequence
  derived and/or modified sequence opt3 from MACC1__Homo_sapiens__NP_877439
augcugaucaccgagagaaagcacuucaggagcggccggauugcccaguccaugucugaagcuaaccucauagacauggaggcagggaaacuuucaaagaguugcaauaucacagaaugucaagaucccgaccuguugcauaacuggccugaugccuuuacuuuacgcggaaauaacgcgagcaaaguggcuaauccauucuggaaccagcuguccgccucuaauccguuucuagacgauauuacgcagcuccgaaacaaucguaagagaaacaauaucucgauucugaaagaggaccccuuccuguuuugcagggaaaucgagaacgguaauucauucgauagcaguggcgacgagcuugauguccaccaguugcuccggcaaaccuccucucgcaacagcgggagauccaagucaguuagugaacugcuggacauacucgaugacacagcacaugcccaccagagcauccauaauucugaucagauuuuacugcacgaccuugagugguugaagaacgacagggaggcuuacaaaauggcauggcugucccagcggcaacuagcccgcucaugucucgaucugaacacuaucagccagaguccuggaugggcucagacccagcuugccgaagugacaauugcgugcaagguaaaucaccaaggcgguucugugcagcugccagaguccgacaucaccguccaugugccccaggggcacguugcagugggagaauuucaagaggucagcuugcgagccuuccucgauccuccacauaugcugaaccacgacuuaucguguacugugucuccccugcucgaaauaaugcuuggcaaucugaacacaauggaggcuuugcuacuggaaaugaaaauuggcgccgagguaagaaaggauccuuuuucccagguuaugaccgagauggugugccuccacucacuggggaaagaaggaccauucaagguccuuaguaauuguuauaucuacaaggacacgauucaggugaaacugaucgauuugagccaggugauguaucucgucguugcagcucaagccaaggcgcugccgucccccgccgcaacuaucugggacuacauucauaaaaccacaucuauagguaucuauggcccuaaguacauucacccaucauuuacugugguauuaaccgugugcgggcauaacuauaugcccggacagcugacaaucucagauauaaagaagggcgguaaaaauauuaguccugucguguuccagcuaugggggaagcaguccuuucuccuggacaagccacaagaucuuagcaucucuaucuucucaugugaccccgacuucgagguuaaaaccgaaggagagaggaaggaaauuaaacagaagcaguuggaggcuggcgaggugguccaccagcaauuucuguucagucucguggaacaucgggagaugcaccuguuugauuucugcguacagguugaaccgccuaacggcgagcccguggcccaguuuagcaucacgacuccagacccuacacccaaucuuaaacgucuguccaacuugccaggguaccuccagaagaaggaagagauuaaaucugcuccccugucgccuaagauauuagucaaauacccaaccuuccaagauaagacucugaauuuuagcaacuauggagugacacuaaaagccguccuccgccaguccaagaucgacuacuuccuggaguauuuuaagggugauaccauugcacuuuugggcgaagggaaagugaaggccaucggacagucaaaaguuaaggagugguacgugggcguacugagagguaaaaucgggcucguccacuguaagaaugugaagguuauuaguaaagaacaagugauguucaugucugacagcgucuuuacgaccaggaaccuguuagagcagauagugcugccgcuuaagaaauugacauauaucuacuccguagugcucacucugguuucagagaaggucuaugauuggaaagugcuagcugacgugcugggcuacagccaucucucucuggaagauuucgaccagauucaggcggauaaggaguccgaaaaagucaguuacguuaucaagaaacuuaaagaggacugccacaccgaacggaauacacgaaaguuuuuguaugagcugauuguggcauuacucaaaauggauugccaagagcugguggcccgccuuauccaggaagcugccguacugacuagcgcagucaaguugggaaaaggcuggagagagcucgccgaaaagcuggugaggcuaaccaagcagcagauggaggcuuacgaaauaccccaucgggggaacacaggagacguugccguggagaugauguggaaaccugcauaugacuuccuguacaccuggucugcgcacuaugguaacaauuaccgcgauguccuccaagaccugcaguccgcucuugauagaaugaagaacccagugacuaaacacuggagggaguugacgggcguucugaucuuagugaauagccucgaaguacugcgugucacagccuucaguaccagcgaggaaguguga

SEQ ID NO: 58687 - RNA, 978 nt, Artificial Sequence
  derived and/or modified sequence opt3 from MACROD1__Homo_sapiens__NP_054786
augagccugcaguccagacucucuggcaggcuugcccaacugcgggcugcagggcaguuguuagugcccccucgcccacgaccgggacaccuggccggugcgacccguacaagaucaaguacuugcgggcccccugcuuuccuaggggucuuuggaaggcgggcccgcacgagcgcaggcguuggugccuggggcgcugcagccgugggaagaaccgcuggcguaaggacaugggccccacucgcgauggcagccaagguggaccuguccacuucuaccgauuggaaagaggcuaagucguuccuuaaaggccugucagacaagcagcgggaggaacauuacuuuuguaaagauuucguccgcuugaagaagauccccacauggaaagaaauggccaaggggguggcaguuaaaguggaggaaccucgauauaagaaagacaagcagcucaacgagaagauuagccugcugagaagugauauaaccaaacucgaggucgacgcuaucgugaaugccgcgaacuccucuuuacugggagguggcgggguagauggaugcauucacagggccgcaggcccacuuuugacugacgaaugucggacacugcaaagcugcaagaccgguaaagcuaagaucacugggggauaccgucuacccgccaaauauguuauucauacggugggcccuaucgcuuacggcgagccauccgccucacaggcagccgaacuccgcaguuguuaucugagcucucuugaucuguugcucgagcacagacugagguccgucgcuuuuccgugcauaucaaccgggguguucggauaccccugugaggcggcagccgaaaucguguuagcuacacugcgggaguggcucgaacagcauaaggacaaagucgaucgacuuauuaucugcguuuuucuggagaaggacgaagauauuuaucgcagcagauugccucacuacuucccaguggccuga

SEQ ID NO: 58688 - RNA, 642 nt, Artificial Sequence
  derived and/or modified sequence opt3 from MACROD2__Homo_sapiens__NP_001028259
augaacgaguucuuuagcguggacgauaauaacgaagaggaagaggacgucgaaaugaaggaggauuccgacgagaauggccccgaagagaaacagucuguugaagagauggaggaacaaucacaggaugccgacggggugaacaccguaacagugccuggaccagcuagugaggaagcagucgaggauugcaaggacgaagauuucgccaaagacgagaauaucacuaaggguggcgaggugacggaucacagcguuagagaccaggaucauccggacgggcaggaaaacgacuccaccaaaaaugagauuaagauagaaacagagucucaaucgucauacauggaaacugaggagcugagcaguaaccaggaagaugcggugaucgucgagcagcccgaagugauuccucucaccgaggaccaggaagagaaggagggagaaaaagcuccaggcgaggauacacccaggaugccugguaaguccgaagggucuagcgaccuugagaauaccccaggacccgauguagagaugaacucccaaguugacaaagugaaugauccuacugaaucacagcaggaggaccagcugaucgccggcgcacaagaugaagccaaggagcagcggaacggcacaaaauga

SEQ ID NO: 58689 - RNA, 2157 nt, Artificial Sequence
  derived and/or modified sequence opt3 from MAD1L1__Homo_sapiens__NP_001291452
auggaggaccugggcgaaaacaccauggugcucagcacacuuagaucccugaauaacuucaucucucagagggucgaagggggaucagguuuggauauuaguacuagcgcccccggcuccuuacaaaugcaguaccagcagucuaugcaacuggaggagcgggcugaacagauacgcucgaagucacaccuaauccagguugagcgagagaaaaugcagauggaacucagccauaagcgugcaagaguggagcuggaaagggccgcgaguacguccgcucggaauuaugagcgcgagguagacagaaaccaagaacuucugaccaggauucggcaguugcaggagcgcgaagccggggcagaggaaaagaugcaggagcaacucgagcgaaauagacagugccagcaaaaccuggaugccgcuucuaagaggcugcgggaaaaagaggacagccucgcacaggccggagaaacaaucaaugcuuuaaagggccguauuuccgagcugcaguggucagugauggaucaggaaaugcgcgucaagagacuugagagugagaaacaagaauugcaggagcagcuggaccuacagcacaagaaaugucaagaagccaaccagaagauccaggagcuccaggcgagccaagaagcaagggccgaucaugagcagcagauaaaagaccuggagcagaaacuuucucugcaagaacaggaugcugccaucgugaagaauaugaaauccgaguugguucggcucccucgacuggaacgcgaguuaaagcagcugagagaggaaucagcacaccucagggagaugcgggaaacuaacggucuucugcaagaggaauuggaggggcuacagcgcaaacugggaagacaggagaagaugcaggaaacccucgugggccuggagcuugaaaaugagaggcuguuggcuaaacuccaaagcugggaacgucuggaccagacaaugggcuuaaguauucggaccccagaggaucugucucgauuugucguggagcuacagcagagagaacucgcccugaaggacaaaaacuccgcgguaacuagcucggccagggggcuugagaaggcacgccaacaguugcaggaggaacugcggcagguuucuggacaacuccuggaagagagaaagaaaagggagacacaugaagcucuugcccgccgacugcagaagcggguguugcuccugaccaaagagcgugaugguaugagagcuaucuuaggcuccuacgacucagaacugacgccggccgaguauaguccccagcuaacuaggcgcaugcgggaggcagaagacaugguccaaaaggugcacagccacuccgccgagauggaagcucagcucucucaggcgcuggaggaacuugggggacagaaacaaagagcagauauguuggagauggagcugaagaugcucaagagccagucaaguuccgccgaacagagcuuccuguuuucuagggaggaagcugacaccuuacgacugaaaguggaggaacuugagggcgagcgcucacgguuggaagaggaaaagagaaugcucgaggcccagcuggaaaggcgugcacuacaaggugauuacgaccagagucgcacaaaaguccugcauaugagccucaauccuacuuccguugcccggcagagacugagggaggaucacucucagcuucaagcugagugcgaacgauugcgggggcuguuacgcgccauggagagaggaggcaccgugccagcagaccucgaagcggcugccgcaucgcugcccagcuccaaggagguagccgagcuuaaaaagcaaguggaaucagcugagcugaagaaccagagguugaaagaagucuuccagacaaagauucaggaguuucggaaagccuguuauacccucacgggcuaccagaucgauauaacuacagaaaaucaguaucgacugaccagucuauacgcagagcauccuggggacugccugauuuucaaggcuacuucuccaagcggauccaaaaugcaacuccuggagacagaauuuucacacaccgugggugagcuuaucgaaguucacuugagacgccaggauagcauucccgccuuccugucuuccuuaacgcucgagcuguuuaguaggcagaccguggcguga

SEQ ID NO: 58690 - RNA, 921 nt, Artificial Sequence
  derived and/or modified sequence opt3 from MAD2L1BP__Homo_sapiens__NP_001003690
auggccagagugccccugggcaggagccucacccuuuccccucggcuggagcacaacgggaugacaucugcucaucacaauuuccgcuugccaggaucacgagacaguccggcaagcgccucccaggucgcggaaaucauugauuuagagugguacgaaaagucugaggaaacucaugcuucgcaaauagagcugcuagagacgucaagcacccaggaaccccucaacgccagugaggcauuuugcccucgugacuguaugguuccagugguauuccccgguccugugucccaggaaggcugcugucaguuuacaugcgagcugcuuaaacacaucauguaucaaagacagcagcugccauugcccuacgagcagcucaagcauuucuauaggaaaccuucuccacaagccgaagagaugcugaagaaaaagccgcgggcuacuaccgaagucagcucccgcaagugucagcaggcacuggccgagcucgaaucaguguuaagucaccuggaggacuuuuucgcuagaacacuuguucccaggguguugauucugcuagggggaaaugcccucagcccuaaagaguuuuacgaacuggaucuuucucuguuggcgccauauuccgucgaucagucacucagcaccgcagccugccugcggcgcuuauuccgagcuaucuuuauggccgacgcauucagugagcugcaagcucccccucucaugggcacugugguaauggcccagggucacagaaacuguggggaagauugguuuaggccaaaacuuaauuaccggguucccucucguggacauaagcugacagugaccuuguccugcggccgcccgagcauuagaacgacugcgugggaggacuauaucugguuccaggccccugucaccuuuaagggcuucagggaauga

SEQ ID NO: 58691 - RNA, 618 nt, Artificial Sequence
  derived and/or modified sequence opt3 from MAD2L1__Homo_sapiens__NP_002349
auggcccugcagcucagcagagagcaaggcaucacccuuaggggguccgcugaaauuguggcagaguucuuuucuuucggaauaaacucaauccuguaccagcgggguauuuaucccagugaaacauuuacucgcguccagaaguacggcuugacguuacugguuaccacagaccuagagcucaucaaauaucugaauaacgugguagaacagcuuaaggauuggcuguacaaaugcagcgugcaaaaguuggucgugguuauuuccaauaucgagucuggggaggugcucgaacgauggcaguucgacauagagugugauaaaacugccaaggacgauucggcgccucgugaaaagucacagaaagcuauccaggacgagauuagaagcgucaucaggcaaauuaccgccacagugaccuuucugccacugcucgagguaaguugcuccuucgauuuacugaucuauacugacaaggaucuuguugugccggaaaaaugggaggaaucuggaccccaguuuauaacaaacagcgaggaaguccgguugcgcuccuucaccacgacuauucacaaggucaauucaaugguggcauacaaaaucccugugaacgacuga

SEQ ID NO: 58692 - RNA, 636 nt, Artificial Sequence
  derived and/or modified sequence opt3 from MAD2L2__Homo_sapiens__XP_011538809
augaccacacugacuagacaggaccucaacuucggccaaguggucgccgauguucuuugcgaguuucuggaaguggcuguacacuugaucuuauacgugagggaggucuaucccguggggauuuuccagaagcggaaaaaguacaauguuccugugcagaugagcugucauccagaacugaaccaguauauacaagacacgcuacacugcgucaaaccgcuccuggagaagaaugauguggaaaaaguaguuguggucauccuugacaaggagcaucgccccguggagaaguuuguguucgaaauuacccagccuccacuguuguccaucucuucagauagucuccugagccacgucgagcagcugcuccgagcauuuauuuuaaaaaucuccguuugugacgccgugcuggaucauaaucccccuggaugcacauucacuguacuugugcacacccgugaagcggcuacaagaaacauggagaagauacaggucaucaaagacuuuccauggauuuuggccgaugagcaagacgugcacaugcaugaucccaggcugaucccucuaaagaccaugacuucugacauucucaaaaugcagcuguacguugaggaacgggcacacaaggguucguga

SEQ ID NO: 58693 - RNA, 1149 nt, Artificial Sequence
  derived and/or modified sequence opt3 from MADCAM1__Homo_sapiens__NP_570116
auggacuucggccuggcccuccuucuggcuggguuguuaggacugcuacucggucagagccugcaagugaagccccuucaggucgagccuccagaaccgguuguggcaguagcccugggcgcguccagacaguugaccugcaggcucgcuugugccgaucgcggggcaucugugcaguggcggggacuggacacaucacugggcgccguccaaagugauacuggucgaagcgugcucacgguucguaacgcuuccuuaucugcagccgggaccagagugugcgucggaucguguggcggcaggacauuucagcacacugugcagcugcuuguauacgcuuuccccgaccaguugaccguuagcccugccgcgcuggugccaggggaucccgaggucgcaugcacagcccauaaagugaccccuguggacccaaaugcucuaucauuuagucuccuggucggaggucaagaacuugagggcgcccaggcacuggggcccgaaguucaggaggaggaagaggaaccucagggagaugaggacguguuguuccggguaacugagcgcuggagacucccaccgcugggcacacccgugccuccagcuuuauauugucaagccaccaugaggcugcccggucucgaacuuucccaccggcaggcgaucccuguccugcauucuccaacgagccccgagccgccugauacuaccucccccgaaucaccagacacaaccaguccugagagccccgauaccacaucucaggaaccacccgacaccacguccccugagccaccggauaagacuucacccgagccugccccacaacaggggagcacacacacuccccgcaguccuggaucuacucgaacaagaaggccagaaauuucccaggcaggccccacccagggcgaggugauaccgacggggagcucgaaaccugcuggagaccaauugccagccgcucuauggaccucuuccgccguucugggucuccugcuucuggcauugcccacauaccaucucuggaagcggugccgucaccuggccgaagacgauacucacccucccgcuucauuacgccugcuaccacaggugagugcgugggcaggccucagagggaccggacaggucggcaucagcccuuccuga

SEQ ID NO: 58694 - RNA, 4746 nt, Artificial Sequence
  derived and/or modified sequence opt3 from MADD__Homo_sapiens__NP_569831
auggugcagaagaaaaaguucugccccagacugcucgacuaccuugucaucguuggcgccaggcacccuagcuccgauucuguggcucaaaccccagagcuguugcggcgcuauccguuagaagaccauacagaguuuccccugccuccagauguaguguucuuuugucagcccgaagggugccuaucaguccgacagcguagaaugagucucagggacgauacuagcuucguguuuacgcugaccgacaaagauacaggaguuacucgguacgguauuugugugaacuucuaucgcuccuuucagaagagaauaucuaaagagaagggcgaagggggagcaggcucgagggguaaggaggggacccacgccacaugcgcgucagaggaaggaggcaccgagagcagugaauccggcucuagccuucaaccucuguccgcugacucaacuccagaugucaaucagaguccccgggggaaacgccgagccaaggcaggaagcagaucuaggaacuccacauugaccucacucugugugcugagccauuacccuuucuuuaguacguuccgggagugccuguauacucucaaacguuuaguagacuguugcucugagcgccugcuugguaagaaauugggcaucccaagagggguucagagggauaccauguggcggauuuuuacaggaucccugcuaguggaagaaaagagcucggcccuccugcacgaccuucgagagaucgaggcuuggauuuaccgccuguugagaucuccgguccccguguccggccagaagaggguggauaucgaaguccucccucaagagcugcagccagcauuaacuuucgcccugcccgacccuucacgguuuacccucguugacuucccacuucaucugcccuuggagcuacuggguguggaugcuugucuccagguacugacaugcauacuucuggaacacaaaguggucuugcagagucgcgacuauaaugcccucagcauguccgugauggcguucguugcaaugaucuacccgcuggaguacauguuuccugugauucccuuacugccaaccuguauggccucugcugaacaacuacuccuggccccuacgcccuauaucauuggggucccagcaucuuucuuucuuuacaaguuggauuucaaaaugcccgacgauguguggcugguagaccucgauucaaacagaguuaucgcuccuacuaaugccgaggugcugccaauacuuccggaacccgagagucuggaguugaagaaacaccucaagcaggcgcuggccuccaugagcuuaaacacacagccuauucugaaucuagaaaaauuucaugagggacaagaaaucccacuccugcuuggcaggcccucuaacgacuugcagucaaccccuaguacugaguucaauccacugauuuauggcaacgaugucgacagcguggaugucgcaacacguguggcuaugguucgguuuuucaauuccgccaacgugcuccagggguuucagaugcacacccgaacgcugagauuauuccccaggccgguagucgcuuuucaagccggaucuuuccuggcaucgcgcccucggcagaccccauuugccgaaaaacuugcuagaacacaggcgguggaguacuucggugaguggaucuugaaucccacuaacuaugcauuccagaggauccauaauaacauguuugacccugcccucauuggcgacaagcccaagugguacgcucaccaacugcagccaauacacuaucgcguuuacgauagcaacucccagcuagccgaagcacugucagugccucccgagcgagacagugauucugaaccaaccgacgauagcggguccgacucaauggauuacgacgauagcagcuccaguuauagcucucucggagacuucgucuccgagaugaugaagugcgauaucaauggcgacacaccgaacguggauccucugacucaugccgcucuuggugacgccucagagguagaaauugacgaguugcagaaucaaaaagaagcagaggaacccgggccagauagugagaacagccaggagaaucccccucugcggucguccucuagcaccacagcgucaaguuccccaucuaccgugauccacggcgcuaacagcgaacccgccgacuccacugagauggaugacaaggcagccguuggagucucaaaaccuuuaccgagcgugccacccaguauaggcaagucuaauguggaucguagacaggcugaaauuggggagggauccgucaggcgccggaucuacgacaacccuuauuuugaaccacaguacgguuuucccccugaggaggaugaagacgagcaaggcgaaagcuauacgccgagauucucgcagcauguuucagggaauagggcccagaagcuccugcgacccaacucucuucgccuggcaagugauuccgacgcugagagcgauucucgggccagcuccccaaauucaacagugaguaacaccagcacugaaggauucggcgguaucaugucuuuugcguccucauuguacagaaaucacaguaccagcuucucccucucuaaccugacacuaccuaccaaaggggccagggagaaggcuacucccuuuccaucgcugaaaguguucggccucaauacacugauggagauuguaacggaagcaggaccuggcagcggggagggaaaccgucgcgcccuugucgaccaaaagucauccgugaucaaacauagucccaccguuaagcgggaaccaccgucuccucaggguagaagcuccaacucaucugagaaucagcaguuuuugaaggaggugguccacagcgugcuggauggccaagggguuggaugguuaaacaugaaaaaggugaggcgacuccuggaaagugagcagcuucggguauucguccuguccaaacuaaaucgcauggugcagagcgaagacgacgcuagacaggauauuauacccgacguggagaucucuaggaaggucuauaaaggcaugcucgaucuguugaagugcacuguucugucauuagaacaauccuacgcccacgcaggucucgggggcauggcgaguauuuuuggacugcuugagaucgcccagacacauuacuauagcaaggagccagacaaacggaagcgaucgcccaccgaaucugugaacacaccuguaggcaaagauccagggcuggcuggaagaggcgaccccaaggccauggcacaguugcgcgugccucagcucgguccgagggcuccauccgccacugggaaaggacccaaggagcuggauacccguagccuaaaagaagagaauuucaucgcaucaauugaacuguggaacaagcaccaagaggucaagaaacagaaggcccuugagaaacagcggccugaagugauaaagcccguuuucgaccucggcgagacggaagagaaaaagagucaaaucucugcugauuccggugugagccugaccucaaguagccagagaacagaccaggauuccgucauuggcgugucuccagcgguuaugaucaggagcuccucacaggacucugaagugaguacugucguaucgaauagcuccggggagaccuugggagccgacucugaucugucaagcaacgcaggcgacgggccuggaggcgaggguuccgugcauuuagcuaguucucgcgggacacucagcgauucagaaauugagacuaauuccgccaccaguacgaucuuuggaaaggcccacagccugaaacccucuauaaaggaaaaacuugcuggcuccccaauccgaacaucagaggacguuagccaaagaguguaccuguaugaggguuugcucggccgggauaaggggucgaugugggaccagcuggaagaugcagccauggagaccuucucuauuaguaaagaaagguccacucuaugggaccagaugcaguuuugggaggaugcguuccuggacgcugucaugcuugaacgcgagggaaugggcauggaucaagggccucaggagaugaucgaccguuaccucagccugggagaacacgauagaaagcgguuggaggacgacgaagauagguuacuggccacacuccugcauaaccuuauuucauauaugcuguugaugaaggugaauaaaaacgacauccgcaagaaaguacgaagacuaaugggcaagucccacauaggucugguguacucucagcagauuaaugagguccucgaucaacuggcaaaccuuaaugggcgggacuuaagcaucuggaguuccggaagcaggcauaugaaaaagcagaccuuuguugugcacgccggcacugauaccaacggugacauuuucuuuauggaagugugugaugacugcgucgugcugcgcucuaacaucggcacaguuuaugagagauggugguacgagaagcucauaaauaugacguacuguccgaaaaccaagguauugugccuguggaggcggaacgggucagaaacucagcucaauaaauucuauacaaagaaaugucgugagcuguacuauugcgugaaggauaguauggaacgcgcugcagcccgacagcaauccaucaaacccggaccagagcuuggcggggaauuuccuguccaggaccugaagaccggagagggcgguuugcuacaggugacacuggaggggauuaaccucaaguucaugcauaaucaauuuuuaaaacugaagaaaugguga

SEQ ID NO: 58695 - RNA, 1191 nt, Artificial Sequence
  derived and/or modified sequence opt3 from MAEA__Homo_sapiens__NP_001017405
auggccgugcaggagagcgcugcacaacuguccaugacccucaagguccaggaauaccccacacuuaaaguuccuuaugagacucugaacaagagauucagggccgcgcagaaaaauaucgaccgggaaacgucucacgugaccaugguaguggcugaguuggaaaagacauuaucaggcugcccagccgucgauagugugguuagccugcuagacgggguggucgagaaacucuccgugcugaagcgcaaggcaguagagucuauucaggccgaagaugagucggcuaaacuuuguaagcgacguauagaacaucugaaagagcacucaagcgaccaaccggcagccgcuaguguuuggaagagaaaaaggauggaucggaugaugguggagcauuugcuccgcugcggauacuauaacacugccgucaagcuggcgagacaguccgguaucgaagaccuggugaauauugagauguuucucaccgcaaaggaaguggaggaaucuuuagagaggcgggagacagccaccugucuggcuuggugccacgauaacaaaagccgccuucgaaagaugaaauccuguuuggaguucucacugagaauccaggaauuuauugaacuaaucaggcagaauaagcggcucgacgccguccgucaugcacgcaaacacuucagucaagcugagggcagccagcuggaugaaguuagacaggccauggggaugcuugcguuucccccugacacucacauaucuccauacaaggaucuguuggaccccgccagguggcggaugcucauccagcaauuccgauaugauaacuaccgccugcaucaguuaggaaauaacuccguguuuacacugacccuccaggcaggccuuucagcuauuaaaacgccucaaugcuauaaggaggacgguagcaguaagucuccagacugucccguaugcuccagaagccugaauaaauuggcccagccucuaccaauggcucacugugccaacucgaggcuggugugcaagaucucuggggaugucaugaaugagaacaauccgcccaugaugcucccuaacggauacguguacggcuauaauucccugcuuucaauucggcaggacgauaaaguuguguguccacgcacuaaggaagucuuccauuuuagucaggcagagaaaguguacaucauguga

SEQ ID NO: 58696 - RNA, 1212 nt, Artificial Sequence
  derived and/or modified sequence opt3 from MAEL__Homo_sapiens__NP_001273306
augcccaacagaaaggccagcaggaaugcuuacuauuucuuugugcaggagaaaaucccugaacugcggcgccgaggccucccagucgcacguguugccgacgcgauuccguacugcuccucugauugggcuaagcccguguucaccccucuuagaaggccagggaugcugguacccaaacaaaacgugucaccuccagacaugagugccuugagcuuaaagggagaucaggcacugcuagguggcauauuuuauuuccucaauaucuuuucccacggggagcugcccccucauugugaacagcgguuccuuccaugcgagauuggaugugucaaauacucucugcaggaaggcaucauggccgacuuucacucguucauuaacccgggugagaucccccgcggguuuagauuccauugccaagcugcaucagauagcagucacaagauaccuaucuccaauuuugagaggggacauaaccaggccacaguguugcagaaucucuaucgguucauucacccaaaccccggcaauuggccuccaaucuacuguaagucugacgaucgcacucgaguuaacuggugccugaaacacauggcuaaggccagcgaaauuagacaggaccugcaacucuuaacgguggaggaucuggucgugggcaucuaucagcagaaauuucuuaaggaacccuccaaaaccuggauaaggucauugcuggacguagcgaugugggauuacaguagcaauacacgguguaaguggcaugaggagaacgacauucuauucugcgcacucgccguuuguaagaaaaucgcuuacugcauuucuaauucccuggccacucuuuucgggauccagcugaccgaagcacacgugccguugcaagauuaugaggcuucaaacagcgucacaccuaagaugguggugcucgacgccggacguuaccagaaacugcgcgucgguaguucuggcuuuucccauuucaauagcucgaacgaggaacagagaucuaacacccccaucggggacuauccauccagggcgaagauuucaggacaaaauaguagcguucggggccgagguauaacucgcuuacuggaauccaucucuaacagcucaaguaauauucacaaauuuuccaacugugauacaagccucucuccuuacaugucacagaaggacggguauaaaaguuucagcucccuuucuuga

SEQ ID NO: 58697 - RNA, 771 nt, Artificial Sequence
  derived and/or modified sequence opt3 from MAF1__Homo_sapiens__NP_115648
augaagcugcucgagaacagcuccuucgaagccaucaauucucagcuuaccguggagacaggcgacgcucacauuauagggagaaucgaaucauacaguugcaaaauggcaggagaugacaagcauauguuuaaacaauucugucaggagggucagccccacguccuggaagccuugagcccuccacagacuuccggcuuaucuccgucgaggcugucaaagagccaagggggagaggaggaaggcccccuaagugauaaaugcucccggaagacgcucuuuuaucugauugcgacccuuaacgagucuuuccgcccugacuacgauuuuagcacagcucgaucccaugaauuuucacgugagccaagucugagcuggguugugaaugccguaaacuguucuuuguuuuccgcagugagagaggacuucaaggaucucaaaccccagcuguggaaugccgucgacgaagagaucugccuggcugaaugugauauuuauucauacaacccugaccucgauagcgacccauuuggugaggaugggaguuuauggucuuucaauuauuucuucuacaacaagaggcugaaacggaucguguuuuucuccugccgcagcauaucgggaucuacuuauacccccuccgaagcaggcaaugagcuugacauggaguugggcgaagaggaaguugaggaagagucaagaagugggggaagcggugccgaggaaacauccaccauggaggaagacagggugccugucaucuguauuuga

SEQ ID NO: 58698 - RNA, 1062 nt, Artificial Sequence
  derived and/or modified sequence opt3 from MAFA__Homo_sapiens__NP_963883
auggccgcugagcuggcaaugggcgccgaacuccccagcuccccucuugcgaucgaguacgugaacgacuucgaucugaugaaguuugaagucaaaaaggagccaccggaagcugagagauucugccacagguugcccccugggucuuuaucaaguaccccacugagcacacccuguuccucuguuccuucgucacccagcuuuugcgccccaaguccuggaacugguggcgggggaggcgccggugggggaggcggcuccucucaggcagggggagcuccagguccgcccagcggcgggccuggagcagugggcgguacguccgggaaaccagcccuagaggaccucuauuggaugucaggauaccaacaucaccugaaucccgaagcucuuaaccugaccccugaggaugccguagaagcguugauuggcaguggccaucacggggcacaucacggagcccaccauccagcugccgcagcugccuaugaggcguuccggggucccggcuuugccgggggaggcggugcagacgauaugggggcuggccaccaucacggagcccaccaugcugcccaccaucaccaugcagcccaccaccaucaccaucaccaccaucaccauggcggggcuggacacgguggcggggcgggacaucacgugcgccucgaggaacgauucagcgacgaucagcuggucucuauguccgugcgugagcugaauagacagcucaggggcuuuucaaaggaagagguuauacgguuaaaacagaagcgcagaacacugaagaacagggguuacgcacaaagcugucgguucaaacgcgugcagcagcgacacauccuugaaagugagaagugccaguugcaaucucaggucgagcagcugaaacuagaaguggggagacucgccaaggagagggaccuguauaaagaaaaguacgagaaacuugcuggccggggaggcccgggguccgccggaggugcaggcuuuccucgugaacccagcccaccucaggccgggcccggaggcgcuaaggguacugccgauuucuuucuguga

SEQ ID NO: 58699 - RNA, 972 nt, Artificial Sequence
  derived and/or modified sequence opt3 from MAFB__Homo_sapiens__NP_005452
auggccgcugagcugagcaugggccccgaacucccuaccuccccacuugcaauggaguacgugaacgacuucgaucuguugaaguuugacgucaaaaaggaaccguuagggagagccgagaggcccggacggccuugcacacgccugcagccagcggguucuguuucaaguacuccccuaagcacgccuuguuccucugugccaucgucacccagcuucaguccuaccgaacaaaagacacaccucgaggaucuguauuggauggcuuccaauuaccagcagaugaacccagaggcccuuaaucugacuccggaagacgcaguagaggccuugaucggcucucaucccgugccucagccacuccagagcuuugauuccuuccgaggggcucaccaucaccaucaccaccaucacccccauccucaccacgcauauccaggagccggcgucgcucaugacgaacuggguccccacgcccauccgcaccaucaccaccaucaccaagcgucaccucccccaaguagcgcagccucuccugcucagcagcugcccaccucccauccagggcccggaccucacgccacagcaucagcuaccgccgcgggcggcaacgggagcguggaggaucguuuuagugacgaucaacucguuucuauguccgugagagaguuaaauaggcaucugcggggauucacuaaggacgaagucauucgccuuaaacagaagagaaggacauugaagaaccgggguuacgcccagagcugccgcuauaaacgagugcagcaaaagcaccaccuggagaaugagaaaacccagcuaauacagcaaguagaacagcucaagcaggaaguuucgagacuggcaagggagcgggaugcuuacaaagugaagugugagaaacuugccaacucuggcuuucgugaagcuggguccacgucagacaguccaagcuccccggaguucuuucuguga

SEQ ID NO: 58700 - RNA, 495 nt, Artificial Sequence
  derived and/or modified sequence opt3 from MAFF__Homo_sapiens__NP_001155045
augagcguggacccccuguccucuaaggcccucaaaaucaagagagaacuuucagaaaacaccccucaccugagugaugaggcuuugaugggcuuaagcgucagggaacugaaucggcaucuacgcgggcucuccgcagaggaaguuacacgacugaaacagcguagaaggacucuuaagaaccggggauacgccgcgucuugccgcgugaaaagaguaugucaaaaggaggagcugcagaagcagaaaucggaauuggagagggaaguggacaagcucgcucgggagaaugccgcaaugcgccuggagcuggaugcccuccgagguaaaugcgaggcuuuacagggcuucgcaagaucagucgccgcugccagggggccagcgacgcugguggcaccggccagcguuauuaccauagugaagaguacacccggauccggcucugguccugcucacgggccagaccccgcccauggaccugcaagcuguuccuga

SEQ ID NO: 58701 - RNA, 489 nt, Artificial Sequence
  derived and/or modified sequence opt3 from MAFG__Homo_sapiens__XP_011521881
augaccacacccaacaagggcaauaaagcccugaaggugaaaagagagccuggggaaaacggaacuagccucacggacgaggaacuugucaccauguccguuagggagcugaaucagcacuugcgggguuuaucuaaggaagagaucgugcaacugaaacagcgccgacguacacuaaagaacagaggcuacgcugcaucaugcaggguaaagcgggugacucagaaagaggaacucgagaagcagaaagccgaacugcaacaggaggucgagaaacuugcgagugaaaaugcuagcaugaagcuggaguuggaugcccuccgcuccaaguaugaagcacugcagaccuucgccagaacaguggcuaggucuccaguugcaccggcccgggggccccuggcugccggacucggcccuuuagugccagguaaggucgcggcaaccucggugauuacuauaguaaaaucaaagacagacgcccgcagcuga

SEQ ID NO: 58702 - RNA, 1122 nt, Artificial Sequence
  derived and/or modified sequence opt3 from MAF__Homo_sapiens__NP_001026974
auggccagcgagcuggcuauguccaacucugaccuccccaccucaccucuugcaauggaauacgugaaugauuucgaccugaugaaguuugaggucaaaaaggaaccaguugagacagauagaaucauuagucagugcggcagguugauagccgggggaagccuuuccucuacuccgaugucgacgcccuguucaagcgugccuccaagucccuccuucucugcgccuagcccagguuccggcucagaacaaaaagcucaccuggaggacuauuacuggaugaccggguauccccagcagcuaaacccugaggcccucggauuuaguccagaagaugcaguagaggcccugaucagcaauucucaucagcuucaaggcgguuucgacggguacgcucggggagcacagcagcuggccgcugccgcgggcgcaggcgccggggcuuccuugggagguucaggcgaagagauggggccggccgcagcuguggucagcgccgugauugcggccgcagcugcccagaguggagcuggcccccacuaucaucaccaucaccaccaugccgcaggucaccaucaccacccuacagccggggcuccaggagcggcaggcucugccgcugccuccgcaggcggggccggaggugcuggcgggggaggccccgccagcgcgggugggggcggaggcgggggagguggcgggggaggcgguggggcagcuggcgccggaggcgcacuccauccucaccaugccgcugggggacugcacuuugaugaccgcuucucggaugagcaacugguuacuaugucugugcgagaacucaaccgucaguuaagaggugucuccaaggaggaagugaucaggcugaaacagaagcggcgcacccuuaagaauagaggcuacgcccagucaugcagguuuaaacggguacaacagcgccauguuuuggagagugaaaagaaccagcugcuacaacagguggaccaccucaaacaggagauuagccgacuggucagagagagggaugcauauaaggaaaaauacgagaaguuaguguccucuggguuccgggaaaauggaagcucaagugacaacccauccagccccgaguuuuucauguga

SEQ ID NO: 58703 - RNA, 471 nt, Artificial Sequence
  derived and/or modified sequence opt3 from MAFK__Homo_sapiens__XP_006715836
augaccacaaaccccaagccuaauaaagcccugaaggugaaaaaggaggcuggcgaaaacgcaccaguccucagcgacgaugagcuuguuuccaugucugugagagaacugaaucagcacuugaggggguuaacuaaagaggaaguaacgcggcugaagcaacgccgacguacccuaaagaacagaggauacgccgcgucaugcaggaucaaacgggugacacagaaggaggagcucgaacgccagagagucgagcugcagcaagaaguggagaaacuugcuagggagaauaguagcaugcggcuggaauuggacgcccuccgcuccaaguaugaggcacugcagacuuucgcccgaaccguugcuagagguccgguggcacccucuaaagucgccacaaccucggugauuacuauaguaaagucaacagaacugagcaguaccuccguuccuuuuucugcugccagcuga

SEQ ID NO: 58704 - RNA, 1110 nt, Artificial Sequence
  derived and/or modified sequence opt3 from MAGEA10__Homo_sapiens__NP_001011543
augcccagagccccuaagaggcagcggugcaugccagaggaagaccugcaaagccaguccgagacccagggccucgaaggggcucaggcaccgcuugccguggaggaagaugcgucuucaaguacaagcacuuccucuucguuccccagcagcuuuccuaguuccucuagcuccucaaguagcucuuguuacccacugauccccuccacgccugaggaggucucagcugacgaugaaaccccaaaucccccucaaagcgcccagauugcaugcaguucuccauccguuguggccagcuugccguuagaccagucggaugagggaucuuccucacagaaagaagagagucccagcacacugcaaguacuaccugacuccgagucucucccacgcagcgaaauagaugagaaggugacugaccugguccaguuccuucuguuuaaauaucagaugaaggaacccaucaccaaagcugagauuuuggaaucagugauccgaaacuacgaggaucacuucccucuccuguuuagugaggcauccgaauguaugcugcucguuuucgguauugacgugaaggaggucgauccaacaggccauagcuuuguguuaguaaccucucuggggcuuacuuaugacggaauguugucagauguucagaguaugcccaagacaggcauccugauacuaauccucagcauuaucuucauugaagguuacugcaccccggaggaagugaucugggaggcccugaacaugauggggcuuuaugacggaauggagcaccugauauacggcgaaccucguaaauugcucacgcaagacuggguccaggagaauuaucuggaauacagacaggugcccggcuccgauccagcuagguacgaguuuuuaugggggccucgggcccaugcggaaauucgcaagaugucucugcucaaauuccuugcaaaggugaacggaucggaccccagaucauuuccacugugguaugaggaggccuugaaagaugaagaggaaagggcucaagaccggaucgccacuaccgaugacacaacugcaauggcuuccgccucaaguucugcgaccgguagcuucuccuaccccgaguga

SEQ ID NO: 58705 - RNA, 1203 nt, Artificial Sequence
  derived and/or modified sequence opt3 from MAGEA11__Homo_sapiens__NP_001011544
augagcaagguguccaccauguucucugaggacgauuuucagucaacagaaagagcccccuacggcccucaacugcaguggagucaggaccucccaaggguccagguuuuccgggagcaagcuaaccuugaagaucgcagcccgcgacguacucagagaaucaccgggggagaacaggugcuguggggucccauuacgcagauauuuccuacaguaaggccagcagacuugacucgggugaucaugcccuuagaacaacgcucccagcacugcaaaccugaggagggccugcaggcccaggaagaggaucuagggcucgucggagcgcaagcucugcaggccgaggagcaggaggcagccuucuuuucuucgacccuuaaugugggcacacuggaagaguugccagcugcagaaucacccagcccuccacaaaguccgcaggaggaauccuucucucccaccgccauggacgcuauuuuugguagccucuccgaugaggggucaggaagucaggagaaggaaggcccuagcacuucuccagaccugaucgaucccgaguccuucucacaggacauucugcaugauaaaaucauagaccucguucacuuacugcuuagaaaguauagggugaaaggcuugaucacaaaggccgaaaugcuggggagcgucauuaagaacuacgaggauuauuuuccugaaaucuuccgggaggcgaguguguguaugcaacuacucuuuggaauugacguaaaagagguugacccaaccucucauuccuacgugcuggucacgagccuuaaucugucguaugaugguauccagugcaacgaacagucuaugcccaaguccggcuugcucauaauugugcugggggugaucuucauggagggaaauuguauuccggaagaggucaugugggaaguuuuaucaaucaugggcguguacgcaggucgcgagcacuuucuguucggggagccuaaacgacuccuuacucagaacuggguacaagaaaaguaucugguguacagacagguccccggaaccgacccagccugcuacgaguucuuguggggcccuagggcucaugccgaaacaaguaaaaugaaggugcuagaguauaucgcaaaugcuaacggccgggaucccacuagcuacccaucccuguaugaggacgcccuccgugaagagggggaaggaguuuga

SEQ ID NO: 58706 - RNA, 945 nt, Artificial Sequence
  derived and/or modified sequence opt3 from MAGEA12__Homo_sapiens__NP_001159858
augccccuggagcagagaagccaacacugcaagccugaagagggccucgaagcccagggggaggcucuuggacuggugggugcacaggccccagcgaccgaagaacaggagacagcuuccucuucaaguacuuuggucgaaguuacguuaagggaggugccggccgcagaaagccccuccccuccacauucuccccaaggcgccucgacccugccuacaacuaucaacuacacccuauggucacagagcgacgaggggaguuccaaugaggaacaggagggaccaucuacauuccccgaucucgaaaccagcuuucagguagcucugucccggaaaauggcagagcuugugcacuuccuguugcucaaguaccgcgcccgagaaccuuuuacuaaagcugagaugcugggcucagucauucguaacuuccaagacuuuuucccagugauauuuaguaaggccagcgaguaccugcagcucguuuucgguaucgaaguggucgaggugguaagaauugggcauuuauauauccugguuacaugucuuggauugucuuacgauggccugcuaggcgacaaucagauugugccgaaaaccgggcuccugaucauaguccuugcgaucauugcaaaggaaggagauugcgcccccgaggaaaagaucugggaggagcuguccguguuggaggcuucagacgguagggaggauagcguguuugcccacccucggaaacuccugacgcaggacuuaguccaagaaaacuaucuggaguaccgccagguuccaggcagugaucccgcauguuaugaguuccucugggggccuagagcucuuguggaaacuucuuacguaaaggugcugcaucacuugcuaaaaauuuccggaggcccacacaucagcuaucccccgcugcaugagugggccuuuagggaaggugaggaauga

SEQ ID NO: 58707 - RNA, 930 nt, Artificial Sequence
  derived and/or modified sequence opt3 from MAGEA1__Homo_sapiens__NP_004979
augagccuggagcagagaucccuccacugcaagcccgaagaggcccuugaagcucaacaggaggcacugggcuugguguguguccaggccgcgaccucuucaaguagcccuuuaguucuggggacacuagaagaggugccaacugcuggauccacggacccgccccagucuccucaaggugccucggcauucccaaccacaaucaacuuuacuaggcagcggcagcccucagagggcagcaguucccgcgaagaggaagggccuucuaccagcugcauucucgagucccuguuccgagccguaauaaccaaaaagguggcugaucuugucggauuucuguugcucaaauaccgugcaagagagccagugacaaaggccgaaaugcuggagucaguuaucaaaaauuauaagcauuguuuccccgaaauuuuuggcaaggcuagugagagccugcagcucguguucgguaucgacgucaaagaagccgauccuacugggcacucuuacguguuaguaacaugccugggacuuuccuaugacggcuugcugggcgauaaccaaauuaugccaaagaccggguuucuaaucauaguucucgugaugaucgcgauggagggaggucaugcaccggaggaagagauuugggaagaacugucagucauggaaguguacgacggcagggagcacagcgccuauggggagccccggaaacuucugacgcaggauuuggugcaggaaaaguaccucgaguaucgccaggucccugacagugauccagcuagauacgaguuccuguggggacccagggccuuagcagagacuucuuacguuaaagugcuggaauauguaaucaagguguccgcucggguccgcuuuuucuuuccuagccuccgagaggccgcgcuuagagaggaagaggaaggcguguga

SEQ ID NO: 58708 - RNA, 945 nt, Artificial Sequence
  derived and/or modified sequence opt3 from MAGEA2B__Homo_sapiens__NP_705692
augccccuggagcagagaagccaacacugcaagccugaagagggccucgaagccaggggagaggcucuugggcuggugggugcacaggccccagcgaccgaggaacagcagacagcuuccucuucaaguacuuuggucgagguuacguuaggcgaagugccggccgcagacagccccuccccuccacauucuccccaaggggccucgucauucagcaccacaaucaacuacacucuguggcggcagagugaugagggauccucuaaucaggaagaggagggcccucgcauguuuccagaccuagaaagcgaguuccaggcugcaauuucccgaaaaaugguagaacucgugcacuuucugcuucugaaguaccgugccagagagcccgucaccaaagcugaaauguuggagucagugcucaggaacugucaagauuucuuuccuguuauauucaguaaggccagcgaguaccugcagcugguguuugguaucgaagucguggagguaguuccaauuucucaucucuauaucuuagugacaugccuggggcuuuccuacgacggauugcugggcgauaaucaggucaugccgaaaaccggccuacucauuaucgugcuggcgauaaucgcaauugaaggggacugugcccccgaggaaaagaucugggaggagcuuucaaugcuggaaguguucgagggacgggaagauagcgucuuugcucacccucgcaaguugcucaugcaggaccugguucaagagaacuauuuagaauacagacaggugccagguagugaucccgccugcuaugaguuccuguggggcccuagggcacucauugagacuucuuacguaaaagugcuucaucacacacugaagaucgggggagaaccacacauauccuaucccccguugcaugagcgggcucuacgcgaaggcgaggaguga

SEQ ID NO: 58709 - RNA, 945 nt, Artificial Sequence
  derived and/or modified sequence opt3 from MAGEA3__Homo_sapiens__NP_005353
augccccuggagcagagaagccagcacugcaagccugaagagggccucgaagccaggggagaggcucuugggcuggugggugcacaggccccagcgaccgaggaacaggaggcugccuccucuucaaguacauuggucgaaguuacuuuaggcgaggugccggcagccgaaagccccgacccuccacagagcccccaaggggcuucuucgcugccuacgaccaugaacuacccacuauggucacagagcuaugaggauaguuccaaucaggaggaagagggacccucuacauucccugaccucgaaagcgaguuucaggcagcccugucccggaaaguagcugaacuugugcauuuccuguugcucaaguaccgcgcccgagagccagucacuaaagcggagaugcugggcucagugguugguaacuggcaauacuuuuucccggugaucuuuaguaaggcauccucuucccugcagcucgucuucgggauugaauuaauggagguggaucccauaggacaccuguauaucuuugccaccugucuuggcuugucauaugacggccugcuaggggauaaucagauuaugccuaaagcuggacuccugaucauuguacuugccaucauagcacgugaaggugacugcgcuccagaggaaaagaucugggaggagcugagcguuuuggaaguguucgagggcagagaagauaguauucucggggaccccaagaaacuguuaacacagcauuuuguccaagagaacuaccuggaauauaggcaagugccuggaucugauccagccuguuacgaguuccucuggggcccccgggcgcuuguggagaccuccuacgucaagguucugcaccauauggugaaaaucagcggugggccgcacauuucguauccucccuugcacgaauggguacuacgcgagggagaagaguga

SEQ ID NO: 58710 - RNA, 954 nt, Artificial Sequence
  derived and/or modified sequence opt3 from MAGEA4__Homo_sapiens__NP_001011549
augagcuccgagcagaagucucaacacugcaaacccgaagagggcguggaagcccaggaggaagcucuggggcucgucggagcacaggccccuaccacagaggagcaggaagcggcuguuucaaguagcuccccacuugugccggguacucuggaggaaguacccgccgcagagucugccggcccuccacaaucgccccagggggcuucagcauugccuacgaccaucagcuucacauguuggagacagccaaacgagggaaguuccucucaggaagaggaaggccccagcacuuccccugacgccgagucauuauuuagggaagcucugaguaauaagguggaugagcuagcccauuuccuccugcggaaauaccgcgcgaaggagcuugucaccaaagcagaaaugcuggagcgagugauuaagaacuauaagcguugcuuuccaguuauauucgguaaagccagcgaaucuuugaagaugaucuuugggauugacgugaaagaggucgauccggcuuccaauacauacacccucgugacuugucugggacugucauaugacggccucuuaggcaacaaucaaaucuuccccaagacagggcugcuuauuaucguauugggaaccauagccauggaaggugauagcgcaagugaggaggaaaucugggaggaacugggcguuauggggguguacgacggaagagagcacacggucuauggcgaaccuaggaaacuacucacucaggauugggugcaggagaacuaccuggaguaucgccaggugccagguucuaaucccgcucgguacgaauuucuuugggggccuagagcccuggcggagaccuccuacgucaagguuuuggaacaugugguaagggugaacgcccggguccgcauugcauauccaagccuccgagaggcugcccuguuagaggaagaggaaggaguguga

SEQ ID NO: 58711 - RNA, 945 nt, Artificial Sequence
  derived and/or modified sequence opt3 from MAGEA6__Homo_sapiens__NP_005354
augccccuggagcagagaagccaacacugcaagccugaagagggccucgaagccaggggagaggcucuugggcuggugggugcacaggccccagcgaccgaagaacaggaggcugccuccucuucaaguacauuggucgaaguuacuuuaggcgaggugccggcagccgaaagccccgacccuccacagucuccccaaggggcuuccucgcugccuacgaccaugaacuacccacuauggucacagagcuaugaggauaguuccaaucaggaggaagagggacccucuacauucccugaccucgaaagcgaguuucaggcagcccugucccggaaaguagcuaaacuugugcauuuccuguugcucaaguaccgcgcccgagaaccagucacuaaggcggagaugcugggcucagugguugguaacuggcaauauuucuucccggugaucuuuaguaaagcaagcgauucucugcagcucgucuucgggauugaguuaauggaaguggaccccauaggacacguauacaucuuugccaccugucugggccuuuccuaugauggcuugcugggggacaaucagauuaugccuaagacaggauuccuaaucauuauccucgcuauaaucgccaaggagggugauugcgcaccagaagagaaaauuugggaggagcugucaguucuugagguguuugaaggccgugaggacagcaucuucggggaucccaagaaacuguugacccaguacuuuguccaagaaaacuaucucgaguacagacaggugccuggaagugacccagcuuguuacgaauuucuguggggccccagggccuuaauugagacuucuuaugugaagguccugcaucacaugguuaaaaucuccggugggccgcggauaagcuacccucuccuucaugagugggcgcugcgcgaaggagaggaauga

SEQ ID NO: 58712 - RNA, 948 nt, Artificial Sequence
  derived and/or modified sequence opt3 from MAGEA9__Homo_sapiens__NP_005356
augagccuggagcagagaucuccccacugcaagccugacgaagaucucgaggcccaaggcgaagaccuugggcugaugggagcucaggagccaaccggugaagaggaggaaacaacuuccucaagugauagcaaagaggaagagguguccgcagccgggucuucgucaccgccccagagcccucagggcggagcgaguuccucuaucagcgucuacuauacguuguggucccaauucgacgagggcucaaguagccaggaagaggaggaaccaucuuccucaguugaucccgcucaguuagaauuuauguuccaggaggcccugaagcuaaaaguggcagagcucguacauuuucugcuucacaaguacagggugaaagaaccugucaccaaggccgagaugcuggaaagcgugauuaagaacuauaaacgguacuucccaguuauauuugguaaggcuagugaguucaugcaagugaucuuugggacagacgucaaagaaguggaucccgcaggacauucuuauauuuugguaacugcccucggccuguccugugacagcaugcugggcgaugggcacucgaugccuaaggcugcccucuuaaucauuguucugggagugauccuuaccaaagacaauugcgcgccagaggaggucauaugggaagcauugucugugauggguguguacgucggcaaggagcauauguucuauggggaaccgcgcaagcugcuaacacaggauuggguucaggagaacuaccucgaauaccgacaggugcccggauccgacccugcccacuaugaguuucuguggggcucaaaagcucacgccgagaccaguuacgaaaagguaaucaauuaucuugugaugcugaacgcacgugagccaauuuguuaccccagcuuguaugaagagguccucggugaggaacaagaggggguguga

SEQ ID NO: 58713 - RNA, 1011 nt, Artificial Sequence
  derived and/or modified sequence opt3 from MAGEB17__Homo_sapiens__NP_001264236
augcccagaggccaggccagcaagaggcgggcucgcgagaaacgacgucaagcaagaggggaagaccagugccugggaggugcccaggcgaccgcugccgagaaggaaaaacucccuuccucuucaaguccagcaugucagagcccgccccaauccuucccuaacgccggcaucccacaggagucucagagggcuucguaccccucaagcccugcaagugccgugucccuuacaucuagcgaugaaggggcuaagggacagaaaggcgaguccccaaauucauuucacggucccaguagcucugaguccacugggcgggaccuguugaacacgaagaccggagaauuaguccaauuccugcuaaauaaguauauucgcaaagagccuauaacaagagaagccaugcucaagguuaucaacaggaaauacaagcagcauuuuccagagauucugcggcgcucaacugagaauguggaaguaguguucggccuuuaucugaaagagauggauccgagccgacagaguuacgucuuggugggcaagcucgacuuucccaaccaggggucucuguccgauggagguggcuucccucugagcgggcucuuaaugguucugcuuucgaccaucuuuaugcacggaaauagagcgacagaagaggaaaugugggagugcuugaacgcacugggcauguauaaggguaggaaacauuucauuuacggggagccacaagagcuagugaccaaggaccucguccgggaaggauaucuggaauaccaacaggugcccucuuccgauccuccacguuacgaguuucuuuggggcccccgcgccagagcugaaacuucaaaaaugaagguacuggaguucguugccaaauugaaugacacaguggcaaguaccuauaagagcagguacgaggaagcucuccgggaggaagaggaacaggcccgagcgcgcgccgucgcaagagauuccgcuagggcccgggcuucucgcagcuuucagccguga

SEQ ID NO: 58714 - RNA, 1044 nt, Artificial Sequence
  derived and/or modified sequence opt3 from MAGEB1__Homo_sapiens__NP_803134
augcccagaggccaaaagagcaaacugagggcccgggagaagcgccgaaaagcucgugaagagacccaggggcucaagguggcacacgccacagcggcugaaaaagaggaaugcccuuccucuucaccaguccuuggagacacuccgacgaguagccccgccgcagguaucccucagaagccacagggcgcucccccuaccacaacugccgcagccgcuguuuccuguaccgagucugaugagggggccaagugccagggagaagagaacgcgucguucucacaagcaacaaccagcacugaaaguuccgugaaagacccaguagccugggaggcuggcaugcugaugcauuuuauuuugagaaaguacaaaaugagggagcccauaaugaaggccgauauguuaaaaguggucgacgaaaaguauaaggaucacuucacagagauccugaauggugcaucucggcgccuagaacucguguuugggcuggaccuuaaagaggauaacccuagcggacauaccuacacgcugguuuccaaguugaaucucacuaacgacggcaaucugucaaacgauugggacuucccaagaaauggccugcucaugccguuacugggggugauuuuucuuaaaggaaacagugcuaccgaagaggagaucuggaaguucaugaaugucuugggugccuaugauggcgaggaacaccugauuuacggggaacccaggaaauuuaucacacaggaccuagugcaggagaaguaucucaaauacgaacagguaccuaacagcgauccaccccgguaucaauuccuguggggaccucgcgcguacgccgagacuaccaagaugaagguucuugaguuucuggcaaaaaugaauggcgcuacaccacgagacuuccccucucauuacgaagaggccuugagagacgaagaggaaagggcucaggugcgguccucaguccgugcccgcagaaggaccacggcaacuacauuucgggcccgaagccgcgcuccguucaguagaucuucccacccuauguga

SEQ ID NO: 58715 - RNA, 960 nt, Artificial Sequence
  derived and/or modified sequence opt3 from MAGEB2__Homo_sapiens__NP_002355
augcccagaggccagaaaagcaaacugagggcccgggagaagcgccgaaaagcucgugacgaaaccagagggcucaacgugccucaagucacagaggcagaagaggaagaggccccaugcuguuccucuucaguuaguggaggugcggcuagcuccucuccggccgcaggcaucccccaggagccucagagggccccaacuacggcugcagccgcugccgcgggggugucgucaaccaagagcaaaaagggagcaaagagucaccagggcgaaaagaaugccuccucuagccaagcuaguacaucaacuaagagucccagcgaggauccucuuacccggaaaucugguucccugguacaguucuuguuauacaaguauaaaauuaagaagucagugacaaaaggggaaaugcugaagauagucggaaaacgcuuuagagagcauuucccagagauccuaaagaaagccagcgaaggccucagugugguuuuuggccuggagcuuaacaaggugaaucccaacgggcacaccuacacuuucauugacaaagucgaucugacagacgaagagucuuugcucuccagcugggauuuuccuaggcggaagcugcugaugccacucuuaggagugaucuuccugaaugguaacucggcaaccgaagaggagauuugggaauuucuuaauauguugggcguauaugacggggaggaacauucuguuuucggagagccguggaagcugaucacgaaagaucuagugcaggaaaaguaccucgaguauaaacagguccccuccucagacccuccacgcuuucaauuccuguggggcccccgagcuuacgccgagacuuccaagaugaaagugcuugaauuucuggcgaaggugaacgguaccacaccuugcgccuucccaacucacuaugaggaagcauugaaggaugaggaaaaagcuggggucuga

SEQ ID NO: 58716 - RNA, 1224 nt, Artificial Sequence
  derived and/or modified sequence opt3 from MAGEB6__Homo_sapiens__NP_775794
augcccagaggccacaagagcaaacugaggaccugcgagaagcggcaggaaacaaacgggcaaccucagggacucacugguccacaggccacggcugagaaacaggaagagucccauucuucaaguagcuccucucgcgcaugucuuggcgacugccgacguucgucagaugccagcaucccgcaagaaagucagggggugucccccaccggaucuccugacgcggucguuagcuacuccaagucagauguggcugccaauggccaggacgagaaaaguccaagcacaucuagagaugcauccguaccccaggagucacaaggugccagcccuacugggaguccagacgcuggagugucuggcuccaaguaugaugucgcagccaacggccaggacgaaaagagccccucgaccucucacgauguguccguuccucaggagucacagggggcuaguccaacaggaagcccggacgccgguguguccggcucuaaauacgaugucgcggcagaaggggaggacgaggaaagcgugucagccagucaaaaggcuauuauauucaaaaggcuguccaaggaugccgugaaaaagaaggcauguaccuuggcucaguuuuuacagaaaaaguucgagaaaaaggaaagcauccugaaagccgacaugcuaaagugcguucggcgcgaguauaaacccuacuuuccucaaauucucaauagaacuucucagcaucugguggucgcguucggaguggaacuuaaggagauggacucaaguggcgagagcuauacacugguguccaaguugggucucccaucugaagggauccugucgggagauaacgcccugcccaaaagcggccucuuaaugucccugcuugucguuauuuuuaugaauggcaacugugcaaccgaggaagaggugugggaguucuuggggcugcuaggaaucuacgacgguauacuccacucaaucuauggcgaugcuaggaagauuaucacggaagaccugguacaggauaaauacguggucuaccggcagguaugcaauagugacccuccauguuaugaguuucuuugggggccccgcgccuacgcugaaacuaccaagaugcgaguucugagaguguuggccgauucuagcaacacauccccgggacucuauccucaucuguacgaggacgcauuaauugaugaagucgagagggcccugcggcuccgugcuuga

SEQ ID NO: 58717 - RNA, 3429 nt, Artificial Sequence
  derived and/or modified sequence opt3 from MAGEC1__Homo_sapiens__NP_005453
augggcgacaaggauaugcccaccgccgggaugccuagccugcuccaguccucuucagagaguccacaaagcugcccggaaggagaggacucccagucuccccuucagaucccucagucgucaccagaaagcgaugacacacuguaccccuugcaaaguccucaguccagaucugagggugaagauagcuccgacccauuacagaggcccccugagggcaaagauucacagaguccacugcaaauuccgcagagcucucccgagggggacgauacucaguccccucuacagaacucacaaagcaguccagaaggaaaggacucucucuccccucuggagauaagccagucgcccccagaaggcgaggaugugcagucuccccuucaaaauccggcuuccucauucuuuaguagcgcacuguuguccaucuuccagucuagcccugagucaacgcagagucccuuugaagguuucccacaguccguccuccaaauuccuguuagcgccgcgucuucaaguacccuggugagcaucuuucaguccucucccgagucgacacagagcccauucgaaggguuuccccaguccccucugcaaauuccaguaucacggaguuucucuagcacucucuuauccaucuuucagucaagcccggagcgcacccagucuacauucgaaggauuugcucaguccccucugcaaauacccgugaguccauccucuuccucaacccuuuugagucuguuccagagcuuuucggagcgaacucaguccacauucgagggcuucgcccagucuagccuacaaauccccgucucaccuaguuuuuccucuacccucgugagccuguuccaguccucaccagaacguacgcagagcacuuuugagggcuucccccaaaguccgcuucagauuccuguuucuuccagcucgucaucuacccuguugagucucuuucaguccagcccagaaagaacacacucuacuuucgagggguuuccccagagccuguuacaaaucccuaugaccuccucauucaguagcacacugcucucuauuuuucaguccucacccgaaagugcacagagcaccuucgagggauuuccacaguccccucuucaaauccccgguucuccaucguucagcucaacgcuguugucccuauuucagaguucuccggagaggacucauagcacauucgaaggcuucccucaguccccacugcagauacccaugaccucaucuuuuagcaguacucuccuguccauucuucaaagcucucccgagucagcccaguccgcuuucgaaggguuuccucagaguccacugcaaauccccgugagcucgucuuucuccuauacauugcucagccuguuucagucaaguccugagcggacccacucuacguucgaaggauuuccgcaguccccauuacagauucccgucagcucaaguagcuccucuagcacccugcuaucccucuuccaaucaucuccugaguguacacagaguacuuuugagggcuucccacagucgccccugcagaucccucaaagcccgcccgaaggugagaacacccauuccccacuucagaucgugccuucuuugcccgaaugggaggacucacugagcccacacuacuuuccucaguccccaccccagggggaggauagucucucuccgcauuauuucccucaaucacccccacagggagaagacagccugagcccccacuacuuuccucagaguccacagggcgaggacagccuuucuccccacuauuucccucaauccccgccacagggcgaagauucaaugagcccccuguacuucccucagucgcccuugcaaggggaggaauuucagucuagucuccaguccccaguaagcauuugcucauccucuacaccuagcagucugccccaguccuucccagagagcucucaaucaccuccggagggacccguucagaguccauuacauuccccucagucucccccagaagguaugcacagccagucgccucugcaaucacccgagagcgcaccggaaggcgaggacucccuaaguccacuccagauaccucagucuccccuggaaggggaggauagccuuuccucauugcauuuuccacagagucccccugagugggaagacucucugagcccgcuccacuucccccaauuuccaccucagggagaggauuuccaguccucacugcaaagccccgugucuaucuguuccaguagcacuucguuaucccugccucagucuuuuccagaaucaccccagagcccuccagagggccccgcccagaguccgcuucaacgcccugucuccucuuucuuuagcuauaccuuggcuucacuccugcaguccagucacgaaagcccacagucucccccugaggguccagcccagucaccccuacaauccccggugagcucuuucccuaguucgacauccagcucacugucucagagcucccccgugaguucauuuccaucuagcaccuccaguagccucuccaaaucuucaccugagagcccccugcagucgccagucauuuccuucaguucuagcacuucacuuucccccuucucugaagagaguagcuccccuguugacgaauacacgucaagcucugauacauugcuggagagugacuccuuaaccgauagcgagucacucaucgaaucugagccacuguuuacuuacacccuugacgaaaagguggaugagcuggcgagauucuugcuccugaaauaucagguaaagcaaccgauaacaaaggcagaaaugcuaaccaaugugauuuccagguacacuggguauuuucccgucaucuuccggaaagcccgcgaguuuaucgagauucuguucggcaucucgcuccgagaaguggacccugacgauagcuacguuuuugugaacacacuggaccuuacgagugagggaugcuugucugaugaacagggcaugucccagaauagacuguuaauucucauacugagcaucauuuucaucaaggggaccuaugcuucagaggaagucaucugggacgugcuuaguggaauugguguaagggccggccgggagcauuuugcauucggggagccacgugaacugcuaacuaaaguuugggugcaggagcacuaccucgaauaucgcgagguccccaacuccagcccuccaagauacgaauuucuguggggacccagggcucauucugaggugauaaagcggaaagucguggaguucuuggccaugcugaagaauacaguuccuaucaccuuuccgucaagcuacaaggaugcguuaaaagacguggaggaacgagcccaagcaauuaucgauacaacugacgauuccaccgcuacggaaucugccaguucgagcguaauguccccaucauucucuagcgaguga

SEQ ID NO: 58718 - RNA, 1122 nt, Artificial Sequence
  derived and/or modified sequence opt3 from MAGEC2__Homo_sapiens__NP_057333
augcccccugugccaggcgucccguucagaaacguugacaaugauagccccaccuccguggagcuggaagacuggguagaugcccagcacccuacagacgaggaagaggaagaggcuucuucagcaaguagcacucucuaccuuguguuuuccccaucuucguucucaacgagcaguucccugaucuuagggggacccgaggaagaggaagucccuucuggugugauuccaaacuugaccgagagcauacccuccucaccuccacaaggcccgccccaggggccuagucagagcccacugucuuccugcuguagcucauuuaguuggucuuccuucagcgaggaaucgucuucccagaagggagaggauacaggcacuugccaaggucuacccgacucagaaaguagcuuuaccuauacacucgaugagaaaguugccgaacugguggaguuccuucuguugaaguacgaggcggaagaaccugucaccgaagcugagaugcucaugaucgugauuaaauauaaggacuacuuuccaguaauccugaaaagggcccgggaguucauggagcugcucuuuggguuagcacugauugagguuggacccgaucauuucuguguguuugccaauacugucggccuuacagacgaaggcuccgaugacgaggggaugccggaaaacucuuugcugaucauaauccuaagcgugauuuucaucaagggaaauugcgcuucagaggaagugauuugggagguccucaacgcaguugguguguaugccggccgcgagcacuuuguauacggggaaccucgagagcugcuuaccaagguguggguccagggacauuaucuggaauaccgugaggugccccacaguuccccaccuuacuaugaguucuuguggggccccagagcucauagcgaaucuaucaaaaagaaaguucucgaguuccuggccaaguuaaauaacacggugccaucaaguuuucccagcugguacaaagaugcgcugaaggacgucgaagagagggugcaggcaacuauagacaccgccgaugacgcuacaguaauggccuccgaaucucucucgguuaugagcuccaaugugucauucagugaguga

SEQ ID NO: 58719 - RNA, 1932 nt, Artificial Sequence
  derived and/or modified sequence opt3 from MAGEC3__Homo_sapiens__NP_619647
augcugcuccccugccacugggugcuugacgccaccuucagcgauggcucccuggggcagugggucaagaacacaugugcuacuuacgcauugucuccuguuguguuaccaccgcaaccccagccucggaaaaaggccacggacaaagauuauucagcguuucaucugggacaccuaagggagguaagacucuuccugcgcgguggcaccagugaccagcgaauggauagccuugugcugugcccaacauacuuuaaguuguggcguacucucuccgggucucccggacugcagcugucggaccuccauuucggcucacaaccugaagguaaauuuagcuuaagaagggcugucagugugaagcagcgggaggaaccacaggauuggccccugaaugagaagcgcacccuuuggaaagacuccgauuugccuacauggagaagggggaccggauauacucugucucuaccagccguuagcccgggcaagcggcucuggggcgaaaaagcagggucccugcccgagucagagccucuuuucacauacacccuggacgaaaagguggauaaauugguccaguuucuccuguuaaaguaucaagccaaggagccacugacgcgcgcugaaaugcagaugaacgugaucaauacuuacaccggauauuuccccaugauuuuucgaaaagcaagagaguucauagagauccucuuugguauuagucuuacagaaguagacccugaucacuucuacguuuuugugaacacucuggacuugaccugugagggcagccuaucugacgaacaggggaugccacagaauaggcugcucauccugauucuuuccgucaucuucauaaagggaaacugcgccucagaggaagugaucugggaggugcugaaugcuauuggccccuggagcgccuuggcggguuucgcagauguccucagucggcuggccuuaugggagucugaagggccggaggcuuuuugugaagaguccggacugcguagcgccgaaggcucgguucuagaccucgcaaacccucaaggccuggcugggcaucgccaggaggauggaagaaggggucuuacagaggccucuccccagcagaaaaagggcggggaagacgaggauaugccagcggccggaaugccucccuugccacaaucacccccugaaaucccaccgcagggcccucccaaaauuuccccacagggucccccucaaaguccaccccagagcccgcuggacuccugcucuagcccucuccuguggacccggcuugaugaggaaucaaguuccgaggaggaagacacggcaacuuggcacgcucugccagagagcgaaucuuugccccgauacgcccucgaugagaagguggcugagcugguacaguucuuacugcuaaaauaucagacaaaggaaccugugaccaaggccgagaugcucacuacagucaucaaaaaguacaaagacuauuuucccaugauauucgggaaggcacacgaauuuauugagcugaucuucggcauugcccuuaccgauauggacccagacaaucauucauacuuuuucgaagauacguuggaccugaccuaugagggaagucucaucgaugaccaaggcaugccuaaaaacugucuguuaauccugauucuuagcaugauauuuaucaagggguccugcgugcccgaggaaguuauuugggagguguugucugcuaucggaccaauacagcgcccggcgagagaaguccucgaguuccugucgaagcuaagcuccauuaucccuucagcauuucccaguugguacauggaugcccugaaagacauggaagauagggcucaggccaucauugacacaacugaugacgcaaccgccauggcuucugccagcccauccgugaugucaacaaauuucugucccgaguga

SEQ ID NO: 58720 - RNA, 2337 nt, Artificial Sequence
  derived and/or modified sequence opt3 from MAGED1__Homo_sapiens__NP_001005332
auggcccagaagauggacugcggcgcugggcugcucggauuccaagcagaggccagcguggaagauuccgcgcuucugaugcagaccuugauggaggcuauccagauuucugaagcacccccuacaaaccaggccacugccgcugcaucaccacaaaguagccagccgcccacggccaaugagauggcugacauacaggucuccgccgcggcagccagaccuaaaucugcuuuuaagguucagaacgccaccacaaaagguccaaauggcguguacgauuucucgcaagcacacaacgcuaaggacguacccaauacucagccuaaagccgcguuuaagucacagaacgccaccccaaaggggcccaaugcagcuuaugauuucagccaggccgcuacaaccggagaauuagccgcaaacaaaagugagauggccuuuaaggcucaaaaugcgacuacaaaagugggcccuaacgcaaccuacaauuucucccagucucugaacgccaaugaccuagcuaacagcaggccaaagacgccguuuaaagccuggaaugauacuaccaaggcacccacagccgacacucagacccaaaacgucaaccaggcuaagauggccacaucccaggcagauaucgagaccgacccugguauuucagaaccagauggggcgacggcucagacaagugccgacggaagccaagcacagaaucucgagucucggacuaucauucgcggcaaacgaacccguaagaucaacaaucugaacguggaagaaaauuccucaggcgaucagagaagggcuccccuugccgccgggacuuggcggagcgcaccuguuccagugacaacccagaaucccccgggagcuccucccaacguccuguggcaaacgccauuggccuggcagaacccuagugguuggcagaaucagaccgcgcgccaaacacccccagccagacagucucccccugcuaggcagacuccaccggcauggcagaaccccguggccuggcaaaauccuguaauauggccaaaccccguuaucuggcagaauccugugauuuggccaaaccccaucgucuggccgggcccugugguguggccaaauccccucgcuuggcagaacccucccggguggcaaaccccaccuggauggcagacacccccaggcuggcaggguccgccugacuggcaggggcccccagacuggccccugccuccagauuggccccugccuccggacuggccacuccccacugauuggccuuuaccacccgacuggauuccugccgauuggccgauacccccagacuggcaaaaccugcggccuucccccaaucuucgcccaagcccuaacucgcgagcaucucagaaucccggagcggcccagccaagagaugucgcuuugcugcaggagagggccaacaagcuaguuaaauaucucaugcugaaagacuacaccaaggugccgaucaaacgguccgagaugcuucgugauauuauccgcgaguauacagacguauacccugaaauuaucgagagagcauguuucgugcuggaaaagaaguuuggcauccaauugaaagagauugauaaggaggaacaucucuauauacugaucucaacccccgagaguuuagcuggcauucuggggacuacgaaagacacaccaaagcucggacuucuguuggucauccuaggugugauauucaugaauggcaacagggccagcgaagcaguucugugggaggcccuccggaaaauggggcugcgacccggagugcgccacccucuucugggcgacuugagaaagcuccugaccuacgaauuugucaagcagaaauacuuagauuauaggcgggugccaaauuccaaucccccugaguacgaguuccuguggggucuacgcucuuaucaugaaacuagcaagaugaaaguacucagauuuauugcugagguucagaagagggacccgcgugauuggaccgcgcaguucauggaagccgcagacgaggcucuggaugcccuugacgccgcugcagccgaagcggaggcucgggccgaggcacgaacaagaauggggaucggcgaugaagccgugucaggaccauggaguugggacgauaucgaguucgaauugcugaccugggacgaggagggcgauuuuggggaccccugguccaggauuccuuucacuuuuugggcucgcuaccaccaaaacgcacggagcagauucccccagacauuugccggaccaaucauugguccuggcgggacggcgucugcuaacuucgccgcaaauuuuggagccauaggcuucuuuugggucgaauga

SEQ ID NO: 58721 - RNA, 1821 nt, Artificial Sequence
  derived and/or modified sequence opt3 from MAGED2__Homo_sapiens__NP_055414
augagcgacaccuccgagucuggcgccgggcugacaagauuccaggcugaagcaucagagaaggauaguagcuccaugaugcaaacucuccuuacggugacccagaacgucgaaguucccgagacaccuaaagccucuaaggcgcuggaagugucggaggacguaaaagugucaaaggcuagcggagucaguaaagccacugagguguccaagaccccagaagcaagggaggccccggcuacacaggcaucuagcaccacucaguugacagauacccaaguuuuagccgcugaaaauaagucccuggccgcggacacgaaaaagcagaacgcagauccccaggccgugacuaugccugcuaccgagacuaaaaaggucucacacguggccgacacuaaaguaaauaccaaggcacaggagacagaagcugccccaagucaagcgcccgccgaugagccugaaccagagagcgcagcugcccagucucaggaaaaccaggacacccggcccaagguuaaagcuaagaaagcccgcaaggugaaacaucuagauggugaggaggacggcuccucagaucaaagccaggcaagugggacgacuggaggccgacgugucucuaaggcccucauggcuuccauggcgagaagggcaagccgggguccuaucgccuuuugggcucgcagagccucgaggacacggcuggcagccugggcucgccgagcccuucugucuuugagauccccaaaagcaaggcgggggaaggcgcgucgcagagcugccaagcuccagucaagucaagaaccggaggcacccccuccaagggacguggcccugcugcagggacgggcuaaugaucucgugaaauacuuacuggccaaggaccagaccaaaauucccauaaagcgaagcgacaugcuuaaagauaucauuaaggaauauacugacgucuacccugagaucauugaacgcgcaggcuauuccuuggagaagguuuucggcauccagcugaaagagauagauaagaacgaccaccuauacauccuccugucuacacuugaaccaaccgaugcugggauucugggaacgaccaaagacagccccaaguugggucuccugaugguguuacugucaaucauuuuuaugaauggcaacagaaguuccgaggccguaaucugggaagugcucaggaaacuugggcugcggccgggaauacaucacagcuuguucggcgaugucaagaagcuaauuacagacgaguuugugaaacaaaaguaucuggauuacgcgcgcguuccuaauucuaaucccccagaauaugaguucuuuuggggucucagaucauacuacgagacaaguaaaaugaaggugcugaaauucgccugcaagguccagaagaaagacccuaaggaaugggcugcacaguauagggaggccauggaagcugaucuuaaagccgcagcggaggccgcugccgaggcaaaggcucgugccgaaauccgggcacgaauggggauuggacugggcagcgagaacgccgcuggccccuguaacugggacgaagcggacaucgggccaugggccaaagcaagaauccaggcuggagccgaggccaaggcuaaagcacaagaauccgguucugccucgaccggcgcgagcacauccacuaauaacucagcuagugccucugcaagcaccuccgggggauuuucagccggcgcuagcuugacagcaacccucacuuucggucuguuugccggguuaggcggagcgggcgcuucuacguccgggaguagcggagccugcgguuucucuuacaaguga

SEQ ID NO: 58722 - RNA, 2226 nt, Artificial Sequence
  derived and/or modified sequence opt3 from MAGED4B__Homo_sapiens__NP_110428
auggccgagggcagcuucuccgugcagucugaaucauacagugucgaggacauggaugaagggagcgacgagguuggagaagaggagaugguggaagguaacgauuaugaggaauuuggcgcuuucgggggauacggcacccugacauccuuugacauccacauucucagagcauucgguucucuugggcccggacugaggauauugucgaaugagccuugggaguuagaaaacccaguacuggcccaaacucuaguggaggcgcuccagcuggauccggaaacgcuugcuaaugagaccgccgcacgggccgcuaacgucgcacgcgccgcugccucaaaucgagcggcacgugccgcugccgcagcugccagaacagcguuuagccaggugguugccagucauaggguggcaacuccccaggucuccggcgaagacacccaaccuacaaccuaugcugccgaggcucagggcccaacucccgagccuccacuggccucuccccagacaagccagauguuggugaccuccaagauggcagccccugaagcuccagcgacgucagcacaaagucagacugggagcccggcccaggaggcugccaccgaaggacccucuuccgcaugcgccuucucacaggcuccuugugcccgggagguagaugcaaaccgcccaagcacagcguuucucggucaaaaugacguuuucgauuuuacucagcccgcuggcgugagugggauggccuucccuagaccaaaaaggcccgcaccggcccaggaagcugccaccgagggaccuucugcagcuuccggcgucccccaaacagguccagggcgggagguggccgcgacccgcccuaagacgacuaaaagcggaaaggcccuggcuaaaacacgauggguggaaccccagaacgucguugcagccgcugccgcaaaggcgaagauggccaccucgaucccagagcccgaaggcgcugccgcagcuacugcccagcacucugcagagccuugggccagaaugggcgggaaaaggacaaagaaauccaagcaucuggacgaugaauacgagucaagugaggaggaacgggaaaccccagcugugccgcccacguggcgugcgagccagccuucccucaccguacgcgcccaauuagcaccaagacccccuauggcuccaaggucucagauucccagccggcacgugcugugccuuccgccucgaaaugucacauugcugcaggagcgcgccaacaagcuagugaaauaucucaugaucaaggacuacaaaaagauuccaaucaaaagagccgauaugcugaaggacguuauaagggaguaugacgaacauuuucccgagaucauugaacgggcuacuuacacccuugagaaaaaguucggaauccaccugaaagaaauugauaaggaggagcacuuguacauccucguguguacacgcgacucaagugcaagacuguuagguaagacuaaagauaccccuaggcugucccuccuucuggucauauugggcgugauuuuuaugaaugggaaccgugccagcgaagcgguacuaugggaggcucugcggaagaugggacuccgacccggcguuagacauccauuccugggugaccuuaggaaacugaucacagaugacuucgugaagcagaaauauuuggaauacaagaagauuccuaauucuaaucccccagaguaugaauuucucugggggcugcgcgcccggcacgagaccucaaaaaugagagucuuaagguucaucgcacaaaaccagaaccgcgauccgcgagaguggaaggcccauuuucuggaagcuguggacgaugcauucaaaacuauggacgucgauauggccgaggaacacgcgcgggcucagaugcgugcccagaugaacaucggcgacgaggcacuaauuggaagauggaguugggacgauauacaaguggaacuccugacgugggacgaggauggcgacuuuggggaugccugggcuaggaucccuuucgccuuuugggcacgcuaccaccaguauauucuuaauagcaaccgggcuaauagaagggccacauggcgagcgggaguuuccucugguaccaacggcggggccucgacuagcguguuggacggacccuccaccucaaguacaauccgcacccggaaugcagcuagagccggcgcuucuuucuuuagcuggauacagcauagguga

SEQ ID NO: 58723 - RNA, 2220 nt, Artificial Sequence
  derived and/or modified sequence opt3 from MAGED4__Homo_sapiens__NP_001092270
auggccgagggcagcuucuccgugcagucugaaucauacagugucgaggacauggaugaagggagcgacgagguuggagaagaggagaugguggaagguaacgauuaugaggaauuuggcgcuuucgggggauacggcacccugacauccuuugacauccacauucucagagcauucgguucucuugggcccggacugaggauauugucgaaugagccuugggaguuagaaaacccaguacuggcccaaacucuaguggaggcgcuccagcuggauccggaaacgcuugcuaaugagaccgccgcacgggccgcuaacgucgcacgcgccgcugccucaaaucgagcggcacgugccgcugccgcagcugccagaacagcguuuagccaggugguugccagucauaggguggcaacuccccaggucuccggcgaagacacccaaccuacaaccuaugcugccgaggcucagggcccaacucccgagccuccacuggccucuccccagacaagccagauguuggugaccuccaagauggcagccccugaagcuccagcgacgucagcacaaagucagacugggagcccggcccaggaggcugccaccgaaggacccucuuccgcaugcgccuucucacaggcuccuugugcccgggagguagaugcaaaccgcccaagcacagcguuucucggucaaaaugacguuuucgauuuuacucagcccgcuggcgugagugggauggccuucccuagaccaaaaaggcccgcaccggcccaggaagcugccaccgagggaccuucugcagcuuccggcgucccccaaacagguccagggcgggagguggccgcgacccgcccuaagacgacuaaaagcggaaaggcccuggcuaaaacacgauggguggaaccccagaacgucguugcagccgcugccgcaaaggcgaagauggccaccucgaucccagagcccgaaggcgcugccgcagcuacugcccagcacucugcagagccuugggccagaaugggcgggaaaaggacaaagaaauccaagcaucuggacgaugaauacgagucaagugaggaggaacgggaaaccccagcugugccgcccacguggcgugcgagccagccuucccucaccguacgcgcccaauuagcaccaagacccccuauggcuccaaggucucagauucccagccggcacgugcugugccuuccgccucgaaaugucacauugcugcaggagcgcgccaacaagcuagugaaauaucucaugaucaaggacuacaaaaagauuccaaucaaaagagccgauaugcugaaggacguuauaagggaguaugacgaacauuuucccgagaucauugaacgggcuacuuacacccuugagaaaaaguucggaauccaccugaaagaaauugauaaggaggagcacuuguacauccucguguguacacgcgacucaagugcaagacuguuagguaagacuaaagauaccccuaggcugucccuccuucuggucauauugggcgugauuuuuaugaaugggaaccgugccagcgaagcgguacuaugggaggcucugcggaagaugggacuccgacccggcguuagacauccauuccugggugaccuuaggaaacugaucacagaugacuucgugaagcagaaauauuuggaauacaagaagauuccuaauucuaaucccccagaguaugaauuucucugggggcugcgcgcccggcacgagaccucaaaaaugagagucuuaagguucaucgcacaaaaccagaaccgcgauccgcgagaguggaaggcccauuuucuggaagcuguggacgaugcauucaaaacuauggacgucgauauggccgaggaacacgcgcgggcucagaugcgugcccagaugaacaucggcgacgaggcacuaauuggaagauggaguugggacgauauacaaguggaacuccugacgugggacgaggauggcgacuuuggggaugccugggcuaggaucccuuucgccuuuugggcacgcuaccaccaguauauucuuaauagcaaccgggcuaauagaagggccacauggcgagcgggaguuuccucugguaccaacggcggggccucgacuagcguguuggacggacccuccaccucaaguacaauccgcacccggaaugcagcuagagccggcgcuucuuucuuuagcuggauacaguga

SEQ ID NO: 58724 - RNA, 2874 nt, Artificial Sequence
  derived and/or modified sequence opt3 from MAGEE1__Homo_sapiens__NP_065983
augagccuggugucccagaacucuagaaggcggcgccgacgugucgccaaggcuaccgcacacaauucaaguuggggcgagaugcaagcccccaacgcgccugggcucccagcugacguuccgggaagcgaugugccccaggguccuuccgacucucagauccuucagggccugugcgccucggaagggccaucaacaagcguauugcccacgagugcagagggaccuuccacuuucgugccacccaccauuucugaagccagcuccgcuucaggccaaccuacaauaagugaggguccagggacuagcgucuuaccgacccccucugaaggacuguccacaucaggcccuccaaccaucagcaaaggccuauguacaagugugacucucgcagccucugaggggagaaauaccuccaggcccccuacgagcucggaggaaccaucuacuuccguucccccgaccgcuucagaggugccuaguacaagccugcccccaacuccuggagaagguaccuccacaucugucccuccaaccgccuacgagggccccagcacgucagugguaccuacuccagaugaggggccgaguacauccguucuucccaccccuggagaaggcccagguacuagcgugccccuggcggcaacagagggguugucuaccucaguccaggccacgccugacgaaggaccaaguaccagcgugcccccgacagcuacugagggccucuccaccccugugccacccacacgggaugaaggcccuucuacuucgguccccgccaccccaggggagggaccuagcacauccguucugcccgcagcuucagacggucagaguauuucucuggugccaacccgcggcaaggggagcuccacuucaguaccgccuacggccacagagggacucagcaccucugugcagcccacugcgggcgaagguuccaguaccagcgucccacccacaccugggggcggauuaucuaccuccgugccacccacugccacagaggaacugucaacgaguguuccuccgaccccaggcgaggggcccagcacuucggugcuuccuaucccaggagaagguuuguccacaucugugcccccuaccgcaagcgauggcucagacacaagugucccgcccacuccaggggagggagcuuccacccugguacaaccuacggcccccgauggcccagguucuagcguucuaccuaaccccggggagggcccauccacccucuuuucaagcagugcuucuguggacagaaauccguccaaaugcagccugguccuuccuucgcccagggugacaaaggccucagucgauucugacagugaaggaccaaaaggcgcagaggggcccauugaguucgaagugcugcgggauugugaauccccuaacagcaucucuauaaugggauugaauacuagccgcguugccaucacccucaagccacaggaccccauggagcagaacguggcugagcuguuacaguuucugcucguaaaggaccaauccaaauauccuauucgagaaucagagaugagagaauacaucgucaaggaguauaggaaucaguucccggagauucuucggcgugcggcagcccaucuggaaugcaucuuucgcuucgaguugagagaacuagauccagaggcucacacauacauacugcucaacaaacugggucccgugccuuuugaaggccuugaggagagucccaaugggccaaagaugggacuguugaugaugauucucggccagaucuuccugaacgguaaucaagccaaagaagcagagauuugggaaauguuauggaggauggggguucagcgggagcgacgccugagcaucuuuggcaacccuaagagacuacucucuguggaguucgucuggcagagguaucuggacuaccggcccgugacugauuguaagccaguagaauaugaguuuuucuggggaccucgcucccaucuugaaaccacgaaaaugaagaucuugaaauuuauggccaagauuuacaauaaagacccgauggauuggcccgagaaguacaacgaagcucuggaggaagacgccgcaagagcguucgcugagggcuggcaggcccucccacacuucaggcgucccuuuuucgaggaagcagccgcugaggugcccucaccagauagugaaguuagcuccuauucuucgaaauacgccccucauagcuggcccgagucacggcuggaguccaaggcacgaaaacuuguccaacuguuuuugcucauggacaguacaaagcugccgauaccaaagaaagggaucuuauauuacauuggaagagaaugcucuaagguguucccugaucugcuaaacagggcugcccgcacccucaaucacguguauggcacugagcuggucguucuugacccccggaaccacagcuacacauuguauaauagaagggaaauggaggaaaccgaggagaucguggauuccccaaaccgccccgguaauaacuuucugaugcaagugcucucauucauauuuauuauggggaaucaugcgcgagaaucugccguaugggcuuuccugcggggauuaggcguccaggcaggucguaaacacgugaucacuuguagauaccugagccagagguacaucgacagucuucgcguuccugacuccgauccggugcaguaugaguuugucuggggcccccgggccagauuggaaaccagcaagaugaaggcucucagguacguggcccgcauucaucgaaaagagccacaggacuggccucagcaguaucgggaagcaauggaggaugaggcgaacagagccgacguugggcacaggcaaaucuucgugcacaauuuucguuga

SEQ ID NO: 58725 - RNA, 660 nt, Artificial Sequence
  derived and/or modified sequence opt3 from MAGEH1__Homo_sapiens__NP_054780
augcccagaggcaggaagucgcggcgccgacguaacgccagagcugcagaggaaaauaggaacaaucggaaaauccaggccuccgaggcgucugaaaccccuauggcugccucaguggucgcaaguacaccagaggacgaucugagcgggccggaagaggaccccuccacuccugaggaagccucuacgaccccagaggaagcuagcucaacagcacaagcccagaagcccagcguuccucgcaguaacuuccagggaacuaaaaagucccuccuuaugucuauucuggcuuugauauuuaucauggguaauagcgccaaagaggcguuaguguggaagguacugggcaagcuagggaugcagccaggaagacaacacuccauuuucggcgaucccaaaaagaucgugaccgaggaauuugucaggcgggguuaccucauuuauaaaccugugccacgcucaaguccgguugaguacgaguucuuuugggggccccgagcacauguggaaagcucuaagcugaaagucaugcacuucguggccagaguaaggaaccggugcuccaaggacuggccuuguaauuaugauugggacucagaugacgaugcugaaguugaggccauccuuaacagcggagcacguggcuacagugcuccauga

SEQ ID NO: 58726 - RNA, 3750 nt, Artificial Sequence
  derived and/or modified sequence opt3 from MAGEL2__Homo_sapiens__NP_061939
augagccagcuguccaagaaccucggcgacucuucacccccugccgaggcuccaaaaccgcccguguacaguagaccuaccguccuuaugagggcaccacccgccagcucccgggcgccuccaguucccugggauccuccaccgaucgaccugcaggcuucuuuggccgcauggcaagcuccccagccugccugggaagcaccacaggggcaauuacccgccccugugguaccaaugacacagcccccggcucugggagguccuauugugcccgccccaccucuaggcgggcccaugggaaagccacccacuccuggcguccucauggugcacccaccgcccccuggugcgccaauggcacagcccccuacgccagggguucugauggugcaucccucggccccgggagcuccuauggcccacccacccccucccggcaccccaaugucacauccucccccaccgggcacaccuauggcacacccaccacccccugggacuccaauggcucaucccccuccgccaggaacccccaugguccacccuccacccccugguacaccgauggcccaucccccaccucccggcaccccaauggcgcacccucccccaccggggacuccuauggcccacccaccacccccuggaacaccaauggcacaucccccuccgccaggcacccccauggcucagccucccgccccaggugugcuuauggcucaaccucugacgcccgggguauugaugguucagccagccgcaccuggagccccgauggugcagcccccucccgcugcgaugaugacucagccccaaccaagcggcgcaccuauggccaaacccccgggcccagggguccucaugauacacccucccggagcucgcgccccaaugacccagcccccugcaaguggugccccgauggcucagcccgccgcacccccugcgcaacccauggcuccuccagcccagcccauggcauccugggccccucaggcucagccacugauccugcaaauucagucucaggugauccgagccccgccccaggugccucaaggcccacaggcacccccugcucagcucgccacaccacccggguggcaggcgacuagcccgggauggcaagccacccagcagggcuggcaggcuacaccuuuaaccuggcaaacgacucaggucacauggcaggcacccgccguuaccuggcaagugccaccucccaugcgucaggguccacccccuauuagaccagggccgcccccuaucaggccaggacccccuccaguacggcaggcucccccucugauacgccaggccccgccagugaucagacaagcacccccugucauuaggcaggcgcccccagugauccggcaggccccugcuguuauucgccaggcacccccagugauccgacaagccccgccugucauaagacaggcucccccagugauuaggcaggcacccccucuuauccggcaggccccacccccuauucguccggccccacaaguauuggcuacucagcccccucuguggcaggcgcuaccacccccucccccacuccgccaagccccgcaggcaagacugccugcuccccagguucaggccgccccacaagugccuacagcucccccagcaacccaggucccugccgcgcccccggcuggcccacaggugccucagcccguccuuccagcaccccuguccgccccuuugucagccccgcaagcugugcacugcccaaguaucaucuggcaggcacccaagggccagccucccguuccacaugagauuccuacgagcauggaguuccaggaagugcaacagacccaggcccucgcguggcaggcucaaaaagcccccacacacauauggcagccacugccugcacaggaagcccaaaggcaggcuccgcccuuaguacagcuggagcagccauuucaaggggccccucccucucagaaggcaguccagauccagcucccaccucaacaggcucaggccuccggaccccaggcggaggugccgacucuuccacugcaaccuucauggcaggcacccccagccguuuugcaggcucaacccgguccucccguggccgcugcaaauuucccacuaggcagcgccaagagucugaugaccccuucuggggaaugucgggccuccagcauugaucgacgcggaucgucuaaagagagaaggacauccucaaaggaacggcgcgcuccgaguaaagacagaaugaucuuugcggcaacuuucugcgcccccaaggcugucagcgccgcaagggcccaucucccagcugcguggaaaaaccugccugccacccccgagacauuugcaccauccucuagcguguucccugcuaccucacaguuucagcccgccagucuuaaugcauucaagggcccguccgccgcuagcgagacuccuaagucucugccauaugccuugcaggaucccuuugcguguguagaagcacucccugccgugccauggguuccccaaccuaacaugaaugcuucaaaagccagucaggcugucccaacguuccugauggcaacagccgcugcaccccaggccaccgcgacuacccaggaggccagcaagacauccguggaaccgccucgucggucugguaaagcuacccgaaagaaaaagcacuuagaggcccaagaagacucgagagggcauacucuggcauuucacgauuggcagggccccaggccaugggagaaccuaaaucucagcgacugggaggugcagucccccauacaggucucaggagauugggaacacccuaacacaccacgcggccugagugggugggagggacccucuacgagccggauucuuuccgguugggaaggcccuucagcuagcugggccuugucugcaugggaggggccauccaccaguagagcccugggacucagcgaaucuccgggcuccucacugcccguuguggugagugagguagcuagcgucucgccugguuccucugcgacucaagacaauagcaaaguggaggcccagccacuuucaccccuggaugaaagggcaaacgcuuugguucaguuccuccuggugaaggaccaggccaaggucccugugcaacgcagugagaugguuaaagugaucuuacgagaauacaaggaugagugccuggacaucauuaaucgggccaacaauaaacuagaaugugcauuuggguaucagcucaaggagaucgacaccaaaaaccaugcuuacauuauaaucaauaagcugggcuaucacacaggaaaccuuguagccuccuacuuggaucguccaaaguucggccugcucauggucgugcugucuuuaauuuucaugaaagggaacugcgugagagaggaccugaucuuuaauuuccuuuuuaaguugggacucgaugucagggaaacaaacggccuguucgguaauacuaaaaagcuaaucaccgagguuuuugugcgccagaaauaucuggaauaccggaggauucccuacacggagccggcggaguaugaguuccucugggggccuagagcuuuucuggaaaccagcaagaugcuuguauugcgauuccuggccaaguuacauaaaaaggacccacaauccuggcccuuucacuaccucgaagcacuggccgagugugaaugggaggauacagacgaggaugaaccugacacuggagauucagcucacggccccaccagccgcccaccgccucgguga

SEQ ID NO: 58727 - RNA, 1806 nt, Artificial Sequence
  derived and/or modified sequence opt3 from MAG__Homo_sapiens__NP_001186145
augcccagcuccaucucugccuucgaggggaccugcgugucaauuccuuguagauuugacuucccagaugaacugaggccggcugucguucacggcgugugguacuuuaacagucccuauccuaagaauuacccacccguaguguucaaaagccggacacaggucgugcaugaguccuuucaaggacgcucucgacuccuuggugaccugggcuugcguaacugcacuuuacugcuaucgaauguuucaccugaacucgggggaaaguauuacuucagaggcgaucuggguggguauaaccaguacacguuuagcgagcacagugugcuugacauagucaauaccccaaacaucgugguacccccugaaguuguggcaggaacagaggucgagguguccuguauggugccagauaauugcccggaacugaggcccgaguugucuuggcucggccaugaaggccugggggagccugccguccugggacggcuccgcgaggacgaagguacuuggguucaggugagcuuacugcacuucguaccaaccagagaggcgaacggccauaggcuugggugucaggcuuccuuucccaauacaaccuugcaauucgaaggauaugccucaauggaugugaaauacccuccagucauuguggagaugaacaguagcguugaagcaaucgagggcucucacgugucccugcuaugcggugccgacucaaaucccccgccucuccugacuuggaugcgggaugggacaguccuucgcgaggcuguggcagaaagccuguugcucgagcuggaagagguaacccccgccgaagacggaguuuacgcuuguuuagccgagaacgcguauggccaggauaaucgaacggugggccugagugucauguacgcaccauggaagccuacugugaacgggaccauggucgccguggagggagaaacaguuucuauucucugcuccacucagagcaaucccgacccaauccuuaccauauuuaaagagaagcagauccugucgacagugauuuaugaaucugaguugcaacuagaacugcccgcuguauccccugaggaugacggugaguacuggugugucgccgaaaaccaguauggccagagagcaaccgcuuucaaccucucaguggaguuugccccaguucugcuucuggaaagucacugcgcggccgcaagggacacggugcaguguuugugcgucgugaaaagcaauccggagcccuccguagcuuucgagcucccuucucggaacgugacuguuaaugaaagcgagcgugaguucgucuacucagaacgcagugggcugguguuaacauccauccugacccuaagaggacaagcccaggcuccacccagggugauuugcacugcccggaaccucuauggcgcaaaaagccuggaacuuccuuuucagggugcccaucgauugaugugggcuaagaucgggccagucggcgcgguuguggcauucgccauacugauugcuaucguguguuacauuacacaaacccgcagaaagaagaauguaacggagucucccucauuuagugccggagauaacccgccuguccucuucagcuccgacuuuaggaucucuggcgcaccagagaaauacgaaucggagcggcgccuggggagcgaaagaaggcuucugggauugcguggugagcccccugaacucgaucuguccuauucacacagugacuuaggcaagcggcccaccaaggauucuuacacacugacugaggagcuagccgaauaugcugagauccgagugaaauga

SEQ ID NO: 58728 - RNA, 4389 nt, Artificial Sequence
  derived and/or modified sequence opt3 from MAGI1__Homo_sapiens__NP_001028229
augagcaaggugauccagaaaaagaaccacuggaccuccagaguccaugagugcacaguuaaaaggggcccccaaggggaacugggagugacuguacucgguggcgccgagcacggggaguucccuuacgugggagcugucgcagccguggaagcggcuggccuuccaggugggggagaaggcccgcggcugggcgagggggaguuguuacuggaaguucagggagugcgcgucucuggucuaccccgauaugacgugcucggcguaauugauucauguaaggaggccguuacguuuaaagcagugcgucaagggggaagacugaauaaggaccuuaggcauuuccugaaccagcgguuucaaaagggcaguccugaucacgaauugcagcagaccauacgcgacaaucucuacagacaugccgucccaugcacaacuaggagcccccgggagggugaggugccugggguggauuauaacuuccugaccgucaaagaauuucuggaccucgagcaguccggaacauuacuggaaguuggcaccuacgagggcaauuauuacgggacuccaaagcccccuucucaaccagugucgggaaaaguaaucacaaccgaugcacuucacucauugcagagcgguaguaagcaguccacgccgaaacgcacuaagucuuauaacgacaugcagaaugcuggcauugugcacgccgaaaacgaggaggaagaugacguccccgagaugaauagcuccuucaccgcugauucaggggaacaagaggaacauacacugcaggagacugcccuaccuccagugaacaguagcaucauugcggcacccaucaccgacccuucucagaaguuuccacaauaccucccccuguccgccgaggauaaucuuggaccgcugccugaaaacugggagauggcuuacacagaaaauggcgagguuuauuucauagaccacaacaccaaaacgacuucaugguuggacccccgaugucucaauaagcagcagaaaccacuggaagagugcgaggaugacgaaggugugcauacagaggaauuagauagcgagcuggagcucccugccgggugggaaaagaucgaggaccccgucuacggcauuuauuacguggaucacaucaacagaaaaacccaguaugaaaacccaguacuugaggcaaagaggaaaaagcaacuggaacagcagcagcaacagcagcagcaacagcagcagcaacagcagcaacagcagcagcaacagacugaggaguggacagaagaccacagugcuuugguucccccugugauuccaaaucauccgcccucuaacccugagccagcccgggaagucccccuacagggaaagcccuuuuucacccguaauccauccgagcugaaaggcaaguuuauccacacgaaacuccgcaagagcucgagaggguucggauuuaccguggucgguggcgaugaacccgacgaguuccugcagauaaaaucucuugugcuggaugggccggcggccuuggacggaaagauggagacaggcgauguuauuguguccguaaacgacacuuguguccucggucauacccacgcacaagugguuaagaucuuccagucaauuccuaucggggcuaguguggaccuggaauuaugcaggggcuacccacugcccuuugauccugacgaucccaauacaagccuagucacuuccguggccauccucgacaaagagccaauuauaguaaacggacaggaaaccuaugauucuccugcuagccauucaaguaagacaggcaaagugaaugggaugaaggacgcccggcccuccagcccagcagauguugccucuaacucaagucacggauacccgaaugacaccgucagccuggcuuccucuaucgcgacucagccugagcuuauuacggugcacaucgugaaaggucccaugggcuucggguuuacaauagcagauucgccaggaggcggugggcaacgagucaagcagauuguugacagcccccgcuguagaggcuugaaggaaggagaucugaucguggaggugaacaaaaagaauguacaggcccucacccauaaccaagucguggacaugcugguugagugcccuaaaggcuccgaagugacucuucugguccagaggggaggguugccagugcccaagaaaucaccuaagagucagccgcucgagcggaaggauucucagaauagcucccaacacucaguuagcucucaucgcucccugcacaccgcuaguccaagccacucuacacagguguuacccgaguucccuccagccgaagcacaggcccccgaccagaccgacuccucaggccagaaaaagccugauccguuuaaaaucugggcucagaguagaagcauguacgagaacaggcugcccgacuaucaggaacaggauauuuuccuauggcguaaggagacugguuuuggguuccggauccucggaggcaaugaaccaggugagccuauuuacauaggccauaucguaccccugggggccgcagacacagauggacgacuuagaucgggcgacgaauugauuugugucgaugggacgccagugaucggaaaaucccaccaacuggugguccagcucaugcagcaggcggcuaagcaaggccauguuaaccugaccgugaggcgcaaaguaguguuugccgucccuaagacugagaacgaggugcccucuccagcaagcucacaccauaguuccaaucagccggccucuuuaacagaagagaagcggaccccucaggguagccaaaacucccugaauacaguuucaagcgggaguggaucuacuuccggcaucgguagcggcgggggaggcgggucgggaguggucucaaccgugguucagcccuaugacguggaaauuagaaggggcgagaacgaagguuucggguuugucauaguaucuagugugucccgcccagaggcuggaacgaccuucggcaaugccugcguugcaaugccccacaaaaucggucgaauuaucgagggcagcccugcugaucggugugggaaacuuaaagugggagaccguauuuuggccgucaacggcugcucuaucacaaauaagagccacuccgauauagugaaccucaucaaagaagcggggaauacuguaacccugagaauuaucccaggagacgagucaaguaacgccacacuacugacuaaugcugaaaagauugcaaccaucacgacaacccauacucccagccagcagggcacacaagagaccaggaacacuaccaagccuaaacaggaaucucaguuugaguucaaggccccgcaggcuacacaagagcaggauuucuacacgguggaacucgagcgcggugccaaaggguuuggauucucccugcggggcggcagagaauauaauauggaccuuuacgucuugaggcuggcagaggacgggccagcggagcgaugcggaaagaugcgcauaggugaugaaauuuuagagaucaacggcgaaaccacuaaaaauaugaagcacucacgggccauugagcucaucaagaacgggggaagaaggguucgucuguuucuuaaacgcggcgacgguagugugcccgaauaugauccuagcuccgaccggcaugggcccgcuacaggaccacagggcgugccugaggucagagccggccccgauaggcgacagcacccaucucuggagucgagcuacccuccggacuugcauaagucauccccucacggggaaaaacgggcacacgcucgcgauccaaagggaaguagagaguacucuaggcaaccuaacgaacaucacaccuggaaugguacaagccggaaacccgacuccggcgccugucgaccaaaggauagagcaccugaggggcgcagggacgcccaggcugaacgugcggccgcagcuaacggacccaagcggagaucaccggagaaaaggcgcgagggcacucgaucugccgauaauacccucgaaagacgggagaagcaugaaaagaggcgcgacgugagcccagagcguagacgggaaaggaguccuacgcgccgaagagacgguucccccagccggaggcgcagaucucuggagaggcuacuggagcagcggcguucaccagaacgccgaagagggggaucccccgagaggcgggccaagaguacagaucgcagaagggcucggagcccugaacgaagacgcgagaggucgcucgacaaacggaaccgugaggauagagcaucucacagggaacgcgaggaagccaaucugaagcaagacgcgggccgguccagccgacacccgcccgagcagagaaggcgcccauauaaagaaugcucaaccgaucuuaguauauga

SEQ ID NO: 58729 - RNA, 4326 nt, Artificial Sequence
  derived and/or modified sequence opt3 from MAGI2__Homo_sapiens__NP_001288057
augagcaagucccugaaaaagaaaucucacuggaccucaaaggugcaugagagugucaucggcagaaaccccgaagggcagcucggauucgagcuuaaagguggcgccgaaaaugggcaauuuccuuaccugggagagguuaagccaggcaagguggcuuaugaaagcgguuccaaauugguaucugaggaguuacugcuagaagugaacgagacaccggucgcagggcucacuauuagggacgugcuggccguuauaaagcacugcaaagauccccuucggcugaagugugugaaacagggaggcaucgucgacaaggauuugcgccauuaccucaaucugcgauuccagaagggcucgguggaccacgaacugcagcaaauuauccgugauaaccucuauuuaagaacgguaccuugcaccacaaggccacauaaagagggggagguucccggaguggacuacauuuuuaucacugucgaagauuucauggagcuggaaaagucaggugcgcuuuuggagagcggcaccuaugaagacaauuacuaugggacaccuaaaccacccgcugagccugccccacugcuacucaacgugaccgaucagauacugccgggagcaacucccagugccgagggcaagcggaaacgcaauaaguccgugucuaacauggaaaaagcuagcaucgagccuccagaagaggaagaggaggaaagacccgucguuaaugguaacggggugguagugacaccugaguccucagaacacgaggacaagagugcaggagccagcggcgaaaugccaucucagcccuacccggcuccugucuacucccagcccgaggagcuuaaggaacaaauggaugacaccaaaccaacgaagccugaggauaaugaggaacccgacccacugcccgacaacugggagauggccuauacugaaaaaggcgagguguacuuuauugaucacaauaccaagacaacuucaugguuggacccuaggcucgcgaaaaaggcaaagccaccggaagaguguaaagaaaacgagcugcccuaugggugggagaagaucgaugacccuauuuacggaaccuauuacguugaucauaucaaucggcgcacacaguucgaaaacccaguguuagaggccaaacgaaagcugcagcagcacaacaugccccauaccgaacucgguacgaaaccucuucaagcuccaggcuuuagagagaagccccuguucacuagggacgccagccaguugaaggggacauuucuaaguaccacucugaaaaagucuaauaugggauucggcuuuacaauaauugguggggaugaaccggacgaguuccuccaggucaaauccgugaucccugauggcccagcagcucaagacggaaagauggagaccggcgauguaauuguuuauaucaacgaagugugcguccuggggcacacgcacgccgacguggucaaacuuuuucagagcgugcccaucggacagucgguuaaucugguguugugucgggguuacccucuccccuucgacccagaggauccugcgaacucuaugguacccccacuggccauuauggaacguccgccucccgucauggugaauggccgccauaacuacgagaccuauuuagaauacauauccagaacaucacagaguguuccagacaucacugauaggcccccucacagccugcauuccaugccaaccgacgggcaacuagauggaacauaucccccuccggugcacgacgauaaugucucuauggcaagcucaggcgcuacucaggccgagcucaugacccugacaauugugaagggugcucagggguucggcuuuaccaucgccgacaguccaacuggacagcggguaaagcaaauacuugauauucagggcugccccggguugugugagggagaccugaucguggaaaucaaccagcagaauguucaaaaccucucccauacggaggucguggauauucugaaagacugcccuaucgguagcgaaacaucucuuauuauacaccgaggcggguucuuuucaccauggaagacccccaaaccuaucauggaucgcugggagaaucagggaaguccgcagacuagccuguccgcacccgccauuccacagaacuugccuuucccgccagcucuccacagaucuucguuuccugacagcaccgaggcguucgaccccaggaagccagauccguacgaacuguaugagaaaucccgggcaaucuacgaaucacgcagaccugacuauaaggaguuagaugugcaucugaggcguauggaaaguggcuuugguuuccggauccuagggggcgacgagcccggacaaccaauucucauaggcgccgucaucgcuauggggucugccgaucgagacggaagacugcaccccggcgaugagcuuguuuacguggacgguauuccuguggcagggaaaacacauagguacguaaucgauuugaugcaccacgccgcucgcaauggacaggucaaccugaccgugcggagaaagguucucuguggcggugaaccaugccccgagaauggcaggagcccuggguccgugucaacucaucacagcucuccgcgcuccgacuaugccacauacacgaacaguaaccaugcagcgccaagcucuaaugcuucacccccugaaggauuugccucacacagucugcagaccagcgaugucgugauucaucgaaaggagaacgaaggcuucggguuuguuaucauaucguccuuaaaucggcccgagucuggaagcacuaucacagugccacacaaaauuggccguaucauugacgguuccccugcagauagaugugccaagcugaaaguaggggacaggauccuugcugucaacggacaaaguauaauuaauaugccccacgccgacaucgugaaguugauuaaagaugcaggccucuccgugacccugcgcaucauaccacaggaggaacuaaacucuccuacaagcgcuccguccucagagaagcagagccccauggcccagcaaaguccacuggcgcagcagucuccucucgcccagcccuccccagcuacuccuaauagccccaucgcacaaccggccccaccucagccccugcagcuucagggucaugaaaacucguaucggucagaggucaaggcuagacaagacguuaaaccagauauuaggcagcccccuuucaccgacuaccgacagccgcccuuggauuaucgccaaccaccuggcggggacuaccagcagcccccuccacuggauuaucggcagcccccuuuacucgacuacagacaacacucuccagauacgaggcaguacccccugagugacuaucgucagccgcaggauuuugacuacuucaccguggacauggaaaagggagccaaaggcuucggguuuuccauccgcggaggccgggaguauaagauggaucuuuacguacugagauuggcagaggacgguccugcgauuaggaaugggcgaaugcgggugggagaucaaaucauagaaauuaacggcgagagcacacgcgacaugacucaugccagagcuaucgaacucaucaaaucugguggcaggcggguccgacugcuacugaagagagggaccggacaggugccagaguaugaugagcccgccccuuggagcuccccagcagcugccgcacccggccucccggaaguuggggugucacuggacgauggacuugccccuuucagucccagccacccagcuccucccucugacccaucccaucagauuucacccggcccuacaugggauaucaagcgcgagcacgacgucaggaaaccaaaggaauugagugcgugcggucagaaaaagcaacgucugggggagcagcgggaaagaagcgccuccccgcagagggcagcucgcccccgauuagaggaggccccuggaggccagggcagaccagaagccgggcggcccgcuucugaggcaagggccccuggacucgcggcugccgaugcagccgacgcugcacgcgccgguggcaaagaagcgccacgugcugccgcagggucggagcugugcagacgggaaggacccggcgccgcuccugccuuugcaggucccgggggaggcggcagcggggcucuugaggccgagggaagggcgggugcccgcgcaggcccacgacccgggccuagacccccaggaggcgcuccugcccggaaggcugcaguggcccccgguccauggaagguuccggggucagauaaacugccuuccgugcuaaagcccggagccagugcugcgucuagguga

SEQ ID NO: 58730 - RNA, 3762 nt, Artificial Sequence
  derived and/or modified sequence opt3 from MAGI3__Homo_sapiens__XP_011539510
auggagagaauggacagcucccugcccgaagaggaagaggaugaagacaaggaggccaucaacggcucugggaaugcugagaacagggaacggcacucagagaguagcgauuggaugaaaaccgugccuuccuacaaucagacaaacucuucgauggacuuccgcaauuauaugaugcgagaugaaacucucgagccacuuccgaagaacugggagauggcauacacggacaccggaaugauuuauuuuauagaucauaauacaaaaacuaccacauggcuggacccccguuugugcaagaaagccaaggcgccugaagauugugaggacggugaauuaccauacggcugggagaagaucgaagauccccaauaugggaccuacuaugucgaccaccugaaccagaaaacucaguucgagaauccuguugaggaagcuaagaggaaaaagcagcuaggacaaguggagauuggcucaagcaaaccagauauggaaaagagucauuuuacaagagaccccucccagcucaaggguguacuggugcgggccucucuuaaaaagagcaccaugggguucggauuuacgaucauuggcggcgaccgcccugaugaguuccugcaggucaaaaacguguugaaggacgggccagcagcccaggauggaaaaaucgcuccgggugacguuauaguggauaucaauggcaacugcguccucgggcacacucaugcagacgugguacaaauguuucagcugguucccgugaaucaguacgucaaccugacccucuguagaggauacccuuuaccagaugacuccgaagaucccgugguggacauugucgccgcuacaccuguuaucaauggccagucacugacuaagggugagaccugcaugaacccacaagauuucaaacccggggccauggugcuugagcagaacggaaagaguggccacacauugaccggcgacgggcugaauggaccgagcgacgcgucugaacagaggguauccauggcaucaagcgguaguucucaaccugagcuagugacgauuccccucaucaagggcccaaaaggguuuggauucgccauagcugauuccccuacuggccagaaggucaaaaugauucuggacagccaguggugucagggucuucaaaagggggauaucauuaaagaaaucuaucaccagaacgugcagaaucugacacauuugcagguuguggagguccucaagcaauuucccgugggcgccgacguaccacuguuaauccugcggggaggacccccuucgccaaccaagacugcaaaaaugaagacagauaaaaaggaaaacgcugggucucucgaggccauuaaugagccgauaccccagccuaugccauuucccccuuccaucauucgcucaggaaguccaaaacuugaccccagcgaaguuuaccugaaguccaagaccuuguaugaggauaaaccgccuaacacgaaggaccuagauguguuccugcgaaaacaggaaucugguuucggcuucagaguccucgggggagacggcccagaucagagcaucuacauaggugcgauuaucccccugggggccgcagagaaggacggcaggcuucgggcugccgaugagcugaugugcaucgacggcauuccugugaaaggcaagucacacaagcaagucuuggaccucaugaccacagcugcccguaaugggcaugugcuguuaacuguucgcagaaaaaucuuuuauggagaaaagcagcccgaggaugacaguucccaggcauucauuagcacccagaacgguucuccaaggcugaaucgggccgaagugccugcucgacccgcgccacaagagccguacgauguaguccuacagcgcaaagaaaacgagggcuuuggguucgugauacucacaucaaagaauaaaccucccccaggaguuaucccccacaagauuggcagagugaucgaggguaguccugcagacaggugugggaaacugaaggucggcgaucacaucagcgccgugaacggacaguccauuguagaacuuucucaugacaauauagugcaauugaucaaggaugcuggcguuacugucacccugacagugauugccgaggaagaacaccaugggccacccucgggaaccaacagcgcacggcaguccccugcccuccagcaccgcccgaugggccagucacaagcuaaucauaucccaggugacagaagugcccuggaaggggagauuggaaaagaugugucuacuagcuauaggcacuccuggucagaccacaagcaucuugcacagcccgauacggcggucaucagcguugugggcucucgucacaaccagaaccuggguugcuacccuguggaguuggaacggggcccacgaggguuuggauucucccucagaggcgggaaagaguacaauaugggacuguuuauauuaaggcuggcugaagacggccccgccaucaaggauggucgcauucauguaggggaccagaucgucgagauuaacggagaaccuacacaaggcaucacccacacucgggcaauagagcuaauucaggccgguggcaauaaagugcuccugcuuuugagaccggggaccggacugauccccgaccacggcgauugggacauuaacaauccaaguagcucuaacguuaucuaugaugagcaguccccucugcccccaucaagucauuucgcuagcauauuugaagagucgcacgugccugucaucgaagagucccucagggugcagauuugugagaaggccgaagaguuaaaggacaucguucccgagaaaaagucuacacugaaugagaaccaaccagaaauuaaacaucagagccuuuugcagaagaaugugucaaaacgcgauccgccuaguucccacgggcauucuaacaagaagaaucuccugaaaguagagaacggagucacccgacggggccguagcgugucccccaagaaaccagcaucacaacacagcgaggaacaccuagacaagauccccaguccucugaaaaauaacccaaagagaaggccccgcgaucagucucucuccccuagcaagggugagaauaaaucgugccaggugucaacucgggcugggucuggacaggaccaauguagaaagaguaggggccgauccgccagcccgaaaaagcagcagaaaauagaagguucuaaggcgccaagcaacgccgaggcuaaacugcuugaaggcaagucccgccggauugcaggguacacaggaucaaacgccgagcagauccccgauggcaaggagaaaagugacgucaucagaaaggaugcuaaacaaaaucaguuggaaaagagcaggacgcguucuccugagaaaaagauuaagcgcaugguugaaaaaucccugcccucaaagaugaccaacaaaacuacaaguaaggaggugagcgaaaaugagaaagggaagaagguaaccacaggagagacuuccucuucgaacgacaaaaucggcgaaaaugugcaguuaagcgagaagcggcucaaacaggaaccagaggagaaggucgugucaaacaaaaccgaagaccauaaggguaaggagcuggaagccgcagauaaaaauaaggagacggggagauucaaaccugaauccaguucucccguuaagaaaacccuuauuacaccaggaccuuggaaggugccgagcggcaacaaggucacuggcaccauagggauggcggagaaaaggcaauga

SEQ ID NO: 58731 - RNA, 1104 nt, Artificial Sequence
  derived and/or modified sequence opt3 from MAGT1__Homo_sapiens__NP_115497
augagaaagggcaaagggcccaucugccuguucagcaggccuacccuccggccaucccgcucuaaggugucacuuauugagggacgaggugccaacauggcugcacguuggagauuuuggugugucaguguuacaauggugguagcccuguugauagugugcgacgucccgagcgcguccgcucagaggaaaaaggaaaugguguuaucugagaaaguuucgcaacugauggaauggacuaauaagcggcccgugauccgcaugaacggcgauaaguucagaaggcuagucaaagccccuccacggaauuacucagugauuguaauguuuacggcacuccagcugcaccgccaguguguugugugcaagcaggccgacgaggaguuccaaauccuugcuaacagcuggcgauauaguuccgcauuuaccaauagaauuuucuuugccauggucgauuucgacgaagggucugauguguuucagaugcugaacaugaauagcgcucccacauucaucaacuuuccugccaaaggaaagccaaaaaggggcgacacuuacgagcuccaggugcgggguuucuccgcggaacagauagcacguuggaucgccgaucgcaccgacgucaauauuagaguuaucaggcccccuaacuaugcugggccauugaugcugggacugcucuuagccgugauuggcggccugguauaccuucggcgaucaaauauggaguuuuuguucaacaagacagggugggcauucgcugcccuguguuuugugcuagcgaugaccaguggacaaauguggaaucauauccgcgguccgcccuaugcccacaagaacccucauacuggccacgucaauuacauacaugggagcucucaggcacaguucguggcugaaacacacauuguucuccuguuuaacggaggcgugacccuugguaugguccuguugugcgaggccgcuacguccgauauggacaucgggaaaagaaagauuauguguguggccggaaucggccucguaguucuguucuuuucauggauguuaagcaucuucaggaguaaauaucacggcuacccauacucuuuucugauguccuga

SEQ ID NO: 58732 - RNA, 903 nt, Artificial Sequence
  derived and/or modified sequence opt3 from MAK16__Homo_sapiens__NP_115898
augcagagcgacgaugugaucugggacacccugggcaacaagcaauucugcuccuuuaaaauuagaacaaagacucagucuuucuguaggaaugaguacucacucacggggcuuugcaaccggaguagcuguccccuggccaauucccaguaugcuaccauaaaagaagagaagggacagugcuacuuguauaugaaagucaucgaacgcgcagccuuuccucgacguuuaugggagagaguuaggcugucuaagaacuacgaaaaggcgcuagagcaaauugaugagaaucucaucuauuggccacgguucauucgccacaaauguaagcagagauuuacaaaaaucacucaguaccugauaaggauccggaaacuuacccugaagcgccagcgaaaguuggugccgcucucgaagaaaguagaaagaagggagaagcggcgugaagagaaagcucugauugccgcacaacuggacaacgccaucgagaaggaacucuuagagcgccugaaacaggauacauauggugacauuuacaauuuccccauccaugcuuuugauaaggcacuugaacagcaggaggccgaaucagacagcagugauaccgaggagaaagacgaugacgaugacgacgaagaggaugugggcaagagagaguucgucgaagacggggaaguggaugaguccgacauaucugauuuugaggacauggauaaguuggacgcuagcuccgaugaagaccaagauggaaaaucaaguagcgaggaagaggaagagaaggcccugucugcgaaacacaagggcaaaaugccucuaagggguccacuccagcggaagcgagcauacguugagauugaauaugagcaggaaacugagcccguggccaaggcuaaaacaaccuga

SEQ ID NO: 58733 - RNA, 1872 nt, Artificial Sequence
  derived and/or modified sequence opt3 from MAK__Homo_sapiens__NP_005897
augaacagauacaccacaaugaggcagcugggcgacgggacuuauggaagcgugcucauggguaaguccaaugagucuggcgaacuugucgccaucaaacggaugaagcgcaaauucuacucaugggaugagugcaugaaccugcgagaaguuaagaguuugaaaaaguuaaaucacgcuaacgugauuaagcugaaagagguaauacgugaaaaugaccaucuauauuuuaucuucgaguacaugaaggagaaccucuaucaacugaugaaagauagaaauaaacuuuuucccgaaagcgugauuaggaacaucauguaccagauucugcagggguuggcauucauccacaagcauggauuuuuccaccgggacaugaagccugagaaucuccuguguaugggcccagaacuggucaagauagccgauuuuggucucgcgcgcgaguuaagaucccagccgcccuauacggacuacgugucuaccaggugguaccgggcuccugagguucugcuucgcucgucaguguauagcaguccaaucgaugucugggccgugggguccauuauggcagaauuguacaugcugcgaccccuauucccuggaacaucugagguagacgaaaucuuuaaaauuugccaaguucucggcacuccaaagaaaagcgauuggcccgagggcuaucagcuggccuccucaaugaacuucagauuuccucagugugugccaaucaaucuuaagacccugauaccgaacgcuaguaaugaagcaauucaguugaugacagagaugcucaacugggaccccaaaaagaggccuaccgccagccaagcucugaaacauccauacuuccaggucggacagguguuagggcccucuuccaaucaccuggagucaaagcagagccucaacaagcaacuucagccucuggaaaguaaaccaucuuugguggaggucgaacccaagccgcuaccugauaucauugaccagguugugggucaaccccagccaaaaacuucccagcagccucugcaacccauccagccaccccagaaccucagcguacagcaaccuccaaagcagcagucgcaggagaaaccgccccaaacacuguuuccuucuaucgugaagaauaugccaaccaagcccaacggcacgcuuucccacaaaucagggcggcgucgcuggggacagacuauuuucaagaguggcgauagcugggaggaacuggaggacuaugacuucggugccucccauucuaaaaagccuagcaugggggucuuuaaagaaaagagaaagaaagauucaccauucagguugcccgagccggugccuaguggauccaaucacagcaccggcgaaaacaagucucucccagcgguuacaucacugaaaagugacagcgaguuauccacugcacccaccucuaagcaguacuaucugaaacagucgcgguaccuaccuggcgugaaucccaagaaggucagccucauagccuccgggaaagaaaucaacccacauacauggucaaaucaacuguuuccuaagagucuuggacccgugggugcugaguuggccuucaaacgaucuaacgcaggcaaucuggggagcuacgcuaccuauaaccaguccggauacauuccaucauuucucaagaaagagguacagagcgccggccaacgcauccaccuggcgccgcuuaaugccacggcaucugaauauacuuggaacacaaagaccgguagagggcaguucuccggcaggacuuacaauccuacagcuaaaaaccugaauauaguuaaccgggcccagcccauuccaagugugcacggacgcaccgauugggucgcuaaguauggcgggcauagauga

SEQ ID NO: 58734 - RNA, 462 nt, Artificial Sequence
  derived and/or modified sequence opt3 from MAL__Homo_sapiens__NP_002362
auggcccccgcugcagccaccggcgggagcacacugccuuccggauucucuguguuuacuacgcucccagaccuucuguucaucuuugaguucauuuuugguggcuuggucuggauauuaguugcgucaagucuggugccguggccccuaguacaggggugggugauguucgucagcguguuuugcuucguugcuaccacaacucucaucauucuguacaucauuggagcccacggcggugaaaccuccugggugacacuugaugcagccuaucauuguaccgcugcacuguuuuacuugucugccucgguccucgaggcucuggccacuaucacaaugcaagacggguucaccuauagacacuaccaugaaaacauagcggcagugguauuuucauauaucgccacgcugcucuacguugugcacgcugucuucagcuuaauuagguggaagaguuccuga

SEQ ID NO: 58735 - RNA, 462 nt, Artificial Sequence
  derived and/or modified sequence opt3 from MALL__Homo_sapiens__NP_005425
auggccagccccgacccuccagcuaccuccuacgcaccgucugaugugcccucaggcgucgcccuguuccucacaaucccuuuugcguucuuucuuccagagcugauuuucggguuuuugguuuggacuaugguggcugccacgcacauaguauaucccuuacugcagggaugggugauguacgucagucuaaccagcuuccucaucucccugauguuucuucugucuuauuuguucgguuuuuacaagagauucgaaucguggagggugcucgacucacuguaucauggcacaacugggauucuguacaugagcgcagccguucuccaagugcacgcuaccaucgucagugagaaauuacuggauccucggauuuauuacaucaacuccgcagccagcuuuuucgcuuuuauagccacacuuuuguacauccugcaugcguucucuauuuauuaccacuga

SEQ ID NO: 58736 - RNA, 6471 nt, Artificial Sequence
  derived and/or modified sequence opt3 from MALRD1__Homo_sapiens__NP_001135780
augcuguucuuucucgacagaaugcuugccuuccccaugaacgagaccuuuugcugucuguggaucgcuugcguguucaauagcacauuggcacagcaaggcacugaauccuuucagugugauaacggggucucuuuaccuccagacucaauuugcgauuucacggaccaguguggagauaguagcgacgagaggcacugccugaauuacgaacggugugauuuugaggacggucuaugccauaugacccaggaucaaucccuccagccgucuuggacaaagcgcucgggcaugauagggcugucacccccuuucuaugaccacaacggagauguuagcgcccauuuucuuagucuggugucccgaguagacucuaucagcuccucauugcguaguagaguguuccucccaacuaaugaucagcacgacugucagauuaccuuuuacuauuucagcugccaagucucuggcaaacugauggugggucugcagacagcgugugggggacccauccagcaucucuggcagaacaccgcugccuuaccuaaucaaugggaaaggaacguuauuaagauccaguccucacagcgguuucaaguggucuucgagggccagauggcaagcacuuacgagcaggacgaagugauagccaucgaugacauuaguuucucuuccggcugccugccagcuaaugaugggauccuuuugugccaggaggcacugaacgccgaacgcgagcuaugucaccccgacacagaucucugcagauuugacgcuaccgaugaggaacugaggcuuugucaagccugcggauucgaguuugacaugugugaauggacgagcgaggcgucggcaggucagauuucuuggaugcggacuaaagcccgcgaaaucccugcuuucgaguccaccccacagcaggaucaaggcggggacgaugagggauauuacguauggguuggcgccaagcacgguuuuacacugaaucauuuggacucacgagcauaucucaacaguagcgugugccacugucuggggaaauccugccauuuacaguucuacuacgcuauggaaucuagcguccugagagugaggcucuauaauaacaaggaggaagagauauuuuggacuuacaauauuucaacccacagucagugggugaaggccgacguccuuaucccggaagaucugaaaacauucaagauuaucuuugagggaaccuugcuaucccagcggagcuucaucgcgcuggaccaccucuggguuuaugccuguggccaaacgcagucucguaaacugugcucagcagaugaguuucccuguacuaguggccagugcauugcuaaggaaagcgugugcgacucccgccaggauuguucugacgagucggaugaagacccugccacaugcagcaaacaucuuaccugugauuucgaguccggguuuugcggaugggaaccauuccugacugaggacucacacuggaaguugaugaagggucucaacaacggcgagcaucacuuccccgcugccgaucauacagcaaauauaaaccacgggaguuuuaucuaccuggaagcccaaagaucuccuggaguagcuaaauuaggcagcccagugcugaccaagcuacucacggcguccacccccugucagguccaguucugguaucaccugucacaacauagcaaucuuucuguguuuacaaggacuuccuuggacgguaaccugcagaaacaggggaagauuauccgguucagugagagccaguggucucacgcaaaaauagaucucauugccgaagcuggcgaguccacccugccguuucaacuuauccuggaggccacaguuuugucaaguaaugcaacuguggcccucgacgacaucagcgucucgcaggaaugcgagauuuccuacaagucucugccucgaaccagcacacagucaaaauucaguaagugugauuuugaagcuaacuccugcgacugguucgaggccaucucuggagaucauuuugacuggauucgcagcucccagucagaauuaagcgcagauuucgagcaccaagcgcccccaagagaccacagucugaaugcuucucagggccauuuuauguucauacuaaagaaauccagcucgcucuggcagguggccaagcugcagucaccuaccuuuucucaaacugggcccggauguauccuuaguuucugguucuauaacuacgguuuguccguaggcgcagccgagcugcagcuccacauggaaaauagccaugauucuacgguuauuuggagggugcuguacaaccaggggaaacaaugguuagaggcuacaauccagcugggacggcuuagccagccauuucacuugucccucgacaaggucucacugggcaucuaugauggugugagugccauugacgauauacgcuucgaaaauugcacccuaccccugccugcagagagcugugaagggcucgaccauuuuuggugcagacacacuagggcuugcaucgagaaacugcgucuuugugauuuggucgacgacugcggcgaucggaccgacgaggugaacugugccccagaacugcagugcaauuucgagacaggaauuuguaacugggaacaagaugcgaaggacgauuuugacuggacccgaucucagggcccgacucccacauuaaauacggggccuaugaaggauaacacccucggaacugccaaaggucacuaccuguauaucgaguccucagaaccacaggcuuuccaggacagugcagcccuucugagccccauuuugaacgcuacagauaccaagggcugcacauuuagauucuacuaucauauguuugggaaaaggaucuaccgccucgccauauaucaacggaucugguccgacucuagaggacagcugcuauggcagauuuucggcaaucaggguaacagguggauccgcaagcaccugaauauuucgagccgacaaccuuuucagauccucguugaggcaucagugggggauggcuucacuggagacauagcgauugacgaucuguccuucauggacuguacccuuuacccaggcaacuugcccgccgaucugccgacgccuccagagaccaguguacccgucacauuaccuccccauaauugcacugacaacgaauuuaucugucggucugaugggcacugcauugagaaaaugcagaagugugacuucaaguacgauugcccagacaaaagcgaugaagcuuccugcgugauggagguuuguucauuugagaagcguucucucugcaaaugguaucagccuauccccgugcaucugcuucaagacagcaauaccuucagauggggacugggcaacgguauaaguauccaccacggggaagagaaucauaggccauccgucgaucacacacagaacacuaccgacggaugguaccuauaugccgauagcucuaauggcaaguuuggugacacggcagacauucucacaccgaucauuucacugaccggcccuaaauguacuuugguguucuggacacauaugaacggggcuaccguaggaucccugcagguguuaaucaagaaggauaauguuacuaguaaacucugggcccaaaccggccagcagggggcacaguggaagcgcgccgaagucuuucugggaauacggagccacacacaaauuguguucagagcuaaaaggggcaucucguacaucggugacguggcggucgaugacauuucuuuucaggauugcuccccccuucugagcccagagcgaaaguguacggaccacgaauucaugugcgccaacaaacauuguaucgcaaaggauaaauugugcgacuuuguuaaugauugugcugacaacucagaugagaccacuuucauuugccgcacaaguucugggcggugugacuuugaguucgaucucugcuccuggaagcaggaaaaggacgaggacuucgauuggaaccugaaagccagcucaauacccgccgcuggaaccgaaccugcagccgaccacacacuaggcaauaguagcggucauuauaucuuuauuaagucccuguucccacagcaacccaugagagcggcuaggaucucuagcccugugauuuccaaacguucaaagaacugcaaaaucauauuucacuaccauauguauggcaaugggaucggagcccuuacucucaugcaggugucuguaaccaaccagacgaagguccuguugaaucugacaguggagcagggcaacuucuggcgccgggaagaguuaagucucuuuggggaugaggacuuccaacugaaguuugaaggaagaguuggcaaaggucagaggggggauauugcacuugacgauaucgugcugaccgagaauuguuugucgcuccacgacagcguccaggaagagcuggccgugccgcuaccaacuggauucugcccccugggcuaccgagaaugucacaacgguaagugcuaccggcuugagcaauccuguaauuuuguugauaacugcggcgacaauaccgaugagaacgaaugugggucuucaugcacauucgagaaaggaugguguggcuggcagaauagccaggcugacaacuuugacugggugcucgggguaggaucccaucagagucugcgcccuccaaaggaucacacuuugggcaaugaaaacggucauuucauguauuuagaggcaaccgccgucgggcugagaggagacaaagcgcacuuuaggucuacaauguggcgggagagcucagcugccugcacgauguccuucugguacuucgugagugcaaaggccaccggcagcauucaaauccucauaaagacugaaaaaggccugucuaagguguggcaggaguccaaacagaaccccgggaaucacuggcagaaggcugauauucuucugggaaaauugcgaaacuuugaagucaucuuccaagguaucagaacacgcgaccuaggcgggggagccgcaauugaugacauagaguuuaagaauuguaccacuguuggcgaaaucucagagcugugcccugagauuacagauuuccucugcagggacaagaaauguaucgcuagccaucugcuuugcgauuauaagccggacuguucggaucguucugacgaagcccacugcgcgcauuacaccaguacgacugguuccuguaacuuugagaccagcucagggaauuggacaaccgccugcuccuuaacucaggauucugaagacgaccuggauugggcaauuggaagccggauccccgcuaaagcccucauaccagacagugaucacacaccuggcuccggccagcauuucuuguaugugaacagcucugggucaaaggagggaaguguagcuagaaucaccacauccaaaagcuuucccgcaucucuggguauguguacugugagguucugguuuuacaugauugacccacgcucgaugggcauccucaaggucuauaccauugaagagucagggcugaauauccuuguguggagcguuauaggaaacaaacgaacgggcuggacauacgguuccgugccucugaguucuaauagccccuucaaggucgccuuugaggccgauuuggacgggaacgaagauauuuucaucgcucuagacgauaucuccuuuaccccagagugcgugacuggaggcccgguuccugugcagcccucaccaugugaagcggaccaauucaguugcauuuacacccugcagugugucccccucucuggcaagugcgaugggcacgaggacuguaucgacggaagcgaugaaauggacugcccuuuauccccaacacccccucugugcucaaauauggaguucccguguagcacugaugagugcauaccaucucuucugcucugugacgguguacccgauugccacuuuaacgaagacgaguugauuuguuccaauaaaaguugcagcaacggcgcacuggugugugccucguccaauucuugcaucccugcucaucagagaugugauggguucgccgacugcauggauuuucagcucgacgaaucaagcuguagugagugcccccugaacuauugccggaauggaggcaccuguguuguggagaagaacgguccaaugugcaggugucgccaaggguggaaaggaaaccguugccacauuaaguucaauccucccgcaacggauuuuacauacgcccagaacaauaccuggacucuucuaggcaucggccuggcuuucuugaugacacauauaaccgucgcgguguuauguuuucuggccaacagaaaaguaccaauucggaagacugaaggguccggaaauugcgcauucgugaacccugucuaugguaauuggucuaacccggagaagacagaaagcucaguuuacuccuuuaguaauccccucuauggcaccacgagcgggucucuggagacucuuucacaccaccugaaauga

SEQ ID NO: 58737 - RNA, 2475 nt, Artificial Sequence
  derived and/or modified sequence opt3 from MALT1__Homo_sapiens__NP_006776
augagccugcucggcgacccccuucaggcccugccuccauccgcugcaccgaccgggcccuuguuagccccuccagcgggagcuacacugaacagacuaagggagccccuccugcggcgccuuucugaacuguuggaucaagccccugagggucgaggcuggcguagacucgcagaacuggccgggucaaggggacggcugcgccucaguugcuuagaccuggagcaguguagccuuaagguguuggaaccagagggcucccccucucugugccuacucaaacugaugggugagaagggguguacugucacggaacuuucggauuuccugcaggcuauggagcacaccgaaguuuugcagcuccugucaccuccaggaaucaaaauuacagugaauccggagagcaaggcaguauuagccggccaauuugugaaacugugcuguagagcuacuggccaucccuucguccaguaccagugguuuaagaugaacaaggagauaccuaaugggaacaccagugaacucaucuucaaugccgugcacguuaaagacgcgggauuuuaugugugcagggucaacaauaacuucacauuugaguucucccaguggucucaacuugaugugugugacauuccagagagcuuucagcgguccguagaugguguuucagaaaguaagcugcagaucugcguggaacccaccagccagaaauugaugccuggcucuacucuaguccugcaauguguggcagugggguccccaauuccccauuaccagugguucaagaaugagcucccgcugacacacgagaccaaaaagcuguauauggucccuuacguugaccuugaacaucagggaacguauuggugccacguguacaacgaucgcgacucacaagauagcaagaaaguagagaucauaaucggccgaacugacgaagccguggaguguaccgaagaugaguugaauaaccucggucaccccgacaauaaggagcagacaacugaccagccacuggcuaaagauaaggucgccuuacugauugggaacaugaauuauagagaacauccuaaacuaaaggcaccccucguggacguuuacgagcugaccaaccuuuugaggcagcuggauuuuaaaguggucagucuccuggaccuuacagaauacgagaugcggaacgcuguggaugaguuccuguugcuccuggacaagggaguauauggcuuacuguacuaugccggccacggguacgaaaauuuuggaaacucuuucaugguuccaguggaugcgcccaauccuuaucguuccgagaacugccuaugcguccaaaauauccucaagcugaugcaggaaaaagagaccggucuuaacguguucuugcuggacaugugucgcaagagaaaugauuacgacgauacgauuccaauccucgacgcccugaaagucacugcaaacauaguguuuggcuaugcuacaugccagggggccgaggcuuucgaaauucagcauagcggauuagccaauggcaucuuuaugaaguuccugaaagacaggcuuuuggaggauaagaagauuaccguucuccuggacgaaguggcagaggauauggguaaaugucaccuaacuaaggggaaacaagcccuggaaauccggucgucucucuccgagaagcgagcucugacagacccgauccagggcaccgaauacucagcggagagucuuguacgcaacuugcagugggcaaaagcccacgagcugcccgaaagcaugugcuuaaaguuugauuguggaguccagauucaacucggcuucgcugccgaguuuuccaaugugaugauaaucuacacgucuauuguuuauaagccuccagaaaucauaaugugcgacgcauacgugaccgauuucccccuggaccuugauauugacccuaaagaugccaacaaggggacaccagaggaaacuggaagcuaucuggucucaaaagacuugcccaagcauugucucuacaccagacugaguucccuacagaaacugaaggagcaccucguguuuacaguaugccugagcuaucaguacucuggucuugaggauacuguggaagacaagcaggagguuaaugucggcaaaccguugaucgcuaagcuggacaugcauaggggguuaggacggaaaaccuguuuccaaacaugccucaugucaaacggcccuuaucagaguagcgccgcaaccuccgguggggcgggccacuaccauucucugcaggauccauuucacggaguguaccacucgcaucccggcaauccuagcaacgugacucccgcugacuccugucacugcucacgcacgccagaugccuucaucaguucuuuugcacaucacgccagcugccacuucuccagaucaaacgucccuguugaaacaaccgacgagauucccuucagcuuuucugauaggcuucguaucuccgaaaaguga

SEQ ID NO: 58738 - RNA, 3051 nt, Artificial Sequence
  derived and/or modified sequence opt3 from MAML1__Homo_sapiens__NP_055572
auggugcugcccacuugcccuauggccgaguucgcucucccaagacacagcgcagucauggaaaggcuucggcgccgaaucgagcugugucguagacaucacuccacaugcgaagccagguacgaggcgguuucuccggaacgguuggaguuagagcgccagcauacuuuugcucugcaccaaagauguauucaggccaaggcaaaaagggccggcaagcaucggcagcccccugcugcaacggccccagcucccgccgcgccugcaccacgccuagacgccgcugaugggcccgaacacggacgaccugccacccaccuccaugacacagugaaaagaaaccuggauucagcaaccaguccacagaauggugaccaacagaacggcuauggggaucuuuucccgggacacaagaaaaccaggcgggaggcuccccugggcguagccauaagcuccaaugguuugccuccagcgucuccccucgggcagucggacaagccuucaggagccgaugcacugcagagcaguggcaagcauucccugggccucgacucuuuaaacaaaaagcgucuggcugauagcucccuucacuugaaugggggaucaaacccaagugaaucuuuuccccugucucuaaauaaagagcucaagcaagagccgguggaagaccugccuugcaugaucacagguaccgucggcuccauuucacagagcaaccuuaugcccgaucugaauuugaacgagcaggaauggaaagagcucaucgaagaacugaaucgcagugugccagacgaggauaugaaggacuuauucaacgaagacuuugaggaaaagaaagauccugagucuuccgggagcgccacucagacaccccuggcucaagacauuaauaucaagaccgaguucucgccagccgcauuugagcaggagcagcucggaucuccccaaguuagagccggcuccgcuggucagacguuccuugggccuucaagugcgccagugagcacugauuccccgucucugggaggcagccagaccuuguuucacacaucaggccagcccagggcagacaacccuaguccaaaucuaaugcccgccuccgcucaagcccagaacgcacagcgggcccuggcuggggucgugcucccuagccagggaccagguggcgccucugaacugucaagugcacaucaacuucagcagauagcggcuaaacagaagcgagagcaaaugcugcagaacccccagcaggccacuccggcuccugccccagggcaaaugagcaccuggcagcagacaggacccucccacucuucguuggauguaccuuaccccauggaaaaaccagcuagcccuuccucauauaagcaagacuucaccaauaguaaacuccugaugaugcccucuguuaacaagagcuccccacgcccgggcgguccuuacuuacagcccucacaugugaaucugcuaagccaccagccacccucuaaccucaaucagaacuccgccaauaaccaagggaguguccuggauuauggcaauacgaagccucuuagccauuacaaagcagacuguggacagggcucuccaggguccggacagucaaagcccgcuuugauggccuaucugccucagcaacucagucacaucagccacgagcagaacucgcuguuucuuaugaaaccgaagccagguaauaugcccuucagaucccuggugccuccaggccaggaacagaaccccucuagcgugccuguccaagcgcaggccacuucaguugggacacagccgcccgcugugaguguagcauccucucauaauagcuccccauacuugucaagccaacagcaggccgcugugaugaaacagcaccaacuccuguuagaucagcagaagcagagggagcaacagcagaagcaucugcagcaacagcaguuucuacagcggcaacagcaccuccuggccgagcaggaaaaacaacaguuccagcgccaccuuaccagaccucccccacaguaccaagacccuacucagggaaguuucccccagcaggucggccaauuuacagguucuuccgcagcggugccagggaugaacaccuugggcccgagcaauucgucaugcccuaggguuuucccccaggccggaaaccugaugccaaugggccccgggcaugcuucugugaguucccucccuacgaacagcggacagcaggaucguggugucgcccaauuuccaggcucucagaauaugccccagagcucccuguaugggauggcaucaggaauuacccaaaucguggcucagccuccgccacaggccacaaacggccacgcacauauuccccggcagacuaauguaggucaaaacaccaguguuagcgccgcuuacgggcagaauagcuuaggcuccucaggacugagucagcagcacaacaagggcacacuuaauccuggguugacuaaacccccagugccucgagucagccccgcgaugggaggccaaaacuccucuuggcagcaucaggguaugccaaaucucucggggcagaccccuggaaacagcaaugugucaccguucacagccgcauccaguuuucacaugcaacagcaggcucaccugaagaugucuagcccccaguucucccaagccgucccaaacagaccuauggcccccaugucaucugcugcagccgugggcagccuacugccaccuguuagugcgcagcagaggaccuccgcucccgccccggcaccaccucccacugccccacaacagggucuccccggccugagcccugcugggccggagcuuggagcauuuucucagucacccgccucccagaugggcgggcgcgcgggauugcauuguacgcaagcauauccagugcggacagccggccaggaacugccuuucgcauacaguggucagcccgggggaagcggcuuaucgucuguagccggucacaccgaccucaucgacucccugcuuaaaaauagaacuagcgaggaguggaugucagaucuggacgauuugcucggcagucaguga

SEQ ID NO: 58739 - RNA, 3471 nt, Artificial Sequence
  derived and/or modified sequence opt3 from MAML2__Homo_sapiens__NP_115803
augggcgacaccgccccaccucaggcuccagcagggggacuggguggcgccagcggggcgggacuccuuggcgguggguccgugacaccgagaguccacucugcuaucguugagaggcugcgggcccgcauugcagugugccgacaacaucacuugucaugugaaggacguuacgagagaggcagggccgaaaguagcgaucgggagcgcgaauccacuuuacagcugcuaucucucguacagcauggccagggggcuagaaaggcaggaaaacacacgaaggccaccgcuacagccgcgacuaccacagcacccccuccacccccugccgcuccacccgccgcaucgcaagcugccgcgaccgccgcaccuccaccgcccccugacuaucaucaccaccaucagcagcaucugcuuaacucaagcaauaacgguggcagugggggaauaaauggcgagcagcaaccacccgcuuccacuccuggugaucagaggaacucugcccugaucgcuuugcaggggagccucaaacggaaacagguggucaaucuguccccagccaacucaaaacgccccaauggauucguggacaacaguuuucuggauauuaagcgaaucagaguuggcgagaaucucagcgcaggccaagggggauuacagauuaacaauggucagucucaaaucauguccggcacacugccgaugucacaggccccucuuaggaagaccaacacguugcccagccacacucacaguccagggaauggacuguucaacaugggccuaaaagaagugaagaaagagccuggugaaacccucucuugcuccaagcacauggacgggcagaugacacaggagaauauauuucccaaccgguacggcgaugacccaggagagcaacugauggaucccgaacuucaggagcuguucaacgaauugacuaauaucagcgucccuccaaugucggaccucgagcuggaaaacaugauuaaugcuaccaucaaacaggaugacccguuuaacauugauuuaggccagcaaucucagcguuccacaccccgcccuucacugccaauggagaagaucgugauaaagagugaguauagccccgggcucacccagggaccuuccgguucuccacagcuuagacccccgagcgcgggcccugcauucucaauggccaauagugcucuguccacgagcucuccaauucccucaguaccucaaagucaggcccagccccagacugggagcggagcauccagggccuugccaucuuggcaagaaguuucgcaugcucagcagcuaaaacaaaucgccgcaaaccggcagcagcacgcgcgaaugcagcaacaucagcagcagcaccaaccuacaaauuggagcgcucugcccuccucagccggcccaaguccggguccuuuugggcaggagaagauucccucucccagcuucggccagcagaccuuuucaccccaauccagcccuaugccaggaguggcaggcgggucuggacaguccaaagucauggccaacuacauguauaaggcuggucccagugcccagggcgggcaucucgacgugcugaugcaacagaaaccucaggaccuuagccgcucuuucaucaauaacccgcacccagcaauggaacccagacagggaaauacuaagccucuguuucacuucaacuccgaucaagcuaaucagcagaugccaucaguguugcccagucagaacaaaccuagccuccugcauuacacacaacagcagcagcaacagcagcagcaacagcagcaacagcagcagcaacagcagcagcaacagcagcagcaacagcagcaacagcagcagcaacagcagcagucguccaucucugcccaacagcagcagcaacagcagagcucaauuagugcgcagcaacagcagcaacagcagcagcaacagcagcagcaacagcagcagcaacagcagcaacagcagcagcaacagcagcagccguccucucaacccgcccagagcuuaccaucccagccucugcuaaggucaccccucccacugcagcaaaaacuuuugcugcagcagaugcaaaaucagccuauagcuggcauggguuaucaggucagccagcaacagcggcaggaccagcacaguguuguggggcaaaacaccggccccucuccauccccgaacccuuguagcaaucccaacacgggaucgggcuacaugaacucacagcagucucuccugaaucagcaacuuauggggaagaagcagacccugcagcgccagaucauggagcaaaagcagcaguugcuccugcaacagcagauguuagcagaugccgaaaagauugcuccacaggaccaaaucaauagacaucugaguaggcccccuccagauuacaaggaccagcgucggaacguaggaaauaugcagcccacagcccaguauuccggcgguagcucuacuauaagccuaaacuccaaucaagcacucgcgaacccugugucaacccacacaauucugacuccgaauaguagccuuuugucuaccucccacgggacacgaaugccaucacugaguaccgccguccagaacaugggaauguacggcaaucuccccugcaaccagccuaauacuuauagcgugacguccgguaugaaccagcugacacaacagagaaaccccaaacaguuacuggcuaaucaaaacaauccaaugaugccuaggcccccaacccuuggcccuucuaacaauaacaauguugccacuuuuggggcaggaucggugggcaacagccagcaguugcgcccgaaucucacccauucaauggcuuccaugcccccacagcggacaaguaacgucaugaucaccucuaauacuacagccccuaacugggcaagccaagaggggacguccaagcagcaggaggcccugaccucagcuggagugagauuccccacuggcacaccagcggccuacaccccuaaucagucucuacaacaggcaguagguagccagcaguucagucaaagggcuguugcucccccgaaccagcugacaccagccgugcagaugcgcccuaugaaucagaugucccaaacucucaacgggcagaccaugggaccccugcgaggccuuaacuugcggccaaaucagcugagcacgcaaaucuuacccaaccucaaucagucugguaccggccugaaccagucacguacagggauuaaucagccuccgucccuuacucccaguaacuuuccaagcccuaaucaaucgucuagagccuuccagggaaccgaucacuccagcgaccuggcauuugauuucuugucacagcagaacgacaauaugggccccgcccucaacagugaugcggacuuuaucgacucucugcuaaagacagaaccugggaaugaugacuggaugaaagauauuaaccuggacgagauacucggaaauaacuccuga

SEQ ID NO: 58740 - RNA, 3402 nt, Artificial Sequence
  derived and/or modified sequence opt3 from MAML3__Homo_sapiens__NP_061187
augggcgacuucgccgcucccgcagccgcggcuaacgggagcuccaucugcauuaauucuucacugaacaguagccucggaggugccggcauaggggugaauaacaccccuaauuccacaccagcagccccgucuucgaaccaccccgcugcaggaggcuguggugggucaggaggcccuggcgggggaagcgccgcugucccaaagcauaguacuguuguggagagacuuaggcagcggaucgaagguugccgccgacaccauguaaauugugagaaccguuaccaacaggcccagguggaacagcuggaguuggaaagaagggauacggucuccuuauaucaacggacccuggagcagcgcgcgaaaaagucuggcgcagggacaggaaaacagcagcaccccagcaagccucaacaggacgccgaggcugccuccgcagaacagagaaaucauacucuaauuaugcuccaggagaccgugaaaaggaagcuggaaggcgcucggucaccacuuaacggugaucaacagaauggggccugcgacggaaacuuuagucccacaagcaagcgcauccgaaaagauauuucugcgggcauggaggccaucaauaaccugccuuccaauaugccauugccgucagcaagcccccuccaccagcuggaccugaagccuagucucccauuacaaaacucuggcacccacacucccgggcugcuugaggauuuguccaaaaacggaagacugccugaaauaaagcuaccaguuaaugguuguagcgaccucgaggauucguucacaauccugcagucuaaagaccuuaagcaggaaccccuggaugacccgaccugcauugauacguccgagacuucauugaguaaccagaauaagcucuuuagcgacaucaaccugaaugaccaagaauggcaggaguuaauugaugagcuggcuaacaccgugccugaagacgauauccaggaccucuucaaugaggauuuugaagagaaaaaggaacccgaguucucccagccagccacagagacuccucuuucucaagaaagcgcuucagucaaaagugaccccucccauagcccauuugcccacgugucuaugggcucaccccaggcaaggccuaguagcuccgggccaccguucucuaccguaucgacagccaccagccugcccuccguugcuucaacgccugcggcaccaaaccccgccaguucuccugcuaauugugccgugcagagcccacagacucccaaccaagcacauacaccgggacaggccccuccacggcccggcaaugguuacuugcuaaacccugcugccgucaccguggcaggguccgcgucaggccccguggcugucccaagcucugauauguccccugccgagcagcugaagcagauggcagcccaacagcagcaacgugcuaaacucaugcagcagaagcagcaacagcagcagcaacagcagcagcaacagcagcaacagcagcagcaacagcagcagcaacacaguaaucagacuagcaacuggucuccccugggaccaccguccucaccuuauggcgccgcauuuacagcugaaaaacccaauaguccaaugauguacccccaggccuucaacaaccagaauccuauaguuccacccauggcgaacaaucuucaaaagaccacgaugaacaauuaucugccucagaaccacaugaauaugauuaaccagcagccgaauaacuuggggaccaauagccucaacaagcaacauaauauccugacauacggaaacacuaaaccauuaacccacuuuaaugccgaccugucgcagcgcaugacacccccuguggcuaacccaaacaagaauccccuaaugccuuauauucagcaacagcagcagcaacagcagcagcaacagcagcagcaacagcagcaacagccgcccccaccucagcuccaggcacccagagcccaucuguccgaggaucagaaaaggcuuuugcugaugaagcagaaagguguaaugaaccagccaauggcuuacgccgcacucccuucucacggccaggaacaacaucccguggggcugccacggacuaccggaccgaugcagagcucagucccucccggcaguggugggaugguguccggcgcgucuccagccggacccggcuuccuugggagccagccucaggcugccaucaugaagcaaaugcugaucgaccagcgagcacaguugauugagcagcaaaagcagcaguuucuccgcgagcaaagacagcagcagcaacagcagcagcaaauacuggcugaacagcaguuacagcaaucccaucugccaaggcagcaccuacagccccaacggaauccuuacccgguucaacaggugaaccaguuccaaggaucaccacaggauaucgccgcaguccgcagccaggccgcucuccagaguaugagaacaucuaggcugauggcgcaaaaugccgguaugaugggcauugggcccucccagaacccuggaaccauggcaacugcugccgcccagagcgagaugggccuugcucccuauucgacgacaccaaccucacagccugguauguacaauaugucuacugggaugacccaaauguugcagcaccccaaccagaguggcauguccaucacacacaaucaagcacagggaccacgucagccugccagcggccagggggugggaaugguaucuggcuucggucaaagcaugcugguuaacuccgcgauaacccagcagcauccgcagaugaaagggcccgugggacaagcucucccacggccucaggccccaccacgacugcagucauuaaugggcacuguccagcaaggugcacagaguuggcagcagagaagccugcaaggcaugccugggaggacaucuggagaacuuggccccuuuaauaacggggccuccuauccguugcaggcuggacagccacgccucacgaagcaacacuucccucagggccugucacagaguguggucgacgcaaauaccgguacugugcggacacuaaaccccgccgcgauggggagacagaugaugccaagccugcccggacaacagggcaccucccaggcuaggccuaugguuaugucuggucucucgcagggcgugccggggaugcccgccuuuagccaacccccugcacagcagcagauucccucaggauccuucgccccuaguucucaaagccaggcuuacgagcgcaaugccccacaggacguauccuauaacuacucaggcgauggggcaggaggcucuuuucccggucugccugacggggcugaucuugucgacagcaucaucaaaggaggcccaggugaugaguggaugcaagaauuggacgagcuguucggcaaccccuga

SEQ ID NO: 58741 - RNA, 2997 nt, Artificial Sequence
  derived and/or modified sequence opt3 from MAMLD1__Homo_sapiens__NP_001170936
auggacgauuggaaaagcagacuggugaucaaauccaugcucccccacuucgccauggucggcaacaggcaggagccucggaaacuucaagaaucugggaccguuaagcgccgacaggaggaagaccauuuucaguucccagauauggcugacggagguuacccgaauaagauuaaacgucccugccuggaggaugugacauuggcaaugggcccuggggcccacccaucaacugcgugugcugaauuacagguacccccucugacgauaaacccaagucccgccgcaaugggaguggccggccaaagccuacuccuggagaauaacccuaugaaugguaacaucaugggguccccauuugucgugccgcagaccacagagguuggacuuaagggccccacugugccuuauuacgaaaagauuaauucugucccagcuguggaccaggagcugcaggaauugcucgaggagcugaccaaaauccaagaucccucgccuaacgaacuggaccucgagaagauuuuaggcacaaaaccagaggaaccccugguacuugaucauccgcaggcaaccuugucaacuacaccuaagcccagcguucagaugagucaccuggaaucccuagccucuagcaaagaguucgcuuccucaugcagucaggugaccgggaugagccuccaaaucccaucuuccucaacgggaauaagcuauaguaucccuucuacuuccaagcagauugucagccccucgucuuccauggcccagucaaagagucaagugcaggcgaugcugccaguggcacuucccccucugccagucccgcaguggcaucacgcccaccaguugaaagcucucgccgcaagcaagcaagguuccgcuaccaaacagcagggccccacaccuucuuggagcgggcugccacccccuggauuaucaccacccuacagaccgguuccuaguccacaucccccuccccugccacucccucccccaccgccucccuuuuccccacagagccuuauggugucuuguaugucaaguaauacucugagcggcuccaccuugagggguucucccaacgcccuacugucgagcaugacauccucaaguaaugcggcccucgggccugcaaugccauaugcucccgagaagcugccuucuccggcccuuacccaacagccacaguucggaccccagagcuccauccuggcuaacuugaugucaagcacgauuaaaacuccucaaggccaccucaugucugcccugccagcauccaaucccggcccuaguccgcccuaccggccagaaaaguuaagcucuccugggcugccccagcaguccuuuacaccacagugcucacuaauccgcagucucaccccuacuagcaaccugcuuucgcaacagcagcaacagcagcagcaacagcagcaggccaauguaauauucaaacccauuuccucuaacagcucaaagacauugaguaugaucaugcaacagggaauggcuuccucuagcccaggugcgaccgagccguuuacguucggcaacaccaagccucugucccauuuugugucagaacccgggccacagaaaaugcccagcaugccuacaaccaguagacagccaucucuccugcacuaucuucaacagcccaccccuacacaggcauccagcgccacugcuucgucaaccgccacagcaacccugcaauugcagcagcagcaacagcagcagcaacagcagccggaccacucuaguuuccuccugcagcaaaugaugcagcagccacagagguuucaacgguccgucgccagcgauucuaugcccgcuuuaccucgccagcaggaggaacaacgaagcggacugauggccaugacucccgagagacagaaugcauacauuucccagcagaugucaccauucgaggcggugcaagaacagguuacgaguaaguguagcaggaucaaggcuucuccucccuccucaaagcaucuaaugccaccucggacaggccuccugcagaacaaucuuaguccggguaugauccccuugacccgucaccagagcugcgaggggaugggcgugauuuccccaacucugggaaaacgccaaggcauauucaccucuucgccucagugucccauccucagccauucagggcagacaccacugggaagauuagacuccgucugccagcacaugcaaaguccuaaggccacucccccggaagugccacugccugguuuuugucccucuagccuuggcacucaguccuugucaccacaucagcucaggcggcccucuguaccucgaaugccgacagcauucaacaaugccgcuuggguuacggccgcagcugccgugaccacugcggucagcgggaagacaccccugagucaaguggauaacuccguccagcagcacagcccaucuggacaggccugccuacaacgcccuucagacugggaggcucaggugcccgcagccaugggcacccagguuccucuggcuaauaacccauccuuuagucuccuggguagccagucgcuuagacaaucucccgugcaggggccuguaccagucgccaauacaacuaaauucuugcagcagggcauggcauccuuuagcccccugucaccgauucaaggaaucgaaccuccaaguuacguggcggccgcugccaccgcagcugccgcaucugccguugcugcgucccaguuccccggcccuuuugacaggacggauauaccacccgaguuaccgccugccgacuuccuccggcagccccagccaccucugaacgaucuuauuagcucacccgacuguaaugagguggauuuuaucgaagcacuguugaaggggaguugcgucagcccagacgaggauugggugugcaaccuccgccugaucgacgauauucuagaacaacacgcugccgcccagaaugcuaccgcacagaacuccggacaaguaacacaggacgccggugcgcuguga

SEQ ID NO: 58742 - RNA, 1962 nt, Artificial Sequence
  derived and/or modified sequence opt3 from MAN1A1__Homo_sapiens__NP_005898
augcccgugggcgggcugcucccucuuuucagcuccccagccggagguguccugggcgggggauugggcggugggggaggcagaaagggcucugggccggcugcauuaaggcugaccgagaaauuuguucuacuccugguguucucagccuuuaucacacuuugcuucggagcgauuuucuuccugcccgacaguagcaaguugcucuccgguguacuguuucacucuucgccugcucugcagccagccgcagaucacaaacccggcccuggggcccgggcugaagacgcagccgagggacgcgcucgacguagagaagagggcgccccaggugaucccgaagcggcacucgaggacaacuuagccaggauacgggagaaucacgaacgcgcucugagagaggccaaggaaacucuucaaaaauugccugaggagauccagagggauauucugcuagaaaagaagaaaguggcacaggaccagcuccgggauaaggcuccauuccgcgggcugccgcccgucgacuuugugccuccaaucggaguugagucacgagaacccgccgaugcggccauuagagagaaaagggcaaagaucaaagaaaugaugaagcaugcuuggaacaauuacaagggcuaugccuggggccuuaacgagcugaaaccuauaagcaaagggggacacaguuccucuuuguucgguaauaucaagggcgcuacgauuguggacgcccucgauacccuguuuaucauggagaugaagcaugaauuugaggaagcaaaaagcugggucgaggaaaacuuagacuuuaaugugaacgccgagauuuccguauucgagguuaauauccgguucgucgggggacugcucucagcuuacuaucuuaguggcgaagagauauuucguaagaaagcgguggaacugggugugaaguugcuaccagcauuccacacacccagcgggauuccgugggcccugcucaacaugaagucuggcaucggacgcaauuggccuugggcuuccggcgggucaagcauucuggccgaguuuggaacucuucaccuggaguucaugcauuugagucaccucucugguaaccccaucuuugcagaaaaagugaugaauaucagaaccguccugaacaaguuagagaaaccacaaggccuguacccuaauuaucuaaaccccuccagcgggcaguggggacagcaucacguuucggugggcggucucggggauucuuucuacgaauaucugcuuaaggccugguugauguccgacaaaacagaccuggaggcuaagaagauguacuuugaugccguacaggcaauugaaacccaccucauaaggaaaucaaguagcggccugacuuacaucgcggaguggaagggaggccuucuggagcauaaaauggggcacuugacauguuucgcuggagguauguuugcccucggcgcagacgccgcuccagaagggauggcccaacauuaucuggaguuaggagcagaaauugcucggaccugccacgaguccuacaaccgaacguucaugaagcugggccccgaagccuuucgcuucgauggugggguggaggcgaucgccacuagacagaaugagaaauauuacauacuaaggccugaagucauggagaccuauauguacauguggcggcucacacaugacccaaaguaucgcaagugggcuugggaagcaguggaggcccuggaaaaccacuguagaguuaauggcggauacucuggccuuagggauguguacuugcugcacgagagcuaugacgauguccagcagucauuuuuccucgcugagacucugaaauacuuauaucugauuuucagugacgaugaccuuuugccgcucgaacauuggaucuuuaacuccgaggcccaucugcuacccauccugccuaaggauaaaaaggaaguggagauucgugaagaguga

SEQ ID NO: 58743 - RNA, 2100 nt, Artificial Sequence
  derived and/or modified sequence opt3 from MAN1B1__Homo_sapiens__NP_057303
auggccgcuugcgagggcagaaggagcggggcacugggauccucucagucagacuuccucacacccccuguggguggcgccccaugggcggucgcuaccacuguugugauguacccgcccccuccacccccuccacaccgggauuuuaucaguguaacgcuuagcuucggggaaaacuaugacaauuccaagucuuggcgccgacguucguguuggagaaaauggaagcaacugucaagguugcagcggaacaugauuuuauuucugcuagccuuccuccuguuuugcggacuucuguucuacauaaauuuggcagaucauuggaaagcccucgcuuuucgccuggaggaagaacagaagaugagacccgaaaucgcaggccugaaaccugccaacccaccggugcuccccgcuccucagaaggccgacaccgauccagagaauuuacccgagauuagcagucaaaagacacagaggcacauccagcgggguccuccacaucugcagauucgacccccgucccaagaccuuaaagaugggacucaggaagaggcgaccaagcgccaggaagcaccugucgaccccagaccagagggagauccucagaggacagugaucucuuggcggggcgccguuauagagcccgaacaaggcaccgaguugccaagccgucgcgcugaagugcccacuaaaccuccacugccgcccgccagaacacaggggaccccuguccaccuaaacuauaggcagaagggagugaucgacguauuccuccaugcauggaaagguuaccggaaguuugcuuggggccacgaugagcugaagccaguuucccgaucauucagugaaugguuugggcuuggacugacguugauugacgcccucgauacuauguggauccugggcuuacgcaaagaguucgaggaagcgagaaagugggugagcaaaaagcugcacuuugagaaagacgucgacgugaaucucuucgaaucuaccauuaggauccuuggugggcuguuguccgccuaucaucuaucaggagauagccuguuccuccggaaggcagaggacuuuggcaaccgccugaugcccgcuuucagaacaccuaguaaaauaccauacucugaugugaauauuggcacuggggucgcccaucccccgagguggaccuccgacagcacaguugcugaagugaccucgauccaacuugaguuucgugagcugucucgguugacgggagauaagaaguuccaggaagccguagagaaagugacucagcacauucacggucucuccggcaagaaagacgggcuggucccuauguuuaucaacacacacucaggauuauucacccaucugggcguguuuacucuaggugcacgagccgauaguuauuacgaauaccuccugaagcaguggauccaagggggcaaacaggagacacagcuuuuggaagacuauguugaggcuauugagggagugagaacccaucugcucaggcacagcgaaccauccaagcugacguucgucggcgagcuugcgcacgggcgcuuuucugcaaagauggaucaucugguguguuucuugcccggaacccucgcccuggguguauaccacggcuuaccugcuagccacauggaacuggcccaggagcuaauggagacaugcuaucaaaugaaucggcagauggaaacugggcucucacccgagauaguucauuuuaaccuguacccacagccuggaagaagggacguggaagucaaacccgcagaucgccacaaucuuuugcgaccagagaccguggaaagucuguucuaucucuaccgggucacaggcgaccguaaguaucaggacugggguugggagauccugcaauccuuuagcagauucacuagggugccgucugggggcuacucaaguauuaacaauguucaggauccucagaaacccgagccacgcgacaagauggagagcuucuuuuuaggagagacccugaaauaccuuuucuugcucuuuuccgaugaccccaaccugcuaucucuggaugccuauguguucaacacagaagcucauccucucccaaucuggacccccgccuga

SEQ ID NO: 58744 - RNA, 3435 nt, Artificial Sequence
  derived and/or modified sequence opt3 from MAN2A1__Homo_sapiens__NP_002363
augaagcugagcagacaguucaccguguuuggcuccgccaucuucugcgucguuaucuuuucucucuaccuuaugcuggacagggggcacuuggauuauccccggaacccucgccgagagggaucauucccacaaggucaguuaaguaugcugcaggagaaaauagaccaucuagaacgucuccuggcugaaaauaacgagaucauuagcaauaucagagauuccgugauuaaccuuucugaaucgguagaggacggcccgaagucaagccagaguaauuuuucccaaggggcaggaucucaccuguugcccagccagcucucccugucaguggauacagccgacugucuguucgcgagucagagcggcucucauaacuccgauguccagaugcucgacguguacucauuaaucagcuuugauaauccugacggugggguuuggaaacaaggauucgauauaacuuaugagaguaacgaaugggacacggagccacuucagguguuugucgugccccacucucauaaugauccuggcuggcuuaagaccuucaacgacuacuuuagggacaaaacacaguauaucuucaauaacaugguauugaagcugaaggaagauucccggcgcaaauuuauuuggagcgagaucucguaccuaucuaaguggugggacauuaucgauauacagaaaaaggacgcuguuaaaucccucauugagaauggccaacuggaaaucgugacugggggaugggucaugccagaugaggccacaccccacuauuucgcacuuauugaccagcugaucgaaggucaccagugguuggagaacaauaucggcgugaagccuagaucagggugggccauugauccauucggacauaguccgaccauggcuuaccuccugaacagggcaggcuuaagccacaugcugauacaacgggugcauuacgccgucaagaaacacuuugcucuccacaagacccuugaguucuuuuggcgccagaacugggaccuggguuccguuacugauaucuugugccauaugaugcccuucuauucuuacgacauuccucacacaugugggccagaucccaaaaucugcugucaguuugacuucaagcgacuaccuggaggcagauuuggcugcccauggggagugcccccggaaaccauacauccugggaauguacagagcagggcccggaugcugcucgaccaauaucguaaaaagucaaaacuguuccgcacgaaggugcuucuggcgcccuugggugaugacuuuagauacugugaguauacugaaugggaucuccaguucaagaacuaccagcagcuguuugacuauaugaauagucaauccaaauucaaggucaaaauucaguuuggcaccuuaagcgauuucuucgacgcacuggauaaggccgacgagacacagagggauaaagggcagucuauguuuccagugcuaucaggagacuucuuuacuuacgcugaucgggacgaucacuacuggaguggcuauuucaccagccgaccuuuuuacaagcgcauggacagaaucauggaaucccaucucagggccgcagagauccuguauuacuucgcucugcggcaagcccacaaguauaaaauuaacaaguuuuugucuucgagccuguacacagcgcucaccgaagcccgcagaaaucugggucuuuuccagcaccaugacgcaaucacggggacugcuaaagauuggguuguggucgacuauggcacaaggcuguuucacuccuugauggugcucgagaagauuauaggaaacucagccuuccuguuaauccugaaagauaagcuaaccuacgacaguuacucucccgauacuuuucucgagauggaccugaagcagaaaagccaggauucccuuccacaaaagaauauuauccguuugucagcugaaccccgguaucugguaguuuacaacccucucgagcaggaccgaaucagccuggugucugucuauguguccaguccaacaguccagguguucagcgccucuggcaaaccgguugaagugcaaguauccgcagucugggauaccgccaauacgauuucagagaccgcuuacgaaauaaguuuuagagcgcauauucccccuuuagggcugaagguguauaaaauucuugagagcgcaucguccaacucucacuuggccgacuacguucucuauaagaauaagguggaggauagcggaaucuucacaauuaaaaacaugaucaauacugaagaggguauaacccuggaaaacucauucguccuacugagguuugaccagacaggccucaugaagcagaugaugacuaaagaggaugggaagcaccaugaggugaauguacaguucaguugguacggaaccacaaucaaacgcgacaaguccggcgcuuaccuguuucuuccagacgguaacgccaaacccuauguguacaccacuccuccauucguucgggucacgcacgggagaauuuauucugaagugacaugcuuuuucgaucaugugacccacaggguccgcuuguaccauauccaaggcauugagggacagagcguugaaguguccaacaucguggacauacgaaagguauauaaucgggagauugcaaugaagaucucaagcgauauuaaaagucagaaccguuuuuacacugaccugaauggcuaucagauccaacccagaaugaccuuaucuaagcucccgcugcaggccaacgucuacccuaugacaaccauggcuuacauacaggaugccaaacacaggcuuacucuguuguccgcacagagccucggggugucgucacuaaauucuggacaaaucgaaguuauuauggaccgccggcugaugcaggaugacaacagaggucuggagcagggcauccaagauaauaagauuacagcgaaccucuucaggauccugcuugagaaacgaagugcugugaauacggaagaggaaaagaaguccgucagcuauccaucuuugcugagccacauaaccuccucauuaaugaaccaucccgugauuccuauggccaauaaauuuaguagccccacucucgagcugcagggggaguucucuccacuucaguccucacugccuugugacauccaccuaguuaaccuccgcacaauccagaguaaggugggaaauggccauagcaacgaagcagcccugauuuugcaccggaaagguuuugauugcagauucuccucuaaggggaccggccuguucuguucgacaacucaaggaaaaaucuuaguacagaagcuccugaauaaguuuauugucgagagccuuacccccucaucccugaguuugaugcauucuccaccgggcacgcagaacauaagcgaaaucaaccucuccccuauggagauuucaaccuucaggauccagcugcguuga

SEQ ID NO: 58745 - RNA, 3453 nt, Artificial Sequence
  derived and/or modified sequence opt3 from MAN2A2__Homo_sapiens__NP_006113
augaagcugaaaaagcaagugaccgucugcggcgccgcuaucuucuguguugcaguguuuagccucuaccuuaugcuggacagaguacagcacgaucccacaaggcaucagaacgggggaaauuucccucggucccagauuucuguguugcagaaccgcauagagcaauuagaacagcugcuagaggaaaaucacgagaucauuucacauaucaaagacaguguccucgaacugacugccaacgcggaggguccaccggcuaugcuucccuauuacacggugaauggcagcuggguugugccuccagagccccgaccuuccuuuuucucuauuucgccacaggauugccaguuugcccuugggggacguggccaaaagcccgaauugcagaugcucaccgucucagaggaacugccuuucgacaacguggauggugggguauggagacagggauuugacaucagcuaugauccacacgacugggaugcagaggaccugcagguuuucguggucccgcauagucacaaugaucccggcuggauaaaaacauuugacaaguacuauacugagcaaacccagcacauccucaacuccauggugucuaaguuacaggaagauccuaggcggcgcuuccugugggccgaggugagcuuuuucgcuaaauggugggacaauauuaacguccaaaagagagcagccguuaggcggcuugugggcaaugggcaguuggaaaucgcuacaggagguuggguaaugccagacgaggccaacucccauuacuuugcgcugauugaucagcuaaucgaaggccaccaguggcucgagcgcaaucugggggcaacuccccgaucaggaugggccguggacccuuucggcuauaguagcaccaugccauaccuucugagaagggcuaacuugacaucuaugcucauacaacggguccauuacgccauuaaaaagcacuucgcagcuacccacucccuggaguuuauguggcgucagacgugggauucagacagcaguacugauaucuucugucauaugaugcccuuuuauucuuacgacgugccgcauaccugcgguccugaucccaaaauuuguugccaguucgacuuuaagcgcuuaccagggggaagaaucaauuguccuuggaagguucccccaagggccaucacagaagcgaacguggccgagcgggcagcucugcuccuugaucaguaucgaaagaaaucccaacuguuccgcagcaacgucuugcuagugccccugggcgacgauuuuagauacgacaaaccucaggaaugggacgcccaguucuuuaauuaucagagacucuucgacuuuuucaacucgcggccaaaucugcacguacaagcucaguuuggcacucuuucugauuacuucgaugcccuguauaagcgcaccgggguugagccgggagcaagacccccugguuucccaguguuguccggcgacuuuuucucauacgccgauagggaagaccacuacuggacaggguauuacaccagucgucccuuuuauaaaagccucgaucggguccuggaggcucauuuacgaggagcggaggugcuguacucccuagcagccgcucacgccagaaggucuggccucgcaggucgcuauccucugagcgacuucacgcuuuugacugaagcccggagaacacuggggcucuuucagcaccaugaugcuauuaccggcacugccaaggaggcagucgugguugacuacggagugaggcugcuucgcucacugguaaacuugaaacaggucauaauccacgcggcucauuaucucgugcugggcgauaaggaaacauaccacuucgacccagaggcccccuuuuuacaaguugaugacacccgacugagucacgacgcacuaccggaacggacggugauucagcucgauuccagcccucguuucgucgugcuguuuaauccacuugagcaggagagauucucuaugguaucauugcuggugaacagucccaggguucgcguccucagcgaagaggggcaaccucuggccgugcagaucuccgcucauuggucuucggccaccgaagcagugcccgacgucuaccagguuagcgugccagugcgguuaccugcucugggacuugguguauugcagcuccaacugggccuagaugggcacagaacacugcccuccucagucaggauauaucuccauggacgacagcugagugugucucgccacgaggccuuuccacuucggguuauugacagcggcacuuccgauuucgcguugucaaauagauacaugcaggucugguuuagcggucugaccggguuacucaagucuaucaggcguguggacgaggaacaugagcagcaaguggauaugcagguucugguguauggcacacgcacuuccaaagacaagaguggagccuaccuuuuccugccggauggcgaagcuaaaccuuauguacccaaggagccacccgucuugcgggugaccgaagggccuuucuuuagcgagguggucgcauacuaugagcacauccaccaggccguuagacucuacaaccugccaggaguggaaggucuaucucuggacauuuccucacucguagauaucagggacuacgugaauaaagagcuggcucugcauauucacacagauauagacagucagggcaucuucuuuaccgacuugaacggguuccaaguccagccccgacgguaucugaagaaguuaccucuccaggccaauuuuuacccgaugccagugauggcauauauucaagaugcgcagaaacgccugacucuucauacggcccaggcucugggaguuagcucgcuaaaggacggccagcucgaagugauccuggauagaagguugaugcaagacgauaaccggggucuggggcagggcuuaaaagacaauaagcgaacaugcaacagauuccgccuccugcuugagaggcguaccgucggauccgaagugcaggauucucacagcacuucauaccccagucuguugucccaucucaccucuauguaucugaaugccccugcacuagcucugccaguugcccggaugcagcuucccggcccugggcucaggagcuuucacccgcuggcauccucauugcccugugacuuccaccuguuaaaccucaggacacugcaagccgaggaggauacccuuccaagcgcugaaacugcgcugaucuugcaucgcaaaggauuugacugcggccucgaggccaagaaccuggguuucaauuguacaacgagucaggggaagguggcacuaggaucucuguuucacggccuugaugucguauuccuccagccuaccucccugacuuuguuauacccccuggcuagcccaucgaacucaacagacguguaucucgaaccuauggagauugccaccuuccgacugagacuugguuga

SEQ ID NO: 58746 - RNA, 3036 nt, Artificial Sequence
  derived and/or modified sequence opt3 from MAN2B1__Homo_sapiens__NP_000519
augggcgccuacgcuagagcaagcggggugugcgccaggggaugucuggacuccgcgggucccuggaccaugucucgggcucuccgcccuccacuuccgccccugugcuucuuuuuguuacugcuagccgcagccggcgcucgagcagggggauaugagacauguccuacuguccagccaaacaugcucaauguucaucugcuuccccacacgcacgaugacgugggcuggcugaagaccguagaucaauacuucuaugguaucaaaaacgacauucagcaugccggggugcaguacauauuggauucagucaucagugcucuccuggccgacccuacacguagauuuauuuauguggaaaucgcguucuuuucaaggugguggcaccagcaaacuaaugcaacccaggagguugugcgggaucugguccgccagggaagacucgaauuugccaacggcggcugggugaugaaugacgaggcugccacacauuacggggcaauuguagaucagaugaccuuaggacugagguuucuugaagacacuuucgguaacgauggccggccacgcguugcuuggcacaucgaccccuuugggcacucccgagagcaagccucuuuguucgcgcagaugggauuugauggcuucuuuuucgguagacuggacuaucaggacaagugggugaggaugcagaaacuagagauggaacaagucuggcgggccucgacaucacucaagccuccaaccgcagaucuguucacgggggugcuuccgaauggauacaaucccccucguaaccugugcugggacguguugugugucgaucagccacucguugaggacccccgcagcccugaauacaacgcuaaagagcugguggauuauuucuuaaauguagccacugcucagggcagauacuauaggaccaaccauacagugaugacuaugggcagugacuuccaauacgagaaugccaacaugugguuuaagaaucuggauaagcucauacggcuugucaacgcacagcaggccaaaggguccucugugcacguucuguauagcaccccagcuugcuacuugugggaacuaaacaaggcgaaucugacaugguccgugaaacaugacgauuucuuucccuaugcagacggaccgcaccaguucuggaccgguuacuuuucaagucgaccugcccucaagcgcuacgagagacugagcuauaacuuccuucaagucuguaaucagcuggaagcucuugugggccucgccgcaaacguagggcccuacggaucuggcgauuccgccccacugaaugaggcuauggccguuuuacagcaccaugacgcagugucagguacgagcaggcagcacgucgcgaacgacuaugcucggcaacuggccgcaggguggggcccuugcgaagugcuacucaguaaugcccuggcucgccuuagaggauuuaaagaucauuucacuuuuugucagcaguugaacaucucuauuugcccccugucccagacagccgcaagguuccaagucaucguguacaauccacucggccguaagguuaacuggauggugcggcugcccguaagcgagggggucuuugugguuaaggacccuaauggacgaaccgugccaucggaugucgugauuuucccgucuuccgacucacaggcucaucccccugagcuucuguucagugccagcuugccagcgcucgguuuuuccacuuauucuguagcccaggugcccagauggaaaccucaggcuagggcaccacaacccaucccgcgccggagcuggagcccugcccugacaauagaaaacgagcacauuagagcuaccuucgauccagacacgggcuuacugauggaaaucaugaauaugaaccagcagcuacuccugcccguuaggcaaaccuuuuucugguacaaugccaguauuggggauaacgaguccgaccaggcaagcggagcguauaucuuucgcccuaaccagcagaagccccuuccagucucucgaugggcccaaauccacuuggugaaaacaccucuggugcaggaaguccaccagaauuucucagcuugguguagucagguugugcggcucuaccccggccaacgucaucuggaguuagaguggagcguggguccaauuccgguaggggauacuuggggcaaggaagucauauccagauuugacaccccucuggagacaaaaggaagguucuacacugauucuaacggccgcgaaauccuugagcggagaagggacuaucgacccaccuggaaguugaaucagacagaaccaguggccgggaacuacuaucccguuaauacccgcauuuacaucacugauggaaacaugcagcucacggugcugacagaccggucgcaggguggcagcucccuaagagacgggucacuggagcucaugguccacaggcgucugcuuaaagaugacggacgcggcgugagugagccuuugauggaaaaugguucuggggcauggguucggggcagacaucugguguuacucgauaccgcucaagccgcagccgcuggacacaggcugcuugcggagcaggaaguacuggccccacaggucguguuggcacccggcgggggagcugccuauaaccucggcgccccuccgcgaacucaauuuagcggucugcggcgcgaccuaccacccuccgugcaucugcucacccuggcuucaugggggccugagaugguccuuuugagacuggagcaccaguucgcaguuggagaagauagcggcaggaauuuaucugccccagugacacucaaccugcgggacuuguuuuccaccuucacuauaacacgacugcaggagacgacccuaguagcgaaucagcucagagaagcugccagucgccugaaguggacuacaaacaccggucccacaccucaccaaacuccguaccaguuggaucccgcaaauauuacccuggagccaauggaaaucaggacguuuuuagccagcgugcaguggaaggaggucgacggcuga

SEQ ID NO: 58747 - RNA, 3174 nt, Artificial Sequence
  derived and/or modified sequence opt3 from MAN2C1__Homo_sapiens__NP_001243423
auggccgcugcacccgcccugaagcacuggagaaccacacucgagaggguggaaaaauucgucagcccucuuuacuuuacugacugcaaccugcggggccgcuuguucggggcguccuguccaguugcuguguuaucuucauuucugacgccggagcgacuacccuaucaggaagccguacaacgugauuucagaccugcacaggugggagacaguuuugguccaaccugguggacaugcugguucagggucgagcucacuauccccgaagccugggugggccaggagguucaucuguguugggagagcgauggggaaggacuuguguggcgggacggcgagccuguccagggucugaccaaggaaggggagaaaacauccuacguguugaccgaucgccucggagagagagacccaaggucucugacucuguauguagaaguugcuugcaauggccucuuaggcgcagggaagggaucgaugauugccgcucccgauccugagaaaauguuucaacugucacgggccgaacuugcgguguuccaccgcgacguccauauguugcugguggaucuagagcuccugcuugguauagcaaagggccuggggaaggacaaccagcgaaguuuucaggccuuguacacagcuaaucagauggugaacgucugugauccagcccaaccggaaaccuuccccguugcacaggcucucgccagcagauuuuucggacagcacggcggugagucccagcauacgauccacgcgacugggcacugccauauugacaccgccuggcuguggccuuuuaaagagacagugaggaagugugcacggucuuggguaacugcuuuacaacugauggaacguaauccagaguucaucuucgccugcagccaggcucagcaacucgaaugggugaaaucccgcuaucccggacuuuacucaaggauucaggaguuugccuguagaggccaguucgucccugugggcgggaccuggguugaaauggauggaaaccugccaaguggugaggcaauggugcggcaguuuuugcaaggccagaauuucuuucuacaggaguucgggaagaugugcagcgaauuuuggcugcccgacacauucggauauucugcccagcucccgcaaaucaugcacggcugugguauacgacgcuuucugacccagaaacuuuccuggaaccuggucaauucauucccucaucacacguuuuucugggagggguuggacggcagcagagugcucguacacuuucccccaggagauaguuacggcaugcaggggucuguugaagaggugcugaagacugucgcuaacaauagggacaagggacgggcgaaccauuccgcauucuuauucgguuuuggcgaugggggaggcgguccuacacagaccaugcuggaccgccuaaaaagacucagcaauacugaugggcugcccagggugcaacuuucgucuccacgucaguuguucuccgcccuggaaucagacagugagcagcucugcacaugggucggcgagcuguuucuugaacugcacaacggaaccuacacgacccaugcucagaucaagaaaggcaaucgggagugcgaacgaauuuugcacgauguggagcuccugagcuccuuagcccuggcaagaucugcccaauuccuauaucccgcugcccagcuccagcaucuguggaggcuuuugcugcucaaccaauuucacgacguugugacagggagcuguauccagaugguagcagaggaagcgaugugccacuacgaggauauucgcucacauggaaacacucuguuaagugcugccgcagccgcucugugugccggugaaccuggcccagaggggcuuuugaucgucaauacccucccguggaagcggauagaagugauggcacugcccaaaccuggaggcgcucacucccuaggucugacaccaagccccggggacucugcccagcauggccucugcucauguaguagcccucaccugacugcggccccagcugcacccgccgcuugcguuagauccgccagggcaccgaccgauucugcgucgcgcccuccacccacaaagaccgacggaagcgugacucuugacaacggcauuauccgagucaaauuggauccuacggggcggcugacauccuuagugcucguagccucaggacgugaggcuauugccgagggcgcaguggguaaucaguucguucuguuugacgaugucccccuuuauugggacgcuugggaugugauggacuaccaccuggaaaccagaaagccaguguuggggcaagccggaacucucgcagucggcaccgaggguggccugagggggagugccugguuccuacugcagaucucuccuaacagccgccucucccaggaaguugugcuggaugugggaugucccuauguacgguuucauacagagguccacuggcaugaagcucacaaguuccuuaaaguggaguuuccagcgagaguuaggucaagccaggccaccuacgagauccaauucggccauuugcagcgaccgacucacuauaauacaucuugggacugggcacgcuuugaagugugggcucaccgguggauggaucuguccgagcauggguucggauuagcccuccugaacgacugcaaguacggcgccagugucagagguagcauucuuucucugucccuacucagggcuccuaaagcacccgaugccacggcggacaccgggcgucacgaguucacuuacgcucugaugccacauaagggaucauuucaggaugccggcgugauacaggcagccuauaguuugaauuucccccuguuagcucucccugcaccaagccccgccccugcgacaucgugguccgcuuuuucuguuagcucaccggccgugguacuggaaaccgucaaacaagcagaaaguuccccacagcgccggucucuugugcugagauuguacgaggcccacgguagccauguggacuguuggcuccaccugucccuacccguccaggaggcuauccugugcgaccuucucgaaaggccugauccagccggccaccugacauugcgagacaaccggcugaaguuaacuuucucacccuuucaaguucucagccugcuucugguguugcagccuccgccccauuga

SEQ ID NO: 58748 - RNA, 2640 nt, Artificial Sequence
  derived and/or modified sequence opt3 from MANBA__Homo_sapiens__NP_005899
augagacugcaccuccuucuguuguuagcccugugcggcgcugggaccacagcagccgagcuaagcuacucccucaggggaaacuggucuaucuguaaugguaacggcucacuggaacuucccggggcggugccuggaugcguccauagugcucuguuccagcaaggcuugauucaggacagcuauuaccgguuuaaugaucucaacuaucgcuggguuucccuggacaauuggacuuacucuaaggaguucaaaauaccauuugaaaucucgaaguggcagaaagugaaccugauucucgaggguguagauacggugucaaagaucuuauucaaugaagucaccauuggggagacagacaacauguuuaaucgauauagcuucgauaucacuaacgugguucgugacgugaauaguauagagcugagauuucaguccgccguccuuuacgcagcccaacagucuaaagcucacaccagguaucaggugccgcccgauuguccuccauugguacagaagggagaaugccauguuaacuucgugcggaaggagcaauguagcuuuuccugggacuggggccccucauucccuacacagggcaucuggaaagauguccgcauugaagcauacaauaucugccaccugaacuacuuuaccuucaguccaauuuaugacaagagcgcccaggaguggaaucuagagaucgaaucuacuuuugaugugguguccucaaaacccgucgggggacagguuauaguggcuauuccuaagcuccaaacacagcagaccuacagcaucgagcugcaaccagguaaaagaauuguagaacuuuucgugaacaucaguaagaacaucacggucgagacuugguggccgcauggccacgggaaucagaccggauauaacaugacagugcuguucgaauuggacggcggucucaauauugagaagucugccaaaguuuacuuuaggacuguggagcugauagaggaacccaucaagggguccccuggauugagcuucuauuuuaaaauuaacggcuucccaaucuuucugaagggcucgaauuggauacccgcggauucuuuccaggaccgggucaccuccgaacuccuucgccuguugcuacagucagugguagacgcaaacaugaauacacugcgaguuugggguggagguauuuacgagcaagaugaauuuuaugagcucugugacgagcugggcaucaugguguggcaggauuucauguuugccugcgcucuuuacccuaccgaccagggguuccuggauagugucacggccgaaguggcauaccagaucaaaagauuaaagagccacccauccauuaucauuuggucuggaaacaaugagaacgaagaggcucucaugaugaauugguaucauaucagcuuuacugacaggcccauauacauuaaagauuaugucacacuguacgugaagaacauccgggaauuaguucuggccggcgacaagucacguccguucaucaccaguuccccuacuaauggugcggagacaguggccgaggcauggguaagccaaaaccccaauucuaacuauuuuggggauguccacuucuacgacuauauuucagauuguuggaacuggaaaguguucccaaaggcucgcuuugccagugaauacggcuaccagagcuggccuuccuucucuacccuagagaaaguuucgagcacggaagacugguccuuuaauucaaaguucagucuccauagacagcaccacgagggaggcaacaaacagaugcuguaucaagcugggcuucauuuuaaguugccccagucuaccgacccacugaggacauucaaggauacuauauaccucacccaggugaugcaggcccaaugcgucaaaacagagacugaauuuuaucggcgaagccgcuccgagaucguggaccagcagggacacaccaugggugcacuguacuggcaacuuaaugauauuuggcaggcccccucaugggcuagccuggaauauggcgggaaguggaaaauguugcauuacuucgcgcagaacuuuuucgcaccucuccugccaguaggauuugagaaugaaaacacauucuauaucuacggcgugucugacuuacacuccgauuacaguaugacccugagcguuagaguccauacuuggucuucccuagagccgguguguucaagggugacggagcgguuugucaugaaggguggggaagccguuugccucuaugaggaacccgugagugagcugcuucgcagaugcggcaauuguacaagggaaagcugcgugguaucguucuacuuguccgcugaccacgagcugcucucuccuaccaacuaucacuuccugagcucaccaaaagaggccgucggauuauguaaggcacagauuacugccaucauaagucaacagggcgauaucuuuguguucgaccuggaaaccuccgcuguugcccccuuuguguggcuugaugucgggucuauuccuggacguuucagcgacaauggguuuuugaugacagagaagacccggacuauccucuucuacccaugggaacccacauccaaaaacgagcuggaacagucauuucaugugacgagccuaaccgauauuuauuga

SEQ ID NO: 58749 - RNA, 1389 nt, Artificial Sequence
  derived and/or modified sequence opt3 from MANEA__Homo_sapiens__NP_078917
auggccaaguucagaaggcggaccugcaucauucuggcucucuuuauacuuuucaucuuuagccugaugaugggcuugaaaauguuacgccccaacacagcaacuuucggggccccuuuuggacuggaccuacucccagagcugcaccagcgaacgauucaucuugguaagaauuucgauuuucaaaaauccgaccguaucaacucugaaaccaauacaaagaaccugaaaucaguggagauuacuaugaagccgaguaaggcgagcgaauugaaucucgaugagcugcccccucugaacaauuaccuccacgucuucuauuacuccugguauggcaacccacaguuugacgggaaauacauccauuggaaucaccccguuuuagaacauugggauccuagaauagcuaagaacuauccacagggaaggcacaaucccccugacgauaucgguucuucguucuacccagagcugggcucauauagcagucgggacccguccgugauugagacccacaugcgccagaugagaucugccagcaucgggguacuugcauuguccugguaucccccugaugugaacgacgaaaauggagagccaacagauaaccugguccccaccauucuagacaaagcccauaaguacaaucucaaagugacuuuucacaucgaaccuuacucaaacagggaugaccaaaacauguacaagaauguuaaguauauaauugacaaauacggcaaccauccagcuuucuaucgguacaagacaaaaaccggcaaugcacugcccauguuuuauguguacgauaguuacaucacgaagccggagaaaugggccaaccuucugacuaccagcgggucucgcuccauucgaaauucaccuuaugacggauuguucaucgcucuccuggucgaggaaaagcacaaauacgauaucuuacagagcgguuucgacggcauuuauacauacuuugccacuaacggguucaccuauggaaguucucaccagaauugggcgucccugaagcucuuuugugauaaguacaaccuuauauucauccccagcgugggcccagguuauauugacacaucgaucagaccuuggaauacccagaacacgaggaaucggauaaacgggaaauacuacgagauuggacugucugcagccuugcaaacucgucccucccuaaucucaaucacaaguuuuaaugaauggcaugagggcacccagauugaaaaggcuguaccaaaacgcacuagcaacacaguuuaucuggauuacagaccccacaagccuggccucuaucuggagcuuaccaggaaaugguccgagaaguacucuaaggaacgggccacguaugcacuggaccgacaguugccagugagcuga

SEQ ID NO: 58750 - RNA, 558 nt, Artificial Sequence
  derived and/or modified sequence opt3 from MANF__Homo_sapiens__NP_006001
augagaaggaugcggcgcaugugggccacccagggccuggcuguggcacucgcccuuagcguccugcccgggucccgagcguugcguccuggagacugcgagguuuguaucucuuacuuagguagauucuaucaagaucugaaggacagggaugugacauuuucaccagcuacuauugaaaacgagcuaauaaaauucugccgggaagcccgcggcaaggagaauagacucuguuacuauaucggggcaacggacgaugccgcuaccaaaauuaucaacgaaguaaguaagccgcuggcacaccauauucccguggagaaaaucugcgagaaacuuaagaagaaggacagccagauaugugaacugaaauacgauaagcagaucgacuuguccacagucgaucucaaaaagcugagggugaaggagcugaaaaagauucucgacgauuggggagaaacuugcaaaggcugugccgagaagucugacuauauccggaaaauuaaugaguuaaugccuaaguacgcuccaaaagccgcgucggcacgcaccgaucuguga

SEQ ID NO: 58751 - RNA, 1296 nt, Artificial Sequence
  derived and/or modified sequence opt3 from MANSC1__Homo_sapiens__NP_060520
auguucuuuggcggggagggaagccugaccuacacacucgugaucauuugcuuccuuacucugagauuguccgccucucagaacuguuuaaagaaaucacuggaagacgucguuauagauauccaaaguagccuauccaaggguauuaggggcaaugagcccguguauacgucuacccaggaagacugcaucaacucguguugcucaacuaaaaauauuagcggggauaaggcuuguaaccucaugaucuuugacacacggaaaaccgcacgccagccuaauugcuaccuguucuuuuguccaaacgaggaagccugcccgcuuaagcccgcgaagggacugaugaguuaucgaauaaucacagauuucccuuccuugacccguaaucucccaucucaggagcugccccaagaggacagccugcuccacggccaguuuucccaggcuguaacuccuuuagcccaucaccauacagauuacucaaaaccaaccgacauuaguuggagagauacgcugagccagaaguucgguucuuccgaccaccuugaaaaauuguuuaagauggaugaggcaucagcccaacugcuagcuuauaaagaaaaggggcauagccagaguucucaguucuccagcgaccaggagaucgcacaccuccugcccgagaacgugucggcccuuccugcuacugucgccguggcgucuccacacaccacauccgcaacuccgaagcccgccacccuguugccuacaaaugcuucaguuaccccaaguggaacgagccaaccccagcucgccacuacagcaccuccagugaccacugucacaucccagcccccgaccacgcugauuucuaccguguuuacaagggcugccgcgacuuuacaagccauggcaaccacagcuguacugacuaccacauuccaggccccuaccgauagcaaaggcucacucgaaacuauccccuuuacggagauaaguaaccuuacacugaauaccggcaacguuuacaauccaacugcuuuguccaugagcaacguggaaucuucaaccaugaauaagacagccaguugggaggggcgggaagcaagcccuggauccucuucgcaggguagcguccccgagaaccaguauggccuaccauucgagaaauggcugcucauugggucccugcuuuucggagugcuguuuuuggugaucggccucguccuguuaggucgcauucugucagaaagucuaagaaggaagcgguacucucgccucgacuaccugaucaacgggaucuauguugacauuuga

SEQ ID NO: 58752 - RNA, 1584 nt, Artificial Sequence
  derived and/or modified sequence opt3 from MAOA__Homo_sapiens__NP_000231
auggagaaccaggaaaaggccagcaucgcuggccacauguucgacguggucguuauugggggagguauauccggccugucugcagccaaacuccuuaccgaguacggggugucaguacugguguuggaagcgagagauagggucggaggccggacauauacuauccgcaaugagcauguggacuacguugauguggguggggcuuaugucggacccacgcaaaaccgaauuuuacgucugaguaaggaacuaggcaucgagaccuacaaagugaauguaagcgagagacucguucaguaugugaagggcaaaacauacccuuuuaggggagccuucccaccggucuggaaccccauugcauaucuggacuacaauaaccuuuggcggacuaucgauaauauggggaaggaaauaccuaccgacgccccaugggaggcucagcacgcagauaagugggacaaaaugacaaugaaggaacugaucgauaaaauuugcuggaccaagacugcccgcagauuugcuuacuuguucgugaacaucaaugugacauccgagccccaugaggucucugcccucugguuucugugguauguuaaacagugugguggcaccacgaggauuuucucggugacuaacgggggacaagaacggaaguuuguaggcgguucaggacaggugagcgagcgcaucauggaccugcucggggaucaggucaaguuaaaucacccugugacccauguugaccagaguuccgauaacauaauuaucgaaacacugaaucacgagcacuacgaaugcaaauaugugauuaacgcgaucccacccacucuuaccgcaaagauccauuuccgaccugaguugccagccgagagaaaucaacugauucagaggcuaccgaugggcgcugucauaaaauguaugauguacuauaaggaagccuuuuggaaaaagaaagacuacugcggcuguaugaucauugaggacgaagaugcacccaucucuauaacacucgacgauaccaagccugacgggagccugccagcuauuaugggauucauccuugcccggaaggcggaucgucuggccaaauugcacaaggagauccgcaaaaagaaaauuugcgaacucuaugcaaaggugcuggguucccaggaggcuuuacaucccguacacuacgaggaaaagaacuggugugaggaacaguacucaggcgggugcuauacggccuacuuuccuccaggaaucaugacucaauauggcagaguuauuaggcagcccgugggucggauauucuuugcugggacagagaccgccacuaaauggaguggcuacauggaaggagcagucgaggccggcgagcgagcugcgcgcgaagugcugaacgggcucggaaaggucacagagaaagacaucugggugcaggaaccggagagcaaggauguuccugcaguggagauuacccacacguucugggaaagaaaucuucccucuguauccggucuguugaaaaucaucggcuucucaaccagcgucacagcccuaggguuugugcuguauaaguacaagcuccugccaaggaguuga

SEQ ID NO: 58753 - RNA, 1563 nt, Artificial Sequence
  derived and/or modified sequence opt3 from MAOB__Homo_sapiens__NP_000889
augagcaacaagugcgacguggucguugugggcgggggaaucuccgguauggccgcugcaaaacugcuccacgauucuggccuuaauguagugguccuggaggccagagacaggguugggggacggaccuacacauugcgcaaccagaaggugaaauauguggauuuaggcgguucauacgucgggcccacucaaaaucgaauccugcgucuagcgaaggaacucggacuggagacguauaaagugaacgaaguagagagacuuauacaucacguuaagggcaagaguuacccuuucaggggcccauuuccgcccguguggaauccuaucaccuaucuggaccauaacaauuucuggcggacaauggaugacauggggcgcgaaauuccaagcgaugcucccuggaaagccccuuuggcagaggagugggacaacaugacuaugaaggaacuccuggauaaacuguguuggaccgaguccgccaagcagcucgcuacauuauuugucaaucugugcgugaccgcagaaacucacgaggugucugcccuuugguucuugugguacgucaaacaguguggagguacaaccagaaucauuucgacgacuaacggcgggcaggagaggaaguuuguuggaggcucaggucaagugagcgaacggaucauggaccugcuaggggaucgcguaaagcucgagcgaccagugauauauaucgaccagaccagagaaaauguccugguggagacacuuaaccaugaaauguacgaggcuaaauacguuauuagugccauucccccuacucugggaaugaagauucacuucaauccaccguugcccaugaugaggaaccagaugaucacccgggugccucucggcuccgucauaaaaugcauuguguauuacaaggagccauuuuggcguaaaaaggauuauuguggcacaaugaucauugacggggaagaggcgcccguagcauacacccuggacgauacgaaaccugaaggaaauuaugccgcuaucauggguuucaucuuagcccacaaggcacgcaagcuggcuagacucacuaaagaggaaaggcuuaagaaacugugcgaguuguacgccaagguucuaggcucucuggaggcgcucgaaccagugcauuaugaggagaaaaacuggugugaagaacaguacagcgggggaugcuacacaaccuauuuucccccgggcauucugacucaauacggucggguccuucgacagccuguggaccgcauauauuucgccgggacagagaccgcaacgcacugguccggcuacauggagggagcugucgaagccggcgagagagcugccagggaaauccugcaugcaauggggaagauucccgaggaugagaucuggcagucagaaccagagaguguggacguuccugcccagcccauaaccacaaccuuuuuggaacggcaccucccaagcgugcccggacuguuacgccugauuggucuaacuacaaucuucucugcuacugcgcucggcuuucuggcacacaagagagggcuuuugguaagggucuga

SEQ ID NO: 58754 - RNA, 3144 nt, Artificial Sequence
  derived and/or modified sequence opt3 from MAP10__Homo_sapiens__NP_061963
auggcccacugcggccagcugaccaacuggcucugucuugcuugggagagaaaggaaagccccgacuuccuguccaucuuuuugagguacauugauuuaacaccuaaacugcauaagauaugcucugacaaaacuaucacgcaaaagacccacugucuacucccacugauuucaagugcacuuagcuccaucgugcugauucaggggugguggcagaaaacagcccauaaguaugcguacaagggagcuaaacacaucgagcagcaaaauccgcagucucggcaucgcccccgaccugccggugcauugccacagauaucgcgugauucaagacagaggugccuccugcugcgguuccucguccgccccagaggcuuuagcuucaguuuugccgaaccugcugcagccuucccaggggcuacugccauggcggcauccuuaucugagaggcuguuuagccuugaauugcugguugacugggugcggcuagaggcccgccuccugcccuccccugcugccgcaguagagcaagaagaggaagaggaggaaaaggagcagggagaggcuucaaguccacgaggccuuuguccggccguggcguucagacuguuggauuuucccacccuccuggucuauccuccagacggucccggggccccugcagcugaaccauggcccggagugaucagguucggccggggcaaaagcugcuuauuucgucugcagccggccacacuccacugucgccuucugagaaccccuuuggcuacucuacugcuccagcugcccccagggaggccuacacccaccccacaacuucugggagccugcgauauuucuuuggcaacggccgcucaccggguugugggucccgcggcauccggcuguucacaucgacaccgcgggagauucccucuccauaacagggucggagaacggacuggcgacaucgcccuggcuuaccgcuuaaccgaucuggguagcagacuacucagucagcuggagaggccacuuacauuuacucguaccgggggaggcgccgaggugucuccgcagacacaacaggaacggcagcaguugcaacagcccgcaucccagccuagcccaaaggaggccgacaaaccccugggcgaacucgagauuccugaagcucagaaggaucugaaggagaugguaaaaucgaaggccgagugcgacaauguugggucuguggaaaacggaaaaaccaauuccgucgugacguguucaggugcaggcaacgggcgaaaugugaguagccuuaacgaggaagucacugagcuggauauggaaacaaauaucuucugcccacccccguuguauuacaccaaccucacucaagagaagccuccacccgcgcaggcuaaaauaacaauugagccucagaugaaugcccccgaagagauggacgacgcauccccagaaaagaaaagaguuaacccucccgcccacaggucuugccugaagcacccaagcucagcugcccaugagcacccgccuauguuagugaaucccccacauauccagaacauuggagcaaccaaucaaacgugucagaccgagcagaaccgcaucaacacaauccggcagcugccccuacucaaugcucugcuuguagaauugagucugcucuaugaucaaccugugacuuccccagcccacauucauccccaccuggcgugguuauacagaaccgaggacaagaaaagcccugaaucuucagccaagaguacaugcaggagcgaggcuaaaaaggauaaacgcuccgucggcgguugugaaaagucugugucgcugcaguacaagaaaaaccagauagagaauuauaaggaggacaaauacagcgaaaaguccucaggggcacuucacaaacgaguuccgaagggccgguugcucuauggacugacuaacacccuacgucugagacucaagcugacaaauccagauaugcuugugguccaugagaaaagggaauuguaccgcaagcggcaaagucagaugcugggcaccaaauucagaauccccucuagcaaggugaaauuacucuccucagccgagcagagccagaagccucaacugccagaagacaaguaucuugauucugacgcuuccuuuacugagaacagugauacgagcaggcagauuucugggguauucgacgagcccuccacaucaaaagaaaccaagcugaaauacgccacugagaagaaaaccguugauugcaguaagaaucgaaucaacaaugugagcuuggaagaggucgugucgccugcaaacuccauaauuccggaacgccucacacccaccaauauccugggagguaacgucgagaugaaaauccagucuccauguguguuucagcaagacgcgguuguggaccggauuguagauaaggagaucgacauuagacaggucaagacuacagauaaugacauacuaauggccgauaucagcgacaaaaggacgggcaagaacucaugcuaugaaaauauuagugagcugaaauacuccgaugaccucucuagcccuuguuacuccgaagauuucugcaccucagaggacacuagccguaguuuuaaggcucacgauucuuccagccgcacagagaaccccaaacauucgcaguauaccucaaagucuagugacacagggguguccaagaaaaagaacagcucugaucggagcuccauccugucaccaccuuucagugccggaagccccguucacucuuacagaaaauuucacaucuccaagacucaggacaaaucacuugaagaggcaaguagcauuuccgcuucugacuugucgagcacccauuggacggaacaaaaggagaaucagauagaucagaacucaaugcacaauuccgaaaucaccaagagggcccaagacauuagugugaaaacacgaucuagcuggaagucccuggagaaaucacagucuccacagacuagccaggucaguuccuauuuaccgagcaacgugucugagcucaauguacuggauucauccaccagugaccauuucgaagagggcaacgaugacguggguagccuuaauaucucgaagcaauguaaagauauuugcgaacugguuaucaacaagcuaccuggguacacaauguga

SEQ ID NO: 58755 - RNA, 8412 nt, Artificial Sequence
  derived and/or modified sequence opt3 from MAP1A__Homo_sapiens__NP_002364
auggacggcguggccgaguucagcgaauacgucuccgaaaccguugaugugcccucuccuuuugaccugcucgaaccaccgaccucagggggauuccuuaagcugaguaaacccugcuguuauaucuuuccugguggcagaggggauagcgcuuuguucgccguaaacggauuuaauauuuuaguggacggcgguuccgauaggaagucuugcuucuggaaacugguccggcaccuagaccgcauagauucggugcuccugacucauaucggggccgacaaccuuccaggaauuaauggccuguugcagcgaaagguugcggagcucgaagaggagcaaucacagggcagcaguuccuacucugauugggugaaaaaccugaucagccccgaacugggggucguguuuuucaauguaccugagaagcuccguuuaccagacgcuuccagaaaggccaaaaggucaauugaagaggccugucugacgcuucagcacuugaaccggcugggaauccaggccgagccccuauaucgcguugugaguaauaccauagaaccucucacacuguuucauaagaugggugucggcagacuugauauguacgugcugaacccagugaaagacagcaaggagaugcaauucuugaugcagaaaugggcugggaacucuaaggcuaagacuggaaucguccucccgaacggcaaagaagccgagauuuccguucccuaucugaccucaaucacagcuuuagugguauggcugccugccaauccaaccgaaaagauugugaggguccucuuucccgguaacgcgccucagaauaaaauccuugaggggcuggagaaguugcggcaccuagauuuccugcgcuacccaguggccacucagaaagaccucgccagcggagcuguucccacaaaccugaagccgaguaaaauaaagcaacgagccgacucuaaggaaucccuuaaagcaaccacgaagacugcugugagcaaacuggccaagagagaggaagucguggaggaaggcgcgaaagaggccaggucggaguuggcaaaggaacucgcuaagaccgagaaaaaggccaaagaaucuuccgagaagccucccgaaaaaccagcuaagccugagcggguaaagacagagucaagugaagcccugaaagcagagaagcguaaauuaauuaaggauaaaguuggcaagaagcaucugaaagaaaagaucagcaaacuagaggagaagaaagacaaggagaaaaaggagauuaagaaagaacgcaaggagcucaaaaaggaugaagggagaaaagaggagaagaaggacgccaaaaaggaagagaaaaggaaggauacuaaacccgaacugaagaagaucuccaaaccagaccuuaagcccuuuaccccugaggugcggaaaacauuguauaaggcuaaagucccaggacgagugaagaucgaucgcucuagagcgauuaggggugaaaaggagcugagcucagagccgcagacacccccugcacagaaaggcacggucccacuccccacuauaagugggcaccgggaacuggugcuuuccagcccugaggaccugacacaggauuucgaagagaugaagcgcgaagagagagccuugcucgcugagcaaagggacaccggacugggcgauaaaccauuccccuuagacacugccgaagaggguccgccuucuacagcaauccaggggaccccacccucaguuccuggccugggacaggaagaacacgugaugaaggagaaagagcuaguacccgaggucccagaagaacaaggcaguaaggaccgugggcucgauagcggagccgaaacggaggaggaaaaagacaccugggaggaaaagaagcagcgggaggcugaacgacugccugauagaacagaggccagggaggaauccgagcccgaagugaaagaggacguuauugaaaaggcagagcuugaggaaauggaggaagugcauccaucugaugaggaggaagaggacgcgacuaaagcugaagguuuuuaccagaagcacaugcaggagccguugaaagucaccccucgcucgcgggaagccuucggcgggagagagcugggacuccaaggcaaggcacccgagaaggaaacaagccuguuuuuauccucacugacuaccccagccggugcuacagagcaugugaguuacauccaggaugaaaccauacccggguauucugagacugaacagacgauuagcgacgaggagauccacgaugaaccugaggaaaggccagcacccccucgcuuccacacauccaccuacgaccuuccgggcccagagggagcaggccccuuugaggcuucacagccugccgauagcgcgguaccagccacuucugggaaaguguauggaacccccgagacagaguugaccuacccuacuaauaucguugcugcaccgcucgccgaagaggaacaugucuccagugcuacaagcauuacggagugcgacaagcugucuuccuucgccaccucaguggcagaggaucaaaguguggcgagccuaacugcaccccagacagaagagaccgguaaaucgucccugcuccuggacacagucacuucuaucccaagcucacgaaccgaagcuacgcagggccuugacuauguuccuagugccgggaccauuucccccacaucuagcuuggaggaagauaagggauuuaaauccccaccuugugaggacuucucagugacuggcgagagcgaaaagcggggugagauaaucgggaagggccugaguggagaacgugcaguggaggaagaggaggaagagaccgcuaacguagaaaugucugagaaauuaugcucccaguacggcacacccgucuuuagcgccccagggcacgcacuccauccgggagaaccugcccugggcgaggcugaggaaagaugucuuucgcccgaugacucaacugugaagauggcgucuccacccccuagugguccacccuccgccacccacacgccuuuccaucaaagcccgguugaggaaaaaucugagccacaggauuuucaggaggcagacagcuggggagauacaaagaggacccccggagugggcaaagaagacgcugccgaggaaacugucaagccuggucccgaggaaggcacacuggagaaggaggaaaaagugccaccuccccgcuccccacaggcccaagaggcuccuguuaacauugaugaaggguugaccggaugcacuauccagcuccugccggcacaggacaaggccaucguguucgagauuauggaagcgggcgagcccaccgggccaauacuaggagcugaggcccugccuggcggucuccggacacugccccaagaaccagggaaaccucagaaggaugagguacuuagauaucccgacaggucauugaguccggaagaugcagagagccugucugucuuauccgugccaucaccugacacggccaaucaggaacccaccccaaaaagucccuguggacucacugagcaguaccugcacaaggaccgauggccugaggugagcccggaagauacacaaucccuuucucugucggaggaaagccccucaaaggagaccucccuagacgucaguucuaaacagcucagcccagagucccugggcacauugcaguuuggugaacugaacuuaggcaaggaggaaauggggcaccucaugcaggcugaggauacuucacaucacaccgcaccuaugucuguucccgaaccucaugccgcgacggcuagcccacccacagacggaaccacucgcuacagugcccaaaccgauaucacagacgauucccuggaccggaaaagcccugcaucuucauucucccacaguacuccaagcggcaaugggaaguaucuucccggagccauuaccucgccggaugagcacauccugacaccugacucuuccuucagcaaaucaccagagaguuugcccggcccugcucucgaagauauugccaucaagugggaggacaaagugccaggucugaaggacagaacgucugaacagaagaaagagcccgaaccgaaggaugagguacuacagcagaaagacaagacccuggagcauaaagaaguggucgagccuaaggauacugcaauauaccaaaaggacgaagcacuucacgugaaaaacgaggccguuaagcagcaggauaaagcgcucgaacaaaaggggagggaccuggagcagaaagauacagccuuggagcagaaggacaaggcacuggaacccaaagauaaggacuuagaggaaaaagauaaggcucucgagcagaaagacaagaucccagaggaaaaggauaaagcccuggagcaaaaggacaccgcucuugaacagaaagacaaggcacuggagccuaaagauaaggacuuggaacagaaagaucgugugcucgagcagaaggagaagauucccgaagagaaagacaaggcccuggaucaaaaaguccgcuccguggaacauaaggccccagaggacacuguugcugaaaugaaagaucgggaccuagagcagacagauaaggcgcccgagcagaagcaccaggcacaagaacagaaagacaaggugagcgagaaaaaggaucaggcccuggaacagaaauauugggcucuuggacaaaaggacgaggcccucgaacagaauauccaggcacuggaggagaaccaucaaacccaggaacaggagucauugguccaggaagauaagacgagaaaaccuaagauguuagaggagaaaaguccagaaaagguaaaagccauggaggaaaagcuggaggcucuccuggaaaagacuaaagcgcuuggccuggaggagagcuuggugcaagaagguagggcccgagagcaggaagagaaguacuggcggggccaggacguugugcaggaauggcaagagaccuccccgacacgcgaggaacccgcaggggagcagaaagaacuagcuccugccugggaggacaccucuccagaacaggauaauagauauuggaggggacgggaggacgucgcacuggagcaggauacuuacuggcgagaacucagcugcgagagaaaggugugguuuccccacgaacuggacggccaaggggcccgcccucacuauacagaggagagggaauccaccuuccuugaugagggaccagacgaugaacaggagguacccuuacgugaacaugcuacacggucaccuugggccucugacuuuaaagauuuccaggagaguucgccgcaaaagggccuggagguggaaagauggcucgcggagagcccagucgguuugcccccugaagaggaagacaaacugacuaggucccccuuugagauuaucucucccccugcaucacccccagagaugguugggcagcgcgugccgagcgccccuggacaggaaucccccauaccagaucccaagcucaugccucacaugaagaacgagccaaccacgcccaguuggcuggcugacauuccuccgugggugccaaaagaccgaccccuuccuccagcaccccugucuccugcucccggcccaccgaccccugcccccgaaagccauacaccagccccuuucucauggggcacugcugaguacgauuccgucguggccgcaguucaggaaggggcggccgaguuggagggaggucccuacaguccacuaggcaaggacuauagaaaagcugaaggggagcgggaagaggagggaagggccgaagcaccugauaagagcucucacuccucaaaaguacccgaggcuagcaagucgcaugccaccacagaaccggagcaaacugaaccagagcagcgcgagccuacccccuacccagacgaacguucuuuucaguaugcagauaucuacgagcagaugaugcugacgggccucggucccgccuguccuacaagagaaccgccauuaggggcugcgggagacuggcccccuugccugaguaccaaggaggccgcagcuggccggaauacuuccgccgaaaaagagcuuagcucacccauuuccccaaagucucugcaaagcgauacaccuaccuucaguuaugccgcacucgcuggccccacugugccaccuaggccggagcccgggccauccauggaaccuagcuugacacccccagccgucccuccccgcgcgccgauccugucuaaaggaccaucaccuccccucaacgguaauauacugaguugcuccccagaccgaagaagccccucuccuaaggagucgggccggucacacugggaugacagcaccuccgauagugaacuugagaaaggggcuagggaacagcccgagaaggaggcccagucuccaagcccuccgcaccccaucccaaugggauccccuacgcuauggcccgaaacugaggcacaugugucaccaccucuggacagucacuugggccccgcccgcccgucuuuagauuuuccugcuagcgcauucgguuuuuccucacugcagccagcacccccucaacucccaagccccgcggaaccuagaucugcuccaugugggucccuggccuucaguggagacagggcacuugcccuggcucccggcccgccuacccggacacgucaugacgaguaccucgagguuaccaaggcccccagcuuggauucgucccugccacagcuacccucuccuucaagcccaggcgcaccccugcucaguaaccuuccucgcccagcuuccccggcccugucugaagggagcucauccgaggcgacaacucccgugauuaguagcgucgccgaacgauuuucuccuucauuagaggcagcugaacaggaguccggagaguuggacccagguauggaacccgccgcacacagccugugggaucucaccccucugucuccagcucccccggccagucuugaccuggcccucgcgccugcuccaucguugcccggcgauaugggggacggaauccugccuugccacuuagaguguuccgaagcagccacggagaaacccagcccauuccaggugccgucagaagauugcgcugccaauggcccuacagagacuucucccaacccacccgguccugcaccagccaaggcugagaaugaagaggcggccgcaugucccgcuugggaaagaggggccuggccugagggagcagaaaggagcucccggccagacacccuacugaguccggagcaacccguaugcccugccggcggcucagggggaccacccucuagcgcuuccccugaggucgaagccgguccacagggcugugcgacagagccccgcccucauagaggggaacucaguccgagcuuccuuaaucccccacugccucccuccauugaugacagggauuugucuaccgaggaggugcggcugguuggacgaggcgguagacgcagggugggcgggccagggacuaccggcgggccuugccccgucacagacgaaacgccaccgacuucagcaagcgacucgggauccagucagucugauagcgacgugccucccgagaccgaagaguguccaucaaucacagccgaagcugcccucgauuccgacgaggauggugacuuucugcccguugauaaagcaggcggggugucuggaacccaccauccucggccaggccacgacccaccuccgcuuccccaaccagauccucgucccaguccaccuagacccgacgucugcauggcugauccagagggucucagcuccgaaucagggaggguggagcgccugcgggaaaaggagaaaguacagggccgagugggaagaagggccccgggcaaggcuaagccugccagccccgcacgccgguuggaccugagagggaaacguucuccaacuccuggaaagggucccgcggauagggccagucgggcuccaccucgcccccgauccacaaccagccagguuacgccggccgaagagaaagacggccauucaccaaugucuaagggguuagucaacggacuaaaagcaggccccauggcucuguccucgaaggguagcaguggggccccuguguauguggaccucgcauacauaccaaaucacuguucuggcaagacugccgaucuugacuucuuuagaaggguccgggcguccuacuauguagugagcggaaacgaucccgcuaauggcgagccuucacgcgccguucuggacgcauugcuggaagggaaagcccaguggggagagaaccuccaagugacacugauuccgacccacgauaccgaagucacuagagagugguaccagcagacacaugaacagcaacagcagcuuaauguguuaguucuggcuaguuccagcaccguggucaugcaggacgagucuuuccccgccugcaagaucgaguuuuga

SEQ ID NO: 58756 - RNA, 7407 nt, Artificial Sequence
  derived and/or modified sequence opt3 from MAP1B__Homo_sapiens__NP_005900
auggcaacaguggucguugaagcuacagaacccgaaccuagcggauccaucgcaaacccagccgcgucuacuucaccgagucugagccacagguuccucgacuccaaguuuuaccuucuggugguagugggggaaauugucacggaggaacauuugaggcgggcuauaggaaauaucgaguuagguauucgcucuugggauaccaaccugaucgagugcaaucuagaccaggaacucaaacuguucgugucgcgacacucagcccguuuuagccccgagguuccuggccagaagauucuucaucacagaagugaugugcuggaaacagucguguugaucaacccauccgacgaggcaguaucuacugagguuaggcucaugauaaccgaugccgcucggcauaaacugcuggugcucacagggcaguguuucgaaaauaccggagaguuaauccugcagagcggcuccuuuucauuccagaacuuuauugaaaucuucacugaccaagagauuggugaacuuuugaguacaacccaccccgcaaauaaggccagccugacgcuauuuugcccugaggagggggauuggaaaaacucuaaucucgaccgccacaaccugcaggauuucaucaauauaaaacuuaacuccgcuucaauucugccagaaauggagggauugagcgaauuuacugaguaucucagugaaucugucgaggugcccuccccuuucgacauccuggagccaccgaccagcggcggcuuuuuaaagcugucgaaacccuguugcuacauuuucccugggggaagaggugauucugcccucuucgcggugaauggcuuuaacaugcuuaucaaugggggauccgaaaggaagucauguuucuggaaacugauccggcauuuggaccgcgucgauaguauucuacugacacacauaggcgacgacaaccucccagguaucaacagcaugcugcagcgaaagauugcagagcuugaagaggaacagucccaagggucuacuaccaauagcgauuggaugaaaaaccugaucucacccgacuugggaguuguguuucucaauguaccugagaaccugaagaauccagagcccaacauaaagaugaaaagaaguauugaagaggccugcuucacauuacaguaucugaauaagcuauccaugaaaccggaaccucucuuuaggagcgugggcaacaccaucgaucccgucauccuguuccagaagaugggcguggggaaacuugagauguacguuuugaauccagugaagucuucaaaagagaugcaguauuuuaugcaacaguggacgggaacuaacaaggacaaggcugaguucauucugccuaauggucaggaggucgaucuccccaucaguuaccugacaagcguguccucucuuauuguauggcauccagccaaccccgcagagaagauaauccggguucuguuuccuggcaauucgacccaauauaacauuuuggaggggcucgaaaagcugaaacacuuagacuuccugaagcagccacuagcuacucagaaagaucucacaggacaggugccgacccccgucgugaagcaaacgaagcugaaacagcgugccgacagccgcgagucccuuaagccugcggccaaaccauugcccucaaagagugucagaaaagagucuaaggaagagaccccugaagugacaaagguuaaucacguggagaaaccacccaagguagaaagcaaagagaaggucauggugaaaaaggauaagccgaucaaaacugagaccaagccuuccguuacagaaaaagaggugccaucaaaggaagaaccaagcccugucaaagcagaaguggcugagaagcaggccacugacguaaaacccaaggcugccaaggagaaaaccgugaagaaagaaacaaagguuaaaccagaggauaagaaggaagagaaagagaagccuaaaaaggaagucgccaagaaggaggacaagacccccaucaaaaaggaagagaaaccaaagaaagaagaggugaagaaggaggugaaaaaggaaauuaaaaaggaggagaaaaaggagccgaaaaaggaagucaagaaagagacuccucccaaggagguuaaaaaggaagugaaaaaggaggaaaagaaagaggugaagaaagaagagaaggagcccaaaaaggaaauaaagaaacugcccaaggacgccaaaaagucuuccacgccucucagugaggcuaaaaagccagcggcacugaagcccaaaguaccuaagaaagaagagagcgucaagaaagauucuguggccgcuggcaagccgaaggagaaagguaagaucaaaguuauuaagaaagaagggaaggccgcagaggccguggcugccgcagucggcacaggagcgaccacugcugccgugauggcagccgcuggcaucgccgcaauugggccagcuaaagaauuagaggccgaaaggucccugaugucaagucccgaggaccuuaccaaggauuuugaggaauugaaggcggaggaaguugacgugacaaaagauaucaagccucagcucgagcugauagaagacgaggagaaacuaaaggaaaccgagccaguagaagccuacgucauccaaaaagagcgggaagugacuaagggacccgcugagagcccugaugaggguauuacaacgaccgaaggcgagggggaaugugagcagacuccggaggaacuggagcccguggaaaagcagggagucgacgauaucgagaaauucgaagacgagggcgcagguuuugaggaaucguccgagacaggggauuacgaagagaaggccgaaaccgaggaggcugaagaaccagaagaggacggcgaagaacauguuugcgugucugccagcaaacacucaccuacagaggaugaagagagugcaaaggcggaagccgacgcuuauauucgagagaaacgcgaguccguagccucuggagacgauagagcagaagaggacauggaugaagcuaucgagaagggcgaagccgagcagagcgaggaagaggcagacgaagaggauaaggccgaagacgcuagggaggaggaauacgagcccgagaaaauggaggcggaagauuaugugauggccgucguggacaaggcagcugaggccgggggagccgaggaacaauacgguuuccucacuaccccaacgaaacagcugggcgcucaguccccugggcgggagcccgcaucaagcauacaugaugaaacccuuccaggaggcagugagucugaggccacagcguccgacgaagagaaccgcgaagaucagccggaggaguucacugcuaccagcgguuauacacaaucgacuauugagaucucaucugagccuacccccauggacgaaaugaguacgccaagagauguuauguccgacgagacaaacaaugaagagaccgaaagccccucucaggaguuugugaacauuacuaaguacgagagcuccuuguauucacaggaauacaguaaaccugccgacgucacaccacugaauggguucagcgagggcucuaagaccgaugcaacugacggaaaggauuacaacgccuccgcuucaaccaucagucccccuagcuccauggaagaggacaaauuuucuaggucggcauuacgugaugccuauuguagcgaagugaaggcgucaacaacgcucgacauaaaagauuccaucagugcuguuucuagcgagaagguguccccgucaaaaucuccaagccugagucccuccccucccagcccacuugagaagaccccucugggcgaacggucugucaauuucucauugacucccaacgagauuaaaguauccgccgaagcagagguggccccaguuaguccugaggugacacaagaagucguggaggaacacugcgcuagcccggaggacaagacccucgaaguagugucgcccucucaguccgucacagggagcgccggacauacuccauacuaucagucaccuaccgaugagaagaguucucaucugcccacggagguuaucgaaaaacccccugcagugcccguguccuuugaguucagcgacgcuaaggaugaaaaugagcgagccucagucaguccgauggacgaaccagugccugacagcgagucccccauugagaaaguucuaucuccacugagaaguccaccucucaucggcuccgaaucagcguacgagucuuuucugagugccgaugacaaggcaucggguagaggggcugaaagcccguucgaggaaaaauccggaaagcagggcucucccgaucaaguaucaccagugagcgagaugacauccaccagucuuuaucaggacaagcaggaggguaaaucuacugauuuugccccuauaaaggaagacuucggccaggagaaaaagaccgaugacgucgaagcuaugagcucacaacccgcauuggcccuggaugagcgcaaauuaggggacguguccccuacacagauugauguuagucaguuuggcagcuucaaggaggacacuaagaugucuaucuccgaaggcaccgugucagauaaaagcgccacaccagucgacgaggggguggcugaagacacguacucgcacauggagggaguagcgucugucaguaccgcauccguggccacuagcucauuucccgaaccuacaaccgaugacguuuccccaucucuccacgcugaggugggcagcccccacaguacugaggucgaugacucccugagcgugucuguugugcagacaccgaccacguuccaagaaacugagaugucaccuaguaaggaagaguguccacggcccauguccaucagcccuccagauuucucucccaaaaccgccaagucgagaacaccgguccaggaccauaggucagaacagagcuccaugaguauugaguuuggucaagagucuccugaacagagccuugcaauggauuucucccgccagucacccgaccacccaaccgugggggccggaguacugcacaucacugagaacggcccuacagaaguggauuauagucccucugacaugcaggauagcucccuaucacauaaaauuccacccauggaggaaccuagcuacacccaagacaaugaucucucugagcugauauccguuagucaggucgaggcuagcccaucgacauccucugcgcacacuccgucacagaucgccagccccuugcaggaagacacccugagugacguggcaccuccacgagauauguccuuauacgcuucucucacgagcgagaaggugcaaucacuggaaggugagaaacuuucccccaaaagugacauuagcccucugacaccacgggagucuucacccuuguauuccccuaccuuuagcgauucuacaagcgccgucaaggagaaaacagcaacaugccauucguccagcucaccgccaaucgacgccgcuucugccgagcccuacggcuuccgugcgagcguacucuuugauacuaugcagcaccaucuggcacuaaacagagaccuguccaccccugggcuugaaaaggauaguggaggcaaaacgcccggggacuucucauaugccuaccagaagccagaggaaacaaccaggucuccugaugaggaggacuaugauuacgaaagcuaugagaaaacuacacgcaccuccgacgugggaggcuacuacuaugaaaagauugagcggacuacaaagagucccagcgacuccgguuacucuuaugaaaccaucgggaaaacgacuaagaccccagaggauggagacuacucauaugagauaaucgagaaaacuaccagaacaccggaagaaggcgguuacagcuaugauauuucggagaagacuaccuccccucccgaaguuaguggcuacucuuacgagaaaacggagaggagccgacgccuccuggacgauaucucaaauggguaugacgauuccgaagacggaggccacacauugggggauccaucuuacaguuaugagacuaccgaaaagauuaccagcuuucccgaguccgagggauacucauaugaaaccagcacuaagaccacacggacgccugacacuucuaccuacugcuaugagacagcugagaaaaucaccagaacuccacaggccaguacauacuccuacgagaccagcgaucuguguuauacggcugaaaagaaaucacccucugaggcaaggcaagacguggauuuaugccucgucuccucgugugaguacaagcacccuaaaacugaacugagcccgaguuucauaaacccaaauccccuugagugguuugccucugaagaaccuacagaagaguccgagaagccacugacccagagcggcggugcucccccucccccagggggaaagcagcagggccgucaaugcgacgaaaccccgccuacuucagugagugaguccgcccccagccagacagacucugauguuccaccugaaaccgaggaaugucccucaauuacagcagacgcgaacaucgauagcgaggacgaguccgaaacuaucccaacggauaaaaccgugacauauaagcauauggacccucccccggccccaguccaggaucgcucuccuaguccccggcacccagacgugucgaugguagaucccgaggcuuuggccauugaacaaaaucucggcaaagcacugaagaaagaccuaaaggagaagacuaaaaccaagaaaccugggacaaagaccaaaagcuccucaccggugaagaagucugauggaaaaagcaagccacuggcugccagucccaaaccugcaggucuuaaggaguccucagacaaaguuucuagagucgccagccccaagaaaaaggaauccguggagaaggcugcgaaaccaacuacgaccccugaagugaaggccgcaaggggcgaggaaaaagacaaggagaccaaaaacgcugccaacgccagugcaagcaagucugcuaagacugccaccgcggggcccggaacaaccaaaacuacaaagucauccgcugucccaccuggccucccgguuuaccuggauuugugcuauauacccaaucauagcaacaguaaaaauguggacguagaguucuuuaagcgagugcggucuuccuacuaugucgugucggguaacgauccagccgcagaagaaccuagccgcgccguuuuagacgcucugcucgaagggaaagcacaguggggaucaaauaugcaagugacgcugauccccacccacgauuccgaggucaugagagaaugguaccaggagacucaugagaagcaacaggaccuuaacauuaugguacuggccucuaguagcacagugguuaugcaggaugaaucauucccagcguguaagaucgaguuguga

SEQ ID NO: 58757 - RNA, 366 nt, Artificial Sequence
  derived and/or modified sequence opt3 from MAP1LC3A__Homo_sapiens__NP_115903
augcccagcgacagaccuuucaagcagaggcgguccuuugccgaucgcugcaaagaggugcaacagauccgagaccagcacccaucuaagauuccggucauaaucgaacguuacaaaggcgagaagcagcugcccguucucgauaaaaccaaguuccuugugccugaccauguaaacaugucagaacuggugaagauuaucagaaggcgguugcaauuaaauccaacacaggcauuuuuccugcuagucaaccagcacaguauggugagcguuuccacucccauugcugauaucuaugagcaggaaaaagacgaggauggguuucucuacaugguguaugccucucaagagacguucggauuuuga

SEQ ID NO: 58758 - RNA, 378 nt, Artificial Sequence
  derived and/or modified sequence opt3 from MAP1LC3B2__Homo_sapiens__NP_001078950
augcccagcgagaagaccuucaagcagagaaggacauuugaacaacggguggaggacguccgccugauccgagaacagcacccuacuaagauuccaguuauaaucgagcguuacaaaggcgaaaagcagcucccggugcuugauaaaacgaaguuccugguacccgaccaugugaacauguccgaguugauuaagaucauuagaaggcgguuacagcugaaugccaaccaagcauuuuuccuacucgucaaugggcacucuauggugucaguuaguaccccuaucagcgagguguaugaauccgagaaagaugaagacggauuucuguacauggucugcgcuucucaggagacauucgguaugaaacuuucgguguga

SEQ ID NO: 58759 - RNA, 378 nt, Artificial Sequence
  derived and/or modified sequence opt3 from MAP1LC3B__Homo_sapiens__NP_073729
augcccagcgagaagaccuucaagcagagaaggacauuugaacaacggguggaggacguccgccugauccgagaacagcacccuacuaagauuccaguuauaaucgagcguuacaaaggcgaaaagcagcucccggugcuugauaaaacgaaguuccugguacccgaccaugugaacauguccgaguugauuaagaucauuagaaggcgguuacagcugaaugccaaccaagcauuuuuccuacucgucaaugggcacucuauggugucaguuaguaccccuaucagcgagguguaugaauccgagaaagaugaagacggauuucuguacauggucuaugcuucucaggagacauucgguaugaaacuuucgguguga

SEQ ID NO: 58760 - RNA, 3180 nt, Artificial Sequence
  derived and/or modified sequence opt3 from MAP1S__Homo_sapiens__NP_060644
auggccgcuguggcaggcagcggggccgcggcugcccccuccucucugcuccuugucguuggaucagaguucgguaguccuggccuguugaccuacguguuagaagaacuggaaagagggaucaggagcugggacguagauccaggagugugcaaccuagacgagcagcucaaggucuuugugucccggcacucugcaacauucucgucaauuguuaaaggccaacgcagccugcaucaccgaggugauaaucuugaaacucugguguugcucaacccgagugacaagucccuguaugaugagcugcguaaucucuuacuggaccccgccucucauaaacuuuugguccuggcugggccuugucuagaggaaacgggagagcuccugcuucagaccggcggcuuuagcccacaccauuuccugcaaguguugaaggauagagaaauaagggacauccucgcaacaacucccccuccaguacagcccccuauucugaccaucacaugcccaaccuuuggggauugggcccaguuagcuccggccguucccggacugcagggugcgcuccggcuucagcugcgcuugaacccuccagcacagcuacccaauuccgagggccugugugaguuccucgaauacguggccgagucacuggaaccuccaagucccuuugagcuucuggaaccgccuacuagcgggggauucuugagacucggcaggcccugcuguuauauuuuuccaggugggcugggagacgcugccuucuuugcagucaacggcuucacaguguuagugaauggcgggucuaacccuaaauccucauuuuggaagcugguccggcaccuagaucgcguugacgcugugcucguaacccaccccggagccgauagccugccaggucuuaauaguuugcugcgaagaaagcucgcggagaggucugagguggccgcaggcgggggauccugggacgaccggcugcgucgccuuaucagccccaaccugggcgucguguucuucaaugcuugcgaagccgcuucgagauuggccaggggugaggaugaagcagagcucgcccugucuuuacuggcucaacuagggauaacgccucucccacugucccggggcccgguucccgcgaaaccuacugugcuuuuugaaaagaugggagucggccgauuggacauguacgugcugcauccacccucagcaggggccgagcgcacccucgcuaguguaugugcccuguuaguuuggcacccugcaggaccaggugagaaaguggucagagugcuguuccccggcugcacaccgccugccugucuuuuggaugggcucgucaggcugcagcaucuacgguuucugcgcgaaccagugguuacuccccaggaccucgagggaccuggcagagcugaaagcaaggaguccguggguucuagggauagcucaaaacgugaagggcugcuugccacccacccccggccaggccaggagcgaccuggaguagcaagaaaggagcccgcgagggcugaagccccacgcaagacagagaaagaagcaaagaccccgcgggaguugaaaaaggacccuaaacccagugucuccagaacgcaaccaagggaggugcgccgagccgcuagcucuguucccaaccugaagaaaacuaaugcccaggcagcuccuaagccacggaaggcccccucaacaagucacagcggcuucccuccgguggcgaacgggccacguucucccccuuccuuaagaugcggagaagccucgccacccagcgcugcaugugguuccccugccucacagcucgucgcuaccccgagucuggagcuuggccccaucccagccggggaagagaaagcacuggaauugccucucgcggccucuagcauucccaggccacgcacuccuucccccgagucacaucggagcccagcugagggaucugaaagacugucccuaaguccgcugaggggcggugaggccgggccugaugcaagccccacagugaccacgccaaccguaacaacucccucucucccugcugaagugggcuccccacacucaaccgagguugacgaaagucugagcgucucguuugagcaagugcuucccccuuccgccccgacaucugaggcaggauugagccugccauuacgaggcccccgcgcccggagaucagcuaguccucaugauguggaccucugccuggucucccccugcgaguucgagcacaggaaggcgguuccaauggccccugcacccgcuucuccagggagcuccaaugauucaagcgcccguagucaggaacgcgccggaggccuuggugcugaggaaacuccuccgaccucuguguccgagagccugcccacacuaucggacucagacccagugccucucgcacccggggccgcggauucugacgaggauaccgaaggauuuggcguaccacggcaugacccucugcccgauccguugaaagucccaccuccccugccagaccccaguuccaucuguaugguggauccugagauguuaccgcccaagacugcuagacagacggaaaacguuagcaggacacgaaaaccacucgcccggccuaacucucgcgcagccgcucccaaggcaaccccuguggccgcggcuaagacuaaaggucuggccggcggggacagagcaagcaggccacuuuccgcccggucagagcccagugagaagggaggccgagcuccucugagcagaaaaucuuccaccccaaagacagccacccgcgggcccucaggaagugcaagcuccaggccgggcgucucugcuacuccuccaaaaucgcccguguauuuggaucucgccuaccugccuagcgguucauccgcgcaccuaguugacgaagaguucuuucagcgugugcgggcccugugcuauguaauuagugggcaagaucagagaaaggaagagggaaugagggcaguccuugacgcucuccuggccucuaagcagcacugggaucgcgacuugcaagugacacugaucccaacguucgacagcguggcuaugcauaccugguacgcagaaacucacgcccgacaucaggccuuaggcauaacaguccucgguuccaauucaaugguuucuaugcaggaugacgcuuuucccgcguguaaaguggaguucuga

SEQ ID NO: 58761 - RNA, 1680 nt, Artificial Sequence
  derived and/or modified sequence opt3 from MAP2__Homo_sapiens__NP_001034627
auggccgacgagagaaaggaugaagcuaaagcaccccacuggaccagcgccccucugacagaggcguccgcucauucucacccaccggaaaucaaggaccagggcggggccggagagggucucgugaggucagcaaacggcuuccccuaccgggaagaugaggagggggccuuuggagaacauggcagucaagguacuuauagcaauacgaaagagaacgggauuaauggagaacuuaccuccgcugaccgcgagacagcagaggaagucucugcccgaauaguucaggugguaacugcugaggccguggcgguccugaagggcgaacaggagaaagaagcacagcacaaggaucaaaccgccgcuuugccuuuagccgcagaggagacagcuaaccugccacccucgccuccacccaguccugccagcgaacagaccgugacuguugaggaagcggccggcggggagagugcacuagcuccauccguguucaagcaggccaaagacaaggucucuaauagcacacucuccaaaaucccggcucugcagggaucaaccaagaguccccguuacagcucugccugcccuuccacgacuaaaagagcaaccuuuucagauagccuucugauucaaccaacaagugccgguucuacugacagguugcccuauuccaagagcggcaacaaggauggggugaccaaaucgccugaaaagcggucuucccucccacgccccucaaguauccugccgccuagaaggggaguaagcggcgaccgggaugaaaauuccuucucucugaacagcucaauuaguuccagcgcucgccgaacaaccagaucugagcccaucaggcgggcggguaaaucagggacgaguacuccaacaaccccuggaagcacugcaauaacacccggcaccccacccuccuacucuucgcguacgccuggcaccccagggacaccgagcuauccccgcacuccucauaccccaggaacacccaaguccgccauccucguuccuucagagaaaaagguggcuauuaucagaacuccacccaaaaguccggccaccccuaagcaguuaaggcugauuaaucagccacuucccgacuugaagaacgucaaaucuaagaucgguagcacagauaauauaaaauaccagccuaagggcgggcaagugcggauucugaacaaaaagaucgacuuuuccaaggugcagucacgauguggaagcaaagacaauauuaagcacucugcaggcggugggaacguccagaucguuaccaaaaagaucgaucuaucccacgugacuucaaaaugcggcagccucaagaauauucgccauagacccggaggcgggaggguaaagauagagucugugaaacuggacuucaaggaaaaagcccaagcuaaggucggaucccuugauaacgcccaccaugugccagguggcgggaacguuaaaaucgacucacagaagcugaauuuucgggagcacgcaaaggcgcgcguggaucacggagcugaaauuaucacgcagaguccuggcagaagcucggucgccucccccaggcguuugucuaacgugagcucaagugguuccauaaaucuccuggagucuccacaguuagcaacacuggccgaggacguaaccgcugcccucgcaaaacaagggcuuuga

SEQ ID NO: 58762 - RNA, 1182 nt, Artificial Sequence
  derived and/or modified sequence opt3 from MAP2K1__Homo_sapiens__NP_002746
augcccaagaaaaagccuaccccaauccagcugaacccggcccccgacggcagcgcugugaaugggacauccucugcagagacuaaccucgaagcccuucagaaaaagcuggaggaauuggaguuagaugaacaacagagaaaaaggcuggaggcguuccuaacgcagaagcaaaaggucggagagcucaaagacgaugacuuugaaaagauuucagagcugggugcuggcaaugggggaguuguguucaaaguaagucacaagccuagcggccuugugauggcccggaaacugauacauuuggaaaucaagccagcaauucgcaaccagaucauucgagagcuccagguccugcacgagugcaauucccccuacaucguggguuuuuauggggccuucuacucugauggagaaauaucgaucuguauggagcauauggacggcggcucacuggaucagguucucaagaaagcugggcguauuccugaacaaaucuuaggaaaggugagcauugcagucaucaaaggucugaccuaucuuagagagaagcacaaaauaaugcauagggacgugaagccaaguaacauuuugguaaauucccggggcgaaaucaaacugugcgauuuugggguuucuggacagcuaauugacagcauggccaacuccuucgugggcacacgcucauacaugagucccgagagacuccaggguacucacuauagcguccagucugauaucugguccauggggcugucacuuguggagauggcugugggaagguacccuaucccaccgcccgacgccaaggaacuggaguugauguuuggcugucaagucgaaggcgaugcggcagagaccccuccacggccccgcacaccugggcgaccacucagcaguuauggaauggacucuagacccccgauggccauuuucgaacuguuagacuacauaguuaaugagccucccccaaagcugccuuccgguguguuuagccucgaguuccaggauuuuguaaacaaaugccuuaucaagaaucccgcugaaagggccgaccugaaacaguugauggugcacgcauucauuaagcggucggaugcugaggaagucgacuuugccggcuggcuauguucuaccaucgggcugaaccaaccauccacucccacacaugcggccggaguguga

SEQ ID NO: 58763 - RNA, 1203 nt, Artificial Sequence
  derived and/or modified sequence opt3 from MAP2K2__Homo_sapiens__NP_109587
augcuggccagaaggaagcccgugcucccugcucuuaccaucaacccaacaauugcagagggcccgagccccacuuccgaaggggccucugaggcgaaucuggucgacuugcagaaaaaguuagaggaacuggaacuagaugagcaacagaaaaagcggcucgaggcuuuccugacgcagaaagccaagguuggagaacuuaaggacgaugacuuugagcgcauaucagaacugggugcaggcaacgggggagugguaaccaaagugcagcaccgaccuaguggcuugaucauggcccguaagcucauucaucuggagaucaaaccagcuauuagaaaucaaaucauaagggagcugcagguccuccacgaaugcaacagccccuacaucguggguuucuauggggcauuuuacuccgauggagagauuucuaucuguauggaacauauggacggcggcucguuagaucagguucugaaggaggccaaacggauuccugaagagauccuugggaaggugucaauagcugucuugcgcggacuggccuaucuaagagagaagcaccagauuaugcauagggacgugaaaccaagcaauauccucguaaacagucggggugaaauuaagcugugcgauuucggcguuuccgggcaacuuaucgacucuauggcgaauagcuuugugggaacacgcuccuacauggcacccgagcgacugcagggcacucacuauucaguccagagugauaucuggagcauggguuugucucucguggaacuggccguggggagauacccuauuccaccgcccgacgcuaaagaguuagaagccauauucggaaggccugucguugauggcgaggagggcgaaccacacuccaucucaccccggccucguccacccgggcgcccggugagcggacaugguauggacaguagaccugcaauggcuauuuuugagcugcucgacuauaucguaaacgaacccccaccuaaacuucccaauggcguguucaccccagauuuucaggaguucgucaacaagugucugauaaagaaucccgccgaaagggcggacuugaaaaugcuaacaaaccacaccuuuauuaagcggucugagguggaggaaguugauuucgccggguggcugugcaagacucuccgacugaaucaaccuggaacaccaacccgcacggcaguguga

SEQ ID NO: 58764 - RNA, 957 nt, Artificial Sequence
  derived and/or modified sequence opt3 from MAP2K3__Homo_sapiens__NP_002747
augagcaagcccccugccccaaacccgacacccccuagaaaucuggacuccaggaccuucaucacuauuggcgaucggaacuuugagguggaagcugacgaucucgucacgauaucugagcuugggcgcggagcauacgguguuguggaaaaaguacgacacgcccagucaggcaccaucauggcggugaagcguauuagagcuacagucaauagucaagagcagaaaaggcuguugauggacuuagauaucaacaugcggacuguggacugcuucuauaccguuacauuuuacggggcccuguuccgcgaaggagauguguggauuuguauggagcuaauggacaccagccucgauaaguuuuauagaaaaguccuggacaagaauaugacuaucccagaggauauacuuggcgaaaucgcaguguccauuguaagggcccuggagcauuugcacucuaagcucucgguuauccaucgggacgugaaacccucaaacguccugauuaauaaggaaggucacgugaaaaugugcgauuucgggaucagcggauaccugguggacagugucgcuaagacaauggacgcaggcuguaaaccuuauauggccccagagcgcauaaaccccgagcucaaucagaagggcuacaacguuaaguccgauguguggucuuuagggauuaccaugaucgaaauggcuauucugcgauuuccuuaugagagcuggggaacgccauuccagcaacuuaaacagguaguggaagaaccgucaccccaguugccugccgacagauuuuccccagaguucgucgauuuuacugcgcagugccugaggaagaaucccgcagagcggaugaguuaccuagagcucauggaacauccuuucuuuacccugcacaaaacaaagaaaacugacaucgccgcuuucgugaaggagauccuuggugaagauagcuga

SEQ ID NO: 58765 - RNA, 1233 nt, Artificial Sequence
  derived and/or modified sequence opt3 from MAP2K4__Homo_sapiens__NP_001268364
auggccgcucccagcccuuccggcgggggagguucuggcgggggaucaggcagugguaccccagggccggugggaagccccgcaccuggccacccagccgucuccucuaugcagggcuuccaaaucaacuuuugcgagaaggcgcagucgaaaagaaaggcucugaaacucaauuucgccaaucccccuuuuaagucaacagcaagguucacucuuaauccaaaccccacggggguucagaauccucauauugaacggcugcgcacccacagcauagagaguuccggaaaauugaagaucucuccagaacagcauugggacuuuacagccgaggauuuaaaggaccugggugaaauuggccgaggggcuuacggaagcgugaacaaaaugguacacaagccguccggccaaaucauggcagugaaacguauuagaucaacugucgaugagaaggagcagaaacagcuacucauggaccuggaugugguuaugaggaguagcgacugucccuauaucgugcaguucuacggugcccuuuuucgggaaggggauugcuggauauguauggagcugaugucuaccuccuucgacaaguuuuauaaguacgucuauucaguguuggaugacguaaucccugaagagauucucggaaaaaucacacuggcuaccguuaaggcccugaaucaucucaaagagaacuuaaagauuauccaccgcgauauaaaaccaagcaauauucugcuugacagaaguggcaacaucaaguugugcgauuucggcauuucugggcaacugguggacuccaucgcgaaaacuagggacgcaggaugucggcccuacauggccccugaacgcaucgauccaagcgcuucgcgacaggguuaugacgucagaucugauguguggucccuaggcauuacacucuacgagcuggccaccgggagguuucccuacccgaaguggaacucaguguucgaccagcuuacgcaggucguuaagggagauccuccccaacugaguaacagcgaagaacgggaauuuuccccaucuuucauaaauuucgugaacuugugccucacuaaagacgagagcaagcguccuaaauauaaggagcuguuaaaacaccccuuuauccugauguacgaggagcgcgcaguagaaguggcuuguuaugucugcaagauucucgaucagaugccagccacccccucaaguccuauguacguggacuga

SEQ ID NO: 58766 - RNA, 1239 nt, Artificial Sequence
  derived and/or modified sequence opt3 from MAP2K5__Homo_sapiens__NP_001193733
augauggagggccacuucccccagagcgacgugaucgggcaaguccugccugaagccaccacaacugcuuuugaguacgaagaugaggacggagauagaauuacgguuagguccgacgaagagaugaaggcaaugcucucuuauuacuauucaaccgugauggagcagcagguaaacggucagcuuauagaaccacugcaaaucuucccgcgggccugcaaacccccuggcgagcgcaauauucauggguugaaggugaacacacgagcgggaccaagucagcacagcucccccgcugucucugauucguuaccuucaaauagccugaaaaagaguuccgccgaacucaaaaagauccuagcaaacggccagaugaaugagcaggacauucguuacagagauacucugggucaugggaacggaggcaccguguauaaggccuaccacguuccaucuggcaaaauccuugcugugaaggucauacuguuggacaucacacucgagcugcaaaaacagauuaugagcgaacuggagauccucuauaagugugauuccucauacauuaucggguuuuacggagcauucuuuguggaaaauaggauaaguauuugcaccgaguucauggacgguggcagcuuagauguauaucggaaaaugcccgaacauguucuggggcgcaucgccguggcugucgugaagggacuuacuuacuuguggucucugaagauucuacacagagacgugaaaccuuccaacaugcucgucaauacaaggggccagguuaagcugugugauuuuggugugucaacccagcuuguaaacagcaucgccaaaacguauguggggacuaaugcguacauggcaccagagcggaucaguggagagcaauauggcauucacucugacgucuggucccugggcaucagcuucauggaauuggcccucgggcgcuuuccguacccccagauacagaagaaccaaggaucgcugaugccuuuacagcugcuccagugcauuguggacgaggauucuccaguucuucccgugggugaguucuccgagccuuuuguccauuucaucacccaguguaugcgaaaacaaccaaaggaaagacccgcuccggaggagcugaugggccacccuuuuauagugcaguucaaugacgggaacgccgcaguaguuucaaugugggugugcagggcuuuggaagaacggcguagucagcagggacccccauga

SEQ ID NO: 58767 - RNA, 1005 nt, Artificial Sequence
  derived and/or modified sequence opt3 from MAP2K6__Homo_sapiens__NP_002749
augagccaguccaagggcaaaaagagaaaccccgggcugaaaaucccuaaggaggccuucgaacaaccacagaccucuucaacaccgcccagggaccucgauaguaaggcuugcauuagcauaggaaaucagaacuuugaggugaaggcagacgaucuugaaccuaucauggagcugggucggggcgccuacggggucguugaaaagaugcgccacgugccauccggacagauuauggcgguaaaacgaauccgugcuacugucaauucucaagagcagaagagauuguuaauggaccuggauauuucgaugaggacgguggacugucccuucaccgugacauuuuauggcgcccuauuccgggagggugauguuuggaucugcauggaacucauggacacuucacuggauaaauuuuacaaacaggugauagacaaagggcagaccaucccugaggauauucuuggaaagaucgcagucagcauugugaaggcccuggaacauuugcacaguaaacucuccguaauccaucgcgacguuaagccaucuaacgugcugauaaaugcucugggccaagucaaaaugugugauuucggcauuagcggguaucucguggacuccguggcaaagacaaucgacgccggaugcaaacccuacauggcuccugagagaauuaacccagaguuaaaucagaaggguuauucagucaaaagugauaucuggagccugggcaucaccaugauugaacuugccauauugagguuuccguacgacucuugggggacucccuuccagcagcugaagcaaguuguggaggaaccuuccccacagcuacccgcggauaaguuuucagcagaguucguagacuuuacaagccagugucucaaaaagaacaguaaagaacggccuaccuauccagagcugaugcaacaccccuucuuuacgcuucaugagucuaagggaacugauguggccuccuucgucaaacugaucuugggcgacuga

SEQ ID NO: 58768 - RNA, 1308 nt, Artificial Sequence
  derived and/or modified sequence opt3 from MAP2K7__Homo_sapiens__NP_001284484
auggccgcuagcucccuggagcagaagcucucuagacuugaagcaaaacugaagcaagagaacagggaagcccggcgccgaaucgacuugaauuuagauauuucaccccagcguccuagaccaauaaucgugauuacccugaguccggcgcccgcuccuagccagagggccgcacuacagcucccacuggccaacgacggcgggucccggucucccucgucagagagcaguccucaacacccaacacccccugcucgcccaagacacaugcuuggacugccguccacuuuguucacgcccaggucuauggaaagcaucgagauugaucagaaacuccaggagaucaugaagcagaccgguuaccugacaauaggcgggcaacgguaucaggcagaaaucaaugaccuggagaaccucggagaaaugggcuccgguacuugcgggcaggucuggaaaaugcgcuuucgaaagaccggacacguuauugccgugaagcagaugagaaggucaggcaauaaagaggagaacaagcggaucuuaauggaucuggacguagugcuuaaaagucaugauuguccuuacauuguccaaugcuucggcacauuuaucaccaauacugacguguucauagcuauggaauugauggggacaugugccgagaagcugaaaaagcguaugcagggaccaauucccgaacgcauccuagguaagaugaccguugcgauugugaaagcacucuauuaccugaaggagaaacacggcgucauccauagagaugugaagccuagcaacauccuucuggacgaaagggggcagauuaaauugugcgauuuuggaauaucuggccggcucguagacuccaaggccaaaacgcgaucagcugguugugccgcauauauggcuccagagcgcaucgaucccccggacccuacuaagcccgacuacgauauuagagccgacguuuggagccuggggaucaguuuaguggagcuggcgaccggacaauucccauauaagaauugcaaaacagauuuugaaguccucacuaaggugcuucaggaggaaccuccccuguugccaggccacaugggcuucucuggggacuuucaguccuucgugaaagauugucuaaccaaggaccacaggaaacggcccaaguacaacaagcugcucgagcauagcuuuauaaaacgcuacgaaacacuggaggucgauguugccucgugguucaaggacgugauggcaaaaaccgagucuccuagaacguccggaguacuuucacagccacaucugccguuuuucagguga

SEQ ID NO: 58769 - RNA, 2865 nt, Artificial Sequence
  derived and/or modified sequence opt3 from MAP3K10__Homo_sapiens__NP_002437
auggaggaagaggaaggcgccguggcuaaggagugggggaccacacccgcaggaccugucuggacugccguuuucgacuacgaagcggcuggugaugaggagcugacgcucagaaggggcgaccgggugcagguacuuagccaagauugcgccguguccggggacgaaggaugguggaccggccagcugccaucuggucgcgucgggguguuuccgucaaacuauguugcacccggagccccugcugcaccagccggcuugcaguuaccccaggagaucccuuuccacgaacugcaacuagaggagauuauaggcgugggcggauuugguaaagucuaccgagcucucuggcguggcgaagagguggccguaaaggcggcaagacuggauccagaaaaagaccccgccguuacagcugaacaggugugucaggaagccaggcuuuucggggcacugcagcauccuaauaucauugcuuugcggggagccugccucaacccaccgcaccugugucuggucauggaguaugcgcgcggcggugcccucaguagaguguuagcagggaggcgggugcccccucauguccugguuaauugggcugugcaaguagcccgcggaaugaacuaccuucacaaugaugcuccagugcccaucauucaucgagaccuuaagagcaucaacauacugauccuagaggccauugaaaaucacaaccucgcagauacuguccugaaaaucaccgacuuuggccuugccagagaguggcacaagacaaccaagauguccgcugcgggcacuuaugcauggauggccccugaagugauuaggcugucuuuguucucgaaaucaagcgauguuuggaguuuuggggugcuccugugggaguuacugacaggagaagucccauaccgggagaucgacgcucucgccguggcauaugguguagccaugaauaaguugacccugcccauaccguccacgugcccugagcccuucgcucguuugcuagaagaguguugggauccagacccucauggccgccccgacuuugggucuauucugaaaagacucgaaguuaucgagcagagcgcccuguuccagaugccacuugaauccuuucacucacugcaggaggauuggaaguuggagauucaacauauguucgacgaucucaggacuaaagaaaaggagcugcggagucgagaagaggaguuacugcgcgcagcgcaggaacagagauuucaagaggaacagcuaaggcggcgcgagcaggaacucgcugagagagagauggacaucguggaaagggagcugcaccuuuugaugugccagcugagccaagaaaagccccguguccggaaacgaaagggaaacuucaaaagaucuaggcuccugaaacuucgcgagggcgguucccacaucucacugccuagcggguucgaacauaagauuaccgugcaggccaguccaacauuggauaagcggaaaggcucugacggagcauccccgcccgccagcccuucgauaaucccaagacucagggcuauucgccugacucccgucgauuguggcgggucuuccucaggaaguagcuccgguggcucugggaccuggagccgaggaggcccuccaaagaaggaggaguuagugggugggaaaaagaaaggccggacauggggacccucaaguacccugcagaaggaacguguuggcggggaggaaagacuaaaaggacucggugagggcuccaagcaguggucuagcucagccccgaaucuggggaagaguccuaaacacacgccaaucgcacccggauuugcuagccuuaacgaaauggaggaguucgccgaagcggaggacggcgguuccucugugccucccucgccauacagcacuccuuccuacuugucaguaccccugccagccgaaccgaguccuggggcuagggcacccugggagccaacacccucugccccuccagcucgcuggggccauggagcccggagaaggugcgaucucgcacuguuaggcugugcgacccugcuuggggccgucggauugggcgcugacguggccgaggcacgagcugccgauggugaggagcaacgccgguggcucgacgggcuguuuuuccccagagcaggaagguuuccucguggccuaagcccgccagcccgcccccacggucggagagaagacguuggcccugggcugggacucgcuccauccgcgacucuggugucacuuagcucugucuccgauugcaauaguacaaggagcuugcugcgaucugacuccgaugaggccgcacccgcugccccuucaccgcccccaaguccucccgccccaaccccuacgcccagcccaucgaccaacccguuaguggaccucgaacuggaguccuucaagaaagauccucggcagucucuuacacccacucauguaaccgcugcaugugccgugagccgcggccacagaaggacaccaucagacggggcgcugggacagcgggggcccccugagccagcuggucacgggcccggaccucgagauuugcucgacuuuccgagacugccagauccccaggcccuauucccugcacgcaggcgucccccagaauuuccuggccggcccacuacccugacauucgccccaagaccuaggccggcugcaagucgcccccgacucgacccauggaagcugguuuccuuugguagaacccuuacuauaucuccucccagccggccagauacgccugagucccccggcccgccaucaguccaaccuacauugcuggacauggauauggaagggcagaaucaggacagcaccgugcccuuaugcggagcccauggcagucacuga

SEQ ID NO: 58770 - RNA, 2544 nt, Artificial Sequence
  derived and/or modified sequence opt3 from MAP3K11__Homo_sapiens__NP_002410
auggagccccuuaagagccucuuccuuaaauccccucugggcucuuggaacgggucaggaagugguggcgggggaggcggugggggaggcagaccagaaggcagcccgaaggccgcuggguacgcaaaucccguguggaccgccuuguuugacuaugagccuuccggacaggaugaauuagcgcugaggaaaggugaccgggucgagguucuaucucgcgaugcugccaucucgggcgacgaaggguggugggcaggacaagugggcggucagguagggauuuucccaucaaacuacgugagccgaggaggcggcccaccuccaugcgaggucgccaguuuucaggagcuccgucuggaagaggugauagggaucggagguuucggcaagguuuauagaggguccuggaggggagaacuuguggcugucaaagcagcccggcaggaucccgacgaggauauuucugugacagcugagagcguacgccaagaagccagacuguuugcgauguuggcacacccuaauaucauugcccucaaggcuguuugucuggaggaaccaaaccugugccucgugauggaguacgccgcaggcgguccguuauccagggcucuggccgggcggcgcgugcccccucauguccuugugaauugggcgguccagaucgcccgaggcaugcacuauuugcauugugaagcacugguuccagugauacacagagaccuaaagucaaacaauauccuccugcuucagcccauugagagugaugacauggagcauaaaacucugaagaucacggauuucggauuggcuagggaauggcacaaaaccacacagaugagcgccgcuggcacuuacgccuggauggcaccugagguaauuaaggccucuaccuuuuccaaagggucagacguguggagcuucggaguccuccugugggaauuacugacaggugaggugccauaucggggcaucgauugccucgcuguugcguacgggguggcagucaacaagcugacccugcccauaccgaguacuuguccugaacccuuugcccaauugauggcugacugcugggcccaggacccacaccgucgcccugauuucgcaucuauucuacagcagcuggaggcccucgaggcucaagugcugagagaaaugcccagggacuccuuucauagcaugcaggagggauggaagcgggaaauccagggccuuuucgaugagcugcgagccaaagaaaaggaguugcucucgcgcgaggaagaacugacaagagcagcgagggaacaacggucucaggcugagcaguuacgcagaagggagcaucugcuagcccagugggaacucgagguauuugaacgugagcugacccuuuugcugcaacagguugaccgggaacgaccacacgugagaaggcgccgggguacguucaaaagauccaagcucagggcacgcgaugggggcgagcgaauuucaaugccccuggacuucaaacaccggaucacuguccaggccaguccuggacuugaucguagaaggaauguguuugaggucggcccaggggacagcccgaccuucccccgcuuucgggcuauccagcuggaaccugccgagccaggacaagcaugggguagacagucccccaggcgauuggaagauucuagcaacggcgagcgccgggcuuguugggccugggggccuucaaguccaaagcccggagaagcgcagaauggcagaaggcguucccgcauggacgaggccacaugguaccucgauagcgacgacucuucaccgcuggguaguccuagcacuccacccgcuuuaaacgggaauccuccccggccaucccuggagccugaggagcccaaaagaccagugccggcagaaaggggcagcucgagcggaaccccuaagcuaauucagcgagcccuccugcggggcacagcucuuuuggccucccuggggcucggacgcgaucugcaacccccaggcggucccgggagagagaggggagaaucaccuaccacgccacccacuccuacaccggcaccaugccccaccgagccuccacccaguccuuuaauauguuucucucugaagacuccggacucucccccaaccccugcgccccuuuugcucgaucugggcaucccaguuggucagcgguccgccaaaucaccucgaagagaggaggaaccccgcggcgggacagugagcccaccgccuggaacgucuagguccgcucccggcaccccagggacaccccguaguccuccacuaggacugauuagccggcccagaccuucuccgcucaggucccgcaucgacccauggucauuuguaagugccggcccccgaccuagcccccugccaucgccucagcccgcaccaagacgggcuccuuggacucuuuucccggauuccgaccccuuuugggauucucccccugccaaccccuuccagggugggccacaagacugcagggcacagaccaaggauaugggagcccaggcuccuuggguccccgaagcgggcccguga

SEQ ID NO: 58771 - RNA, 2580 nt, Artificial Sequence
  derived and/or modified sequence opt3 from MAP3K12__Homo_sapiens__NP_006292
auggccugccugcacgagaccagaacacccagcccuuccuucggcggguuugugucuacucucucagaagcuaguaugaggaaacuugacccagauacgagcgacuguaccccggagaaggaucugacacccacucaugucuugcaguuacacgaacaagacgcaggagguccuggcggggccgcgggauccccagagucucgggcuucgcgcguucgagccgaugaagugcgucugcagugccagucaggcagcgguuuccuagaggggcucuuuggaugucugagacccguauggaccaugaucggcaaggcauacaguacagagcauaaacagcaacaggaagaccuuugggaggugccuuucgaagagauucuggauuugcagugggucggcuccggggcccagggagcuguguuucucgguagguuccacggcgaggaaguugcagugaagaaaguccgggaccugaaggagaccgauauaaagcaucugcgcaaacucaagcacccaaacaucauuacuuuuaaaggggugugcacacaagcccccuguuauugcaucuuaauggaguucugugcucagggacagcuguacgaaguacuuagagccggcaggccuguuaccccaucuuugcugguggacuggagcauggguauugcagggggaaugaauuaucuacaccuccauaagaucauacaccgggaucugaaauccccgaacaugcuuaucacguacgacgaugucgugaagauuucagacuuuggcacuuccaaggaacugagcgacaaaucuaccaagauguccuucgcgggcacaguggccuggauggcucccgaggucauccgcaaugagccuguuucagaaaaaguggauauuuggagcuuugggguaguguugugggagcuccugacuggagaaaucccauauaaggacgucgauaguucugccauaauuuggggugugggcuccaacagcuuacaucugcccguuccuucgucuugcccagacggguucaaaauccuccuucgacaguguuggaauaguaagcccagaaacaggccgucauuucggcaaauucuguugcaccuagauaucgcaagugcugacgugcugagcaccccucaggagacauacuucaaaucccaggccgaauggcgugaggaggucaagcuccacuucgaaaagaucaaaucugagggaaccugccugcaucgccuugaagaggaacuggugaugagaaggcgggaggaguugcgacacgcgcucgauauucgcgaacauuaugagagaaagcuggaaagggccaauaacuuauacauggagcugaaugcacuaaugcuccaacuggagcuuaaagaacgggaguugcugcgcagagaacaggcucucgagaggcguugucccggccugcuuaagccacacccuagccggggucuguugcaugggaacacgauggaaaaacucauaaagaagcgaaauguaccccagaaacugucaccacacaguaagagacccgacaucuuaaaaacugagucccugcuaccuaagcucgaugccgcucugagcggcguuggacuuccaggcugcccgaaagggcccccuucuccaggaaggucacgccgggguaagacaagacacaggaaggccagugcaaaaggcagcugcggggacuugcccggacugcgcaccgccgugccuccacaugagcccggcgguccgggguccccuggcggacucggcgggggaccaucugcuugggaagcgugucccccugcacugcgagguuuacaccaugaucugcuuuugcggaagaugucgagcuccucacccgaccuccugagugccgcucuaggcucucgugggagaggagccacuggcggugcaggggacccaggcagcccucccccagccaggggagauacaccgccuuccgagggcucagcucccgggagcaccucuccagacucccccggaggcgccaaaggugaaccuccacccccugucgggccgggagagggcgugggucugcucggcacggggcgcgaaggaaccaguggcagagggggaagccgggcaggcucucagcaccugacaccagcggcucuuuuguacagggccgcagucacucgaucccaaaagcgcgguauuucaagugaggaggaagagggggaaguggauagcgagguugaacugaccucgucccagcgguggccccagucuuuaaacaugagacagagccucucaacauuuaguuccgagaauccuucugacggagaggaaggcacugccagcgagccaucccccucagguaccccugaagugggcagcacaaacaccgaugagaggccggacgagcguagugaugacaugugcucucaaggguccgaaaucccccuggauccaccucccagcgagguaauaccaggaccugaacccucgucacuuccaauuccgcaccaggagcuguugcgcgaacggggcccucccaauucugaggacagugauugugacuccacugagcucgauaacagcaacucugucgacgcucugagaccacccgccagccuaccuccauga

SEQ ID NO: 58772 - RNA, 2280 nt, Artificial Sequence
  derived and/or modified sequence opt3 from MAP3K13__Homo_sapiens__NP_001229246
auguacugcggcauccagauucuggcccucugggagagagggguguguacccaagcucccugcuauuguauaaucauggaauacugcgcacacggacagcuuuaugagguccugagggccggucggaagauuacaccucgcuuguuaguugacuggagcacuggcaucgcguccgggaugaacuaccugcaucuacacaaaauuauccaucgagaucucaagucuccaaaugugcugguaacgcacaccgacgcugugaaaauaucagauuucggaacaaguaaggaacuuagcgacaaauccacuaagaugucuuuugccggcaccgucgcauggauggccccggaggugauccguaacgaacccguuucggagaagguggauauuuggucauucggugucgugcugugggaguugcucacaggggaaaucccuuauaaagacguagauagcagugcuauuaucuggggaguuggcuccaauucucugcaucugccagugcccagcaccuguccugacggcuuuaagauacucaugaaacagacuuggcaguccaagccaagaaacaggcccucauuccggcaaacauuaaugcaccuggauauugcaagugccgacguccuugcuaccccucaggagacguacuuuaaaagccaggccgaauggcgcgaggaggugaagaagcacuucgagaaaaucaagucugaggggacuugcauucauagauuggaugaagaacugaucaggcggcgccgagaggaacuaagacacgcgcucgacaucagggagcauuaugaacggaaacuggagcgugcaaauaaccuuuacauggaacuguccgccauuauguugcagcucgagaugcgcgaaaaggagcugauaaaaagagagcaagcuguggaaaagaaauacccaggaaccuauaagaggcacccgguccggcccaucauucacccuaaugccauggagaaguuaaugaaacgaaaggguguuccacauaaaucaggcaugcagacaaagcgccccgaucugcucagaagcgaagggaucccuacuaccgagguggcaccaacagcuaguccccuuucuggauccccgaaaaugagcaccucgucuuccaagucaagguaccggaguaagccucgccacagaaggggcaacagccgugguucccauucugacuuugccgcgauacugaaaaaucagcccgcccaggaaaacagcccacacccuacguauuugcaucaagcacagucacaguaccccagucuacaccaccauaauucccugcaacagcaguaucagcaaccacccccugcuaugagccagucucaccauccacggcucaacaugcacgggcaggacauugccacuugugcuaauaaccugcgauacuucggaccggccgcagcccuuagaucaccccugaguaaucacgcucagaggcaauugccuggcagcuccccagaucucaucucuacagcgauggcagccgacugcuggcgcucgagcgagcccgauaagggccaggcugggccuuggggauguugccaggccgacgcauaugauccaugucugcagugccggcccgagcaauacgguuccuuagacaucccgucagccgaaccuguaggcagaaguccagaucugucuaaaagccccgcucauaacccucuacucgagaacgcccaguccucagaaaagaccgaggagaaugaauuuagcgggugcaggucugaguccagucugggaacuagccaccuuggcacacccccagcauugccucgcaaaacccgaccccugcagaagucuggugacgauuccucagaagaggaagagggggagguggacagugaagucgaguucccacggcgucagagaccgcauagguguauuagcucgugccaauccuacucuacguuuagcucagaaaacuucaguguguccgauggcgaggaaggaaauaccucugaccacagcaacuccccugacgagcucgcggauaagcuggaggaccgccuugcugaaaaacuggaugacuugcucucacagacacccgagaucccaauugauauaagcagucauucugacggccuguccgauaaggaaugugccguucggagagugaaaacucagaugagcuuagggaagcugugcgucgaggaaaggggauaugagaaucccaugcaauuugaggaaucggacugugauucaucugacggugagugcagugaugcaaccgugcgaacaaacaaacacuacuccagcgccacuugguga

SEQ ID NO: 58773 - RNA, 2844 nt, Artificial Sequence
  derived and/or modified sequence opt3 from MAP3K14__Homo_sapiens__XP_011523743
auggccgugauggagauggcuugccccggcgcaccugggagcgccgucggacagcaaaaggaacugccaaaagcgaaggagaaaaccccgccccucgguaagaaacaguccucuguuuacaaacuugaagcuguggagaagucaccuguauucuguggcaagugggaaauccugaacgacgugauuacaaaggggacugccaaagagggaagugaggcaggcccagccgcuauaagcaucauugcacaggccgaaugcgaaaauucccaggaauuuucucccacguucucggagagaaucuuuauugcugguucaaagcaauauagccagagugaguccuuggaucagaucccuaacaaugucgcccacgcgaccgaagggaaaauggcaaggguguguuggaagggaaagcggcgcucuaaagcccgaaagaaacguaagaaaaagagcuccaaaucauuagcucaugccggcguugcacuggcuaagccacuacccagaacaccugagcaggaaaguugcacuauaccagugcaagaggacgaaagcccgcucggcgcccccuacgucaggaacaccccucaguucacaaagccacugaaagagcccgggcuuggacagcuguguuuuaagcaguugggugagggccuccggccugcgcugccacgcucugaacugcacaaacucaucucccccuuacaaugccugaaucauguguggaaacuucaccauccgcaggaugggggaccuuugccccugccaacccacccuuuccccuauucaagacuaccacaccccuuuccuuuccauccacuccagccguggaagccccacccucuggagagcuuucuuggcaagcuggccuguguagacagucaaaagccauugcccgauccucaucucucuaaacuggcaugcguugacuccccaaagcccuuaccggguccucaccuggaaccaagcugucucucgagaggggcucacgagaaauucucuguggaagaguaccuuguccaugcccugcagggauccgugucaaguggccaggcucacagcuugacuucccuagccaagacaugggcagcccggggcucucgcagccgagagcccucaccuaaaaccgaagauaacgagggggugcugcucacggaaaagcugaagcccgucgacuaugaguacagagaagagguucauugggcuacucaccagcuuaggcugggacgggguaguuuuggcgaggugcaucguauggaagauaaacaaaccggguuccagugcgcgguaaagaaagugcgcuuggaggucuuuagagcagaggagcucauggccugugcuggacugacauccccaaggauugugccuuuauauggcgccguucgggagggucccugggugaauaucuucauggaacugcuagaagggggcagccucggacagcuggucaaggaacagggcugccuuccagaggaccgagcauuguacuaccuggggcaagcccucgaaggacuggaguaucuucacucucgcaggauucugcacggugaugugaaagcugacaacguauugcucucaagugauggcagccaugccgcacugugcgacuucgggcacgcgguuuguuuacagccggacggacugggcaagucccuacucacuggugauuacaucccugggaccgagacacauauggcucccgaagugguccugggcaggucuugcgacgccaagguggaugucuggucgagcuguugcaugaugcuucacauguugaauggaugucacccauggacccaguuuuuccggggcccccugugccucaaaauagcauccgagccuccacccgugcgcgaaauuccuccgucaugugccccacugacggcucaggccauccaagagggguuaagaaaggaacccauucauaggguuagugcagcugagcugggagguaaagugaaccgugcccuucagcagguaggcggguugaagucuccuuggcggggagaguauaaagaaccacgacaucccccuccgaaucaggcgaacuaccaccaaacucuccacgcccagcccagagagcugagcccaagggcuccuggcccccgcccagcagaagagacaaccggucgggccccuaagcuacagcccccacugccgccugaacccccagagcccaauaaauccccuccacucacucugucaaaggaggaaagcgggaugugggagccccuuccuuugucuucccuggaaccggcuccagccagaaaccccaguagcccugagaggaaggcaacaguccccgagcaagaauuacagcagcucgagaucgaacuguuucuuaauucucugucccagccauucucauuggaggaacaagagcagauccucaguugccugagcauugacucgcuaucccugucugaugacagcgagaaaaacccuucaaaggcgagucaguccucucgcgauacccucagcuccggcgugcauucauggagcagucaggccgaagcucgaucuuccagcuggaacaugguucuggcccggggacgucccacggacaccccaucguauuuuaauggcgugaaaguccaaauacagucacuuaacggggagcacuugcacaucagagaguuccauagggugaagguaggagauauugcaacaggcaucucuagucagauaccugcugccgcauuuucccuggugacuaaagacggucagccgguucgcuacgauauggagguccccgacagcgggauugacuuacaauguacccucgccccagauggaucuuucgcuuggagcuggcgggugaagcacggccagcuggaaaauagaccuuga

SEQ ID NO: 58774 - RNA, 3648 nt, Artificial Sequence
  derived and/or modified sequence opt3 from MAP3K19__Homo_sapiens__NP_001018054
augagcuccaugcccaagccugagagacacgccgaaucucugcucgacaucugccaugauaccaacucaaguccaacagaccuuaugacugugacgaaaaaucagaacauuauacugcaaagcaucuccaggucugaggaauuugaucaggacggcgauuguucgcacucaaccuuggucaaugaggaagaggacccgagcgggggacggcaggauuggcagccccgcacagaggaauuuaguacuucccauaugaaguacucuggucgaagcauuaaauucuuacugccuccacuaucccuccugcccacccguucaggcguucuuacaaucccucaaaaccacaaguuuccaaaagagaaggaaagaaauauucccagucugaccagcuucgugccuaaguugucuguauccgugaggcagucagacgagcucagcccaaguaacgagccgcccggggcucuggucaaaucucugauggauccuacucuccgguccagcgacggauuuaucuggucgcgcaauaugugcucuuucccaaagacaaaccaucacagacaguguuuagaaaaagaggaaaauuggaaguccaaagagauagaagagugcaacaagaucgagauuacccacuuugaaaagggccagucacuggugaguuucgagaaucuuaaagaagguaacauccccgcaguuagggaggaagauauugacugucaugggagcaagacgcggaaaccugaggaggaaaauucccaauauuugucuagccgcaagaacgagucaaguguggccaaaaauuacgaacaggauccagagaucgucugcacuauacccuccaaguuucaggaaacccagcacagcgagauuacaccgucucaagacgaggaaaugcgaaacaacaaagcggcuucaaagagagugagucugcauaagaaugaggccauggaaccuaacaauauccuagaggaguguacuguacucaaaagccuguccucuguuguguucgacgaucccauugacaaacuuccagaaggaugcucgagcauggagaccaacaucaagaucuccauugcagaaagggccaagccugagaugucacggauggucccccugauacacaucacauuuccaguggauggcagucccaaagaaccugugauugcuaagccaucuuugcagacccguaagggcacgauccacaauaaccauagcgucaauauaccgguucaccaggagaacgacaaacauaagaugaacucccaccgcucaaaacucgauagcaagacuaaaacaucuaagaagacuccccaaaauuucgugauuuccaccgaggggccuaucaaaccaacaaugcauaagaccaguaucaaaacgcagauuuuucccgcacugggauuaguagacccuagaccauggcagcugcccagguuccagaagaaaaugccgcaaaucgccaagaagcagagcacccaccggacacagaaaccuaagaaacagucuuucccauguauuugcaagaaucccgguacucaaaaauccugugugccucucucaguccagcccaccgaaccacgacuuaacuaucuggauuugaaguacagugacauguuuaaagagauaaauagcacagcuaacggcccugggaucuaugaaauguucggaacucccguguacugccacguucgcgagaccgaaagagaugagaauacauauuacagggagauuugcucggccccauccggccggcgcaucaccaacaaguguagaucuagccauucagaaaggaagaguaacauccguacucggcuaucccagaaaaagacgcacaugaaaugcccgaagacaucuuuugguauuaaacaggagcauaaggugcugauaagcaaggaaaaauccucaaaggcgguccacagcaaucuccacgacaucgagaacggggauggaauuagugaaccugacuggcaaaucaaaucuuccggcaaugaguuccugagcucgaaggacgagauucaucccaugaaccuugcacagaccccagaacagucaaugaaacagaaugaguuucccccugugucugaucugaguaucguagaagagguuuccauggaggaaagcacuggcgaccgagauauaucuaacaaucaaaucuugaccacaagccucagagaccugcaggaguuagaggagcugcaccaucagauuccauucauccccuccgaagauucaugggccgugccuagugagaagaacagcaauaaguacguccaacaggagaaacagaacaccgcuucucuauccaaggugaaugccucaaggauucucacuaacgaccuggaauuugauagugucagcgaccacuccaaaacacuuacgaauuucucuuuucaggcaaagcaagagucggcuagcucacagaccuaucaguacugggugcauuauuuggaucacgacucccuggccaacaaaaguaucacuuaccagauguucgggaagacacucucuggaaccaauagcauaucccaagaaauuauggauucaguuaacaacgaggaacugacagacgagcuucuggguuguuuggcggccgagcuccuggcauuagaugaaaaggacaauaacucuugccagaaaauggcuaaugagacugacccggaaaaccugaaucuagugcuccgcuggcggggcagcaccccaaaggagauggggagagaaacgaccaaaguaaagauccagaggcacaguuccggacugcgcauuuaugaucgagaggagaaauuucuuaucagcaacgaaaagaaaauauucucugaaaauucauugaaguccgaggaacccauccuguggacaaagggcgagauucucgguaaaggggccuacggcacugucuauuguggacugaccagucagggccaauuaaucgcugugaagcagguugcccuggacacaagcaacaaacuugcagccgaaaaggaguaccggaaauugcaggaagagguggaucuccugaaggcucuaaagcaugucaauauuguggcguaccuggggacuugccuccaagaaaacaccguaucgaucuuuauggaguucgugccuggagguucuauauccagcauuaucaaucguuucggcccacugcccgagaugguuuucuguaaauauacgaagcagauccuucagggggucgcauacuugcacgaaaacugcguggugcauagagacauuaaaggaaauaacgucaugcugaugccuacaggcaucauuaaguuaauagauuucgguugugccaggcgccucgcuugggccgggcugaauggcacccacucagacaugcuuaaaaguaugcauggaacuccguauuggauggcacccgagguuaucaacgaaucuggcuacgggcggaaguccgauauuuggagcaucggaugcacaguguuugagauggccaccgguaagccaccucuggcuucaauggacagaauggccgcaauguucuauauuggcgcgcacaggggguugaugcccccacucccugaucacuuuagugaaaacgcugccgacuucgugcgaaugugucugacucgcgaucagcaugagcggcccagcgcacuacaacugcucaaacacuccuuucuggagagaucucauuga

SEQ ID NO: 58775 - RNA, 4539 nt, Artificial Sequence
  derived and/or modified sequence opt3 from MAP3K1__Homo_sapiens__NP_005912
auggccgcugcagccggcaacagagcgagcuccucuggguuccccggagcuagggccaccucaccugaggcugguggcgggggaggcgcccugaaggcuaguagcgcaccagccgcugccgcgggucuccuucgggaagcaggguccggaggccgcgagcgagccgacuggcguagaaggcagcugcggaaagugcgcucugucgaauuggaucaauuaccggagcagccccuguuucuagcugccucgccuccagcaucaagcacaagucccuccccugaaccagcugacgccgcgggcucugggacuggauuccagcccguugccgugccuccaccgcacggugcagcuagcagaggcggggcccaucucacggaguccguagcugcccccgauucaggagcaaguagcccugccgcugcggagccaggcgaaaagagggcacccgccgcugagccuucuccagccgcagcccccgcuggucgggaaauggagaauaaagagacccugaaggggcuucacaaaauggacgaucgcccggaggaacgaaugaucagagaaaagcugaaggccacaugcaugccugcauggaaacaugagugguuggaaaggcggaaccgucgcggacccguggucgugaagccaauuccuguuaaaggcgacggcuccgagaugaaucaccucgcggcugagucacccggggaagugcaggccagcgcagccaguccagcuucuaagggaagaaggucccccagcccugguaacucgccaucuggccggacugucaaauccgagucaccgggggugcgacgcaagagaguaagucccguuccuuuucaaagcggaaggauaaccccaccccggcgcgccccuuccccagauggcuucucucccuacagcccggaagagacaaauagaagggugaacaaggucaugcgugcacggcuguaucugcuccagcagaucgguccuaauucauuuuuaauugggggcgacaguccagauaacaaauaccgaguguucaucggaccccagaauuguuccugcgcuagaggcaccuuuuguauucaucugcuuuucgugauguugagggucuuucaacuggaaccuagcgaccccaugcuauggcgcaagacucucaaaaacuucgagguugagucucuguuucagaaguaucacucacggagaaguagcaggaucaaagccccaucccgcaauacaauacagaaguucgugucucgaaugucgaacagccacacccuuuccucaaguucuacgagcacuuccucaagcgaaaauucuaucaaagaugaggaggaacagaugugcccuauuugucuguuggggaugcucgacgaagagucccugaccguaugcgaggauggaugucggaacaaguuacaucaccauugcaugaguaucugggcggaagagugucguagaaauagggaaccccugauuugcccacucugucgcagcaaguggcggucucacgacuuuuacucccacgagcuuucaaguccgguggacagcccuucgucccugagagccgcucaacagcagacaguccaacagcagcccuuggcagguucuaggcgaaaccaggagagcaacuucaaucuaacucauuauggcacccaacagaucccacccgccuacaaagaucuggcugaaccuuggauacagguguucgggauggagcucguuggaugccuguuuucacgcaacuggaaugugcgggaaauggcccuuagaaggcugagucacgacgucuccggcgcauugcuccuggcgaacggugagucuacagggaauagcggcggauccucaggcagcaguccaucugggggagccaccuccgguagcucgcagacgucaauuucuggcgaugugguagaagcaugcuguaguguuuuauccauggugugcgccgaccccgucuauaagguguacgucgcagcucugaaaacucuacgugccaugcucguguacacaccuugucauagccuggcagagcgcaucaaguugcaacgguugcugcagccgguuguggauaccauucucguaaaaugcgccgacgcuaacucuagaacuagccagcuguccaucucaacacuucuggaguuguguaaggggcaggcgggagaacucgccgucggcagggagauccugaaggcagguaguauugggauaggcggaguggauuauguuuuaaauugcauccugggcaaccaaaccgaaagcaauaacuggcaggagcuacucgggcgacugugucuuauugaccgguugcugcucgaguucccagcugaauuuuacccccacaucgugucuacggaugucucccaggccgagccuguggaaauacgcuauaaaaagcuguuaucacugcuuaccuucgccuugcagaguauugacaauagccauuccaugguaggaaaacucucuagaaggaucuaccugucgagcgcucggauggugacaacuguuccacacgucuuuucaaagcuacuggagaugcucuccgugaguucuagcacccacuucacacgaaugagacgcaggcugauggcaaucgccgaugaaguggagauugcggaagcuauccaacuuggcgucgaggacacuuuggacggucagcaggauuccuuucugcaagccucaguucccaacaauuauuuagagaccacagaaaacucuagcccugagugcaccgugcaucucgaaaagacugggaagggacugugugcaacgaaacuuagugccuccagcgaggacauuucugagcgucuggcuucaauauccgugggcccgaguagcucgacaaccacuaccacaaccacuacagaacagcccaaaccaaugguacagacgaagggucggccucacucucagugccuuaauuccagcccccucucacaucacagucaacugauguucccagcacuaucuaccccuuccagcucaacucccagugucccagccggcacagcgaccgaugugagcaaacacagacugcagggguuuaucccguguaggauuccuuccgcuucuccccagacacagcgcaaguucagccuccaauuucaucgaaacugcccagagaacaaagacuccgauaagcugucacccguuuucacucagucuagaccucuuccaaguucgaauauccaccggcccaagccuagcaggccgaccccaggaaacacguccaaacagggcgaccccucuaaaaauucaaugaccuuggaucugaacagcuccaguaaaugcgacgauucuuuuggguguagcucaaauuccaguaacgccgugaucccuagcgacgaaacagucuucacucccguggaggaaaagugccgcuuagauguuaauaccgagcucaacucuuccauugaggaccugcuugaagcaucaaugccaagcucggauacaacugugaccuucaaaucugagguagccguccugaguccugaaaaggcugagaaugacgacacguacaaagaugacgugaaccauaaucagaaguguaaggaaaagauggaggccgaggaagaggaagcacuagcuauagccauggcgauguccgccagccaagaugcacuccccaucgugccacagcugcaggucgagaacggagaagacauuaucauuauccaacaggauacaccugagaccuugccgggccacacuaaggcuaaacagcccuaucgugaggacacagaauggcugaagggucagcaaauaggguuaggagccuuuucauccugcuaccaggcucaggauguuggcaccgguacucucauggcagugaaacagguaaccuacgugagaaauacaucuagcgagcaagaagaggucguggaggcccugcgggaagagaucaggaugaugagucaucuuaaccacccaaauauuauccgcaugcugggcgccacgugugaaaaguccaacuauaacuuguucauugaguggauggcugggggaagcguugcgcaccuccugucuaaguacggcgcauuuaaagaaucaguggucaucaauuauaccgagcagcuacugcgagggcuuaguuaccuccaugagaaccagauaauucacagagacgugaagggagccaaucuguugaucgauuccacuggccagcggcugaggauugcugacuucggugccgcagcccgcuuagcuagcaaagggacaggagcgggcgaauuucaaggucagcuccugggcaccaucgccuucauggcaccugagguucuuagagggcagcaguauggaaggucuugcgauguguggucggucggcugugcuauaaucgaaauggccugcgcaaagcccccauggaacgccgagaaacauucaaaucaccuggcuuugauuuuuaagaucgccagcgcgacaacugcaccuuccauucccagucaucucucuccggggcugcgggacguagcccuacguugucuggaacuucaaccacaggaucgcccucccagccgagagcuccugaagcacccaguguucagaaccacgugguga

SEQ ID NO: 58776 - RNA, 1860 nt, Artificial Sequence
  derived and/or modified sequence opt3 from MAP3K2__Homo_sapiens__NP_006600
auggacgaucagcaagcccugaacagcaucaugcaggaccucgcugugcuucacaaggcauccagacccgcccugucuuugcaggagaccaggaaagcgaagucaaguagcccuaaaaagcagaaugauguccggguuaaauucgaacaucgcggcgagaagcgaauuuuacaauuuccacguccggugaagcuggaagaccuaagauccaaagcuaagauagccuucgggcagucuauggaucuccacuacacaaacaaugagcugguaaucccccuuacuacgcaggacgaucuggacaaagcaguggaauugcucgauaggucgauucauaugaagucacugaaaauccugcucgucauuaacggaagcacccaggccacaaauuuagagccucugccaagucuugaggacuuggauaacacuguguuuggugcugaacggaagaagcgccuguccaucauaggccccaccucuagagacaggagcuccccuccacccggguauaucccugaugagcuacaccaaguugcacggaauggaucauucacaaguauuaacagcgaaggcgaguuuaucccagagucuauggaccagaugcucgacccgcugucccuuucaagccccgaaaauagugguucuggguccugcccuagccuggauucgccauuggacggagagucuuaccccaaaucccgcaugccucgagcccagucauauccagauaaccaucaggaguucagugacuacgauaaucccauuuuugaaaaguucggcaaaggcgggaccuauccgagaagguaccacgugagcuaucaccaucaagaauacaacgacggacggaagacuuuuccucgugcucgcagaacacaggguaccucccucaggucucccgucagcuucucaccaacggaucacagucuguccacuagcucuggcucaaguaucuuuaccccugaguacgacgauagccggauacgacgcagaggguccgacauugauaaucccacauuaacugugauggacaucucuccacccucgaggagcccucgggccccaaccaacuggcgccugggaaaacuccuuggccagggugcguucgggagaguauaucuguguuacgacguugauacaggaagggaguuggcagugaagcaaguccaguuugacccggauucccccgaaaccucaaaagaggugaaugcccuagaaugcgagauucagcugcucaagaaccugcuucaugaacguaucgugcaguauuacggcugucugcgggacccucaagagaagacguugaguaucuucauggaguauaugccaggcgggucuauuaaagaucagcucaaggcuuacggagcccugacugaaaacgucacacgaaaauauaccagacagauauuagaggguguucacuaccugcacagcaauaugaucgugcauagggacauuaagggcgcaaacauccuacgcgauuccacugggaauguaaaacucggagacuucggcgcuucaaagcggcugcagacaauaugccuuagcgguaccgggaugaagucugugacgggcacccccuacuggauguccccugaagucauuaguggagagggcuaugggagaaaagccgauaucuggagcguggcguguacaguuguggaaauguugacugagaagccacccugggccgaguuugaagcaauggcugccaucuucaaaauugcuacccaaccgacaaacccuaagcugccaccccacgucucugacuacacuagggauuuucucaaacgcaucuucguggaggccaagcugcgaccuuccgcagacgaacuucugcggcauauguuuguacacuaucauuga

SEQ ID NO: 58777 - RNA, 1881 nt, Artificial Sequence
  derived and/or modified sequence opt3 from MAP3K3__Homo_sapiens__NP_002392
auggacgagcaggaagcccugaacagcaucaugaaugaucucguggcucuacaaaugaacagaaggcaccggaugcccggcuacgagaccaugaagaauaaagacacagggcauuccaaccgccagucugauguccgaauuaaguucgaacacaauggagagcguagaauaaucgcauuuucaaggccuguuaaauaugaagacguggagcauaagguaacuacgguguucggucagccacuggauuugcacuacaugaacaaugaguuaaguauucugcuuaaaaaccaggacgaucucgacaaggccaucgauauucuggaccggagcuccucuaugaagucgcuucgcauccuguugcucucacaagauagaaaucauaacagcaguuccccgcacucuggcgucagcaggcaagugcggauaaaagcgucccagucagcuggggacaucaauaccauuuaucagcccccugaaccacgcagucgacaccugagcguuucuucccagaaccccggaagaucaagcccuccacccggcuacgugccugagaggcagcagcauaucgcccggcaggguaguuauacaucuauuaauuccgaaggggaguuuaucccagagacuagcgaacaaugcaugcuggauccgcucucgucugcagagaacuccuuaucaggaaguugucagagccuggaccguuccgccgacucucccagcuuccgcaagucaagaaugaguagggcucaguccuuuccugauaaucggcaagaauacagcgaccgagagacccagcuuuaugauaaaggcgucaagggcgggacauacccacgcagauaccacgugucuguacaucacaaagacuauucagauggaaggcggaccuucccccgcauaagaaggcaccaggguaacuuguuuacucugguuccuaguagccguucccuaucuacaaacggcgaaaauauggggcucgcagugcaguaccuggacccacggggacgacuuagaucggccgauagcgagaacgcucuguccguccaagagaggaaugugcccaccaagucaccgagugccccuauuaacuggcgccggggcaaguugcucggucagggggcguucggaagaguguaucugugcuacgacgucgauacgggcagggaauuagcaucuaaacagguucaguuugaccccgauagcccagagacuuccaaggaagugucagcccuggagugugaaauccaacuccuuaaaaaucugcagcaugagcgcauuguacaguauuacggcugcuugcgagaccgggcugagaagacccuaacaaucuucauggaauauaugccugggggaagcgugaaagaccagcugaaggccuacggugcacucacugagucugucacccguaaauacacaagacaaauccuggaaggcauguccuaucuucacaguaacaugauugugcauagggauauaaagggggcuaauauccugcgcgacagcgccggaaacguuaaguugggcgauuuuggugcgucuaaacggcuccagaccauuuguauguccgggacgggcaugagaucagugacuggaacacccuacuggaugaguccagaggucaucagcggcgaaggguauggaaggaaggccgacguguggucgcuggguugcaccguaguugagauguuaacugagaaacccccuugggcagaauacgaggcuauggccgcuauauucaagauugccacacagccaaccaauccgcagcugcccucccacaucucugaacauggccgagauuuucuacgccggaucuucguggaggcaagacaaaggccuagcgccgaggaacuccugacgcaccacuucgcucagcuuauguauuga

SEQ ID NO: 58778 - RNA, 4827 nt, Artificial Sequence
  derived and/or modified sequence opt3 from MAP3K4__Homo_sapiens__NP_005913
augagagaggccgcugcagcccuggugcccccuccagcguucgcugucaccccggccgcagccauggaggaacccccuccacccccuccacccccuccaccgcccccugaaccagagacagaaagcgagcccgagugcugucucgcugcaaggcaggaaggcacucuuggggacuccgccugcaagucuccugagucagaucuggaagacuuuagugaugagacgaacaccgagaauuuguacggaacaagcccacccuccacuccgcggcaaaugaaacgcaugucuaccaagcaccagcgaaacaauguuggucguccugcuucgagaucaaacuuaaaagaaaagaugaaugcccccaaccagccaccucauaaagacacaggcaagaccguggagaauguagaagaguauagcuacaagcaggagaaaaagaucagggcggcacugcggacuacagaacgcgaucacaaaaagaacgugcaauguaguuucaugcuagacuccgucgggggaucucuccccaaaaagagcauuccagauguggaccugaauaagcccuaucuuucccugggcugcucaaacgccaaauugccuguuagugugccaaugccgauagcuagacccgccaggcagaccagccggacggauuguccugcagaccgccucaaguuuuucgagacucugcgacugcucuuaaaacugaccucugucuccaagaaaaaggauagagaacagaggggucaggagaauacaucaggguuuuggcuuaaccggagcaaugaauugaucuggcuggagcuacaggcuuggcaugccggacguacuauuaacgaccaagauuucuuucucuacaccgcgcgccaggccaucccagacauuaucaaugaaauacugacauucaaaguggacuauggcaguuuugcauucguaagagauagggcuggcuuuaacgggaccucuguugagggacagugcaaggccacgcccgguacuaagaucgugggcuacuccacacaccaugagcaccuucaacggcagcgagucagcuucgaacaggugaaacgcauuauggagcuguuggaauauaucgaggcucucuacccuucgcugcaagccuuacagaaggacuacgaaaaauaugcagccaaggauuuucaggacagagugcaggcucugugucucuggcuuaacauuaccaaagaucugaaucaaaaguugaggaucauggggacuguccuaggaauaaagaaccugucugacauuggcuggccaguuuucgagauccccuccccgcggccuucaaaagguaaugagccagaauacgagggggaugacacagaaggagagcucaaggagcuggaaaguagcaccgaugaguccgaagaggaacagauuucugacccccgcgugccugagaucagacagcccaucgauaacagcuucgacauucagucaagggacugcauaaguaaaaagcuggagcgucuugaauccgaggaugacagcuugggcuggggcgcgccagauuggucuacggaagcaggguuuucacggcacugucucaccaguaucuaucgaccuuucguagacaaagcccugaagcaaaugggauuaagaaagcugauucuaaggcuccauaaacugauggaugguagccuucagcgcgcucggaucgccuuggugaagaaugacagacccgucgaguuuuccgaguucccagauccgauguggggcucugacuacgugcagcugucgaggacaccucccagcuccgaagagaaaugcucagcaguuaguugggaggaacucaaggccauggaucugccaucuuuugaacccgcuuuccuugugcugugucgcgucuugcucaacgugauacacgagugccugaaauuacgacuggaacagcggccugccggggagccaagccuacucuccauuaagcaacugguacgugagugcaaggaaguucuuaaaggaggcuugcugaugaagcaguauuaccaguuuaugcuccaggaggugcuggaagacuuagagaaacccgauuguaauaucgacgcauucgaggaagaucugcauaagaugcuuauggucuauuuugacuacaugagaucauggauccaaauguugcagcagcucccucaagcgagccacucucugaaaaaccuacuggaggaagaguggaauuucacuaaggaaauuacccacuacaucagggguggggaggcucaggccggcaaacucuuuugcgacauugcaggaaugcugcuuaaguccacaggcaguuucuuggaguuugggcugcaggaaagcugugccgaguucuggacuucugcugaugacuccucagccagugaugaaauacgccggagcgugaucgagauuucgagagcauuaaaggaacucuuccaugaggcuagggagcgagccuccaaagcgcugggauuugccaagaugcuucgcaaagaccuggaaaucgcugcagaguuccgguugucugccccggucagagaucuccuggacgugcuaaagagcaaacaguauguuaaggugcaaaucccaggucuggaaaaccuccagauguuuguacccgauacccuggcugaggaaaagucaauuauacuucaguugcugaaugccgcagcgggcaaagacugcaguaaggauuccgacgaugucuuaaucgacgccuaccuccugcuuacaaaacacggggauagggcucgugacucugaggacagcuggggaaccugggaggcccagccugugaagguugugccacaagucgaaacuguggauacgcugcgcuccaugcagguagacaaccuacuccuggugguuaugcagucagcacauuugacaauucagcggaaggcuuuccaacagagcaucgagggccugaugaccuuaugucaggaacaaacuuccucucagcccgucauugccaaagcacuccagcagcugaagaaugaugcccuugagcugugcaacagaaucuccaaugcuauagacaggguggaucacauguuuaccagcgaguucgacgcggaaguggaugagucggaaucagucacauugcaacaguauuaccgagaggccaugauccaggguuauaacuuuggguucgaauaccauaaagagguugugcggcucaugucuggcgaguuucgccagaagauuggagacaaauauaucaguuucgcaagaaaguggaugaacuacgugcugaccaaaugugaauccggcagggggacucggccucgaugggcuacacaaggauuugauuuccuacaggccauugagccggccuuuaucagcgcucugcccgaagacgauuuccuuucucuccaggcacugaugaaugagugcauaggucacguaauuggcaagccacacagcccugucacgggguuguaccuggccauccauagaaacaguccccgcccaaugaaggugccuaggugucacucagaucccccaaauccgcauuuaauuaucccuacccccgaaggauucaguacucguagcaugccaucugacgcgcggucccacggcucacccgcugccgcagccgcugcagccgcggcugccguugcagccaguagaccuagcccauccgguggggauucugugcuccccaaaucgauaagcucagcucacgacacaaggggcuccagugucccugagaacgaucgccuggccucuaucgcagcugagcuucaguuucgaagccuguccagacauucaucuccgaccgaggaacgggacgaaccagccuaucccaggggagauagcaguggcuccacacgccguagcugggaguugagaacucucauuucucaaucaaaggacaccgcguccaaacuggggccuaucgaagccauucagaagagugugcggcuauucgaggagaaaagguaccgcgaaaugcgaagaaagaauaucauaggacagguuugcgauacgcccaaaagcuaugacaacgugaugcacguaggccugcggaaggucaccuuuaaguggcagagggguaauaaaauuggggagggacaauacggcaagguguauacauguaucucgguggauacuggugaacuuauggcaaugaaagagauccgcuuccagccaaacgaccauaagaccauuaaagagacagcugaugaacucaagaucuuugagggcauuaagcacccuaaucuggucagauacuucgggguugaauugcauagggaggaaauguauauauuuauggaguacugcgacgagggaacuuuagaagaggugucucggcugggccuccaggaacacguaauccgucuguacuccaaacaaauuaccaucgccauuaacgugcuucacgagcaugggaucguccaccgcgauauaaagggagcuaauaucuuccugacgagcucaggcuugauuaaacuaggugacuuugggugcagugugaagcugaaaaacaaugcacagacaaugcccggagaaguuaacucuacccucggcacugccgccuauauggcuccagaggugaucacacgagcgaagggugagggccaugggagagcagccgacauuuggucccugggaugugucgugaucgaaaugguuaccggcaagaggccuuggcacgaguacgaacauaauuuccagauaauguauaaaguggggaugggacacaagccgcccauuccagagcggcuuagcccugaaggcaaagacuuuuuaucacacugccuggagagugaccccaagaugcgcuggacugcuagccagcucuuggaucauuccuucgucaaaguauguaccgacgaggaauga

SEQ ID NO: 58779 - RNA, 4125 nt, Artificial Sequence
  derived and/or modified sequence opt3 from MAP3K5__Homo_sapiens__NP_005914
augagcaccgaggccgacgaaggcaucacauucuccgugcccccuuuugcuccaucuggguucugcacuauuccggagggagguauauguagaaggggcggggcagccgcggucggagaaggcgaggaacaccagcugcccccuccacccccugguucauuuuggaacguugagagugcugccgcaccagggaucggaugccccgccgcuacgagcuccucuucggcaacccggggccgcggcucaagcguagggggagguagucgacguacaacuguggccuacgugauuaaugaggcuucccaaggccagcucgucguggccgaaucugaggcgcuucagagccugagagaagcaugugagaccguuggggccacauuggagaccuuacauuucggaaagcuggauuuuggcgaaacuacagugcuagacagguucuauaacgcugauaucgccgucguggagauguccgacgcauuucggcagccuucacucuucuaccaccuggguguacgcgaaaguuuuagcauggcuaauaacauuauccuuuauugcgauaccaauucugacucccugcaaucauugaaagagauaaucugucagaagaacacgaugugcacugggaauuacaccuucguuccauauaugauuacaccgcauaacaaaguguacuguugcgauagcaguuuuaugaagggacucacugaacugaugcagcccaauuucgagcugcucuuaggcccuaucugucugccacuugucgacagauuuauucaguugcugaaaguggcccaagcgucuuccagccaguauuucagggagucgauccuaaacgauauacggaaggcccgcaaucucuacaccggcaaggaacuggcagcugagcuugcccgaauuagacagaggguggacaacaucgaaguccugacagcugauauuguuaucaauuugcuccugucuuaccgggacauccaggauuaugacuccauugugaaauuaguagagacccuggaaaagcuccccacguucgaccuugccucacaccaucacgugaaauuucacuacgcauucgcccugaaccgucgcaauuugccuggggauagagcuaaggcgcuagacauaaugaucccaaugguccaaagugagggacagguggcaagcgauauguauugccugguugguaggauuuacaaagacauguuucucgauuccaacuucacugacacagagucucgggaucauggcgccagcugguuuaagaaggcuuucgaaucagagcccacccugcagagugggaucaacuaugccgugcuucuguuggcagccggacaccaauuugaauccagcuucgagcuccgaaaagucggcgugaagcugucuucauuacuggguaaaaaggggaaucuagaaaaacuccagaguuacugggagguaggcuuuuuccugggagcuagcguucuugccaacgaccauaugcgcgugauacaggcauccgagaaguuguuuaaacugaagacuccggcgugguaucucaagucuauugucgaaacaauccugaucuacaaacacuucgugaaacuuaccacggagcagccugucgcuaagcaagaacugguggauuuuuggauggacuucuugguugaggccaccaagacagaugugacuguagucagauuccccgugcucauucuggagccaaccaaaaucuaccagccuucguauuuaagcauuaauaacgaaguugaggaaaagacaauauccaucuggcacgugcugcccgacgacaagaaaggcauucaugaguggaauuuuucagcaaguucugucaggggagugagcaucuccaaguucgaagaacgguguugcuuucuauacguacuccacaacucagaugacuuccagaucuauuuuugcacugagcugcauuguaaaaaguucuuugaaauggugaauaccauuacagaggaaaaagggcgcagcaccgaggaaggugauugcgagucugaccuuuuggaguacgauuaugaauacgacgagaacggcgauagaguuguccuggggaagggaacuuauggcauaguguacgccgguagggaccucuccaaucaggugcguaucgcuauuaaggaaaucccagagcgggauagucgauacagccaaccccugcacgaagagauugccuuacauaaacaccugaagcacaaaaacaucguccaguaucuugggucuuucuccgagaauggcuuuauaaagaucuucauggaacagguuccuggaggcucauugagugcacuccugagaagcaaaugggggccacuaaaggacaacgagcagacgauuggauuuuacacaaagcaaauccuggaaggucucaaauaucugcaugauaaucagauugugcacagggacaucaagggcgauaacgugcuuauaaauaccuacucggggguauugaaaauuuccgacuucggaacuucuaagcgccuggcuggcaucaacccguguaccgagacauuuaccgguacuuuacaguauauggcccccgagauuaucgacaaagggccucggggcuacggaaaggcggccgauauauggagccucggcugcacaaucauugaaauggcuacggggaaaccacccuucuaugagcugggagaaccucaggcagccauguucaaggucggcauguuuaaggugcauccagagauccccgaaucaaugagugcugaggccaaagcauucauucuuaaguguuuugagccggacccugauaaaagagcgugcgccaacgaccuguugguugaugaguuccucaagguguccucuaaaaagaagaaaacccaaccaaagcugagcgcucuauccgccgguucaaaugaguaccugaggagcaucagucuccccgucccugugcugguugaagacacuucuuccagcucggaguacgggucagugucucccgauacagaacuuaaaguagacccauuuaguuucaagacccgcgcaaaauccuguggagagcgagaugucaagggcauacggacauuguuucuggguauuccugacgagaacuucgaagaucacagcgcucccccaucuccggaggaaaaggacagcggcuuuuucauguuacguaaagauuccgagagaagggccacucuccaccgcauccugaccgaagaccaggacaagaucgugcggaaucuuauggagucacuggcacagggggccgaggaaccuaaacuaaagugggagcauauuacgacccucaucgcuagucugagagaauuugugaggagcacagaucgaaaaauuauagcgacuaccuugucuaagcugaaguuagagcucgacuucgauucccacggaaucucacaaguccagguugugcuguucggcuuucaggacgccguaaacaaagugcuucgcaaucauaacauuaagccccacuggauguucgcacuggauaguaucauucggaaagcuguccagacagccaucacuauauuggugccagagcucagaccccauuuuagccuggccuccgaaucugacaccgcugaucaagaggaccuagauguugaagacgaucacgaggaacagccuucgaaucagacggugaggcguccacaggcagucaucgaggacgccguggcgacaagcgggguuucaacccuguccaguacugugucucacgacagccaauccgcucaucgcucacuuaacguccagcucggacggaugaagauugagacaaauagacuguuggaggaacugguaaggaaagaaaaggaguuacaggcccuccugcaccgagcaaucgaagagaaagaucaggagauuaagcaucuuaagcugaaaucucaacccaucgaaauaccugaguugccgguguuccaccucaacagcaguggcaccaauacugaagacuccgagcugaccgauuggcuacggguuaacggugccgacgaagauacaauuagccgcuuucuggcugaggacuauacgcuucucgaugugcuguacuaugucaccagagacgauuugaagugcuuaaggcugcgagggggaaugcucuguacucuguggaaagcaaucaucgacuuccggaauaagcagacauga

SEQ ID NO: 58780 - RNA, 3843 nt, Artificial Sequence
  derived and/or modified sequence opt3 from MAP3K6__Homo_sapiens__NP_001284538
auggccggccccugcccuagaagcggggcugagagggcaggauccuguuggcaggacccacuggccguggcgcucucucggggucgccaacuugcugccccgcccggccgagggugcgcacguucaagaccucugagugucguuuacguguugaccagggaaccacagcccggauuagagccucgggaaggcacagaggccgaaccacugccccuacgcugucucagagaggcuugcgcacagguaccuaggccacggccgcccccucagcugcgcagccuuccauucgguacucuggaguugggggauacggccgcucucgacgccuuuuauaacgcggauguggucgugcuggaaguuuccucuucgcuggugcaacccucacucuucuaccacuuaggaguccgagagagcuuuaguaugaccaauaacgugcugcuuuguucccaggcagacuugccugaucugcaggcccuaagagacugcguaggcucuuauacacucaucccauacguugugacugcuaccggcaggguccuguguggggaugccggacuucugcgggguuuggcagacggccucgugcaggcuggggugggaacagaagcccuguuaacuccccuggucggccgucucgcgcgccuucuggaggccacuccgacagauagcugcgguuauuucagagagaccauuaggcgggacauacgacaagcacgcgaaagauuuuccgggccucaguugaggcaggagcuagcucggcugcagcgcagacucgauucaguugaacugcuuagucccgacaucauuaugaaucuguugcucagcuacagggaugugcaagacuauucugccaucauugagcugguagaaacguuacaggcucugccaacuugugacguggccgagcagcauaacgucugcuuccacuacaccuuugcacuaaaucgucggaaccgaccuggagauagagccaaggcucucuccgugcugcuucccuugguucaacuggagggcucaguggcgccagaccucuacuguaugugcggcaggaucuauaaagauauguucuuuagcaguggguuccaggacgcaggacaucgcgaacaggccuaccacugguaucggaaggcuuuugaugucgagcccucucugcauuccgguauaaaugccgcagugcuucugaucgccgcuggccagcacuucgaagacagcaaagaguugagacucauugggaugaagcugggaugcuuacuggccaggaaaggcuguguagaaaagaugcaauacuauugggauguugguuuuuaccuaggggcacagauccucgcgaacgacccuacacaggugguccuggcugccgagcagcuuuauaaguugaaugcaccaauuugguaccuggugucggucauggagacuuuccuccuguaccaacacuuccgcccgacccccgaaccuccaggcggacccccucgacgggcccauuuuugguuacacuuccugcuucagucuugccagccauuuaaaacagcuugugcccagggcgaucaaugcuuggugcucguucuggagaugaacaaggugcuacugcccgcaaaacucgaaguacgugggaccgacccggucuccacggugacucugucacuuuuggagccugaaacacaggauaucccaaguagcuggaccuuccccguugcuuccauauguggagugucugccagcaagagagacgagaggugcuguuuucuguaugcguuaccucccgcccaggacguccagcucugcuucccaucagugggucauugucaaugguuuugcggccugauucaggcuuggguaacuaauccugauaguacagcacccgccgaggaagcugagggggccggagaaaugcuugaguucgacuacgaguauaccgaaacgggcgagcgccugguguuggguaaagggaccuacggcguugucuaugcaggacgggauagacacacaagggugcgaaucgcgauuaaggaaaucccagagcgcgacucccgguuuagccagccgcuccacgaagagaucgcccugcauagaaggcuacgucacaagaacauugugcgcuaccugggcucugcuucacaagggggauaucucaaaauauucauggaggaagucccugguggcagucugagcucccuuuugcggucuguuugggggccccugaaggauaaugagucgacuaucagcuuuuacaccagacagauuuuacagggacucggcuaccugcaugacaaccacaucgugcauagggauauaaaaggugacaaugugcuuauuaacacauucuccgggcugcuaaagaucucagauuuuggcaccaguaaacgacucgccggaaucaccccauguacagaaaccuucacuggcacgcugcaguauauggcacccgagauuaucgaccaagggccucggggauacggcaaggcugccgauauuuggucuuuggguugcacaguaauagaaauggcaaccgggcgcccacccuuccacgagcugggaagcccucaggccgcuauguuucaggucggcauguauaaagugcacccgccaaugcccuccucauuaagcgcggaggcccaggcauuccuccugagaacuuuugaaccugacccaaggcuucgggcuucugcccaaacccuguugggugaucccuuccuccagccuggcaagcgauccagaaguccgagcucuccccgccaugccccaaggccuuccgacgcucccucagcaaguccaacaccuagcgccaacucgaccacucagucccagacauuucccugcccacaagcgccgucucagcacccucccagcccacccaagcguugucugucauacgggggaacgagucagcuacggguuccugaggaaccagcugccgaggaacccgcauccccugaggagucuagcggccugucccuucuccaucaagaaucaaaaagaagggccaugcuggcugcaguguuggagcaggaacugccggccuuagcggagaaucuccaccaggagcagaagcaagaacagggggcucgccugggacgaaaccacgucgaggaacuucugagaugcuugggcgcccauauccacaccccaaaucggaggcagcucgcacaggagcugcgcgcccuacaaggucgucugagagcucaggggcuuggacccgcccuccugcaucggccuuuguucgcauuucccgacgcugugaaacagauuuuaaggaagcgccagauccgaccacacuggauguucguucuggauagccuccugaguagagccgugcgggcggcccuuggcguacuggguccugaagucgagaaagaggcagugucucccagguccgaagaguugagcaacgaaggcgacucgcaacagucaccagggcagcagucuccucuaccgguggagcccgaacaaggaccagcuccucugaugguccagcucagucugcuucgcgccgagacugauagauuaagggagauccuggcuggcaaggaacgggaguaucaggcacucguucaacgugccuugcagcgccugaaugaagaggcccgaacauacgugcucgcucccgaaccaccuaccgcgcuguccacagaccaggggcuuguacaguggcugcaagaguugaacguggauagcggaacuauucagaugcuacugaaucauucuuuuacccuccacacguuacugaccuaugcaacaagagacgaucuuauauacacuaggauccggggcgguauggucugucgcauuuggagagccauccuggcucagagggccgggagcacccccgugacauccggaccguga

SEQ ID NO: 58781 - RNA, 429 nt, Artificial Sequence
  derived and/or modified sequence opt3 from MAP3K7CL__Homo_sapiens__NP_001273546
augaucagcaccgccagagugcccgcugacaagccugucaggauugcauucucccugaacgaugccucugacgauacaccaccggaggacucaauaccccucguuuuuccugaacuugaucagcaacugcagccauugcccccuugccacgacagugaggaaagcauggagguguucaaacagcauugucagaucgcggaagaguaccacgagguaaagaaagaaauuacuuuacuggagcaacggaagaaagaacuaaucgcuaagcucgaucaggccgagaaggagaaaguggacgcagccgaacugguccgcgaguuugaagcucuuacggaggaaaaucgaacccugcguuuggcacagucccagugcguggagcaacucgagaagcugaggauucaguaucagaaaagacagggcucgucuuga

SEQ ID NO: 58782 - RNA, 1740 nt, Artificial Sequence
  derived and/or modified sequence opt3 from MAP3K7__Homo_sapiens__NP_003179
augagcacugccuccgcugcaucuucaaguagcuccucuucggccggcgagaugaucgaagcgcccucacaggugcugaacuucgaggaaauugacuacaaggagauagaagucgaggagguuguggggagaggagcuuuugguguagugugcaaagccaaguggagggcaaaagaugucgccaucaagcaaauugaaagcgagagugaacggaaggcuuucaucguggagcuccgccagcuuucccgaguuaaucacccuaacauugugaagcuguauggcgcauguuugaauccagucugcuuagugauggaguacgccgaagggggaucucuguauaacguacuacauggcgcugagccgcuccccuacuauacagccgcgcacgcaaugagcuggugucugcagugcucccaggguguugccuaccuucauucaaugcaaccuaaggcucugauccaccgugacuugaaaccacccaaucuccugcugguggccgggggaacuguccucaagauaugugauuuuggcacggcaugcgacauccagacccauaugacaaacaauaaaggcagugcugccuggauggcgccugaaguguucgaggggagcaacuauucugaaaagugugauguguuuuccuggggaauuaucuuaugggaggucauuacuagaaggaaaccauucgacgagaucgguggccccgccuuucggauaaugugggcaguucacaaugggacccgcccuccacugauuaagaaccuuccgaagcccaucgaaucauugaugacaagaugcuggagcaaagauccuagucagaggccaucuauggaggaaauugugaagaucaugacccaccugaugcgguacuuccccggagcugacgagccucuacaguacccaugucaauauuccgaugaaggccagagcaauucggccacuucuacagguuccuuuauggacaucgcuucaaccaacacgaguaauaaaagcgauacuaacauggagcagguacccgccaccaaugacacaauuaagcgccucgaguccaaacugcuuaagaaccaggcaaaacaacagucugaaagcgggcgacugucauugggagccaguagaggcuccagcguggagucucucccgccuacuucagaaggcaagaggaugagugcugauaugagcgagauagaagcgcggaucgcagccaccacagggaacggacagccccgucgcagauccauucaagaccugaccgucacggguacugagccaggccaggugucuucgaggagcuccucaccuaguguucggaugaucacaaccucugggcccacuagcgagaagccaacacgaucccaucccuggaccccugacgauucaacggacaccaauggaagcgauaacucuauaccaauggcuuacuuaacacuggaccaccagcuccagccgcuugcccccugcccuaauuccaaagaaaguauggcaguguucgagcaacauuguaagauggcccaggaauauaugaaaguccagacugagauugcucuguugcuacagcgcaagcaagagcugguggccgaacucgaucaggacgagaaagaucagcagaacaccagcagacugguacaagaacacaagaaacuucuggacgagaauaaaucuuuguccacauacuaucagcagugcaagaaacagcucgaaguuaucaggucacaacagcagaagcggcaaggcaccaguuga

SEQ ID NO: 58783 - RNA, 1404 nt, Artificial Sequence
  derived and/or modified sequence opt3 from MAP3K8__Homo_sapiens__XP_005252421
auggaguacaugagcaccggcuccgacaacaaggaagagaucgaucugcucauuaaacaccuuaaugugucugacgucauagauaucauggaaaaccuguaugccucagaggaacccgcuguuuacgagccuaguuugaugacaaugugccaggacagcaaucaaaacgaugagagauccaagucuuuacugcuaucggggcaggaagugccauggcucucaagcguaagguauggaacuguggaggaccugcuugcauucgccaaucauauuaguaacacggcgaaacacuuuuacggucagcggccgcaggaauccggcauccuguugaauauggucauuacaccccaaaacgggcgcuaucagaucgauucugacgugcuccugauaccuuggaagcugaccuaccgaaauaucggaagcgauuucauuccacguggcgcuuuugguaaaguuuaucucgcccaggacaucaagacuaagaaaagaauggcauguaaguuaauucccguggaucaguucaaaccuuccgacgucgagauccaagccugcuuuaggcaugagaacauagcugaacuguacggggcagugcuuuggggagagaccguacacuuguucauggaagccggcgagggcgggucaguucuggaaaagcuagagaguuguggaccaaugcgggaguuugaaauuaucugggugacaaaacauguccucaagggucuggauuuccuucacagcaagaaagugauucaccaugacaucaagcccucuaauaucguguuuauguccaccaaagcuguccugguugacuucggcuugucagugcagaugacugaggauguauacuuuccuaaggaccuccgcgggacagaaauuuauaugagcccagaggugauacugugcagaggacacaguaccaaagccgauaucuacucuuuaggcgcgacgcugauucauaugcagacugguaccccgcccugggucaagagguauccucgguccgcauacccaagcuaucucuacaucauacacaaacaggcucccccucuugaagacauugccgaugacuguucgccagggaugcgcgagcugaucgaggccucuuuggaacgaaaccccaaucacagaccgagggcagcugaucuacugaagcaugaggcccucaacccuccccgggaagaccaaccacguugccagucccuggauucagcgcuucuggagcgcaagagauugcucaguaggaaagaacuggaguuaccugagaauaucgccgacagcuccuguacaggaucuacugaagagagcgaaaugcugaagcggcagcgaucacuauauauugaucucggcgcacuggcuggcuacuucaaccuugugcgcgggcccccaaccuuggaguacggauga

SEQ ID NO: 58784 - RNA, 3315 nt, Artificial Sequence
  derived and/or modified sequence opt3 from MAP3K9__Homo_sapiens__NP_001271159
auggagcccagcagagcccugcucggcugccuugcuuccgcagccgcggcugccccuccaggggaagacggagcaggggccggcgcugaggaagaggaagaggaggaagaggaagcagccgcugccguggggccgggagagcugggcugugaugcgcccuugccuuacuggaccgcagucuucgaguaugaagccgcuggugaggacgaauuaacacugaggcuaggggauguuguggagguacucucuaaggacucacaggugaguggagaugaaggcugguggacuggccaacugaaccagcgggucgggaucuuuccaagcaauuacgugacgccccgcuccgccuucucuucgcgaugccagccuggaggugaggacccaucauguuaucccccuauucagcuucuggagauagauuuugcagaauugacccucgaggaaaucauuggcaucgggggauucggcaaaguuuaccgugcuuuuuggauuggugacgagguggccgucaaggcggccagacacgauccagacgaagauaucagccaaacaauagagaacgugaggcaggaggcaaaacuguucgcuaugcugaagcauccgaauaucauugcccuccgggguguaugcuuaaaagaacccaaccugugucuuguuauggaguuugcucgcggaggcccuuugaauagagugcugaguggcaagaggaucccacccgacauucuagucaacugggccgugcagaucgcacgggggaugaauuaucuccacgaugaagccauagugccuauuauccaucgcgaccugaaguccucuaacauucuuauccugcagaaagucgagaauggagacuugagcaacaagauccucaaaauuacugauuucggucuggcucgagaauggcacagaaccacaaagauguccgcggcaggcaccuacgccuggauggcuccagagguuauaagggccucaauguuuaguaaagggagcgacguguggucuuauggaguauuacugugggagcuccuuacuggcgaagugcccuuccgggguaucgaugggcuggcagucgccuacggcguggcuaugaauaaguuggcccuaccgauuccuuccacaugccccgagccauuugcaaagcugauggaagacuguuggaacccugauccccauucacguccaaguuucaccaauauccucgaccaacugacgacuauagaggagagcggauuuuucgaaaugcccaaagauucuuuccacugccuucaggacaacuggaagcacgagauucaggaaauguuugaucagcugcgcgcgaaagagaaggaauugagaaccugggaggaggaacucacaagggcugcccugcaacagaaaaaucaggaggaauuacugcggcgacgcgagcaagaacuagcagagagagagaucgacauccucgaaagggagcugaacauuaucauucaucagcuuugucaggaaaagccucggguuaaaaagcgcaagggcaaauucagaaaguccagguugaaacugaaggaugggaaccguauaagccucccaucggacuuucagcacaaauucacugugcaagccucuccgaccauggacaagcggaagucccugaucaauucacgaaguagcccucccgcuuccccaacaauuauccccagacuuagggccauccagcugaccccuggagagucuagcaaaacguggggucgcucaagugucgugccaaaggaagagggcgaggaagaggaaaaacgggcacccaagaaaaaggggagaacuuggggaccgggcacauugggucagaaggagcucgcuuccggggaugagggcagcccucagaggcgcgaaaaagccaacggacugucuaccccaucagagaguccccauuuucacuuaggccuaaagagccuaguagacggguacaaacaaugguccucuucggcgccuaaucucguuaagggaccccgaagcuccccagcccugccugguuucacuucacuuauggaaauggaggaugaagacagugagggccccgggucuggagagagccgguugcagcacuccccaucacagagcuaucugugcauuccguuuccucguggcgaagauggugacgggcccucuuccgauggcauacaugaggaaccaacacccgugaacagugcuaccagcacgccucagcucaccccaacaaauucucugaaaagaggaggcgcacaccauaggcgcugugaggucgccuuacuggggugcggagcugugcuugccgcaacuggcuuggguuucgaccuccuggaagcggggaagugccaacuacugccccucgaggagccugaaccgccagcccgggaggaaaagaaaagaagggagggacuguuucagcgauccucacgcccccggagaaguaccagcccuccaucgaggaaacuuuucaagaaggaagaacccauguugcuguuaggcgauccuuccgcuucucucacacugcuuagccugucaaguaucuccgaguguaacucuacucguagcuugcuccgcuccgacucagaugaaauugucguguacgagaugccgguuagccccguggaagccccaccucugagucccugcacccacaauccacugguaaacguccggguggagagauuuaaaagggacccuaaucagucucugacacccacccauguuacucucacgacaccaucccagccgagcucgcaccgacggaccccuucagauggugcacugaagcccgagacucuuuuggcuucucgcaguccauccagcaacggccugucucccagcccuggggccggaauguuaaaaaccccaucccccucaagagacccuggcgaguucccgaggcucccagaccccaauguggucuuuccucccacaccacggcgauggaacacccaacaggauaguacucuggagagaccuaagacacuugaguuccugccccgcccaaggccuagcgcaaaucgucagcggcuagacccguggugguucgugucucccucccacgccagaucaacgaguccagcuaacagcuccucuaccgaaacuccuucgaaucucgauagcuguuuugcgucauccaguucuacaguagaagagaggcccgggcugccagccuugcugccuuuccaagcaggacccuuaccgccaaccgagcgcacacuccuggaccuugaugcugaaggccagagccaggacuccacugugccucugugccgagccgaguugaacacccauagacccgccccauaugaaauccagcaagaguuuuggucauga

SEQ ID NO: 58785 - RNA, 3408 nt, Artificial Sequence
  derived and/or modified sequence opt3 from MAP4__Homo_sapiens__NP_001127836
auggccgaccugagccucgcugaugcacuuaccgagcccuccccugacaucgaaggcgagauuaagagagauuucauagccacacuggaagcggaggcuuuugacgauguggucggggaaacuguuggaaaaacggacuacaucccauuguuagauguggacgagaagaccgguaacucugagucaaagaagaaaccgugcagugaaacaagccagauugaggauacucccuccucuaagccuacccugcuagccaauggcgggcacggaguagaaggcucggacacaaccgguucaccaacugaguuccucgaggaaaagauggcauaucaagaguaccccaacagccagaauuggccugaagauacaaacuuuuguuuccagccagaacagguggucgaccccauccaaaccgauccuuuuaaaauguaucaugacgacgaucuggccgaccuuguguucccaaguuccgcuacggcagauacuucuauuuuugccgggcagaaugacccgcugaaggauagcuacggaaugucccccugcaacaccgcuguugugccucagggcuggucagucgaggccuugaauaguccacacagcgagucuuucgugucccccgaggcgguagcagaaccuccacagcccacagccguuccgcucgagcuggcuaaagaaaucgagauggccucagaagagaggccucccgcacaagcucuggagauaaugaugggccucaagacuaccgacauggccccaagcaaagaaacagagauggcguuagccaaggauauggcacuggcuaccaagacggaaguggcccuugcuaaagacauggagaguccuacuaaguuggaugucacacuggccaaagacaugcagcccucuauggaauccgauauggcacucgugaaggacauggagcucccaaccgagaaagaaguggcccuggucaaggacguucgguggcccacugagacagaugugagcucggcuaaaaacguagugcuuccuaccgaaacggaggucgcgccagcaaaggacgugacccuguugaaggagacagaacgcgccucuccgaucaaaauggaucucgcucccuccaaggacauggggccuccaaaagagaauaagaaagaaacugagcgagccucacccauuaagauggaucuggcaccuaguaaggacaugggaccacccaaagaaaacaagaucguuccggccaaagauuuagugcugcucagcgagauugaggucgcucaggccaaugacaucauauccucuaccgaaauuagcucagcagagaagguggcgcuuaguuccgaaacagagguagcucuggcccgugauaugacuuugccuccagaaaccaacguuauccuaacaaaagacaaggcacugccccucgaggccgagguggcuccugucaaggauauggcccagcugcccgaaaccgagauugcaccagcuaaagacguggccccuagcacugucaaggaagugggucuucugaaagauaugucucccuugucagagacggaaauggcgcucggcaaggacguuacaccaccgccugagaccgaggugguacugaucaaaaaugucuguuuacccccagaaauggagguggcccugacugaagaccaaguucccgcucuaaagaccgaggcaccucucgccaaggauggggugcugacacuugcuaacaaugucaccccagccaaagacgugcccccuuugagugagacugaagcaacaccgguaccaaucaaggauauggagauugcgcagacgcagaaaggaauaagcgaagacucccaucuggagucucuccaagaugugggccagucggccgcucccaccuuuaugaucagcccugaaacuguuacagguaccgggaagaaaugcucccugccagccgaggaggacucaguccuugaaaagcugggagagagaaaacccuguaacagucagccuucugaauugagcuccgagacaucaggcauugcaaggccggaagagggccggcccguggugagcgggacuggaaacgauaucaccacgccaccuaauaaggagcuacccccaucuccugaaaagaaaaccaagccccuggcuacaacucagccagccaaaaccuccacaaguaaggcaaaaacucaaccgaccagcuuaccuaagcagcccgccccaacgacaauagguggccugaacaagaaacccaugucucuagcuuccgggcucgucccugcggccccacccaagcgcccugcaguugcuucagccagaccgaguauucugccaagcaaagacgugaagcccaaaccuaucgccgaugcuaaggcacccgagaagagggccucgccauccaaaccugcgucugcucccgccagccggucaggaaguaaguccacccagacuguggcaaaaacaaccacugccgcugcaguagccucuaccggcccaagcucccgcucaccuagcacacuuuugccgaagaaacccacggcgaucaagaccgaagguaagccagcugaggucaaaaagaugacugccaaaagugugccugcagaccugucucgacccaaguccacaagcaccucgucaaugaaaaagacaacuacccucucugggacggccccagcugccggcguugugccuaguagagucaaagcaacacccaugccguccaggccaagcaccacuccuuucauugauaagaagcccaccucugcuaaaccaagcuccacaacuccccggcugucacguuuagccaccaauacaagugcgccugaccugaagaacgugcgcagcaaaguuggaucuacggaaaauaucaagcaccagccgggcggggguagagccaaaguggagaagaagaccgaggcagcugccacuacaaggaaacccgaauccaacgcuguaaccaagacugcaggaccaauugccucagcccaaaaacagccugcuggcaagguccagauagugaguaaaaaggugagcuauucccauauccagucuaagugcgggucgaaagauaauauuaagcacguccccggaggcgguaacguucaaauccagaauaaaaagguggacaucagcaaaguaucauccaagugugggaguaaggcgaacauuaaacacaagccuggcggaggcgacgugaaaauagagucucagaaacuuaauuuuaaagaaaaggcacaggccaaggucgggagcuuggauaacgugggacaucucccagcugguggcgccguuaaaaucgagacauaccggcugaccuuccgagcaaaugcccgcgcuagaacggaccacggggcggauauuguguccaggcccccucauuuuccaggaggccccaacucagguucucggguccuagggccgcugagccgcgccgugcacuga

SEQ ID NO: 58786 - RNA, 2466 nt, Artificial Sequence
  derived and/or modified sequence opt3 from MAP4K1__Homo_sapiens__NP_001036065
auggacguggucgaucccgacaucuucaacagagauccuagggaccacuacgaucugcuccagcggcuuggcgggggaaccuauggugagguuuuuaaggcccgcgacaaagugagcggcgaucugguagcuuugaagauggugaaaauggaaccagacgaugacgucuccacauuacaaaaggagauucugauacuaaaaacuugccgacaugcaaauaucguggccuaccacgggucuuaucucuggcugcagaaacuuuggauuuguauggaguucugcggagcgggcucacugcaggauaucuaccagguuacggguaguuugagcgagcuccaaauuuccuaugugugucgugaaguccugcaggggcuggcuuaccuccauucucagaagaagauccacagagacauaaagggagccaacaucuuaauuaaugaugcaggcgaggugaggcuggccgacuuuggcaucucggcucagauuggggcaacccuugcccggcgcuugucauucaucggaacaccguauuggauggcucccgagguagccgcgguugcacugaaagguggcuacaacgaacuaugcgacauauggagccucgggauuacugccaucgagcuggcugaacuucaaccuccacuguuugaugugcaucccuugagaguccucuuccugaugaccaagaguggauaccagccuccaagguuaaaagagaagggcaagugguccgccgcauuucacaauuucauuaaagugacacugaccaagucucccaaaaagcggccuagcgcuacuaaaaugcucucccaccagcuugugucacagccaggucugaaccgcggguugauccuagaccugcucgauaagcugaaaaauccgggaaagggccccaguaucggcgacauugaggaugaagaaccugaacuuccacccgccauaccucgaagaaucaggagcacacaucggucuuccucacuggggauuccagacgcggauuguugccgucgccacauggaguuuagaaaguugaggggaauggaaacccggcccccggccaacacggcacgacuccaaccuccccgcgaccugagaagcaguucuccaaggaaacaguuauccgagagcucggaugacgauuaugacgacgucgauaucccuacucccgcugaggacaccccacccccucugccaccgaagcccaaauuccggucuccuuccgaugaagguccaggcucaaugggggacgauggacagcuaagucccggcguucucgugcgcugugccagcgguccuccacccaauuccccgagaccugggccacccccuucuacaagcucaccccaucugacugcucacagugagccaucccuuuggaacccucccagcagggaauuggacaagccaccgcugcucccucccaaaaaggagaagaugaaacguaagggcugcgcccugcuuguaaaacuguuuaauggauguccauugcggauacacucuaccgcagccuggacacaucccucaaccaaggaucaacaccuccuguuaggcgcugaagaggggauuuucauccugaaccgaaaugaccaggaggcgacgcuagaaaugcucuuuccuaguagaacuacauggguguacagcaucaacaauguccugaugucccuuucuggaaaaaccccacauuuguauucgcacagcauucugggucuccuggagaggaaggaaacucgcgcaggcaaccccaucgcccauauuuccccucaccgguuacuggcuagaaagaacauggugucaacaaaaauacaggauaccaaggggugcagggccuguugcguugcagagggagccaguucuggcgguccguuccuuugcggggcuuuggaaacgagcgugguccuccugcagugguaccaaccaaugaauaaauuccuacuggugcgccagguacucuuuccccugccuaccccacuuuccguuuucgccuugcugacaggccccggaucagaguuaccugcaguguguaucggcgucagcccggggcgacccggaaagucugugcucuuucacacuguccgguucggugcgcuguccugcuggcuuggcgagaugaguaccgaacaucgugggccagugcagguuacacagguggaggaagacaugguaaugguccugauggauggaagcgugaaauugguuacuccugagggcucucccgugagaggucucaggaccccagagauuccuaugacagaagcugucgaggccguggcaaugguagggggccaacugcaggccuuuuggaagcacggagugcagguuugggcucuaggcuccgaccagcugcuccaagaacugcgcgaucccacccuuacuuuccgguugcuggggucaccaagaccggucgugguggagacgaggccugucgacgaccccacagccccaaguaacuuauauauccaggaauga

SEQ ID NO: 58787 - RNA, 2463 nt, Artificial Sequence
  derived and/or modified sequence opt3 from MAP4K2__Homo_sapiens__NP_004570
auggcccugcucagagacgugagccuucaggaucccagggaccgguucgagcuguugcaacgcgucggcgcugggaccuacggagauguuuauaaggcacgagacacagugacuuccgaauuagccgcgguaaaaaucgugaagcuggauccuggugacgauauuucuucacuacagcaggagauaacgauccuccgugaaugcagacacccaaacgucguggcuuacauuggcaguuaucugaggaaugaccggcuuuggaucuguauggaguuuugcgggggaggcagccugcaggaaauuuaccaugccaccgguccguuggaggagcgccaaaucgcauauguuuguagagaagcccucaaagggcugcaccaucugcacucccagggaaagauacauagggauaucaaaggcgcuaaccucuuacugacacuucagggcgacgugaaguuggcagauuucggggucucuggagagcugacugccucgguggcuaagcggcgcucauuuauugguacccccuacuggauggccccugaaguagcggcaguugagcgaaaaggcggguauaaugagcuaugcgacgugugggcccucggaaucacagcuauugaacugggcgagcuucagccaccccuguuccacuugcacccuaugagagcccucaugcugaugagcaagaguuccuuucaaccacccaaauuaagggauaagacccgguggacucagaacuuccaucacuuucugaaacucgcacuuacaaagaauccuaagaaacguccaaccgcugaaaagcuguugcagcauccguucacgacucagcaacuaccccgcgcccugcucacccagcugcuugacaaagcgucugacccucaccuggguacaccaagccccgaggauugugaauuggagacuuacgacauguuuccugauaccauccacuccagagggcagcauggaccagccgagaggacacccucagaaauacaauuccaccaggucaaguuuggcgcaccgcggcgaaaagagaccgacccucucaacgaacccugggaggaagaguggacgcuguuaggcaaggaggaacugagugggagccuacuccagucugugcaggaggcucuggaagaacgcucccuuacuauuagaucagccagcgaguuccaagaguuggauaguccagacgauacaaugggaaccaucaaaagggcuccuuuucuggguccccucccaacugaucccccugccgaggaaccacugucuuccccgcccggcacacuuccuccacccccuagcgggccaaauucgucuccccuguugccgaccgcaugggccacgaugaagcagcgggaggacccugaacgcuccucaugccauggacucccacccaccccuaaggugcacaugggcgcuuguuucaguaaagucuucaacgguugcccccugagaauccaugcggcaguuacauggauccacccagugacuagggaccaguuuuuaguagugggggccgaggagggcaucuacacccugaaucuacacgaacuccaugaggauacacuggaaaaacuuauuagccaccguuguuccugguuguauugcgucaacaaugugcugcucucucugagcggaaagucaacucauauaugggcucacgacuuaccuggccuguucgagcagcggcgacuucaacagcagguucccuugaguaucccaaccaacagacucacacagaggauuaucccgcgccgguuugcccuguccaccaagauaccugacacuaaagggugucuacaaugcagaguggucaggaaucccuacacgggagcaacauuccugcucgccgcucugccaaccagccuuuugcuguuacagugguaugaaccccuccagaaguuucugcuucugaagaacuucucuucaccuuugccaagucccgccgguaugcucgagccucuggugcuagauggcaaagagcugccgcagguaugcguuggggcagaaggaccagagggccccgguugucgcgugcucuuucacguccugccucuugaagcgggguugacuccagacauucugauucccccugagggcaucccgggaagcgcucaacaggugauucaggucgaucgagacaccaucuuaguguccuucgaacggugcguucguauugugaauaugcaaggcgagcccacagccacccucgcaccagagcugacuuuugauuucccuauagaaacaguagucugucuucaggacucugugcuggccuuuuggucgcaugggaugcagggaagaagccuagauacgaacgagguuacccaggaaaucacugacgagacaaggauuuuccgcgugcucggugcucaccgggauaucauccuggaauccauucccaccgacaacccagaggcccauucaaauuuguacauacugacaggccaccaaaguacuuauuga

SEQ ID NO: 58788 - RNA, 2622 nt, Artificial Sequence
  derived and/or modified sequence opt3 from MAP4K3__Homo_sapiens__NP_001257354
augaaccccggcuucgaccugagcagaaggaauccucaggaggauuuugaacucauccaacggauuggguccggaaccuacggugacguguauaaggcccgcaacgucaauacaggcgagcuugcugcaauaaaaguuaucaagcuggaaccaggggaggauuucgccgugguacagcaggaaauuaucaugaugaaagacugcaagcacccgaacauuguggcguacuuuggaucuuauuugcgacgugauaaauuauggaucuguauggaguucugcggcggugggucacugcaggacauauaccaugucacuggaccccuaagugagcuccaaaucgcuuaugugagcagagaaacgcugcagggccuuuacuaucugcacuccaagggcaagaugcauagggauauuaaaggggccaauaucuugcucaccgacaacggacacguuaagcuggcagauuuuggugugucugcccagauuacagcuacuaucgcaaaacggaagucguucauaggcaccccuuacuggauggccccagaggucgcugccguggaacgcaaagggggauacaaucagcugugugaccucugggcgguaggcauuacagcaaucgaguuagccgagcugcaacccccuauguuugaucuucauccaaugagagcuuuguuccugaugaccaagucaaacuuucagcccccuaagcuaaaagacaagaugaaauggagcaauaguuuccaccacuuuguuaagauggcccucacuaaaaacccaaagaaaaggccgacagcagaaaagcugcuucagcaucccuucgugacccagcaccugacgcgguccuuggcuauugagcuccuggauaaggucaauaacccugaccauucuacuuaucacgacuuugaugacgaugacccagaacccuuaguggccgugccucaccgcauccauagcaccucccgaaaugucagagaggagaaaacaaggucagagaucacuuucggucaaguuaaguucgauccaccccugcggaaagagaccgaaccgcaccaugagcucgaccuucagcuggaauacgggcagggacaccaaggcggcuauuuucuaggggcgaacaagagucuacugaaaagcguggaggaagaacuccaucagcguggacacguagcccaccuggaggaugacgaaggugaugacgaugagucuaagcauuccacacuuaaggcaaaaauuccucccccacugccucccaagccaaaaucaauauucaucccccaggaaaugcacagcaccgaggacgaaaaucagggcacgauuaagcgcugcccuaugagugggucuccagcuaaaccgucccaagugcccccuagaccacccccuccaagguugcccccgcauaagccugucgcccucggaaacggcaugagcucguuucagcugaacggugagcgggacgggucuuuaugucagcagcaaaaugagcaccgaggcacuaaccugucccgcaaggagaaaaaggaugugccaaaacccaucucaaauggacuaccucccacaccaaagguucacaugggcgcuugcuucaguaaaguguuuaacggguguccucucaagauacauugcgccagcuccuggauuaaucccgacaccagagaucaguaccugaucuucggagcagaagaagguaucuauacucuuaacuugaaugagcugcacgagacaucuauggaacagcucuuuccaaggcgguguaccuggcuguacgucaugaacaauugccuucugagcauuucaggcaaggccagucaguuguauucccauaaccucccggggcuguucgacuacgcucgccaaaugcagaaauuaccuguggcgauccccgcacacaagcugccagauagaauuuugcccaggaaauuuagcguaucugccaagauaccugagacgaaauggugucagaagugcugcguugugcguaauccauacaccggacauaaauaucucuguggcgcucugcagacaucaaucguccuuuuggaauggguggagcccaugcaaaaguucaugcugauuaagcacaucgacuuuccuaucccgugcccacuccggauguucgaaaugcuggucgugcccgagcaggaguacccuuuaguuuguguggguguaagucgagggagagauuuuaaccaggucgugagguucgaaacuguuaauccaaacagcaccuccucuugguucacagagucggacacuccccaaaccaaugugacacacgucacccagcuggaacgcgauacuauucuugugugcuuggacuguugcauaaaaaucguaaaccuccagggccggcuaaagagcuccagaaaacugucaagugagcugacguuugauuuccagauugaaucuaucgugugucuccaagacagcguucuggccuuuuggaagcauggaaugcagggcagguccuuccgcucaaacgaggucacacaggagauuagcgauucuacccgaaucuuucggcuuuugggguccgaccguguggugguccuggaaaguagaccuacugacaauccgaccgcaaacagcaauuuauauauacucgccggacacgagaacucuuacuga

SEQ ID NO: 58789 - RNA, 3720 nt, Artificial Sequence
  derived and/or modified sequence opt3 from MAP4K4__Homo_sapiens__NP_001229488
auggccaacgacagccccgcuaagucccugguggauaucgaccucucuucacuuagagauccugcaggcauuuucgagcuggucgaaguuguggggaauggaaccuacggucagguauauaaaggcaggcacgugaagacagggcaauuggccgcgauaaaagucauggacgugacugaggaugaagaggaagagaucaaguuagagauuaacaugcugaaaaaguacagucaucaccggaauaucgcuacguauuacggagccuuuauuaagaaaagcccaccgggccaugacgaucagcuauggcucguuauggaguucugcggugcaggguccaucaccgaccuggugaagaacacaaaaggaaauacucuuaaggaggauuggauagccuauaucucucgcgaaauucugcgaggcuuggcucaccuccauauccaccacgucauucaucgugacaucaaaggccagaacgugcugcugaccgagaaugcagagguaaagcucguugauuuuggggugucggcccaguuagacagaacagucggaaggcggaacaccuucauagguacucccuacuggauggcuccugaagugauugccugugaugagaauccagacgcgacauaugacuaccgcucagaucuguggagcugcggcaucaccgcaauugaaauggccgagggggcucccccucuuugugacaugcacccaaugagagccuuguuucugauccccaggaacccuccaccgcggcuaaagaguaaaaagugguccaaaaaguucuuuucuuucaucgaaggaugccucgugaaaaauuacaugcaacgccccagcacggagcagcugcuuaagcauccuuuuauucgagaucagccaaacgagagacaggucaggauacaacugaaagaccacaucgaucggacucguaagaagcgcggcgaaaaagacgagaccgaauaugaguacuccgguucagaagaggaggaagaggaaguucccgagcaggaaggggagccuaguagcauugugaauguaccaggagagucuacauugagaagggauuuccuccggcugcagcaggaaaacaaggagcgauccgaagcauuacgcagacaacagcugcuccaggagcaacagcuuagggagcaggaagaguauaaacggcagcuguuggcugaacgccaaaagagaaucgagcagcagaaagaacagaggcgucggcuagaggagcaacagcgaagagaaagggaggcccgccggcagcaggaaagagagcaaaggcgccgagaacaggaggagaagcggcgucuggaagaacucgaaagaaggcgcaaggaggaagaggagcggagaagggcggaagaggaaaaacgacgcguggagcgggagcaggaauacauaagaaggcagcuggaggaggaacaacgucaccuugaaguccugcagcagcaauugcuccaggagcaggccaugcuguuagagugucgcuggcgggaaauggaggaacauagacaggcagagaggcugcaacgacagcuacagcaggaacaggcuuaucuccugucacuucaacacgaccaucggcgcccccacccgcagcauagccagcaaccucccccaccucagcaggagagaaguaagcccucuuuucacgccccagagcccaaagcucacuacgaaccugccgauagggcacgggagguggaagaccgauucagaaagacuaaucauuccagcccagaggcccaaucgaaacagaccggccgcguuuuggaaccgcccgugccuucuagguccgagucauuuaguaacggcaacagcgaguccguccacccagcucugcagcgucccgcggaaccucaggugccaguacggacaaccucuagaagccccguucucucaaggcgcgauaguccgcugcaaggguccggacagcagaauagccaggcaggucaacgaaacucuacgucaauugagccuagacuucugugggaacggguggagaaguuggucccaaggcccggcagugggagcuccucuggaucgagcaauuccggcucacagccugguagucaucccgggucucagagcggcuccggagagcgcuuccgugugagaucaagcucuaaguccgaaggcaguccaagccagcggcucgagaacgccgucaaaaagccugaagacaaaaaggagguguucaggccccugaaaccagcugacuuaacugcccuggcaaaggaacuacgcgccguugaggaugugcgaccgccucacaagguaacagacuauucuuccucaagugaggaaagcgggaccacugaugaggaagacgaugacgucgagcaagaaggagcugaugagucgacauccggucccgaggacaccagagccgcaucuagccucaaucugucaaacggcgaaacggagagugugaaaaccaugaucguucacgaugacguggaauccgagccagcgaugacacccucuaaggaagggacucuuaucguccggcagacccagagcgcuuccucaacauugcagaaacauaagagcaguucuuccuuuacuccuuucauugauccaaggcugcuccaaaucagccccucgucaggaaccacagugaccucuguagugggcuuuaguugcgacgguaugcgcccugaggccauuagacaggauccgacuaggaaaggguccguugucaaugugaacccaacgaauacacggccccagagcgacaccccugagauacguaaguacaaaaagcgcuucaacucugaaauccugugugcagccuuauggggcgugaaucugcuugucggaacugagagcggcuugaugcuccuggaccgauccgggcaaggaaagguuuacccacuaauuaacagaaggcgguuucagcagauggaugugcuggaaggucucaaugugcugguaaccaucucaggcaaaaaggacaaacuucgcgucuauuacuugaguuggcugagaaacaagaucuuacacaaugaucccgagguggagaaaaagcagggguggacaaccguuggagaccucgaaggcugcgugcauuauaaggucgugaaauacgagaggauuaaguuccugguuauagcucuuaaaagcucuguggaaguauaugccugggcaccuaagccguaccacaaauuuauggcuuucaaguccuuuggugagcugguccauaagcccuugcucguggaucugacuguggaagaggggcaacggcuaaaagucaucuauggcucaugugccggauuccacgcgguugacguggauaguggcagcguauacgacauuuaccugccaacacacauccagugcuccauuaagccucaugccaucauaauccuccccaacacggaugggauggagcugcuuguguguuaugaagacgagggagucuacgugaacaccuauggccgaauuacuaaagauguuguguugcaguggggugaaaugccaacaucugucgcuuacaucagaucgaaucagaccaugggguggggagagaaggcaauugaaauccgcagcguggagacaggccaccuggacgguguuuuuaugcauaaaagggcccaacgguuaaaguuccucugcgagcguaacgauaagguguuuuucgcuucagucagauccggcgggaguucucagguauauuucaugacucugggaaggaccagccuucuguccugguga

SEQ ID NO: 58790 - RNA, 2541 nt, Artificial Sequence
  derived and/or modified sequence opt3 from MAP4K5__Homo_sapiens__XP_006720076
auggaggcaccccugagaccugcugcagacauccucaggcggaacccacagcaagauuacgaacuugugcagcgcgucggcagcgggaccuauggagacguuuacaaggcccgaaaugugcacacaggugagcuggcggcuguaaaaauuauaaaguuggaaccgggcgaugacuucuccuuaauccagcaggagauuuuuauggugaaagaaugcaagcauuguaacaucgucgccuauuucgggucuuaccugucacgugagaaacuauggauuugcauggaguauuguggaggcgguagucuccaagauaucuaccacgugacugggccccugagcgaacuucagauagcauauguuugcagagagacgcugcagggauuggccuaccuccauaccaagggcaagaugcacagggacaucaaaggcgcuaauauucugcugacagaucauggggacgugaagcucgcagauuuuggagucgccgcuaaaaucacugccaccauugcgaagcggaaauccuucaucgguacaccuuacuggauggcaccagaaguggccgcuguagagaagaacggcggguauaaucaguuaugugacauaugggccguuggaauuaccgcaaucgagcugggcgaacuucaacccccuauguuugauuugcacccaaugcgcgcucuguuccuaaugucuaagucgaacuuucagcccccuaaacucaaggacaaaacuaaguggucaagcacauuccacaauuuugugaaaauugcccugaccaagaacccgaaaaagagaccaacggcggagaggcuucugacucauaccuucgucgcccagcccgguuugagucgggcacucgcuguggaacuguuagauaaggugaauaacccugacaaucacgcccauuacacagaggcugacgaugacgauuuugaaccacacgccaucauccgccacacuauucgauccaccaacagaaaugcaagggccgagcggacagcuucugagauaaacuucgacaaacugcaguuugaacccccucuccguaaggagaccgaagcgcgcgaugagauggggcuuagcuccgacccaaauuucaugcugcaauggaaccccuucgucgauggagcaaacacgggcaaaucaacaaguaagagagccaucccgccucccuugccaccuaaacccaggauuagcucuuauccagaagacaauuuucccgaugaggagaaggcuuccacuaucaagcauugcccugacucagaaagccgggccccacagauacuacgacgccagaguucuccguccuguggccccguugcagagaccagcucgauugggaacggagaugguaucucuaaacugauguccgaaaauacugagggcucagcccaagcuccucagcucccaagaaagaaagacaagagggacuuccccaaaccugccaucaacgggcugccacccacaccgaaggugcuuaugggagcaugcuuuaguaagguauucgauggcuguccucugaaaauuaauugcgcgaccagcuggauccacccagacacgaaggaucaguacauuauauuugguaccgaagacgggaucuauacauugaaccucaaugagcugcaugaggcuacuauggaacaguuauucccccggaaauguaccuggcuguacgugauuaacaauacacuaaugucccucucugagggcaagacuuuucaacuguauagccacaaccuuaucgccuuguucgaacaugccaaaaagccuggacuggccgcucacauccagacccaccgcuuucccgauaggauucucccaagaaaguucgcccugacaaccaaaauaccugacacuaagggcugccauaaaugcuguaucguccguaaucccuacacggggcacaaguaccuuugcggagcacugcagucagguauuguguugcuccagugguaugagccaaugcaaaaauuuaugcugaucaagcauuucgauuuuccguuaccuaguccccugaacguuuucgagaugcuagugauuccagaacaggaguaccccauggucuguguggcuaucuccaaaggcacagaaagcaaucagguaguucaguucgagaccauaaaccucaauucugccucaaguugguuuacugaaaucggggcgggaagccaacagcuggacuccauucacgugacccagcuugagcgggauacagucuuggugugccuggacaaguucgucaagaucgugaaccuccagggcaaacugaagucuucgaaaaaguuagccagcgagcuguccuuugauuuccgaauugaaucaguugugugucuucaagacaguguauuggcuuuuuggaaacacgguaugcaggggaagucuuucaagagcgaugaggucacccaggaaaucuccgacgagacuagaguguuuaggcuccugggcucagaccgcguugugguccuagaaagccggccuacagagaacccaacggcacauucuaaucuguauauacucgccggacacgagaacuccuacuga

SEQ ID NO: 58791 - RNA, 2442 nt, Artificial Sequence
  derived and/or modified sequence opt3 from MAP6__Homo_sapiens__NP_149052
auggccuggcccugcaucaccagagcuuguugcauugcaagguucuggaaccagcuggacaaggccgauauagcggugccucucgucuuuacaaaauacagcgaggcuacugaacacccaggcgccccgccccaaccuccacccccucagcagcaggcacaaccagcccuugcucccccuuccgcacgggccguugcuaucgagacgcagccagcccagggggaacuggacgcgguggcacgcgccaccggaccggcucccgguccuacaggcgagcgagaaccagccgcagggcccggacguucuggcccugguccaggguugggaucaggcaguacuagcggccccgcugauuccguaaugagacaggacuauagggccuggaaggugcaacggccggagccuucuugucgccccagaucggaguaccagccaucagaugcgccuuucgaaagggagacccaguaucagaaagacuuucgggccuggcccuuaccacgccgaggggaucaucccuggauuccuaagccaguccaaaucagcgcagcuagucaggccuccgcuccgauucugggagcccccaaaagaaggccucagucucaagaacgguggccagugcaggcagccgcugaggcgcgugagcaggaagcagcccccgguggcgcugggggacuagccgcaggcaaggccagcggugcugacgagcgcgauacaagaaggaaggccgggccugcauggaucguucggcgagcggaaggacucggccacgagcagaccccacugcccgcugcccaagcacaggugcaggccacuggcccggaagcugggcgcgguagagccgcagcugacgcccuuaauaggcagauacgggaggaggucgcguccgccgugucaaguagcuaccgcaacgaguucagagcuuggacagauaucaaaccuguaaagccaauuaaagcaaagccccaauauaaaccucccgacgauaagaugguucaugaaaccucuuacuccgcccaguuuaagggagaggcuucaaaaccaacgacugccgacaauaaggugaucgacaggcgucggauucgaagccuguauagugaaccuuucaaagaacccccaaaggucgagaaaccgucugugcaguccagcaagccuaaaaagaccucggcaucucacaagcccacaagaaaagcgaaggauaaacaggccguguccggccaagcugccaagaaaaagucagcagaggggccaaguacuaccaagcccgacgauaaagaacagagcaaggagaugaacaauaaauuggcugaagccaaggagucccucgcacagccugucucugacagcucaaaaacacagggaccaguugccaccgaacccgauaaggaccaaggcagugugguaccuggucugcugaaggggcagggcccgauggugcaggagccacucaaaaagcaaggauccgucgugcccggcccuccaaaagauuuagggcccaugaucccucugccgguuaaggaccaggaucauacggugcccgagccacuuaaaaacgaaagcccugucauaucugcucccgugaaggaccagggaccaucaguaccuguucccccaaagaaucagaguccgauggugccugcgaaagucaaggaucaagguagcgugguccccgaguccuugaaagaccagggcccaaggauucccgaaccugugaagaaccaggccccaaugguucccgcaccugugaaagacgaggggccgaugguaucugcuucggucaaggaucagggaccaauggugagcgcccccguuaaagaccaaggcccuaucgugcccgccccagucaagggugaggggccuauugugcccgcuccaguaaaggaugaaggcccuaugguguccgcaccgaucaaagaccaggaucccaugguuccagagcacccuaaggacgaaucagccauggcgacugcucccaucaaaaaucagggaaguauggucucugagccagugaagaaccagggccugguggucagcgggccuguuaaagaucaagacguggugguacccgaacacgccaagguccaugauuccgcagugguugccccggugaagaaucagggaccagucgugccugagucaguuaaaaaccaggaccccauucuaccagugcucguaaaggaucaaggucccacaguccugcagccuccgaaaaaucagggccgcauagugcccgagccacuuaagaaccaggugccuaucguccccguuccucugaaagaccaagauccauuggugcccguaccugcuaaggaccaggggccagcagugcccgaaccgcucaagacccagggaccucgggacccacagcugcccacugucagcccuuuaccaagagugaugauucccacagccccgcacaccgaguacaucgaaucuuccccuuga

SEQ ID NO: 58792 - RNA, 2205 nt, Artificial Sequence
  derived and/or modified sequence opt3 from MAP7__Homo_sapiens__NP_001185540
augcccggcagcgccaccgcucugagacacgagaggcucaagaaaacaaacgcacggccuaucccacuugggcuguucacuauuaaugaagaggacgaacagcaaaagaacggaaauucccgccgaccgaaagcccccgauucuuacaaggugcaggacaaaaagaacgcgucaagucguccugcuagcgccauauccggucagaauaacaaucauucuggcaacaagccagaucccccuccagucuugagaguugacgauaggcagcgguuagcacgcgagagaagggaggaacgggagaaacaacuggccgcucgcgaaaucguguggcuagagcgagaagagagagcaaggcagcacuaugagaagcaucucgaggaacggaaaaagcgucuggaggaacagcgccagaaagaagagagaaggcgggccgcuguagaggaaaagcgacgccaaagacuugaggaagacaaggagaggcacgaagccgugguccggcgcacgauggagagaucgcagaaacccaagcagaaacauaauagguggucauggggagggagccugcacggcaguccuuccauucacucugcggcacgucgguugcagcucagcccaugggaguccucagugguuaaccgacugcugaccccgacacauaguuuucucgccagaagcaagucuacugcugccuuauccggugaagcagcuucaugcagccccaucauuaugccuuacaaagccgcgcacagucgcaauucuauggauaggccaaagcuguucgugacacccccugagggguccagccggagaaggaucauacauggaaccgccucguauaaaaaggaacgcgagcgagaaaacgucuuguuucuuaccucuggcacucggcgugcaguguccccaucaaaucccaaggcuagacaaccggccaggagucgccuguggcuaccuagcaaaucccucccccaucugccaggcacaccucggcccaccucuagccuuccacccgggucaguaaaggcugccccugcacagguuagaccaccgagucccggaaacaucaggccugugaaacgagaggucaagguggagccagagaaaaaggaccccgaaaaggaaccucagaaaguggccaaugagccaucccugaagggucgcgcucccuuggucaaaguugaggaagcgacgguggaggaacggacuccggcagagccugaaguaggcccagccgcucccgccauggccccugcacccgcuagcgccccagcgccugcaucugcucccgccccagcaccggugccuacccccgccauggucucagcuccaaguagcacagugaacgccuccgcaucuguuaagacuucggcugggaccacagaucccgaggaggccaccagacuccuggcggagaaaaggcguuuagcccgcgaacaacgggaaaaggaggaaagagagaggcgagagcaggaggaacuggaacggcagaagcgcgaggaacucgcucagagaguggcagaggagaggacgacucggcgagaagaggaaagcagacgccuugaggccgagcaagcuagggaaaaagaggaacagcugcagcgucaggccgaggaacgggcauugagagagagggaggaagcggagcgcgcccaacgacagaaggaagaggaagcuagaguccgggaggaggccgaaagggugcgccaggagcgugaaaaacacuuccagagagaggaacaagagcggcuagagaggaagaaacgccuggaagagauuaugaagcgaacaagacggaccgaagcaacugacaagaaaacauccgaucagaggaacggagacaucgcuaagggcgcccucaccggugggacggagguaucagcacugccuuguaccacaaaugccccaggaaacggcaaacccguuggcaguccucacguggucacuucucaccagagcaaggugaccgucgaguccacaccggaucuugaaaaacagccaaaugagaacggggugucaguucaaaaugaaaacuuugaggaaauuaucaaucugcccauaggaagcaagccuucucgcuuggacgugacuaacuccgagaguccagagauuccccucaauccuauccuggcuuucgacgaugaagguaccuuaggcccgcugccccagguagacgggguccagacacaacagaccgcggaggugauuuga

SEQ ID NO: 58793 - RNA, 1944 nt, Artificial Sequence
  derived and/or modified sequence opt3 from MAP9__Homo_sapiens__NP_001034669
augagcgacgagguguucuccaccacacuggccuacacuaagucucccaaagucacgaagagaaccacauuucaggaugaacucaucagggcuauuacugcacggucagcccgccaacgaaguagcgaguauuccgacgauuucgacucugaugaaauaguuucgcuuggcgacuuuucagauaccagcgcggacgagaacagugugaauaaaaagaugaacgauuuccacaucuccgacgaugaagagaaaaauccuucuaagcuguuguuuuuaaagacaaacaaaagcaaugggaacauuaccaaggacgagccaguaugcgcuaucaaaaaugaagaggaaauggccccggauggaugugaggacauuguggucaaguccuucucagagagucagaacaaagacgaagaguuugaaaaggauaagaucaaaaugaagcccaaaccucguauacugagcaucaagucuacuuccucagcagagaauaacagccuagacacagaugaccauuucaaaccaagucccagaccuaggucuaugcucaagaaaaagucccacauggaagagaaggauggucuggaggacaaagaaaccgcccuuagcgaggaacuggaguugcauucggcuccaucuucccuccccacgccuaauggcauucagcuggaagcagagaagaaagccuuuucagagaaccuggauccagaagacaguugccucacuagcuuagcuuccucuagccugaagcagauccuuggggauucauucaguccgggauccgagggcaaugccagcgguaaagaccccaacgaagagauuaccgaaaaucacaacucuuugaagucagaugagaacaaggagaauaguuuuagcgcggaccaugugacaacugcaguugaaaaauccaaggagucucaagugaccgccgacgaucuggaagaggagaaagcuaaggccgaacuaaucauggacgaugaccggacagucgauccucuccugucgaaaagccaguccauacuuauuucaaccagugcaacggcuucuagcaagaagacuaucgaggaccgcaacauuaaaaauaagaaauccacaaacaauagagccucaagcgcgucugccaggcugaugaccuccgaguucuugaagaaaaguagcucuaagcggcgcacuccauccacaaccacgucaagucacuaccucgggacccugaagguguuagaucagaaacccagccagaagcaaucgaucgaaccugaccgagcagauaacaucagagcugccguauaucaggaauggcuggagaaaaagaauguuuaccuccacgagaugcauaggauuaaacggauagaauccgagaaccuucguauccagaaugaacagaagaaagcugccaagcgcgaggaagcacuggccucuuuugaggcuuggaaggcgaugaaagagaaggaagcuaaaaagauugccgcuaaaaagagauuggaggaaaagaacaaaaagaaaacagaggaagagaaugccgcaaggaagggagaggcccuacaagcauucgaaaaauggaaggagaagaaaauggaauaucugaaggagaaaaaccggaaggagcgagaauacgagcgcgccaaaaagcagaaggaagaggaaacuguggcagagaaaaagaaagacaaucucaccgcggucgagaaguggaacgaaaagaaagaggcuuucuuuaaacagaaggaaaaggagaaaaucaaugaaaagagaaaagaggagcugaagagggccgagaaaaaggauaaggacaaacaagcaauaaacgaauaugaaaaguggcuugagaacaaagaaaagcaggagcggauugagcgcaaacagaagaagagacacagcuuccuggaaucagaggccuugccacccuggaguccgccuuccaggacaguguuugcuaaaguguucuga

SEQ ID NO: 58794 - RNA, 1269 nt, Artificial Sequence
  derived and/or modified sequence opt3 from MAPK10__Homo_sapiens__NP_002744
augagccugcacuuccucuacuauugcuccgaacccacccuugacgugaagaucgccuuuugucagggcuucgauaaacaagucgacguuucuuacauugcuaagcauuauaacaugucaaaaaguaagguggauaaucaguuuuacagcguagaagugggggacuccacauucacuguccugaaaagauaucagaacuugaagccuauaggaucuggugcacagggcaucgugugcgccgcguacgaugcuguuuuagacaggaauguggccauuaagaaacugucgcggccauuucaaaaccagacgcacgcaaagcgcgccuaucgagagcuaguccucaugaaaugugugaaucauaagaacaucauuucacugcuuaauguauucaccccgcagaaaacacuggaagaguuucaggauguuuacuuggugauggaacucauggacgcuaaccugugccaagucauccagauggagcuggaucacgagcguaugagcuaccucuuauaucagaugcugugugggauaaagcaucuucacagugcaggaaucauucacagagacuugaagcccuccaauaucguggugaaaucugauugcacucugaagauucuagacuucggccucgccaggaccgcugguaccagcuuuaugaugacaccuuacgucguuacucgguauuaccgcgccccagaagugauccuggggaugggauauaaagagaacguagauauaugguccgugggcuguauuaugggcgaaauggucagacauaagauccuuuuccccgggagggacuacauugaccaguggaauaaagugaucgagcaacugggaacaccuugcccagaguuuaugaagaaauugcagcccaccguucggaacuauguggaaaaucgcccuaaguacgcgggucucacguucccaaagcuguuuccggauucauuauuccccgcagacagugagcacaacaaacugaaggccagccaggcucgagaucuccuuucuaaaaugcuggucaucgacccugccaagagaauuuccguggaugacgcauugcaacauccauacauaaauguaugguaugaucccgcugaaguugaggccccuccaccccagaucuacgacaaacagcuagaugaaagggagcacacuauugaggaauggaaggagcugaucuauaaggaagugaugaacucagaggagaaaaccaagaacggcgucgugaaagggcagccgagcccuagugcgcaaguccagcaguga

SEQ ID NO: 58795 - RNA, 1095 nt, Artificial Sequence
  derived and/or modified sequence opt3 from MAPK11__Homo_sapiens__NP_002742
augagcggccccagagccggguucuacaggcaggagcugaacaagaccgugugggaagucccucaacggcuccagggacuucgcccaguugguuccggcgcuuaugggucugugugcucagcauacgacgcccgacugcgucagaaaguagcggugaagaaauugaguagaccguuucagagcuuaauccacgcuaggcggacauaucgcgagcugagacuacucaagcaucugaaacacgaaaaugucauuggacuucuggauguguucacucccgccacguccauagaggacuuuucugaaguuuacuuggugaccacacucaugggcgcagaucugaacaauaucgucaagugucaagcccugucggacgagcaugugcaguuccucguauaucaguuacugaggggucuuaaguacauucacucagcugggaucauucaucgggauuugaaaccuagcaacguugcagugaaugaggacugcgaacugcgcauccuagauuuuggacucgcccgacaggcugacgaggaaaugacuggcuaugucgccaccagaugguacagggcgccagagauaaugcugaacuggaugcacuacaaucaaacaguggauaucuggagugugggcuguauuauggcagagcuucugcaggggaaggccuuguuccccggauccgacuauaucgaucagcucaaacggauuauggaagucguugguaccccuucuccagaggugcuggcuaagaucagcuccgaacacgcccguacuuacauacagucauuacccccuaugccacaaaaagaccugaguagcauuuuucgcggcgcaaacccgcucgcuaucgaucuucuggggagaauguugguacuagacucugaccagaggguguccgccgcggaggcccuggcacaugcuuauuucucacaguaccacgaucccgaagacgagccugaggccgaaccauaugaugagagcgucgaagcuaaggagcggacacucgaagaguggaaggagcugaccuaccaagaagugcuuaguuuuaaacccccugagccacccaagccgccuggaucucuggaaauugagcaguga

SEQ ID NO: 58796 - RNA, 1074 nt, Artificial Sequence
  derived and/or modified sequence opt3 from MAPK12__Homo_sapiens__NP_001290181
augagcucucccccuccagccagauccggcuucuacaggcaggaggugaccaagaccgcuugggaaguccgggcaguuuaucgcgaccugcaaccgguggggucaggagccuacggugcgguaugcagugcuguggauggccgaacuggggccaaagucgcaaucaagaaacucuaucgucccuuucagagcgagcuuuucgccaagagagcuuacagggaacugcgguuguuaaaacacaugcgccaugagaacgugauuggacugcuagacguuuuuacgccugaugaaacccucgacgauuucacagacuuuuaucuggugaugccauucaugggcacugaucuugguaagcugaugaagcacgagaaauugggggaggacagaauacaguuucucgucuaccagaugcugaagggacugagggaucucaaacccggcaauuuagcagugaacgaagacugugagcugaagauccuugauuucggcuuggcccggcaagcugacuccgaaaugaccggguauguaguuacacgcugguaccgagccccugaggugauucugaauuggaugagauacacccagacugucgauaucuggucugugggaugcauuauggcggagaugaucacagguaaaacccuauuuaagggcucggaccaucucgaccagcugaaggaaauaaugaaagugacggggacuccacccgcagaguucguccagaggcuucaaucagaugaagccaagaacuauaugaaaggacugccugaguuggaaaagaaagacuuugcuagcauccucaccaaugccaguccacuggcaguuaacuuacuggagaagaugcucgugcuugaugcugagcagcggguaacagccggcgaagcgcuggcccacccguacuucgaguccuugcaugacacugaagaugagccccaggugcagaaauaugacgauucuuuugacgaugucgaccguacccuagaugaauggaagcgcgugacauacaaggagguucugagcuucaaaccuccaagacaacucggugcaaggguguccaaggagacaccccuguga

SEQ ID NO: 58797 - RNA, 1098 nt, Artificial Sequence
  derived and/or modified sequence opt3 from MAPK13__Homo_sapiens__NP_002745
augagccugaucagaaagaaaggcuucuacaagcaggacgugaacaaaaccgccugggagcuccccaagacauaugucuccccuacucacguugggucuggagcuuacgguucagugugcagugcaauugauaaaaggagcggcgaaaagguagccauaaagaaacuuucccggccauuucaaucugagaucuucgcgaagcgcgcuuaucgagaacuguuguuacugaaacauaugcagcacgagaaugugauugggcuacucgacgucuuuacgccggccucgucacugcguaacuucuacgauuuuuaucuugugaugcccuucaugcagaccgaccugcagaagaucaugggaauggaauuuagcgaggagaaaauucaauacuugguuuaucagaugcucaagggccugaaguacauccauagugccggugugguccacagagaucugaaaccugggaaucucgcagugaacgaagacugugaguuaaagauacuggauuucggacuugcuaggcaugcagacgccgaaaugacaggcuacguaguuacucggugguaucgcgcuccagaggugaucuuguccuggaugcacuacaaucagaccgucgauauuuggucugugggcugcaucauggccgagaugcugacagggaaaacccuauuuaagggaaaagacuaucucgaucagcugacucaaauucuuaaggugacagguguccccggcaccgaguucguucagaaacugaacgacaaggcggcaaagagcuacauccaguccuugccucagacgccaagaaaagauuuuacucaacucuuccccagggccucaccucaggcugccgaccuguuagaaaagaugcuggaacucgacguggauaaacggcuuaccgcagcucaggcccugacacacccauuuuucgagccguuccgcgaccccgaagaggagacugaagcgcaacagccuuuugaugacaguuuggagcaugaaaagcuaaccguagaugaguggaaacagcacauauauaaggaaauugugaauuucagcccaaucgcccgaaaggacucuagaaggcgguccgggaugaaacuguga

SEQ ID NO: 58798 - RNA, 1083 nt, Artificial Sequence
  derived and/or modified sequence opt3 from MAPK14__Homo_sapiens__NP_001306
augagccaggagagacccaccuucuacaggcaagaacugaacaagacaaucugggaggugccugaacgguaucagaaucucuccccagucggcucuggggccuacggaucaguuugcgcugcauuugacacuaaaacgggucuucgcguggccguaaagaaacugagucgaccguuccagagcauuauacacgcgaagcguaccuauagagaguugagguuacugaaacauaugaagcacgaaaacgugaucggccuacucgaugucuuuacacccgcucggucccuggaggaguucaaugacguguaccuuguuacucaucugaugggggccgauuugaacaauauugugaagugucagaaacucaccgacgaucacguccaauuucugaucuaucagauucugcgcggacucaaguacauccauucugcagacauaauccacagagauuuaaaaccuucgaaccuggccgugaaugaagacugcgagcuuaagauuuuggauuucggccuggcuaggcacacagacgaugaaaugaccgguuauguagcaacucggugguaccgcgccccagagaucaugcuaaacuggaugcauuacaaucagacaguugacauuuggucagugggguguaucauggcugagcuccugaccggacgaacgcuuuuucccggcacugaucacauaaaccagcugcaacagauuaugagauugaccggcacaccuccagccuaucucaucaauaggaugcccagccaugaagcgcggaacuacauucagagucugacucagaugccuaaaaugaauuucgcaaacgucuuuaucggggccaauccauuagcuguggaccugcucgagaagaugcuugugcuggacuccgauaagcguaucaccgccgcacaggcuuuggcccacgcguauuucgcccaauaccacgacccggaugacgaacccgucgcagauccuuaugaccagucuuuugagagccgcgaucuacugauugacgaauggaaaucccucacauacgaugagguuauaucauucgugccacccccucuggaccaagaggaaauggagaguuga

SEQ ID NO: 58799 - RNA, 1635 nt, Artificial Sequence
  derived and/or modified sequence opt3 from MAPK15__Homo_sapiens__NP_620590
augugcaccguggucgaccccagaaucguuaggcgguaccugcuccgccgacagcuuggccaaggggccuauggaauuguguggaaggcuguagaucguagaacaggugagguggucgcaauaaagaagaucuucgacgccuuuagggauaaaacugacgcgcagcggacguuccgcgaaauuacccuguugcaggaguuuggcgaucacccuaacaucauuagcuuacuggacgugaucagagcugaaaaugauagggacauauaccuaguuuucgaguuuauggauacagaccucaacgccgugauccggaaagggggacugcuucaggauguccaugugcgcuccauuuucuaucaacuguugcgagcaacuagauuucuccacucuggccauguaguucacagggaccagaaaccaucaaaugugcugcuggaugccaacuguaccgucaagcucugcgacuucgguuuagcucggagucugggggaccuuccggaaggacccgaggaucaggcagugacagaguacguggccacccguugguaucgcgcuccugaagucuugcugagcucccauagauacacucuaggcguugacauguggucucucggcuguauccugggggagaugcuuaggggacggccacuguuucccgguacaucgaccuugcaccagcucgaacugauuuuagagacgaucccuccacccucagaggaagaucugcucgcccuuggcagcgggugccgagcgagugugcugcaccaauugggaucccgcccuagacagacucuagacgcacugcucccaccggauaccucucccgaggcccuggaccuucugaggcgguugcucguauucgcuccugauaagcgccugagcgccacacaggcauuacagcauccauaugugcaaagauuucacugucccuccgacgaaugggcuagggaggccgauguccguccucgggcgcaugaaggcgugcagcugucaguuccagaguaccgaaguagaguguaccagaugauacuagagugcggugggagcucuggaacuuccagggaaaaaggccccgagggcgucucaccgagccaagcccaccuccacaagccucgcgcagacccccagcugccaagucggaccccugugcaggggcccagaccaaggccccagucuuccccuggacaugauccagcugaacacgagagcccgcgcgccgcuaaaaauguaccccgacaaaacucggccccucuuuugcagacagcacugcucgguaauggcgaacggccacccggggccaaggaggcuccuccacugacccuuucucugguuaaacccuccggacguggcgcggcaccgucauugacgagucaggccgcugcccagguggcaaaccaagcccucauuagaggugacuggaaucgcgggggcggagucaggguggcuagcguccaacaggugccuccacggcugcccccugaggccagacccggcaggcgaauguucuccacuucugcauuacagggggcgcagggaggugcucgcgcccugcuaggcggguauagccaggcauacggaacaguuugucauucagcccucggccaucugccacuuuuggaaggucaccacguguga

SEQ ID NO: 58800 - RNA, 1083 nt, Artificial Sequence
  derived and/or modified sequence opt3 from MAPK1__Homo_sapiens__NP_620407
auggccgcugcagccgcggcuggcgccgggcccgagauggugagaggacaggucuucgacguugguccuagguacaccaaccugagcuauaucggcgaaggggcauacggaauggugugcuccgccuaugauaauguaaacaaggugcgggucgcuauuaaaaagauaucuccauuugagcaccaaacauacugucagcgcacucuccgagaaaucaaaauucuucugcguuucagacaugagaauaucauuggcaucaacgacauaaucagggcaccgacgauugaacagaugaaggauguguauaucguucaggacuugauggagaccgauuuauacaaacugcuaaagacacaacaccucucaaaugaccauauuugcuauuuucuguaccagauccuucggggucugaaguacauacacagugccaacguguugcaucgcgaucucaaacccagcaaucugcugcucaacacuaccugugacuuaaagauuugcgauuucgggcuggcuagagucgccgacccugaucacgaccacacaggauuucuuaccgaguauguggcgacuaggugguaccgggcaccagaaaucauguugaacuccaaaggcuauacaaagucuauugauaucuggucgguaggcuguauccuggccgagaugcuaucaaaucgccccauuuucccugggaaacauuaccucgaccagcugaaucacauacuuggaauccuggguagcccaagucaggaagacuugaacugcauuaucaaucucaaggcucgaaacuaucuguuaucccugccccauaagaauaaaguuccuuggaacagacucuuuccaaacgccgauucuaaggcacuugaccuguuggauaaaaugcuaaccuucaauccgcacaagaggauagagguggagcaagcucuggcccaccccuaccucgaacaguauuacgacccuagcgaugagccaauugcggaagcccccuuuaaauucgacauggagcuggaugaccuuccuaaggaaaaacugaaggaguugaucuuugaggaaacggcacgguuccagccaggcuaccguuccuga

SEQ ID NO: 58801 - RNA, 1074 nt, Artificial Sequence
  derived and/or modified sequence opt3 from MAPK3__Homo_sapiens__NP_001035145
auggccgcugcagccgcgcagggcgggggagguggcgagcccagaaggaccgaaggggugggaccuggcgucccaggugagguugaaauggugaaggggcaaccguucgacguaggaccccgguacacacagcugcaguauaucggcgagggcgcuuacgggauggugagcuccgccuaugaucacguccgcaaaacucgaguggcaauuaagaaaauaucuccuuuugaacaucagacguacugccaacguacccucagagagauccagauucuucugagguuccggcacgagaacguuaucgguauucgcgacaucuugagagccucaacauuagaagcuaugagggauguguauauaguccaggaccugauggagacugaucuauacaagcuccugaaaagucagcaacuuagcaaugaccauaucuguuauuuucuguaccagauuuugcggggacucaaguacauccacuccgcaaacgugcugcaucgcgaucugaagccaucuaaucucuuaauuaacaccacaugcgaccugaaaaucugugauuucggccuugcccgaauagcugaccccgaacacgaucacaccggguuuuugacugaguauguagccacaagaugguacagggcgccugagauuauguuaaauucgaagggauauaccaaaucaaucgacauuuggagcguuggcugcauccuagcagaaaugcucaguaaccggccaaucuuccccgguaagcauuaccuggaucagcuuaaucacauucuggggauauugggauccccuucucaggaggaccucaacuguaucauuaauaugaaagcccguaacuaucugcaaagccugccauccaagacgaagguggcuugggccaaacuguuuccgaagucagacaguaaagcacucgaucuucuggaccgcauguugacuuucaaucccaacaagagaaucaccgucgaagaggcucuagcccauccuuaccuggaacaguauuacgauccaacagacgaggugggccagagccccgcggccgugggccucggggcaggagagcaagguggcacuuga

SEQ ID NO: 58802 - RNA, 2166 nt, Artificial Sequence
  derived and/or modified sequence opt3 from MAPK6__Homo_sapiens__XP_005254596
auggccgagaaguucgaaagccugaugaacauccacggcuuugaccucggguccagauacauggaucuuaagccccugggaugcgguggcaauggguugguguucucugcugucgacaacgauugugacaagaggguugcaauuaaaaagauaguguuaaccgauccucagucaguaaaacaugcccugcgggagaucaagauuauccgccgacuagaccacgauaauauugugaaggucuuugaaauccucggaccaaguggcagccaacugacagacgauguggguucccuuacugagcugaacucuguuuauauagugcaggaauacauggagacggacuuggcgaauguccucgagcaggggccgcugcuggaggaacaugcucgucucuucauguaucaguuacugagaggacuuaaauacauccacucggccaacguguugcauagggaucugaagcccgcaaaucuauuuauuaacaccgaagaccucguacugaaaaucggcgauuucggccuugcccggauuauggacccucacuauucacacaaggggcaucugagcgagggauugguuacaaaaugguaccgcaguccaagacuccuguuaucccccaauaacuauacuaaggcuaucgacaugugggcagccgguugcauauuugcugagaugcugaccggcaagacacucuucgccggggcgcacgaacuugagcaaaugcagcugauuuuggaaucuaucccugugguccaugaggaagauaggcaggagcuacugagcgugauuccaguguacauccggaaugacaugaccgagccccacaaaccucucacucagcugcuuccaggaaucucccgcgaagcacuggauuuucuugagcaaauucucacauucucaccgauggaccgacugaccgccgaagaggcuuuaagucaccccuacaugagcauauauucuuuuccuauggaugaaccaaucuccucacaucccuuccacauugaggacgaggucgaugacauccugcuaauggaugaaacgcauagccacauauacaacugggagagauaucaugacugucaguuuagugaacacgauuggccuguucacaauaacuucgacauugacgaggugcagcucgauccaagggcccugucugacguaacugaugaagaggaggugcaggucgacccccggaaguaccuugauggcgaccgugaaaaauauuuggaggauccggcauucgacaccaauuacuccacagaaccuugcuggcaauauagcgaucaucacgagaacaaguacugugaccuggagugcucgcauacuuguaacuacaaaacccgcagcuccucauaucucgauaaucugguguggagagaaagugagguuaaccacuacuaugaacccaaguugaucaucgaccugagcaauuggaaagagcaguccaaggaaaagucugauaaaaaggguaaaagcaagugcgagaggaacggguuggugaaagcucagauugcccucgaggaagcgucacaacagcuggccggaaaggagcgggaaaagaaucagggcuuugacuucgacaguuuuaucgcaggcacaauucaguuauccagccaacacgagccaaccgaugucguggacaaacugaacgaucuaaauucuucaguaagucagcucgaacugaagucucuuauauccaaaucuguuucgcaggagaagcaggagaaagggauggcuaacuuggcccaacuggaagcucucuaccagagcuccugggacucacaguucgugaguggaggugaggauugcuuuuucaucaaucaguuuugugaaguccgaaaggacgagcaaguggaaaaggagaacacguauacuucuuaccuggauaaauucuuuagccgcaaggaggacacagaaauguuagagaccgaaccugucgaggauggcaaacugggggagagaggacaugaagagggcuuccuuaauaacuccggugaauuuuuguucaauaagcagcucgagucaauugggaucccccaguuucacagcccagugggcucuccccugaaauccauccaggccacucuaacaccuagugcaaugaaaagcucuccacaaauuccgcaucagaccuauuccucaauacugaagcaccucaacuga

SEQ ID NO: 58803 - RNA, 2451 nt, Artificial Sequence
  derived and/or modified sequence opt3 from MAPK7__Homo_sapiens__NP_002740
auggccgagccccugaaggaagaggacggcgaagaugggagcgcugagccuccaggaccggugaaagcagaacccgcccacaccgcggcuuccgucgccgcaaagaaccucgcccuucugaaagcuagaucuuucgacguuacauuugaugugggugacgaguacgagaucauugaaacuauaggcaauggggcauauggaguagugucaagugccaggcggcgcuugacgggccagcaagucgcuaucaagaaaauuccuaacgccuucgaugugguuaccaaugcgaagcgaacauuacgugagcugaagauccuaaaacauuuuaagcacgacaacauuaucgcaauaaaagauauccucagaccaacugugcccuacggugaauuuaagagcgucuaugugguacuggaccuuauggaguccgaucugcaucagauuauccacucuucgcagccuuugacccucgagcauguuagguacuuucuguaucagcugcuccggggguuaaaauacaugcacucagcccaagugauucaccgcgaccugaagccaagcaaucuuuuggucaacgaaaauugcgagcugaagaucggagauuucggcauggcuagaggccuauguacaagucccgccgaacaucaguauuuuaugaccgaguacguggcaacuaggugguaccgggcuccugaacucaugcugucccuucacgaguauacacaggccauagaccuguggucuguggggugcauuuucggagagauguuggcgcgccgacagcucuuuccagguaaaaacuacguccaucaacugcaguuaaucaugaugguucugggcaccccgagccccgccgugauucaggcaguaggggcugaaagagugagggccuauauccagucccucccuccacggcaacccgucccuugggagacgguguacccaggagcugaucgucaggcccuuucacuguugggccgcaugcuaagauucgaacccagugcaaggaucagcgccgcugcggcacugcggcacccguuucucgccaaguaucacgacccugacgaugagcccgacugugcuccaccuuucgauuuugccuucgaccgagaagcacugacucgcgagagaauuaaagaggccauaguugcugaaaucgaggauuuccaugccaggcgggaagguauucgccagcaaaucagauuucagcccucucuucagccaguggcauccgagcccgggugcccugacgucgaaaugccaucaccgugggcgcccagcggagauugugcuauggagaguccuccacccgccccuccacccugcccgggcccugcaccagacaccauagaucugacauugcagcccccucccccagugucugagccugcucccccaaagaaagacggcgccauuuccgauaauacuaaggccgcacucaaagcugcccuguuaaagagccugaggucgcgucuacgggacgggccgucugcgccucucgaagcccccgagccacgaaagcccguaaccgcucaagaaagacagagggagcgcgaggaaaaacggagaaggcgccaggagcgagcaaaggaacgggagaaacguagacaggaaagggagcgcaaggagcggggagccggugcuuccggcgggccuucaacagacccacuggccggacuuguuuugagugauaacgacagaagccugcucgaaagguggacccgaauggcacgccccgcggccccugcucugacguccgugccggccccagcacccgcuccuacuccaacacccaccccuguccaaccgacuucucccccaccuggccccguggcccagccaacagguccucagccccagagcgcagggucaaccaguggcccagucccgcaaccugccugucccccacccggaccugcuccacaccccacgggcccuccggggccaauccccgugccugcgcccccacagaucgccaccuccacaagccuucuggcagcucagucuuugguuccucccccaggacucccugguucaaguacuccgggcgugcugcccuacuucccaccuggguuacccccaccugaugccggaggcgcuccccagagcuccaugucugagucgccggacguaaaucuggucacccaacagcuaagcaaaucccagguggaagauccacucccucccguuuucucagguacaccaaaggggaguggcgccggauauggcgugggguucgaccuggaggaauuucuuaaccaaucuuucgauaugggagucgcagacgguccccaggauggccaggccgacagcgcguccuugucagcuagccugcucgccgauuggcuggaggggcauggaaugaauccugcagacauugagucuuuacagcgggaaauccaaauggauuccccgaugcugcuugccgacuugcccgaccuccaggauccauga

SEQ ID NO: 58804 - RNA, 927 nt, Artificial Sequence
  derived and/or modified sequence opt3 from MAPK8__Homo_sapiens__NP_001265477
augagcagauccaagagggacaacaauuucuacucuguggagaucggcgauucaaccuuuacaguccugaaacgguaucagaaccucaagcccauugggaguggagcccaagguauaguuugcgcugcauacgacgccauccuugaacgcaauguggcgauuaaaaagcugagccgaccuuuccagaaccagacucacgcuaaacgugccuauagagaguugguauuaaugaagugugugaaucauaagaacaucauuggccugcuaaaugucuuuacgccacagaaaucccucgaagaguuccaagauguguacaucguuauggaacugauggacgcaaaccuuugccaggugauacagauggagcuggaucacgagaggaugucuuauuugcucuaccagaugcugugugggaucaagcaucugcacucggccggaauuauccaucgggaccucaaaccgucaaauauugucgugaagagugauugcaccuuaaaaauccuggacuuuggccuugcucgcacagcagguacuagcuucaugaugacccccuauguaguuacaagauacuacagggccccugaagugauauuggggaugggauauaaggagaacgcugauuccgaacacaauaagcugaaagccucucaagcgcgggaccuacucagcaagaugcuggucauugaugcauccaaacgcaucucaguggacgaggcccuucagcacccauacauuaacgugugguaugaucccagugaggcugaagccccuccacccaagaucccugacaaacagcuggacgagcgagaacauaccaucgaggaauggaaggaguugauuuacaaagaggucauggaucucgaagagagaacuaagaauggcguuauaaggggccagccaagcccgcuggcacaagugcagcaguga

SEQ ID NO: 58805 - RNA, 2136 nt, Artificial Sequence
  derived and/or modified sequence opt3 from MAPK8IP1__Homo_sapiens__NP_005447
auggccgagagagaaagcggcgggcugggagguggcgcugcaagucccccugccgcgucuccauuccucgggcuucacaucgcuucaccgcccaacuuuaggcugacccaugacauuaguuuggaggaguucgaagaugaagacuuaagcgagauaacagaugagugcggaaucucccugcaguguaaggacacucuaucucuccggccuccacgcgccggccugcuuucggccggugggggaggcgcaggcucacgacugcaagcugaaauguugcagauggaucucauugacgcaacgggggauacccccggagccgaggacgaugaagaggacgaugacgaggaacgugcugccagaaggccuggugcgggcccacccaaagcagagagcgggcaggaaccugccagucggggacagggccaaucccagggucagucucaggggccaggaagcggcgauacauaccgcccgaagagacccacuacccugaaucuguuuccucaagugccaaggucccaggacacacucaacaauaacucauuaggcaaaaagcacaguuggcaggaccgggucagcaggucuuccucaccccugaaaaccggggagcagacuccuccacaugaacacaucugccuuagcgaugaguugcccccgcaaaguggaccugcucccacaaccgaccgagguacgucuacugauuccccauguagaaggagcaccgccacacagauggcaccucccggcgggccacccgcugccccuccaggaggccggggucauucgcaccgugaccgcauucacuaucaggcggauguuagacuggaggccacugaagagaucuaccuaaccccggugcaaaggcccccugacgcagcugaaccaacaucugccuuccugcccccuaccgagucccggaugucaguaaguagcgauccagaccccgcugccuauccguccacggcagggcgaccucauccaucuauaagcgaagaggaggaaggcuuugauugccucucaagucccgagcgcgccgaaccucccggaggcggguggagaggaucccuuggugagccaccucccccaccgagggcuagccugucuucagacacuuccgcguugagcuacgauuccgugaaguauacacucgucguggacgaacacgcacagcuggaguuaguuucucugcggccuuguuucggcgacuacucggaugagagcgacuccgccaccguguaugauaauugcgcuucagucaguucucccuacgaaagcgccaucggggaggaauacgaggaggcaccacgcccccagccuccagccugucucuccgaagacucaacucccgaugagccugacgugcauuuuagcaagaaauuccuuaacguauuuaugucuggaagauccaggaguagcucugcugaauccuucggccuguuuucaugcauuaucaauggugaggaacaggagcaaacacaccgugccauuuuccgguuuguuccgcgacacgaggaugaauuggagcuagaaguggacgauccacugcucgucgagcugcaggcagaagacuauugguacgaggcguauaacaugagaaccggggcuaggggcguguuccccgccuacuaugcaaucgaggugacgaaggaaccugagcauauggccgcucuugccaaaaauagugauugggucgaccaguuccgcguuaaguuucugggaagcgugcagguaccauaccacaaaggcaacgauguguugugugcagcuaugcaaaagauagccaccacacggagacucacuguccauuucaaucccccuucguccugcgugcuggaaauuucuguucgcggggugaagaucggagucaaagcggacgacagccaggaggccaaggguaacaaauguucacacuuuuuccaguuaaagaauauuaguuuuugcggcuaucauccgaaaaacaauaaguacuucggguuuaucaccaaacaccccgcugaucaccgcuucgcaugccauguguuuguauccgaagacucuacaaaggcccuggcugagagcguuggacgagccuuccagcaauuuuacaagcaguucguggaguauacuuguccaaccgaagauaucuaccuagaguga

SEQ ID NO: 58806 - RNA, 2475 nt, Artificial Sequence
  derived and/or modified sequence opt3 from MAPK8IP2__Homo_sapiens__NP_036456
auggccgacagagcugagauguucagccuguccaccuuucacucucucucacccccuggcugcaggccaccgcaggauaucagucuugaagaguucgacgaugaagaccugagcgagauuacagaugacuguggguugggauuauccuacgauucugaccauugcgaaaaggauucgcugucacuaggucggagcgagcaaccccacccuauauguaguuuucaggacgauuuccaggaguuugaaaugaucgacgauaacgaggaagaggacgacgaggaugaagaggaagaggaagaggaggaagagggcgacggggaaggacaggagggcggugauccaggguccgaagcacccgccccuggaccacucauucccucuccuagcguggaggagccacauaaacaccgcccgacuacgcugcgacuuaccacacugggcgcgcaagacuccuugaauaacaauggcggguucgaucucguccgucccgcuucauggcaggaaacugcccugugcaguccugcaccagaggcccugagagaacuccccggaccuuuaccagcuaccgacacaggucccggcggggcacagagcccgguuaggccuggaugugauugcgagggcaaccggcccgccgaaccgccugcucccggugggaccucuccauccucagaccccggaaucgaggccgaucugcgcagcagaaguucuggcggccgagggggacggcgcuccagccaggagcuuucgucuccugguuccgacucagaagaugcgggcggggcacgauugggaagaaugauuaguagcaucuccgagacugaacuggagcuaucuagcgacggcgguucaaguuccagcgggaggucuucacaucucacaaauaguauagaggaagccagcuccccagcuucugagccggaacccccucgggagccaccccgucgcccugccuuucugccagugggccccgacgauaccaacucggaauaugagagcggauccgagucagaaccggaccuuagugaggaugcagacucuccuuggcuguugagcaaucucguauccagaaugaucucagaaggcagcucuccaauuaggugucccgggcaaugccuguccccugcuccccggccaccuggagagcccgugaguccagccgguggcgcggcccaggauagccaggacccggaagcagcugccgggccuggaggcgucgaguuaguggauauggagacgcugugugcucccccacccccugccccagcagcccccaggccugguccggcucagccagggcccugccucuuccuuucuaacccuacucgcgacaccaucacaccacugugggcggcacccggcagagccgcuaggccuggacgggccuguuccgcagccugcucagaagaggaagaugaggaagacgaugaggaggaagaggacgcugaagauagugccggcagcccagggggacgcgguacuggccccucggcaccaagagacgcguccuugguuuacgacgcugugaaguauacccuagucguggaugagcacacacaacuggagcucguaucucugaggcguugcgccgggcuuggacacgacagcgaagaggauucaggcggugaagcaagugaggaagaggccggggcugcccuguugggcggaggccagguuuccggggacaccucuccugauagccccgaccucacguuuuccaaaaaguuccugaauguguuugucaacucaacuagccggaguucuuccacagagagcuucggauuauuuucgugucuggugaauggcgaggaacgagaacagacccauagagcaguguucagguucauuccacgccacccugaugagcuagaacucgacgucgaugaccccguucugguggaggcugaggaagaugacuuuugguuccgggguuuuaacaugagaacuggggagaggggaguauucccagccuuuuacgcgcaugccgugccgggcccugcuaaagaucuuuuggguucaaagcgcucucccugcugggucgaacgauucgacgugcaauuucugggcaguguugaggugccaugucaccaggggaauggaauccucugcgcagccaugcagaagauagcuacagcccggaaacugaccguccaccuucgucccccugcauccugugaccuggaaauuagcuugagaggcgugaagcucucucugagcgggggaggcccagaguuccagaggugcucccacuuuuuccaaaugaaaaacaucucauuuugugguugccauccccgcaauaguuguuauuucggguuuauuacgaagcauccuuuacugagccgguucgcgugccacguauucguuucucaggaguccaugagaccgguggcccagucagucggaagggcuuuucuagaauacuaucaggagcaucucgccuacgcauguccaaccgaagauaucuaccuggaguga

SEQ ID NO: 58807 - RNA, 3993 nt, Artificial Sequence
  derived and/or modified sequence opt3 from MAPK8IP3__Homo_sapiens__NP_001035529
augauggagauccagauggacgaaggcgggggaguggucguuuaccaagaugacuauugcagcgguuccgugaugucugagagaguaucaggccuggccgggaguauuuacagggaguucgaacggcucauacacuguuaugaugaagagguggucaaggagcuuaugccccuggugguuaacguguuggaaaauuuagacagcguccuguccgagaaccaggaacaugagguggagcuagaacuccugcgcgaggauaaugaacagcuucugacccaguacgagcgagaaaaagcauugcguagacaagcagaggagaaguuuaucgaguucgaagacgcccucgaacaggagaaaaaggaacugcagauucagguagagcacuaugaguuucaaacaaggcagcuggaacucaaagcgaagaacuacgcugaucagaucucucgguuagaggaacgcgagucggaaaugaagaaagaguauaaugcccugcaucagagacacacugagaugauucaaacguacguugaacauaucgagaggucaaagaugcaacaggugggaggcaacagccagaccgaaaguucccuuccuggucggcgcaaagagcgaccaacaucuuugaaugucuucccgcuggcagacgggacugugagagcccagauaggaggcaagcuagugcccgcuggcgaucacuggcaccucagcgaccuggggcagcuucaguccucaaguagcuaccaaugcccucaggaugagaugucugaauccggacagucaagcgcagccgcuaccccaaguacaaccgguacuaaaucuaacacacccaccuccagcgucccuucggccgcgguuacgccacugaaugagucuuugcagccccucggcgacuauggggugggauccaagaacucaaagagggcacgggaaaaacgugauagucgcaauauggagguacaagugacucaggaaaugagaaacgucagcaucggcauggguuccucugacgaguggagcgacgugcaggauauuaucgacucaaccccugagcuggauauguguccagaaacaagguuagaccggacugggaguuccccgacccagggaauuguuaauaaggccuuuggcaucaacacagauagccuguaccaugagcucucuaccgcuggcucagaagugauaggggacgucgaugagggagccgaccuucugggugaguucaguggcauggggaaagaagugggaaauuugcuacuggagaacagccaacuccuggaaacgaagaacgcacuuaauguaguuaaaaacgaucugauugcuaagguggaccaguuguccggcgagcaggaaguccuccgaggugagcuggaagccgcgaaacaggccaaggugaaguuagagaaucgcaucaaagagcuggaagaggaacuaaagagagucaaaucugaggcaauuaucgcuaggcgggagcccaaggaagaggccgaagaugugucgagcuaucucugcacugaguccgacaaaaucccuauggcucaacgcagaagguuuacacguguugaaauggcccgggugcugauggagcgaaaccaguacaaggagagacuuauggaauugcaggaggcaguaagguggaccgaaaugauucgcgccucacgggagcacccaaguguccaagaaaagaaaaagucuacuauauggcaguucuuuagcagacuguucuccucaagcucuagucccccuccagcuaaaaggcccuauccguccgugaauauccauuacaagagcccuacaaccgcgggguuuucucagcgccgaaaccacgcaaugugucccauuuccgccggcucacggccacucgaguucuuuccugacgaugacugcacgaguagcgcucguagagagcagaaaagggaacaauaucgccagguucgggagcacgugagaaaugaugacggaaggcugcaggccuguggcuggucgcuucccgcaaaguacaagcagcuguccccaaacgggggacaagaagauacccgaaugaaaaauguccccgugccuguauacugccgcccauugguggagaaggacccgacaaugaaacucuggugugccgcugguguuaaccugucuggcuggcggcccaaugaagaugacgccgggaacggagucaagccugcaccaggcagagaucccuuaacuugcgacagggagggugauggggagccuaaaagcgcgcauaccucaccagaaaagaagaaagcuaaggagcugcccgaaauggacgccacaaguucccguguguggauccuaacuucuacccucacaaccagcaaaguggucauaauugaugcaaaucagccgggcacuguuguggaccaguucacgguguguaacgcccacguacugugcaucuccucaaucccugcugccagcgacagugauuauccacccggagagauguuccuugacucugaugucaauccugaggaccccggcgcagaugggguguuggcuggaauuacacugguugguugcgccacccgcuguaacgugccacgguccaacugcagcucgagaggcgacacuccuguccucgauaaggggcagggagaaguggcgaccaucgccaauggcaaaguuaaccccucacaaucuacagaggaagcuaccgaggcaacugaagugccagacccggguccuagugagcccgagacagccacgcugaggccagggcccuuaaccgaacauguauuuacugauccugcuccaacacccuccagcggcccucagccgggaucugagaauggcccagaacccgacagcuccucaacccgaccugagccagaacccaguggggauccuacaggagccggcagcucugcagcgccgacuauguggcugggugcccagaacggguggcuuuacguccacuccgcuguggccaauuggaagaaauguuugcauucaauuaagcucaaggacagugugcugagccuaguccacguuaaaggacgggugcugguagcacucgcugauggcacccuggccauauuccaccgcggugaggacggccaaugggaccuuuccaacuaucauuugauggaucuggggcacccccaucacucuaucagaugcauggcaguggucuacgacagggugugguguggauauaagaauaaaguucacgugauucagccaaagacgaugcagaucgagaaaucguuugaugcccauccucggcgagaaagccaggucagacaauuagcuuggaucggcgacgggguguggguuucaauucgccucgauuccacccugaggcuuuaccacgcgcauacacaccagcaucugcaggacguggauauagagcccuaugucaguaagauguugggaacuggcaagcucgguuucucuuuuguacguaucaccgcccugcuaguggcagggagccggcuguggguuggaacaggcaacgguguggucauuuccaucccacucacugaaaccgugguacugcacagaggccagcuuuuggggcugagggcuaauaaaacgucaccuacaucuggagagggcgcccgccccgggggaauuauccacguguacggcgacgauagcagugaccgagccgcuuccagcuucauaccauacugcucuauggcacaagcccaguuauguuuucauggucacagagaugcggucaaguucuuuguuucagugccggggaacgugcucgcuacccugaauggauccguccuugacaguccugccgaaggccccgguccagcagcccccgcuagcgagguggagggccagaaacugcggaacguucuaguacucucgggaggggaaggcuauaucgacuucaggauuggggauggagaggacgaugaaacugaggagggcgcuggugacaugucucaggugaagccuguccuguccaaagccgaacgcagccauaucauuguguggcaaguuucauacacaccagaguga

SEQ ID NO: 58808 - RNA, 729 nt, Artificial Sequence
  derived and/or modified sequence opt3 from MAPK9__Homo_sapiens__NP_001128516
augagcgacuccaagugcgauucucaguucuacucagugcaagucgccgacaguaccuuuacaguucugaaaagauaucagcagcucaagcccaucggcagcggggcucagggaauugugugugcagccuucgauacuguacuugguauaaacguggcggucaaaaagcuguccaggccuuuucaaaaucagacgcacgcuaaacgggccuaccgcgaguugguguuacugaagugcguuaaccauaagaauaucauuucucuacucaacguguucaccccacagaaaacacuggaagaguuucaggacgucuaucuugugauggaacugauggaugcaaauuugugucaaguaauccacauggagcucgaccaugaacgaaugucguaccugcuguaucagaugcucugcggcauuaagcacuuacauucagccgggaucauacaccgugaucugaaaccgagcaacaucguugugaagagugacuguacucuuaaaauuuuggauuucggacuggcuagaaccgcaugcacaaauuuuaugaugacccccuacgucgugacuagguauuaccgggccccugaggugauccuaggcauggguuacaaggagaacgucgacauuugguccguuggguguaucaugggagaacucgugaagggcugcguaauauuccagggcacagaucgcauucugccaagagaccuugggcccgcuaugcugucuuga

SEQ ID NO: 58809 - RNA, 1569 nt, Artificial Sequence
  derived and/or modified sequence opt3 from MAPKAP1__Homo_sapiens__NP_001006618
auggccuuccuggacaaccccaccaucauucucgcucacauaagacagagccaugugacauccgaugacacuggcaugugcgagaugguccuuaucgaucacgacguugaucuggaaaagauucauccuccaucuaugccgggggacucaggaagugagauccaagguagcaauggcgaaacgcagggguacguguaugcacaguccguagauauuaccucuucgugggacuuuggaaucaggcggcgcucaaacacagcccagcgauuggagcguuuaagaaaagaaaggcaaaaucagauaaaguguaaaaacauccaguggaaggagcggaauagcaaacagagugcgcaagagcugaagucccuauucgaaaagaaaucucucaaggagaaacccccuauuagcggcaagcaguccauccugucagugcgccuugaacagugcccacugcaguugaacaaucccuuuaacgaguacaguaaauucgaugguaaggggcacgucggaacuaccgcuacaaagaaaauugacguguaucucccucugcauagcucucaagauagacugcucccaaugaccguugugacuauggccuccgcaaggguccaggacuuaaucggccugauauguuggcaguacacaucagagggccgggaacccaaacuuaaugauaacgugagcgccuauugcuugcacauugcugaggacgacggggaaguagauaccgacuuuccuccacuggauaguaaugagccgauccacaaguucggauuuucuacgcuagcacucguugaaaaguacuccagccccggucugacuucgaaagagucucuuuucgugcgcauuaacgccgcucauggcuuuucccugauccaagucgacaauaccaaggugacaaugaaagagaucuugcucaaggccgugaagcgaagaaaagggucacagaaggucaguggaccucaguauaggcuggaaaaacagagcgagccaaacguugcgguggauuuagacuccacucuggaaucucaaagcgcaugggaguucugucucguacgggaaaauucaagucgugccgauggcguguuugaggaggacucccagauugauauagcuaccguccaggacaugcuuagcucucaccauuacaagucauucaaagugaguaugauccaccgccugagauuuacaaccgauguucaguuggguauuagcggggacaagguggaaaucgaccccgucacgaaccaaaaggccuccacuaaauucuggauaaagcagaaaccuauuucuaucgauucggaccuacugugcgcaugugaucucgcugaggaaaagagcccaucccacgccaucuucaaacugacauaccuuucaaaccaugacuauaagcaccuguacuuugagagugaugcggccaccgugaaugaaauuguauugaagguuaacuauauccucgagucuagggcaagcacugcucgggccgacuacuucgcucagaaacagcgaaagcugaaucgcagaacauccuuuucauuccaaaaagagaagaaaagcggacagcaguga

SEQ ID NO: 58810 - RNA, 1113 nt, Artificial Sequence
  derived and/or modified sequence opt3 from MAPKAPK2__Homo_sapiens__NP_004750
augcugagcaacucccagggccaaucucccccugugccauucccggcccccgcuccuccaccccagccuccaacccccgcacucccucacccaccggcccagcccccuccacccccuccacagcaauuuccccaguuccaugucaagucagggcuucagaucaaaaagaaugcgauuauagacgauuacaaaguuacaagucaggugcugggauuggguaucaacggcaagguauuacaaauuuuuaauaaaagaacucaggagaaguucgcucugaagaugcuacaggacugcccgaaagccaggcgggaaguggagcuccacuggcgcgcaagccaguguccucauaucguccgaauuguggauguuuaugaaaaccuguacgccgggcguaagugccuucugaucgugauggaguguuuggacggaggcgaacucuuuuccagaauacaagauaggggugaccaggcuuucacggagcgggaggcaucugaaaucaugaaaucgauuggggaggccauccaguaucugcacucaauuaauaucgcucaucgcgaugucaagcccgaaaaccugcucuacaccagcaaaagaccaaaugccauauuaaagcugacagacuuuggauucgcgaaggagacuaccagucacaacucccuuacaaccccuugcuauacucccuacuauguggcaccagagguauugggccccgaaaaauacgauaagucuugugacauguggagccugggcguuauuauguacauccuacucugcggguauccuccauuuuacuccaaucacggacuggccauuucaccggguaugaaaacaaggauccggaugggccaauaugaguuccccaacccugaauggagugaggugagcgaagaggucaagaugcuuauccgcaaucuguugaaaaccgagccaacgcagcgaaugacuauuaccgaauuuaugaaccaucccuggauaaugcagucuacaaaggugccucagacuccacuccacaccuccagagugcugaaagaggauaaggaaaggugggaggacgucaagggguguuuacaugauaaaaauucagaccaagcuacauggcugacccggcucuga

SEQ ID NO: 58811 - RNA, 1149 nt, Artificial Sequence
  derived and/or modified sequence opt3 from MAPKAPK3__Homo_sapiens__NP_001230855
auggacggcgagaccgccgaggaacaagggggacccgugccuccaccggucgcucccgguggcccugggcugggaggcgcaccaggugggagaagggaacccaagaaauacgccguuacagaugacuaucagcucagcaaacaggugcuuggacugggcguaaacggcaaaguguuggagugcuuccaccggcgcacugggcagaagugugcguuaaaacugcuauacgauuccccuaaggcucgacaggaagucgaccaucacuggcaagccucuggagguccacauaucgugugcauucucgauguuuaugagaauaugcaccauggcaagcguugucugcuuauaaucauggagugcauggaagggggagagcuguuuucaaggauucaggaaagaggcgaccaggcauucacggagcgggaggccgcugaaaucaugcgcgauauugguaccgcaauccaguuuuugcacagucacaacauagcccauagagacgugaaacccgagaaucuccuguacacaagcaaggaaaaagaugcuguccugaagcucacugacuucggguuugccaaagagaccacacaaaacgcguuacagaccccuuguuauacuccauacuauguggcaccggaaguacugggacccgagaaguacgauaaguccugcgacauguggucucuuggcguuaucauguacauuuugcuguguggcuucccuccauuuuauucgaauacagggcaggccaucucacccggaaugaaaaggcggauucgccuaggucaguacggcuucccuaacccagaguggagcgaagugagugaggaugcuaagcaacucauccgacugcuucugaaaaccgaccccacggaaagauugacuauaacccaguuuaugaaucacccguggauuaaccaguccauggucgugccucaaacaccccuccauacugccagggugcugcaggaggacaaggaucacugggacgaagucaaagaggagaugaccucugcauuagcuacaaugcggguugauuaugaccaggugaagaucaaagaucugaagaccagcaauaaccgucuccuuaauaagcgcagaaagaagcaggccggguccucaagugcgagccaaggaugcaacaaucaguga

SEQ ID NO: 58812 - RNA, 4545 nt, Artificial Sequence
  derived and/or modified sequence opt3 from MAPKBP1__Homo_sapiens__NP_001122080
auggccguggagggcagcaccaucacauccagaauuaagaaccugcucaggucucccucaauaaaacuucggcgcaguaaggcugggaaucgacgugaagaccugagcuccaaagucacuuuggagaagguuuuaggaaucacggugucugguggcagagggcuggcaugcgauccuaggucgggacugguagccuacccagcgggcuguguggucguucucuucaacccgcggaaacacaagcagcaucacauucuaaauucaagccgcaagaccaucacagcucuugccuuuagucccgacgguaaauaucuggugacuggggaauccggacauaugccugcagugagagucugggauguggccgagcacucucaaguagcugaauugcaggagcauaaguacggcguugcaugcguggccuucagcccauccgcuaaauauauugucucagugggcuaccagcacgacaugaucgugaacgucugggccuggaagaaaaauauaguuguggcgaguaacaagguaagcucuagggugaccgcagucuccuuuucagaggauuguagcuauuucgugacagccgggaaucggcacaucaaguuuugguaccucgacgauaguaaaaccucuaagguuaacgcuacugugccccugcugggacgcuccggucucuuaggcgaacugcgaaauaaccuuuucacagacgucgccugcgggagaggcaaaaaggcagauagcaccuuuuguauuacgucgucuggauugcugugcgaguucuccgacaggcggcuacucgauaaauggguggaacugcguaauaucgacucauuuacuaccacaguagcucauuguauuaguguuagccaggauuauaucuucugcgguugugccgacgggacugugcgccuuuuuaacccuuccaaucugcacuucuugucuacccucccaagaccccaugcgcugggaacagacauagccagcgucaccgaggcaucaagguuauuuaguggcguggcuaacgcccgguacccugauacgauugcucugacuuucgacccaacaaaucaauggcucuccugcgucuacaacgaucacagcaucuaugugugggacguucgagauccgaagaaagugggcaagguauacucugcccuuuaucacucaaguugugucuggagcguggagguuuaccccgaagugaaggacuccaaccaggcaugccugccuccaucuucguucauuaccugcagcuccgauaauacuauccgcuuguggaacacagagucaagugggguccauggaucuacccuacacagaaauauccugagcuccgaccucauuaaaauaaucuauguggaugguaacacgcaggcccugcuugacaccgaacugcccggcggggauaaggcugacgcgucauugcucgacccuaggguaggcauucggagcguguguguuucuccaaauggacagcaucuggcauccggugaucgcauggggacauuaagaguccacgagcugcaaagucuaagcgaaaugcucaaaguggaggcccaugacucugagauccugugccuugaauacuccaagcccgauacuggcuugaaacugcucgcuucagccaguagggaccgucugauacacgugcuugaugcaggacgggaguauagccugcagcagaccuuggacgaacacucguccucuauuacagccgucaaguuugcugccagcgauggccagguucgaaugaucucauguggggcagacaagaguaucuacuucagaacugcgcaaaaauccggagauggugugcaguuuaccaggacacaucacgugguacgcaagaccacucucuacgacauggaugucgagccgucuuggaaauauacggcuauuggcugccaggaccggaacaucagaauuuucaauauaagcuccgggaagcagaaaaagcuguuuaagggaucacaaggcgaagaugguacauuaaucaaagugcagaccgacccuagcgggauuuacaucgccacaaguuguucugacaagaaccuguccaucuucgauuuuagcucgggcgagugcguugcaaccauguucggacauucagagauugugacaggcaugaaauuuucuaaugacuguaagcaccuaauaagugucuccggggauagcugcaucuucguguggaggcucucuagcgaaaugaccauuuccaugcgccagcgacuggccgagcuucggcaacgucagagaggagguaaacagcagggccccucaaguccacaaagggcuagcgggccuaaccgccaccaggcccccucuauguuguccccaggacccgcacugucaagugacagcgauaaggaaggcgaggacgaagguacugaggaggaacucccugcucugccaguuuuagccaaguccacuaaaaaggcgcuggccucugugccgucgcccgcacuuccucggagcuugucacauugggagauguccagagcucaggaaaguguaggguuucucgauccagcccccgcugccaauccuggcccaaggcgacgcggacgguggguccagcccggcguggagcugucugugagaagcaugcuagaccugaggcaacucgagacgcuggcaccgucccuucaggauccuucacaggacucuuuggcgaucauuccaagcgggccccguaaacacggacaggaagcccuggagaccaguuuaacuucccaaaacgaaaagccuccccgcccacaggcuagccagccuuguucuuauccccauaucauacggcuccugucacaagaggaaggcgucuucgcccaggaucuugagccagcaccgaucgaggacgguauuguuuacccugaacccuccgauaauccaacaauggacaccagugaguuucaggugcaggcucccgccagagggacacugggaaggguauauccuggcagccgaucgucugaaaaacacuccccagacagcgcaugcucaguggauuacaguucuuccuguuugagcucacccgagcauccuacugaagacagugagagcaccgagccgcucuccgucgaugguaucucuagcgaccuggaggaaccagccgaaggcgaugaggaagaggaggaagaggaagggggaaugggccccuaugggcuacaagagggauccccucagacgccagaccaggagcaguuccugaagcaacacuucgaaacccucgcuucaggcgcggcccccggugcaccugugcagguuccggagcggucugaaagucgcucgauuagcuccagauuucugcuucaggugcagacaaggcccuugcgggagccaucuccuucaagcuccagucuggcuuuaaugucucgacccgcccaagucccacaggccagcggggaacagccuagaggaaacggcgcuaaucccccaggugcaccgccugagguggagcccucauccggcaacccaaguccccaacaggccgcgagcguucuccugccucgcugcaggcuuaacccagauucuuccugggcucccaaacguguggccacugcaucaccuuucagcgggcugcagaaggcccagucgguccacucucuaguaccgcaagaacggcaugaggcuagucuccaggcaccaucccccggagcccuguugagcagagaaaucgaggcgcaggacggccuggggucauuaccucccgcugauggaaggccaucccgcccucacucuuaccagaaucccaccacaagcaguauggccaagauaucccgaagcauuucugugggcgaaaaccucggucugguugcagagccacaagcccaugcuccuaucagagugucaccgcuuaguaaacuggccuugcccucccgggcacaccucguccuggacauuccaaagccucuacccgauaggccaacucuggcugccuuuagcccugugaccaaagggcgcgcgcccggagaggccgaaaagccgggcuucccaguaggucuuggcaaagcacauucuacgacagagcguugggcuugccucggggaaggaaccacuccuaagcccagaacagagugucaggcccacccaggccccucgucaccuugcgcucagcagcugccggugagcuccuuguuucaagggcccgaaaaucugcagccaccucccccugagaagaccccaaaccccauggaguguacuaaaccuggagcagccuuaagucaggacucugaaccagccgucagccucgagcagugcgaacaacugguugcugagcuucggggcuccgugaggcaggcggugcgccuguaccacucagucgcagguuguaagaugcccagugccgagcagucucgaaucgcucaauugcucagagacaccuucagcuccgugcggcaggaacuggaggccguugcaggggccguacuaucaagcccgggaucuuccccuggcgcugugggcgcggaacagacacaggcccugcuugagcaauauagugaacuccuguugagggcagucgagcgcagaauggagaggaaauuauga

SEQ ID NO: 58813 - RNA, 807 nt, Artificial Sequence
  derived and/or modified sequence opt3 from MAPRE1__Homo_sapiens__NP_036457
auggccgugaacgucuacagcaccuccguuacaucugacaaucugucaagacacgauaugcucgcuuggaucaacgagagucuucagcugaauuugacuaagauugaacaauuaugcagcggcgcagccuauugucaguucauggacaugcuguuucccggguccauagcgcucaaaaaggugaaauuccaggcuaagcuagagcaugaauacauccagaacuuuaaaauucugcaagccggauucaagaggauggguguagauaagaucauuccuguggacaaacuugucaagggcaaauuucaggauaauuucgaguuugugcagugguucaagaaauuuuucgacgcaaacuaugaugggaaggacuacgauccaguugccgcucggcagggacaagaaacggcaguggccccgucucuggucgcucccgccuugaauaagccuaaaaagccacucaccucgucaagcgcggcaccccagcgcccuaucaguacacagcgaacugccgcugccccaaaagcaggccccggugugguacguaagaacccugggguuggaaauggcgacgaugaggcugccgagcugaugcagcaagugaacguccugaaacucaccguggaagacuuagagaaggaaagagauuuuuauuucggcaaacugaggaauauagagcuuaucugccaggagaacgaaggggagaaugacccaguguugcagcggauugucgacauccuguacgcgacagaugaaggauuuguuauuccggacgaggguggcccccaagaggaacaggaggaauauuga

SEQ ID NO: 58814 - RNA, 855 nt, Artificial Sequence
  derived and/or modified sequence opt3 from MAPRE2__Homo_sapiens__NP_001137298
auggccgugaacgucuacagcaccuccaucacacaggagacuaugucuagacacgacauuauagcuuggguuaaugauaucgugucacugaacuauacgaagguagaacaacucugcaguggcgcagccuacugucaguucauggacaugcuuuuucccgggugcauuagccugaaaaaggugaaauuccaggcgaaguuggagcaugaauauauccacaauuuuaaauuacugcaggcuuccuucaagaggaugaacgucgauaaggugauuccuguugagaagcuagugaaaggacgguuucaagacaaucucgauuucauccagugguuuaaaaaguucuacgacgccaacuaugaugguaaagaauacgacccagucgaggcacgccagggccaggaugccauaccgcccccugacccaggggagcaaaucuuuaaucugcccaagaagucucaucacgcuaacucgccuaccgcaggagccgcuaaaucaagcccagccgcgaagcccggcaguacaccuucccgaccaucuagcgcaaaacgugccuccucaagugguagcgcuucuaaguccgauaaagaccuugaaacucaggugauucagcugaaugagcagguacauucauugaagcucgcccuggaagggguugagaaagagagagauuucuauuuuggaaagcugagggaaaucgagcucuuaugucaagaacacggccaggagaacgacgaccuggugcagcggcuuauggauauuuuguacgcaagcgaagaacacgagggccauaccgaggagccggaagcugaggaacaagcccacgagcagcagcccccucagcaagaggaauacuga

SEQ ID NO: 58815 - RNA, 846 nt, Artificial Sequence
  derived and/or modified sequence opt3 from MAPRE3__Homo_sapiens__NP_001289979
auggccgugaacgucuacagcaccuccguuacaucugagaaucugucaagacacgacaugcucgcuugggugaacgauagucuucaucugaauuauacuaagaucgaacaguugugcagcggcgcagccuacugucaauucauggacauguuauuucccgggugcguacaccugaggaaagugaaguuccaggcgaaacuagagcaugaauauauucacaacuuuaagguccuccaggcugccuucaaaaagaugggaguggauaagauaaucccuguugagaaacuggugaaggguaaauuucaggacaauuucgaauuuauucaaugguucaagaaauuuuucgaugcaaacuacgacggcaaggauuauaauccacuucuggcccggcaggggcaggacgucgcuccgcccccuaacccaggagaucagaucuuuaauaaguccaaaaaguugauuggcacggcagugccccaacgcaccucuccuacaggucccaaaaacaugcagacuucggggcgacucucaaauguagccccaccuuguauccugcguaagaacccaccgagcgcuagaaauggaggccaugagaccgacgcccagauacuggagcucaaccagcaauuaguugaucugaaacuuacaguggacggcuuggaaaaggagagggauuucuacuuuaguaaacugcgggacaucgaacuaauuugccaggagcacgaguccgaaaauucucccgucaucagcgggauuaucggaauacucuaugcgaccgaggaagguuucgcaccuccagaggacgaugaaauugaggagcaccagcaagaagaccaggaugaguacuga

SEQ ID NO: 58816 - RNA, 2331 nt, Artificial Sequence
  derived and/or modified sequence opt3 from MAPT__Homo_sapiens__NP_001116538
auggccgagcccagacaggaauuugaggugauggaagaccacgcuggcaccuacgggcugggagauaggaaggaccaagguggcuauacaaugcaucaggaucaggagggggacacugaugcaggacucaaagaaagcccucuucagacgccaaccgaggacggcuccgaggaaccggguucugagacaucagaugccaagaguacucccaccgcggaagacgucacagcuccucugguugaugagggggccccaggaaaacaagcagccgcucagccccacaccgagaucccugaaggcacuacagcagaggaagccggcauuggggacaccccuagcuuggaggaugaagcugccggacaugugacgcaggagcccgaguccgguaagguagugcaggaaggcuuuuuacgggagccugggccaccgggacugucucaccaacuaaugucgggcaugcccggugcgccucuccugccagaagggccccgcgaggcaacucgacagccuucaggaaccggcccagaagacacagagggcgggcgucaugcccccgagcuucugaaacaccaguugcucggagaucugcaccaggaagguccgccucugaagggcgcugggggaaaggagagacccggcagcaaagaagaggucgacgaagacagggauguggacgagaguuccccacaagauucuccucccagcaaggccuccccagcacaggacggucggcccccucagacugcugcccgcgaggcgaccucaauaccaggguucccggccgaaggcgcaaucccccucccuguugauuucuuaaguaaagugagcacagagauuccagcuucugaacccgacggaccuuccgucggcagagccaaggggcaagaugcuccacuggaguucaccuuucauguggagaucacgcccaacguacagaaagaacaggcccacucagaggaacaucuuggaagggcagccuucccgggugcuccuggcgaggggccagaagcgcggggacccagcuugggcgaggacacuaaggaggcagaucugccugaacccagugagaagcagccagccgcugccccucgcgguaaacccguuucucgagugccacaacuaaaggcaagaauggucuccaaaagcaaggacgggacaggcucggaugacaaaaaggccaaaaccucuacuagguccucagcuaagacacucaagaaucggccgugccugaguccuaaacaccccaccccaggaagcuccgacccccuuauucagccuucuagcccagccgugugucccgaaccuccgucaaguccaaaguacguguccagcgucacgucucguaccggcucaaguggggcaaaagagaugaagcugaaaggagcggaugguaagacaaagaucgcuacuccccgcggcgccgcaccuccagggcagaaaggacaggccaacgcuaccagaauacccgccaagacaccuccggcacccaaaacuccaccuagcuccgcuaccaagcaaguucagaggcggcccccaccagccggcccccgaucugaacgcggugagccaccgaaaucgggggacagaagcggcuauuccucaccuggaagucccggcacaccagggucuaggagccggacccccuccuugccuacuccacccacgcgcgagccuaagaagguggcgguagugagaacaccgccaaaaucacccagcucugccaaguccaggcuccagaccgcuccuguccccaugccagaucugaaaaaugugaagaguaaaaucggaagcacugaaaacuuaaagcaccagccuggcggugggaagguucaaauuaucaauaaaaagcuggaccucucuaacgugcaguccaaaugcggaucaaaggauaauauuaaacauguccccggcgguggcagugugcagaucguauacaagccaguugaccuuagcaaagugaccucgaagugugggucccugggaaacauacaccauaagccuggcgggggacaggucgaggugaaaucugaaaaguuggauuuuaaagaccguguccaaagcaagauuggcucacuagauaauaucacacacgugccgggugggggaaacaaaaagauugagacccauaagcugacuuuccgggaaaaugcaaaagccaagacagaccacggcgcugagaucguuuauaaaagucccgugguauccggugauacgucuccacgacaccucagcaacgucuccucaaccggcagcaucgacaugguggauaguccucagcuggccacucuugcagacgagguuucugcgucccuggccaagcagggguuguga

SEQ ID NO: 58817 - RNA, 1014 nt, Artificial Sequence
  derived and/or modified sequence opt3 from MARC1__Homo_sapiens__NP_073583
augggcgccgcugggagcuccgcacuggccagauucgugcuccuugcgcagucuaggcccggauggcugggugucgcugccuugggcuuaaccgcaguugcccugggggcuguggcauggcggcgcgccuggccuacacgacguagaaggcuacuccaacagguaggaacuguggcucagcuguggaucuacccagucaagucaugcaaaggcgugccgguuagugaggccgaauguacggcgaugggucuucggagcgggaaccugcgcgacagauuuugguuggugauuaaucaggagggaaacauggucaccgcaaggcaagaaccccggcucgugcugauaucccugacaugcgauggcgacacucucaccuuaucugccgcuuauacaaaggaucugcuuuugccuaucaaaaccccaacuacaaaugccguacacaagugucgcguucauggccuggagauugaagggcgagacugcggagaggcaaccgcucaguggaucacgucguuccuaaaaucacagcccuacagacucgugcacuuugagccucauaugaggccacggcguccccaccagauugccgaucuguuccgcccuaaggaccaaaucgcguauagcgauaccaguccauuucuuauacuguccgaagccucuuuggcagaccucaacagcagacuggagaagaaagucaaggcuacuaauuucaggccgaacaucgugauuuccgguugugauguguacgccgaagacucaugggaugaguuacugaucggcgacgucgagcucaaacggguuauggcuugcagucgauguauucuuacaacuguggaucccgacaccgggguaaugagccgcaaggaaccucuggagacauugaaaucuuauagacagugcgacccauccgaaaggaagcuauacggaaagucaccccuguuuggccaguauuucgugcucgagaauccugguaccaucaaagucggggauccaguguaccugcuuggacaguga

SEQ ID NO: 58818 - RNA, 738 nt, Artificial Sequence
  derived and/or modified sequence opt3 from MARC2__Homo_sapiens__XP_011507986
auguucuggcuggugaucaaggaggacggccacauggucaccgccagacaggaacccaggcucguucuuauuagcauaaucuacgagaacaauugccugauuuuucgggcuccugauauggaccaauugguguuaccauccaaacagccgucuucaaacaagcugcauaauugucgcaucuucgggcuagauauuaaaggacgagacugcgguaacgaagcagccaagugguuuacaaauuuccucaaaacugaggcguaucgucugguacaguuugaaacgaacaugaagggcagaaccaguaggaaacuucugcccacauuggaucagaauuuccaaguggcuuacccugacuauuguccacuccugaucaugacugaugccagccuggucgaccucaacacccggauggagaagaagaugaaaauggagaauuuucgccccaacauagugguuacagggugcgaugcauucgaagaggacaccugggaugaauuacugaucggauccguggaggucaagaaagugauggccuguccuagaugcauucuuacuacaguagacccagauaccggcguuaucgacaggaagcagcccuuggacacgcugaagucuuaccggcuaugugauccuucggagcgcgaacucuauaaacugucaccacuuuuugguauuuacuauagcguggagaagaucgggagucugcgagucggagacccgguguacagaaugguguga

SEQ ID NO: 58819 - RNA, 870 nt, Artificial Sequence
  derived and/or modified sequence opt3 from MARCH1__Homo_sapiens__NP_001159845
augcugggcuggugcgaggccaucgcuagaaacccccacaggauuccuaauaacacccggacaccagaaauaagcggggaccucgcagaugccucccagacuucuacgcuuaaugagaagucaccgggacgcagugcgagccgauccucuaacaucucgaaggcuucaagccccaccacagguacugccccucguagucaauccagacugucuguguguccaagcacccaggacauuugcaggaucugucauugcgaaggcgaugaggaaucccccuugauuacaccuugucggugcaccgggacuuuacgcuucguccaccagucaugucugcaucaguggaucaagaguagcgacacaagaugcugugagcuaugcaaauacgauuuuauaauggagaccaagcucaaaccacugaggaagugggaaaaacuucaaaugacgacuucugagcggcgcaaaaucuucuguuccguuaccuuucacgugauugcaaucacaugcguaguguggucacuguaugucuugauugaccgaacugccgaagagaucaagcagggaaaugauaacggcgugcucgaguggcccuucuggaccaaacugguuguggucgcuauagguuuuacagggggacugguguucauguacguacagugcaagguuuaugugcagcucuggagaagguuaaaagcauacaaucgggucauuuuugugcaaaacuguccugacaccgccaagaagcuggagaaaaauuucagcugcaacgugaauacggauaucaaggacgcugucguugugccaguaccgcagacuggcgccaacagucuucccucugcggaaggcgggccuccagaaguggucuccguguga

SEQ ID NO: 58820 - RNA, 741 nt, Artificial Sequence
  derived and/or modified sequence opt3 from MARCH2__Homo_sapiens__NP_001005415
augaccacaggcgacugcugucaucugcccgggagccucugcgauuguuccggaucuccugccuucucaaagguggucgaggcuacuggucuuggcccaccgcaguacguugcacaagugacgaguagagacgggaggcuguugagcaccguaauccgggccuuagauacacccuccgacggaccuuuuugccgcauuugucacgaaggcgcgaacggugagugccugcuaucuccaugugggugcacuggaacccucggcgcugugcacaaaucgugucuggaaaaguggcuuucaagcaguaauacauccuauugcgagcugugucauaccgaguucgccgucgaaaaacgaccccguccuuugacugaguggcucaaggauccaggccccagaacagagaaaaggacccugugcugcgacaugguguguuuucuguucauaacgccucucgcagccaucucugggugguuaugccugcggggagcucaggaucaccuucgcuugcauagccagcuggaagcaguuggucuaauugcccucacuaucgcucuguuuaccauuuacgugcuuuggacacuggucuccuucagauaucacugucaguuguacucagaauggaggaagacuaaccaaaaggugcggcucaaaauccgcgaggccgacaguccagagggcccgcagcacagcccccuggcggcaggguuacugaagaaaguagccgaagagaccccuguuuga

SEQ ID NO: 58821 - RNA, 837 nt, Artificial Sequence
  derived and/or modified sequence opt3 from MARCH5__Homo_sapiens__NP_060294
augcccgaccaggcccugcaacagaugcucgauagaagcugcuggguguguuucgcuaccgacgaagaugacaggacagcagaauggguccggccuugccgcugucgaggcuccacuaaguggguucaccaggccugccuucagcguuggguggaugagaaacaaagagggaacucuacggcgaggguagcuuguccacagugcaaugccgaauaccugaucguguuuccgaaguugggacccgucguguauguuuuagaccuggcagaucggcuaauuucaaaagccuguccuuucgcugcagccgguauaauggugggcaguaucuacuggaccgcugucacauauggggccgugacuguaaugcagguugugggacauaaggagggccucgacgucauggaacgcgcggauccacuguuucuucugauugguuugcccaccaucccugugaugcucauucuggggaaaaugaucagaugggaggacuacgugcugaggcucuggcggaaguauagcaacaaguuacagauacuuaauuccaucuucccaggaauuggcugccccgucccucgcaucccagcagaggccaacccgcuggcugaucacguuucugccacacgaauuuuguguggcgcacugguguuucccaccaucgcuacuauaguagggaaacuaauguucucgucagugaauagcaaccuccaaagaacaauucugggagguaucgccuuugucgcgauuaagggcgccuucaaaguguacuuuaagcagcagcaguaucuuaggcaagcacaucggaaaauccugaauuacccugaacaggaggaggcuuga

SEQ ID NO: 58822 - RNA, 2733 nt, Artificial Sequence
  derived and/or modified sequence opt3 from MARCH6__Homo_sapiens__NP_005876
auggacaccgccgaggaagauaucugcagaguguguaggagcgagggcacacccgaaaagccucuguaccacccaugcgucuguacuggguccauuaaauucauacaucaggagugccucguucaauggcuuaagcacucucggaaagaauauugugagcugugcaagcaucgcuuugcuuucacgccgaucuacucacccgacaugccuagucgauugccaauucaggauaucuuugcaggauuagugaccagcauugguacagccauccguuauugguuccacuacacucugguagcguuugcuuggcuaggcguggucccccucaccgccuguagaauauauaaaugccuguucacaggguccgugucuucgcuucugaccuugccucucgacaugcugucaacugagaaccugcucgcagauuguuuacagggaugcuuuguugugacauguacccugugcgccuucaucagccuugucugguugagggaacagauugugcauggcggugcuccaaucuggcuggagcacgcagcucccccuuuuaaugccgccgggcaccaucaaaacgaagcgccagcaggaggcaauggcgccgagaacguagcugccgaccagccggcaaaucccccugcugagaacgccguugugggggaaaauccagaugcgcaggacgaucaggccgaggaagaggaagaggacaacgaggaagaggaugacgcaggagucgaagaugcugccgacgcuaauaacggugcccaagacgauaugaauuggaacgcacuagagugggaccgggccgcugaggaacucacgugggagcgcaugcugggccuugaugggagucugguguucuuggaacacguguuuugggucguuucccucaauacucuguucauuuuaguguuugcguucugccccuaccauaucggacacuucucucugguaggccucgguuuugaggaacacgugcaggcaagccauuucgaggggcuuauaaccacaauugucggauauauccuguuggccauuacucuaaucaucugucacggccuggcuacccucgugaaguuucauagauccaggcggcugcuuggcguuugcuacauuguggucaaggugucacuguugguaguuguggaaauaggggucuucccucucaucuguggaugguggcuggacauuugcaguuuagagauguuugaugccacacugaaagaccgcgagcucagcuuccagucugcaccagguaccacgauguuucuacacuggcuggugggcauggucuacguguucuauuuugccuccuucauccuuuugcugcgagaaguucucagacccggggugcugugguuucuuaggaaccugaaugauccggacuucaacccuguacaggagaugauacauuugcccauuuaccggcaccuccgucgcuuuauccugucagucaucguguucggaagcauuguuuuacugaugcuauggcucccaaucagaauuauaaagagugugcugccuaacuuccuucccuauaaugucauguuguacucugaugcuccaguguccgaacugagccucgagcuguuacugcuucaaguaguguugcccgcccuccuggagcagggccacacuaggcaguggcuaaaaggucugguucgggcauggacagucaccgcgggguaucuccuggaccuucauucguacuugcugggcgaucaagaagagaacgaaaauucugcuaaccaacaggugaauaacaaucagcacgcccgaaacaauaacgcaaucccuguggucggagagggcuuacaugccgcucaccaggccauucuccagcaagggggaccaguugguuuucagccguaucgcagaccccugaauuucccucuuaggaucuuucuguugaucguguucauguguauuacucuccugauagcaucccuaaucugccugacacucccaguguuugcuggccgguggcugaugucauucuggaccgggacggccaagauucacgaacuuuacaccgcggccuguggauuguacguaugcuggcugacaauccgcgcugucacugugaugguugcauggaugccccagggcagaagggugauuuuucagaaagucaaggaguggaguuuaaugaucaugaagacccucauaguggccguucugcuugcuggugugguaccucugcuacucgggcuguuguucgagcuggucaucguggccccauuacgugugccccucgaccagacaccgcuguuuuauccuuggcaggacugggcacuuggcguccugcaugcgaaaauuaucgccgcuauuacuuugaugggaccacaaugguggcucaagaccguuaucgaacagguguacgccaacggcauacggaauauugaucugcacuauaucguacgaaaacuagcagcucccgugauuagcguccugcuucucucccugugugugccuuacguuaucgccucuggggugguccccuugcugggagugacagcagagaugcagaacuuaguucauagaaggauauauccauuccuccugaugguggucguacuuauggccauccugagcuuucaggugcgccaauucaagcgguuguacgaacacauuaaaaaugacaaguaucucguuggucagagacuggugaacuacgagaggaaaucaggcaagcaggggaguuccccucccccaccgcaaagcucucaggaauga

SEQ ID NO: 58823 - RNA, 1908 nt, Artificial Sequence
  derived and/or modified sequence opt3 from MARCH7__Homo_sapiens__NP_001269735
auggagagcaagcccuccagaaucccuaggcggauuucugugcagccaucaaguagccuguccgcccgcaugaugucuggcucgcgagggucaagccucaacgacaccuaccacagucgugauuccucuuucagacuugacagcgaauaucaauccacaucagcuagugcaagcgccucuccguuucaguccgcgugguacucagagagcgaaauaacucagggagcuaggagucggucucagaaucaacagcgcgaucaugacuccaaaagacccaagcugagcugcacgaacuguaccacaucggccgguaggaaugucggcaacggguugaauacuuuaucugauguucaggaccgggugccuuccuauucacagggagcacgcccaaaagagaacaguaugagcacccugcaacuaaauacauccucuaccaaccaccagcuccccagcgaacaucagacuauccugucaagucgagauuccagaaauagccuuaggucuaacuucucaagucgggagagcgaguccucucguucgaauacacagccuggcuuuagcuacuccucaagucgcgacgaagccccaauuaucucuaacagcgagagaguaguguccucacaaaggcccuuccaggaaagcucugauaaugagggucggcgaaccacgcgcagacuguuguccaggauugcuaguagcaugucuuccaccuuuuucucacggcgcaguagccaggacucgcucaacacuagaucccugaauagcgagaacagcuaugucucaccuaggauccugacagcaagucaaucccguucuaacgugccaagcgccuccgaaguuccggauaaucgggcuucagaggccagccagggguuucgauuccucagaaggcgcuggggauuaaguucucugucccacaaccauagcucggaaucagacucugagaauuuuaaccaggaaagugagggccggaauacuggccccuggcuuuccagcucuuugagaaacaggugcaccccucuguucagccgccgacggcgugaggggagagaugaauccucaaggauaccaacaagugacaccagcucucgcucccacaucuuucggagagagucaaaugaagugguccaccuagaggcgcagaacgacccccucggagcagccgcuaauaggccucaagccagugcagcuagcuccucugccacgacugguggcucgacaagcgauucagcgcaagggggacgaaacaccggcauuuccgguauccugccagggagucuuuuccgcuuugccgugcccccggcacugggaucuaauuugacugacaacguaaugauuacaguugauaucauaccuagcggcuggaacuccgcugacggcaagucagauaaaaccaagucugcccccagccgggacccagaaagacuccagaagauuaaagagagucuguuacuggaggauuccgaagaggaagagggggaccucuguaggaucugccagauggcugccgcaucuucuucaaaucuucugauugaaccuuguaagugcacgggauccuugcaauacgugcaucaggauuguaugaaaaaguggcuacaggccaaaaucaauagugguagcucgcuggaggcugucaccacaugcgagcucuguaaggaaaagcuggagcuuaaccuggaagacuucgauauccacgaguugcaucgugcgcacgcaaacgagcaggccgaauaugaguucauuucuuccggccucuaccuggugguguuacugcaccuaugcgaacagagcuuuucagacaugauggggaauacuaacgagcccaguacccgcguccggcuccagagaaugauacccaaaaagacagaaacuaucaccggacaucugauucuuccaaauuucaucuga

SEQ ID NO: 58824 - RNA, 876 nt, Artificial Sequence
  derived and/or modified sequence opt3 from MARCH8__Homo_sapiens__NP_001002266
augagcaugccccugcaccagaucuccgccauuccuucucaagacgcuauaucagcaagaguguacaggaguaagaccaaagagaaggaacgggaggaacagaacgagaaaacacucggccauuucaugagccacuccucuaauaucucgaaggccgggucaccaccgagcgcgagugcucccgccccugucuccucuuuuagccgcacuuccauuacgccaucaagucaggauaucugccgaauuugucauugcgaaggagacgaugagagcccccuuaucaccccuugucacugcacagguucucugcauuucguucaccaggcauguuugcaacaguggauaaaauccucagacacucguugcugugaguuaugcaaguaugaauuuaucauggagaccaagcugaaaccacuaagaaagugggaaaaacuccagaugacaagcagugagaggcggaagauuauguguucugugaccuuccacguaaucgccauuacuugcguggucuggucccuguacgugcuuaucgaucgcacagcugaggaaauaaaacagggccaagcaaccgggauucuggaguggcccuuuuggacgaaguugguuguggucgccaucggauucacuggcggucuccuguuuauguaugugcaguguaagguauacguucagcuguggaaaagacucaaggcuuauaacagggugauuuacguccagaauugcccugaaaccagcaaaaagaacaucuucgagaaaucgccauuaacagaaccgaauuuugagaacaagcauggguauggaaucugccacucugacacuaauuccucauguugcaccgagcccgaagauacaggcgccgagauuauacauguguga

SEQ ID NO: 58825 - RNA, 999 nt, Artificial Sequence
  derived and/or modified sequence opt3 from MARCKS__Homo_sapiens__NP_002347
augggcgcccaguucagcaagaccgcugcaaaaggggaggccgcggcugaaagacccggagaggccgcaguggccuccucuccuucaaaggcuaacggucaagaaaauggccacgucaaaguuaacggggacgcaaguccagccgcugccgagagcggagcgaaggaagaacugcaggcaaauggcuccgccccggcugccgauaaagaggaacccgcagcugccgguucuggggcggccucgccuucagcagcugagaagggagaaccagccgcugccgcagcccccgaggcuggcgcgagcccuguggagaaggaagcaccagccgagggcgaagcugccgagcccgggaguccuacagcagccgaaggagaggcugccuccgcagcgucuagcacuuccucaccaaaagcugaggacggugccacgccgagucccagcaacgaaaccccuaagaaaaagaaaaagagguuuucuuucaagaaauccuuuaagcucucaggcuucagcuuuaaaaagaauaaaaaggaggcaggggaaggaggcgaggccgaagcuccagccgcagagggugggaaagaugaggcugccggaggcgcggccgcugcagccgcugaagccggcgcagcgaguggggagcaggccgcugcccccggagaagaggcagcugccggugaagagggcgcagccgggggagacccucaggaggcuaagccacaagaagcggccguagcacccgagaagccgccugcuucugaugaaacaaaagccgccgaggagcccuccaagguggaagagaaaaaggcugaagaggcaggcgccagcgcggcugccugcgaagcaccaucggccgcugguccuggggcacccccagagcaggaggccgcgcccgcugaggagccugccgcagccgcugccucuuccgcaugugcugccccaucacaggaagcgcagccggagugcagucccgaagccccuccagcagaggcugccgaguga

SEQ ID NO: 58826 - RNA, 1563 nt, Artificial Sequence
  derived and/or modified sequence opt3 from MARCO__Homo_sapiens__NP_006761
augagaaacaagaaaauccugaaggaggacgaacuccuuagcgagacccagcaagccgcuuuccaccagauugcaauggaacccuuugagauaaaugugccuaaaccaaagaggcggaacggcgucaauuucucccuggccguugugguaaucuacuugauuuuacugacagcgggggcuggacuacucgugguccaggugcugaaccuucaggcccgccugcgaguuuuggaaauguauuuucucaaugauacucuggcagccgaggacucuccgucauucagucugcuccaaagcgcucaucccggugagcacuuagcacagggcgccucccgucugcagguucuucaggcucaauugacgugggucagagugucucaugaacaucugcuacagaggguagauaacuuuacccagaauccugggauguuccggaucaaaggagagcagggcgccccaggucuccaagggcacaagggagcgaugggcaugcccggcgcaccugggccacccggaccuccagccgaaaagggugcuaaaggcgccauggggcgcgacggagcaacaggcccgucggguccccaggggccuccaggaguuaagggcgaggcuggccugcaggggccccaaggagccccugguaaacagggcgcgacugggaccccaggaccccagggcgagaaggguucaaaaggggauggcggacuuauuggcccgaagggggaaacaggaaccaagggugagaaaggcgaccugggguugccuggaagcaagggcgauagagguaugaaaggggacgccggcgugaugggacccccaggcgcacaggggaguaagggagauuuugguaggccugggcccccaggccucgcuggauuccccggcgccaaaggugaccaagggcagccuggccugcagggagucccaggcccgcccggggcugugggacacccuggcgccaagggugaaccaggguccgcaggaucucccggccgggccgguuuaccuggcagcccagggucccccggagcuacuggccugaaagggucaaagggagauacaggccuccagggucaacaggggcgcaagggagagaguggcgugccggguccugcgggcgucaaaggggaacagggaagcccaggccuugcagggcccaagggagccccuggccaggcuggucaaaaaggggaccagggaguuaaggguucuuccggcgagcagggcgugaaaggggagaagggagaacgaggcgagaacucaguaagcgugagaaucgucgggaguucuaauaggggacgggccgaaguguacuauuccggcaccugggguacgauaugcgaugacgaguggcagaacagcgacgcaaucguguuuugucguaugcugggguacucgaagggacgcgccuuguauaaagugggcgcuggcacugggcaaauuuggcuagauaauguccagugcagaggaaccgaaucuacacugugguccuguacuaagaacucauggggucaccaugacugcagucacgaggaggaugccggcguggaauguagcguauga

SEQ ID NO: 58827 - RNA, 2343 nt, Artificial Sequence
  derived and/or modified sequence opt3 from MARK1__Homo_sapiens__NP_001273055
augagcgccagaacaccccugccuaccgugaacgagagggacacugaaaaucacacguccgucgauggcuacaccgagccacauauccagccgacaaagucuucaagucggcaaaacauuccccgcugccgaaauagcauaacuuccgcuaccgacgaacagccucacaucgggaacuaucgucuccagaaaacaauuggaaaggguaauuucgcaaaaguuaaacuugccagacaugugcugaccggcagggagguagcggugaaaaucauugauaagacucaguugaacccaacaucuuuacaaaagcuguuucgggaaguccgcaucaugaaaauacuaaaucaccccaacaucgugaaacucuucgagguuauugagaccgaaaagacgcuguaccuugugauggaguaugcuucgggcggagaagucuuugacuaccugguggcccauggcagaaugaaggagaaggaggcaagggccaaguuccggcagaucguaucagcuguucaguauugucaccagaaguacauugugcaccgcgauuugaaagcagaaaaucuccugcuggacggugauaugaacaucaagauagccgacuuuggguucagcaaugaguuuacugucggaaacaaacucgauaccuucugcggcaguccuccauaugcugcccccgaauuauuucaaggcaagaaauacgacgggccugagguggauguguggucccugggagucauucuuuacacauugguuucugguagccugccauucgacggccagaaucuaaaggaacuccgagagagagugcugagggggaaauaucggaucccguuuuacauguccacugauugugagaaccuucugaagaaguugcucguacugaaucccauuaaacguggaucauuagaacagaucaugaaggaccgcuggaugaacgugggccaugaggaagaggaacugaaaccuuauaccgagccagaccccgauuucaacgacacaaagagaaucgauauuauggucaccauggguuuugcgagggacgagauaaaugaugcacucaucaaccagaaauacgacgaagugauggccacguauauucuucuggggcggaagccuccagaguucgaaggaggcgagaguuugagcucuggcaaucuaugccaacgaucccgccccucaagcgaucugaacaauaguacucuccagucuccggcucaccugaagguucagagauccaucagcgccaaccaaaaacagaggcgguucucggaccaugcagggccuucuauacccccagcuguguccuacacaaagcgcccucaggccaauucagucgaaagugagcagaaagaggaaugggauaaggacguggcgagaaaacuuggaagcaccacuguagguuccaagucugagaugacagccagcccccugguuggcccagaaaggaagaaaucaaguaccauucccuccaacaauguguauagcgggggaucuauggcacgucggaacacguacgucugugagcgaaccacagauagauacguggcuuugcaaaauggcaaggacucaagucucacugagaugagcgucuccucuaucucgagcgccgguuccucaguggcuagugccguuccuucugcaaggccacgccaccagaaaagcauguccaccucagggcacccgaucaaggugacacugcccacuauuaaagacggcagcgaagccuaucggccuggaaccacacagagaguaccagcugcgucucccuccgcacauaguaucagcaccgccacuccugauaggacgcgcuuuccacgagggucuuccucacggaguacauuccacggggagcaguuacgugaaagaaggagcgucgcuuacaacggacccccggccucgccuucccaugagaccggugcauuugcccacgcucgccggggcacuucuaccgggauuauaagcaagaucacaucaaaguucgugagaaggaguaccuccggagaaccaaaagagcgagacaaggaggaaggcaaagauucuaagccccgcagccugcgguuuacuugguccaugaaaacaacgucaagcauggacccuaaugauaugaugagagagauuaggaagguucuagacgccaacaauugcgauuaugaacaaaaagagcguuuccuccuguuuugugugcauggugacgcacgccaggauagucuuguccagugggaaauggaggugugcaaguugccccggcugucucucaacgggguaagauucaagaggaucuccggcaccagcaucgcguuuaaaaacauugcuucgaagauagccaaugagcugaaacuuuga

SEQ ID NO: 58828 - RNA, 2367 nt, Artificial Sequence
  derived and/or modified sequence opt3 from MARK2__Homo_sapiens__NP_001034558
augagcuccgccagaacaccccugccuacccucaacgagagggacacugaacagccaacgcuuggccaccuggauucuaagccgucaaguaaaagcaauaugauccgggggcgcaacuccgcuaccucugcagacgagcaaccccauauuggaaauuaccgauuguuaaagacaauagguaaaggcaacuucgccaaggugaaacuggcgcgucacauccuaacugggaaggaagucgcuguuaagauuaucgauaaaacccagcucaauucgucaagccugcagaaacuuuuuagagaggugaggauuaugaaaguacugaaccauccuaauaucgugaaguuguucgaagucauagagacagagaaaacccucuaucuggugauggaauacgccaguggaggcgagguuuuugacuaucugguggcacacggucggaugaaggaaaaggaggcccgcgcuaaauucagacagaucgucuccgcagugcaauacugccaucagaaguuuauuguacacagggaucucaaagccgagaacuuacugcuugacgcugauaugaauaucaagauugccgacuucggguuuucuaacgaguucacuuuuggaaauaaauuggauacauucuguggcagcccacccuaugcggcaccugaacuguuucagggcaagaaauacgacgggccagaaguugauguguggucccuaggagucauccucuauacccuggugucagguagucuucccuucgacggccagaaccugaaggaguugcgggaacgcgugcuccgagggaaguacagaauaccuuuuuacaugagcacggauugcgagaaucuguuaaagaaguuccugauucucaacccaucuaaaaggggaacucuugagcaaaucaugaaggaccgguggaugaaugucggccacgaagacgaugagcugaaaccguauguugaacccuugccugacuacaaggauccacgucgcaccgagcuaaugguguccauggguuauacaagagaagagauucaggacucacugguagggcagagguacaacgaggugauggccacuuaucuccugcuuggauacaagagcagugaacuggagggcgauaccaucacauugaaaccccggccuucugcugaccucaccaacuccagcgccccaucgcccucucauaagguccagcgauccgugucagcaaauccgaaacaacgcagauucagugaucaggcugccggcccugcgauccccacgagcaacuccuauucuaagaaaacucagagcaauaacgccgaaaauaagaggccagaggaagaccgggagucagggcgcaaggcaaguuccacagcuaaaguuccugccagcccccugccaggauuagagagaaagaaaaccacucccacaccuucuaccaacucagugcugaguacgagcaccaauaggucccguaacucuccacuacucgaacgggcuucgcugggucaagccagcauucagaauggcaaggauucccuuacaaugccggggucacgagcaaguacugccucugcuagcgcggcagucuccgccgcuagacccaggcagcaccagaaaucaaugagcgccucugugcauccuaacaaggcauccggauugccacccaccgagaguaauugugaaguaccucgcccaagcacagcuccccaacggguuccgguggccucuccuuccgcccacaacauaucaaguagcggcggugcaccagacagaacuaauuuuccccgcggggucucguccaggucuaccuuccacgcgggccagcugcgacaggugcgggaucagcaaaaccucccuuacggagucacacccgcuagcccaucaggccauagucaggggcguagaggagccuccgguucuaucuuuagcaaguucaccuccaaauuugugaggcgcaaucugucauuccgguuugcaagaaggaaccuuaacgagccugagagcaaggaccgaguugaaacucugcgcccccacgugguaggcagugggggaaaugacaaagagaaggaagaguuccgggaagccaaaccaagaucuuugagguuuacgugguccaugaagacaaccagcucgauggagccgaacgagaugaugcgugaaauucgcaaaguccucgaugcuaauucaugccagucugagcugcaugaaaaguacauguuacuguguaugcacggcacuccuggucaugaggacuucgugcagugggaaauggagguuugcaagcuaccccggcucagucugaacggggugagauuuaaaaggaucuccggcaccagcauggccuucaagaauauagcaucuaaaauugcuaacgagcuuaaguuguga

SEQ ID NO: 58829 - RNA, 2262 nt, Artificial Sequence
  derived and/or modified sequence opt3 from MARK3__Homo_sapiens__NP_001122390
augagcaccagaacaccccugccuacugugaacgagagggacacggaaaaucacaccucccauggcgaugggcggcaggaggucacaucucgcacuucacgaaguggagcccguugcagaaacagcaucgcuuccugugcagacgaacaaccacacauugguaauuacaggcuccuuaagaccauaggcaaagggaacuucgccaagguuaaacuggcgcggcauaucuugacaggacgcgagguggcuauuaagaucauugauaaaacccaguuaaauccgacuucucugcagaagcuauuuagagaaguaaggaucaugaagauacucaaccaccccaauaucgugaaacuguucgaggucauugagacagaaaagacccuuuaucugaucauggaguacgccucgggcggugaaguguuugacuauuugguugcacaugggcggaugaaagagaaggaggcccgcucaaaauuccgacagauugugagcgcuguccaauacugccaccagaagagaaucgugcacagggaucucaaggcagaaaaccugcugcucgacgccgauaugaauauaaaaauugcugacuuuggauucaguaacgaguuuacgguaggcggcaaguuagauacuuucuguggguccccuccauaugccgcgcccgaacuguuucaggggaaaaaguacgacgguccugagguugauguguggucucuuggcgucaucuuguauacccuggugagcgggucccuaccauucgacggacagaaucucaaagaacugcgggagcgugugcuucgcggcaaguacaggauucccuuuuacaugucaacagauugcgagaaccuguugaaaagauuccucguccugaauccuaucaagcgggguacuuuagaacaaaucaugaaggaccgauggauuaacgcagggcaugaggaagacgagcugaaaccauuuguugaaccggagcucgauauaagugaccagaagcgcaucgauauuauggugggaaugggcuauagccaggaggaaauccaggagucucuuuccaaaaugaaguacgacgaaauaaccgccacauaucuguugcuaggcagaaaaucaagcgagcuggaugcuagugacucuuccagcucgucuaaucucucccuggccaagguaaggcccucaagugaucuuaacaacagcaccgggcaauccccucaccauaaggugcagcggucugucagcucaagucagaaacaacgcagauacuccgaccacgcaggaccagcuauucccagcgugguugccuauccuaagaggucucagacgucaacugcggauagugaccugaaagaagaugguaucagcucccguaagucuucgggcagcgccgugggaggaaaaggcaucgcaccagcuucccccauguuggguaaugccucaaacccgaauaaggcugacauuccugagcggaagaaaaguucuacaguccccagcuccaacaccgccucagggggcaugacucgaagaaauacauacguguguagcgagaggaccacggcagaccgccacucuguaauccagaacggaaaggaaaauuccaccauuccagaucagcggacaccuguugccaguacucauagcauaucuuccgcugcgacccccgacagaaucagguucccacgcggcacagcaucacgaaguacuuuccacgggcaaccccgggagcguagaaccgccacauauaacggaccuccagcuagcccgucgcucucccaugaagccacuccccugucucagaccaggagccgcgguucaacgaauuuauuuaguaaacugacauccaagcuaacccggagaaacaugucuuucagguuuauuaaacgacucccuacugaguacgagcgcaauggccgguacgaagggagcuccagaaacgugucagcagagcagaaggaugaaaauaaggaggccaaaccaaggagccugcguuucaccuggaguaugaagacaaccucuuccauggaccccggagauaugaugcgcgaaauccggaaaguccuugacgcuaacaauugcgauuaugagcagagagagagguuuuugcuguucugugugcacggcgacggucaugccgaaaaccucguccaaugggagauggaagugugcaagcugccucgacuuagccugaacgggguucgguuuaaacgcaucucgggcacuucaauugcauucaagaauauagcgucuaaaaucgcuaacgaguugaagcucuga

SEQ ID NO: 58830 - RNA, 2259 nt, Artificial Sequence
  derived and/or modified sequence opt3 from MARK4__Homo_sapiens__NP_001186796
augagcuccagaaccgugcuggcccccggcaacgacaggaacucugauacacacgggacucucggaucaggucggaguagcgacaagggcccuuccuggucuucgcgcucacuuggggcucgaugccguaauagcaucgcaaguuguccagaggaacagccgcaugucggaaauuacagacuguugaggacgauuggcaaagguaacuucgccaagguuaaauuagcgcggcacauacugaccgggcgcgagguggcuaucaagauuaucgauaaaacacaacuaaaucccuccucucuccagaagcuguuuagagaaguaaggauuaugaagggacuuaaccauccuaauaucgugaaacuguucgaggucauagaaacugagaagaccuuguaucucgugauggaguacgccagcgcaggcgaaguuuuugacuaucuggugucccacggccggaugaaagagaaggaagcccgcgcuaaauuccgacagaucgucucagcagugcauuacugccaccagaagaacauuguacacagagaucugaaggccgagaaucucuuacuggacgcugaggccaacaucaaaauugcggauuuuggguucaguaaugaauuuacacuuggaagcaaguuggacaccuucugugguucuccacccuaugcagccccugagcuguuucaaggcaaaaaguacgaugggccagaaguugacaucuggucccuaggagugauacucuauacucuggucucaggcagccuucccuucgauggucauaaccugaaagaguugagggaacgggugcuccgugggaaguaccgcgugccuuuuuacaugaguacagacugcgagucuauucugagaagguucuuaguccugaauccagcuaaacgguguacccucgagcagaucaugaaggauaaguggauuaacaucggauaugaaggcgaggaacuuaaaccguacacggagcccgaagaggacuuuggcgacacuaagcgaaucgagguuaugguggggaugggauauacccgcgaagagauuaaagaaucccugacaagccagaaguacaaugagguaacugccaccuauuugcuacuggguagaaaaacagaagagggcggggauaggggagcaccuggccucgcucuggcccgggugcgcgcgccaucggacaccacgaacgguacuucuuccucaaaggggacaagucacagcaagggccagagauccucuagcucaaccuaccauaggcaacgucggcacagugauuucugcggacccuccccugccccacuucaccccaaacgaagcccgacuucuacaggcgaggcagaacugaaggaggaaagauugccugggaggaaggcuucauguaguaccgccggaagcgguucccgcggccugcccccaucuucgccuauggucagcuccgcucauaaccccaauaaagccgagauaccagagcggagaaaagacucaacgaguacccccaacaaucucccuccaucuaugaugacaaggcgcaacacuuaugugugcaccgaacgaccgggggcagagcggcccagcuuacugccuaauggaaaggaaaacuccucaggcacaccacguguucccccugccagcccaucuucccacagucuagcucccccgagcggugagagaucuaggcucgcgcgcggguccacuauccggucaaccuuccauggcggacaggugagagauaggcgagcaggcgggggagguggcgggggaguccagaauggcccuccagccagucccacacuggcucacgaagccgcaccucuucccgccggucgcccacggccuaccacuaacuuguuuacgaagcugacaagcaaacucaccagaaggguggcugacgagcccgagcguauugggggcccagaaguaacuucgugucaucugccgugggaucagaccgagacagccccucgccuucugcgguuccccugguccguuaaguugaccucuagcagaccacccgaagcacucauggcggcucugaggcaagccacugcagccgcucgaugccggugucgccagccucagccauuuuuacuggccugccuacacggaggcgcagggggacccgagccucucucacacuucgaaguggaggucugccaacugccgagaccaggccuuagggguguguuguuucggcgagucgcugggacagcccuggcguucagaacgcucgugacccgcaucaguaaugaccuggaguuauga

SEQ ID NO: 58831 - RNA, 1782 nt, Artificial Sequence
  derived and/or modified sequence opt3 from MARS2__Homo_sapiens__NP_612404
augcugagaaccagcgugcucaggcuucugggccggacaggggccucccgcuugucuuuacuggaggacuucggaccccgauacuauucaagugguagccuauccgcuggcgaugacgcaugcgauguccgugccuacuuuacuacgccuaucuucuauguuaacgcggcuccacacauugggcaucucuacucugcccugcuugcagacgcccuguguagacacaggcgguugcgcggaccgucgaccgcugcaacaagauuuucaacuggcaccgaugaacauggucucaagauacagcaagccgcugccacagcggggcuggcacccaccgagcugugcgacagggugagcgaacaguuccagcagcucuuucaagaggccggaaucaguuguacugauuucauucggacaaccgaagcucgccaccgaguagccgugcagcauuuuuggggcgucuuaaaauccagaggccugcuuuauaaggggguguacgagggaugguauugcgcaucugacgaguguuucuugccugaagcuaaaguuacgcagcagccaggucccagcggcgauuccuuuccugugucacuggagagugggcacccagucagcuggacuaaggaagagaauuacaucuucaggcuaucucaauuucggaaaccccuccagcguuggcugcgcggaaacccucaggccauuaccccagagccguuccaccaugugguacuucaguggcuggacgaagaguugcccgaucucuccguuucaagaaggagcagucaucugcacuggggcaucccugugccaggugacgauucucaaacaauauacgucugguuagacgcgcuggugaauuaucucacugugaucggguaccccaacgccgaauuuaaguccugguggccugcaaccagccacauuaucggaaaggacauucuuaaauuccacgcuaucuauuggccagccuuccuguugggcgcuggcaugucgcccccgcagcggauaugcguccauucucacuggacaguuugugggcagaagauguccaaaucacuaggaaaugugguagauccucgaaccugccugaaccgcuacacgguggacgguuuuagauauuuccuccugaggcaaggcguccccaauugggauugugacuacuaugaugagaaggugguuaaacuucugaacagugaauuggccgacgcacucgggggacuguuaaaucggugcacugccaagcgcauuaacccaagcgagacauacccugcuuuuuguaccacuugcuuccccuccgagccaggccuggugggucccucugucagagcgcaggcagaagauuacgcccuagugagcgcuguagccacacucccuaagcagguugcagaccauuaugauaauuuuaggaucuacaaagcccuggaggcugugucaaguugcguccgucagaccaacggguucgugcaacggcacgccccauggaaguugaauugggaauccccggucgacgcacccugguugggcacggugcugcauguugcgcucgagugucugcgaguguuuggaacccuucugcagccuguaacaccaagccuugcugauaaacuccugucuagauuaggcgucucagccagugaaaggagccugggggagcuauauuuccucccccgcuuuuacggacacccuugcccauucgagggucggagacugggccccgaaacugggcuuuuguuuccgaggcuggaccagucccgcaccuggcucgugaaggcacaccgaacauga

SEQ ID NO: 58832 - RNA, 2703 nt, Artificial Sequence
  derived and/or modified sequence opt3 from MARS__Homo_sapiens__NP_004981
augagacuguucgugagcgacggcguccccgggugccucccuguucuugccgcugcaggaagggcccggggucgcgcggaggugcugaucuccaccguaggcccagaagauuguguggucccguuuuugacacgacccaaggugccuguuuuacagcuggacucugggaacuaccuauucucaacuagcgcuauuugccguuacuuuuuccuccugagcggaugggagcaagaugaccuuacgaaucaguggcuggaaugggaggccaccgaauugcagccagcacucuccgccgcucuguauuaucuggugguccagggcaaaaagggugaggaugugcucgggucuguaagaagggcauuaacacacauagaccauucgcugucacggcaaaacugucccuuucuugccggagagacugaaaguuuggcugauaucguucuguggggcgcccuauacccucuccugcaggacccagcguaucuucccgaggaacugagugcauugcacuccugguuccagacccucucuacacaggagccuugccaacgcgccgcugagaccgugcugaaacagcagggcgucuuagcccugagaccauaccuccagaagcaaccgcagcccagcccugcagaagggagggcugugacuaaugagccagaagaggaggaacuugccacacuguccgaggaagagauugcgauggccgugaccgcaugggaaaaaggauuggagucacuacccccucugcggccacagcaaaaccccguccucccgguugcuggugaacgcaaugugcugaucacgagugcccuuccuuauguaaacaaugugccccaucugggcaacauuaucgggugugucuugagcgcugauguguuugcccgauacucuagacucaggcaguggaauacucuguacuuaugcggaaccgacgaguauggcacagcaacugagaccaaggcccuggaagagggucuaacaccacaggaaauaugugauaaguaccacaucauucaugcugacaucuaucggugguucaacauuuccuuugauaucuucgggcguaccacgacuccucagcaaacaaaaauaacccaggacauuuuucagcagcuccugaagcgcggauucguucuucaagacacuguggagcaguugagaugcgaacacugugcgagguuucuggcagaucgguucgucgagggcgugugccccuucuguggcuacgaggaagcccgaggggaccagugcgauaaaugcggaaagcucaucaaugcuguagagcugaaaaagccacaguguaagguuugccgcucaugucccgugguccaaagcagucagcaccuuuuucuggacuugccuaaacucgaaaagagacuggaggagugguuagguaggacacugccaggcucugauuggaccccgaacgcccaguucauuacgcgguccuggcuacgcgacgggcucaaacccagaugcaucaccagggaucugaaguggggaacaccugugccacuugaaggcuuugaggacaaagucuucuaugugugguuugaugcaacuaucgguuacuugagcauuaccgccaauuauacagaccagugggaacguugguggaagaaccccgagcaaguugaucuguaccaguucauggcuaaagacaaugugccuuuucauucgcucguauucccauguucugcccugggggcagaagacaacuacacuuuagucucccaccugauagcgaccgaguaucuuaacuacgaggauggcaaguuuucaaagagucggggagugggcguuuucggggacauggcucaggauacaggaauccccgccgacauuuggcgauuuuauuugcucuacaucagaccggaaggucaagauagcgcauucuccuggaccgaccugcuacugaaaaauaacucugagcuccugaauaaccuuggcaauuuuauaaacagggccgggauguucgugagcaaguucuuuggaggcuaugucccugaaaugguguugacuccagaugaccagcgccuguuagcucauguaacgcucgagcugcagcacuaccaccagcuucuggaaaaagugcggauuagagaugccuugaggucaauccucacaaucagucgccaugguaaucaauauauucagguuaacgagcccuggaagcgaaucaaaggguccgaggcagaccggcagcgugcuggcaccgucacuggacuggccgugaauauugcggcccuacugagcgugaugcuccagccuuacaugcccaccgucucugcuacaauacaagcacagcugcagcuuccaccucccgccugcucaaucuugcugaccaacuucuuauguacucucccagcuggccaccagauugggacaguuaguccgcuguuucaaaaacuugaaaaugaucagaucgagagccugagacagagguucggagguggccaagccaagacguccccuaagcccgcagugguggaaaccguaacuacagcgaagccacagcagauccaggcccuaauggacgaggucaccaaacaagggaacauugugcgcgaacucaaggcucagaaagccgauaagaaugagguugcagcugagguggccaagcuguuggaccugaaaaagcaguuagcagucgccgaaggaaaacccccugaggcuccaaagggcaaaaagaagaaauga

SEQ ID NO: 58833 - RNA, 522 nt, Artificial Sequence
  derived and/or modified sequence opt3 from MARVELD1__Homo_sapiens__NP_113672
augcugcccccuccaccgagacagcccccuccacaagccagggcugcacggggcgccgugcgccuccagcgacccuuccuucguagcccucugggggucuugagauuacugcagcuacucgcgggagcugccuuuuggaucaccauugcaacauccaaguaccaggguccaguucacuucgcccuguuugugucuguacuuuucuggcuguugacucucggccuguauuuucugacgcucuuagggaaacaugagcuggugcccguccuuggaucaaggugguugauggugaacguugcucacgacgugcuggcagccgcucuauacggcgccgcgaccgguauaaugagugaucaaaugcagcggcauagcuauugcaaucucaaggacuacccucugccaugugcauaucacgccuuccuugcugccgcagucugcgggggagugugucauggccuguacuugcucuccgcucuguauggcugcgggcgcagaugucagggaaaacaggaaguagccuga

SEQ ID NO: 58834 - RNA, 1641 nt, Artificial Sequence
  derived and/or modified sequence opt3 from MARVELD2__Homo_sapiens__NP_001231663
augagcaacgacggcagauccaggaaucgggaucgccgauacgacgaggugcccucugaucugccuuaucaggacaccacaauccguacucacccaacgcuccaugauucagaaagagccgucagugcugacccgcuucccccuccaccccugccuuugcaaccacccuucgggccugauuuuuacagcuccgacaccgaggaaccagcaauugccccggauuuaaagcccguuaggcgguucgugccugacucuuggaaaaacuuuuuccgcggaaagaaaaaggauccagagugggacaaacccguaucggauauaagauauaucucagacgguguggaaugcagcccuccagcgagucccgcuaggccgaaucaccgguccccucugaacucuuguaaggaccccuacggcgggagcgagggaacauuuuccucacgcaaggaggccgaugcagucuucccacgagacccuuauggcagucuagauagacauacucagaccgugaggacauacagcgaaaaaguugaggaauauaaucuccgguacucuuacaugaaguccugggccggucugcuucguauucuggggguggucgaguugcuccugggagcuggcguguuugcaugcguaaccgccuauauccacaaagacucagagugguacaaccuguucggcuauagccagcccuacgggaugggagguguuggcgggcucggaaguauguauggcgguuacuauuacacugggccaaagacacccuuuguguuagucguggcuggacuggccuggauuaccacgaucauaauccuuguguugggcaugucuauguacuaucgcacuauucugcuagauuccaauugguggccucucaccgaguucggcaucaacgucgcgcuguuuauucuuuacauggcagccgcuaucguuuaugugaaugacacaaacagagggggacuguguuacuauccauuguucaauacuccgguaaacgccguguuuugcagggucgaagguggccagauagcagcuaugauuuuccucuucgugaccaugaucguuuaccugauuagcgccuuagugugucugaaacucuggcggcaugaagcggcccgacgccacagagaguauauggaacaacaggagugcgagauggcaacaucgggggauaggcagcgggacucugaagucaauuuuaaggagcuucgcaccgcuaagaugaaacccgaacuguuguccggacacaucccuccaggccauauccccaagccuauugugaugccagauuacguagccaaauaccccguuauacagacggacgaugagagagaaagguauaaggcuguguuccaagaccaguuuucagaguacaaagagcuaagugccgaaguccaggcagugcugcguaaguucgacgagcucgaugccgucaugagccggcugccgcaccauuccgaaucucgacaggagcacgaaagaaucagcaggauucacgaggaguuuaaaaagaagaaaaacgacccuacuuuccuugaaaagaaagagcgcugugauuaucugaagaauaaauugucacauaucaagcaacggauacaggaauacgacaaggugaugaacugggauguucaggguuauaguuga

SEQ ID NO: 58835 - RNA, 1233 nt, Artificial Sequence
  derived and/or modified sequence opt3 from MARVELD3__Homo_sapiens__NP_001017967
auggaggaccccagcggcgccagagaaccuagggcucggccacgcgagcgagauccggggcguagaccccacccugaccagggaaggacccaugaucggccacgcgacagacccggugauccuaggcggaagcgcuccucugacggcaaccgaagaagggauggggaccgggauccagaacgugaccaagagcgcgauggaaauagagacaggaaccgggaucgagaacgcgagagagagagggaacgggaccccgaccgcggcccuagaagggauacacaccgugacgcagguccacgggccggggagcauggagugugggaaaaaccgcgacagucaagaacuagggauggcgcgcgcggccugacgugggacgcugccgcacccccugggccagcccccugggaggcuccugagccaccccagccgcagcggaagggagauccugguagaaggcgccccgaaagugagccaccuagcgaacgauaccuccccuccaccccacggcccggccgugaggaagucgaguauuaccaaucugaggcagaagggcuucuggagugccacaaauguaaguauuugugcacaggaagaggcguugugcagaucguagaaguggucuuaaaugguauggugcugauuuguauaguugccucguacuucgugcuagcuggguuuucagccagcuucaguuccggaggcggcuuugggaacaauuauuacucuccuuucgagggaacugaacucgagcaggucaggcagcuggaccaacaguauaccauccuucgcagcccacugauuuacgguggcguggcgguauccuuggggcucggaguucugacaaugggcgugcugcuccagggugcaaaaucacggaccauguuaagugggaaguggcugcuuacugaggccgcuuuuagcuugcuggccgcagucggcuacugcacaggaaucggcguguaucuacauguggcucuccagauuaacucuaccgauacguguaagacuagagaaaggcuguacgcccgaaaagggcuuaccuggauggacugccaacuggcgggaacagauggugccgcagcuacuuucgccuguuugcucgucaucauguauggcgcuuccguugugcuggccuuacgcucauaccgggagcagaagagauauaaagggagcagggaacagccgggaaguuacucugacgcacccgaguaucugugguccggcacccucuga

SEQ ID NO: 58836 - RNA, 978 nt, Artificial Sequence
  derived and/or modified sequence opt3 from MAS1__Homo_sapiens__NP_002368
auggacggcagcaacgugaccuccuucgucguugaggaacccacaaauaucucuacugggagaaacgccucagugggaaaugcucacaggcagauuccuauaguacauugggugaucaugaguauuagcccagucgguuuuguggagaacggcauccugcucugguuccuuugcuuucggaugcgccgaaauccguucacgguuuacauuacccaccuguccaucgcagauauaucuuuguuauuuuguaucuucauucugucgaucgacuaugcccuagauuacgaacucucaagcgggcauuauuacacaauugugacucugagugucaccuuucuuuucggauauaacacaggccuguacuugcucaccgcgaucuccguggagcguugccugucuguacuguaucccauaugguacagaugucacaggccuaaguaccaaagcgcucucguuugcgccuuacugugggcacuuuccuguuuggugacuacaauggaauaugucaugugcauugaccgggaggaggaaucacauagucgcaaugauuguagagccgugaucauuuuuaucgcuauccugagcuuccuaguguuuaccccacucaugcuggucucuuccacgauucuuguugugaaaauaaggaagaacacuugggcaucacacagcaguaaacuguacaucguaauuauggugaccaucauaauuuucuugaucuuugccaugcccaugcggcuccuguauuuacuguacuaugaguacuggucuacauucgguaaucuccaccauaucucccuucuguucagcacuauuaacucgucugcuaauccuuuuaucuauuucuuugucggguccucaaagaaaaagcgcuucaaggaaaguuugaaagugguucuaacccgagccuuuaaggacgagaugcagccaagaaggcagaaagauaacugcaauacagugaccgucgagacggugguauga

SEQ ID NO: 58837 - RNA, 1137 nt, Artificial Sequence
  derived and/or modified sequence opt3 from MAS1L__Homo_sapiens__NP_443199
augguguggggcaagaucugcugguucagccagagagccggguggaccgucuuugcugagucccaaauuucucugucauguagucucugccuucacagcggagaccaggaagcacagaaccccaaucugguuucccaguugugugguguguucuuacaaaacgagacaaaugaaacuauacauaugcagaugucuauggccguaggccagcaggcgcugccucuaaacaucauugcuccaaaagccgugcucgucucgcugugcggggugcuucugaauggaacgguguuuugguugcucuguugcggcgcaaccaacccguacaugguuuauauccugcaccuggucgccgcugaugugauuuaccucuguugcucagcaguagguuucuuacaaguuacacugcuuacuuaucaugggguggucuuuuucauccccgacuuuuuggccauacugagcccuuucaguuuugaggugugucuaugccuccugguggcuaucuccaccgaaaggugugucugcguucuuuucccaauuugguaccggugccaccgccccaaguauacaucuaaugugguauguacccugaucuggggauugccuuuuugcauuaacaucgugaaaagccucuuccugacuuacuggaagcaugucaaagccugugugauauuuuuaaagcuguccggccucuuccacgcgauucuuucacugguuaugugcgugaguagcuugacacuacugauccgauuccucuguugcucucagcagcagaaggcaacccgugucuaugccgugguacaaauuuccgcuccaauguuucugcuuugggcccugcccuugucaguugcaccucucaucacggauuucaaaauguuugugacuaccagcuaccugaucaguuuauuccugauuauaaauucuuccgcuaacccaaucauuuacuuuuucgucggcagccuaagaaagaaaaggcucaaggagucgcugcgggugauccuucagcgcgccuuggcggacaaaccggaggucgggagaaauaagaaggccgcaggaauagaucccauggaacagccucacucuacacaacauguggagaaccugcucccaagggaacaccggguugacguggagacuuga

SEQ ID NO: 58838 - RNA, 1143 nt, Artificial Sequence
  derived and/or modified sequence opt3 from MASP1__Homo_sapiens__NP_001027019
augagauggcugcuccuuuacuaugcccugugcuucagcuuguccaaggcuucugcacacaccguggaguuaaacaauauguuuggccagauccaaucacccggguacccugacaguuauccaagcgauuccgaagucacauggaacauuacuguuccggacggauucaggauaaaacuguacuuuaugcauuucaaucuagagucuucguaucucugugaauacgauuaugugaagguagagacggaagaccaggugcuggccaccuuuugcggucgggagacaacugauaccgagcagacacccggccaggaagucgugcuuucaccugggagcuucaugaguaucaccuuucgcuccgacuucucuaacgaggaacgauuuacuggauucgaugcgcacuacauggcuguugacguggaugaguguaaagagcgugaagacgaggaacugagcugcgaucauuacugucacaauuauauuggcgguuacuauugcuccuguagauuuggguacaucuugcauacagacaacaggaccugccgggucgaguguucagauaaucucuucacgcaacgcacuggagugauuaccaguccagacuuucccaacccuuauccaaagagcucugaaugccuguacacaaucgagcuggaggaaggcuucaugguaaaucuccaguucgaggacauauuugauaucgaagaccaccccgagguuccuuguccauaugauuacauuaaaaucaaggugggcccgaaggucuuagggcccuucugcggagaaaaagccccugagccaauuuccacucagucacacagcgugcugauccuuuuucauagugacaacucuggugagaauagaggcuggagguuguccuaccgggcagccgggaacgaaugccccgagcugcagccuccagugcacggaaagauagaacccagccaagcuaaauauuucuuuaaggaucagguccuaguuucgugugacaccggcuacaaagugcucaaggauaauguagagauggacacauuccagauugaaugccugaaggaugguaccuggucuaacaaaaucccgacguguaagaaaaaugagauugaccuugaguccgaacugaagucagaacaggugacugaguga

SEQ ID NO: 58839 - RNA, 5592 nt, Artificial Sequence
  derived and/or modified sequence opt3 from MAST2__Homo_sapiens__XP_011539364
augaagagauccaggugccgggaccgcccccagccuccaccgcccgaucgacgugaggacggcgugcagagagccgcugaacugagccagucucucccuccaaggcggcgcgcgcccccugggagacagaggcuugaggaacggaccggaccagccggucccgagggcaaagaacaggaugucguuacaggggugucaccucuguuguuccgcaaguuaagcaacccagacaucuuuagcuccacuggaaaaguaaagcugcaacgacagcuaucucaggaugacuguaaacucuggagaggcaaucuggcgucgucacuuagcgguaagcagcuguugccgcucaguuccucugugcacagcuccgucgggcaagugacguggcagucaaguggagaggcuagcaaccugguuaggaugcggaaucagucucugggccaguccgcccccucacucaccgcaggcuuaaaggagcugagccuuccucgucgcgggaguuugauuucuacacugugcagaggagccgaagugaaccaacacauguucuccccaacuagcgcucccgcacuauuucucaccaaagucccuuucucggccgauugugcucuggccacaucuccacuugcgaucuuucugaaucccagggcacacuccucaccggguaccccuugcaguagccggcccuugccaugguccugucgaacuucuaaccgcaagagccucaucgugacaucaaguaccuccccuacgcugcccagaccacauagccccuuacacggccauacuggaaauucuccucuggacucaccaaggaacuucaguccgaaugcccccgcucacuuuagcuucguaccugcccggcgcaccgauggaagaagguggucccucgcaucucuuccaucgagcggcuacgguacaaacacucccuccucaaccguuaguucuagcugcuccucacaggagaaacugcaccaguugccuuuucaaccaacagcugacgaacuacauuuccugaccaagcacuuuagcacggagucugugcccgaugaggaagggcgucaguccccggccaugcggccucgaaguagaagccucucuccaggaaggucccccgucucauucgacagugagauuaucaugaugaaucauguguauaaagaacgcuuuccuaaggcgacugcccagauggaggaacggcuggcagaguucauuagcucgaacacacccgauuccgugcuuccacuggcugacggcgccuugucuuucauccaccaccaggucauagagauggcuagagacugucucgauaagagcaggucaggccugaucaccagucaauacuuuuaugaauuacaggacaaucuggagaaacuacuccaggaugcccaugaacgcuccgagucuagcgaaguugcauucgugaugcagcugguaaagaaacuuaugauuaucauugcccgaccugcucgguugcuggagugccucgaguuugaccccgaagaguucuaccaucugcuugaagcggcagaggggcaugccaaggaaggacaagguaucaaaugugauauaccacguuauauugugucccagcugggcuugacuagagacccgcucgaggagauggcucagcugucaagcugcgauaguccugacacacccgaaaccgaugacucuaucgaggggcacggagccuccuuaccaagcaagaaaacgcccucggaagaggauuuugagaccauuaagcugaucucaaacggcgcauacggugccgucuuccuagugaggcauaagucuacacgccagcgguuugcuaugaaaaagaucaauaaacaaaaccucauucugagaaaccagauacagcaggccuucguugaaagggacauccuuacuuuugcagagaauccuuucguggucaguauguuuuguuccuucgacaccaagcgacacuugugcauggugauggaauauguagaagggggcgauugcgcgacacugcucaaaaacauuggagcucugccaguugacauggugcgcuuauacuuugccgaaacuguccuggcacuugaguacuugcacaauuauggcaucgugcaucgggaucucaagcccgacaaccugcuaauaaccagcauggggcacauuaagcugacagauuucggacucucuaaaaucggucugaugagccuuaccacuaauuuguacgagggccauaucgaaaaggacgccagagaguuccuggauaaacaagucugugggacgccugaauauauugcuccggaggugaucuuaaggcagggauacggcaagccaguugacuggugggccauggguauuauacucuaugaauuucugguggggugcguacccuucuuuggcgauacaccugaggagcuuuucggacaggucaucuccgacgaaauuguguggccagagggcgaugaagcacugcccccugacgcucaagauuugaccucaaaacuccugcaccagaacccgcuagagcgucuggggacuggaagugccuacgaaguuaagcagcaccccuuuuucaccggucucgacuggacaggccugcuucgccagaaggcggaguuuaucccacaauuggagagcgaagacgauaccucuuauuucgacacucgguccgagagauaccaucacauggauucagaagacgaggaggaagugagugaggaugggugucuggaaaucaggcaguuuagcuccugcucuccucgauucaauaaagucuacucgagcauggagcgguuaucacuccuggaggaacgcagaacacccccaccuacgaagaggucccuuagugaggaaaaagaggaccauucugauggacuggccggccuaaagggucgggaccgaagcugggugauugggucccccgaaauacucagaaaacgccugucaguaucugagagcagucacaccgaauccgauagcucuccaccgaugacugugaggcgucgguguucaggcuugcuggacgcuccuagauuucccgagggaccagaggaagcauccaguacauuaaggcgccagccccaggagggcaucuggguucucaccccuccaagcggggaaggagucucgggccccgugacagagcauucuggugaacaacgaccuaagcuggaugaggaggccguggggagauccagcggaucaaguccggcuauggaaacucggggcagggguaccucucagcuugccgagggcgcaacggcgaaggccauuuccgaccuggcuguccgccgugccagacaccgguugcucagcggggauucaaccgagaaaaggacagcacgcccaguuaacaaggugaucaaaagugcuagcgccacugcacugucccuacugauucccucugagcaccauaccugcagcccucuugccucccccaugucaccacacucucagaguucgaauccuagcucccgagacucuucacccagcagagacuuccucccagcucugggauccaugcggccuccgaucauaauccauagggcgggcaagaaauauggguuuacauugcgcgccauuagaguguacaugggagauagugacguauauacuguccaccauaugguguggcacguugaggauggcggucccgcaucugaagcugggcugaggcagggagacuuaaucacccacgugaacggcgagccaguccauggucucgugcacacggaaguuguggagcugauucuuaagagcggcaauaaaguagccaucucaacaaccccucuggaaaacacuuccauaaaggucgggcccgcccggaagggaaguuacaaagcuaagauggcacgucgcagcaaacgaucuagaggcaaggaugggcaagaguccaggaaacggagcucauuguuccgcaagauuacaaagcaggccucgcuccugcauaccucuagaagucuauccagccugaauaggucacuuuccucuggagagagcggcccagguaguccuacucacucccacagccucucuccccggucaccgacccagggguaucgagugacaccagacgcggugcauagugucggaggcaacuccagccaaucuucgucaccuagcuccaguguucccucuagcccagcugguuccggccacacgagacccucaagucugcauggguuggccccuaaauuacagcgccaguacaggucuccgcggcguaagagcgcaggauccaucccccugucaccacucgcccacaccccuagucccccuccacccacugcuucuccucagagauccccaaguccccugagcggccauguggcacaagccuucccgacaaaacuucaccugucgccuccauuggggaggcagcuaucccgccccaagucugcggaaccuccacggucaccccugcucaaacgaguacagagcgcugagaagcuggccgcagcccuugcugccagugaaaagaaauuagcaaccuccagaaagcacucucuggaucucccgcauagcgaguugaaaaaggaacugccucccagggaggugucaccacucgaggucgugggagcucgcuccguucugaguggcaaaggugcccuuccugggaagggagugcugcagcccgcgccaagccgggccuugggcacacuaagacaagaccgugcagaaaggcgggagucucugcagaagcaggaagcuauucgcgaggucgauucauccgaagacgauacugaggagggccccgaaaauagccagggggcccaagagcucucuuuagcuccucacccagaagugagucagucgguugcaccgaaaggagccggugaguccggcgaggaagaccccuuuccuagccgagacccaagaucacuggggcccauggugccuucucuucugaccggaaucacgcucggcccacccaggauggagagcccuuccgguccgcaucggcgcuuggggaguccacaggccauagaagaggcugcgucaucuagcuccgcaggacccaaccugggccagaguggcgccacagauccuauacccccagaaggguguuggaaggcucaacaccuccacacccaggcccugacugcacuuagcccuuccaccucuggacuaacacccacuucaagcugcucgccaccguccaguaccucugguaaacugagcauguggucauggaaguccuugauugagggcccugacagagccucucccaguaggaaagcuacaauggcaggcggguuagccaaccugcaggaucucgagaauacgaccccagcacaacccaagaaccugagcccucgagaacaggggaaaacucagccacccuccgcuccucggcuugcccauccgucauaugaggacccaagccaggguuggcugugggaaucugagugugcacaagccgucaaggaagaucccgcucucaguaucacacagguaccugacgccuccggggaucguagacaggacgugccaugccgcggaugucccuugacccaaaagagcgagccuucacugaggcggggccaagagcccggcgggcaccagaaacauagagaucuagcgcugguuccagacgaacuccuuaagcagacuuga

SEQ ID NO: 58840 - RNA, 7872 nt, Artificial Sequence
  derived and/or modified sequence opt3 from MAST4__Homo_sapiens__NP_001158136
augggagagaaggugagcgaagcccccgagccugucccacgugggugcuccggacacgguucuaggaccccggcuucagcucugguugccgcgaguagccccggagcuuccucugccgaaucgucaagcgggagugagacgcucuccgaagagggagagccuggcgguuucucucgggaacaucagccacccccuccacccccucuugggggaacucugggcgcacgcgccccagcugcaugggccccggcuagcguguuguuagagcgaggcguccuggcccucccaccuccacuccccgggggagcggugccuccagcaccccgugguuccucagccagucaagaggaacaagacgaggaacuggaucacauccuuagcccgccucccaugccauuucggaaguguucuaacccugacgucgcuuccggccccgggaagucacugaaauacaagaggcaguugagcgaggauggacggcagcuccgcagaggcagucuggguggggcccugacgggaagguaucucuuaccaaaucccguggcaggccaggcuuggccugccucugcggaaaccuccaaccugguucggaugcgcagccaggcccuuggccagucggcaccaucuuugacggcuucccugaaagaguugucacucccgcgaagagggaguuucugcaggacuagcaaucggaagucccugauuggaaacggucagucucccgcccuuccucguccacauagcccccugucagcucacgccggcaauaguccucaagacuccccacgcaacuuuagccccucugcaucagcccauuucaguuuugcuagaaggaccgaugggcggcgauggagcuuggcgucccucccgucuucgggauacggcacaaauaccccuagcuccacugugucaaguucuuguagcucccaggaaaagcugcaccaguuaccauaucagcccacaccugacgagcugcacuuccucucaaaacauuuuugcaccacggagagcauagcaacugaaaaccgcuguagaaauacccccaugaggccacggucucgcucccuuaguccugguagaagccccgccugcugugaucacgagaucauuaugaugaaccaugucuacaaggaaagguucccaaaagcuacagcccaaauggaggaacgucugaaggagaucauuacuucuuauuccccggacaauguguugccucuagcagaugggguacugucauuuacccaccaccagaucauagagcucgcccgggacugccuggauaaaagucaucagggccuuaucacaagccgauacuuccuggaauugcaacacaagcucgacaagcuguuacaggaggcucaugauagaucggaauccggagagcuggccuuuauuaaacagcuaguuaggaagauccucauugugaucgcacgccccgcgcggcugcuugaauguuuggaguucgacccagaggaauuuuauuaccugcucgaggcugccgaaggccacgcaaaagaggggcagggaauaaagaccgacauucccagauacaucauuucucaacugggucuuaacaaagauccucuggaggaaauggcccauuugggcaauuaugacagcgggacggcugagacuccagaaacagaugagucagucaguuccucuaacgccagccucaagcugaggcgcaaaccccgagaauccgacuucgagaccaucaaguuaaucucaaauggagcauacggcgcuguguauuucgugcggcacaaggagagccgucagagauuugccaugaaaaagauuaacaaacagaaccugauacuaaggaaucagauccaacaggcguucgucgaacgcgauauucucacuuuugccgagaacccuuucguugugaguauguacugcucuuuugaaacacggagacaccuguguaugguaauggaguauguggaagguggggacugcgcuacccuuaugaagaauaugggcccguugccagucgauauggcaaggauguacuucgccgagacggugcuggcucucgaguaucugcauaacuacggaaucguucaccgagacuuaaaacccgauaaucugcuugugaccuccaugggccauauaaaguugacagacuuugggcucagcaaggucggacugaugucgaugacuaccaaccuauacgaaggucacauugagaaagaugcccgcgaguuccuggacaaacaggugugcggcacaccugaguauaucgcaccagaaguaauccuccggcagggguacggaaaacccguugacuggugggcgaugggcauuauccuguaugaguuucuuguggguugugucccuuucuuuggggauacuccggaggaauuguucggccaagugauuucagacgagauaaauuggcccgaaaaggaugaggccccaccucccgacgcucaggaucugaucaccuuacuccugagacagaacccacuugagaggcugggaacaggcggggccuacgaagucaaacagcacagauuuuuccgcucuuuggacuggaauagucuccugcggcaaaaggcagaguucauuccucagcuagaauccgaggaugacaccagcuauuuugauacuagaucugaaaaguaccaucacauggagacggaggaagaggacgauacaaacgacgaagauuucaauguggagaucaggcaguuuagcuccugcucacaucgauucaguaaaguuuuuagcucuaucgaccggauuacccaaaacuccgcugaagagaaggaggacucaguggauaaaacuaagaguaccacacugcccagcaccgaaacucucuccuggucuucggaguauagcgaaaugcagcagcugucaacauccaauaguucugacacggagagcaaccgccacaaacuuuccucaggauugcugccaaaguuagccauaucuaccgaaggcgagcaggaugaggcagccagcuguccgggugacccucaugaagaacccgggaagccagcucuacccccugaagagugcgcgcaagaggaaccagagguaacuacacccgccaguaccaucuccagcucuacacugucagucggauccuucagugaacaccuugaucagauuaauggcagaagcgaguguguggacucgacugauaacucuuccaaaccuagcucagaaccggcaagucacauggcuaggcagcggcuggagucuaccgagaagaaaaagaucuccgguaaaguuacaaagucacuaucagccagugcccucagccugaugauuccaggcgacauguuugcugugucccccuuggggucuccuaugagcccccauucccugucaucugauccaaguucgagccgagacuccucuccuucaagagauagcuccgcagccagugcgucuccccaccagccaaucgucauacauagcucaggcaagaacuacggcuucaccauccgcgcuauuaggguguacguaggggacuccgauaucuauacagugcaccauauuguuuggaaugucgaagagggaaguccugccugccaagcaggcuuaaaggccggugaccucaucacucacauaaacggggaaccggugcacggacuggugcauaccgaggucauugaacuucugcuaaagagcggcaauaaaguuucuaucacaacuacccccuuugagaacacguccauuaagacagguccagcucguagaaauucauacaaaagcagaauggugaggcgcucgaagaaaucuaagaagaaagagagucucgaacgaagacggucccuguucaagaaacuagcaaagcagccuagcccccugcuucacaccucaagguccuuuucuugucucaaccgcagccugaguuccggcgagagcuugccagggucuccuacucauucacugaguccccguuccccgacaccaagcuauagaucuaccccugacuuccccucgggaacuaauucaagccaguccaguucuccaagcuccucagcccccaacaguccugcgggcucugggcacauccggccgagcaccuuacacggacucgcucccaaacugggcggucagagguaccgcuccgggcgaagaaagucagccggaaauauaccacuuagcccucuggcacggacacccucuccuacgccacaacccaccuccccucagaggaguccaagccccuugcucggccauucgcuggguaacuccaagaucgcccaggcuuuuccgucuaaaaugcacucaccuccaacuauugugcgccauaucguaagacccaagagcgccgaaccuccaaggaguccccuacugaaacggguccaauccgaggaaaaacuuucuccgagcuauggcucagauaaaaagcaccucugcucccguaagcauagucuggaggugacacaggaggaaguucagcgcgagcagagccaacgagaagcaccuuugcagucuuuagacgagaaugugugugauguacccccacugucaagagcuaggccuguggagcaggggugccucaaacggcccguuucccgcaaggugggaagacaggaaagcguagacgaucuggacagggauaaacuuaaggccaaagucguggugaagaaagcggacggcuucccagagaagcaagaaucucaccagaagagucacgggcccggaucggaucuggagaacuucgccuuguuuaaacuagaggaacgggagaagaaagucuacccuaaggcaguugaacgauccagcaccuucgagaauaaggcuucaaugcaggaagccccaccgcugggcucucuccugaaggacgcacuucacaagcaggcaagcgugagagccuccgagggugccaugagugaugggcgcguacccgcugaacacaggcaaggaggcggcgacuuucggcgugcgccugcaccagggacauuacaggacggacugugucauucacucgauagagguauuucuggcaaaggggagggaacugaaaagagcucccaggccaaagaauugcugaggugcgagaagcucgacaguaaacuggcuaacaucgauuaucuucgcaagaagaugagccuggaagacaaagaggauaauuugugccccgugcuaaagccuaaaaugaccgccggcucccacgaaugucugccagguaaccccguccggccuacagggggacagcaagagccgccacccgcaucugagucacgagccuucgugagcucgacacacgcugcgcagauguccgccguuaguuuugugccucucaaggcauuaaccggcagagucgacucuggcacugaaaaacccgggcugguggcuccagagagcccuguuaggaagucacccuccgaauacaaacuugagggacgcucugugaguugccugaaaccaauagaggguacccucgauauugccuugcugagcggcccgcaggcauccaagacagaacucccuucacccgagagcgcccaaucuccaagucccuccggggacguccgggcuagcguaccuccagugcugcccucaucuuccggcaagaagaacgauacuaccucggccagagaacuuagcccuaguucucuaaaaaugaauaaguccuaccuguuggagccgugguucuuaccacccagccguggccugcagaacagcccugcgguuagucucccagaccccgaauuuaagagggaucggaaagguccucaucccacagcacgcuccccagggacggugauggagagcaauccgcagcagcgagagggaucuucaccuaagcaccaagaccauaccacugaucccaaacugcuuacaugucugggccagaaccuccacagcccagacuuggccagaccuaggugcccccugccaccugaggcuucccccucucgggagaagccgggccuacgcgaaaguucggagagagggccaccuaccgccaggagcgaacgauccgcugcacgggccgacacuugucgugagcccucaauggagcugugcuucccagaaacagcuaaaaccucugauaauagcaagaaccuccuuagugucggaagaacgcaucccgacuuuuauacucagacccaggccauggagaaagcaugggcgccugguggcaagacaaaucacaaggaugggccgggagaagcccgcccacccccuagggacaacuccucacugcacucugcuggcauccccugugagaaagaauuagguaaggugcggagagggguagagccaaaaccugaggccuugcuggcacgcaggagccuccaacccccaggaaucgaauccgagaagagugaaaaacugagcucuuucccuucacuucagaaggauggcgcuaaggagccggagcgaaaagaacagccccugcagcggcauccauccagcauuccucccccaccucucaccgccaaggacuugaguucucccgcagccagacaacacugcuccucgccgagccaugcuucaggcagggagccaggggcgaaaccuuccacugccgaacccucuaguagcccacaggaucccccuaagcccguggcagcucacucagaguccagcucucacaaaccacgcccuggaccggaccccgguccaccuaagacaaagcaucccgaucguagucuguccagccagaaaccaucagucggcgccaccaaggggaaagaaccugccacacaaucuuuaggaggcucgagccgggaggguaaggggcacuccaaaaguggacccgacguuuuuccggcaacuccuggcucucagaauaaggcuucagauggcaucgggcagggagaggguggcccaagcgugccccuacauaccgacagagccccucuggaugcgaagccacagcccacguccgggggaaggccucucgaagugcuugagaaaccaguccaucugccccgcccgggccauccuggucccagugaaccagcugaccaaaaguugucugccgugggggagaaacagacacugagccccaagcacccuaaaccauccaccguuaaggacugucccacucucugcaaacagaccgauaaccgacagacagacaagucaccuagccaaccagcagccaauacugaucggagagcugaaggcaagaaauguaccgaggcacuguacgccccggcggagggagacaaacuugaagcuggccucucuuucguacacuccgagaacaggcugaaaggggccgaacgccccgcagccggaguggguaagggcuucccugaggcuagagggaaaggaccaggcccccagaagccuccaacggaagccgauaagcccaaugguaugaaacggaguccgucagcaacagggcagagcucguuuagguccaccgcuuugccugagaagucucugaguugcagcucauccuucccagagacucgugccggcguccgagaagcgucugccgcaagcagugacacauccagcgcuaaagccgcaggaggcauguuagagcuacccgcuccuucuaaccgcgaucauagaaaggcccagcccgccggggaaggacggacccacaugacuaaaucagacucccugcccagcuuuagggugaguacacucccgcuugagucucaucacccugaucccaauaccauggguggcgcgucacaucgcgacagagcucuguccguuacggcaacugugggggagaccaagggaaaggauccagcccccgcucaaccuccacccgcccggaaacagaacgucggcagggacgugacaaagccuagcccagcaccgaacaccgaccgacccauuucguugucuaaugaaaaagauuucguaguccgucagagacgcgguaaggagagucugcgguccagcccucacaaaaaggcccucuga

SEQ ID NO: 58841 - RNA, 2640 nt, Artificial Sequence
  derived and/or modified sequence opt3 from MASTL__Homo_sapiens__NP_001165774
auggaccccaccgccggcagcaagaaagagccugggggaggugcugcaacagaagagggcgugaacagaaucgccgucccaaagccgcccuccauugaagaguucucuauaguuaaaccuaucucaaggggcgcguuuggaaagguguaccugggccagaaaggugggaagcucuaugcuguaaagguggucaaaaaggccgauaugauuaauaaaaacaugacucaccaagugcaggcagaacgggacgcccuugcucugaguaagagcccauucaucguucauuuguacuauuccuuacagucugcaaauaacguguaccuggucauggaguaucuaauuggaggcgaugugaaaucgcuccugcacaucuacggcuauuuugacgaggaaauggccguaaaguacauaucagagguugcucuugcccuggauuacuugcaucgccacgggaucauucaucgagaccucaagcccgauaauaugcugaucagcaacgaaggacacauuaaacugacggacuucggucucaguaaggugaccuuaaaucgugauaucaacaugauggacauacugacaacuccuuccauggcgaaaccaagacaggauuauucuaggacccccggccaaguccuuagcuugauuuccucacugggguuuaauacaccuaucgcagagaagaaccaggacccagccaauauucuaagugcuugccucagcgagaccucucagcugucccagggacuuguguguccgaugucaguggaucaaaaagacacuacacccuacagcaguaagcuguugaaaucuugccucgaaaccgucgccuccaacccuggcaugccaguuaagugucugacgagcaauuuacugcagucgcggaagcgccucgcaacuucuuccgcuucaagucagagccacaccuucaucuccucuguggagagcgaaugccauucaagucccaaaugggagaaggacugucaggaauccgaugaggcccuugguccuacaaugaugagcuggaacgcgguagagaaacugugcgccaagucugcaaaugcuaucgaaacuaaaggguuuaacaagaaggacuuggagcuagcccugucaccaauucacaacaguagcgcucuccccaccacaggaagauccugugugaaucuggccaaaaagugcuucucuggcgaagucucgugggaggcaguggaacuugauguuaacaauauaaacauggacaccgauacgagccaacugggcuuucaucaguccaaucagugggccguggacucagggggaaucagugaggagcacuuggguaaaaggucucucaagcggaacuucgaacuggucgauagcuccccguguaaaaagauuauccaaaauaagaaaacuugcguggaguauaagcacaacgaaaugacaaauuguuacaccaaccagaauacuggcuuaacaguagagguucaggaccugaaacuaucagugcauaagagccagcaaaacgauugcgcuaauaaagaaaacauagucaauucuuuuaccgacaagcagcagacgccugagaagcuccccauuccaaugaucgcgaaaaaccugaugugcgagcuugaugaagacugugagaagaacuccaaacgcgacuauuugaguagcucuuuccugugcuccgaugacgaucgagcaucaaagaauaucaguaugaacagcgacucguccuuuccugggauuucuaucauggaaagcccccucgagucacagccacuggauagugacagauccauuaaagagucuagcuucgaagaguccaauauagaagauccccuuaucgugaccccugacugucaagagaagacaucaccaaaaggagucgaaaacccggccgugcaggagagcaaucagaagaugcuggggcccccuuuggagguucucaagacucuggcuaguaaaaggaacgccguggcauuccggucuuuuaauucccacauuaacgccagcaauaacucggaaccaucacguaugaauaugaccucuuuagaugcuauggacaucaguugcgccuacuccgguagcuaucccauggcaaucacaccuacucagaagcgcagaucuuguaugccacaucaacagacccccaaccagauuaaaagcgggacaccguacaggaccccuaaguccguacggcgaggcgucgcgccaguggaugacggacgcauacugggcacucccgauuaccuagcuccugagcuccugcuugggagagcccacggacccgcaguugacuggugggccuugggugugugccuguucgaauuucucacgggcaucccaccuuucaaugacgagacaccccagcaagucuuucagaacauucugaaaagggauaucccauggccggaaggggaggagaaguuaucagacaaugcucagagugccguggaaauucugcuuaccaucgaugacacuaagcgggcaggaaugaaagaguugaagcgccauccucucuucagcgauguagacugggaaaaccugcaacaccagaccaugcccuuuauaccacagcccgaugacgagacagauaccucuuauuucgaagcuagaaacacugcccagcaccuaacaguguccggcuuuucacuguga

SEQ ID NO: 58842 - RNA, 1188 nt, Artificial Sequence
  derived and/or modified sequence opt3 from MAT1A__Homo_sapiens__XP_005269899
augaacggccccguggacgggcugugcgaucacagccucuccgagggagucuucauguuuaccucugaaucaguuggugagggccauccugacaagaucugugaucagauuagugacgccgugcuugaugcucaccugaaacaagacccaaaugcaaagguagccugcgaaacaguguguaaaacugggauggucuuguuaugcggagagauaacgagcauggcgaugguggauuaccagagaguugugagggacaccaucaagcauauuggcuaugaugacuccgcuaaagguuucgauuuuaagacauguaacguccugguggcccuagaacagcagucuccggacaucgcacaaugcguacaccucgaucggaaugaggaggacguuggggccggagaccagggccugauguucggcuacgcuacugaugaaaccgaggaauguaugccccuuacaauuauccuggcacauaaguugaacgcccgcauggcugaccuccgacguucggggcugcugccuuggcucagaccagauucaaaaacccaggugacuguccaguauaugcaagacaauggagccgugauacccgugaggauccacacaauugucaucagcguucagcacaacgaggauauuaccuuagaggaaaugcggcgcgcgcugaaggaacaggugaucagagcaguagugccugccaaauaccuugacgaggauacggucuaucauuugcagccaagugguagguuugugauaggcgggccccaaggagacgcuggcguuacuggucggaagauuaucguggauaccuacgggggauggggcgcccacggcgggggagcauucuccgguaaagacuauacaaaggucgaucgcucugcugccuacgcggcccgauggguggcaaagagccugguaaaagcuggccuaugcagaaggguucucgugcaggucuccuacgccauugggguggcugagccucugucaaucaguaucuuuacuuauggaaccagccagaagacagaacgggagcuucuggacgucgugcauaaaaauuucgacuugcguccaggcguuauugugcgcgaucucgaccugaagaaaccgauauaccaaaagaccgccuguuauggucacuuugggagaucugaguuccccugggaaguaccuaggaaauuagucuuuuga

SEQ ID NO: 58843 - RNA, 1188 nt, Artificial Sequence
  derived and/or modified sequence opt3 from MAT2A__Homo_sapiens__NP_005902
augaacggccagcugaauggguuccacgaggccuuuaucgaagagggaaccuuccucuuuacaagcgaauccgugggugagggccaucccgacaagauuugcgaucaaauaucugacgcuguccuugaugcacaucugcagcaggacccugaugccaaaguugcgugugaaacuguggcuaagacggggaugaucuuguuagccggagagauuaccucaagagcagccguagacuaccagaaaguggucagggaggcugugaagcacaucggcuaugaugacaguagcaaagguuucgauuacaagacaugcaacguucugguggcacuagaacaacaguccccagacauugcccaggggguccaccucgaucggaaugaggaagacaucggagcuggcgaucagggccugauguuuggguaugccacugacgagaccgaggaauguaugccgcuuacaauagugcuggcgcauaaguugaacgcaaaacucgccgagcugcgccgaaauggaacccugcccuggcuccguccugacucuaagacucaaguaacaguucaguacaugcaggauagaggugcuguguuaccaaucaggguccacaccauugugaucucggugcagcacgacgaagaggucugccuggaugaaaugcgggacgcccuuaaagagaagguuauuaaagcagugguacccgcuaaguauuuggaugaggacacgaucuaccaucugcaaccuucaggccgcuucgugauagggggaccacagggcgaugccggucuaacugggagaaagauuaucgucgacaccuauggaggcuggggcgcgcacgggggaggugccuuuagcggcaaagauuacacaaagguggacaggagugcagcuuacgccgcucgguggguugccaaaucccucgugaaagggggacugugucgccgaguccuugugcagguaucuuaugcaauuggcguuagccauccccuguccaucucaaucuuccacuacgguaccagucaaaagagcgaaagagaguugcucgaaauugugaagaaaaacuuugaucugaggccuggggucauagugcgggacuuagaccugaagaagccaaucuaucagcguacugccgcuuacggccacuucggacgcgauucuuuuccgugggagguccccaaaaagcucaaauauuga

SEQ ID NO: 58844 - RNA, 1005 nt, Artificial Sequence
  derived and/or modified sequence opt3 from MAT2B__Homo_sapiens__NP_037415
auggugggcagagagaaggaacugagcauccacuucgucccuggguccugcaggcucguugaggaagaggugaacauuccuaaucggcgcguacuugugaccggagccacaggucuguugggccgagcuguccauaaagaauuucagcaaaacaauuggcacgcagugggguguggauuccguagagccaggccaaaguuugagcagguuaacuuacuggacucuaaugcggugcaucacauaauccaugauuuccagccgcacgucauugugcacugcgcugccgagcggcgccccgacguaguugaaaaccagccugaugcagccucacaacuaaauguggacgcuaguggcaaccucgcaaaagaggccgcugccgucggugcguuucugaucuacauuagcuccgauuauguguucgacgggacuaauccacccuacagagaagaggauaucccugcaccacuuaaccuguauggaaagacgaaauuggacggcgagaaggccgugcucgaaaauaaccugggcgcugccguccugaggauacccauccucuacggggagguugaaaaguuagaggaaucugcagugaccguaauguuugauaaagugcaguucucgaauaagucagcuaacauggaccauuggcagcagcgguuuccuacacacgucaaagauguggccacuguuugucgccaacuggcggagaagcgaaugcuugacccaagcauuaaaggaaccuuccauuggagugguaaugagcagaugacaaaguaugaaauggccugcgcaaucgcugaugccuuuaacuugccguccucucaccugagacccauuaccgacagcccugugcuaggcgcucagaggccacggaacgcccagcucgacuguuccaagcuggagacucuugggaucggacaacguacacccuuccgcauaggcauuaaagaaucacuguggcccuuuuugaucgauaagagauggaggcagaccgucuuccacuga

SEQ ID NO: 58845 - RNA, 1527 nt, Artificial Sequence
  derived and/or modified sequence opt3 from MATK__Homo_sapiens__NP_002369
augcagggccacuuccccgccgagagaagggaagggcggccucgccgaggaacccguggucaacagcagcugcucgugagcccaagauuucuuagggcuuggcauccgcccccugucuccgcacggaugccaacacgcagaugggcccccggcacucagugcaucacgaagugugagcacaccaggccuaaaccaggggaacuggcguuccggaagggagacguugugacaauuuuggaggcuugcgaaaacaaaucuugguaccgcguaaagcaucacacuucaggccaagaggguuuacuggccgcaggggcccuacgagagagagaagcucucagugcagaucccaaacugagccuuaugccuugguuucauggaaagauauccggccaggaggccgugcagcagcugcaaccaccggaagacggcuuguuccucgucagggagucugcucggcaccccggggauuaugugcuguguguuucguuuggacgugacgugauccacuaccgcguccugcauagagauggucaccucaccauugacgaggccguguucuuuugcaauuuaauggauaugguagaacauuauucaaaggacaaaggcgcgaucuguacaaagcugguuaggccuaaacggaagcacgggaccaaaagcgcagaggaggaacuugcccgagcuggaugguugcugaaccuacagcaccucacucugggcgcccagauuggugaaggggaguucggagcagugcuucagggcgaguaccugggccaaaaggucgcugugaagaauaucaaaugcgaugugacagcccaggcguuuuuggacgaaaccgccgucaugacgaagaugcagcaugagaaccucguucgccuguuaggggugauacugcaccaaggacucuauaucguaauggaacaugugaguaaagguaaucuugucaacuuccugagaacuaggggccgggcauuggugaauaccgcucagcuacugcaguuuucccuccacguugccgaggggauggaauaccuggagucuaagaaacuugugcaucgcgaucuggcugccagaaacauuuuggucagcgaggaccucguggcaaagguauccgauuucggacuggccaaagcugaaaggaagggcuuagacucaagucgucugccaguuaaguggacagcgcccgaggcacuaaaacacgguaaguuuacuagcaaaucugacgugugguccuucgggguccuccugugggaaguguucucauauggccgggccccuuacccaaagaugagccuuaaagaggucagugaagcuguggagaagggauaccgaauggagcccccggaaggcuguccugggcccguucacguguugaugucuuccugcugggaggccgaaccagcaagaaggccucccuuucgcaagcuggccgagaaacucgcucgggagcugagaagcgccggagcaccagcgucgguaucuggucaggaugcugacggcuccaccucacccaggagucaagaaccuuga

SEQ ID NO: 58846 - RNA, 2871 nt, Artificial Sequence
  derived and/or modified sequence opt3 from MATN2__Homo_sapiens__NP_002371
auggagaagaugcuggccggcugcuuccuccuuauccuggggcagauuguguuguuacccgcugaagcaagagagaggagccggggacgcuccauaucucgaggucgucacgccagaacccauccucaaacagcgcugcuagaaucaaguugugagaacaaaagggcugaccucgucuuuaucauugauagcucccggucuguuaauacucacgacuacgccaaggugaaagaguucaucguagauauucugcaguuucuugacaucggcccagaugugacgcgcgucgggcuguugcaguauggaucgaccgugaagaacgaguucucacucaaaacauuuaagagaaagagcgagguugaaagggcagugaaacggaugcgccaucugaguacuggcaccaugacaggucuggccauacaguacgcucucaauaucgcauucuccgaggccgaaggggcucgaccguuaagagagaacguccccagggugauuaugaucguaaccgacggacggccucaagauucuguugccgagguggcggcaaaggcccgugacacuggcauucugaucuuugcuauaggcgucggacagguggauuucaauacacuuaaaagcauuggguccgaaccacacgaggaccauguguuuuuggucgccaacuucucacagaucgaaacccugacgaguguuuuucagaagaaacuaugcacugcacacauguguagcacccucgagcacaauugcgcucauuucuguauuaacauccccgguucuuaugugugccgcuguaagcaaggcuacauccugaauagcgaucagacaacuugcaggauucaggaccuuugugccauggaagaucacaacugcgagcagcuguguguaaaugugccugggucauuugucugccaaugcuauagcggauacgcguuggccgaggacggcaagagauguguggcaguugacuauugcgcuagugaaaaccaugguugugagcacgaaugcgugaaugccgaugggucuuaccucugucagugccacgagggauucgcucugaacccagacaaaaagaccuguacaaaaauagauuacugcgccuccagcaaucauggcugucagcacgaaugcgucaacaccgacgauucguauucuugucauugcuuaaagggcuucacgcugaaccccgacaaaaagacuugccggcgaaucaauuacugugcacucaacaaaccugggugcgagcacgagugugugaauauggaagaguccuauuacugccgcugucauagaggauauacacuugauccaaacgguaagaccugcucaaggguagaccacugugcccaacaggaucacggcugcgaacagcuguguuugaauacugaggacaguuuuguuugccaguguagcgaaggguuccuaauuaacgaggaucugaagacaugcucccggguggacuacugccuccugucugaccauggaugugaguauagcugcgucaauauggaucgcucauuugcuugucaaugcccggaaggccacgugcuuagaagugacgguaaaaccugugcgaagcuggauuccugcgcauugggggaccauggcugugagcacagcugcgucucuucagaagauaguuucgugugucagugcuuugagggauacauccucagggaggacggcaaaacgugucgucggaaggauguuugccaggccauagaccacgggugcgaacauauuugugugaacagcgaugacuccuauaccugcgagugucuggaaggauuccgauuagcugaggaugguaaaagaugcaggcgcaaggacguauguaagucuacacaccauggcugcgaacacaucugugucaauaacggaaauucguacaucugcaaauguagcgagggguuugugcuggccgaggauggccggagaugcaagaaauguacugaaggucccauugaccuaguuuucgugaucgacggguccaagucacucggcgaggaaaacuuugaggucgugaaacaguucguaaccggaauuauagauagucugacaaucucuccuaaggcagccagggugggccuuuugcaauacagcacucagguucauaccgaauuuacacugcgcaauuucaacuccgcuaaggacaugaaaaaggccgucgcacacaugaaauauauggggaagggaucaaugaccggucucgcgcugaaacacauguuugagcgauccuucacucagggcgagggggcucggccacuuucuacgcgugugcccagagccgcaauuguguucacagauggaagggcccaggacgaugucuccgaaugggcuaguaaggccaaggcaaauggcaucaccauguacgcuguugguguggggaaagccaucgaggaagaacugcaagaaauugcgagcgagccuacuaacaagcauuuguuuuaugccgaggacuucucuaccauggaugaaauauccgagaaacucaagaaaggcaucugcgaagcucuggaggacucagauggacgccaggacaguccagcaggcgaguuacccaagacagugcagcagccgaccgaaagcgagccuguaacuauuaacauccaagaucugcuaucgugcuccaauuuugccguccagcaccgguaccucuucgaagaggacaaccugcuuagaucuacacagaaauugagccauucaacgaagcccaguggguccccacuggaagagaagcacgaucaauguaaaugcgagaaucucauuauguuucagaaccuggcuaaugaagaggugaggaaguuaacccagcgacuggaagagaugacucagcgcauggaagcccuugagaaccgguugagauauagguga

SEQ ID NO: 58847 - RNA, 1461 nt, Artificial Sequence
  derived and/or modified sequence opt3 from MATN3__Homo_sapiens__NP_002372
augcccagaccugccccagcuaggcggcugccgggccuccuucuguuguuauggccccugcuacuccugccuagcgcagccccagaccccguggcgcgcccuggguuccgacgucuugagaccagaggaccagguggcucccccgggaggcggccuucuccagcugccccggauggagcacccgccucaggcacaagugaaccuggucgcgcuagaggggcaggagucugcaagagcaggccacuggacuugguuuuuaucauugauuccucucggucggugcgcccccucgaguucacuaaaguaaagacguuugugucacgaauaaucgacacccuggauauuggcccugccgacacaagagucgcugugguuaacuacgccagcacugugaaaaucgaguuccagcugcaagcguauaccgauaagcagagucucaaacaggcagucggcaggauuacaccauuauccaccgggacuaugucuggacuggccauccagacagcuauggacgaggccuuuaccguggaagcuggugcacgggagcccagcuccaauauaccgaagguagccaucauuguuacggauggccguccucaagaccaggugaacgaggucgcggcccgcgcacaggcuucagggaucgaacuuuacgccgugggaguggauagagcugacauggccaguuugaagaugauggcaagcgagccccuggaagaacacgucuucuauguugagacuuacggcgugauugaaaaacuaucuuccagguuucaggagaccuucugugcccucgauccaugcguacuggguacacaucaaugucagcacgugugcaucucagacggggaaggaaagcaucacugugagugcagccagggcuauacucuuaaugcugacaaaaagaccuguagugcgcuggaucggugcgcauugaacacacauggcugugaacacauaugcgucaaugaccgaucuggguccuaccacugugagugcuaugagggauacacccucaacgaagaucgcaaaacgugcagcgcccaggacaagugugcucuggguacucauggcugccaacacauuugugugaaugauagaacagggucgcaucacugcgaguguuacgaaggauauaccuuaaacgccgacaagaaaacuugcucuguuagggauaagugugcacugggcucccacgguugccagcauaucugugugucagacggggccgcuaguuaccacugcgauuguuauccuggcuacacacucaaugaggacaaaaagaccugcagcgccacggaagaggcacggcgccuugucuccaccgaggaugcgugcggaugugaagcuacacuggccuuucaggacaaagugucuagcuauuugcaaagacuaaacacuaagcuggacgauauucucgagaaacugaagaucaaugaauacggccagauccauagguga

SEQ ID NO: 58848 - RNA, 2544 nt, Artificial Sequence
  derived and/or modified sequence opt3 from MATR3__Homo_sapiens__NP_001181883
augagcaaguccuuccagcaaucuucacugaguagagacagccagggccacgggagggaucucuccgccgcuggaaucggucuucuggcagccgcgacccagucuuugucgaugcccgcuucauuaggccggaugaaccaggggacagcccgccuggcaagccuaaugaaucucggaaugaguuccucucugaaccaacagggcgcccauagcgcucuuuccucagcaaguacuagcucucacaaucugcaguccauuuuuaacauagguucacgagggccuuugccacucagcagucagcaucguggagacgccgaucaagccucuaauauccuggccuccuucggccugagcgcgagagaccucgaugaguuaucgagguacccggaagacaaaauuacgcccgagaaccugccucagauccuuuugcagcugaagcggcgcagaaccgaagagggcccaacacuaucuuaugggagggauggacgguccgcaacucgcgaacccccuuaccgagugccaagagacgauugggaggagaaaaggcacuuucggcgugacucauucgaugaccgcggucccagucucaauccuguccuggauuaugaccauggcagcagaucccaggaaucuggguacuaugacaggauggauuacgaggacgaucggcuucgagacggagaacgcugcagagaugacagcuuuuucggcgagaccucacacaacuaucacaaguuugauagugaguacgaaaggaugggucgggggccaggaccgcugcaagagcgcuccuuguucgaaaagaagagaggcgcucccccuagcucuaauauugaggacuuucauggccuccugccaaagggguacccccacuuauguucaaucugcgaucugccuguucauaguaacaaagaauggagccagcacauaaauggagcuucccacucuaggcguugucagcuccuucuggagaucuauccagaguggaaccccgacaaugauacaggucauaccaugggcgacccguucauguugcaacagucgacuaacccugcccccgggauucuaggaccaccucccccaaguuuucaccugggcggucccgcaguggggccucggggcaaucucggagcuggcaacgggaaccugcagggaccacgacauaugcagaaggguagaguagaaacauccagggugguccacaucauggacuuccaacgcggcaaaaaucuucgguaccagcuguugcagcucguggagccguuugggguuauuucaaaccaucugaucuuaaauaagauaaacgaagccuucauugagauggcgaccacggaagaugcccaggcagcuguggacuauuacacuaccacacccgcccuggucuucggaaaaccugugagaguacaccuaagucaaaaguauaagaggaucaaaaagccagagggcaaacccgaucagaaguuugaccagaaacaggagcucggucgcguuauucaccugucuaaucuuccucauagcggguacuccgauucagcuguguugaagcuggccgaaccauauggcaaaaucaagaacuacauccucaugcgaaugaaaagccaagcauucauugagauggaaacucgggaggacgccauggcuauggucgaucacugccugaaaaaggcgcuuugguuucagggacguugugugaaaguggaccugucugaaaaguacaaaaaguugguccucagaauacccaauaggggcaucgaucuguuaaagaaagacaagucccgcaaacggaguuauagcccggaugggaaggagucuccuuccgacaaaaagucaaagaccgauggaagucagaaaacagagagcucgaccgaagguaaggagcaggaagagaaauccggcgaggacggggaaaaggacacgaaagaugaccaaacugagcaggaaccaaacaugcugcuagagucugaagaugagcuccugguugacgaggaagaggcagccgcucuuuuggaaagcggaucaagugugggcgaugagacagaccuggccaaucucggugauguagcauccgacgggaagaaggaacccucugauaaagccgugaagaaagacggcagcgcuuccgccgcagcgaagaaaaagcugaaaaaggucgauaagauugaggaguuagaccaggaaaacgaggcugcccuggaaaauggaaucaaaaacgaggaaaauaccgagccuggcgcagagucaagcgaaaacgccgaugaccccaauaaggacacuagcgagaacgcugaugggcaaucugacgaaaacaaagaugacuacacaauaccagaugaguauagaauuggaccuuaccagcccaaugugccaguuggcaucgacuaugugaucccgaagaccgguuucuacugcaaacuuuguuccuuguuuuauacgaacgaggaagucgccaagaauacccauugcagcucgcucccucacuaccagaagcugaaaaaguuccuaaacaaacuggcagaggaaaggcgacagaagaaagagacauga

SEQ ID NO: 58849 - RNA, 1842 nt, Artificial Sequence
  derived and/or modified sequence opt3 from MAU2__Homo_sapiens__NP_056144
auggccgcucaggcagccgcggcugcccaagcagccgcugcacaggccgcucaggccgaggcggcagacagcugguaccuggcccuccuuggcuucgcugaacacuuuagaaccuccucucccccuaagaucaggcugugcgugcauuguuugcaggccgucuucccauuuaaaccgccccaacggauugaggcacgcacacacuuacagcuggggucaguucuauaucaucacacuaagaacagugaacaggcucgaagccaucucgagaaagccuggcugauaucccagcaaaucccucaguucgaagaugugaaguuugaggcggccucucuucugucggaguuguacugccaggaaaauucaguagacgcagcuaaaccacuccugcguaaggccauucagaucagccaacagacgcccuauuggcacuguagacugcucuuucaguuagcucaacugcacacccuugagaaggauuuggugagugccugcgaccugcuaggagucggugcagaauacgccagggugguuggcuccgaguauacacgggcucucuuucugcuuucuaaagggaugcuguugcucauggagcgcaagcugcaggaagugcauccuuuacugacucucuguggacagauugucgagaacuggcagggcaauccaauccaaaaagaaagccuuagaguguucuuucugguauugcagguuacccacuaccuagaugcgggucaggugaaguccgucaaacccugccugaagcagcuccaacaguguauacagacaaucucaacccugcaugacgaugagauucuuccuaguaacccagcagaccuguuccacugguugccgaaggaacacaugugcgugcucguguaucuggucacuguuaugcauagcaugcaggccggguacuuagagaaagcucaaaaguacacagauaaagcccugaugcagcuagagaagcucaaaaugcuggacuguucucccauccuuuccucauuucaggugauuuugcuggaacacaucauaaugugcaggcucguaaccggacauaaggcaacggcccugcaggagauuagccaagugugucagcuuugccagcaaaguccucggcuguucucuaaucacgcugcccaguugcauacucuccugggcuuauauugcgucuccgugaacuguauggauaaugcagaagcgcaguuuaccacagcucugcgccuaacuaaccaccaggagcucugggccuucaucguuaccaaucuggcaagcguguacauucgagaaggcaacagacaccaagagguccuuuauucguugcuggagaggaucaauccagaccauucuuuccccguguccucacacugccuccgggccgcugccuuuuacguacgugggcuguucaguuucuuccagggacgcuauaacgaagcaaaaagauuuuuaagggagacacugaagaugagcaaugcugaagaucuuaaccgguugaccgccuguucccucguucugcuaggucauaucuucuacgugcugggcaaucaccgagagucuaacaacauggucgugccugcgaugcagcucgccagcaagauuccagacaugucaguccagcuguggaguuccgcucuuuugcgcgaccugaauaaagcaugcgggaacgccauggaugcucacgaagccgcacaaaugcaucagaauuuuagccagcaguuacuccaagaccacauagaggcguguucucugcccgagcauaaccuuaucacguggacugauggaccgccucccgugcaguuccaggcccaaaauggcccaaacacaucacuggcuaguuugcucuga

SEQ ID NO: 58850 - RNA, 1200 nt, Artificial Sequence
  derived and/or modified sequence opt3 from MAVS__Homo_sapiens__NP_001193420
augcccgugcaggagacccaagccccugaaagcccaggcgagaacuccgaacaggcucugcagacacucucuccgagagcaauccccaggaauccugacgggggaccacuugagucaaguagcgaucuggccgcguugucccccuuaacuucuucgggucaccaggaacaagacacggagcugggcucaacccauacagcuggggccacuagcagucuaaccccuucccggggaccagucucucccagcguuuccuuccagccucucgcacgcucaacaccacgagccagucgucugccgggccccaccgguagcgugguaucuacugggacauccuuuucaagcaguucuccuggacuugcuuccgcaggcgccgcugagggcaagcagggggccgaaagcgaucaggcggagccaauuauaugcucgucuggagcagaagcccccgcuaacucccugccuucaaaagugccaaccacguugaugcccgucaauacuguggcccucaagguuccggcaaacccugcuagugugagcaccguccccuccaaacugccaacaucuagcaagccucccggugccgugccaucaaaugcgcugacuaaccccgccccuaguaaacucccaaucaauuccaccagagcaggcaugguaccgagcaagguucccacaucuaugguguuaaccaaggucucagcuaguacggugccuacugacgggagcuccaggaacgaggagacaccagccgcucccaccccugccggagcaacuggcgguucuucggccuggcuggauagcuccucagaaaaucgggggcuuggaagugaguugucuaaaccaggcgugcuggcuagccaagucgacucccccuucucaggcuguuuugaagaucuagcgauuagcgcaucuacaucccucgggaugggaccgugccacgguccugaggaaaacgaguacaagagugagggcaccuucgggauccauguugccgaaaauccaagcauucagcugcuugagggaaaccccggcccucccgcugacccagauggugggccucgcccccaggccgacagaaaauuucaggaaagggaggugccaugucaccggccgucuccuggcgcacugugguugcaaguagccgugacgggaguccucgugguuacccuguuagugguccuguaucgccgaagacuccauuga

SEQ ID NO: 58851 - RNA, 483 nt, Artificial Sequence
  derived and/or modified sequence opt3 from MAX__Homo_sapiens__NP_002373
augagcgacaacgaugacaucgagguggaauccgaugaggaacagcccagauuccaaucugccgcugacaagagggcacaccauaaugcccuggagcggaaacgccgagaucacauuaaggacucauuucauagucuccgugauagcgucccuucccuucagggcgaaaaagcgucuagagcucagauacuggacaaggccaccgaguacauccaguauaugaggcggaaaaaccacacacaucaacaggauauugacgauuugaagcgccagaaugcauuacuggagcagcaaguuagagcccuagaaaaggcuaggucgucagcacagcuccagacuaacuacccaagcagugacaauucccuguauacgaacgccaaagggucuaccaucagcgcuuucgauggagguuccgacucaaguagcgagucugaaccggaggagccccagucccggaagaaacuucgcauggaagccucauga

SEQ ID NO: 58852 - RNA, 1482 nt, Artificial Sequence
  derived and/or modified sequence opt3 from MAZ__Homo_sapiens__NP_001036004
auguuccccguguuuccuugcacccugcucgccccaccguuccccguccuuggccuggacagcagagggguuggagguuugaugaacuccuuuccuccaccccagggccacgcucaaaauccuuuacaggugggggcagagcugcagucuagguucuuugccucacagggaugugcgcaaaguccauuccaggcugcccccgcaccuccaccgacaccccaggccccugcugcagaaccacuacagguagaucuccugcccgugcuugccgcugcccaagagagcgcggcagccgcugccgcagcugccgcggccgcagcugccgucgcugccgcaccuccagcccccgcugcggcauccacuguggacacggccgcucugaagcagccgccugcacccccaccucccccacccccuguuucugccccagccgcugaagccgcaccgcccgcgucggcugccaccaucgcagccgcugccgcaacagcuguggucgccccuacuucaaccguggcgguagccccaguugcuagcgcauuggagaaaaagacaaaaaguaagggccccuacauuugcgcccucugugcuaaagaauuuaagaacgguuauaaucugcggcgccaugaggccauacacaccggggcaaaggcgggacgagugccuuccggcgccaugaaaaugccaacuauggucccccugucucucuuaagcgugccgcagcuguccggcgcugggggagguggcggggaggccggagcaggcgguggggcugccgcaguggccgcuggaggcgucguuacaaccacggcgucaggcaagcguaucaggaaaaaccaugccugcgaaaugugugggaaggcauucagagauguguaccaccuuaaucggcauaaauugagucacagcgacgagaagccuuaucagugcccaguaugucaacagcgcuuuaagagaaaagauaggaugucuuaccacgugcggucccaugacggagcuguccacaagcccuauaacugcucacauugugguaaaucuuucagucgcccugaucaccugaauagccacgugcgacagguucauuccacugaaagacccuuuaagugcgagaaaugugaggccgccuucgcuaccaaggacaggcuacgggcacacacagugcgucaugaagagaaagucccaugccacgugugcggcaagaugcucagcucggccuacauuucugaucauaugaagguacacucccaagggccucaccauguuugugaacugugcaacaaaggauuuacuaccgcggcuuaucuucgcauccacgccgugaaggaccauggccugcaggcacccagagccgauaggauuuuguguaaacucugcucaguccacuguaagacaccagcucagcuggcaggucacaugcagacccauuuagggggcgccgcgccgccugugcccggagacgcuccacaaccccagccuacgugcuga

SEQ ID NO: 58853 - RNA, 1569 nt, Artificial Sequence
  derived and/or modified sequence opt3 from MB21D1__Homo_sapiens__NP_612450
augcagcccuggcacggcaaggccaugcaaagagcuagcgaggcaggggccaccgcgccuaaagcuagcgccaggaacgcacggggagccccaauggacccgacagaaucucccgcugcaccugaggccgcucugccaaaggccgguaaauucggccccgcgcgcaagucagggagucgacagaaaaagagcgcaccugauacucaggaacguccacccgugagagccacgggagcuagggccaagaaagcaccucagcgggcucaagacacccagccauccgaugccacaucugcgccgggcgccgagggucucgaacccccugcagcucgcgagccagcccuuucgagagcugggucaugcaggcagcggggagcccgcuguagcacuaagccccgaccuccacccggcccgugggacgucccuagucccggccugccaguuuccgcaccuaucuuggugagaagggaugccgcucccggggcgucuaaauuacgggcaguacuggagaagcuaaaacucagccgugacgauauuuccaccgccgcuggaauggugaagggugucguggaccaucugcuucugcgcuugaagugcgauucagccuuuagaggcguugggcuccugaauacaggaaguuacuaugaacacgugaaaauaagcgcaccaaacgaguucgacgucauguuuaagcuggaagugcccaggauccagcucgaggaguacucuaauacccgggccuauuacuucguaaaauuuaagcgaaacccuaaagaaaauccauuaucccaauuccuggagggcgaaauucuuucagcuagcaagauguugaguaaauuucgcaagaucauuaaggaggaaaucaacgauauaaaagacacugauguuaucaugaagagaaaaaggggugggucuccggccgugacacugcuaauuuccgagaagaucagcgucgacauuacccucgcacuggagucgaaaucuuccuggcccgcgucaacgcaggaaggacuucggauccagaauuggcugagugcuaaggugcgcaagcaguugagacucaaaccuuucuaucuggugccaaagcaugccaaagagggcaacggcuuucaagaagagacuuggagguuauccuucucccacauagaaaaggagauucugaauaaccaugggaaaucuaagaccuguugcgagaauaaggaagagaaauguugccguaaggacugucucaaacuuaugaaguaccuguuggaacagcuaaaagagcgguuuaaggauaagaaacaccuggacaaguucagcucauaucacgucaaaacagcauuuuuccauguuugcacucagaacccccaagauagucagugggaccgaaaggaucucggacuguguuucgacaauugcgugaccuacuuucuucagugucugagaacagaaaaauuggagaacuacuucaucccugaguuuaaucucuucuccagcaaccugauugauaagaggucuaaagaauuuuuaaccaagcagaucgaguaugaacgcaacaaugaguucccaguauuugacgaguucuga

SEQ ID NO: 58854 - RNA, 1476 nt, Artificial Sequence
  derived and/or modified sequence opt3 from MB21D2__Homo_sapiens__NP_848591
augaagauggccgcucccaccgcaaacaaagccgcgagccuggggugcaauaacaagccugcuuucccagagcucgacuuuagauccggggccaggguggaagaacuuaauaaacugauccaggaguucacaaagcacgaucaacgggaguacgacgaucagcgcgcauuggaaauucauacugccaaagacuuuauauucucuauguuaggaaugguccagaagcuggaucagaagcuaccgguugcuaacgaguaucuccugcuuucagguggcgugcgagaggggguaguggaccuggauuuggacgaacucaaugucuacgcacguggaacggauuaugacauggauuuuacccugcuggugcccgcccucaaauuacacgacagaaaccaaccuguuacacuggauaugaggcauagugcucuuugucacagcugguugucccugcggcuauucgacgagggcacuaucucuaaguggaaagacugcuguaccauuguggaucauaucaauggugccacaaacuacuuuuucucgccaaccaaggucgcggacugguuuuaugauucaauuagcaucgugcucagugaaauacagaaaaagccccagcgcgggaugccuaagguagagaaaguugagaagaauggaacuaucauuuccaucauucugggcgugggcucuagcagaaugcuuuacgacaucgucccagugguguccuucaaaggguggcccgcagucgcccagucauggcugauggaaaaccacuuuugggauggaaagauaacagaggaagagguuauuagugguuucuauuuggugccugcuugcagcuacaaaggcaagaaagacaaugaauggaggcucucuuuugcccgguccgagguacaacugaagaaguguaucucaagcaguuuaaugcaggcauaccaggcuugcaaagccauuaucaucaagcugcucucucgcccaaaagcgauuuccccguaucaccuucgaagcaugaugcugugggccugugauagauugcccgcaaacuaccuagcucaggaggacuaugccgcucauuuccugcucgggcugauagaugaccuucaacacugccuggugaauaagauguguccuaacuacuucaucccacagugcaauauguuggaacaucucucggaggaaaccgucaugcugcacgccaggaaauuaucuuccgugcggucagaucccgcagagcaucugcguacggccauugaacacguuaaggcugcgaaccgccuaacucucgagcugcagagaaggggaaguaccacaagcaucccuuccccacaaucugacggcggugaccccaaccagccggaugaccggcuugcaaagaaauugcagcagcuggugacugagaauccuggcaagagcauaucagucuuuauuaaccccgaugacgugacccgaccacacuuccgcaucgaugacaaauuuuucuga

SEQ ID NO: 58855 - RNA, 1968 nt, Artificial Sequence
  derived and/or modified sequence opt3 from MBD1__Homo_sapiens__NP_001191065
auggccgaggacuggcuggauugccccgcucucggcccuggguggaagagaagggaaguguuccggaaaagcggagcaaccuguggucgcuccgacacauacuaucagucuccaacuggcgaucgaauccguucaaaggucgagcuuacgagauaccuggggccggccugcgacuugaccuuauuugauuucaaacaaggcauucuguguuaucccgcgccuaaggcucacccaguugccguggcaaguaaaaagaggaagaaacccagccggccugccaagacacgcaaaagacagguaggaccacaguccggugaagugaggaaggaggcuccccgggacgaaacuaaagcagauaccgacacagccccugcuucuuuuccagccccggggugcugugagaacugcggaauaucguucucaggcgauggcacccagcgccaacgacuaaagacucucuguaaggacugcagagcgcagaggaucgcauuuaaucgggagcagcguauguucaaacgcgucggguguggagaaugcgccgcuugucaggugacagaggauugcggugccugcagcaccugucugcuucaacugccccaugacguugcaaguggcuuguuuugcaagugugaaagaaggcggugccuccgaauuguggagcgcuccagaggguguggagucugcaggggcugucagacgcaggaggauugcggucacuguccuaucugccugcggccaccccgcccugggcugagaaggcaguggaaaugugugcaacgucggugccuccgaggaaagcaugcuagaaggaaaggcggcugcgacucuaagauggccgcgcgccggagaccaggggcccagcccuuaccgccucccccaccuagccagucccccgaaccaacugagccccacccuagggcacuggcuccaucaccgcccgccgaguucauuuacuauuguguagacgaagaugaacuucaaccuuacaccaaccgccgacagaaucggaaaugcggagcuugugccgcaugcuugcguagaauggacugugguaggugcgauuuuuguugcgacaagccaaaguucggcgggaguaaccagaaacgccagaagugucgguggagacaaugccugcaguuugccaugaaaaggcuacuccccagcguuuggucugaguccgaggauggagcuggcucaccuccacccuaucgacgccggaagagaccgagcagugcgaggcgucaucaccuggguccuacacuuaaaccaacucuggcaacccgcacagcccagcccgaccacacccaggcuccuacgaagcaagaagccgggggcggauucguguugcccccaccuggcacugaucucgucuuucugcgggagggggcaucuucccccguccaggugccaggaccgguggccgcuagcacagaagccuuacugcaggaggcacaguguucgggucucucuuggguuguggcgcuuccucaaguaaagcaggaaaaagcugacacccaggaugaguggacucccggcacagccgugcugaccuccccagucuuggugcccgggugcccuucaaaggcaguugacccaggacuacccagugugaaacaggagccuccggauccagaagaggacaaggaagagaauaaagacgauagcgccuccaagcuggcucccgaagaggaggccggcggugcagggacgccugucaucaccgaaauauucucucucggcggaacaagauucagggacacugcuguguggcugccaagccuucaaggccgacauucagggcgggaggauggaugcaagguaugggaaaccgaggacacaguugagcccaccaguacuuccuggaacccucgcgguuggccgggcacacacgugagccugucucccccuccagccucaaugaugugggucaguuguagaaggagcuggugccccuccucucagucguga

SEQ ID NO: 58856 - RNA, 1236 nt, Artificial Sequence
  derived and/or modified sequence opt3 from MBD2__Homo_sapiens__NP_003918
augagagcccaccccggcgggggaaggugcuguccugagcaggaagagggugaaagcgcugcaggcggguccggagccggcggugacucugcgaucgagcaagggggacagggcucagcucuggccccaaguccggugagcggcguccggcgcgaaggggcacgaggagguggccgugggagaggaagguggaagcaggccggccggggugggggaguuugcggccgcggcagagggaggggacggggucgcggccgagggagaggaaggggccggggucgugggagacccccuuccggcggaucuggccucgggggagaugguggcggguguggaggcggugggucgggcggaggcggggcuccacgcagggagcccgugccuuucccaucaggaagcgcaggucccggcccucgggggccacgagccaccgagaguggaaaacgcauggacugcccggcccuucccccuggcuggaagaaagaagagguaauuagaaaguccggucugucugcugggaaaagcgauguguacuauuuuuccccaucaggcaagaaguucaggaguaaaccccaguuggcgcgguacuuaggaaacacagucgaccugagcucuuuugauuuccgcacuggcaagaugaugccuuccaaacuacaaaagaauaaacagagacucaggaacgacccacugaaucagaacaaggggaagcccgaucuuaauacgacccugccgauacgucagacagcaucaaucuuuaaacaaccugugacuaagguuaccaaccaucccagcaauaaagugaagagugacccacagcggaugaacgaacagccucgacaguuguucugggagaaaagacuccaaggacugucugccuccgaugucacagagcagauuaucaagaccauggaacugcccaaaggccuccaggguguggggccaggaagcaaugacgagacuuuacugucggcuguagccucugcacuucacacauccucagcucccauuaccggccaaguuagugccgcgguggaaaagaacccugccgucugguugaauacgagccagccacuguguaaggcauuuaucgugacugaugaggacauaaggaaacaggaggaacgcgugcagcaaguccggaagaaacuagaggaagcucucauggccgauauccuguccagagcugccgacaccgaggaaauggacauugagauggauucuggugacgaagcauga

SEQ ID NO: 58857 - RNA, 876 nt, Artificial Sequence
  derived and/or modified sequence opt3 from MBD3__Homo_sapiens__NP_001268382
auggagagaaagaggugggaaugccccgcccugccucagggcugggagcgggaagaggugccacgccgaagcgggcucuccgcuggacaccgugacgucuucuacuauucuccgucagguaaaaaguuuagaaguaaaccccaacuugcaagguaccugggcgggagcauggauuuguccaccuucgacuuucggacaggaaagauguuaaugucuaaaaugaacaagucgcgccagagaguuagguaugauucaagcaaucaggugaagggcaaaccugaccugaacacugcccuaccaguacggcagacggcgaguaucuucaagcaacccgugaccaaaauuacaaaucauccuuccaacaaggucaaaucugauccacagaaggcuguggaccagccccgccagcucuuuugggaaaagaaacugagcggucuuaaugccuucgauauagcagaggagcugguuaagacuauggacuugccuaaagggcuccaaggagugggcccaggcuguaccgaugaaacacugcuguccgccaucgcuucagcacuccacaccaguacuaugccgauuacagggcaguuaagcgccgcugucgagaagaaccccggaguguggcugaauaccacgcagccucuuugcaaagccuuuaugguaacugacgaagauauccgaaagcaggaggaguugguucaacaggugagaaaaaggcuggaagaggcgcuaauggcagacaugcucgcccaugucgaggaacuggcucgggauggugaagccccacuugacaaggcaugugcugaggacgaugacgaggaagaugaggaagaggaagaggaggaacccgacccugauccagagauggaacacguguga

SEQ ID NO: 58858 - RNA, 627 nt, Artificial Sequence
  derived and/or modified sequence opt3 from MBD3L2__Homo_sapiens__NP_653215
augggcgagcccgccuucaccagcuuuccuucccugccagugcucgggaagcucaaaagaaacaugaugccgugggcucugcagaagaaaagggaaauccacauggcaaaggcccaucggcgccgagcggcucguucugccuugcccaugagauuaacaucaugcauuuucaggcggccugucacucgcauaagaagucacccagacaaucaaguuaggcggcgcaaaggagaugagcaucuggaaaagccccagcagcuaugugcauaccgaagacuccaggcccugcaaccuugcagcucccagggugaggggucuucgccacuucaccuggaaucaguguugagcauccucgcucccgggacggcaggagagagucuggacagggccggcgcugagcggguacguuccccucuggaaccaaccccgggucgcuuucccgccguggcgggcggaccuacaccaggcaugggcugucagcuucccccuccauuaucugggcagcuggucacucccgcagauauuagaaggcaagcccggcgagugaagaaagcucgcgagagacuugccaaggcauugcaggcugacaggcuggcccggcgcgcggaaaugcuaaccggagguuga

SEQ ID NO: 58859 - RNA, 1725 nt, Artificial Sequence
  derived and/or modified sequence opt3 from MBD4__Homo_sapiens__NP_001263199
augggcaccacagggcuggagagccucucccuuggagacagaggugccgcucccacugugacgucuucagaaaggcuggucccugauccaccgaacgacuugcggaaggaggauguugcaauggaauuagagcgcgugggcgaagacgaggagcagaugaugauuaaacgaaguagcgaaugcaauccccugcuacaagagccuauugccuccgcgcaguucggggcuaccgccggaacagaaugucguaagucuguaccaugcggcugggagagaguggucaaacagaggcucuuugguaagacugcagggcgguucgauguguacuuuauaucgccccagggacugaaauuccgcucaaagagcagucuugccaacuaucugcacaagaauggcgagaccuccuugaaaccugaagacuuugauuucacaguucucucuaagagaggcaucaaaagcagguacaaggacuguuccauggcugcacugaccucacaucugcaaaaccagaguaauaacagcaauuggaaccuccggacucgcucuaaaugcaagaaggauguguuuaugccacccuccucaagcagugaguuacaggaaucucgagggcuguccaauuucacaagcacccaccuuuugcugaaagaggacgaaggagucgaugacgugaacuuuagaaagguaaggaaaccuaaggguaaaguuacgauucuaaagggcaucccaauuaaaaagacuaagaaagggugucggaagucgugcucuggauucgugcaguccgauucaaaacgugagagugucuguaauaaggccgacgcugagagcgaaccgguggcccaaaaaucccagcucgaccgcaccgugugcaucucugaugcgggcgcauguggugagacacugagcgucacuucagaagagaacagucuuguuaagaagaaagaaagaucccugagcucugggucaaauuuuugcagugagcagaagaccagcggaauaaucaacaaauucuguuccgccaaggacucugagcauaaugaaaaauaugaggauacauuuuuggaaucggaggaaauuggcaccaagguggagguaguggagaggaaggaacaccuccauacggacauccugaaacggggcagcgagauggauaacaacugcucccccacucgaaaggacuucacagaagauaccauuccucgcacucagaucgagagaaggaaaacaucauuauacuucaguucuaaguauaauaaagaggcucugagcccaccccggcgcaaggccuuuaagaaauggaccccuccaagaucccccuucaaccucguccaagaaacgcuuuuucacgacccguggaagcuguugauagcaaccauuuuccuaaauaggacaucagggaaaauggcuaucccugugcuguggaaguuucucgagaaauaccccagcgccgaaguugcgcguacugccgauuggcgggacgugucugagcugcuuaagccacugggauuguaugaucuccgagcaaaaaccauugucaaguucuccgacgaauaccugacaaagcaguggaaauacccuaucgaguuacacgguaucggcaaguaugggaacgacaguuacagaaucuuuugcgugaaugaguggaaacagguacaucccgaagaucacaagcugaacaaauaucaugacuggcuaugggagaaucacgaaaagcucagccugucuuga

SEQ ID NO: 58860 - RNA, 4485 nt, Artificial Sequence
  derived and/or modified sequence opt3 from MBD5__Homo_sapiens__NP_060798
augaacggcgggaaggagugcgacggaggugauaaagaaggcgggcugcccgccauccaggugccugucggauggcaaagaaggguugaccagaauggcgugcucuacguaagcccauccgguucucuucugucauguuuggaacaggugaagaccuauuuacugacagaugggacuugcaaauguggacuagaaugcccgcucauucugcccaaggucuucaacuuugacccuggcgcugcagugaaacagcggacggccgaggauguuaaggcggacgaagaugugaccaagcucuguauacacaaacgcaagaucauugcugucgccacacugcauaaaaguauggaggcaccacaccccagcuuggugcucacuuccccuggcgggggaaccaaugccacaccaguaguucccucucgagcugcaaccccucguucggugagaaacaagucacaugaggguaucacuaauagcgucaugccagaaugcaaaaacccguucaagcugaugauuggcaguuccaaugccauggggaggcuguacgugcaagagcuccccggaucucagcagcaggaauuacacccuguguauccacggcaacgccugggcagcuccgagcauggucagaagucacccuuuagagggagucacggaggccuuccuagcccagcuucuuccggcucacagaucuacggggacggaagcauaagucccaggacagauccguuggguucuccugacgucuucacccgguccaaccccggcuuucacggggccccaaauagcucgccuauccaucugaaccgcacgccccuaucuccacccuccguuaugcuccacggaucaccugugcagaguagcugugcgauggcaggccgaacuaauauuccacuguccccgacccuuacaacuaaaucucccguaaugaagaaaccuaugugcaacuucagcaccaauauggagaucccaagagccauguuucaucacaagcccccucaagguccacccccgccuccacccccuucaugugcucugcagaaaaagcccuugacaagugaaaaagauccacucgggauucuggacccuauccccuccaagccagugaaccagaauccggucauaauuaacccuaccagcuuccacucuaacgugcauucacaaguucccaugaugaaugugaguaugccacccgccgucgugccuuuaccaagcaaccugccccucccuacgguaaagccgggccacaugaaucauggaucccacguucagagggugcagcauucugcaucgacuagccuuuccccaucacccgucacaaguccugugcacaugaugggcaccgggaucggacggauugaggcuucuccacagcguagccgcuccucaagcacuucuuccgaucacgguaacuuuaugaugcccccugucggcccgcaagccacaaguagcgggaucaaagugcccccaagaucuccuagguccaccaucggaucaccccggccaaguaugccuagcucgcccuccacgaagucugacggccaucaccaguauaaagacauuccaaauccgcugauagcggguaucagcaacguuuugaauaccccuucaagugccgcauuccccacagcuuccgccgggucuagcuccgugaagucacagccaggccuacugggaaugccccucaaccagauucugaaucaacauaacgcugccagcuuuccugcaaguucucuucuguccgccgcugcgaaagcacaguuggccaaucagaacaagcucgcuggcaauaacagcucgucaucuaguaauuccggggccguagcaggaagcgguaacacugaaggccacucuacccugaacacaauguucccacccacugccaauauguuacugccuaccggggagggacagagcggccgagcugcccuacgcgauaagcucaugucccaacagaaagacgcacugagaaagaggaaacagccgccaacaaccguccuuucauugcugcggcagagucaaauggauagcucugcggugcccaagccuggucccgaccuccugcgcaaacaggggcagggcuccuuuccaaucucaaguaugagccaacuucugcaguccaugucuugccagucgagccacuugucauccaacaguacuccuggauguggcgcuucuaauacggcccuccccugcagcgcaaaccagcugcauuucacagauccauccaugaacucaucuguuuuacaaaauauaccucugagaggggaagccgugcacugccauaaugcuaacaccaauuucguccacagcaacaguccggugcccaaucaucaccuagccggacucauuaaccagauccaggcauccggcaauugugguaugcugagccagucugggauggcucuuggaaacucauugcacccaaauccuccccaauccaggaucaguacuagcucgaccccaguaauuccuaacucuaucguguccagcuacaaccagacaucaagugaggccggcgguucuggccccuccagcucaauugcgauagccgggaccaaucauccggcuaucacuaagacaacgaguguucugcaggacggagucauugugaccacugcagccggcaacccacuccagagccaacugccuaucggguccgauuuucccuucgugggacaggagcacgcuuuacauuuuccaucuaauagcacauccaacaaucaucugccccacccucuuaacccgucauugcucucuagucugcccaucucgcuaccagucaaucagcaacaucugcucaaccagaaucugcuuaacauuuugcagccuagcgccggcgaaggugacauguccucuauaaauaacacccugucaaaucaccaguuaacacaccuccaaagccugcuuaacaauaaccagauguuucccccuaaccagcagcaacagcagcuguugcagggguaucaaaaucuccaggcauuccagggacaguccacuaucccaugccccgcgaacaauaacccuauggccugucuguuccaaaauuuucagguucguaugcaggaggaugcugcccuacugaacaagcggauuaguacccaaccaggccucacggcacugcccgaaaauccgaacaccacacuuccuccauuccaggacacucccugcgaguugcagccucgaaucgauccaucucugggucagcaagugaaagacggcuuagugguagggggacccggcgacgcuagcgucgaugccauuuacaaggcagugguugacgccgcuucaaaagggaugcaaguggucaucaccacagcgguuaauuccacuacccagauaaguccgaucccugcccucagcgcaaugucugcuuuuacggccuccauuggagauccccugaaccuuucaagcgccgugucggcugugauccacggcagaaauaugggugggguagaccaugauggaaggcugcgcaacucucggggcgcaagacuaccaaagaaucucgaccacgguaaaaacgucaaugaaggcgauggguucgaguacuuuaagagugccuccugucacacaagcaagaaacagugggacggagagcagucaccuaggggcgaacgcaaccgauggaaguaugaggaguuccuggaucaucccgggcacauucauuccucuccaugccacgagcggcccaauaacgugagcaccuugccuuuucugccaggagaacagcauccgaucuuacuucccccucguaacuguccaggcgacaaaauacuggaggagaauuucagauacaacaauuauaagaggacuaugaugaguuucaaagaacgccuugagaacacaguggaacggugcgcgcacauuaaugguaacagacccaggcagucccgaggguuuggagagcuguugagcaccgcuaagcaggaucucguccuggaggaacaaucuccuucaaguuccaauagccuagagaacucucugguuaaagacuacauccacuauaauggcgauuucaacgccaagucggugaauggcuguguaccaucacccagcgacgcaaaguccauuaguucugaagacgaucuucgcaacccugacagcccguccucaaaugagcucauccauuaccggccaagaacuuuuaacgugggggaucuggucuggggacagauaaaagguuugaccaguuggcccggcaagcuggugagggaagacgauguucacaauucuugccagcaaagcccugaggaggggaaaguggaacccgagaaguuaaaaacacucacggaaggacuggaggccuauucccguguccgcaagcggaacagaaagucaggcaaacuuaacaaucaucuggaagcugcaauccacgaggccaugagcgaguuggacaagaugucugguaccgugcaccagauuccacagggggauaggcagaugcgaccucccaaaccaaagcggcgcaaaaucuccagauga

SEQ ID NO: 58861 - RNA, 3012 nt, Artificial Sequence
  derived and/or modified sequence opt3 from MBD6__Homo_sapiens__NP_443129
augaacggcgggaaugagagcuccggagccgacagagcugguggccccguggcaaccucugucccuaucggguggcagaggugcguucgggaaggagccgugcuguacauuucaccaaguggcacagagcucagcucccuugaacaaacucgcucuuaucuguugucggaugguacguguaagugcggguuagaguguccgcugaacguacccaaaguguucaauuuugacccucuagcgccagucacccccggaggcgcuggcguggggccugccucagaagaggauaugacaaagcucugcaaccaccgacguaaagcaguugccauggcuacucuguacagaagcauggagaccacauguagucauuccucuccaggagaaggugcaagcccccagauguuccacaccguguccccuggcccaccgucagccaggcccccuugccgggucccacccacuacaccucuuaaugggggaccaggcagucugcccccggagccucccagcgugucucaggcuuuuccaaccuuggccgguccugggggacucuuucccccacgccuggcggaccccguaccuuccggcggcucaagcaguccaagauuccugccgagggggaacgcacccucuccugccccacccccuccacccgcuauaucccucaaugccccgagcuauaacuggggagcagcuuuacggucgucucugguuccuuccgaucuugguucaccacccgccccucaugcgaguagcucucccccauccgacccucccuuguuccacuguagcgaugcccugacgccaccgccucuacccccaucaaauaaccuccccgcacauccuggcccagcuagucagcccccuguguccagcgccacuaugcaccucccgcuuguccuggggccauugggaggcgcucccaccguggaagguccuggggccccacccuuucucgcaucuucacuguuaagugccgcugcgaaggcacaacacccuccgcugcccccaccuagcacacuccagggccgccgacccagagcccaggcuccauccgccucucauucgagcucccuuaggccuucacagcggcguccccgcagaccaccgacuguguucaggcuguuggagggacggggcccucaaacuccccgacgcaguagaccaagggcacccgccccugucccacagcccuuuucucuaccugagccgagccagccaauccugcccuccguucucucacugcuugggcugccuacacccggaccaagccacucugacgguuccuucaauuugcucggcagugaugcucaucugccucccccaccuaccuuaagcucuggguccccgccccagccacggcacccuauucaacccucacugccaggaacgaccaguggcagccuaucguccgugccuggugcccccgcaccgccagcggcuucuaaagccccuguagugcccagcccaguccuccagucacccagugaagggcugggcaugggagcaggcccugccugcccgcuucccccauuggcugggggagaggccuuuccuuuccccuccccugaacagggucuggcacucucuggcgcuggguuuccaggaaugcugggcgcccuuccccugccuuugagccucggucaaccacccccguccccucuguuaaaccacucacuguucggggugcuaacaggcggaggcgggcagccacccccugagccacuccugcccccgccuggaggccccgguccaccucuugcgcccggggaaccagagggacccagcuugcugguugccagucuccugccuccaccgcccucugacuuacugccuccacccuccgcuccuccaagcaaucuuuuggcaucguuccucccccugcuagcccugggcccuaccgcuggugauggcgaggggucagccgaaggagcaggcgggccgucuggagagccauuuaguggccucggugaccugagcccccuuuuguucccuccccuguccgcgccaccuacuuuaaucgcccucaacucugcucugcuugccgcaacacuggaucccccaagcgggaccccgccucagcccuguguguuguccgcuccacagcccggaccuccaacgucaagugucaccacagccacuaccgaccccggcgcaagcucucucgguaaggccccuuccaauucaggccgcccgccacaacugcuaaguccccugcucggggcuagccugcuuggagacuuguccucucugacaucgagcccuggcgcguuaccaucacuccugcagcccccugggccccuucuguccggacagcuaggccuccagcuguugccaggugggggagccccgccuccccugagugaagcaucuagcccauuagcuugccuccugcaaucccuucagauuccucccgagcagccagaagccccuugucugcccccggagucaccagccucugcuuuggagccugaacccgcaagaccaccccucagcgcccuggcgccuccgcauggcaguccagaucccccugugcccgagcuacugacugguaggggcuccgggaagcguggacggcgaggcgggggaggccuuagagguaucaacggggaagcuaggccagcccgcggacggaaaccuggcagcagaagggagcccggccgccucgcacugaagugggggacccgaggagguuuuaacggccagauggaacggucuccacguagaacacaccauuggcaacacaauggggaguuggccgagggaggcgcugaaccuaaagacccgcccccaccugguccccauucagaggaucugaagguaccaccugggguugugaggaaaucccgccggggaagaaggcgaaaguacaaccccacccgcaauaguaacagcucgcggcaggacauaacuuuagaaccgucuccaacggcaagagccgcggucccucugcccccaagggcucgucccggccgcccugccaagaauaaacggagaaagcuggcacccuga

SEQ ID NO: 58862 - RNA, 465 nt, Artificial Sequence
  derived and/or modified sequence opt3 from MB__Homo_sapiens__XP_005261662
augggccugagcgacggggaguggcagcucgugcuuaacgucuggggaaagguugaagccgauauccccggucacggccaagaggugcugauuagauuguucaaagggcauccugaaaccuuagagaaguuugacaaauucaagcaccugaaauccgaagaugagaugaaggcuucugaggaccuaaagaaacauggagcaacaguacucacugcccugggcgguauacuuaagaaaaaggggcaccaugaagcggagaucaaaccacuggcucagucacacgccacgaagcacaagauuccggugaaauacuuggaauuuaucagugagugcauuauccagguccuccagagcaagcaucccggagauuucggcgcagacgcccaaggcgcuaugaauaaagcacuggagcuguuuaggaaggauauggccuccaacuauaaagaacucggguuccagggauga

SEQ ID NO: 58863 - RNA, 1032 nt, Artificial Sequence
  derived and/or modified sequence opt3 from MBIP__Homo_sapiens__NP_001138363
auggccgcugcaaccgagcugaacagacccagcuccggcgacaggaaucucgaacggcgcugccgaccuaaccuuucucgugaggugcuguacgaaaucuucagaucauugcacacauuagucgggcagcuggaucuaagggacgauguugugaagauuacuauagacuggaauaaacuccaaagucugagcgccuuucagccagcgcuucuguucuccgcuuuggagcagcauauccucuaucugcagccguuucuggccaagcuccaaucucccauuaaagaagagaacacgaccgcaguagaggaaaucggacggacagagauggguaauaagaacgaagugaaugauaaauucucgauuggcgacuuacaggaggaggaaaagcacaaggagucagaucugcgcgacgucaaaaagacucagauccauuuugauccugaagugguucagauaaaagccgggaaggcugagaucgacagaaggauuagcgcauucaucgaacggaaacaagccgagauuaacgagaauaacgugcgcgaauuuuguaaugucaucgauugcaaccaggagaauaguugugcucgaaccgacgccauauucacaccauaccccggauuuaagucccacgugaagguaucuagaguugugaacaccuauggcccucagacuaggccagaagguauucccgggagcggacauaaaccuaauuccaugcuucgggauugcggcaaccaggcggucgaggaacguuugcaaaacaucgaggcacaccuacgccugcagacaggcgggccagugccgagagacauuuaccagaggaucaagaaacucgaggacaagauccuggaacuugagggaauuucacccgaauauuuccaaagugugagcuuuucugguaaacggcgaaagguccagccuccacagaauuacucccuggccgaguuggaugagaaaauaucagcucucaagcaggcccuguuacgcaagagcagagaagcagagaguauggcuacccaccaucugcccuga

SEQ ID NO: 58864 - RNA, 747 nt, Artificial Sequence
  derived and/or modified sequence opt3 from MBL2__Homo_sapiens__XP_011538118
augagccuguuccccucccucccucuucuguuguuaucuaugguggccgcuucauacagugagacugucacaugcgaagacgcacagaagacuuguccagccguuaucgcgugcagcuccccgggcauuaacggguuucccggaaaagaugguagagacggcacgaagggggagaaaggagaaccuggccaaggucugagggggcuacagggaccacccggcaagcucggcccuccagggaaucccggaccuucugguucgccaggcccgaaagggcagaagggagaucccggcaagucaccugacggugauagcagucuggcugccuccgagcggaaagcacuucagaccgaaauggcccgcauaaagaaauggcugacauucucuuuggggaagcaagugggaaacaaauuuuuccucacuaauggcgagaucaugaccuuugagaagguaaaggcucugugugugaaauuccaggcaagcgucgccacaccacgaaacgcugccgaaaauggcgcgauucagaaccugaucaaggaggaagcauuucucgggauuaccgacgagaaaacugagggacaguucguggauuuaacagguaaucgucugaccuauacgaacuggaaugaaggcgagcccaacaaugccggguccgacgaagauugcguucuuuugcugaagaacggacaauggaaugacgugccuuguucaaccagucaccuagcugucugcgaguuuccaaucuga

SEQ ID NO: 58865 - RNA, 1149 nt, Artificial Sequence
  derived and/or modified sequence opt3 from MBNL1__Homo_sapiens__NP_066368
auggccgugagcgucacccccaucagagacacaaaguggcugacucucgagguuugcagggaguuccagcggggcacguguucccgcccugauaccgaaugcaaauuugcucacccaucuaagucaugucaaguggaaaacgggcgaguaauugcaugcuucgacagucuuaaaggacguuguagcagagagaauugcaaguaccugcauccgcccccucacuugaaaacacaguuagaaauaaacgguaggaauaaccugauccagcagaagaauauggccaugcuagcgcaacagaugcagcucgcuaacgccaugaugccaggcgcaccccugcagccugugccaauguuuuccgucgcccccucucuugcuacuaaugcaucggccgcugccuucaacccuuaucuggggccagugucaccgagcuugguucccgcggagauucucccuaccgcaccaaugcuggugacaggaaaucccggcgucccugugccagccgcugccgcagcugccgcgcaaaagcugaugcggaccgaucgccucgagguauguagagaauaccagagggguaacugcaaucgcggggagaacgacugucgguuugcccaucccgcagauaguacuaugaucgacacaaaugauaacaccguuacggugugcauggacuauauuaaaggacgauguuccagagaaaagugcaaauacuuccacccgccugcucauuuacaggccaagaucaaagcugcccaguaucaagucaaucaggcagccgcugcgcaggcagccgcuacugccgcagccaugggcauaccccaagcugugcugccaccucuucccaagaggccagccuuggagaagaccaacggcgcaacagcgguguuuaacacugggaucuuccaguaccagcaggcucuggccaauaugcaacuacagcagcacaccgcauuucugcccccuggaucuauucucugcaugacaccagccaccagcgucguuccgauggugcacggugcuacgcccgccacuguauccgcagcuacaaccucagccacaagugugccuuucgcggccacugcuaccgcaaaccagaucccaauuaucagcgccgagcaucuuacgucucacaaauaugucacccaaauguga

SEQ ID NO: 58866 - RNA, 1104 nt, Artificial Sequence
  derived and/or modified sequence opt3 from MBNL2__Homo_sapiens__NP_659002
auggcccugaacguggcucccgucagagacaccaaguggcucacacuugagguuugcaggcaguuccaacggggcacuuguagccgcuccgaugaagagugcaaauuugcacacccuccaaagucuugucagguggaaaaugggcgaguaaucgccugcuucgacucacugaaaggacguuguaguagagagaacugcaaguacuugcauccgcccacgcacuuaaaaacccagcuggaaauuaaugguaggaacaaucuaauacagcaaaagacagcggcugccaugcucgcacagcagaugcaguuuauguucccuggcacuccacugcaucccgugccuaccuuuccagucgggcccgccaucggaacaaacaccgcuauuagcuucgcaccuuaucuugccccagugacuccgggcguuggucuggugcccacagagaucuugccuaccacgccagucauugugcccggguccccuccaguaacuguucccggaucuaccgcuacacaaaagcuccugcggacugauaaacuggaggugugucgcgaauuucagagaggcaauugcgccaggggcgagaccgacugucgguucgcgcacccggcagauucgacaaugaucgacaccucagauaacacggucacugugugcauggacuacauaaaggggcgcuguaugcgagaaaaaugcaaguauuuucauccucccgcccaccuccaggcuaaaaucaaggccgcacagcaccaagcuaaucaggccgcgguggccgcacaggcugccgcugccgcagccacagucauggcuuucccaccuggagcguuacauccccugccaaagagacaagcacuugagaaaagcaacgguaccagugccguuuuuaaucccuccguguugcacuaccagcaggcucugacuucugcccagcuacaacagcaugcagccuucauuccuacaggcagcguacucugcaugaccccagcuacguccaucgugccgaugaugcacucagccaccagugcaacagucagcgcggcuacuacccccgccacaucugugccuuuugcagccacugcuaccgccaaccagauuauccugaaguga

SEQ ID NO: 58867 - RNA, 1488 nt, Artificial Sequence
  derived and/or modified sequence opt3 from MBOAT1__Homo_sapiens__NP_001073949
auggccgcugagccccagccuagcucccugucuuacagaaccacaggcucaacuuaucuccacccacuuagugaacuguuggggaucccguuagaccaagugaacuucgucguuugccagcugguggcacuauuugccgcguucugguuuaggauuuaccuccggcccggaacgaccagcuccgauguacgccaugcuguggccacaauauucgguaucuauuuugucauuuucuguuuuggcugguacucugugcaccuguucguucuugugcugaugugcuaugcaaucauggucacugccucggugucaaauauucaucgauacagcuuuuucguagcuaugggguauuugaccaucugucacauaagucguaucuacauuuuucauuacggaauccucacaaccgacuucuccggcccucugaugauuguuacucagaagaucacaacccuggcauuucaggugcacgauggucucgggagaagggccgaggacuuaucugcugaacaacaccggcuggccauaaaagucaagccauccuuccuugaguauuuguccuaccugcuaaacuucaugucagugauugcgggacccugcaauaacuuuaaagauuauaucgcauucauugaaggcaagcauauccacaugaaacuccuggaggugaauuggaagcgcaagggcuuucauagucuuccugagccaagccccacgggggccgucauccacaaacugggaauuacuuugguuucucuccuguuauuccugacccucacaaagacuuuuccugugaccugucuuguagacgauugguucgugcacaaagcuagcuuuccagccagacugugcuacuuguaugucgugaugcaggcaucaaagccgaaauacuauuucgcuuggacacuagccgacgcgguuaacaaugccgcagguuuuggcuucagcgggguggauaagaacggaaauuuuuguugggaccugcucaguaaccugaauauauggaagaucgaaaccgcuacgucuuucaaaauguaccuugagaacuggaauauucagacugccacauggcugaagugcgucuguuaccagagggugcccugguauccuaccguauugacuuuuauccucuccgcucuguggcauggcguuuacccagguuauuacuucacauucuuaaccgggauacuggugacgcuagccgcacgggccguccgcaacaauuaucgacacuacuuucucagcucgagagcucugaaagcgguguaugaugcaggaaccugggccgucacacaacuugcugugucuuacacuguugcccccuucgugauguuggcaguagaaccuaccauuucccuguacaagucaauguauuuuuaccuccauaucaucagucugcuuauuauccuguucuugccaaugaaaccccaggcccacacacagaggcggccgcagacucucaacagcauuaacaagcguaaaaccgacuga

SEQ ID NO: 58868 - RNA, 1563 nt, Artificial Sequence
  derived and/or modified sequence opt3 from MBOAT2__Homo_sapiens__NP_620154
auggccaccacaagcacuacgggcuccacccugcuccagccccuuucuaacgcugugcaacugccuaucgaccaggucaauuucguugugugccaguuguuugcauuacuggccgcgauuugguucagaacauaccuacacucaaguaagacuagcuccuuuauaaggcauguaguggcuacccuccuggggcuuuaucuggccuuguucuguuuuggaugguacgcacuccacuuccugguccagucugguaucucguauugcauuaugaucauuaucggcguggagaacaugcauaauuacuguuuuguuuucgcccugggguaucucacagugugccaagucacccggguguacauauuugauuauggacaguacucagcugacuucagcggcccaaugaugaucauuacucagaaaaucacaaguuuagcaugugaaauucacgaugguauguuucgcaaggacgaggaacugaccuccucucagcgagaucuugccguacguagaaugccgagcuugcuggaguaccuauccuauaacugcaauuucauggggauccucgcuggaccccuguguucauacaaagacuauauaacguuuauugaaggcaggaguuaccauaucacucaaagcggcgagaacgggaaggaggaaacccaguaugagcggacagaaccuucuccaaauacugccguugugcagaaacuucuggucugcggauugucccuccuguuccacuuaaccauuuguacaacccugcccguggaguacaacaucgaugagcacuuccaggcgacggcaucauggccuacuaagaucauuuaucucuacauaagccuucuggccgcucgcccaaaguacuauuuugccuggacauuggcagacgcuaucaauaacgccgcggguuucggcuuuagaggguacgaugaaaauggagccgcaaggugggaccuaauuaguaaccugcggauccaacagauagagaugucuaccuccuucaaaauguuucucgauaauuggaacauucagacugcucuguggcuuaagcgcgugugcuaugaacgaacaucauucucgcccaccauccaaacguuuauccugucugccauuuggcauggcgucuacccugguuauuacuugaccuuccucacagggguucugaugacuuuagcugccagagcaaugaggaauaacuuucggcacuauuucaucgagccaucccagcugaaacuauuuuacgacgugauuaccuggauaguaacacagguggccaucucauacacugucgugccguucguucuccugaguauuaagcccagccuuaccuuuuauuccucuugguacuauuguuugcauauccugggaauccucgugcugcuucuguugccugucaaaaagacacagcgucgcaagaacacccacgaaaauauucaacucagccagagcaaaaaguucgaugagggcgagaacagucugggccaaaauuccuucagcacuacgaacaaugugugcaaccagaaucaggaaauagcuucuagacacucaaguuuaaaacaguga

SEQ ID NO: 58869 - RNA, 1308 nt, Artificial Sequence
  derived and/or modified sequence opt3 from MBOAT4__Homo_sapiens__XP_011542911
auggaguggcuguggcuguucuuucuucaccccaucagcuucuaccagggcgccgcuuuuccuuucgcacuguuguuuaacuauuuaugcauuauggacuccuucucuaccagagccagguaccuguuucuacucacagggggaggugcgcuggcuguggccgcaaugggcucauaugccguccuuguuuucacuccagcugugugugcaguagcccuguugugcagucucgcuccgcaacaggugcaucgguggacguuuuguuuccagaugagcuggcagacccugugccaccuggggcuccauuacacagaauauuacuuacacgagcccccuuccguccgcuuuuguauaacucugucuucgcuuauguugcugacccaacgagugacaucacuaagccucgauaucugcgaaggaaagguuaaagccgcgaguggcgguuuccguuccagaucuagccuguccgagcauguguguaaggcacuuccauauuuuucauaccuguuguucuuccccgcccuccucgggggaaguuuaugcagcuuucagagguuccaggcucggguccaggggucuuccgcccugcacccucgccacucauuuugggcacucagcuggagaggccuucaaauucugggcuuggaaugucuaaauguggcuguaaguaggguuguggacgccggagcgggucugaccgauugccagcaguucgaguguaucuacgucguguggacuacagccggccucuuuaaacugaccuauuacucucauuggauucuugacgauucccuguugcacgcagcuggguucggaccagagcucggccagagccccggugaagagggguaugugccugacgccgauaucuggacgcuggaacggacucaucgcauaucggucuuuucucgaaaguggaaccaauccaccgcuagaugguuaaggcggcugguuuuccagcacucacgugccuggccacuacuccagacauuugcauucagugccugguggcacggacugcauccgggccaaguguuuggcuucguaugcugggcugugauggucgaggcggacuaccuuauccacagcuuugcaaaugaguucauucgcuccuggcccaugagauuguucuauaggacucugaccugggcccauacacagcucaucauugcuuacaucaugcuggccguggaaguucggucucuuagcucacugugguugcucugcaacaguuauaauuccguguuuccuauggucuacuguauacuguuacugcuacucgcaaaacgaaagcacaagugcaacuga

SEQ ID NO: 58870 - RNA, 594 nt, Artificial Sequence
  derived and/or modified sequence opt3 from MBP__Homo_sapiens__NP_001020252
auggccagccagaagagacccucccaaaggcacggcucuaaguaccuggcuaccgcaucaacaauggaccaugcccggcacggguuccucccucgccaucgagauacuggaauccuugacaguauugguagauuuuucggcggggaucguggagcgccaaagaggggcagcgguaaagugccguggcugaagcccgggcgguccccuuugccaucucacgcucgcucgcagcccggauuaugcaacauguauaaagacucacaucacccugccagaacggcacacuacggcagccugccacagaagagucauggcaggacccaggaugagaaucccgucguucacuuuuucaagaacauagugacaccucggacuccaccgcccucccaagggaaaggacgcggucuaucucucagccgauuuuccuggggcgccgaagggcagagaccuggauucggcuauggugggagggcuucagacuacaagagugcacauaaaggauuuaagggcguagaugcccagggcacccugagcaaaaucuucaaacuugggggacgggacucucguuccgguucaccaauggcucgcagauga

SEQ ID NO: 58871 - RNA, 1956 nt, Artificial Sequence
  derived and/or modified sequence opt3 from MBTD1__Homo_sapiens__XP_005257525
auggagaacaccaaggaccugacagaacacagcuccagaucugagaggaaacggcgcgauucauucggcauguuugacggguacgauaguugcagcgaagacacuuccucuucgucaagcagugaggaauccgaggaggaaguggcccccuugccuucuaaucuuccaaucauuaagaacaauggacaggucuauacguacccggaugguaaaagcggcauggcuaccugugagaugugcgggaugguuggagugcgagacgcauucuauuccaagacaaaacguuuuuguucaguaaguugcagcagaucuuacuccucaaacagcaagaaggccaguauacuggcgagguugcaaggcaaacccccuacuaagaaagcuaagguguuacagaaacagccacuggucgccaagcuagcagccuaugcucaguaccaagcaacccuccagaaucaggccaagacaaaagcugccgugucuauggaagguuucuccugggggaacuauaucaauagcaacucguuuauugcggcacccguuaccuguuucaagcaugccccuaugggaacuugcuggggcgauaucucugagaaugugcgggucgaggugccaaacacagacuguucccugcccaccaaaguauuuuggauugcuggcaucguuaaacuugccggguacaaugcacuguugcgcuacgaaggauucgagaacgauucaggucucgacuuuuggugcaauauauguggcagugauauccacccugugggguggugcgcugccagcggaaagccacuggucccgcccagaacgauucagcauaaguauacuaacuggaaagcguuccuggugaagaggcucaccggcgccaagacauuaccuccagacuuuucccaaaaagugucugaaagcaugcaguaccccuucaagccuuguaugcgggucgagguuguggauaaacgccaccugugccgaacuagaguagcaguggucgaaucagugaucggugggaggcuucgguugguuuaugaggagagugaagaccguaccgacgauuuuuggugccauaugcacuccccacugauucaccauaucggauggagccgcucuauaggccacagauucaagaggucagacauuaccaaaaagcaggauggccauuucgacacacccccgcaccuauuugcuaaggugaaagaggucgaucagaguggggaaugguucaaggagggaaugaaacucgaagccaucgacccucugaaucuuagcacgauuuguguggcuacuauccggaagguacuggccgaugguuuucucaugaucggcauugacggguccgaggcagccgauggaucugacugguucugcuaccacgcuacaucgcccagcauauuuccaguuggcuucugugagaucaacaugauugaacucaccccuccccgagguuauacuaaacugccauuuaagugguucgauuacuuacgcgagacaggguccaucgcggcacccgugaagcuguuuaacaaagacgucccuaaucauggcuucagagugggaaugaagcucgaagccgucgaccuuauggagccaaggcugauaugcguggcuaccguuacgcggauuauccaccgcuugcuaagaauccauuuugauggcugggaagaggaguaugaccaauggguggauugugaaucaccggaccuguaccccguaggguggugccagcucaccggauaccagcugcaaccuccagccagucagucuagcagggagaaccaguccgcaucaagcaaacagaagaaaaaggccaagucucaacaguauaaaggucacaagaaaaugacaacucuucagcugaaggaagaguugcucgauggcgaggacuacaauuuccugcagggggcuuccgaucaagaaaguaacggaagcgccaauuuuuauauuaaacaggagcccuga

SEQ ID NO: 58872 - RNA, 3159 nt, Artificial Sequence
  derived and/or modified sequence opt3 from MBTPS1__Homo_sapiens__NP_003782
augaagcuggugaacaucuggcuccuucuguuggucguuuuacugugcggcaaaaagcaccuaggggacagacucgagaaaaagagcuucgaaaaagcccccuguccuggaugcucccaucugacccuuaagguggaguuuucuucaacaguaguggaauacgaguauauugucgcuuucaaugguuacuuuacugcaaaggccaggaacaguuucauaagcuccgcgcugaaaucuucggaaguggauaauuggcggaucauuccacgcaacaauccgucaagcgacuaucccagugauuuugagguuauccagauuaaggagaaacaaaaggcuggcuugcucacgcuggaagaccacccuaacaucaaacgagugaccccacagcguaaggucuucagaucccugaaguacgccgagucugaucccacagugccuuguaaugaaacuagguggagccagaaauggcaguccucacggccacuccgcagagcaaguuuaagccuggggucuggauuuuggcaugccaccggcaggcacuccucacggcgccuuuugcgagcuauacccagacaaguagcacagacacugcaggccgacguucuauggcagauggguuauaccggggcuaacgugagggucgccguguucgauacuggacucagcgagaagcauccucacuuuaaaaaugugaaggagcggacaaacuggaccaaugaacguacgcuggacgauggccuuggccacgggacuuucgucgcgggaguuaucgcaaguaugcgcgagugccaagguuuugccccagacgcugaacugcauauuuucagaguguuuaccaacaaucagguaucuuacacauccugguucuuggaugccuucaacuaugcaauccucaaaaagauugacgugcugaauuuaagcaucggcgggccggauuuuauggaccaccccuucgucgacaaagugugggagcugacugcuaacaacguuauaauggugucggccauuggaaaugauggcccucucuacgguacccuuaacaauccagcggaccagauggaugucaucggggugggaggcauugacuuugaagauaacaucgccagguucucuucccggggcaugacaaccugggagcugcccgggggauacggucgaaugaagccugacaucguaacguauggcgcagggguucgcggaucaggcgugaaggguggguguagagcuuugaguggcacuagcgucgccuccccaguggucgcuggagccgugacacuacugguuucuaccgugcagaaaagggagcucguaaaucccgcaagcaugaagcaagcccugauugcuucagcgcggcgccuuccgggcgucaacauguuugaacaggggcauggaaaacuggauuugcucagagcauaccagauacugaauaguuauaagccucaagccuccuuaagccccucuuacaucgaccugacugagugcccauauauguggccuuacuguucacagcccauuuauuacgguggcaugccaacagugguuaacgugaccauccuaaaugggaugggagucacgggcaggauaguggauaaacccgacuggcagccuuaccucccacagaacggugauaauauugaaguagcuuucaguuauagcuccgugcuguggccguggucuggguaccuugccaucucgaucagcguuaccaagaaggcagccuccugggagggcauugcucaaggacacgucaugaucacaguggccucacccgcagaaacugagaguaaaaacggcgcggagcagaccucuacagugaaguugccuauuaaagucaagauaaucccaacucccccucguagcaaacggguucugugggaccaguaucacaaucuccgauacccacccggguauuuuccgagagacaaccugaggaugaagaaugauccucuugacuggaacggagaucauauucacaccaacuuccgcgacauguaccagcaucugcgguccauggguuauuuuguggaaguguugggcgcuccauucacaugcuuugaugccucacaauacgggacccuccugaugguagacagcgaggaagaguacuuccccgaagagaucgcaaaguuaagaagggaugucgacaauggacugucucuagugaucuuuuccgauugguauaacacgaguguuaugcgcaaagugaaguucuacgacgagaauacucgacagugguggaugccugauacaggcggugccaacauucccgcucucaaugaacugcuuagcgucuggaacaugggguucucugacggcuuguaugagggagaauuuacccuggccaaucacgauauguacuaugcauccggcuguucaauagcuaaauucccagaggacggggugguuaucacucagaccuuuaaggaccagggacucgaggugcugaaacaagaaacagccguagucgagaacgugccuauuuuaggccuguaccagauccccgcggaaggugggggacggauugugcuuuauggcgauaguaauugcuuggacgauagccaucgucagaaggacuguuucuggcuccuggaugcccuacugcaguacaccucguacggugucacuccaccgucccucucucacagcggcaacagacaaaggccucccucaggggcuggaaguguuacaccagagcgcauggaaggcaaucaccuucaucgguauuccaaggugcuugaggcacacuugggggaccccaaaccuagaccacugcccgccugcccuagguuaucuugggcuaagccgcagccacucaacgagacggcccccagcaaucuguggaaacaucagaagcugcuguccaucgauuuggacaaaguagugcucccuaacuuucgaucaaaucgcccacaaguccggccccugagcccuggagaaaguggcgcaugggauauaccgggugggaucaugcccggaagauacaaccaggaggugggccagaccauuccaguuuucgcguuucuaggugccauggugguccuggcuuucuuugugguucagaucaacaaggccaaaucuaggccuaagcgucgcaagccccgggugaaaagaccacaacucaugcagcagguccacccucccaagacuccauccguauga

SEQ ID NO: 58873 - RNA, 1560 nt, Artificial Sequence
  derived and/or modified sequence opt3 from MBTPS2__Homo_sapiens__NP_056968
augauccccgugagccuggucguugugguagugggcggguggaccgucguguaccucacagaccuuguucugaaguccucuguguauuucaaacacucauacgaggauugguuggaaaacaauggauuaaguauuagcccuuuucauauaagauggcagacugccgucuucaacagggcuuuuuauuccuggggucggcgcaaggcacgaaugcuguaccaaugguucaauuuuggcaugguguucgggguaaucgccauguuuucuucguucuuucuacucggaaaaacgcugaugcagacccuugcgcagaugauggcugacucaccaagcaguuauuccucuagcuccucaaguucuagcuccucaagcaguucuuccagcucgucuuccucaaguagcuccucucugcacaacgagcagguuuugcaaguggucgugccgggcauuaaucuccccgugaaccagcugacauacuucuuuacugccguccugaucagcgguguugugcaugaaauugggcacggaaucgcagccauacgugagcagguaagauucaauggcuuuggcaucuuccucuucauuaucuauccuggggcuuuuguggauuuauucaccacacaucugcagcuuauuucaccaguccaacaguugaggaucuuuugcgcaggaauauggcacaacuucgugcuggcccuacucgguauucuggcucuuguucuguugcccgugauccuccugccuuuuuacuacaccggcgucgggguguuaauuacugaaguagccgaggacaguccagcgaucggaccccggggccuguucguuggugaucucgugacacaccuucaggacuguccugucaccaaugugcaggauuggaacgagugccuggacacgaucgcauaugaaccacaaauuggguacuguauauccgccagcacuuugcagcagcuaucuuuuccgguccgcgcuuauaagagacuggauggaucaaccgagugcuguaauaaccauagucucacagacgugugcuucagcuacaggaauaacuuuaauaaacggcugcacacuugucuucccgcccgcaaggcaguugaagcuacccaagugugccgaacaaacaaggauuguaaaaaguccucuucgagcuccuucugcaucauuccuucacuggagacccauacgagauugaucaaaguaaagcacccaccccagauagacaugcucuaugucggccacccucugcauuuacacuacacugugaguauuacaucuuuuaucccaagguucaacuuucugagcaucgaucuacccguuguggucgagaccuucgugaaauaucucauuucccugucaggcgcccuugcgaucguaaaugccgugccguguuucgcauuggacgggcaguggauucugaacagcuuucucgacgcuacucugacaucuguuauaggagauaaugacgucaaggaucuuaucgguuucuuuauucuguugggcggguccgugcuccuggccgcuaacgugaccuuaggacuguggauggucacggcccgguga

SEQ ID NO: 58874 - RNA, 954 nt, Artificial Sequence
  derived and/or modified sequence opt3 from MC1R__Homo_sapiens__NP_002377
auggccgugcagggcagccaaagaaggcugcucgggucccuuaacucuacccccacagcuaucccucagcugggauuggcagccaaucagacuggugcgcggugcuuagaggucucaauuagugacggccuguuccuaagccucgggcugguuucccuuguggaaaacgcucugguaguggccacgauagcaaagaaucgcaacuugcacucuccaauguacuguuuuaucugcugucucgcccugucggaucugcucgucucaggaagcaauguguuagagaccgcuguuauucugcuuuuggaagcaggcgcccugguggcucgagccgcgguccuacagcaacucgacaacgugaucgauguaauuacaugcaguuccaugcugucuagccuuuguuuccugggugcaaucgccguugaccguuauauauccaucuuuuacgcuuugagauaucauucaauugugacucucccgagggcccggcgcgcagucgcugccaucuggguggcgaguguggucuucagcacccuguuuauugccuacuaugaucacguugcaguguuacugugccucguaguguucuuucuugcuaugcuggucuugauggccgugcuauacguucauaugcuggcuagagccugucagcacgcacaggggaucgccaggcuccauaaacggcagcgccccgugcaccaaggauucggccugaagggcgcugucacacuuaccauacuguuggggaucuuuuuccucugcuggggaccauuuuuccugcacuuaacucugauugugcuauguccugagcaucccacaugcgguuguauuuuuaaaaauuucaaccucuuccuggcgcuuaucaucugcaaugcaauuauagacccuuugaucuaugccuuucacucucaggaacugcgaagaacccucaaggagguacugacgugcuccugguga

SEQ ID NO: 58875 - RNA, 894 nt, Artificial Sequence
  derived and/or modified sequence opt3 from MC2R__Homo_sapiens__NP_001278840
augaagcacaucauuaacagcuacgagaauauaaacaauaccgccagaaacaauuccgacugccccagggugguccugccugaagagaucuucuuuacaauuucuaucguuggcgugcucgaaaaccuuauuguacuguuggcuguguucaaaaauaagaacuuacaggcaccaauguacuuuuucaucuguucacuggccauaagugauaugcuagggagccucuauaaaauccuggagaauauucuuaucauucugcggaacaugggauauuugaagccgcgcgguuccuuugaaacuacggcggacgauaucauagacucucucuucguccugucgcugcucggcucaauuuuuagcuuaagugugaucgcugccgaucgauacauuaccaucuuccaugcacugcguuaucacuccaucguuacaaugagaaggacuguggucgugcuuaccguaauuuggacauuuugcaccgggacuggaauaacaaugguuaucuucucucaucacgugcccaccgucauuacguuuacuagcuuguucccucugaugcuaguguuuauccucugucuguacgugcauauguuccuucuggcccggucccacacccgcaaaauaucaacauugccaagagcuaauaugaagggcgcaauuacucucaccauccuguuaggugucuucaucuuuugcugggcccccuucguucugcacgugcuccuuaugacauuuuguccuaguaacccauauugcgcuuguuacaugagccuguuccaaguaaaugggauguugauuaugugcaacgccgugaucgaccccuuuauuuacgcguucaggucuccugagcuacgggaugcauuuaagaaaaugauauucuguucccgcuauugguga

SEQ ID NO: 58876 - RNA, 972 nt, Artificial Sequence
  derived and/or modified sequence opt3 from MC3R__Homo_sapiens__NP_063941
augaacgccagcugcugucugcccuccgugcagccuacccucccaaauggcucugagcaccuucaagcuccguucuuuucaaaccagaguagcuccgcauucugcgaacaggucuuuaucaagcccgagguuuuccugucuuuggggauugugucguuacuggaaaauauccuaguaauacucgccguggucagaaacggaaaucugcauucaccuauguacuuuuuccuuuguagccuggcgguggcugacauguugguuaguguguccaacgcccucgagacaauuaugaucgcaauuguccacucugauuaucugacuuuugaagaccaguucauccaacauauggauaauauauuugacagcaugaucugcauuucccugguggccucaaucuguaaccucuuagcuauugcaguagauagguacguuacgaucuucuaugcccugcgguaccacaguauaaugaccgugcgcaaagcucuuacauugauugucgccaucugggugugcuguggugugugcggcgucguuuuuauuguguauagcgagucuaagaugguaaucgugugucugaucacuauguucuuugcgaugaugcuacucauggggacccuguacguccauauguuccuuuucgcacgacugcacgugaaacguauugccgcuuugccacccgccgacggaguugcaccucagcagcacuccugcaugaagggcgcugugacaauaaccauccuccugggugucuuuauuuucuguugggccccauuuuucuuacaucuggugcucaucauaacuugccccacaaauccuuauugcauuuguuacaccgcgcacuuuaacacguaccuuguacugaucaugugcaauucaguuaucgauccauugauuuaugccuucagaagccuagagcugaggaacacuuuucgggaaauccucugugggugcaauggaaugaaccugggcuga

SEQ ID NO: 58877 - RNA, 999 nt, Artificial Sequence
  derived and/or modified sequence opt3 from MC4R__Homo_sapiens__NP_005903
auggugaacagcacccacagaggcaugcauacaucccugcaccucuggaauaggucuucauaccggcuucauaguaacgccagcgagucccuggggaagggauauucugacgguggcugcuacgaacaguuguucgucucgcccgagguuuuugugacuuuagggguaaucucacugcuagaaaauauucucgugauagucgcuaucgccaaaaacaagaaucugcacagcccuauguauuucuuuauuuguagucuugcaguggcggauaugcugguuuccgugucuaacggaagcgagacgaucgucauuaccuugcucaauuccacagacacugaugcucaaucauucaccgugaacaucgacaauguaauagauaguguuaucugcagcucucugcuggccuccauuuguucacucuuaagcaucgcaguggaccgcuacuuuacaauuuucuaugcccugcaguaccauaacaucaugaccgucaaacgagugggcauaauuaucaguugcauuugggcugcauguacugugucugguauccuuuuuaucauuuauuccgauagcucggccgucauaaucugcuugauuacaauguucuuuaccaugcuggcucuaauggccucucucuacguucacauguuccugauggcgcgucuucacaucaagagaauagcagugcugccagggacgggagccauuaggcagggcgcuaauaugaaaggcgccaucacuuugaccauccucauugggguauuuguggucuguugggcaccguucuuucugcauuuaaucuucuacauuuccugcccccagaacccuuauugugugugcuucaugucacacuuuaaucuguaccucauacuuaucauguguaacaguauuaucgacccacugaucuaugcuuugcggagccaagaacuacgcaagacauucaaggagauuauaugcugcuacccccugggaggucucugugaucuguccucuagauauuga

SEQ ID NO: 58878 - RNA, 978 nt, Artificial Sequence
  derived and/or modified sequence opt3 from MC5R__Homo_sapiens__NP_005904
augaacagcuccuuccaucugcacuuucucgaccuuaaucugaacgccaccgagggcaauuugucugggcccaacgugaagaauaaaucaaguccuugcgaagauaugggaaucgcugucgagguuuucuuaacacugggugugauuagccuacucgaaaacauacugguaaucggcgcaauugugaagaauaaaaaccuucacuccccaauguacuuuuucgucuguucucuggccguggcggacauguugguuucgaugucaagcgcuugggagacuaucacgauuuaucuccugaauaacaagcaucuggugaucgccgaugcauuugucagacacauagacaauguguucgauaguaugaucugcauuuccguaguugccucuauguguagccucuuagcuaucgcaguggacagguacgucaccaucuuuuaugcccugcgguaccaucacauuaugacagcucgccgauccggggccauaauugcgggaaucugggcauucugcacuggcugugguauuguguuuauccuuuauucagaaaguaccuacgugaucuugugccugauuagcauguucuuugccaugcuauuccuccuggucucucuuuauauacacauguuucuguuggcucguacacauguuaaaagaaucgccgcacucccgggggcuuccucagccaggcagcggaccagcaugcaaggagcggugacuguaacaaugcuguuaggcguguucaccgucuguugggcccccuucuuucugcaccucacgcuuaugcugaguugcccucagaacuuguacuguucucgcuucaugucccauuuuaauauguaccuaauucugaucaugugcaacagcgugauggauccacucauauaugcauucagaucgcaggagaugaggaagacuuuuaaggagauuaucuguugccggggcuuccgcaucgcuugcucuuuuccccgaagagacuga

SEQ ID NO: 58879 - RNA, 1941 nt, Artificial Sequence
  derived and/or modified sequence opt3 from MCAM__Homo_sapiens__NP_006491
augggccugcccagacucgugugcgccuuccuucuggcugcauguugcuguugcccuagggucgccgggguuccaggagaggcggaacagccggcucccgaguugguggaaguagagguggguagcaccgccuuacugaaguguggccuaucccaaucucaggggaaccucucacacgucgacugguuuagugugcauaaagaaaagcggacacugaucuuccgcguucgacagggacagggccaaagcgagccuggugaguacgaacagcgucuuucccugcaggauagaggggcaacuuuggcccucacucaggugaccccacaagacgagaggauuuuucugugccagggaaaacggccccgcucucaggaauauagaauacagcugagggucuacaaggcuccugaggagccaaauauccaagugaacccccucggcauuccuguaaauucgaaagaaccagaggaaguugcaacaugugugggccggaacggguauccgaucccccaggucauuugguacaagaauggacgcccuuuaaaggaggaaaagaaccgagugcacauccagucaagccaaacuguggagaguuccggucuguauacccuucagucuauauugaaggcccagcuggucaaagaggauaaggacgcucaguucuacugcgaacuaaauuauagacucccaagcggcaaccauaugaaagaguccagggaaguuacagugcccguauuuuacccuaccgagaagguguggcuggaagucgagccaguggggaugcuuaaggagggagaucggguugaaauccguugucuggccgacggcaaucccccgccucacuucucaauuaguaaacaaaaccccagcacucgcgaggcggaagaggaaacaaccaaugauaacgguguguugguccucgagccagcaagaaaggagcauucugggagguacgaaugccagggacuggacuuagauacgaugaucucccugcucucagagccucaggaacuucuggugaauuauguaagcgacguucgggugagucccgccgcuccagagcgacaggaggggucuuccuugacucuaaccugugaagccgagagcucgcaagaucuggaauuucaguggcuccgcgaggaaacaggccagguccuggagagaggccccgugcuucagcugcacgacuugaaaagggaggcaggagguggcuaccggugcgucgcuucugugccuuccauuccagggcucaaccgcacucaacugguuaauguggccaucuucggaccgcccuggauggcguuuaaggaaagaaaaguaugggucaaggagaacaugguguuaaaccugucaugcgaagccaguggccacccuaggccaaccauaagcuggaauguuaacgguacagcauccgagcaggaucaggacccccagcgugugcuaucuacccucaauguccuggugacgccugaacuuuuggagacugggguagaguguacagcuagcaacgaccugggcaaaaauaccucaauucucuuccuggaacuugugaaccugacuacauugaccccagauaguaauacgaccacaggacucuccacuagcaccgccucuccccauacacgggcuaacucaacgaguaccgagcgaaagcugccggaaccugagagcagaggcguugucaucguggccgugauugucugcaucuuaguucuggcagugcuaggggccgugcucuauuuucuguacaagaaaggaaaacuuccauguaggcgcuccgguaaacaagaaaucacauugcccccuucucggaagucggagcugguagucgaggugaaaagcgacaagcuccccgaagagaugggccuguuacagggguccucaggagauaagagagcuccaggcgaccagggugaaaaauauauugaucugaggcacuga

SEQ ID NO: 58880 - RNA, 543 nt, Artificial Sequence
  derived and/or modified sequence opt3 from MCAT__Homo_sapiens__NP_055322
augagcgugagagucgccaggguugcuugggugcggggccugggggcauccuaccgccgaggagccucuucauuccccguaccuccaccgggugcgcagggcguggcugagcuccuucgugacgccaccggggcagaagaggaagcccccugggcugcaacagagagaaggaugccuggacaaugcaguguccuguuguuuccaggccaggguagccaggugguugggaugggacggggcuuacugaacuauccccgcgugagagaacuauacgccgcugccaggcggguccucggcuaugaucugcuugagcuguccuugcacgggccucaggagacucucgaccgcacggugcauugucaaccagcgaucuucguagcaucucuggccgcuguugaaaagcugcaccaucuccagcccucggugauugagaauugcgucgccgcagcuggauuuucagugggugaauuugccgcguuaguguucgccggcgcaauggaguucgcugaggggagcaccgucaguccugaagaguuucuguga

SEQ ID NO: 58881 - RNA, 2178 nt, Artificial Sequence
  derived and/or modified sequence opt3 from MCCC1__Homo_sapiens__NP_064551
auggccgcugcaagcgccguguccguccugcucguugcggcugagagaaacagguggcaccggcuucccucucuguuguuaccuccacgcaccuggguguggcgacagcguacaaugaaguacacuacggccaccggcagaaauaucacaaaaguacugauugcaaaccgaggggaaauagccugccgggugaugcgcacugcuaagaaacuaggaguccagaccguggcaguuuauucagaggccgacagaaauaguaugcauguggauauggcugacgaagccuacagcaucgguccggcgcccucccagcagucuuaucucucgauggagaagauuauccaggucgcaaaaacaucagccgcucaagccauucacccuggcuguggguuccugagcgaaaacauggaguuugcagagcuuugcaagcaggaaggaaucauauucaucggcccacccccuagugcuauuagggauauggguaucaaguccaccucuaaaagcauuauggccgcggccggggugccaguaguugagggauaccauggcgaagaccaguccgaucagugucugaaggagcacgcacggcgcaucggcuaucccgugaugauaaaagcuguccgagggggagguggcaaggggaugagaauugugaggucagagcaagaauuucaggagcaguuggaaagugcccggcgugaggcuaaaaagagcuucaaugacgaugccaugcucaucgaaaaguuuguggacacuccucgccaugucgagguucagguguucggagaucaccacggcaacgcaguauaccuguuugagagagacugcucugugcaaaggcggcaucagaaaauuaucgaagaggccccagcuccggguaucaaguccgaagucaggaaaaagcugggggaggcggcagugcgcgccgcuaaagccguuaauuaugugggagcaggcacagucgaauuuauuauggauucaaagcacaacuuuuguuucauggagaugaauaccagacuccagguggagcaucccguaacggaaaugauaacuggcaccgacuuaguugaguggcaacugaggaucgccgcuggggaaaagauuccucuuagccaggaggaaaucacauugcagggacacgccuuugaggcacggauauacgcggaggauccaaguaacaauuucaugcccguggcugguccucugguccaccuaucuacuccacgcgccgaccccuccaccagaauugaaacaggcgugaggcagggggacgaggucagcgugcauuacgauccgaugaucgcaaagcucguugugugggccgcugaccgucaagccgcacugaccaaacuucgguauucgcugcgacaguacaacaucguaggauugcacacgaauauugauuuucuccugaacuuaucuggccauccugaguucgaagcugguaauguccacacugacuucaucccccagcaucacaaacagcugcuccuuuccagaaaggccgcggccaaagagucacugugccaagcugcauuggggcuaauucugaaggaaaaagccaugacagauaccuuuacucuccaggcucacgaccaguucaguccauuuagcuccucuagcggcaggcgccugaacauaucauauacacggaacaugacccuuaaggauggaaagaauaacguggccaucgcaguuacguacaaucaugacggcaguuauuccaugcagauugaggauaaaaccuuccaagugcuggggaacuuguacagcgaaggagacuguacauaucucaagugcucugucaaugguguggcgucaaaagccaagcugaucaucuuagagaacacuauuuaccuguuuaguaaagaaggcagcauagagaucgauauuccuguacccaaguaccuauccucugugucgagccaggagacccaagggggaccacucgcucccaugacaggcacuaucgaaaagguuuucgucaaagccggugacaaggugaaagcaggggacucccugauggugaugauugcuaugaagauggagcacaccaucaaaucaccuaaggauggcacagucaagaaaguuuucuauagagaaggagcccaggcaaauaggcauaccccacuuguggaguucgaagaggaggaaagugacaagcgcgagucugaauga

SEQ ID NO: 58882 - RNA, 1692 nt, Artificial Sequence
  derived and/or modified sequence opt3 from MCCC2__Homo_sapiens__NP_071415
augugggccgugcugagacucgcucuuaggcccugcgcacgggccagcccugcgggcccacgcgcuuaccacggggacuccgucgccucucugggaacccagccggauuuggguucagcauuauaucaagagaacuacaagcagaugaaagcccugguuaaucagcuacaugaacgaguggagcacaucaagcucggcgggggagaaaaagcucgugcacugcauauuaguagaggcaaacuucugcccagggagcggauagacaacuugaucgauccugguagcccauuccucgaacugucccaguuugccggguaucaacuguacgacaaugaggagguacccggaggcggcauuaucacagggauuggacgcgugucuggugucgaauguaugaucauagcuaacgaugccacugugaagggcggggcguauuacccuguuacggugaagaagcagcucagagcacaggagaucgccaugcagaauagguuaccaugcauuuaucuggucgacucgggaggcgcuuaccuuccccggcaagccgauguguucccugaccgcgaucacuuuggucgaaccuucuacaaccaggcaaucaugucaagcaaaaauauugcucagaucgccguaguuauggggaguuguacagcgggaggcgccuaugugccagcaauggcugacgaaaacauaauugucagaaagcagggcacuaucuuuuuggccgggccgccccuggugaaagcugccaccggagaggagguguccgcagaagaucuagguggcgccgaccuccauugcaggaagucuggggucagcgaucacugggcucuggacgaccaccaugcgcuucaccugacacggaaaguugugcguaauuugaacuaccaaaagaagcucgauguaaccauugagccuuccgaggaaccacuguuccccgcagacgaauuauauggaaucgugggcgccaaucugaaacgcucauuugaugucagagaggugaucgcuaggauuguugacgguagucgguucacugaguuuaaggccuucuacggggauacacucgugaccggcuuugcacgaauauucggauauccugucggcaucguggggaacaauggaguacuuuuuagcgaaucugccaaaaaggguacgcauuucguucagcuguguugccagcgcaacauuccauugcuauuccugcaaaauaucacuggcuuuaugguggggagagaguacgaagcugagggaauagccaaagacggcgcaaagauggucgcggcuguggccugugcacagguccccaaaauuacccucaucaucgguggguccuauggcgccggaaacuacggcaugugcgggagggcuuacucaccgcgguuccuguauauuuggccuaacgcccgcaucagcgugaugggaggugaacaggcagcuaauguucuugccacaauuacuaaggaucagagagcgagggagggcaagcaauuuaguucugccgacgaggcugcacugaaagaacccauaaucaagaaauucgaggaagaggggaacccauacuauuccagcgcccgugugugggaugacggaauuaucgauccugcugacacccgguugguacucggccugucguuuucugccgcauuaaaugcgcccaucgaaaagacagacuucgguauuuuucgaauguga

SEQ ID NO: 58883 - RNA, 360 nt, Artificial Sequence
  derived and/or modified sequence opt3 from MCCD1__Homo_sapiens__NP_001011700
auggugcugccccucccuuggcuuagcagauaccacuuccugagguuguuacugccauccuggucucuagccccgcagggcucacaugggugcuguagucaaaaccccaaggcuagcauggaggaacagaccuccucucggggaaaugguaaaaugacaucgccuccacgcggccccgggacucaccgaacggcagagcucgcccgugcggaggaacugcuugaacagcagcuggaguuguaucaagcucuccuggagggacaggaaggcgccugggaggcacaggcccugguccucaagauccagaaauuaaaggaacaaaugagaaggcaucaggagucacugggugggggagcuuga

SEQ ID NO: 58884 - RNA, 3060 nt, Artificial Sequence
  derived and/or modified sequence opt3 from MCC__Homo_sapiens__NP_001078846
augauggccgcugcagccgcggcugccgcaggcagcuccucuucagggggagguggcgggggaaguggcagcuccucuucgucaagcgacaccaguuccacaggugaggaagagagaaugaggcggcuguuccagacuugcgauggggacggagauggcuacaucucucgcaacgaccuccuuauggugugucgacaacugaauauggaagagagcgucgccgaaauuaugaaccaguugggcgcugaugagaaugggaagauauccuuucaggacuucacgcguugcagaaugcaguuaguuagggagauccggaaagaagagguggaucugucagcaaagagugacaacagcuguaccaaaaagcuacgcgauagaauugccucuuggcccacauccucagacaauagccucggagcucugagugccgcgagggaaucuugggaguaugauuccggugcacgggaccuucaaagcccugauguacagucgcagucugcccugcagaaauugcucgaguacggcggguccucacugcaccaacaggcugcccugcauaagcucuuaacucagaguccacacaucggaaacagcgugggcgguuccuaucuggaacuugcaaauaccuugcauucugcugcccuggcgagccuaaagggggacauugucgagcucaacaaacgccugcagcaaacagaacgagagagagaccuucuggaaaagaaauuggccaaggcacagugcgagcagucacaccucaugagggagcaugaagaugugcaagagcggaccacucugcguuacgaagaacgcaucacagaauuacacaguguuauagcugagcugaauaaaaagaucgacagacuccagggaaccacgauuagggaggaagaugaguauuccgaacuucggagcgagcugucucagucacagcacgaagugaacgaggacagucgaagcauggaucaagaccagacuuccgucucuaucccggagaaucagucgaccauggugacagccgauauggacaacuguagcgaucuaaauuccgaauugcagcgcguacugacuggccucgagaacguugugugcggcagaaagaaaucaaguuguucucugagcgucgcugaaguggacaggcauauugagcaacuuaccacagccuccgagcacugcgaucuggcaaucaagaccguggaagagauagaaggggucuugggacgggaccucuaccccaaucuggccgaggaacgcucaagaugggagaaagaguuagcuggucugagggaagagaacgaaagccuaacggcgaugcucuguucuaaggaggaggagcugaaccguacuaaagcaacaaugaaugccauucgggaggaacgagacagacuuaggcgccggguuagagaguugcagaccaggcugcaguccgugcaggcuacuggcccuaguagcccagggcgccucacaucuaccaaccgacccaucaauccuuccacgggagaacugucaaccaguagcucguccaacgauauuccaaucgccaagaucgcagagcggguaaaacuuucuaagacacguagcgaaucaaguuccucugacagacccgugcugggcagcgagauuuccucaauaggugucagcaguucuguggccgagcauuuggcucacucccuccaagauugcagcaauauccaggaaauuuuucagacucuguauucgcacgggucagccaucucugagaguaagauaagggaguucgaaguugagaccgaacgcuuaaacucccggauugagcaucugaaaagccagaaugaccuacucacaaucacucuggaagaguguaagucuaacgcagaaagaaugagcaugcuugugggcaaauacgaguccaaugcgaccgcuuugaggcuggcccuccaauacucagagcagugcaucgaagcauaugagcuguuacuggcccuugcugaaagugagcagagcuugauucucggacaauuucgagccgcaggcgucgggucuuccccuggagaucagucaggugacgaaaacaucacacagaugcugaagcgcgcucacgauugccggaaaaccgccgagaaugcggccaaggcucuacugaugaagcucgacggcaguugugggggagcauucgccguggcuggcugcagcguacagccaugggagucccugucuucgaacagccauacuucaacgacauccaguaccgccucuagcugugauacugaauuuaccaaagaggacgaacaaagacuuaaggauuacauucagcaguugaaaaaugacagggcagcgguuaagcugacaauguuagagcucgaauccauacacaucgauccgcugucauaugacgugaaaccccguggugacucucagcgccuugaucuggagaacgccgucuugaugcaagagcucauggcuaugaaggaagagauggccgaacugaaggcacagcuauaccugcucgagaaagagaagaaagcucuggaacuuaaguugagcacccgggaggcccaggaacaggcauaucuggugcauauugagcacuuaaaaagugaagucgaggagcaaaaggaacagagaaugaggucccucagcucuacuucauccgggaguaaggacaaaccuggcaaggagugcgccgaugcugcgagcccagcccugucgcuugcagaacugcgaacaacguguucugagaaugaacuagcugccgaguucaccaacgccauccggcgcgagaaaaagcucaaagcuagagugcaggaacugguuuccgcauuggagaggcugacuaagagcucagaaauccggcaccaacagagugccgaguuugugaacgacuuaaaacgagcuaauucuaaccucguagcggccuacgaaaaggcaaagaaaaagcaucagaauaaacugaagaaacuugagucccagaugauggccauggucgagagacacgaaacacaagugcgcaugcugaagcagaggauugcuuugcucgaggaagagaacagccguccccauaccaaugagacaucacuguga

SEQ ID NO: 58885 - RNA, 531 nt, Artificial Sequence
  derived and/or modified sequence opt3 from MCEE__Homo_sapiens__NP_115990
auggccagagugcugaaggcugcagccgcgaacgcugucggccucuucagcaggcuucaagcccccaucccuaccguucgggcauccucuacaucacaaccacuggaccaggugacugggaguguauggaauuugggacgcuuaaaccacguggccauugcugucccggaucuggagaaagcagccgcuuuuuacaagaauauacuaggugcccaggugagcgaagcgguuccccucccugagcauggcguguccgucguguucguaaaccuggggaauacgaaaauggaacuucugcacccauugggacgagacucucccaucgcaggcuuucuccagaagaacaaagccggugggaugcaucacauuugcaucgagguugauaauauuaacgcugccgugauggaccugaagaagaaaaagauccguucgcugucagaagaggucaaaauaggagcacauggcaagccugugaucuuccuccacccaaaagauuguggcgggguguuagucgagcuggaacaggcuuga

SEQ ID NO: 58886 - RNA, 2958 nt, Artificial Sequence
  derived and/or modified sequence opt3 from MCF2__Homo_sapiens__NP_001093325
augcaggacaucgccuuccugagcggcgggagaggaaaggauaacgcuuggauuauaaccuuucccgagaauugcaacuucagguguaucccugaagaggugauugcaaaaguccucacauaccuuacuuccaucgcccggcaaaaugguucugacucacgcuuuacgauuauccuggaucgacguuuggacaccuggaguagcuuaaagauaucccugcagaaaaucucugcgucguucccaggcaaccuacaccucguucuggugcuuagaccgacaucauuucugcagaggacuuucaccgauauuggguuuugguucagccaggaagacuuuauguugaagcuccccguagugaugcugaguuccgucucugaucugcucacauauaucgacgauaaacaauuaaccccugagcugggaggcacucuucaguacugccauagcgaauggauuaucuuccggaaugcuauagagaacuuugccuugacagugaaggagauggcacagaugcugcaguccuucgguaccgaacuagccgagacggaacucccagacgauauucccucaaucgaggagauucuggcuauccgcgcagaaagauaucaccuucugaagaaugacaucacugccguuaccaaagaggggaagauuuugcucacaaaccuggaagugccugauacugagggagcugucaguagcagguuagaaugucaucggcaaauaucuggcgacuggcagaccaucaauaaacugcucacacaggugcacgacauggagaccgccuuugauggcuucugggagaagcaucagcuuaaaauggaacaauaccugcaguuguggaaguucgagcaggacuuucaacagcuaguaacggaaguugaguuccugcucaaccagcaggcggaacuggcagaugugacugggacaauugcccaagucaagcagaaaaucaagaaacuugagaaucuggacgagaacucccaggaauugcucucaaaggcucaguuugugauacugcacggacacaaauuagccgcaaaucaucacuaugcucuggaucuaauuugccaacgcuguaacgagcuccgauaccugagcgacauccuugugaaugaaaucaaggccaaaaggauucaguugaguagaaccuucaagaugcauaagcugcuccagcaggcgcggcaaugcugugaugagggugaaugccugcuugccaaccaggagaucgacaaauuucagucuaaggaggaugcacagaaagcucugcaagacauugaaaacuucuuggagauggcccucccauuuauaaauuaugaacccgagacucugcaguacgaguucgaugucaucuuauccccugaacugaagguucagaugaaaacaauucaacuaaagcucgagaacauccguagcaucuuugaaaaucagcaggcuggcuuccgcaaccuggccgacaagcacgugagaccaauucaguuuguagugccgacccccgagaaucuugucacgucggggaccccuuucuuuucuuccaaacaaggaaagaaaacauggaggcagaaccagucaaauuugaagauagaagugguuccagacugucaggagaaacggaguagcggccccuccucuagccuggauaacgguaauucacucgacgugcugaagaaccacgucuuaaaugagcugauccaaacugaacgaguguacguacgcgagcuuuauaccguuuugcucggguacagagcagaaauggauaacccugagauguucgaccugaugccaccccuacugaggaauaagaaagauauucucuucggaaacauggccgaaaucuaugaguuucauaaugacauuuuccugaguucccuugagaacugcgcucacgcgccggaacgggugggcccuugcuuuuuggagcgcaaggaugacuuccagauguacgcaaaauauugucagaacaagcccagaagcgaaacaaucuggaggaaauacucugagugcgccuuuuuccaggaaugucaacguaagcugaagcaucgguuacgacucgauucauaucugcuuaaaccaguccagagaauaacuaaguaccagcuguugcucaaagagcugcuaaaguacaguaaagacugcgagggcagcgcucugcucaagaaagcccuggaugcaaugcuugacuugcugaaguccgugaaugauucuaugcaccaaaucgccauuaacggguauaucggaaauuuaaacgaacucgguaagaugauuaugcagggcggguuuucggucuggaucggacauaaaaagggcgcuaccaaaaugaaggaccuggccagguucaaaccuaugcagcgccaccuuuuucuguacgagaaggcaauaguguucuguaagcggagaguugaaagcggugagggguccgacagguaucccucauacaguuuuaaacacugcuggaagauggaugaggugggcauuacagaauauguaaaaggagacaaucgcaaguucgagaucugguacggcgaaaaagaggaagucuauauugugcaggcgucuaacguugaugugaagaugaccuggcuaaaggagauccgaaauauacuccugaaacaacaggaguugcugacugucaagaaacggaagcagcaggaccaauuaacggaacgugauaaauuucagaucagccuccagcagaacgacgagaagcaacagggggcuuucauuuccacagaagagaccgaacuggagcauacuucaaccgugguagaggugugugaagccaucgcaagcguucaggccgaggcuaauacagucuggaccgaagccucucaguccgcagagauuagugaggaaccagcugaguggagcucuaacuacuucuaccccacuuaugaugaaaaugaggaagagaacagaccucuuaugaggccaguguccgagauggcccuguuguacuga

SEQ ID NO: 58887 - RNA, 3345 nt, Artificial Sequence
  derived and/or modified sequence opt3 from MCF2L2__Homo_sapiens__NP_055893
augcugagcugccucaaggaggaaaugcccccucaggagcuuaccagaaggcuggccacagugaucacucacgucgacgaaauuaugcaacaggagguucggccauugauggcuguggaaauaaucgagcaguuacaucgccaguucgcaauucuguccggcgggcgaggagaggauggugccccgaucauuacguuucccgaauuuucuggcuuuaaacacaucccugacgaggauuuccuaaacguaaugaccuaccucacaucaauaccaaguguggaagcggcuagcaucggguuuauugucgugaucgaccguagaagggauaagugguccucuguuaaagccucgcugacucggauugcaguggccuuccccggaaaucuucaacugaucuuuauauugcgcccuucaagauucauucagaggaccuuuacagacaucggcauuaaguauuaccggaacgaguucaaaaccaaggucccaaucaucauggugaauagcguaagugaucuccaugguuauauugacaagucccagcugacucgcgagcuugggggaacacucgaauaccgacacggccaguggguuaaccauagaaccgcuauagagaauuuugcauuaacgcugaaaacuaccgcccaaaugcuucagacauucggcucuuguuuggcuacugccgaacugcccaggagcaugcuauccaccgaggaucuccugaugucacacacacggcagcgugacaagcugcaggaugaacugaaauugcucgggaagcaaggaaccacgcuguuaaguugcauccaggagccugcgacuaaauguccaaacagcaagcugaaucucaaccagcuugagaaugugacaaccauggaacgccuguugguccaacuagacgagacugaaaaggcauuuucucacuucugguccgagcaucaccugaaacucaaccagugccugcagcuucagcauuucgaacacgauuuuuguaaggccaaacuggcuuuggacaaucuccuggaggagcaagccgaguucacagguauuggcgacucagugaugcacguggaacagaucuuaaaggaacauaaaaagcuggaggaaaagagccaggagccgcuagagaaggcacagcuccuggcucuugucggggaucaauugauacagagucaccauuaugccgcggacgccauuagacccaggugcguugaacugcggcaccucugugaugacuuuaucaacggaaauaagaaaaagugggauauccugggcaaaucucuugaguuccaucgacagcuggacaaggugucccaguggugcgaagcagguauuuacuugcucgcuagccaagccguagauaaaugucagucgcgcgaggggguggacaucgcucugaacgauauugccaccuuuuuaggaacggucaaggaguauccucugcuaucuccaaaggaguucuacaaugaauuugaacuccugcuuaccuuggacgcaaaagccaaggcucagaaagugcugcagagacucgaugacguucaagagauauuccacaagaggcaagugucccugaugaaauuagcggcaaagcagacacggcccguccagccuguggccccacaccccgaaucaaguccgaaguggguaagcuccaaaacuucucagccuagcaccucaguuccccuggcucgcccacuuagaacaagugaggagccuuacacugaaaccgaguugaacuccaggggcaaggaagacgaugagacaaaauuugaagucaagagcgaggagaucuucgaaucucaucacgagcguggcaaccccgaacucgagcagcaggcccggcugggggaccuaucaccacgaagaaggauuauccgcgaucugcucgaaaccgaggagaucuauauuaaagaaauaaagaguaucauugacggauacaucacucccauggauuuuauuuggcugaagcaucuuaucccugacguguugcaaaauaacaaagauuuccuguuugguaauauacgggaguuauaugaguuccacaacagaacguuccucaaggaacuggagaaaugcgcagaaaauccagagcuucuggcccacuguuucuugaagaggaaagaagaccuccagaucuacuucaaguaucauaaaaaccugccgcgcgcucgagccauuuggcaggagugccaggauugcgcauacuuuggcgugugucaacggcagcuagaccacaaucugccccucuucaaguaucugaaggggccuagccagcgucuuaucaaauaccagauguugcugaagggauuacucgauuuugaauccccagaggacauggagauugaucccggcgaacugggugggucugcgaaagacggcccuaagagaacaaaagacucggcuuucagcaccgagcuucaacaggcccuggcagucaucgaagaucuaauaaaguccugcgagcucgccguggaccuggcugccguuacugaauguccagaugacauuggaaaguugggcaaacuguuacuccaugggcccuuuucaguguggaccauccacaaggauagguacaaaaugaaggaccugauucgcuucaaaccgagucagcggcaaaucuaucuuuuugagagaggaauaguauucugcaagaucaggauggagccuggugaucagggccugucuccacauuacagcuuuaagaaagcaaugaaguugaugacacucuccauucgacagcuggggcgcggaucacaccggaaauucgaaaucgcuagcagaaacggccuagagaaguauauucugcaggccgcgucuaaagaaaucagggacuguugguuuuccgagauaaguaaacuucucauggaacaacagaauaacauuaaggaucaggguaauccccaguucgagaugagcaccucuaaaggguccggcgccggaucaggcccuuggaucaagaacauggagcgugcuacuacaaguaaagaagaccccgcaagcucgaccgggggaaucaaggguugcuccucucgcgaguucagcucaauggauacguuugaagacugugagggcgccgaggauauggaaaaagagaguuccgcucugucuuuggccgggcuguuccaaagcgacgacucccacgaaacuugcucaagcaagagugcauuuuuagagcggggagaaucuucccagggcgagaaagaggaaagagaugaggaagagacagcgaccaggagcacagaagaggagcgagccggugcuucgacugggcggcucgccccagcaggcgcuaccgccggauuccaggcacgcgcccugagaccuaggacgucagcucaggaaucuuga

SEQ ID NO: 58888 - RNA, 3378 nt, Artificial Sequence
  derived and/or modified sequence opt3 from MCF2L__Homo_sapiens__NP_001106203
augagauucuggcugaggaccgaggaaauggcccucgaggaaauggugcagcggcuuaacgcugucagcaagcacacagacgagaucaugcaucaagauauuguuccccugugcgcagccgacauacaggaucaguugaaaaagcgcuuugcguacuuauccggcgggcgaggacaggacgguucuccugugaucacuuucccagauuauccggcuuuuucagaaauucccgacaaagaguuccaaaauguaaugacguaccugaccaguaucccuagccuacaggaugccggcauuggguuuauccucgugauagaccguagaagggauaaguggacauccgucaaagcaucugugcugcggaucgccgcuucguucccagcaaaccuucagcugguuuuggugcuccgccccacuggauuuuuccagagaacccugucagacauugccuuuaaguucaauagggaugacuuuaagaugaaagucccugugaucaugcugagcaguguaccagaucuccacggcuauauugacaagucccaauuaacagaggaccugggugggacccuugauuacugucauucucggugguugugccagcgcacugcuaucgaaaguuucgcccugaugguuaaacagacagcgcagaugcuacaauccuuuggaaccgagcucgcagaaacggagcugcccaacgacgugcagucaacuagcagcguccuuugugcccacaccgagaagaaagauaaggcuaaggaagaccugcgauuggcccucaaagagggccauucugugcuggaauccuuaagagagcugcaggcagaaggcucagagccuagcgugaaucaagaucagcucgacaaccaggcuacaguccagaggcuucuggcccaauugaaugagacugaagcggccuucgaugaguucugggcaaagcaccagcagaaacuagaacagugccugcaacuccggcacuuugagcagggguuccgugaaguuaaggcuauacuggacgccgcuagucagaaaauugccaccuuuacagauaucggaaacucucuugcacauguggagcaccuguugcgcgaccucgccuccuucgaggaaaagagcgguguagcuguggagagagcgagggcacugucguuagauggcgaacagcugauugggaauaaacauuaugccgucgacucuauccggccaaagugucaagagcuacgacaccucugcgaccaguuuuccgcugaaaucgcccgcagaaggggacugcuuucaaagaguuuggagcugcaccggcgccucgagaccagcaugaaauggugugaugaaggcauuuaccugcuugcaucccagccgguggacaagugccagucucaagauggugccgaggcugcccugcaggaaauagagaaauucuuggagacgggggcagaaaacaagauccaggagcucaaugcgauuuauaaagaauacgagagcauccugaaccaagacuuaauggaacauguuagaaagguguuucagaagcaggcuucaauggaggaggucuuccacaggcgucaggccagucugaaaaagcuagcagcccggcaaacucgacccgugcagccuguagcuccaagacccgaagcccucgcaaaauccccuuguccaagccccggaauaaggcgcggcucugaaaauucaaguagcgaaggcggggcucugcggagaggaccguacaggcgcgccaaguccgagaugucugaaucgcgacagggucggggcagcgcgggggaggaggaagagucccuugccauuuugcguagacauguuaugucagaacugcucgauacagagagggcuuauguggaggagcuguuaugcguccuggagggauacgcagccgaaauggacaacccucuuauggcucacuugcucaguaccggccugcauaauaaaaaggaugugcuauuugguaacauggaggaaaucuaucacuuccacaaccgcaucuuucugcgggagcucgagaauuacacugacugucccgaacuggucgggagaugcuuccuugagaggauggaagauuuucagauuuaugagaaguacugccaaaacaaaccacgaucugaaaguuuguggcgccaguguuccgacugcccuuucuuccaggagugucagcggaagcuggaucauaaauuaucacucgacagcuaucugcuuaagcccgugcaaagaaucacaaaauaccagcuguugcucaaggagaugcugaaguacucuaggaauugcgaaggcgccgaggaucuacaggaagcacuguccaguauucucggaauacugaaagcgguuaacgacagcaugcaccuuaucgccauuaccggcuaugacgggaauuugggagaucuggguaaguuacucaugcaaggcucuuuuuccguguggacggaccauaaacgugggcacaccaagguaaaagagcuggcucgcuucaagccaaugcagcggcaccuuuuucugcaugaaaaagccguccuauucuguaagaagagagaggagaacggagaaggcuacgagaaagcacccucauauaguuacaagcagagccucaauauggcugccguggguaucacagaaaacguuaaaggggaugcaaagaaauuugagaucugguauaaugccagggaagagguguacauuguccaggcuccuacuccagagauaaaggcggccugggugaacgaaauccgaaagguacugaccucgcaauugcaggcaugccgggaggcuucccagcaccgcgcccuggaacagucucagagcuuaccgcuccccgccccuacaucaacuagcccauccagaggcaauucuaggaacauuaaaaagcuggaggagcggaaaaccgacccccuuagccuggaaggauauguguccucagcuccuuugacaaagccacccgagaaaggcaagggguggagcaagaccagucauucucucgaagcaccggaggaugacggagguugguccagcgccgaggaacaaaucaauucgucagaugcggaggaagacggcgggcugggaccuaaaaagcuaguuccaggcaaauacacugucguggcugaucacgagaagggugggcccgacgcccugcgagugagaucuggcgaugucguugaacuugugcaggagggagacgaaggccucugguacgugcgcgauccuacgacagggaaagagggauggguacccgcaaguucccugagcgucagguugggcccaucugguagcgcccagugucuguccucaagugagagcucuccuggguccgcuguguuaucaaacaguagcuccugcucugaaggaggccaagcacccuucucggaccuccaggguuga

SEQ ID NO: 58889 - RNA, 441 nt, Artificial Sequence
  derived and/or modified sequence opt3 from MCFD2__Homo_sapiens__NP_001164979
augaccaugagaagccugcucaggacacccuuccuuugcggccuguugugggccuuuugugcuccuggggcacgggccgaggaaccagcggcuuccuucucucagccgggaucaauggguuuagacaagaacacugugcacgaucaagagcauaucauggaacaccuggagggcgucauuaauaaacccgaagccgagaugaguccucaggagcuacagcuccauuacuuuaagaugcacgacuaugaugggaacaaucugcuugacggacuggaauugagcacggcaauaacccauguucacaaagaggaaggcuccgagcaggccccacucaugucugaggaugaacugaucaacauuaucgacggugugcugcgcgaugacgauaagaauaacgacggguacauugauuaugcugaguucgcaaaaucgcuccaauga

SEQ ID NO: 58890 - RNA, 1269 nt, Artificial Sequence
  derived and/or modified sequence opt3 from MCHR1__Homo_sapiens__NP_005288
augagcgugggcgccaugaagaaaggggucggcagagcuguuggucugggcgggggauccggcugccaggcaaccgaggaagacccccucccuaacuguggugccugcgcgccagggcaaggaggcaggcgguggcgccuuccgcagcccgcuuggguggagggaucuucagcccgacugugggaacaggcaacagggacuggauggauggauuuggaggccaguuuacugccuacggguccaaaugcuagcaacaccuccgacggccccgauaaucuaacaucugcagggucgccuccacguacuggaucaaucagcuacauuaacauaaucaugcccaguguauucggcaccauuugucuccuggguaucauuggaaauuccacagugaucuuugccgucgugaagaaaucuaaacuucacuggugcaacaauguuccugacauauucaucauuaaccugagcguggucgauuugcucuuucugcuggggaugccauucaugauccaucagcucaugggcaauggcguguggcacuuuggggaaaccauguguacuuuaauuacagcuauggacgccaacucccaauucaccucaacguauauccugacugcgauggcaauagauagauaccuugccaccguacauccgauuaguagcacaaaguuuaggaagcccucuguugcuacuuuggugaucugccugcuaugggcccucuccuucauuucaaucaccccugucuggcuguaugcacggcuuaucccauuucccggaggugcugugggcugugggauucgccugccuaauccagacacagauuuguacugguucacccucuaucaguuuuuccuggccuuugcguuacccuucguggucauaacggccgcauacguuagaauccugcagaggaugacuagcaguguggcuccggccucucagcgguccauucgccuccgaacaaagagaguaaccaggacugcuaucgccauaugccuuguguucuuugucuguugggcaccuuauuacgugcugcaauugacacagcuaagcauuucgcggcccacccugacguucguuuaccucuauaacgccgcuaucucucugggauacgcaaauuccugccuuaacccauuuguguauaucguccugugugagaccuuccguaaacgcuuggugcucucaguaaagccugcggcccagggccagcugagagcuguuaguaaugcccaaacagcagacgaggaaaggacugagagcaaagguaccuga

SEQ ID NO: 58891 - RNA, 1023 nt, Artificial Sequence
  derived and/or modified sequence opt3 from MCHR2__Homo_sapiens__NP_001035269
augaaccccuuccacgccagcugcuggaauaccuccgcugagcugcucaacaagucuuggaauaaagaauuugcauaccagacagccucaguggucgacacuguuauccuuccuaguaugauuggcauaaucuguagcacggggcuggugggaaacauuuugaucguauucaccauuaucagauccaggaagaaaacagugccagauauauauaucugcaauuuagcggucgcugaccuggugcauauuguugguaugccguuucuaauccaccaaugggcccggggcggggaguggguguucggaggcccccucuguacuauuaucaccucucuggauacaugcaaccaguuugcauguucggccauaaugaccgucaugucaguggaccgcuacuucgcucuuguacagccuuuucgacugacucguuggagaacaagguauaagaccauucggaucaauuugggucucugggcagccagcuucauucuggcucugccaguuuggguguacaguaaagucaucaaguuuaaggaugggguggaauccugcgccuucgaccucacgucucccgaugacguguuaugguauacucuguaccuuaccaucacaaccuuuuucuuuccuuugccacugauucuagucuguuauauacucauccugugcuacacuugggagauguaccagcaaaacaaagaugcgcgcuguugcaaucccagcguuccuaagcagagagugaugaaacuuacaaagaugguacugguguuggucgugguuuucauucucuccgcagccccauaucaugugauccagcuggucaacuuacagauggaacaaccgacccuggcuuucuacgugggauauuaccucucaauaugucuuaguuaugccucuagcuccauuaaucccuuucuguacaucuugcuaucaggcaacuuccagaaaaggcugccucagauccagcggcgcgcaacggagaaggagauuaauaacaugggcaauacucucaagagccacuuuuga

SEQ ID NO: 58892 - RNA, 1158 nt, Artificial Sequence
  derived and/or modified sequence opt3 from MCIDAS__Homo_sapiens__NP_001177716
augcaggccugcggcgggggagcugcagguagaagggccuucgacagcaucugucccaaccggaugcuggcgcucccuggccgcgcccuucugugcaagccagggaaaccggagcgaaaguuugcucccccucguaaauucuuuccaggauguaccggcgguucccccgugucugucuacgaagauccuccagacgcagagcccacagccuugccugcuuuaacuacgauugaucugcaagaccuagcagauugcucaagucuccuggggagcgacgccccaccgggaggcgaucuugcugccucccagaaucacucucaucagaccgaagcggacuucaaccugcaggauuuuagagacacaguugaugacuugauaucggauucaagcaguaugaugucccccacucucgcaucuggcgacuucccuuuuagcccaugugacaucucccccuucgggccuugccugucaccaccccuggauccgagggcccuccaaaguccucccuuacggccaccugacgugcccccacccgagcaguauuggaaggaaguagcugaucagaaucagcgcgcccugggagacgcacuuguggagaacaaucaauugcacgucacccugacacagaaacaggaggaaauugcuagccuaaaggagagaaacgugcagcucaaggaacuggccucuaggacccggcaucuugcguccguucuggauaaauugaugaucacucaaucacgcgacuguggugccgcagcugagccuuuucuccugaaggccaaagcuaagcgaaguuuagaggaacuggugagcgccgcaggccaggauugcgccgaggucgacgcuauucucagagaaaucucugagaggugugaugaagcgcuucagucccgggacccaaaacguccgcgccuguugcccgagccugcaaauacagauaccagaccagggaaccuacacggagccuucaggggccugcggacggacugcagccgaucggcucucaaucugucucauuccgagcuugaagagggugggucauuuaguacucgcauaagaagccacuccaccaucaggacacuggccuucccccaaggaaacgcauuuacuauucggaccgccaauggcggcuacaaguuccgcugggugccuucuuga

SEQ ID NO: 58893 - RNA, 2625 nt, Artificial Sequence
  derived and/or modified sequence opt3 from MCM10__Homo_sapiens__NP_060988
auggacgaggaagaggauaaccugagccuccuuaccgcccuguuggaagagaaugaauccgcuuuagacugcaacucugaggagaauaacuuccugacaagagaaaauggcgagcccgaugcauuugacgaacuauucgaugccgacggggauggagagucauacacugaggaagcggacgauggugagacgggcgaaaccagggacgagaaggaaaaccucgcuacacuguuuggggauauggaggaccuuacugaugaggaagaggugccugccagucagagcaccgaaaaucggguccugccagcaccggcccccagacgagagaaaacaaacgaagaguugcaagaggaacuccguaaucugcaggagcagaugaaggcucugcaggaacaacucaaaguuaccacuaucaagcagacagcauccccugccagauuacagaaaucuccagagaagucgcccaggccuccacugaaggaacggcgcgugcagcgcauucaagagucaaccuguuucagcgcugagcuugacguacccgccuugccuaggacgaaacggguggcgcgcacuccaaaggcaaguccgcccgacccuaaauccucuagcucccgaaugaccucagccccaagucagccccugcagacaauaagcagaaacaagccuucuggaaucacuaggggccagauugucgguaccccaggguccucaggagaaacaacccaacccaucugcguggaggcuuuuagcggccuacggcuccgucgcccgagaguuaguucuacggaaaugaauaaaaagaugacuggcaggaagcugauucggcuuucccagaucaaagagaagauggcccgagagaaacuggaagagauagauugggugacauucggggucaucuugaagaaagugaccccucagagcguaaacucgggaaagacuuuuucuauuuggaaacucaaugaccugcgcgauuuaacacaauguguuucccuguuccucuuuggugaagugcacaaggcacuuuggaagaccgagcagggcacggucguggggauccugaacgcuaaucccaugaaaccaaaggacggaucagaagaggugugcuugaguauugaucauccucagaaaguccuaaucaugggcgaggcccuggaccucgguaccuguaaggcgaaaaagaagaacggggaacccugcacacagacuguuaaccugagagauugugaguauugccaauaccacgugcaggcccaguauaaaaaguugagcgcaaaaagggcugaccugcaguccaccuucucuggaggccggauaccaaagaaauuugcccgcagaggcacuagcuugaaggaaaggcucugucaagauggguucuacuauggagguguaucaagugcuuccuacgccgcaagcauugccgcugcgguggcacccaagaaaaagauccagacaacccugucuaauuuagucgugaaaggcacaaaccugauuauccaggagacccgucagaagcuagggaucccucaaaaaucacucaguugcagcgaagaguuuaaggagcugauggaccuuccaacuuguggagcccggaauuugaagcagcaucuggcuaaagccacggcauccggcauuauggguucuccgaagcccgccauaaaaucgaucagcgcuuccgcccuccugaagcagcagaaacaacgaaugcuugaaaugagaaggcgcaagucagaggaaauucagaaacgguuccugcagaguucuagcgagguugaauccccugcagugccaucaagcucuagacaacccccugcgcagccacccaggacaggguccgaguucccgcgcuuggagggcgcuccugccaccaugacuccaaagcucggacgaggcguccuggaaggggaugacguguuauuuuaugacgagagucccccuccccggccaaagcugagcgcacuagccgaagcuaaaaagcucgccgcaaucaccaaacugcgugcuaagggacagguacuuacaaaaaccaacccuaauucuauaaagaagaaacagaaggauccccaagacauuuuggagguuaaagagagaguggaaaagaacacuauguucuccucacaggccgaggaugaacuggagccagcgaggaaaaagcgccgggaacagcucgccuaccuggagagugaggaauuucagaagaucuuaaaagcuaagagcaaacacacagguauccugaaggaggcagaagccgagaugcaagaaagauacuucgagccgcuugucaaaaaggagcagauggaagagaagaugaggaauauucgagaagugaaaugccgcgucgugacgugcaagaccugugcuuauacucauuuuaaauugcucgagacaugcguuucggaacagcacgaguaccacuggcaugacggcgugaagcgguucuuuaaauguccuugcgggaacagauccaucucucuggauaggcuacccaauaagcacuguagcaacugcggacuguauaaaugggagcgugacggcaugcucaaggaaaagaccgguccaaaaauugggggcgagacacugcuuccccgcggagaggaacaugccaaguuccuuaauucacugaaauga

SEQ ID NO: 58894 - RNA, 2715 nt, Artificial Sequence
  derived and/or modified sequence opt3 from MCM2__Homo_sapiens__NP_004517
auggccgagagcuccgaaucuuucaccauggcuucaagucccgcacagagaaggcggggcaacgacccucugacaagcuccccagggcgcaguucgcgacguacugaugcccucacgucaagcccgggaagagaccuucccccuuuugaggaugaaagugagggucuguugggcaccgaagggccauuagaggaggaagaggacggagaagaacugaucggcgaugguauggagagggacuaccgggcgauucccgaacuagaugcuuaugaggccgaagggcucgcacuggacgaugaggacguggaagaacuuacagccucccaacgcgaggcugcagaaagagccaugaggcagcgggaucgcgaggcuggacgaggccugggcagaaugaggcggggguugcucuacgacucugaugaagaggacgaggagcguccugcccgcaagagaaggcaggucgagcgggcgacugaagacggagaggaagaugaggaaaugauagagagcaucgagaaucuggaagaccugaaaggucacuccguucgagagugggugucaauggcaggcccacgccucgaaauucaucacagauucaagaacuuuuuaaggacccauguagauagucacgggcauaauguguucaaagagcggaucagcgacaugugcaaggagaaccgcgaaucucuggucgugaauuaugaggaucuugccgcuagagaacacguuuuggccuacuuucugcccgaggcaccagcugaacuacuccagauuuucgacgaggccgcgcuggaggugguccuugccauguauccaaaauacgauaggaucacaaaccacauacaugugcguaucucccaucugccguugguagaggagcuccggucacugcgacaauuacaccugaaucagcucauuagaaccagcggaguugugacuucuuguacaggcguccuuccccagcugucuauggugaaguauaacugcaauaaguguaacuuuguguuggguccuuucugccagucccaaaaucaggaagucaaaccagggagcugucccgagugccagucggcaggaccuuuugaaguuaacauggaggagaccaucuaccagaauuaccaaaggauucgcauccaggaaucuccaggcaagguggcugccggccggcuacccagauccaaagacgcuauacugcucgccgaucugguagacucauguaagccgggggaugagauugaacuuacgggaaucuaucacaacaauuacgacgguagucugaacacugcaaacggcuucccuguguuugccaccgucauuuuggcuaaucacguggcgaaaaaggacaacaagguugcagugggggagcucacagaugaagacgucaaaaugaucacuagccuguccaaggaucagcaaaucggagagaaaauuuucgccucuauagcucccagcaucuauggccaugaggacauuaagagggguuuagcccuggcacuauuugggggcgaaccuaaaaauccuggaggcaagcacaaagugcgcggggauaucaacguacuccugugcggagaccccgguaccgccaagucacaguuccuuaaguacauagagaaaguuaguucccgagcuauuuucacaaccggccagggggccagcgcagugggauugacggcguauguccagcggcauccagugucucgugaauggacucuggaggcuggcgcccucguccuggcagauagaggugugugucuuaucgacgaguuugauaagaugaaugaccaagauaggacaucaauccacgaagccauggagcagcagaguauuagcaucuccaaagcugggauuguuaccucucugcaggcccgcugcacugugauagcagcugccaaccccaucggcggacgguacgacccuucguugacauucagcgaaaauguagaucucaccgagccaauuaucuccagauuugacauccugugugucgugagggacacgguugauccggugcaagacgaaauguuagcgcgauucgucgugggcucacauguacgccaccaccccaguaacaaggaggaggaagggcuggccaauggaucugcugcagagccugccaugccaaacaccuaugguguggaaccccuaccucaggagguucucaaaaaguacauuauauacgcuaaggaacggguccauccaaaacugaaucagauggaucaggacaagguggccaaaauguauagcgaucuuagaaaggaguccauggcaacaggcucaauccccauuacugugaggcacaucgagagcaugauucguauggcggaagcccaugcucgcauccacuugcgggacuacgucauagaggaugacguuaacauggccaucagagugaugcuggaaucuuuuauugauacccaaaaauucuccgugaugaggaguaugcgaaagacauuugcacgguaucucagcuuccgcagagacaauaacgagcuguuacuguuuauccuuaagcaguugguagcugaacaggucacuuaccagaggaaucgguucggggcccaacaggauaccauugaggugccggagaaagaccucguugauaaggcacgacagaucaacauacacaaccugucugccuuuuaugacuccgaacuauucagaaugaauaaauuuucacaugaccugaagcgcaaaaugauucuccaacaguucuga

SEQ ID NO: 58895 - RNA, 5943 nt, Artificial Sequence
  derived and/or modified sequence opt3 from MCM3AP__Homo_sapiens__XP_006724127
augaaccccacaaauccuuucagcggccagcagccauccgccuuuucugcuucaagcagcaacguggggacacugccguccaagcccccuuuccgauuuggacagccaucucucuucggucaaaauucgacucuuucaggcaaaagcaguggguuuucccaggucucuagcuuccccgcauccucaggaguuagucauaguucuuccgugcaaacgcugggcuuuacccagacaucaagcguggguccuuucaguggguuggaacauacuucuaccuuuguggccacauccggaccaagcucgucuuccgucuuaggcaacaccggcuucucauuuaagagucccacuagcgugggggcguucccuuccacaucugcuuuuggacaggaagccggugaaaucguuaauagcggcuucgggaaaaccgaguucucauuuaagccacuggaaaacgcaguguucaaaccgauucuaggagccgaaagugaacccgagaagacgcagucccaaauagcuagcggcuuuuucacuuuuucucacccuaucucaagugcaccaggugggcucgcccccuucagcuuuccucaggucaccuccucuucggcuacaacuagcaauuucaccuuuuccaagccagugucaaguaacaauucucugagcgccuucacacccgcgcuuuccaaccagaauguugaagaggagaagaggggaccgaagucaauuuuuggcagcucuaacaauuccuucaguagcuuuccuguuucuuccgcagugcugggcgagcccuuccaggccucaaaagcugggguccggcaaggaugcgaggaagccgugagucagguggagccauugccuagccucaugaagggucugaaacgcaaggaagaccaggaucgaucgccccgucgacauggccacgagccagcagaagacuccgauccccugucuagaggggaccauccuccagauaagcggccgguccgccucaacaggcccaggggaggcaccuuauucggucggacgauccaagacguuuuuaaaagcaauaaggagguggggcgccugggcaacaaagaggcuaagaaagaaacuggauucguagagucagccgaaagugaucacauggcgauuccuggcgggaaccaguccgugcuugccccaucucgaauccccggagucaauaaggaggaagagacagagagcagagagaaaaaggaggacuccuugagggguaccccugcacggcagucaaaccguagcgaaaguacugauucucugggcgggcuauccccaagcgaggugacagcuauacagugcaagaauauccccgacuaucucaacgaucgcaccauucuggaaaaucacuuuggaaaaaucgccaagguucaaagaauuuucacgaggcggucgaagaaacuugcugugguccacuuuuucgaccacgccucagcagcccuggcuagaaagaaaggcaaaucuuugcauaaagauauggcgaucuuuuggcaccgcaagaaaauaaguccgaacaagaaaccuuucucccucaaggagaagaaaccaggugacggggaggugagccccucuaccgaagacgcaccuuuucagcacagcccccugggcaaggccgcuggaagaacaggcgccuccucauuacugaauaaaaguagcccaguaaagaaaccuucucuccuuaaggcacaucaguucgagggggauuccuuugacucagccagugaaggaagcgagggucugggccccugcguuuugucccuaucuacucugauugggaccguggcugagacaucgaaggaaaaauauaggcuccuggaucagcgggaccgcaucaugagacaagccagggucaagcguacugaucuugacaaagcacggaccuucgugggaacaugucuggauaugugcccagagaaggaacgauacaugagagagaccaggagccaguugucagucuuugaagugguuccgggcacugaccagguggaucacgcggcugccguaaaagaguauucccgcaguucugcagaccaggaggaaccucucccccaugagcugcggccauuacccguccugagcagaacgauggauuaccuagugacacaaauuauggaccagaaggaagguucccucagggacugguaugauuucguuuggaaccgcacccgagggauccggaaagacaucacucagcagcaccugugugauccucuuaccgugucauugauugagaagugcacacguuuccauauacacugugcccacuuuaugugcgaagaaccaaugucuagcuucgacgcuaagaucaauaacgagaauaugaccaaaugucugcaaagucucaaggaaauguaccaggaucugagaaacaaaggcgucuuuugcgccuccgaggcagaguuccagggauauaaugugcuucugagcuugaacaagggcgacauucucagggagguacaacaguuucaucccgcugugcgcaauucuucagaaguuaaauucgccguccaggcguuugccgcucugaacuccaacaauuucgugcgguuuuucaaguuagugcagagugcaagcuaccugaacgccugucuacuccacugcuacuuuucgcaaaucagaaaggaugcucugagggcccuuaauuucgcauauacugucucuacacagcgauccacgauauucccuuuggacgggguugugcgcaugcugcucuuucgggauugcgaggaggcgaccgacuuccugacuugucauggauuaacagugagcgauggcugcguagaacugaacagaucagccuuucuugagccggaagguuugaguaaaaccaggaagucugucuucauuacacguaaacucacuguguccguuggggagaucgugaauggaggcccacugcccccugucccacgccacacccccguguguagcuuuaacucacagaauaaguacaucggugagagucuagcugccgaacugccuguuagcacgcagcggccgggcuccgacaccguagggggaggcagaggggaggaaugcggaguagagcccgaugcaccacucucuagccugccucaaucccuucccgcuccagccccuucacccgucccauugccgccugugcuggcauuaacacccucuguggccccaagucucuuccagcugucgguccagcccgaaccuccacccccugagccgguuccaauguauagcgacgaggaccuugcucaggugguagaugaacugauucaagaggcguugcagagggacugugaagaggugggcuccgccggugcagcuuacgccgccgcugcacucggggucucuaacgccgcgauggaagaucugcuaacugcugccaccacaggaauccugcgacacauugcagccgaggaggugucaaaagaacgggagcgcagagaacaggagaggcaacgggcugaagaggagcgacucaagcaggaaagagagcugguucuuagcgaauugucccagggccuggcaguggaguuaauggagcgcgucaugauggaauuugugagggagacuugcagucaggaacucaagaaugccguugagaccgaccaacgugugcgggucgcgagauguugcgaagauguaugugcucaucugguggaccuuuuccugguugaggagauauuucagacggccaaagaaacacuacaggagcuccagugcuucuguaaguaucugcaaagguggcgcgaagcagugaccgcccggaaaaaguugagaagacagaugagggcuuuucccgccgcaccuugcugcgucgaugugucugaccgccugcgugcuuuagcccccagcgcggaguguccaaucgccgaagagaaccucgcaagaggucugcuugaucugggccacgcugggcgguugggaauuucaugcacuaggcuccgccgacugagaaauaaaacagcccaucagaugaagguacagcacuucuaccaacagcuacuguccgacguggcuugggcaagucuugaucucccuagccuggucgccgagcauuugcccggccggcaggaacacguauuuuggaagcugguguuagugcucccagacgucgaggaacagucuccugaguccugugggaggauccuggccaacuggcuuaaagugaaguucaugggagaugaaggcucaguugacgacaccagcucggaugcuggugggauccaaacucugucuuuguucaauagucucuccagcaaaggagaccagaugauuucaguaaacgugugcauaaaggucgcgcacggcgcacuguccgauggugccaucgacgcuguggagacccagaaagaucuacugggcgccucugggcuuaugcuccuguugccgcccaagaugaaaagcgaggacauggcagaagaggauguuuauugguuaagugcccugcuccaacugaagcagcuucugcaggcuaagccauuucagccugcguugccccuagugguccuggugccauccccuggaggcgacgccguagaaaaagaggucgaggaugggcucaugcugcaagaccuugugagcgcaaaguuaauuucugauuacacaguuacggaaauccccgacaccauuaaugaccugcagggaucaacuaaagugcuccaggcuguccagugguuggugagucauuguccgcacucccuggaucucugcugucaaacacugauccaguacguugaggacggcauaggucaugaguucagcgggcgcuuuuuccacgauagaagggagcggcgucuuggaggccuggccucucaggaaccaggcgcaaucauugaguuguuuaacucggugcuacaguuccuggccucagucgugagcuccgagcaacucugcgacuuaaguuggccuguaaccgaauuugcugaggccgggggaucucgccugcuuccccaucugcacuggaacgcgccagaacaccucgcaugguugaagcaggccgugcuggguuuccagcucccccaaauggaucugccuccgcuuggcgcucccuggcuaccaguuuguagcauggucgugcaguaugccucccagaucccuucaagucgacagacacaacccgugcugcagucucaggucgagaauuuguuacauagaacuuacuguagguggaaaagcaaguccccuucaccaguacacggggcuggacccagcgugauggaaauuccuugggacgaucugaucgcacucuguauaaaccauaagcugcgggacuggaccccaccccgccuuccgguuacgucugaggcccuguccgaggauggccagauuugcguguacuuuuucaaaaaugaccucaagaaauacgaugucccuuugaguugggaacaagcuagacugcagacacagaaggagcuacagcugagggaaggucggcucgccaucaaaccauuucaccccagcgcaaacaauuucccuauuccacuucugcacaugcaucgaaacuggaagagaucgaccgagugcgcgcaagaagggcgcauccccuccacugaggacuuaaugaggggagccucugcugaggaauugcuggcccagugucucucaagcagucugcuucuggagaaggaagagaauaaacgguuugaggaucagcuccagcaaugguuguccgaagacucuggcgcauucaccgaccugaccagcuuaccgcuauaucugccucagacucucgugucacuuucccacaccauagagcccguuaugaagacaagugugacgaccagcccacagucugauaugaugcgugaacaacugcaguugucagaggcuacuggcacaugccugggggaaagacucaaacaucuggagaggcuuauccgcuccagccgggaggaagaggucgccucugaacuccaccugagugcauugcuggacaugguggauauuuga

SEQ ID NO: 58896 - RNA, 2457 nt, Artificial Sequence
  derived and/or modified sequence opt3 from MCM3__Homo_sapiens__NP_001257401
augcugaucugcagccagggccccagacucuuccuugaggugaccuuugggggagguaaguccucugaagucuucgccccuggcuggucacacccagggaaccugcaugcuacauugguugaggugguauuauggcaaagggcauggcgggugccgugguguuggacuauguggaguugcggacgccugcgagaaauuacguggaccagcuggacaacucgucuacucaauaacgccuuugaggaacuggucgcguuccagagagcucuuaaagacuuuguggccuccauagaugcaaccuacgccaagcaguaugaggaguucuacguuggccuggaagguucuuuugggucgaaacacgugucacccaggacauugaccagcuguuuccucaguugcgucguguguguagagggaaucguuacuaagugcucccuggugcggccuaaagucgugcgcucugugcauuauuguccagcuacaaagaagaccauugaaagaagguacagcgaccugacgacucucgucgcauuucccuccucaaguguuuauccuaccaaagaugaggagaauaacccauuagaaacagaguacggccugagcguguauaaggaccaccagacuaucaccauucaagaaaugcccgagaaagccccugcuggccagcuuccacggucuguagaugugaucuuggacgaugaccuggucgauaaggccaaaccgggggaccgcgugcagguugugggaacauaccgaugccuacccgguaagaagggcggguacaccuccggaacguucagaacuguccucauagcguguaaugugaaacagaugucaaaggaugcacaaccuagcuuuagugccgaagacaucgcuaaaauuaagaaauucucuaagacaagguccaaagauaucuuugaccagcuggccaagagccuugcaccaucgauucauggccacgacuauguaaagaaagcuauccugugcuugcuccugggugggguugagcgggauuuagagaacggaucucacauacguggcgacauuaauauccugcucauuggcgaucccuccguggccaagucacagcuucugcgcuacgucuuguguaccgcgccuagagccaucccaacuacagggaggggaaguagcggugugggccuaaccgcagcugucacgaccgaccaggaaacaggggagcggcgacuggaagccggagcuauggugcucgccgaucgcggcguugugugcaucgacgaguucgauaaaauguccgacauggauagaacugcaauucaugaaguaauggagcaagguagggucaccauagccaaggcugggauccacgcgcggcugaacgcacgcugcucugugcuugccgcugccaaucccguuuauggcagauacgaccaguauaaaacaccgauggagaacauuggacugcaggauagcuugcucucaagguucgaccuguuauuuaucaugcuggaccaaauggauccugaacaggaccgugagauaagugaucaugugcuacggaugcaccgauacagagcacccggcgaacaggacggggaugccaugccacucggauccgcugucgacauucuggccacugaugacccuaauuucagccaggaggaucaacaggacacccagaucuaugaaaagcacgauaaccuuuugcaugguacaaagaaaaagaaagagaagauggugucugcagcguuuaugaaaaaguacauccacguagcuaagauuaucaaacccgugcugacccaggagucagccacuuacauugcagaagaguauaguaggcuccgcagccaagacuccaugucuucggauacggcccggacaagcccaguuaccgcuagaacucuggaaacccuuauaaggcuggccacagcacaugcuaaggcccgcauguccaaaaccgucgacuugcaggacgcggaggaggccguggaacucgugcaguacgcuuauuucaagaaaguccuggagaaggaaaagaaacgaaagaaacggucagaggaugaaagugagacugaggacgaagaggaaaagucucaggaggaucaagaacagaaacguaagagaaggaaaacacgccagcccgacgcaaaggauggcgacagcuacgauccuuaugacuuuuccgauacggaggaggaaaugccacagguucacaccccgaagacugccgacucacaagagacaaaagaaagccagaagguggaguuaucugaaucccggcugaaggcuuucaaaguggcccuacucgauguauuuagagaggcacaugcgcagaguaucgggaugaauaggcugaccgagagcauuaaccgagacucugaggaacccuucuccucagucgaaauccaagccgcucuuaguaaaaugcaggaugacaaucaggugaugguuagcgagggaaucauauuuuugauuuga

SEQ ID NO: 58897 - RNA, 2592 nt, Artificial Sequence
  derived and/or modified sequence opt3 from MCM4__Homo_sapiens__NP_877423
augagcucccccgccucuaccccuucaagaaggggcagucggcgcgggcgagcuacaccagcacagacuccgcguagcgaggacgccagauccucucccucgcaaaggcggcgcggagaagauucaacgagcaccggugagcugcagccuaugccaacaagucccggcguggaccuccaguccccugcggcucaggauguccuuuucucuagcccaccccaaaugcacuccucagccaucccucuggacuuugauguuaguagcccauugacuuacgggaccccgucuuccagaguggaaggaacacccaggucaggcguacgggguaccccugugcgccagcgaccagacuuagggagcgcacagaagggacugcaggucgaucuacaaagugacggcgccgcugcagaggauauuguggccucugaacagucccucggccagaaacugguuauaugggggacugacgugaacgucgcugccugcaaggagaauuuccagagauuucuucaaagguucaucgauccccuggcgaaagaggaagagaacgugggaauugacaucacagaaccuuuguauaugcagcggcucggugagauuaauguaaucggcgagccauuucugaacguuaauugugaacauauaaagagcuucgauaaaaaccuguaccgucagcucaucucguauccccaagaggugauuccgaccuuugacauggcagucaaugaaaucuucuuugaccgcuacccugauucuauuuuagagcaccagauccaggugagacccuucaacgcccugaagacgaagaauaugaggaaccuuaauccagaagacauagaucaguugauuacuaucuccgggauggugauucggaccucacaacugaucccugagaugcaggaggccuuuuuccagugccaggucugugcucauacaacucgaguugaaauggaccgcggaagaaucgcagagcccagugugugcgguaggugucacaccacacauagcauggcucuaauucacaaccggucccucuuuucugauaaacaaaugauaaagcugcaggaaagcccagaggacaugcccgccggccagaccccucacacgguaauccuuuucgcgcauaaugaucugguggacaaaguccagccaggggaucgcgugaacguuacuggaauuuauagagccgugccgaucagggucaauccccgugugucaaacguaaagaguguuuacaaaacacacauagacgugauucauuaucggaagaccgaugcaaagcgauugcacggccucgacgaagaggcugagcaaaaacuguucuccgaaaagagagucgaguuacugaaagaacucagcaggaagccugacaucuacgagcgccuugccucugcucuggccccaucaaucuacgaacacgaggauauuaaaaagggcaucuugcuacagcuguuugggggaacucggaaagacuucagucauacagguagaggcaaguuuagggcagagauuaacauacuccugugcggggaucccggaaccagcaagucccagcuucugcaguauguguacaauuuggucccucgcggccaauauacgucugguaaagggucgagcgccgugggccucaccgcuuacguuaugaaggacccagaaacacgacagcugguguuacagacuggagcgcugguacuauccgauaacggcaucuguugcauugacgaguucgauaaaaugaaugaaucaacccggaguguccuccacgaggugauggagcaacagacacugucuaucgcaaaggccgggaucauuugucagcuuaacgcucguacuagcguuuuggccgcagccaaucccauagaaucccaguggaacccgaaaaagaccacaaucgagaauauucaacugccucauacccuccugucaagauuugaccuuaucuuccuguugcucgauccacaggacgaggcuuaugauaggcgccuggcccaccauuuaguggcacuguacuaucagagcgaagaacaggcggaggaggaacuacucgacauggcuguccugaaggauuacauugccuacgcacacucuacuaucaugccccggcuuuccgaggaagccagucaggcuuugauagaggccuauguggacaugagaaaaaucggaagcucuagggguaugguauccgcauacccucgacaacuggaaucacucauucgccuggcugaggcccacgcgaaggugcgguuaaguaacaaaguugaggccaucgacgucgaagaggcuaagagacugcauagggaagcacuuaaacagagcgccacggauccccguacaggcauuguggacaucucgauauugaccacugggauguccgcuaccucucgcaagcggaaggaggaacucgccgaggcacugaaaaagcuaauucugagcaaaggaaagacaccagcgcucaaauaucagcaacuguuugaggauaucagaggccagucagacauugccaucaccaaggauauguucgaagaggcucuuagggccuuggcagacgaugacuuucugacugugacagguaagacgguccgauuacucuga

SEQ ID NO: 58898 - RNA, 2205 nt, Artificial Sequence
  derived and/or modified sequence opt3 from MCM5__Homo_sapiens__NP_006730
augagcggcuucgacgaucccgggaucuuuuacuccgacucuuucggaggugaugcccaggcugacgagggccaagcaagaaagucacagcugcagaggcgguuuaaagaguuccuccgccaguaucgaguggggaccgaucguacaggauuuacuuucaaguacagagacgaacuuaaaaggcacuauaaccugggcgaauacuggauugaggucgaaauggaggauuuggccaguuuugacgaggauuuagcggacuaucuguacaagcaaccugcugaacaucuacagcuccuggaggaagccgcaaaagagguugccgaugaggugacgcggccacgcccgagcggugaagagguacuucaggacauacaggugaugcugaaguccgaugcuucucccucgucaauccggagcuugaagagugacaugaugucccaccucgucaaaauuccugggaucauuaucgcagccucugcugugagggccaaggcgacccggauaagcauccaaugccgcuccugucgaaauacacugacuaacauugcaaugagaccaggacuggaaggcuaugcccuccccaggaaaugcaauaccgaccaggcuggccggccuaaguguccauuagaucccuacuucaucaugccugacaaaugcaaguguguugauuuucagacacugaaguugcaggaguugccagacgccgugccgcauggggaaaugccccgucacaugcaacuguacugcgaucgcuaucuaugugacaaagucgugccuggaaacagaguaaccauuauggguaucuacucaauaaagaaauucggccucacuacaaguagggggcgggaucgaguuggagugggcauucgcagcucuuauaucagaguccuggguauucagguggacaccgauggguccggaaggucauuugcaggcgcugugagcccacaggaggaggaagaguuccggcgccuugccgcgcugcccaaugucuacgaaguuaucaguaagucuaucgccccuuccauuuuuggcgggacggacaugaaaaaggcaauagcuugccuucucuucggagguagcagaaaaaggcugccagauggcuuaacucguagaggggacaucaaccugcucaugcuuggagaccccggcaccgccaagucgcaacuguugaaguucguggagaaauguucuccgauugguguauauacauccgggaagggcucaagugcugccggacuaacugcaagcgugaugcgagauccuuccucuagaaauuuuaucauggaaggcggggccaugguccuggcugacggaggugugguuugcauagaugaguucgacaaaaugagggaggaugaccgcguggcgauucaugaagcaauggagcagcagaccaucagcaucgccaaggcuggcauuacaaccacgcucaacucacgguguaguguccuggccgcagccaauuccguguuugggagaugggaugaaacuaaaggagaggacaacaucgauuucaugcccacaauucuuagcagguuugacaugauauucaucguaaaggaugaacacaaugaggagcgcgacguuaugcuggcuaagcacgugauuaccuugcaugucucugcccucacucagacacaagcaguggaaggcgagaucgaucuggcgaaauuaaagaaauuuaucgcuuacugccgagucaagugcgguccacggcugucagccgaagcagccgagaaacuaaagaaccguuauauuauaaugagaaguggggcuaggcagcacgagcgcgacagcgaccggagauccucuaucccuauuaccgugaggcagcucgaagccaucguucgaauugcagaggcucugucgaagaugaaacuucagcccuucgccacggaagcggauguggaggaagccuugcgccuguuucaaguaagcacccucgacgcugcacuguccggcacacuuucaggagucgagggcuucaccagucaggaggaucaggaaaugcugucucggaucgagaagcaguugaaaagaagguuugccauagggagccaaguguccgaacauucaaucauuaaggacuucacuaaacagaaguacccagagcacgcuauccacaagguucuccagcugauguuacgucgcggagaaauucagcaucggaugcaaagaaaagugcuguacaggcuaaaguga

SEQ ID NO: 58899 - RNA, 2466 nt, Artificial Sequence
  derived and/or modified sequence opt3 from MCM6__Homo_sapiens__NP_005906
auggaccuggccgcugcagccgagcccggcgcggggagccagcaccucgaagugagagaugaggucgcugaaaagugccaaaaacuuuuccuggacuuuuuggaggaguuccaguccucugauggagaaaucaaguacuuacagcuggccgaggaacuaauuaggccugagcggaacacccucguugugucauuuguagaccuggaacaguucaaucaacagcuuaguacaacuauacaggaggaguuuuaucgcguguacccauaucugugucgagcauugaaaacguucgucaaggaucguaaagaaaucccgcucgccaaggacuuuuacguggcuuuccaggaucugcccaccagacauaagauuagggagcugacaagcucccggaucggucucuuaacucgcauuucuggccaaguugugagaacccacccuguccauccagaacuggugucggggacauuucuuugcuuggacugucagaccguaaucagggauguugagcagcaguucaaauauacucaacccaacauaugccggaauccugugugugcaaaccgccgaagauuucugcuagacacaaauaagucaagguucgucgauuuucagaaagugcggauccaggaaacccaagccgagcucccacguggaagcauuccccgcagucuggaggugauccuuagagcugaagccgucgaguccgcgcaggcaggcgacaagugcgauuucacggguacucugauuguugugccugacguaucuaaauugagcaccccaggggccagggcugaaacaaacucccgggugucaggagucgacggcuacgagacugaaggcauccgagggcuccgcgcccugggagugagagauuuaaguuauaggcugguuuuccucgcauguugcguggcuccgaccaauccccgguuugguggcaaggagcuucgcgacgaggaacagacagccgagagcauaaagaaccagaugaccgucaaagaaugggagaagguguucgaaaugucucaagauaaaaaucuguaccacaacuuguguacgucccuauuuccuacuauucaugggaaugacgagguaaagagaggaguucugcucaugcuguucggcggugugccaaaaacaaccggggagggaacuucacuuaggggcgauaucaacgucugcauugugggcgaccccagcacagcgaagagucaguuucugaaacacgucgaagaguucucuccucgugccguguacaccuccgggaaggcaagcucggcugccggauugacggcugccguugugcgggaugaagagucucacgaguuuguaaucgaagccggugcacucaugcuggcugacaauggcgucuguugcaucgaugaguucgacaagauggaugugcgagaccagguugcgauucaugaagcaauggagcagcaaaccauauccaucacaaaagccggggugaaggcuacuuuaaacgccagaaccucaauucuggcagccgcuaauccaaucaguggacacuaugacaggagcaaaucccuaaagcagaacauaaaccucucugcccccauuaugagccgcuuugaucuguucuuuauccuugucgacgaaugcaaugaggugacagauuacgcaaucgcgcggagaauuguagacuugcauucaaggaucgaggaaaguauugaucgcguguauucccuggacgauauacgacgguaccuccuguucgcucgucaguuuaaaccgaagaucagcaaggagucugaagacuucauuguugagcaguauaaacaccuuagacaaagggauggcucaggugucacuaagaguagcuggcgcaucaccgugcggcagcuggaauccaugaucagauugucugaggccauggcaaggaugcacuguugcgacgaggugcagccuaaacaugucaaggaagccuuccgacuccugaacaaaucgauuauacgcguugagacacccgaugugaauuuagaccaggaagaggaaauccaaauggagguggaugagggggcuggcggaauuaacggccacgccgacagcccagcaccuguaaaugggaucaacggauacaaugaagacauuaaccaggaguccgcucccaaggccucacugcggcuagguuuuagugaauauuguagaaucucuaaucucauaguccugcaucuuaggaagguggaggaggaagaggaugaaagcgcguugaaacguuccgagcugguuaacugguaccucaaggaaaucgagucagagauugacagcgaagaggaacugaucaauaaaaagcgcauuaucgagaaagugauacaccgguuaacccauuacgaucacguccugauugaacuuacucaggccggcuugaaggggucuacggagggauccgagaguuaugaagaggacccauaccucgugguuaaccccaauuaucugcuagaagauuga

SEQ ID NO: 58900 - RNA, 2160 nt, Artificial Sequence
  derived and/or modified sequence opt3 from MCM7__Homo_sapiens__NP_005907
auggcccugaaggacuacgcucucgagaaagaaaaggugaaaaaguuccuucaggaguuuuaucaagaugacgaacugggcaaaaagcaguucaaguacgggaaccaguuggucagauuagcacacagggagcagguugcccuguauguggaucuagacgauguagcggaagacgaucccgagcucguggacagcaucugcgagaaugcucggcgcuacgccaaacuguuugcagaugccguccaagaacuucugccucaguauaaggagcgagaagugguuaacaaagacguguuggaugucuacauugagcaucgucucaugauggagcagagauccagggacccaggaauggugcggucuccgcagaaucaauaucccgcugaacugaugcgcagauucgagcuguacuuucaggguccuucaaguaacaagccaaggguaauacgggaaguucgcgcagauagcgugggcaaacucgucaccgugcgagggaucgugacaagagucuccgagguuaagcccaagauggugguagccacuuacacgugugaccagugcggagcugaaaccuaucagccuauucaaucuccaacauucaugcccuuaaucauguguccuucgcaggagugccagacuaauaggucaggcggucggcuguaccuucaaacccgugggagccgcuuuauuaaauuccaggagaugaagaugcaggaacacagugaccaggugccagucggaaacaucccgagauccauaacaguguugguugagggcgaaaauaccaggaucgcccaacccggcgaucaugugucugucacugggauuuuucugccuauccuacggacaggauuccgacaggugguacagggucuccugagcgagaccuaucuugaagcgcaccgcauuguuaaaaugaacaaguccgaggacgaugagucaggcgcaggggaacugacgagagaggaauugaggcagaucgccgaggaagacuuuuacgagaaacucgcugccaguauagcaccagagauuuauggacaugaagaugugaagaaagcucuguuacugcuccuugucggcgguguggaccaaagcccccgggggaugaagauccgcggaaauauuaacaucugucugaugggcgauccuggcgucgccaagucucaguugcuauccuacaucgacagacuggcgccaaggucacaguauacuaccgggcguggaagcaguggugugggccucacagccgcaguucugcgggauucuguguccggggagcuuacucuggaaggaggcgcuuugguacucgccgaccagggugucugcuguauugaugaguucgacaaaauggcugaggccgaccgaaccgcaauacacgaagugauggagcaacagacaaucagcauugccaaggcugggauccugaccacguuaaaugcgagaugcucgauacuggcagccgcuaaccccgccuacggcagguacaauccgcgccggucucuagaacagaacauucagcucccugcagcccugcuuuccagauuugauuugcuguggcucauccaagacaggcccgaucgcgacaaugaucugcgacuugcucagcacaucacuuauguucaucagcacucacggcaaccaccuagucaguucgagccccuggacaugaaauugaugcguagauacauugccauguguagggaaaagcagccaauggugcccgagagccucgcagauuauaucacagcggcuuacgucgagaugcgccgggaagccugggcauccaaagacgccaccuauacuucugcuagaacacuguuagccauucugaggcuaagcaccgcacucgcucgacugcgcaugguggauguaguggagaaggaagacguuaacgaggccauacggcuuauggaaaugucaaaggauaguuugcugggagacaaaggccagacggcgagaacccaaaggccugccgaugucaucuucgcuacagugcgugagcucguguccgggggacgcagcguccgguuuucugaggcagaacagagaugcguuucaagggguuucacuccagcccaguuucaggcugcccuggacgaguacgaagaguuaaacguguggcaagugaaugcaagucgaacccggauuacauucguauga

SEQ ID NO: 58901 - RNA, 2523 nt, Artificial Sequence
  derived and/or modified sequence opt3 from MCM8__Homo_sapiens__NP_001268449
augaacggcgaguacagagggaggggauucggucggggccgcuuucagagcuggaagcgagggcguggaggcgguaauuucuccgggaaauggagagaaagggagcaccggcccgaccugucuaagaccacaggaaaacgcacuucagaacaaacgccucaguuucuccuuaguaccaagacaccacagagcaugcaguccacucuggauagauucaucccguauaaaggcuggaaguuguacuuuucugagguguauucggacucaagccccuuaauugaaaagauacaagccuucgagaaauuuuucaccaggcauaucgaucuguacgacaaggaugagauugaacggaaaggcaguauccuagucgacuuuaaggagcucacagaagggggagagguuaccaaccugauuccugauaucgcuacugagcuucgcgacgcaccagagaaaacacuggccugcauggguuuggcgauacaccaggugcucaccaaggaucuggaacgacaugcugccgaacugcaggcacaggagggccucuccaaugacggggaaacgaugguaaacgugccccacauccaugccagagucuauaauuacgagccuuuaacucaacugaagaacgugagggcuaauuauuacggaaaauacauugcacuucggggcaccguugugcgugucucuaacaucaagccauuguguacaaaaauggccuuccugugcgcugccuguggugagauucagagcuuuccccuaccugaugggaaguauucccucccaacuaaaugcccggugcccguaugucgcggaagaucauucaccgcgcugaggaguagcccucuuacaguuaccauggacuggcagucuaucaagauacaggaacugauguccgaugaccaacgggaggcaggccgcauuccacgaacgaucgaaugcgaguuggugcacgaccucgucgauucaugugugcccggcgacacugugacaauuaccgggaucgucaaaguuagcaaugccgaagagggaaguagaaacaagaaugauaagugcauguuucuguuauacaucgaggcuaacucuauuuccaauagcaaaggucagaagacuaaaucgucugaagacggcuguaagcacgggaugcugauggaguucucccucaaagaucuuuaugccauacaggaaauccaagcagaggaaaaccuguucaaguugauuguaaauucacuaugcccugugaucuuuggacaugagcuggugaaggcuggccucgcccuggcgcuuuucggugggagucagaaauacgccgacgauaagaacaggauaccaauucggggcgacccccacauccuggucgugggagauccgggcuuggggaaaagccagaugcuccaggcagcuuguaacguugccccucgcggaguguaugucugcgguaauacaaccacgaccuccggccugacagugacuuuaucuaaggacagcucaaguggggauuuugcucuggaggccggagcccuaguacucggcgaccaagguaucugcgggauugacgaguucgauaaaaugggcaaccagcaucaggcacugcuugaagcuauggaacagcaauccaucagcuuggcgaaggcaggaguuguguguucucugcccgccagaaccucaauuauagcugccgcaaauccagucggcgggcacuacaacaaggccaaaacagugagugagaaucucaagaugggaagcgcucugcuuuccagguuugaccuggucuucaucuugcucgauacuccuaacgagcaccaugaccaccuguuaucugaacaugugauugccauccgugcagguaaacagcggaccaucucgagcgcgacaguugcucgaaugaacucccaggauucaaauaccagugugcuggagguagucucugaaaagccccuaagcgagagacucaaagugguuccaggcgaaacuauugaccccauaccucaccagcugcuuaggaaguauaucggguacgcccgccaauacguguauccacgguuguccacggaggcagccagaguccugcaggauuuuuaccucgagcugaggaagcagucacagcgcuuaaauagcucuccgauuacaacccgacaacuggaaucccuuauccgguugacugaggcucgugccagacucgaacugagggaggaagcaaccaaagaggacgcugaggauauuguggaaaucaugaaguauaguaugcuaggaacauacagcgacgaguucggcaaccuggauuuugaacgcucucagcaugguuccgggaugucaaaucggaguaccgccaaaagauucauaagcgcgcucaacaauguagccgagaggacuuauaacaauaucuuucaguuccaccaacugcgacagauugcuaaggaacuuaacauccagguggcagacuuugagaacuucauuggcucguugaaugaucagggauaccugcucaaaaagggccccaaaguuuaucaauuacagacaauguga

SEQ ID NO: 58902 - RNA, 3432 nt, Artificial Sequence
  derived and/or modified sequence opt3 from MCM9__Homo_sapiens__NP_060166
augaacagcgaccaggugacccuggucggccaaguuuucgaguccuacgugucugaauaucacaagaaugauauccuccuuauucugaaagagagagacgaagaugcccauuaccccguaguggucaacgcuaugacauuguuugagacuaauauggaaauaggggaguauuucaacauguuuccuucagagguguuaacgaucuucgacagugcacugaggcggagcgcccuaaccauucuccagucccugucucagccagaagcgguuucgaugaagcagaaucuucacgcucgcaucucaggacugccggugugccccgaguugguccgagaacauauuccuaaaacaaaggaugugggucacuuucucagcguaacuggcaccguuauccguacaagucuggugaaaguccuggaguucgagagagacuacauguguaacaagugcaagcauguguuugugauaaaagccgauuucgaacaauauuacaccuuuuguaggccauccucuugccccagccucgaguccugugacucaaguaaguucacuugcuuaagcgggcugucuuccucaccuacacggugucgcgauuaucaggaaaucaaaauucaggagcagguccaaagacuuagcguuggaaguaucccaaggucuaugaaggugauuuuggaagacgaucugguagacuccugcaaaagcggcgaugaccuaaccaucuacgguauagugaugcagcgguggaagcccuuucagcaggacguccgcugugagguggagauuguucucaaggcaaauuacauccaagugaacaaugaacagucgucugggauuaucauggaugaggaaguccagaaagaguucgaagacuuuugggaguauuacaaguccgauccuuucgccggacgaaacgugauccuggcuucacuuugcccacaaguauucggcauguaucugguuaaauuggcaguggccaugguccucgcuggcgggauucagagaacggacgccacuggaaccagggugcggggugagagucaccuguuacuggucggcgauccggggacaggaaagagccaguuucucaaauacgcggcaaagauaacuccccguuccgugcuuaccacaggcaucgguucuaccagcgccgggcugacgguuacugcugugaaagacucaggagaauggaauuuggaggccggcgcucuaguacuggcugaugccggccucuguugcauugacgaguucaacagucugaaggagcacgaucgcacauccauccaugaagcgauggagcagcaaaccauaagcgucgccaaggcagggcuugugugcaaacugaauacuagaacaaccauuuuggcugccacgaacccuaagggacaguaugacccacaggagucuguuucagugaauaucgcucucgguaguccccuguuaagcagguuugaucugauccuaguccuccuggacaccaaaaacgaagacugggaucggauuaucuccucuuucauucuugagaacaagggcuacccuucgaaaagcgaaaaguugugguccauggagaagaugaaaacauauuuuugucugauacgaaaucuccagccaacucugucagacguggggaaccaaguacuucugcgcuacuaccagaugcagagacagagugauugcaggaaugccgcacggaccacaauccgcuugcucgagucucugauuagauuagccgaagcucacgcgaggcugauguuccgugacacugugacccuagaggaugcaaucacaguugucagcgugauggaauccucaaugcaaggaggcgcccuccuggguggggugaacgcacuucauaccagcuuucccgagaauccgggcgaacaguaucagcggcagugugaguugauccuggagaagcucgaacugcaaucuuuacuguccgaggaacuucgaagauuggagaggcuccagaaccagaguguccaccaaagccagccucgcguucuggaaguggagacuacgcccggaucucuacggaauggcccaggggaggaauccaacuucagaacaucaagucagcaggagauuaauuacagcacccacauauuuucgccuggagguucccccgaaggcucuccagugcuggaucccccuccacaucucgagccgaacaggagcacuucacgcaaacacagugcccaacauaagaauaaccgagacgacucccuggauugguucgacuuuauggcaacccaccagucugaacccaaaaauacaguagucgugagcccucauccaaagaccuccggggagaacauggccucaaagaucagcaauaguacuucucagggaaaagagaaguccgaacccggccagcggagcaaaguugauauuggucuuuugccuucgccaggggagacaggcgugcccuggcgugcugacaacgucgaaucaaacaagaaaaagagacuggccuuagauucugaggcagcggugagugcugacaagccggacuccguucucacgcaccacgugccuaggaaucugcaaaaacuuugcaaggagcgcgcccagaaacugugucggaacagcaccagaguaccagcacagugcacuguccccucucauccucagagcacacccgugcacuccccagauaggauguuggacucaccuaagcgaaaacgccccaagagucucgcccaaguggaagaaccagcuaucgaaaaugucaaaccgccuggaagccccguugccaagcuggcaaaguucaccuuuaaacagaagucuaaacuaauucauuccuucgaggaucacucacacgugaguccaggcgcuacaaagaucgccguacauagccccaaaauaucccagcggagaacuaggcgugacgcggcccugccugugaagcgcccagggaagcucaccucuacgcccggaaaccaaaucucgagccagccucagggugaaaccaaagaggucucacagcaaccgccagagaagcacggcccccgggaaaaagugaugugugcuccugagaagagaauuauccagccagaacuggagcuugggaaugaaacaggaugcgcacauuugacuugugagggcgauaaaaaggaggaaguuuccgguaguaacaagucugggaaagugcacgccugcacccuggcuagguuagccaauuucuguuuuacacccccuagcgaguccaagucaaaaucuccgcccccagaacgaaagaaccggggcgagcgcggaccuagcagucccccaacuaccacggcaccuaugagagucuccaaaaggaagucuuuccagcuccggggcagcacagaaaagcugauugugucaaaagagucccuuuuuacccugcccgagcuaggggacgaagcguucgauugcgacugggaugaggaaaugcgaaagaaaaguuga

SEQ ID NO: 58903 - RNA, 1923 nt, Artificial Sequence
  derived and/or modified sequence opt3 from MCMBP__Homo_sapiens__NP_001243307
augcccugcggcgaggacuggcugagccacccucucgggaucgugcagggauucuuugcccaaaacggugucaauccagauugggaaaagaaaguuauugaguacuucaaggaaaaacuuaaggagaacaaugcuccgaaaugggugcccucccugaacgaaguaccuuugcauuauuuaaagccaaauucuuuugugaaguucagauguaugauacaggacauguuugaucccgaguucuacaugggcgucuaugagaccgugaaccagaauacaaaagcacacguucugcauuuugggaaguacagggacguggccgaaugcggaccucagcaagagcuagaucucaacucaccacggaauacuacgcuggaacgccagaccuucuauuguguccccgugccuggcgagaguacauggguaaaagaggcguacguuaacgcuaaucaggcccgagugagcccauccacuucuuauaccccgucgcgucacaagagaucauacgaagacgaugacgauauggaccuucagcccaacaaacaaaaggaucagcaugccggugcaaggcaggcugggagcgucggaggccugcaguggugcggcgagccuaagcgguuggaaacagaggcaaguaccgggcaacagcucaauucccugaaccugucuagcccauuugaccucaauuuccccuuaccuggagaaaaagguccagccugucuggugaagguguacgaggauugggacugcuuuaaagucaacgacauccuugaguuguauggcauucuguccguugaucccgugcuaucaauccucaacaaugacgaacgcgaugcuagugcccugcuugacccgauggaguguacugauacagcggaggaacagagaguacacagcccucccgcaucucuggugccaaggauucacgucaucuuggcccaaaagcuccagcauauaaacccucuguuacccgcuugccugaauaaagaagaguccaagaccuucgugagcucauuuaugagugagcucucuccaguucgggccgaacuucugggguucuugacgcacgcacuacugggagacucccucgcugccgaguaccugauccuucaucugauuagcacuguguauacccgccgagaugucuugccccucggcaaauucacagugaaccugucggguuguccuagaaauucuacuuuuaccgaacacuuauacaggaucauucagcaccugguaccagcguccuuccggcuacagaugacaaucgagaacaugaaucaucucaaguuuauaccgcacaaggacuauaccgccaaccgucugguuucagggcuuuugcaacugcccaguaauacgagccucgugauugaugaaacucugcuugagcagggacagcuggacacaccuggcguccauaacgugaccgcauuguccaaucucaucacuuggcagaaagucgauuacgacuucucuuaucaccaaauggaguuuccaugcaacauuaauguguucaucacaagcgaaggccgcucacuguuacccgcugacugucagauccaucugcagccucagcuaauuccacccaacauggaggaauacaugaauagucuccuguccgccguucuuccgagcguguugaacaaguuuagaauauaccugacccuccugagguucuuagaguauucuaucucagaugagauuacgaaagcuguagaagacgauuuugucgagaugcggaagaacgacccucaaaguaucaccgccgaugaccugcaccagcuuuuggugguugcacgaugccucagccuguccgccgggcagacaacucuaucucgcgaaagauggcugagggcuaaacagcucgagucgcugcggcgcaccagacuucaacagcagaagugcgugaauggaaacgaauuguga

SEQ ID NO: 58904 - RNA, 1743 nt, Artificial Sequence
  derived and/or modified sequence opt3 from MCOLN1__Homo_sapiens__NP_065394
augaccgcccccgcuggcccuagagggagcgagacagaaaggcugcucacuccaaacccgggauacgguacgcaggcaggccccuccccugccccacccaccccuccagaggaagaggaccuucggcgccgacugaaguauuucuuuaugucucccugcgauaaauuccgugcgaaggggagaaaaccuuguaaguugauguuacaaguggucaaaauccugguugugacaguacagcuaauucucuuuggacugucaaaucagcuugcugugacuuucagggaagagaacaccauagccuuucggcaccuguucuugcucggcuacagugacggugcagaugacacauuugccgcuuauacccgcgagcagcuguaccaagcaaucuuccaugccgucgaucaguaucuggcucucccagacgugagcuuagggagauacgccuauguuaggggaggcggcgauccguggacuaauggguccggacuggcgcuuugccagcgguacuaccaccgcggucauguggaccccgcaaacgauacauuugacauugauccuauggucgugaccgacuguauccagguagauccacccgaacgaccuccacccccgccuucugacgacuugacgcugcuagagucgucaagcaguuauaagaaucucacucugaaguuccacaaacuuguuaacgugaccauucauuuuagacugaagacaaucaauuugcaaucccucauaaacaaugaaauccccgauugcuacacuuucucuguccugauuaccuuugacaacaaagcccacagcggcaggaucccaauuuccuuagagacacaggcucacauccaggaguguaagcauccuucaguguuccagcacggggauaauaguuuccggcugcucuuugacguggucguuauacuuaccugcagccugucuuucuugcuaugugcccguucccugcuccgcggauuucugcuucaaaacgaguucgugggcuuuauguggagacagaggggucggguaauuucacugugggaacgauuggaguucgugaaugggugguauauccuccuggucacgagcgauguguuaacuauuaguggaacaaucaugaaaaucggcauugaagcaaagaaccuggcuucuuacgacguuugcuccauacuacucggcaccagcacucugcuugugugggucggggugauccgcuauuugacauuuuuccauaauuacaacauucugaucgccacccucagaguagcgcugcccucgguuaugagguuuuguugcuguguggccgucauauaucuuggauacugcuucugcgguuggauugugcugggcccauaccacgucaaguuucggucuuuguccauggugucagaaugucucuucagucugaucaacggggaugacauguuuguuacguucgcagcuaugcaggcccaacagggacgcagcuccuuaguguggcuguucucucagcuauaucucuacagcuuuaucucacuguucauuuauaugguacuuaguuuguuuaucgcucugauuaccggcgccuacgauacaauaaaacaccccgguggggcaggcgccgaggaguccgaacuccaggcuuauaucgcgcaaugccaggacagcccuacuucuggaaaguucagaaggggcucagggagugcauguagccuguuaugcuguugcggacgugauccauccgaggaacauucucugcuugucaauuga

SEQ ID NO: 58905 - RNA, 1734 nt, Artificial Sequence
  derived and/or modified sequence opt3 from MCOLN3__Homo_sapiens__XP_011540041
auggagggcagaagggccggggcuggacgggaaaugcagcuguuccgcgcagcccccaagccuccagcggagauggcugacccggaaguggucguuagcuccuguucuucacacgaggaagagaaccgaugcaauuuuaaccaacagaccagucccagcgaggaacuccuucuggaggaucagaugcguagaaaauugaaguucuuuuucaugaauccuugcgaaaaauuuugggccaggggucggaagccauggaaauuagcaauccagauucugaagauagccauggugacaauccagcuaguacucuucggccuguccaaccaaaugguggucgcuuuuaaggaggagaauacuauugcauucaaacaucuuuuucugaagggguacauggaccgcauggaugacacguaugccguguacacccagucugauguuuaugaccaguugaucuucgcugugaaccaauaccuccagcuguauaaugucucggugggaaaccacgccuacgaaaauaaaggcacaaagcagucagcgauggcaauuugucagcauuuuuauaaaagagguaacaucuaccccgggaaugauacuuucgacauagauccugagaucgaaaccgagugcuuuuucguagaaccagacgagcccuuccacauuggaaccccugccgagaacaagcugaaucucacauuagauuuucauaggcugcuuacuguugaauugcaauucaagcugaaagcuaucaaccuacagacagugcggcaccaggagcucccagacuguuacgauuuuacccugacgauuacuuucgacaauaaggcccacagcggccgcaucaaaauaagucuugacaacgauauuuccauccgagaaugcaaggacuggcaugucucuggcagcauucagaaaaacacccacuauaugaugaucuuugaugcauucgugauccugacauguuuggugucccucauucugugcauaagaucagucaucaggggguuacaacugcagcaggaguuuguuaauuucuuucuccuucauuacaagaaagaagugaguguaagcgaccaaauggaguucgugaacggaugguauauuaugaucauaauuucugauauccugacuaucauugguuccaucuugaagauggagauucaggcuaagucacuaaccagcuacgacgucuguaguauacugcucggcacaucuaccaugcugguguggcuugggguuauccgguaucugggauuuuucgccaaauacaauuugcucauucugacguuacaggcggcccugccgaacgugauccguuuuugcuguugcgcagcuaugaucuaucuaggcuacugcuucugugguuggauuguccucgggcccuaccacgauaaguuccgcucccugaauauggugagcgaaugccucuuuucguugauaaacggagacgauauguucgccacuuuugcuaaaaugcagcaaaagucuuaucugguauggcuuuucuccagaaucuaccuguauucauuuauuagucuuuucaucuacaugauucugagcuuguuuaucgcccucauaacagacaccuaugagacuaucaaacaguaccagcaggauggcuucccugaaacagagcugaggaccuuuauuuccgaauguaaggacuuaccaaauucuggcaaguaucggcuggaggacgaucccccuguuagccuauucugcuguugcaaaaaguga

SEQ ID NO: 58906 - RNA, 1833 nt, Artificial Sequence
  derived and/or modified sequence opt3 from MCPH1__Homo_sapiens__NP_001166045
auggccgcucccauccugaaggacguggucgcauacguugagguguggagcuccaacggcaccgaaaauuauucuaaaacauucacuacgcagcucguagauaugggggccaaggugucaaaaaccuuuaacaagcaagucacacacgugauuuucaaagacggauaccagaguacuugggauaaggcgcagaagagagguguuaaacuugugagcguccuguggguggagaagugcaggaccgcuggcgcccauauagacgaauccuuguuuccugcagccaauaugaacgagcacuuaucuucgcugaucaaaaagaaacggaaguguaugcagccaaaggauuucaauuuuaaaacaccggaaaacgacaagcgcuuccaaaagaaguuugagaaaauggcuaaggagcuacagcgacagaaaaccaaucucgaugacgauguacccauucugcuuuucgaaucaaacgggagccugaucuauacuccuacaauugagaucaauaguucccaucacucugcaauggaaaagcguuugcaggagaugaaggagaaaagagaaaaccucagcccaaccuccucacaaaugauacagcagagucaugacaaucccagcaacucucugugcgaggccccucugaauaucuccagggauacgcucuguucagacgaauacuuugcuggaggcuuacacagcaguuucgaugaccugugcgguaacucuggguguggaaaucaggagcggaaacuugaaggcuccauuaacgacaucaaaagcgauguuugcauuucgucuuuggugcugaaggccaacaauauccacuccucaccaaguuuuacucaucuagacaaaagcaguccccaaaaguuccucucuaaccugagcaaggaggagauaaaucuucagcgcaacauugcgggcaaagucgugaccccugaucagaagcaagcagccgggaugucacaggaaacauuugaggaaaaauauagacugaguccaacuuuguccagcaccaagggacaccuccugauccauucuaggccgcggucaaguagcgugaaacgcaagcgagucucccacgguucucacucgcccccuaaggagaaauguaagagaaaaaggagcacacggcguuccauuaugccacgcuuacagcugugcagaucagaagacaggcuccagcauguugcuggccccgcccuugaggcacugaguuguggggagucuagcuacgaugacuauuucuccccugauaauuugaaggaacgguacucagagaaccuaccacccgaaagccaacugccgucuuccccugcucagcucaguugccgaagccugucuaaaaaggagcgcaccuccaucuucgaaaugucagacuuuaguugugugggaaagaaaacgagaacuguagauaucacaaauuucaccgccaagacuauuagcucgcccaggaaaacaggcaacggugaggggcgggcgaccuccucuugcgugacgagcgccccagaggaagcacuucgcugcuguagacaggcuggaaaggaggacgccugcccugaaggcaauggcuuuucauacaccauagaggaucccgcucugccaaaagggcacgacgacgauuugacaccccucgagggaagucuggaagagaugaaggaagccgucgguuuaaaauccacucagaacaagggcaccacaucuaagaucagcaauuccucagagggggaagcacaaagcgagcaugagccuuguuucauuguggacugcaacauggaaacuuccaccgaggaaaaagagaaucugccaggaggcuauucugguuccauguga

SEQ ID NO: 58907 - RNA, 1428 nt, Artificial Sequence
  derived and/or modified sequence opt3 from MCRS1__Homo_sapiens__NP_001012300
augaccagaggcacagggggaacugcccagaggggucggagcggccccgacucccaagggcugcucgauucuucacuuauggcuaguggaacggcaagccgcuccgaggacgaagagucucuggccggccagaagcgagcgucgucacaggcuuuggguaccaucccuaaacguagaagcaguuccagguucauuaagcggaaaaaguuugaugacgaauuaguggagucuagccuggccaaauccucaacacgcgcaaagggggccaguggagucgaaccaggcagaugcagcggcucugagccguccucaagcgagaagaaaaagguuaguaaagcucccucuacuccugugccacccuccccugcaccagcccccgggcuaaccaagagggugaaaaagagcaagcagccucuccaagugacaaaagaucugggacgguggaagccagcugacgaucuucuguugauaaacgccguccuccagaccaaugaccugacuucggugcaccuggguguuaaauucucuugucgcuuuacacuccgagaagugcaggagagaugguacgcguuacuguaugauccggucaucuccaaacuugcaugccaggccaugaggcaauugcaucccgaagcuauugccgcaauccagucaaaagcucuguucaguaaggccgaggagcagcuacucagcaaagugggcuccaccucucagccuacgcuggaaacuuuucaagaccuucugcaccggcauccagaugcguucuacuuggcccguaccgcaaaggcucuccaggcccacuggcagcugaugaagcaauauuacuuacuggaggaccagacaguacagccccucccuaaaggggaucagguucuuaacuuuagcgacgcugaagaccugauugaugacucaaaguugaaagauaugcgcgacgaggugcuagaacaugagcugauggucgccgauagaaggcaaaagcgggagauccgacagcucgaacaggagcugcacaaauggcagguacuuguggacaguauaacuggaauguccagcccagauuucgacaaucaaacccuggcagucuugcgcggcagaaugguuagguaucucaugcggucucgcgaaaucacacuggguagagccaccaaggauaaccagauugacguggauuuaucacuggaggggcccgcuuggaagaucaguaggaaacagggaguaauuaagcuaaagaauaacggcgacuuuuucaucgcgaaugaaggccgucggccgauauacauugacgggcgaccugugcucuguggaagcaaguggagacuguccaacaauucugucguggagaucgcaucgcuuagguuuguuuucuugauuaaccaggaucugaucgcccucauccgcgcugaggccgcaaaaauuacgccccaauga

SEQ ID NO: 58908 - RNA, 2337 nt, Artificial Sequence
  derived and/or modified sequence opt3 from MCTP1__Homo_sapiens__NP_001002796
augcuggacagcugcaagcucaaauccgccuguaaccuucccuucaucugcaauaagaaaauuauaaacaccgcuggcacaucuaaugcagaggugccucuggccgauccagggauguaccaguuggacaucacuuuaagaaggggacaaucacuggcggcucgggaucgcgguggcacgagugacccguaugucaaguuuaaaauugggggaaaggaaguuuuccgaagcaagaucauucacaaaaaccuaaaucccgugugggaggaaaaggccuguauccucguagaucaucugcgugagccucuuuacauaaaaguguuugacuaugauuucggccugcaggacgauuuuauggguuccgcauucuuggaccucacccagcuggaacugaacagaccaacagaugucacucucaccuuaaaggacccccacuacccugaucaugaccuggggaucauucuuuugucugugauccugacaccaaaagagggagagucgagggacguuaccaugcuaaugcggaagucauggaagcgcagcaguaaagaacucuccgagaaugaaguggucggcucuuauuuuagcgugaagucccuguucuggagaacuugcggcaggcccgcccuuccuguacugggguuuugucgggcugaguugcagaacccauacugcaaaaauguucaauuccagacacagucacuccgccugagugauuuacaccgaaagagccaucuguggagaggaauugugucuaucacccucauagaggguagggaccuuaaagcaauggauuccaacggccugucagacccguaugucaaguuucgguuggggcaccagaaauacaagagcaagauuaugcccaaaacgcuaaauccucaauggcgugaacaguucgauuuucaccuguacgaggaacgcggaggcgugaucgacauuacugccugggauaaggacgcugguaaaagagaugacuucaucgggaggugucagguggaucucagugcccugucucgggagcagacccauaaacuugaacugcaauuggaggagggagaaggccaccucguccuguuaguuacacugacugcguccgcaaccgugagcaucucggaccuaucuguaaacucccucgaggaccagaaagaacgagaggaaauucugaagcgcuauucaccacuuagaauauuccauaauuugaaggaugugggcuuucugcaggucaaagugaucagggccgaggggcucauggcugccgacguuacaggaaagagugaucccuucugcguggucgagcugaacaaugaccggcuucugacccacacgguguacaaaaacuugaacccugaauggaauaagguauuuacuuucaacauuaaagauauccacagcguucucgaggugacagucuaugacgaagaucgcgacagauccgcagauuuucuggguaagguggcuauaccauuacugucuauucaaaauggcgagcagaaggccuacguccuaaagaacaagcagcucaccgggcccacuaaaggagugaucuaucuggaaaucgacguuauuuucaaugcggugaaggccagccuuaggacauugaucccgaaagagcagaaguacauugaggaagagaaccgucugucaaagcaacuccuguuacggaauuuuauacgaaugaaaagauguguaaugguccuggugaacgcagcuuauuacguuaauaguugcuucgauugggacuccccucccaggagccuugccgcuuuuguguuguuccucuuugucguguggaacuucgaacuguacaugaucccucuaguacugcuccugcuuuugaccuggaauuauuuucugauuaucucuggcaaggauaaccgccagcgggacacggugguugaggacauguuagaggaugaagaggaagaggacgauaaagacgauaaggacucagagaaaaaggguuucaucaauaaaauuuacgccauacaggaagucugugugagugugcagaacauccucgaugaggucgccagcuucggggaaagaauuaagaauaccuuuaacuggacaguuccauuccuguccuggcuugcaaucguggcucugugcguguuuacugcgauuuuguauugcaucccccucagguacauaguacuggucuggggcaucaacaaguucaccaaaaagcuacgcucuccauaugcaauugacaauaacgagcugcucgauuuucugucgcgagugcccagcgacguucaagugguccaguaccaggaacuuaaaccugauccaucccauucaccguauaagcggaaaaagaauaacuugggauga

SEQ ID NO: 58909 - RNA, 2472 nt, Artificial Sequence
  derived and/or modified sequence opt3 from MCTP2__Homo_sapiens__NP_001153115
auggaccuggauaagcccagcguguggggcucccucaaacagagaaccaggccucuucugaucaacuugucuaagaaaaaggucaaaaagaauccaucaaagccgcccgacuuacgggcccgccaccaucuggaucgacgucuaagucucagcguuccugaccugcuugaggcugaagcacuggccccagaggggagacccuacuccggaccucaaucuucguauacaucagugccaagcaguuuguccacugcggguauuuuccccaaaucuagcuccucaagucucaagcagagcgaagaggaacuggauuggucucaggaggaggcuucccacuuacauguaguggaaacggacucagaggaagccuacgcaagcccugccgagaggcggcgcgucaguucuaacggcauauuugaucuccagaaaaccuccuuagggggagacgcuccagaggaaccggagaagcugugcggcagcucggaucuuaaugcaucuaugacaucccaacacuucgaagaacagucagugcccggugaagccagugacggguugagcaaccugccuuccccauuugcuuaucuacucacuauccaucugaaagagggaagaaaucuuguugugagggaucgguguggcaccucugaccccuacgucaaguucaagcugaacggcaaaacauuguauaagagcaaagugauuuacaagaaucucaacccuguaugggaugagaucguugugcugccaauucagucauuagaccagaaacugcgcgucaagguguaugaccgagaucucaccacaagugacuuuaugggguccgccuucgugauccuuagcgaucuggaauugaauagaacuaccgagcacauacuaaaacuggaagaccccaacucucucgaggaugacaugggagucaucguucugaaucuuaaccuggugguaaagcaaggugauuuuaagaggcaccgguggucaaaucguaaacgcuugagugcgagcaaguccucucucauuagaaaccugagguuaucggaaagccugaaaaagaaucagcuauggaacggcaucauuuccaucacgcuccuggaggggaaaaacgugucaggaggcaguaugacugagauguucguccagcuuaaguugggugaccagcgguacaagucuaaaacccugugcaagagcgcaaauccgcaauggcaggaacaguuugauuuccauuacuuuuccgaccgaauggggauacucgauauugagguguggggaaaagacaacaagaaacacgaggagcgccugggcacauguaagguugacaucucagcccuuccucugaagcaagcuaauugcuuggaacucccccuggauagcuguuuaggcgcccugcuaaugcucgugacucugaccccaugcgcaggggucucuguguccgaccuuuguguaugcccuuuggcugaucugagugagagaaaacagauuacacagagguauugucuccagaacagccugaaggacguuaaagaugugggaaucuuacaagucaaggugcugaaagccgcggaccuuuuggccgcagauuucucugguaaguccgaccccuuuugccuccuggagcuaggcaaugaucggcugcagacccauacggucuacaagaaccucaauccagaauggaacaaaguguucacuuuccccaucaaggacauucacgauguucuggaggugacaguauuugacgaagauggggacaaaccuccagacuuccuuggaaaggucgcuauaccguugcugucaauccgcgauggccagcccaauuguuaugugcugaaaaacaaggaccucgagcaggccuuuaaagguguuauuuaccuggagauggaucuuaucuauaauccugugaaggcuaguauaagaaccuucacuccaagggaaaagcguuuugucgaggacagccggaaacugucgaagaaaauuuugucccgagauguggacagaguaaagaggaucacaauggccaucuggaacaccaugcaauuccucaaaucuugcuuucagugggaaagcacgcugcgcucaaccauugcauucgccgagagugaaaagaaggggcuaaucgagcggauuuacauggugcaggauauaguuuccacaguccagaaugugcuggaggaaaucgcuucuuuuggcgagagaauuaaaaacacuuucaauuggaccgugcccuuucucagcucccuggcgugccuuaucuuggcagccgcuacaaucauucuguauuucauaccuuuaagguacaucauucucaucuggggaauuaacaaguuuacuaaaaagcugcgcaacccauacucaaucgacaauaacgaacuucuggauuuccuaagccgaguccccagugacguucaaaaagugcaguaugccgagcucaagcuguguucuucccacagcccguugcggaagaaacguucggcacuguga

SEQ ID NO: 58910 - RNA, 549 nt, Artificial Sequence
  derived and/or modified sequence opt3 from MCTS1__Homo_sapiens__NP_001131026
augggcaaggggagauucgacgagaaagaaaacgugagcaauugcauccagcugaagaccuccgucauuaaaggaauaaagaaccaacucaucgagcaguuucccgguauugaaccuuggcuuaaucagaucaugccgaaaaaggauccaguuaagauugugaggugucacgagcauaucgaaauacugacaguaaacggcgaguuguuauucuuucggcagcgcgaggggcccuucuacccuacucugcgacuacuccacaaauauccauuuauccugccccaucaacagguggacaagggagccauuaaauucguccuuucuggcgcuaauaucaugugcccuggucugacgucaccaggggcaaaguuguaccccgccgcgguggauaccauuguugcuaucauggccgaaggaaaacagcacgcacucugugugggcgucaugaagaugagugccgaggacauagaaaaggugaacaaaggcauugggaucgagaauauucauuaucugaacgauggacuguggcacaugaagacauacaaauga

SEQ ID NO: 58911 - RNA, 993 nt, Artificial Sequence
  derived and/or modified sequence opt3 from MCU__Homo_sapiens__NP_001257608
auggccgcugcagccggcagaagccugcuccuucuguuguccucuaggggaggggguggcgggggagcgggcgguugcggggcuuuaaccgccggauguuuccccggccugggcgugucacggcaccgccagcaacagcaccaccgaacaguccaucagcguaucgcaaguuggcagaaccuaggggccguuuacugcagcacugugguaccuuccgacgaugugacggucguguaucaaaauggacucccaguuauuucugugagacugccgucgaggcgggagcgcugucaguuuacccuuaagcccauaucagacagcgucgguguguuccugagacaguugcaggaagaggauaggggcaucgaccggguagcuauuuacaguccugaugggguucgcguggcagccuccacaggaaucgaccuccugcugcucgaugacuuuaaauuagucauuaacgaucugacuuaucacgugcgaccacccaagagaguggaaaugggcuucugccaugucggucaaaauggguuugagcuuuugaccucuagcuaccugccugcuuccgccucacagagugcggaaaucauagcaguuaggaucgagauuagccggaaagccgagaagcguacaacccuagugcucuggggaggccuggcuuauauggccacucaguucggcauccuugcacgccugacauggugggaauacucuugggacauuauggagccaguaaccuauuuuaucacguacggguccgcuauggccauguacgcguauuucgugaugacuagacaggaauacgucuaucccgaggccagggaucggcaauacuugcucuuuuuccacaaaggagcaaagaagucacgauuugaccuggagaaauauaaccaguuaaaggaugcuauagcccaggcugaaauggaccugaaacgccucagagacccucuucaagugcaucugccauugaggcagauuggugagaaggauuga

SEQ ID NO: 58912 - RNA, 1080 nt, Artificial Sequence
  derived and/or modified sequence opt3 from MCUR1__Homo_sapiens__NP_001026883
auggacugcggcagcguagggggacagagaacccaaaggcugcccggucggcagcgccuccuuuuccugccugucggcuuguccgggcgaccaggaggcucugagacaucagcccguagauguuuaagugcucugagcgauggucuaggggcacucaggccgcgggcccccgcggcucgcggaggcguuuccagagccucuccucugcuucuguugcuccuggugccaucgcccaggcuggcagccgcugcaccucggcgccagcucggcgacugggaacgaucaagauuaggguacgccgcuccacccgccggaaggagcagugcguggcggugcuccccugguguagcagccgcugccggcgcacugccacaguaucacgggccggcucccgcccuugugucuugucgucgcgaguugagccuguccgcgggaucacuacaacucgaaagaaagaggcgggauuuuacgaguagcggcucucgaaaacuguacuucgacacucaugcccuugucugccuguuggaggauaacgguuuugcaacccagcaggcugaaaucauuguguccgcccucguuaagauacuggaggcuaauauggacaucguguauaaagauauggucacaaagaugcagcaagagauuacuuuccaacaggugaugucacagaucgccaacgugaaaaaggacaugauuaucuuagaaaagagcgaguuuagugcacugcgcgccgaaaaugagaaaauaaagcucgagcuucaccagcugaaacagcagguuauggaugaagugaucaaggucagaaccgacacaaaauuggauuucaaccuagagaagucuagggugaaggaacuguacucccucaaugagaaaaagcugcuugaacugcggaccgagauuguggcuuugcaugcgcaacaggaccgcgcacucacucagacagauagaaaaaucgagaccgaagucgccgggcugaagacgauguuagagagccacaaacuggacaacauuaaguaucuagcuggaucgaucuuuacuugucucaccguugcccugggcuucuacaggcuuuggauauga

SEQ ID NO: 58913 - RNA, 6270 nt, Artificial Sequence
  derived and/or modified sequence opt3 from MDC1__Homo_sapiens__NP_055456
auggaggacacccaggccaucgauugggacguggaagaggaagaggaaacagagcaaagcuccgagucucugagaugcaacgucgaacccguuggcaggcuccacauuuucucaggggcucauggaccugagaaggauuuuccacuucaccuggguaaaaaugugguaggccggaugccggacuguaguguggcauugcccuucccuagcauauccaagcagcaugccgaaaucgagauuuuagcgugggauaaagcuccaauccugcgcgacugcgggucucuaaacggaacucagauucuccgacccccuaagguccugucgccaggcgugucacaccgucuuagagaucaggagcugaucuuguuugccgaccuccugugucaauaccauaggcuggauguuagccuccccuucgugagucgggguccuuuaacggucgaagagaccccacgcgugcagggggaaacacagccgcagagacugcuuuuggcagaggacuccgaagaggagguagauuuucugucugaaaggcggaugguuaaaaagagccgcacuaccuccucaagugugauaguccccgagagcgacgaagagggacacucuccugugcuaggcggccucgggccacccuucgccuuuaaucugaacuccgauacagacguggaagagggacaacagccugcuaccgaggaagcaucaagcgccgcucgaagaggugccacugucgaggcgaagcagagugaagcagagguugugacagaaauccagcuugagaaagaccaaccacugguaaaggagagggauaaugacaccaaagugaagcggggcgccgggaacggagucgugcccgcuggcguuauuuuggaacguucucagccgccuggugaggauuccgacacggauguggacgaugacagccgccccccagggagaccugccgaaguccaccucgagagggcacagcccuucggauuuaucgauucggacacugaugcugaggaagagcggauuccagccacccccgugguaaucccuaugaaaaagcgaaagauauuccauggcguuggcacacgcgggccaggagcgccgggucuggcccacuuacaagaaucucaggcaggcuccgacacugacguggaggaagggaaagcuccccaggccgucccucuggagaagucacaggcuaguauggugauuaauagcgauaccgacgaugaggaagaggucuccgccgcacucacacuugcccaucugaaagaaucucaaccagcuaucuggaacagagacgcggaggaagauaugccccagagggugguuuugcuacagcggagccagaccacgacugagcgcgacucagauacagacguggaggaagaggaacugccuguagagaauagagaagcaguccucaaggaucacaccaaaauuagggcccuggugcgugcucacagugagaaggaccaaccacccuuuggagauuccgacgauagcguugaggccgacaaaucuucaccgggcauccaucuugaacggagucaggcaagcacuacaguggacaucaacacccaggucgagaaggaagugccuccagguuccgccauuauacacaucaagaaacaucagguaucuguggaggggacgaaucaaaccgauguuaaggcugucggcggacccgccaaacuguugguggugucgcucgaggaagcauggccucugcacggcgacugcgagacagaugcggaagaggggacuagcuuaaccgcuuccgucguugccgacgugcgaaagucacagcugcccgcagaaggagaugccggugcugagugggccgcagcugugcuaaaacaggagagagcccaugaaguaggcgcgcaggggggaccaccugucgcccaaguggagcaggaccuccccauuaguagggaaaaccugacagaucuuguuguggacacugauaccuugggcgagucuacacagccacaacgcgaaggugcucaggucccgaccgggcgggagagagagcagcacgugggcggaacuaaggacagcgaagauaauuauggcgacuccgaggaucuggaccuccaggcaacgcaauguuuccuggaaaaccaggggcuugaggccguucagucaauggaagacgagccuacacaggcuuuuaugcugacccccccacaagaguugggacccagccacugcucuuuccagacuaccgguacacucgaugaaccuugggaggugcuggccacccagccauucuguuuaagggaauccgaggacagugagacucagcccuuugauacacaucuggaagcauacggcccuugccuaagcccgccacgcgcgauccccggggaccaacacccugagucuccaguacauacggaacccaugggaauacagggccgaggucggcagaccgucgauaaggugauggggauuccuaaagagacugccgaacgugugggcccggagagaggaccccucgagagggaaacagagaagcugcuuccagaacgccaaaccgacgucacaggcgaggaagaguugacuaaagggaagcaggaucgggagcagaaacagcugcucgcuagagacacccaaaggcaggaauccgauaagaauggagagucagccaguccugaacgagaccgcgagagccugaagguugaaaucgagacgucggaggaaauccaggagaaacaggugcaaaagcagaccuuacccuccaaagcauucgaacgggagguagagagaccaguggcuaacagggaaugugauccugccgagcuggaagagaagguccccaaagugauucuugaacgugacacacagcgcggcgagccagagggugggucucaggaccaaaagggacaggcaagcucaccgacuccugaacccggcguuggugccggcgauuugccagggcccaccagugcuccugugccauccggaucucagagcggcgggcggggaucccccgucucaccuagaaggcaccagaagggccuccugaacugcaaaaugccgccagcggagaaggccagccgaauccgggcagcugaaaaagugagucgcggugaccaagagucucccgaugccugucuaccucccacaguuccagaagccccugcucccccacagaagccucugaauucccagagccaaaaacaccucgcaccgcccccacugcuuucgccuuugcugcccucaauuaagccaacugugagaaaaaccaggcaggacgggucucaggaggccccugaggcgcccuuaaguuccgaacucgagccguuucauccaaagccuaagauacggacgcgaaaaagcucuagaaugacacccuucccagcuaccagcgccgcacccgaaccucacccguccacuucaacagcccagcccgucaccccaaagccuacuagucaagcuacccgcagcaggacaaaccguucuuccguaaaaacgcccgagccugugguuccaaccgcacccgaacugcagccuucaacuaguacagaucagccagugaccagcgagcccacaucccaggucacucggggaagaaagucuaggucgagcgugaaaaccccggagacgguagugccuacagcccuugaacugcaaccaucaaccuccacugaccgccccgucaccagugagccuacaucucaggcgacucgaggcagaaagaaucggagcuccguuaagaccccagaacccguggugccgacagcuccugaguugcagcccucaacgucuaccgaucagccagucacuagcgagccuacauaucaagccaccaggggucgcaaaaaccguaguuccgugaagacucccgaaccaguuguacccacagcaccugagcucagaccaagcaccucuacggaccggccggugacucccaaaccuaccucaaggacaacccgcucccgaacuaauaugaguagcgucaagacaccagaaaccgugguucccacagccccugagcugcagaucucgacuucuaccgaucagccagugacgcccaaaccuacauccagaaccacucggagcaggaccaacaugucaagugucaagaauccggaaucuacagugccaauugcucccgagcuaccucccuccacuagcaccgagcaaccaguaacgccugaacccacaucacgcgccaccagaggcaggaagaaccggaguagcgggaaaacuccagagacacuggucccgaccgcaccuaagcucgaacccuccacuucuacagaccagccagugacccccgagccuacgagccaggcuacucguggacgcaccaaucgauccucaguuaaaacaccagaaaccgugguccccacagccccugagcugcagccgucuacuaguaccgaucaaccagugacgcccgagccuacaucgcaggcgacuagaggcaggaccgaccggagcuccguuaagacaccagaaaccgugguccccacugccccugagcuucaggcaucugcuucaaccgaucagcccgugacaagcgaaccaacgucccgcacuaccagagggaggaaaaaccggaguucuguaaagacaccggagaccgugguuccugccgcucccgaauugcaaccaagcacuucaacagaccagccugucacccccgagccaacgucccgagcaacuagaggacgcacaaauaggaguagcgugaagaccccugagucuaucgugcccaucgccccggaacugcagccauccaccucacggaaccaguuagucacuccugagcccacaagccgugccaccagaugcaggacaaaucgcucgucuguaaaaacuccagaacccgugguuccuacggcuccggagccacaucccaccacaaguacugaccaaccugugacccccaagcucacaucccgggcgacccgaagaaaaacuaacaggagcucagucaagacgccaaaaccuguggagcccgcagccuccgaucuggaaccauuuaccccuacagaccagucuguuacuccggaggcuauugcccagggcggucagagcaagacccuucgcaguuccacagugcgggcaaugcccgucccaaccacuccugaauuccaaagccccgugacaacggaucagccaauaucuccugagcccaucacccagccgucaugcauuaaaagacaacgugccgcugggaauccaggaagucuggcggccccuaucgaccacaagcccuguuccgcaccacuagaacccaagagccaggcuucuaggaaccagcgguggggcgccguacgcgcagccgagucgcucacugcuauuccugagcccgccucaccacagcuguuggaaacaccuauccaugcgagccaaauacagaaaguggagccggcaggucgauccagauuuacccccgaacugcagccaaaggccagucagucuaggaaacggagcuuagcuaccauggauuccccuccccaccaaaagcagccacagcgcggcgagguuucacagaaaacagucaucauuaaggaagaggaggaagacacugccgagaagccugggaaagaagaggauguggugacgcccaagccgggaaaaagaaagagggaccaagcugaagaggagccuaaccgaaucccaagucggucucuccguagaaccaaacugaaucaggaaagcacagcacccaagguccuuuucacuggcguuguggaugcccgcggggagagggcuguacuggccuugggaggcucccucgcagguucagcggccgaagcuagccaccuggugaccgaccggauuagacgcacagucaaguuucuaugcgcccuggggaggggaaucccuauacuuucucucgauuggcugcaucagucccgaaaagcaggcuucuuuuugccacccgacgaguacgugguuaccgauccugagcaagaaaagaacuucggcuuuagucugcaggacgcuuuaagccgggccagagagaggcgccuccuggaaggguaugagauuuacgugacuccaggaguccagcccccgccuccccagaugggugaaaucauuucguguugcggcgggacguaucuuccauccaugccccguucuuacaaaccucaacggguagugaucacauguccacaggacuucccccacugcucaauaccucugagaguuggauugccacuccugagcccggaguuccuacugaccggcgugcuuaagcaggaggcaaaacccgaagccuuuguccucaguccucuggagauguccucuacuuga

SEQ ID NO: 58914 - RNA, 741 nt, Artificial Sequence
  derived and/or modified sequence opt3 from MDFIC__Homo_sapiens__NP_001159817
augagcggcgccggggaggcucuggcacccggaccuguggguccacagagagucgccgaagcgggcgggggacaacucggcuccaccgcucaggguaagugcgacaaagauaacacagagaaggacaucacucaggccaccaauucucacuucacgcauggggaaaugcaggaucaaucaauuuggggaaacccgagugacggcgagcuuauaaggacacagccccagcggcugccucaguugcaaacuagcgcacagguuccauccggcgaagagaucgggaaaauuaagaauggacacaccgguuuaucuaacggcaaugggauccaucacggagccaaacauggcucggcugauaaccgcaagcugucagcacccgugagccagaagaugcaccgaaaaauucagaguucccuaucuguaaauagcgacaucuccaagaaaucaaaggugaacgccgucuuuagucagaaaacagguagcucuccugaggauuguugcgugcacuguauacucgcuugccuguucugugaauuucuuacccugugcaauaucguuuuggggcaagccuccuguggaauuugcacuucagaggcguguugcuguugcugcggcgacgaaaugggcgaugacuguaacugcccaugugauauggacugcgggaucauggaugcauguugcgagagcagugacugucucgagauuugcauggaauguugcggaaucuguuuccccucuuga

SEQ ID NO: 58915 - RNA, 741 nt, Artificial Sequence
  derived and/or modified sequence opt3 from MDFI__Homo_sapiens__NP_001287733
auguaccaggugagcggccaaagacccuccgggugcgacgccccuuauggagcuccaucugcagccccgggucccgcgcagacccugucacuccuuccuggccuggaggucguuacagggaguacucacccagcugaagccgcacccgaggaaggcagcuuggaggaagccgcuacgccuaugccacagggaaacggucccgggaucccucagggauuagauuccaccgaccuggaugugccaacagaggcaguaacuugucaaccgcagggcaauccccuaggcugcaccccucuccugccaaacgacucugggcaucccucggagcuuggagguacaaggcgggccggcaauggggcucugggaggcccuaaggcccaccgcaaauugcagacccauccaucacucgcgagccaggguaguaagaaauccaagucuagcuccaaaucaacuacaagucaaauuccccugcaggcacaggaagauuguugcgugcacuguauacugagcugccucuucugugaguuuuuaacccugugcaacaucguccuugacugugccacgugcgggucuuguuccucagaagauagcugcuugugcuguugcuguugcggaaguggcgagugugcugacugcgaucugccgugugaccuagauugcggcauucucgacgccuguugcgagucugcagauugucuggaaaucugcauggagugcugugggcuuugcuucuccagcuga

SEQ ID NO: 58916 - RNA, 2868 nt, Artificial Sequence
  derived and/or modified sequence opt3 from MDGA1__Homo_sapiens__NP_705691
auggaggugaccugccugcuccuucuggccuugauccccuuccacuguagaggccagggggucuacgcuccugcacaagcccagauuguucaugcgggacaggcuugcgugguaaaggaagacaacauaagcgagaggguguauacaauccgggaaggugauacuuuaaugcugcagugucuagucacgggccacccacgcccgcaagugcgauggaccaaaacagccggguccgcaucugacaaguuucaggagacuucaguuuucaaugaaacccuccguauugagagaaucgccaggacacagggaggccgguacuauugcaaagcugagaacgguguggggguccccgcaauuaagaguauccgcguggauguacaguaccuggacgaaccuaugcuuaccguucaucaaacugugagcgaugucagaggaaauuuuuaucaggagaaaacaguguuccugagguguaccgugaacuccaauccacccgcccgguuuauauggaagcgcggcucugacacguugucgcacucacaggauaacggcgucgacaucuacgaaccucucuauacucagggggagaccaagguucugaaacugaagaaucuccgaccacaagauuacgcuagcuacacaugccaggugaguguaagaaacgugugugggauucccgacaaagccaucacuuucagguuaaccaauacaaccgcgccuccagcacugaaacuuuccgucaacgagacguuggugguuaauccgggugaaaacgugacuguccagugccugcuaacaggcggggauccccucccucaacugcaguggucucauggaccaggcccccuuccucugggugccuuggcucagggaggaacccucagcauuccauccgugcaggcccgggacucaggcuauuacaauuguacugcaacaaacaauguaggcaaccccgcuaaaaagaccguuaaccuguuagugcguaguaugaagaaugccacguuucaaaucaccccggaugucauaaaagagagcgaaaacauucagcuggggcaggaccucaaacuuucuugccacguggacgcggucccucaggagaaggugacauaucaaugguucaagaauggaaaacccgcccgcauguccaagagacuguugguuacuaggaacgauccagaacuaccugcagugaccucaagccuggagcucaucgaccugcacuuuagugauuacgguacauaucuuuguauggcuucuuuccccggcgccccaguacccgaccuguccgucgaggugaauauuagcucggaaacuguuccuccaaccaucucugugccgaaagggcgggcugucgugacaguacgagagggaucccccgccgaauugcagugcgaggugcgcggcaagccuagaccacccguucucuggucaagggucgauaaggaagcagcccuguuaccuaguggucugccacuagaggagacccccgacgggaaacuccggcuggaacgcgugagcagagauauguccggcacuuacaggugccagacggcucguuauaacggauuuaaugugcggccgcgagaggcgcagguccaacuuaacguucaguucccuccagaaguggagcccucuagccaggacgugagacaggcauugggcaggccuguacugcuccgcuguucacugcuucgggggaguccccaaagaaucgccuccgcugucuggagguuuaagggacagcuguugccaccucccccagugguuccggccgcagccgaagcuccugaucaugccgagcuccgccuggacgcagugacacgagauagcucugguucauacgagugcagugucagcaaugacgugggcuccgcggcuuguuuauuccagguuucugccaaagcauacucgcccgaauuuuauuuugacaccccaaaccccacucggagccacaagcuguccaaaaauuacucauaugugcuacaauggacccagcgugagccugaugccguagacccaguccucaacuacagacugaguauuaggcagcuuaaucagcauaacgcuguggugaaggccauacccguccgccggguugaaaaggggcaauugcuggaguauauccucacagaucugagagugccucacucuuacgagguaagguuaaccccguauacuacauucggagcaggcgacauggcuagccgaauuauccacuacacggaaccaauaaauucccccaaccugucagauaauaccugccauuuugaggacgaaaagauuugugguuacacucaggaucuuacagacaacuucgauuggacccgccagaacgccuugacacagaauccuaagcggagcccaaacacugggcccccuaccgacaucucuggcacgccggagggauauuacauguuuaucgaaaccuccagacccagggagcucggcgaucgugcgcgccuggugaguccacuauauaaugccagcgcuaaauucuacugcgucucuuucuucuaucacauguacgggaagcauauuggaucccugaaccuccuggugcggucaagaaauaaaggugcacuugacacacacgccuggaguuugagcggcaacaaggggaauguuuggcaacaggcucaugugccuaucucgcccuccggaccauuucagauuauauucgagggcgucagggguccuggguaucugggcgauaucgccauugacgacgugacuuuaaagaaaggagaauguccccgaaagcagaccgauccaaacaaaguuguggucaugccgggcucuggggcaccuugccaaagcucaccccagcucuggggaccaauggcgaucuuucugcuugcccugcagcgguga

SEQ ID NO: 58917 - RNA, 2871 nt, Artificial Sequence
  derived and/or modified sequence opt3 from MDGA2__Homo_sapiens__NP_001106970
auggaccugcucuacggccuuguguggcuguugacagucuuacuggaggggaucagcggacaggguguuuaugccccaccuacagugagaauuguacacuccggccuagcuugcaacauagaagaggaaagguacucugagcggguguauacuauccgcgaaggggagacgcucgagcugaccugucuugucacaggacauccacgaccgcaaauucguuggacuaagaccgcaggcucagccagugauagauuccaggacagcuccguguuuaaugaaacacugaggaucaccaacauucagcggcaccagggugggcgcuacuauugcaaagcggagaauggauugggcucucccgcuaucaagucgauaagaguugauguguacuaucucgacgauccugucgugacuguacaucaaucaaucggcgaagccaaagagcaguucuacuacgagaggacaguuuuucugcgguguguggcaaacagcaauccacccguccgcuauaguuggcgaagagggcaggaagugcugcuccagggauccgacaaggguguggagauuuacgaaccuuucuuuacccaaggcgagacgaaaaucuuaaagcugaagaaccuuaggccacaggauuaugccaauuacucuugcauugcuagcguccggaacguuuguaauauccccgacaaaaugguguccuuccguuugucaaacaagacugcaaguccuagcauaaaacugcuaguagaugacccaauuguggucaauccgggggaagccaucacccucgugugcguuacaacuggaggcgagcccgcuccuucucugaccugggugcgcuccuuugguacacuuccagagaagaccguccugaacgggggaacguugacuauucccgccaucacaucagaugacgcgggcaccuauagcuguaucgcaaauaacaaugugggcaacccugccaaaaagaguacuaacauuauaguaagagcucucaagaaagggagguucuggaucacaccagaucccuaccacaaggacgacaauauucagaucggacgggaaguuaaaauaucuugccagguggaggccgucccguccgaggaacugaccuuuagcugguucaagaacggucgaccuuuacgcucgucugaaagaauggugauuacgcaaaccgaucccgacgucuccccaggcacaacuaaucuggauaucaucgaccucaaauuuaccgauuucgggacauauacuuguguggcaucacuuaagggaggcgguauuagugacaucagcauugauguuaacauauccucuagcaccgugccucccaaucugacaguaccacaggagaaaucacccuuggucaccagggagggggacacuaucgaacuacagugccaagugacgggcaagccuaagccaauuauccuguggagucgggcugauaaagagguugccaugccggacggauccaugcagauggaaagcuacgauggcacacuccgcaucgugaacgucucuagagagaugucagggauguacaggugucagaccagucaguauaauggauuuaacgugaagccccgugaagcgcugguacaacuuauugugcaguacccuccagccguugagcccgcauuccuggagauacggcagggucaggaccgaagcgucacuauguccugcagaguguugagggcuuauccuauccgcgugcucaccuacgaauggcggcugggcaauaaauuacugagaacagggcaauucgacucucaggaguauaccgaauacgccgucaagucgcuaagcaacgagaauuauggaguuuacaacugcuccauuaucaaugaggcuggcgccgguagguguucauuucucgugacugggaaagcauacgccccagaauuuuauuacgauacauauaaccccguguggcagaaucgccaucgaguauacaguuauucucugcaguggacgcaaaugaacccggacgcugucgaucggauuguggcguaccgucuuggcaucagacaggcaggacagcagagguggugggagcaagaaauaaagaucaacggcaauauucagaagggggaguugaucaccuauaaccugacugaacucauuaaaccugaggccuacgagguucgccugacaccacuuaccaaguuuggagaaggugacagcacaauccgggugauaaaauacuccgcucccgucaauccucaccugagagaguuccacugcggcuuugaagaugggaacauuuguuuguucacucaggacgauaccgacaauuuugauuggacgaagcaaucaaccgccacaaggaacacuaaauauacccccaauacaggaccaaacgcagaccgaagcggcucuaaggaggguuucuacauguauaucgaaacuucccgcccucggcucgagggggagaaggccagacuguuaagucccguguuuagcauugcucccaaaaauccguacggcccuaccaacacggccuauugcuucucuuucuucuaccauauguauggacagcacaucggcguucugaauguguaccuaaggcucaaggggcagacaaccauagaaaacccccugugguccucaaguggaaauaaaggccagcguuggaacgaggcacauguaaauaucuacccaauuacuagcuuucaacuuaucuucgaagguauucgcgggcccggaaucgagggcgauauagcgauugacgaugucucgaucgcugaaggugagugugccaagcaggacuuggcaaccaaaaacuccguggacggcgccguggggauccugguccacauuuggcuguucccuaucauuguucucauaucuaucuuaagcccacggagauga

SEQ ID NO: 58918 - RNA, 1059 nt, Artificial Sequence
  derived and/or modified sequence opt3 from MDH1__Homo_sapiens__NP_001186040
augagaaggugcagcuacuuccccaaggacgugaccgucuuugauaaagacgauaaguccgagccuauccggguucuggugacaggcgccgcugggcagauugcauauucucuccuuuacucaauaggaaacgguaguguauucggcaaagaccaaccaaucauucugguguuguuagauaucacuccgaugauggggguccuggacggagugcuaauggaacuccaggauugugcccugccccuucugaaggacguuauugcgacggauaaagaggacguggcuuuuaaggauuuggacgucgccauccucgugggcagcaugccucgccgagaagguauggagcguaaggaucugcugaaagcaaauguaaagauauucaaaucccagggggccgcucucgacaaguaugccaaaaagucuguuaaggugaucgucgugggaaacccagcaaauaccaacugcuuaacagcuucgaaaucagcccccagcauuccuaaggaaaauuuuaguugucugacuagacuugaccacaacagggcgaaagcacagaucgccuugaagcugggcgugaccgcuaaugaugucaaaaacguuauuaucuggggcaaucauuccucuacacaauacccagacgugaaccacgccaagguaaaacuacaggggaaggaggugggagucuaugaggcacucaaggaugacagcuggcugaaaggugaguucgugaccacuguucagcagcggggcgcugccgugauaaaggcgcgcaaacuuuccucagccaugagugcagcuaaggccauuugcgaucaugucagagacaucugguuugggacacccgaaggagaguucgugagcaugggcguaauuucugaugguaauuccuacgggguuccugacgaucuguuguauucauuuccaguggucaucaaaaacaagaccuggaaguucguggaaggacucccgaucaaugacuuuagcagggagaaaauggaucugacggcuaaggaauuaacugaggaaaaagagagugccuucgaauuucugucuuccgcauga

SEQ ID NO: 58919 - RNA, 1017 nt, Artificial Sequence
  derived and/or modified sequence opt3 from MDH2__Homo_sapiens__NP_005909
augcugagcgcccucgcuagacccgcauccgccgcgcuuaggcggucuuucucaaccagugcucagaacaaugccaagguggcaguccugggcgccagcgggggaaucggucaaccuuuguccuuacugcuaaagaacucuccacucguuucgcgccugacacuuuacgacauugcucacacuccgggcguggcagccgaucugucacauauagagacgaaagcugccguaaaaggguauuugggacccgaacagcucccugacugccugaagggcugugauguggucgugaucccagcggguguuccccgaaaaccugggaugacccgugacgaucuguuuaauacaaacgcaacuauuguggccacccucacagcugccugcgcacagcacuguccagaggcuaugaucugcgucauugccaaucccgugaacagcaccaucccuauaacugcggaaguauucaagaagcauggaguuuacaauccaaacaaaaucuuuggcgugacaaccuuagacauugucagagccaauacguucguggcagagcugaagggccuugauccggcuagggugaacguccccguuaucgggggacacgccgguaaaacuauuaucccuuugauaagucaguguaccccaaagguggacuuuccccaagaucagcugacagcucuaacuggccggauucaggaagccgggaccgagguagugaaagcaaaggccggagcuggcuccgcgacacucucuauggcauaugccggugcucgcuucgucuuuagccugguggacgccaugaaugggaaggagggaguuguggaaugcuccuucgucaaaucacaggagaccgaauguacguacuuuaguacuccucuucuguugggcaagaaaggcaucgagaagaaccucgggauuggaaaagugagcucuuucgaggaaaagaugaucuccgaugcaaucccagagcugaaagccucaauuaagaagggugaagacuuuguaaaaacauuaaaguga

SEQ ID NO: 58920 - RNA, 264 nt, Artificial Sequence
  derived and/or modified sequence opt3 from MDK__Homo_sapiens__NP_001257481
augcagcacagaggcuuccugcuccuuacccuguuggccuuacuggcucuaacaagcgcaguggccaagaaaaaggcggacugcaaauacaaguuugagaacuggggagcuugugauggggguacuggcacgaaagucaggcaagggacccucaagaaggcccgguauaaugcacagugccaggaaacaauccgcguuacuaaacccuguaccccuaagacaaaagccaaggcuaaagcaaagaagggaaaaggcaaggacuga

SEQ ID NO: 58921 - RNA, 2040 nt, Artificial Sequence
  derived and/or modified sequence opt3 from MDM1__Homo_sapiens__NP_001191957
augcccgugagauucaagggccugagcgaguaccagaggaacuuucucuggaaaaaguccuaucuuucugaaucaugcaauaguagcgucgggcggaaauacccuugggccggacugcgcuccgaccaauuggguaucaccaaggagccaucuuucauuucgaaacgacguguuccguaucacgauccccagauaucaaagagcuuagaauggaacggcgcuaucagugaguccaaugugguagcaucuccugaaccagaggcccccgagacaccuaagagccaggaagcggagcagaaagacgugacucaagaaagaguccauucccuggaggcuucaagggugccaaagcggacgcgcagucacagcgccgauucuagagcagagggggccuccgacguugaaaacaaugagggagugaccaaccauacacccgucaaugaaaacguggagcuagaacacucaacuaaaguacucagcgagaauguugauaacggcguguuucauaauaagagucaguucgucccuccauuuaaagguaacucugugauucacgagaccgaauacaagaggaauuucaaggggcuguccccggugaaagagcccaaacuucggaacgaccugcgcgaaaaucgaaacuuggagacagucagcccugaaagaaaaucgaacaagaucgaugacaggcucaaacuggaggcugagauggaacugaaggaucuccaccagccaaaacggaaguuaacccccuggaagcaucagcgucugggaaaaguuaauucugaguaucgcgcaaaguuucuuuccccugcccaauacuuguauaaagcuggcgccuggacucacgugaagggcaacaugccaaaucaggggucacugaacgcgaugugguacgcagaaguaaaagagcuaagagaaaaggccgaguucuacaggaagcgggugcagggaacacauuuuagucgagaccaccucaaucagauucugagcgauuccaacuguugcugggacgucucuagcaccacgucaagugaggguacuguguccagcaauauccgcgcucuugaucuggccggcgaccccaccucucacaaaacauugcaaaaguguccgucaacugaaccugaggaaaaagggaacauaguugaggagcagccccagaagaauaccacagaaaaacucggagugagugcaccaaccaucccugucagaaggcggcuggcuugggacacggagaacacuagcgaagaugugcaaaagcagcccggcgagaaggaagaggaggacgauaaugaagaggaaggugaccgcaaaacagggaagcaggccuucaugggagagcaggaaaaauuagauguaagagagaaguccaaagcggacaagaugaaggagggcucugauucgagcguuuccucagaaaaaggcgggaggcugccaacccccaagcuccgugagcuuggagguauucaacggacucaucacgaccugacaaccccugccgugggcggggcagucuuggugaguccaucuaaaaugaagccgcccgcuccugaacagcgaaaaagaaugacgagccaggauugccuagagaccuccaagaacgacuuuacaaagaaggaaucaagggccgucagccugcucacuucuccagcugccggaaucaagaccguggauccccugccucuucgcgaggacuccgaggacaauauucauaaauucgcagaagccacacugccaguuaguaagauccccaaauauccgacuaacccuccaggccaguugcccagcccuccccacgugccaucuuacuggcauccuucccggagaauacaagguucacucagggaucccgaguuucagcacaauguagggaaggcucgcaugaacaaccugcaguuaccacagcacgaagcguucaaugacgaggaugaggaccgacugagugaaauuagcgcacggucggccgcuuccucucuacgugccuuccaaacccucgcaagagccaaaaagaggaaggagaacuuuuggggcaaaacauga

SEQ ID NO: 58922 - RNA, 1335 nt, Artificial Sequence
  derived and/or modified sequence opt3 from MDM2__Homo_sapiens__NP_001138809
augugcaacaccaauaugagcgugcccacagacggcgccgucacuacgucccagaucccugcuucugagcaagaaacccugguuagaccaaagccgcuccuucugaaauuguuaaagucagugggggcacagaaagauacauacacuaugaaggagguacuguucuaucuaggacaguacauuaugaccaaaaggcucuaugacgaaaagcagcaacacauaguguacuguaguaacgaucugcuuggugaccuguuuggcguccccagcuucuccgugaaggagcaucggaaaaucuauacaaugauuuaccgcaauuugguuguggucaaccagcaggaaucuucggauucagggaccagcgugagugagaaucgaugccaccucgagggaggcuccgaccagaaggaucugguacaagaacugcaggaggaaaaaccuucuagcucccaucucguuucacguccaaguacuagcucuagaaggcgggccaucuccgagacagaggaaaacucagacgaguuaagcggugaacgccagagaaagaggcacaaaagugauucuauuucccugagcuuugacgagucgcuugcguugugugugauccgggaaauaugcugugagcgcucauccucaagugagagcaccgggacgcccuccaauccugaucuggacgcuggagucuaucaggugacuguguaccaagccggcgaaucugauaccgacagcuucgaggaagacccagagaucucacuagcagauuacuggaagugcacaaguuguaacgaaaugaaucccccucucccaucccauugcaaccgauguugggcccugagagagaauuggcuuccggaggacaagggcaaagauaagggggaaauuagcgagaaagcuaagcuggaaaacucuacucaggcagaggaaggauuugacguccccgauugcaaaaagaccaucguuaaugacucaagggagaguuguguggaggaaaacgaugacaaaauuacacaggccagccaaucccaggagucugaagauuauucgcagccuagcaccuccucaaguaucauauacucuagccaggaggacguaaaggaguucgaacgggaggaaacgcaagauaaggaggaauccguggagucuagcuugccacucaaugcuauugagcccugcgucaucugccagggucguccuaaaaacggcuguauugugcacgggaagacuggacaccugauggccugcuuuacaugugcgaaaaagcugaaaaagcgcaacaagccaugccccguuuguagacagccgauccagaugaucguguuaaccuauuucccuuga

SEQ ID NO: 58923 - RNA, 1323 nt, Artificial Sequence
  derived and/or modified sequence opt3 from MDM4__Homo_sapiens__NP_001191100
augaccagcuucuccacaucugcccagugcucaacgagugacagcgcuuguagaaucucccccggccaaauuaaccaggugaggccuaagcugccacuccuuaaaauacugcacgcagccggggcgcagggagagauguuuacugucaaggaaguuaugcauuacuugggucaguauaucauggugaaacaauuauacgaucagcaggagcagcacaugguauauugcggcggggaccugcuaggagaacuccugggccggcaaucuuucucggugaaggauccgucaccccuuuacgacaugcugcgcaaaaauuuggucacccucgcuacagccacuaccgaugcagcccagacacuggcucuggcacaggaccauagcauggauauuccuagucaggaccaacucaagcaguccgccgaggaaucuagcaccucccgaaagcguacuacagaggaugacaucccaaccuuacccacgucagagcacaaauguauucauaguagagaagaugaggaccugaucgaaaaccuugcucaggaugagacuagcagguuggaccuggguuuugaggaaugggacguggccgggcuaccuuggugguuccucggaaaucugcggucuaacuauaccccacgcuccaauggcucaacagaucuucaaacuaaccagguuauagaggugggcaagaaugacgaucuggaagacagcaaaaguuugucugaugacaccgaugucgaggugacauccgaagacgaguggcagugcaccgaguguaagaaauuuaacagccccucgaagagauacugcuucagguguugggcgcuccggaaggauugguauucugacugcuccaaacugacgcacucauuaaguacuagcgauaucacagcaauuccugaaaaggagaaugaagggaacgacguaccagacugucgccgaaccaucuccgccccgguugugagacccaaagaugcuuacauuaagaaagaaaauucuaagcuguuugacccuugcaacagcgucgaguuccucgaucuugcccacucaagugagucccaggagacuaucagcucuaugggagaacaacuggacaauuugucagagcagaggacagauaccgaaaacauggaggacugucagaaucuacugaaaccaugcagucucugcgaaaagcggccccgugaugguaacauaauucauggccgcacggggcaccuggugaccuguuuucauugcgcaagaaggcuuaagaaagcuggagccagcuguccuaucugcaagaaagagauucagcuggugaucaaggucuucaucgcguga

SEQ ID NO: 58924 - RNA, 1719 nt, Artificial Sequence
  derived and/or modified sequence opt3 from ME1__Homo_sapiens__NP_002386
auggagcccgaagccccuagaaggcggcacacccaucagcgcggcuaccugcucacacgaaacccacaccuuaauaaggaccuggcuuucacuuuggaggaacgucaacaguuaaacauccaugggcugcuaccgcccagcuuuaauucccaggagauucaggugcucagagucguuaaaaacuucgaacaccuuaauucugauuuugacagguaucugcuguugauggaucuccaagaccggaacgagaagcuguucuaccgcgugcugacgucagauauagagaaauuuaugccuaucguauauaccccaacagugggacucgcaugccagcaguacaguuuagucuucagaaagcccaggggucuguuuauuacuauccaugaccggggccacauugccagcgugcuuaaugcguggccugaagauguuaucaaagcuauaguggucaccgacggggagcgcaucuugggacugggcgaucuagguuguaacgggaugggcauuccagugggaaagcucgcccuguauacagcaugcggcgggaugaauccccaggaaugucuuccuguaauccuggacguuggaaccgagaacgaggaauugcucaaggauccacuguacauugguuuacgacaaagaagggugcggggcuccgaguaugacgauuuccuggacgaauuuauggaggccgucucuucgaaauacgggaugaauugccucauccaguucgaagacuuugcuaacgugaaugcauuccgucuucugaacaaguaccgcaaucaguauuguacuuuuaacgaugacauacagggaacagccucaguggcugucgccggcuugcuagcggcacugagaauuaccaaaaacaagcucagcgaucaaacgauccuguuccagggugccggggaggcugcccuuggaauugcacaccugaucguuauggcuuuggagaaagaaggccucccgaaggagaaggccaucaaaaagauuuggcugguggacaguaaaggcuuaauaguaaaggggagggcgucccugacucaggaaaaagagaaguucgcccaugaacacgaggagaugaaaaaucuagaagcaaucgugcaagagauuaagcccaccgcucucaucggagucgccgcuauagguggcgccuuuucugaacagauucugaaggauauggcagccuucaacgagcggccuaucaucuuugcucuuagcaauccaacauccaaagcggaaugcucagcagagcaguguuacaagauuacuaaagggcgagccaucuucgcuaguggaagccccuuugacccugugaccuugccaaacggccagacacuguaucccggucaagggaauaacucuuacguuuucccgggcguggcccucggagucguggcaugcggccugcgccagauuaccgauaauauauuucuuacgacugccgagguaaucgcucagcagguuuccgacaagcaucuggaagaggggagauuguauccuccccucaacacaauuagggaugugucacugaaaaucgccgaaaagaucgucaaggacgcauaccaagagaaaaccgcgacuguguauccagagccucagaauaaggaggcuuucguccggagccagauguacaguacagauuacgaccagauuuuacccgacuguuauucuuggccagaagaagugcagaaaauacaaaccaagguugaucaguga

SEQ ID NO: 58925 - RNA, 1440 nt, Artificial Sequence
  derived and/or modified sequence opt3 from ME2__Homo_sapiens__NP_001161807
augcugagcagacucagaguggucuccaccacaugcacucuugccugucggcaucugcacaucaaggagaaaggcaagcccuugauguuaaacccucgcacgaauaaagggauggcuuucacccugcaggaacgacaaaugcuaggacuccagggucugcuuccaccgaagauugagacacaggacauacaggcacugcguuuucacagaaacuugaaaaagaugacuucuccccucgaaaaguacaucuauauuaugggcauccaagagaggaaugaaaaacuguucuaccggauucugcaggaugacaucgagucacucaugccuauaguuuauaccccaacagugggguuagccugcagucaguacggacauaucuuucgcagacccaagggccuguucauuagcaucuccgauaggggucacguacggucuauuguggacaacuggccugagaaucaugucaaagcggugguugugaccgauggggaacgcauccuuggauugggcgaccugggcgucuaugggaugggaauaccaguggguaagcuaugucucuacacugcuugcgccggcauucgacccgauagaugucugccuguaugcaucgacguugggacagauaacauugcacuucugaaagacccauuuuauaugggauuguaccagaagagggaucggacccaacaguacgacgaucucaucgacgaguucaugaaggccaucacggaccguuauggccgcaauacucugauucaguuugaagauuucgguaaccacaaugcuuuuagauucuuaaggaaauaccgggagaaguauuguaccuuuaacgacgauauacaggggacagcagccguggcucuggccggacuccuugcggcacaaaaagucaucucgaagccgauuucagagcacaaaauccuguucuugggcgccggcgaagcugcccuagggauagcaaaucugauugugaugagcaugguggagaacggacucagugaacaggaggcucagaagaaaaucuggauguuugacaaguacggucugcuugucaagggccgaaaagccaagaucgauuccuaucaagaacccuucacucauucugcgccugagagcauuccagacaccuucgaggaugccguuaauauccugaaacccuccacaauuauagggguggcaggagcuggccgcuuguuuaccccugacguaaucagagccauggcuucaauuaacgaaaggccagugaucuucgcccucaguaaucccacggcacaggccgagugcacugcugaagaggcguacacacugaccgaaggucgguguuuauuugcaagcgggucuccguucggcccugucaagcugacugauggacgcguguuuacacccggccaggggaacaacguuuauaucuucccaggauacaggauuccuauaugcuga

SEQ ID NO: 58926 - RNA, 1815 nt, Artificial Sequence
  derived and/or modified sequence opt3 from ME3__Homo_sapiens__NP_001155058
augggcgccgcucuggggaccggaacaagacucgcacccuggccugguagggccugcggcgcgcuuccacgguggacuccgacggcucccgcccaggggugucacagcaagccuggaccagcacgccccgugccucugaaaaagcgaggcuacgacgucacccguaacccacauuugaauaaagguauggccuucacauuagaggaaagacugcaacuagggauccacggacucauucccccuugcuuucugucccaggauguucagcuucugaggauaaugcgguauuacgagcgccagcaaucugacuuggauaaguauaucauucucaugacucugcaggacagaaacgaaaaacuguucuacagggugcucaccucagauguagagaaguuuaugccaaucguguauacaccgaccgucggcuuagcuugucagcauuacggccugacuuuccggcgcccccgagggcuuuuuauuacaauccacgacaagggacauuuggcaaccaugcugaauaguuggccugaagauaacauaaaagccgugguugugacggacggugagagaauccuaggccucggggaucugggaugcuauggcauggguauuccagucgggaaacuugcucuguacacugccuguggaggcgugaauccccagcaaugcuugccuguacuccuggacguuggcaccaacaaugaggaauuacugagggauccacucuacaucgggcuuaagcaccagcgggugcacggaaaggcguaugacgaucuguuggacgaguucaugcaggcagucacagacaaauuugguauuaacugucuaauccaguucgaagauuuugccaaugcuaacgccuuccgucugcucaauaaguaccgcaacaaguauugcauguuuaaugacgauauacaaggcacugcaagcguggcuguggccgggauucuggcggcccuuagaaucaccaaaaacaagcuguccaaucaugucuucguuuuucagggagcaggcgaggcugccauggguauugcucacuugcucgugauggcccuggagaaagaagggguacccaaggcagaggccacaaggaaaaucuggaugguggacucuaagggcuuaaucgucaaaggacggucgcaucugaaccacgaaaaggagauguucgcucaggaucacccggaagugaacucacuagaggagguugugcgacucgucaagccuaccgcgauuauaggcguggcagccaucgcuggggccuucacggaacaaauucugcgcgacauggcuagcuuucaugagagacccaucauauucgcccuuaguaauccaacuuccaaagcugaauguacagccgagaagugcuacaggguaaccgaaggacgggguauuuuugcaucuggcagcccuuucaaauccguuacuuuggaggaugggaagacauuuauccccggacagggcaacaaugcguauguguucccaggugucgcucugggggugaucgccggcggcauucgccacauccccgacgagauuuuucuccugaccgcagaacagauagcccaggaggucucagaacaacaucuuagucagggaagacuguacccuccauugagcacgaucagggaugugucucuccguauugcuaucaaaguucuggacuaugccuacaagcacaacuuagcauccuacuauccggagcccaaggauaaagaagcauucgugcggucacugguauacaccccugacuaugacagcuuuacacuagauaguuacacuuggccaaaggaggccaugaauguccagaccguguga

SEQ ID NO: 58927 - RNA, 558 nt, Artificial Sequence
  derived and/or modified sequence opt3 from MEA1__Homo_sapiens__NP_055438
augggccccgagagacaccugagcggggccccugcuaggauggcaaccgugguccucggaggugacacaaugggcccagaacggaucuucccgaaccagacugaggaacuugggcaucaaggacccuccgagggcacgggugauuggucuucagaagaaccugaggaggagcaggaagagaccgggaguggaccagccggcuacagcuaucagccccugaaucaggacccugagcaagaagagguugaauuggcgccagugggcgauggggacguaguggcugauauucaggaccgcauacaggccuuaggacugcaccuacccgauccuccacucgaguccgaagacgaggaugaggaaggugcaacagcccugaacaaucauucuucgaucccgauggaccccgagcacgucgaacuugugaagcgaacuauggcuggcguuucacugccugcaccaggggugcccgccugggcucgugagauuagcgaugcccagugggaagacgucgugcaaaaagcguugcaggcaagacaggccaguccugcuuggaaguga

SEQ ID NO: 58928 - RNA, 3351 nt, Artificial Sequence
  derived and/or modified sequence opt3 from MECOM__Homo_sapiens__NP_001098547
augauccuggacgaguucuacaacgugaaguuuugcauugaugccagccagcccgacgucggcuccuggcucaaauauauaagauucgcuggguguuacgaucaacacaaucuuguugcaugccagaucaacgaccagaucuuuuauagggugguagccgauauugcgccuggagaagaacuguuguuauucaugaagucugaagacuacccacaugagaccauggcuccggauauucacgaggagcggcaguaucgcugugaggacugcgaucaacuguuugaaucaaaagccgagcuagcagaccaucagaaguuccccuguaguacaccucacagcgccuuuuccaugguggaagaggauuuccagcagaaacucgagucugaaaaugaccugcaagagauccauacuauacaggaaugcaaggagugugaucaggucuuuccagaccuucagucgcuggaaaagcacauguugucacacacggaggagcgagaauacaaaugcgaccaaugucccaaggcuuucaacuggaaaagcaaucucauccgucaucagaugagucacgauuccgguaagcauuaugagugcgaaaacugugcaaaacagguguuuaccgacccuucuaaucugcaaagacacauuaggagccagcacguuggcgcccgggcucaugccugcccagagugcgggaagacauucgcgacuuccucaggacugaagcagcacaaacauauccacaguagcgugaagcccuuuauuugugaagucugccauaaaucuuacacccaguucuccaaccucugucgccacaagagaaugcacgcagauugcaggacacaaaucaaauguaaggacugcggccagauguucucaaccacuagcaguuuaaauaaacaucggcgcuuuugugaggguaagaaccacuucgccgcugggggauuuuucggccagggcauaucucugccugggacaccagccauggauaagaccuccauggugaauaugagccaugcaaacccgggacuugcugacuacuuuggugccaaucgacaccccgcgggcuugacguucccuacugccccaggguuuucguucucuuuucccggacuguucccuuccggccuauaucacagaccaccccucauuccggcaucaaguccuguaaaaggucugagcuccaccgagcagacaaacaagucucaaagcccccuuaugacucauccacagauccugccugcuacccaggauauuuugaaagcccucucaaagcaccccaguguuggggacaauaaaccaguggaacugcagcccgagagguccagcgaggaacggccuuuugaaaagaucucugaucaaucagagaguagcgacuuagaugacgucuccacaccaucuggaucggaccuggagaccacgagcggcuccgaucucgaaucagacaucgagagugauaaggaaaaauucaaggagaacggcaaaauguuuaaggacaaagugucuccgcuucagaaccuggcuagcauuaauaacaagaaggaguacuccaaucauucaauauucagccccucuuuggaggaacagacugccguguccggggcagucaacgauaguaucaaagccauugcuagcaucgcggaaaaguauuucggaucuacaggucuaguuggccugcaggacaaaaaggugggggcacucccuuacccauccauguuuccccugccuuucuuuccagccuucucacaaaguauguaucccuuuccggaucgugaccuucgcagccugccuuugaaaauggagccacagucgcccggagaaguaaagaagcuccagaaaggcuccucugagagcccuuucgaucugaccacuaagagaaaagacgagaagcccuuaacaccagugccuucaaaacccccagucaccccggcuacgagucaagaucagccucuggaccuauccauggguucuaggagccgggccuccgggaccaagcucacagaaccccgaaagaaucacguguuuggcggaaagaagggcucaaacguugagagccgcccagcaagugaugggucucugcagcaugccagacccacuccuuucuuuauggacccaauauacaggguggaaaaacggaaacuuaccgaccccuuggaggcucugaaagaaaaguaucuccgcccuuccccgggauuccuguuucacccacaguuccaacuucccgaucagagaacauggaugagcgccauugagaauauggcagagaaacuggaaucguuuucagcguugaagccugaggcuucugaacuccugcagagugucccauccauguucaacuucagggcucccccuaaugcauuaccggagaaccugcuacguaaggguaaagaacgguacacuugccgauacuguggcaagaucuuucccagaagcgccaaucucaccaggcaucugcgcacacacaccggggagcagccauaucggugcaaauacugugacagaucuuucagcaucuccucaaaccuucaaaggcacgugcgcaauauucauaacaaggagaaaccuuuuaagugccacuugugcgaucgauguuucggacagcagacuaaucuggaccggcaucucaagaaacacgaaaacggcaacaugagugguacggcuacaagcucuccccacuccgagcuggaaucaaccggggccaucuuagaugacaaggaggaugcauauuuuacugagauucguaauuucauaggcaacaguaaucauggaagccaguccccaagaaacguagaagagaggaugaauggcucucacuuuaaagacgaaaaggcucugguuaccucgcaaaacagcgaucuuuuggacgaugaggaaguggaggacgagguccuccuggaugaagaggacgaagacaaugauaucacagggaaaaccggaaaggagccugugacuucaaaccuacaugaagguaaucccgaggacgauuacgaggaaacauccgcccuggagaugaguugcaagacgucuccaguccgcuauaaagaagaggaauacaagagcggccucuccgcgcuggaccacauucggcacuucaccgauucacuuaaaaugagaaagauggaggacaaccaguauucugaggccgaauugagcaguuuuuccacuagccaugugccggaggaacugaaacagccuuuacacaggaagucuaaaucacaagccuacgcaaugaugcucucccugagugauaaggagagccuucauucgacaucucacuccagcucaaauguuuggcauaguauggcccgagcugccgcagagucuuccgcgauccagagcaucucacacguguga

SEQ ID NO: 58929 - RNA, 1497 nt, Artificial Sequence
  derived and/or modified sequence opt3 from MECP2__Homo_sapiens__NP_001104262
auggccgcugcagccgcggcugcccccagcggcgggggagguggcggggaggaagagagacuggaagagaaguccgaagaccaggaucuccaaggacuuaaagacaagccucugaaauucaagaaagugaagaaggauaaaaaggaggagaaagaaggcaagcacgagccaguccagccgucugcacaucacucagccgaacccgcugaggcagguaaagccgagaccagugaagggagcggauccgcuccugccguuccagaggcgucugcaucgcccaagcagaggcggucaaucauucgcgaccgaggcccuauguacgaugacccaacauugcccgaaggcuggacucguaaguuaaaacagagaaagagcgggaggagugccggaaaauaugauguguaccugauaaacccucaagguaaggcuuuucgguccaaaguagagcuaaucgccuauuucgaaaaggugggcgacacgucucucgauccaaaugacuuugauuucaccgucacagggcgcggaagcccguccagaagggagcagaaacccccuaagaagccaaaaucacccaaggcaccuggcacuggucgggggcgcggacgaccaaaaggcaguggcaccacaagacccaaggcugccaccagcgagggggugcagguuaaaagggugcuggaaaagucuccgggaaaacuucuggucaagaugccuuuucagacuucccccgguggcaaggcggaagggggaggcgccacaaccucaacgcaagugaugguaauuaaacggccaggucguaagcgcaaagcagaggcugacccucaggccauccccaagaagagagggaggaaaccaggcagcguuguggcugccgcagccgcugaggcgaagaaaaaggcagucaaagaaaguucuauucgguccgugcaggagacuguguugcccaucaagaagcgaaaaacccgcgagacagucagcauagaaguuaaggaggugguaaaaccucuccuggugucgacucugggagaaaagucuggcaaagggcucaagaccugcaaauccccaggaagaaagucaaaggagaguagcccgaaagguagguccucuagcgccucaagucccccuaagaaagaacaucaccaucaccaccaucacuccgagagcccaaaggcucccgucccuuuacugccaccccuuccgccuccacccccugagcccgaaucuucagaggauccaacaaguccucccgaaccacaggacuugagcuccucuguguguaaagaggagaagaugccgcggggcgggucgcuggaaagcgacggaugcccuaaggagcccgccaaaacccaaccagcaguugccacggcugccacugcagcggaaaaguacaaacaucgcggcgagggugaaagaaaggauaucguguccucaaguaugcccaggccuaaccgugaggagccagucgacucucggacacccgugaccgaacgaguaagcuga

SEQ ID NO: 58930 - RNA, 6534 nt, Artificial Sequence
  derived and/or modified sequence opt3 from MED12__Homo_sapiens__NP_005111
auggcagcuuucggcauccugagcuacgaacaccgcccccucaagaggccucggcuugggccuccggacguguauccccaggauccuaaacaaaaggaagacgagcugaccgcauugaacgucaaacagggauuuaauaaccagccagccguuuccggugaugaacacggcucugcgaagaaugugucauucaaccccgcuaaaauuaguagcaauuuuuccucuauaaucgccgagaaguuacgcugcaacacacugccugacacugggcgacguaagccacaggucaaucaaaaagauaacuucuggcuggugacggcaagaucgcagucagccauuaauaccugguuuacagaccucgcuggaacuaagccccugacccagcuugccaagaaggucccuaucuucagcaaaaaggaagagguguuuggcuaccuggccaaguauacaguuccagugaugagggcugccugguugauuaaaaugaccugugcguacuaugcagccaucagugagacuaaggucaaaaagcggcacguggauccguucauggaauggacacagauaaucaccaaauaccucugggagcaacugcagaagauggcugaauauuaccgccccgguccugccggguccggaggcugcggcucuacgauugggccacugccccaugacguagagguugcaaucagacagugggauuacacugagaaacucgcuauguuuauguuccaggacggaauguuagauaggcacgaauuucugaccugggugcuugaguguuucgaaaagauucggccuggugaggacgaauugcugaagcuacuccugccacuucuguugcgcuauagcggcgaguuuguccaauccgccuaccucucacgaagacuggcguauuucugcacaaggcgguuagcccugcagcucgauggggugaguagccauucuucccacgugaucucagcacagagcacaagcacccuucccacaaccccggcuccucaacccccaacgucuuccacuccuagcacacccuucucggaccuguugauguguccacagcaccguccccuagucuuuggacugucuugcauacuccagaccauucugcuuuguugcccuuccgcccugguuuggcauuacucauugacugacagucgcaucaaaacaggcagcccacucgaucaccuaccgauugcucccuccaacuuaccuaugccagaggguaauucugccuucacccagcaagugagagcaaagcugagggaaaucgagcagcagaucaaagaacgggggcaggccguagaggugcgauggagcuuugacaagugucaagaagcuacggcgggauucaccauuggccgcguccuacauacacucgaggugcuggauucacacaguuuugagagauccgacuucagcaacucucuugauucauugugcaauaggauauuuggccuggggcccaguaaagacggacacgaaaucagcuccgaugacgaugcaguugugucucuccugugugagugggccgucucgugcaagcggagcggucgccauagagcuauggugguagccaaacuucuggagaaaaggcaggcagagauugaagccgagcguugcggcgaguccgaagcugccgacgagaaggggucaaucgcaaguggaucuuugagcgcgccuuccgcuccaauauuccaggauguucuccugcaguuuuuagacacucaagcccccaugcugaccgacccgcggucagaaagcgagcgaguggaguucuuuaaccuaguccuccuguucugugaacuuauuagacacgauguguuuucucauaauauguauacaugcacuuugaucuccaggggcgaccuggcauucggugccccugggccaagacccccuagucccuucgaugacccagcugaugacccugagcacaaagaagccgagggcaguucuuccucaaagcucgaagaucccggacugagugagagcauggacaucgauccaucguccucugucuuauuugaggacauggaaaaaccggauuucagccuguuuucaccuaccaugcccugugagggcaaggggaguccaucccccgaaaagccugacguggagaaagaaguuaagccacccccuaaagagaagauugagggaacacuugguguguuguacgaucagccgcggcauguacaguaugcaacccacuucccaaucccccaggaagagucuugcagccacgaauguaaccaaagacucgucgugcuguuuggcguugggaaacagagggacgacgcucgccaugccauuaagaagauaacuaaagauauccuaaaggugcugaaccgaaaaggaacggcggagacagaccagcucgccccuauugucccacugaaucccggcgaucuuaccuucuuggguggggaagacggccaaaagcggcguagaaacaggccugaggcuuuuccgacugcagaggauaucuucgccaaauuucagcaccugucccauuacgaccagcaccaggugaccgcucaaguaucacgcaauguguuagaacagaucacuagcuucgcccucggaaugaguuaccaucugccccuuguucagcauguccaguuuauuuucgaucugauggaguauucuuuguccauaagcggccucaucgacuuugcaauucaacugcuaaacgaacugucggugguggaggcggagcuccugcuuaagucaucugauuuggucgggaguuacaccacuucccugugcuuauguaucguugccgugcuccggcacuaucaugcuugccugauucuuaaucaggaccagauggcccagguguucgaaggacugugugguguagucaaacacggcaugaacagaagcgaugggucuagcgcagagaggugcauccuagcuuaccucuaugaccuguacacauccuguucacauuugaagaauaaguucggagaacuguuuagugauuucugcagcaaagugaagaacacgauauauugcaauguugagccaucugaauccaacaugcgaugggccccugaguuuaugaucgacaccuuagagaaucccgcagcccacacuuucacauacaccggccucgguaaaucacugagugaaaacccagcuaaucgcuacagcuuuguguguaacgcgcuuaugcacgucugcguggggcaucacgacccugaucggguuaaugacauugccauccugugugcagaguugacaggcuauugcaagucccucucugcugaauggcugggagugcuaaaagcccuguguugcucgagcaacaacggcacuuguggguucaaugaucuucucugcaacguagacgucucagaucuguccuuucaugacaguuuggccaccuucguggcuauucugaucgcaagacaauguuuacuccuggaggaucuuauaaggugcgccgcgauucccucucuguugaaugcugccuguagcgaacaggacuccgagccaggagcacgucucacgugccgcauccugcuacaccuguuuaagaccccgcagcuuaacccuugccaaucagauggcaauaagcccacaguggguauucggucuagcugugacagacaucuccuggccgcuagucagaacaggaucgucgauggggcaguuuucgccguguugaaagcgguauuuguguuaggagacgcugagcugaagggcuccgguuucacugucaccggcgggacagaagaacucccagaagaggaaggaggcgggggaagcggcggucgacggcaagggggccgcaauauaucuguggagacugccucacuggacguuuacgcaaaauaugugcuuagauccaucugccagcaagagugggucggcgaaaggugucugaagaguuugugcgaggauagcaacgaccuacaggaucccgugcugucgucugcccaggcucagcggcucaugcaacugauuuguuacccucaccgacuuuuagacaaugaagauggugagaacccacagagacagcgcaucaaaaggauucugcagaaucucgaccaauggaccaugcgucaguccagcuuggagcugcagcucaugaucaagcagacgcccaacaaugaaaugaacucacugcuugagaauauagccaaggcaacaauugaaguuuuccaacagagugcugagaccggaucuuccagcgggucaacugccaguaacaugccuagcuccucuaaaacaaagccggugcugagcuccuuggaacggucaggagucuggcuaguagcgccacugaucgccaaacuccccaccucugugcagggccacguuuuaaaggcagcuggggaggagcuggaaaaaggacaacaucuuggcaguucgagcagaaaggagagggaucgccagaagcagaaauccaugucucugcucucacagcaaccauuuuugagccuggugcucacuugccugaagggucaggacgaacagcgagaggggcuucuaaccucccuguauagucagguccaccaaaucgugaacaauuggagagaugaccaguacuuggaugacuguaaacccaagcaguuaaugcaugaagcccugaaacuccggcugaaccuuguaggaggcauguucgauacagugcagaggucuacgcaacagaccacugagugggcuaugcugcucuuggagauuaucauuagcgguacagucgacaugcagucaaauaacgaacuguuuaccacaguucuagacaugcuguccgugcucauaaauggcacucuugcagccgauaugaguagcaucucucaaggguccauggaggaaaacaagcgcgccuauaugaaucuggcuaaaaaguuacagaaggaguugggagaacgucagucagacagccuggagaaagugagacagcuccugccacuuccuaagcaaacccgggaugucauuacgugcgagccccagggcucgcugaucgacacaaaagggaacaagauugcgggauucgauucuaucuuuaaaaaggaaggccuccaggugaguaccaagcagaaaauauccccaugggacuuguucgagggucugaagccuagcgcaccguuaucaugggggugguuuggaacuguuaggguagaucgccgaguggccagaggcgaggaacagcagcggcuacugcucuaccacacccaccuuaggccccgcccaagagcuuacuaucuggagccuuugccccugccaccugaagacgaggaacccccggccccaacacuccuggagccugagaaaaaggcacccgagccacccaaaacugauaagccuggcgccgcuccgcccuccaccgaggaaaggaagaaaaagucuacaaaagggaagaaacggagccagccagcgacgaagaccgaggacuacggaauggguccuggccguagugggcccuauggagucacugugccuccagaucuucuccaucaccccaauccuggcuccaucacacaucugaacuaccgccaggguagcauuggguuguauacccaaaaucagccacugcccgccggaggcccgcgaguugacccuuacagaccagugagguuacccaugcagaagcuaccuacucggccaacauaucccggcguccugccgaccacgaugacuggggugaugggacucgaaccuucuucauacaaaaccaguguauaccgccagcaacagcccgcagucccacagggucaaagacuuaggcagcagcugcagcaaucccagggcauguuggggcagagcucugugcaccagaugacaccuucgucaagcuauggacugcaaaccucccagggcuacacucccuauguuagucaugugggucuccagcagcacacagggccagcuggaaccaugguacccccuucuuacagcucccaaccauaucagucaacacacccgaguacuaaccccacccugguggauccuacgcggcaucuucagcaacgaccaucuggcuacguucaccagcaggcccccacauauggccauggguuaaccagcacucagagauucucccaccaaacccugcagcagacaccuaugaucucaacuaugaccccaaugagcgcacagggagugcaagccgguguccgcucuacggcuauucuccccgagcagcagcagcaacagcagcaacagcagcagcaacagcagcagcaacagcagcagcaacagcagcagcaacagcagcaauaccacaucaggcagcagcagcaacagcagauauugcggcagcaacagcagcagcaacagcagcaacagcagcagcaacagcagcagcaacagcagcagcaacagcagcagcaacagcaucagcaacagcagcagcaacaggccgcgccuccgcagccacagccccaaucccagccucaguuucagcgucaaggccugcagcagacacaacagcagcagcaaaccgcagcccuagugagacagcugcagcagcaacucaguaauacucagccccagccaagcacaaacauuuucgggagguacuga

SEQ ID NO: 58931 - RNA, 6438 nt, Artificial Sequence
  derived and/or modified sequence opt3 from MED12L__Homo_sapiens__NP_443728
auggccgcuuucggccugcucagcuacgagcagagaccccuuaagaggccucggcuggggccaccggacguguauccccaagauccuaagcagaaggaagacgaguugaccgccgucaacguuaaacagggauuuaauaaccagccagccuucacuggugaugaacacggcuccgcgcgcaauaucgugauuaaccccucuaagauaggggcuuacuuuucaaguaucuuagccgagaaacugaagcuaaauacuuuccaagacacgggaaagaaaaagccucagguaaacgcaaaagauaauuauuggcucgugaccgcccgaagccaguccgcuauucacucuugguuuucggaccuggcaggcaacaagccacuuucaauccuggccaaaaagguccccauuuugagcaagaaagaagauguguucgcuuaccucgccaaguauaguguuccuauggugcgugcgacauggcugaucaaaaugacuugcgcauacuauuccgccauaucugaggcuaagaucaaaaagagacaggccccagacccgaaucuggaguggacccaaauuagcacaagguaccuccgggaacaguuagcaaaaaucuccgauuuuuaccacauggcuucaaguaccggugacgggcccgucccugugccacccgagguagaacaggccaugaagcagugggaguauaacgagaagcuggcguuccauauguuucaagaaggaaugcuugagaaacacgaauacuugacuuggauucuggauguucuagagaagauccgcccuauggacgaugaccuccugaaacuucuguugccacucaugcugcaguauagcgacgaguucgugcagucugccuacuuauccagaaggcuggcauauuuuugugcucggcgccucucacuucuguugagcgauagucccaaucuacuggccgcucauucuccgcacaugaugauaggcccuaacaauuccagcauuggcgcccccucgccagggccucccggaccagguaugucucccguccaacucgcauucuccgacuuucugucaugcgcccagcacggcccucuuguguacgggcugaguuguauguugcagacagugacccucugcuguccaagcgcucuggucuggaacuauuccacgaaugagaacaagucugcgaacccgggaagccccuuagaucugcuacagguugcaccuucaagucucccaaugcccggcgguaauacugccuucaaccaacaggugcgagcuagaaucuacgagguagaacagcagauuaaacaaagggggcgggccguggagguccguugguccuucgacaagugccaggaaagcaccgcaggagugacaaucucucgcguucugcauacucuugagguguuggauagacacuguuuugacaggaccgauucaaguaauagcauggaaacacuguaccauaagaucuucugggccaaccagaauaaagacaaccaggaggucgcuccuaaugaugaggccgugguaacccuccugugcgaaugggcaguuuccuguaagcggucuggcaaacaccgagcgauggcuguggccaaacuucuggagaaacgccaagcagaaauugaggccgaaagaugcggcgagucggaggucuuggacgaaaaggagagcauauccucaaguucucucgcugggagcucccugccaguguuucagaacgucuuacugagguuccuagauacgcaggcccccucacucagcgacccaaauucugaaugugagaagguggaguuuguuaaccuggugcuuuuguucugcgaauuuauccggcacgacguauucucccaugaugcauauaugugcacucugauuagucgcggagaccucagcgucacagcuucuaccagaccuagguccccagugggugagaaugccgaugaacacuacucaaaagaccaugauguuaagauggagaucuuuagucccaugccuggcgaaagcugugagaacgcgaauacuucgcuggggcgucggauguccgugaacugcgagaaauuagucaagcgagaaaaacccagagagcugauauucccaucuaauuaugaccuuuugaggcaccuccaguacgccacacauuuuccuauuccccuggaugaaagcucaagucacgaguguaaccaacgcaccauccuacuguauggagugggcaaggaacgggacgaggcuagacaccagcucaagaaaaucacgaaggauauucugaaaauccuuaacaagaaauccaccacagagacugguguaggggacgaaggccagaaggcaaggaaaaauaagcaagagaccuucccaacauuggaaacuguguuuaccaagcugcaguuacucucuuacuucgaucagcaucagguuacaagccaaauuuccaacaauguccuggagcagauaaccucauucgccagcggaacaaguuaucaccuuccgcuggcucaucacauccaguugauuuuugaccucauggaaccugcccugaacaucaauggccuaaucgauuucgcaauucagcugcucaacgagcugucugugguggaggcggaacuuuugcugaaauccagcucguuagccgggucauacacgacaggacucugcgucuguauaguugcugugcugcgccgauaccacucuugccuuauccugaaucccgaccaaaccgcccagguguuugagggucuauguggcguagucaagcaugugguuaacccaagugaaugcuccagccccgagcgguguauucucgcauaucuguacgacuuguaugugucuugcagccaucugcguuccaaauucggggauuuauuuucaagugcuuguagcaaggucaaacagacuaucuacaauaacgugaugccugccaauucuaaccucagaugggacccagauuucaugauggacuuuauugagaaucccuccgcaaggucaaucaacuauaguaugcugggaaagauacuuagcgauaaugccgcuaaccgcuacuccuucguuugcaacacccugaugaaugugugcaugggccaucaggacgcgggucggaucaacgauauugccaauuuuucuucggaauugacagcauguugcaccguacucagcucagaguggcuggggguccuaaaggcucuguguugcuccaguaaccacguguggggcuucaaugacgugcuuuguacugucgauguuucugaccucagcuuucaugauucccuggccacauucaucgccauuuugaucgcuagacaaugcuuuucacuggaagacgugguacagcacguggcauuaccuucucuccuggccgcggcuuguggagaugccgacgcagagccgggcgccaggaugacgugccgacuucuguugcaccucuuccgcgcuccacaggcauguuuccugccccaagccaccgggaaaccuuuuccaggaauacggagcaguugcgacagacaucuacuggcggcugcccacaacuccauugaagucggugcaguguucgccguucuuaaggcuaucaugaugcucggcgaugccaaaauugggaauaacagcgugucuucacugaagaaugacgauuuuacuaugaggggauugcguugugacggcaacgcagaugacaucuggacagcuucccagaaucccaaaaguugcgguaagagcauaucgaucgagaccgccaacuuacgcgaguaugcgcgguacguccugagaacaauuugccagcaggaaugggugggggagcauugucucaaggaaccugagaggcugugcacugauaaagaacuuauccuggacccgguuuugucuaauaugcaagcccagaagcuacugcagcucauuuguuacccccacggcaucaaagagugcaccgagggagauaaccugcagcgacaacauauaaagcggauucuucagaauuuagaacaguggacgcugcgccaguccuggcucgaguugcaacugaugaucaaacagugucucaaggacccaggcagcgggucaguggcagaaaugaacaaccugcuugauaauaucgcuaaggccaccauugaggucuuccagcagagugcugaccugaacaauucuuccaacagcggaaugucauuguuuaauccuaacaguaucggcagcgcagacacauccucuacuagacaaaaugguauuaaaaccuuccuaagcuccucagaaaggcgaggggucuggcugguggcaccccucauagcccgguuaccaacaucuguucagggaagagugcugaaggcugcgggcgaggagcuugaaaaaggucagcaccugggcaguucgagcaagaaagagcgcgauaggcaaaagcagaaauccaugucucucuugucacagcagccuuuucugagccucguccugacuugccuuaaggggcaagacgaacagcgugagggacuacugaccuccuugcagaaccaggugaaucaaaucuuaaguaacuggcgggaggaaagauaucaggaugacauuaaggcaaggcagaugaugcacgaggcccugcagcuccgccugaaucuuguaggcgggauguucgauacggugcaacgaucuacacaguggaccacugacugggcucugcucuugcugcagaucauuacaagcggaaccgucgauaugcauacuaacaaugaacuauuuaccacaguucuggacaugcucggcgugcuuaucaacgguacgcuggccucagauuuauccaaugcaagucccgggggaagcgaggaaaacaaaagagccuacaugaauuuggugaagaaacugaagaaagagcucggcgacaagcggucugaguccauagauaaggucaggcaacugcuuccacugccgaaacagaccugugacgugaucacuugcgaaccuauggguucacucauugauacaaagggcaacaaaaucgcuggguucgacagcauugacaagaaacagggauugcagguuucgaccaagcaaaagguaucucccugggaucuguuugagggccagaaaaacccagcgcccuuaaguugggccugguucgggacagugcgcgucgaccguagagugaucaaguaugaagaacagcaccaucuacugcucuaccacacucacccuaugccaaaaccccgguccuauuaccuucagccucugccguugccacccgaagaggaggaagaggaaccuaccagccccguuucacaagagccagaaaggaaguccgcagagcugucugaucagggaaaaacgacaaccgacgaggaaaagaagacuaaaggccgcaagcgaaaaaccaagagcaguuccagaguggaugaguauccucagagcaauauauaccggguacccccgaacuacucuccuauuucaagucagaugaugcaucacccgcaauccacacucugggguuauaaucugguggggcagccccagcagccaggauucuuucuucaaaaccagagccucacuccuggcgguucuaggcuggaccccgcuggcucguucguaccaaccaauacaaaacaggccuugucaaacaugcugcaacgcagaagcggggcaaugaugcagccucccuccuuacaugccaucacgagucagcagcaacuaauccagaugaagcugcuccagcagcaacagcagcagaggcuucugcggcaagcucagacccguccguuucagcaaggacagccaggcgaucaggccgcguuguucgcagcccaggcucgcccuucuccccaacugccacaguaccccgggcuccagcaggcccaaacuaugccucagggauauacaauguacggcacccagaugccgcugcagcaaacuagccagcagcaagcugguuccgucgugcuuucacccaguuauaauucucgagcauacccagccgcucacagcaacccuguuuuaauggaaagacugaggcagauucagcagcaacccuccggguaugugcagcagcaggccucaccuuaccuccaaccauugacaggaagccagcggcugaaucaucaggcacuacagcaaucuccccuggucggcggcgggauagacgcggugcucaccuccgcccacccuaaccuuccaaguguuccccugccgcaggauccuaugcgcccaagacagccccaggugaggcaacagcagcgguugcugcaaaugcagcagccucagcaaccacagccccagcagccgccucaaccccagcagagcucgcagucccaaucucagacgcucggacugcaggcuaugcaaccacagcagccuuuauuuccccgacagggucuucaacagacucagcagcaacagcagaccgccgcacuggucagacagcuccaaaagcagcuaucaagcaaucagccacagcaaggcgugacacccuacgggcacccuagucauuucuga

SEQ ID NO: 58932 - RNA, 6525 nt, Artificial Sequence
  derived and/or modified sequence opt3 from MED13__Homo_sapiens__NP_005112
augagcgccuccuucgugcccaacggcgcuucucuggaggacugccacuguaaucucuuuugccuugcagaucugaccgggaucaaguggaaaaaguacgucuggcaggggccuacuucagccccaauuuuguucccgguuacugaagaggaccccauauuaagcagcuuuuccagaugucugaaagcggauguguuggguguauggaggcgggaccagcgcccuggccgacgugaacucuggaucuucugguggggagaagauccaucuuuugcugaccugauucaucacgaucuuucggaagaggaggacggggugugggaaaacggccugucauaugagugcagaacgcuacucuucaaggccguccauaaucugcuggaaaggugucucaugaaccggaauuuugugcgcaucgguaaaugguucguuaagcccuacgagaaggaugagaaaccuauuaacaagagcgaacacuuaaguugcuccuuuaccuucuuucugcauggggacucuaauguguguacaagcgucgagaucaaccagcaccagccaguguaucuuuuguccgaagaacacauaacucuggcacagcaaucaaauagucccuuccagguaauccuaugcccuuuuggacucaacggcacccugacaggccaggccuucaaaaugagcgauucugcuaccaagaaacuuauuggggaauggaagcaguucuacccaaucuccuguugccugaaggagaugucagaggaaaaacaagaggacauggauugggaagacgacagcuuggcagccguugaggugcucgucgcuggagugagaaugauuuauccggccuguuuugugcuggucccccagagugauaucccuacuccaucucccguugguuccacacauugcagcucgucuugcuuaggcgugcaccagguaccugcguccaccagggacccagcaaugucaagugugacgcugacucccccgaccagcccugaagagguccagacaguggauccccaauccguucagaagugggugaaauucucuagcgucucagacggguuuaauagugauuccacuagccaucacggaggcaagauaccacggaaacucgccaaccacgugguagaccgcguuuggcaggaguguaauaugaaccgagcucaaaauaagagaaaauacucugccucaaguggugggcuuugcgaagaggcaaccgcugccaagguggcgagcugggauuucgucgaagccacacagaggaccaacuguuccugccugcggcauaagaacuugaaaucucguaaugcaggacagcagggccaagcuccuucgcuaggccagcagcagcaaauucugcccaagcacaaaacgaacgagaagcaggagaaaagcgagaagccacagaagcgcccccucacuccuuuucaucacagaguguccgucucagacgauguggggauggacgccgauagugcuucucagaggcugguuaucagcgccccagacucccaagugcgguucucaaauauucgaacaaacgacguagcaaaaaccccgcagaugcauggaacugagauggccaauagcccccagccuccaccccuuucuccucacccaugugaugucguggacgaagguguuacaaagacccccuccacgccgcagagucaacacuuuuaucagaugccuaccccagauccccuggugccuagcaaacccauggaggaccgcaucgauucuuugucccagucauucccaccucaauaccaggaagcugucgagcccacaguguacguaggcacugcggugaaccucgaggaagacgaggcaaauaucgccuggaaguauuacaaauuuccaaagaagaaagauguugaguuccugccgccucaguuacccagugacaaguuuaaagaugacccagucgggcccuucggacaggagagcgugaccucggugacagaacugaugguccaaugcaagaaaccucuaaagguuuccgaugagcucgugcagcaguaucagauuaagaaccaaugucugucugcuauagccagcgacgcagagcaggaaccaaaaaucgaucccuacgccuuuguggagggcgacgaagaguuccuuuucccugacaagaaagauagacaaaauucagaaagggaggcugguaagaaacauaagguagaggacgggacaagcuccgucaccguguugucucacgaagaggaugccaugagccuguuuuccccgucaauuaaacaggacgcaccacggcccacaagccaugcgcgcccuccaaguaccucucucaucuaugauuccgaccuggcuguuagcuacacugaucuugacaaccuguucaauucggaugaagacgaguugacgcccggcucaaagaagucugccaacggaagugaugacaaagcauccugcaaggaaagcaaaacaggcaaucucgauccucugucuuguauaagcaccgccgacuuacacaagauguauccgacucccccaucccuggagcaacacauuaugggguuuucaccuaugaacaugaauaacaaagaguacggaaguauggacaccacacccgguggcaccgugcuagaagggaacaguucuuccaucggagcucaguucaagaucgaggucgaugaaggcuuuugcucaccaaagccuagugagauuaaagacuucagcuacguguauaagcccgagaauugucagauccucguugguugcuccauguuugccccacugaaaacucuuccgucucaauacuugccucccauuaagcugccagaagagugcauauauagacagucguggacaguggggaaacucgaacuguuaagcucaggccccuccaugccuuucaucaaggagggagauggcaguaacauggaccaggaauacgggacggcauauaccccacagacucauacaucuuuuggaaugcccccuagcuccgcuccgccaucaaauucuggugccggcauucugcccagcccuaguacccccagguucccaacaccucguacuccccggaccccacgaacgccuagaggggcgggaggcccggccuccgcucaagguagcguaaaguacgagaacucugaucuuuauucacccgcauccaccccaaguacauguaggccuuugaauagcgucgagcccgccacugugccaucgaucccugaagcucacucucucuacgugaaccugauccuauccgagagcgucaugaaucuguuuaaagacugcaacuucgauucauguugcauuuguguuugcaauaugaacauaaagggggccgacgugggcguauacauccccgauccgacccaggaagcacaguaucgcuguacaugcggauuuagugcggugaugaaucggaaauucggcaacaauucuggacucuuccuggaggacgaacuugauauuaucggaagaaacacugacuguggcaaggaggccgagaaaagguuugaggcuuugcgcgccaccuccgcagagcaugucaauggugggcugaaggaaagcgagaaguuaucagacgaucucauucugcuucugcaggaccaaugcacgaacuuguucaguccauuuggagcugccgaucaggacccuuuccccaaaagcggcgugaucuccaacuggguucgaguggaagaacgggauuguugcaaugacugcuaccucgcacuggagcacggucgucaguuuauggauaacaugucuggcgggaaggucgacgaagcccuagugaaaagcuccugucugcauccauggucaaagagaaaugauguuucuaugcagugcagucaagacauacucaggaugcugcuuucguugcagcccgugcugcaggaugcuauccagaaaaagcgcacaguccggccuuggggaguacaaggcccguuaaccuggcagcaguuccacaaaauggcggggagaggaagcuauggcacugacgagucccccgaaccacucccuauucccacauuucugcuugguuacgauuaugacuaccuggugcuaucuccuuucgcccucccauauugggagaggcugauguuggagcccuacgggucacaacgagacaucgcauacguugugcuguguccugaaaacgaggcuuuacucaauggagccaagagcuuuuuccgcgaucugaccgccauuuaugaauccugccggcuuggccagcacagaccagucaguaggcuguugacugacgguaucaugcgugugggcucuaccgcuagcaagaaacucucagagaagcugguagcagaaugguuuucccaggccgcggaugggaacaaugaggcuuucaguaaacuaaagcuguacgcccaggugugucgcuaugaccuuggacccuaccucgcaagccugccguuggauucuucccuguuaucacaaccuaaccucgucgccccaacaagccagucgcugauaacgcccccucagaugaccaauacuggcaacgcuaauacaccaucugcaacccuugccagugcggcuuccagcacaaugacuguuaccucagggguggccauuuccacgucuguggcaacagccaacagcacccugacuaccgcuaguacauccaguucuucaaguuccaauuugaacagcggagucucuucgaauaaacuccccucauucccgccuuuuggcagcaugaacuccaacgccgcagguaguaugucuacucaggcuaauaccgugcaaagcgggcagcugggaggccagcagacauccgcccuacaaacggcggguaucucaggcgagaguucuagccugcccacccagccacauccugacguuuccgaaucaacuauggaucgggacaagguagggauucccacagauggagacagccacgccgugaccuauccacccgcaaucgucguguacauaaucgauccuuucacuuaugagaacacagacgaaucuaccaauuccaguagcguuuggacgcuuggccuccugagaugcuuuuuggagauggugcagacuuuaccaccgcauauuaagucgaccgucuccgugcaaaucauucccugucaguaccugcuccagccuguaaaacacgaagauagggagaucuacccacagcaucugaagucucuugcuuucucagccuuuacacaaugccgacggccccugccuaccagcacuaacgucaaaacauugaccggguucggaccaggccuagcuauggagacagcacugcgcagucccgacagaccugaauguauaaggcucuaugccccgccauuuauucuggcccccgugaaggacaaacagacugagcuuggugaaaccuucggggaggcuggacagaaguacaauguuuuauuugugggcuauugccugucccacgaucagcgguggauccucgcgucuuguacggacuuguacggcgaacugcucgagacaugcaucauuaacaucgaugucccuaaucgagcaagacgcaagaaaagcucagccaggaaguucgggcugcaaaaacuuugggaguggugccugggauuggugcagauguccagucuacccuggcguguugugauuggucggcugggcagaauagggcacggagaacucaaggacuggagcuguuuacugucuaggcgcaaccuucagucacuguccaaacgacucaaggauaugugcagaauguguggcaucagcgcugccgacucuccaaguauuuugucggcaugccuggucgccauggagccucaggguuccuuugugaucaugcccgauagcguaucaaccgggucuguguucggacggagcacuacccucaauaugcaaacaucccagcugaacacuccacaggacaccaguuguacgcauauucuuguuuuuccgacaucagcuucuguccagguggcgagcgccaccuauacuacagaaaaucuagaucuggcauucaacccuaauaacgacggcgcugauggcauggggaucuucgacuuguuagacaccggagaugaccuggaucccgacauaaucaauauucucccagccucccccacugguaguccugugcacagcccaggcucccauuacccccacgggggagaugcaggcaagggucaaucuacagacaggcugcuuucaaccgagccucacgaggaagucccgaacauccugcagcagccacucgccuugggguauuuuguaagcacggcuaaagccggaccccugccugauugguucuggucggcgugcccacaagcacaguaccaguguccccuauuucugaaggccucccuccaucuucacgugccuaguguucagucugacgagcuguuacauagcaaacacucacaucccuuggauuccaaucaaacuucugacgugcugcgcuucguccucgaacaguacaacgcucugaguuggcuuaccugcgauccagccacacaggaccguagaagcugucugccgauucacuuugugguucucaaccaguuguauaauuucaucaugaacaugcuguga

SEQ ID NO: 58933 - RNA, 6633 nt, Artificial Sequence
  derived and/or modified sequence opt3 from MED13L__Homo_sapiens__NP_056150
augaccgccgcugcgaacuggguggccaauggcgcgagccuggaggacugccacuccaaccucuucucucuugcugaacugaccgggaucaaguggagaagguacaauuuuggaggucauggcgauugugggcccauuauaucagccccugcacaggacgauccaaucuugcugagcuucauucggugcuuacaagccaaccugcucuguguauggcgccgagacguuaagccggauugcaaggagcuguggaucuuuugguggggagacgaacccaaucuugugggcgugauucaccaugagcuacagguggucgaagaggguuugugggagaacgggcucagcuaugaaugucguacucugcuguucaaggcuauccacaaucucuuagagagaugccugauggauaagaacuuugugaggauaggaaaaugguucguucggccuuacgaaaaggacgagaagccagugaauaaauccgagcaucuuucuugugcauuuacguucuuuuugcacggcgaaucgaacgucugcaccucaguggagaucgcccagcaccagcccauuuaucugaucaaugaggaacacauucacauggcucaaagcaguccugccccauuccaggucuugguuucccccuacggccucaacgggacacugacuggacaggcguauaagaugucugauccugcaacccgcaaacuuaucgaagaguggcaguacuuuuauccaauggugcugaagaaaaaggaggaaagcaaggaggaagacgaguuggguuacgaugacgauuucccggucgccguggaagugauagucggcgggguuagaaugguguaccccuccgcuuuuguacucauuucacaaaaugacaucccugugccacagagugucgccagcgcaggaggccauauugcugugggucagcaggggcugggaucuguuaaagaccccuccaacuguggcaugccuuuaacaccacccaccucaccggagcaagccauccugggcgagagcgggggaaugcagagugcggccucucaccucgugucccaggaugguggcaugaucacuaugcacagcccuaagaggucggggaaaauucccccaaaacuucauaaucacaugguccaucggguguggaaagaaugcauacugaaccgcacacaaucuaagcgaucccagaugucaaccccuacguuggaggaggagcccgcaaguaacccagcuacuugggacuucguagaucccacccagagaguuagcuguuccugcucuaggcacaaacuacugaagcggugcgccgugggaccuaaucguccaccgacagucagccagcccggcuucucagcugguccuaguuccaguucuucacucccacccccugccaguagcaagcauaaaacugcagaacgccaagagaagggggacaaacugcagaagagaccacuuauccccuuucaccacaggccguccguggccgaggaacuguguauggagcaggauaccccuggccagaaauugggacucgcuggcauugacucuucgcuggaagucagcuccucacggaaguaugauaagcaaauggcggugccaagucgaaacacaucuaaacagaugaauuuaaaccccauggacagcccucauucccccaucucaccacugccucccacccuaagcccacagccgcgcgggcaggagacggagucucucgauccucccuccguuccagugaaucccgcacuguacggaaacggucuugaauugcaacagcugaguacucucgacgauagaacaguacuggucggccagaggcuuccucugauggccgaggugagcgaaaccgcuuuguauugcgggauacggccaucuaaucccgaguccucagaaaagugguggcacaguuaccgccucccuccgagcgacgacgccgaguucagaccacccgagcugcagggagaaaggugugaugcaaaaauggagguuaacucggaauccacugccuuacaacgucugcuagcucagccuaauaagcgguuuaaaauuuggcaggacaagcaaccacagcuccagccccugcauuuccuugauccuuugccgcugucucagcaacccggcgacagccucggugaggugaacgauccauauacauuugaagacggggauaucaaguacaucuucaccgccaauaaaaagugcaaacagggcacggagaaggacucacugaaaaagaacaagagugaggauggauuuggcaccaaagacgucacaacuccugggcacuccacccccgugccagauggaaagaaugcaaugucuauuuucagcuccgcgacaaaaacugacguacgacaggauaacgcugccgguagagcaggcucaagcaguuuaacccaggugacagaccuggccccuucucuucacgacuuggauaauaucuuugacaacuccgaugacgaugaacucggggcuguuagccccgcccugaggucgucaaagaugccagcagucggaaccgaggaccgcccgcuaggcaaagauggucgggcugccgugccuuaucccccaacuguggcggaccugcaaagaauguuccccacgccuccaucucucgaacagcaucccgccuuuaguccugucaugaacuacaaggaugggauuuccagcgagacaguuaccgcucugggcaugauggaaucuccgauggugagcaugguguccacucagcuuaccgaguucaaaauggagguagaagacggauugggcucaccaaagcccgaggaaauaaaggauuuuaguuacguccacaaagugccuagcuuccagcccuucguugggucuuccauguuugcaccacugaagauguuaccuucacauugucuccugccccuuaaaaucccagacgccugccuguucaggccuaguugggcuauuccgcccaagaucgagcaauugccaaugccucccgccgcaacauuuauccgcgauggauauaauaacgugccaagcgucggcucccucgcggacccugacuaccugaauacaccccagaugaacacuccggugacacuaaauucugccgcuccagccucgaacagcggugcagggguucugccuucacccgcuacgccacgauucuccgugcccaccccucggacuccgcguacacccagaaccccaaggggaggcgguacagccaguggccaggggucuguaaaauaugauagcacugaccaaggauccccugcaucaacccccucuacgacccgcccucucaauagcgucgagccagccacaaugcagcccauuccugaagcucacagucuguacgugacucuuauauuguccgauagcgugaugaacaucuuuaaggaccggaauuucgauucuuguugcauuugugcgugcaacaugaauaucaagggcgccgacgucgggcuguauauuccagauucauccaacgaggaccaguacagauguaccugcggauuuagugcaaucaugaauaggaaauuaggcuauaacagcggucucuuccuggaagaugagcuugacauauuugggaaaaauucggauaucggacaggcugccgaacgacgccugaugaugugccaaucuacauuccuaccccagguugagggcacuaaaaagccgcaggagccuccaauuucccuccuguugcuguuacagaaccaacauacccagcccuuugccagccucaacuuccuggacuacaucucaaguaauaaccggcagacgcuuccuugugugucuugguccuacgacagaguacaggcugauaauaacgacuauuggacagaaugcuuuaaugcacuggagcaagguaggcaguacguggauaacccaaccggcgggaaagucgacgaagccuuggugcguagcgcgacuguucacucauggccccacaguaaugugcucgauauuagcaugcuguccucucaggacgucgugcgcaugcuacugagccuucagccguuccuccaagaugcuauccagaagaagcggacaggaagaaccugggagaacauacagcauguucaaggcccucugacuuggcagcaguuccacaaaauggccgggaggggaaccuauggcuccgaagagucacccgagccauugccuauucccacacuguuaguggguuacgacaaggauuuucucacgaucucuccauucagucugcccuuuugggaacgacuucuguuggacccuuaugggggacaucgggaugucgcauacauuguaguguguccagagaaugaagcccuccuggagggcgcuaaaaccuucuuucgcgaccuaucggcaguuuaugaaaugugcagacugggucagcacaagccgaucuguaaagugcuuagggauggcauaaugcgggucgggaagacuguggcccaaaagcucacagacgagcugguaagcgagugguucaaccagcccugguccggagaagagaaugacaaccauucucgauugaaauuauacgcacaggugugcagacaccaccuggcuccuuaccucgccacccugcagcuugauucaagccuguugaucccacccaaguaucaaacaccuccagcagccgcucagggccaggccacucccgggaaugcaggaccucuagcuccgaacggcuccgccgcgccacccgccgguagugcauuuaauccuaccucuaacagcucauccacgaaccccgcugccaguagcucugcuuccgggucaagcgucccaccuguuucgucuagugcauccgcccccggaauuagccagaucucaacaaccuccucuagcggcuucaguggcuccguagggggacaaaauccaagcacugguggcauuucugccgaccgcacccaggggaacaucggauguggcggugauacagacccggggcagucaaguucccaaccuagccaggauggacaggaaucugugacugagagggagcguauaggcauucccaccgaaccagacucggcugauucacaugcgcaucccccugcagucgugaucuacaugguugacccauuuacauaugccgcugaggaagauagcacguccggcaauuucuggcugcucagucugaugcggugcuacaccgagaugcuugacaacuuacccgaacauaugagaaauucuuuuauccugcagauuguaccuugucaauauaugcuccagacuaugaaagaugaacagguguucuacauccaguaucuaaagagcauggccuucuccgucuacugccaauguaggcgcccgcugccaacacagauucacauaaaaucacucaccggguuuggacccgcagccaguaucgagaugacucugaagaacccugaacgaccaucucccauucagcuuuacagcccucccuucauccuggcuccaauuaaagacaagcagacagaguugggugaaaccuuuggcgaggcgucccaaaaguauaaugugcuauucguuggguacugccugucacacgaucagagauggcucuuagccagcugcacggaccugcauggagaacuucuggagacuuguguggucaacaucgcacucccgaaucggucuaggcgcuccaaagugagugcucguaagauaggcuugcagaaacugugggaguggugcaucgguauuguacagaugaccagccucccuuggagagucgugaucgggcggcugggaaggcuuggccacggcgaacuaaaggacuggucgauucuguugggggaguguuccuuacaaacaaucucuaaaaagcugaaggauguuugccgcauguguggaauaucagccgcagacagccccaguauucucuccgccugccugguggcuauggaaccacaggguucuuuugucgugaugccugaugccguuaccaugggcagcguguucgggcgaucaacugcgcuuaacaugcaguccagucaacugaauacaccccaggacgcaagcuguacccauauccucgucuuuccaacaucuucaacuauccagguggccccugcuaacuaucccaaugaggauggauucuccccgaacaaugacgauauguuuguagacuugccauucccugaugacauggauaacgacauuggcauacugaugaccgguaaucuacacagcucucccaacaguucgccagugcccuccccugggagcccgucaggaaucggcguuggcucucauuuucagcacagcagaucccaaggggaacggcugcucaguagggaggccccagaggaacuuaaacagcagccccuggcuuuaggauacuucgucucaacggcaaaggccgagaacuugccucagugguuuuggucuagcugcccccaagcucagaaucaguguccacuguuccucaaagccucccugcaccaucacauuaguguggcacagacagacgaacuucugccugcgcgcaacagccaaagagugccccauccacucgauuccaagaccacuucugacgucuugagguucguacuggagcaguauaaugccuuaucauggcuaaccugcaacccugcuacacaggaucggacuagcugucugccggugcacuuuguugugcucacccaacuuuacaaugccaucaugaacauucuguga

SEQ ID NO: 58934 - RNA, 4365 nt, Artificial Sequence
  derived and/or modified sequence opt3 from MED14__Homo_sapiens__NP_004220
auggcccccgugcagcuggagaaccaccaacucgucccuccaggcgggggagguggcgggagcggaggcccgcccuccgcuccugcaccacccccuccaggugccgcgguugcugccgcagccgcugcagccgcuucucccggguacagacuuucaacccugaucgaguucuuguuacauagggccuauagugagcugauggugcuaacagaccuccugccucgcaagagcgauguagaacggaaaauugagauagugcaguuugcgucccgaacucgucagcuuuucgucagacuguuggcacucgugaagugggccaauaacgcuggaaaaguugaaaagugcgccaugaucucuucguuucuggaccagcaagcaauucuguucguggauacggcugacaggcucgccucauuagcgcgggaugcccugguccacgcacgccuuccauccuuugcuaucccguacgccauugacguguugaccacaggcaguuaucccagacugccuacuuguaucagggauaaaauaaucccacccgacccuauuaccaagaucgagaagcaggcuacacuacaucagcucaaucagauucugcggcaccgccuuguaaccacugaucugccaccccaauuggccaaccucacaguugcaaauggccgagugaaauucagagucgagggggaauuugaggccacccugacggugaugggagacgauccggacgugccuuggagguuacugaagcucgaaauccuugucgaggauaaagagacuggugacggccgggcucugguucauuccaugcagauaucuuucauucaccaguuggugcagagccgucuauuugcggacgaaaagccccugcaagauauguacaacugccuccacuccuucugucugucacuucagcuggagguauugcauagucagacccucaugcugauccgcgaaagauggggagacuuagugcaagucgagagguaucacgcagggaaaugccugagccuaucuguguggaaucagcagguucucggccggaagacagguacugccuccgugcauaaggucaccauuaaaaucgaugaaaacgacgugucaaagccacugcagaucuuucacgauccuccccuuccagcuagcgacaguaaauugguagagcgagccaugaagauugaucaccugucuauagagaaacuccugaucgacuccguucaugcacgcgcccaccaaaagcugcaggaacugaaagcuauuuugagaggguucaaugccaacgagaauagcucgaucgaaacagcacuccccgcgcugguggucccuauauuagagccauguggaaacucugaaugccugcauauuuuuguggaucuacacuccggcauguuccagcucaugcuguacggccuugaccaggcuaccuuggaugacauggagaagucagucaaugacgauaugaagaggaucaucccguggauucaacagcugaaauucuggcucgggcagcagcgguguaagcaaaguaucaaacaucugcccacgauuagcuccgagacuuuacagcugucuaacuauagcacacacccuauaggaaaucuuucaaagaacaaauuguuuaucaagcucacccgccugccacaguacuacauugugguugaaaugcuagaggugcccaacaagccuacucagcugaguuauaaauacuauuucauguccguaaaugccgcagacagagaagauagcccagccauggcucuccugcuucaacaguuuaaggagaacauccaggacuuggucuucaggacaaaaaccgguaagcaaacgcguaccaaugccaaacggaagcugucugaugaccccugcccgguggaaucaaagaaaacaaagcgagcaggcgagaugugugcuuuuaacaaaguuuuagcccacuucguggcgaugugcgauacuaauaugccuuuugucgggcucagacuggagcuuaguaaccuggaaaucccacaucagggagugcagguagagggcgacgguuucagccacgccauuagguugcucaagauacccccuuguaaagggaucaccgaagagacacagaaggcucuggaucgcucccuacuggacugcacuuuucggcuccaaggcagaaauaacaggaccuggguggcagagcugguuuucgccaauugcccccuuaacggaacaucuacccgcgaacagggcccaucgcgacaugucuacuugacuuaugagaaucuguuaagcgaaccugucgggggacggaaggugguggagauguuucucaacgauuggaauagcauugcucgucuguacgaauguguucuugaguucgccagaucacugcccgacaucccagcacaccuaaacauuuuuagugaggugaggguguauaauuaccgcaaacucauccugugcuacgguacgacaaagggcucuagcauauccauccaguggaacucaauucaccagaaauuccauaucagcuuggggaccguaggaccgaacucuggcuguuccaauugccacaacacuauucugcaucaauuacaggaaauguucaauaagaccccuaacgucgugcagcuccugcagguucuuuuugauacacaagcgccccugaaugccaucaacaaauugccaaccgugcccaugcucggucugacucagcggacaaauacggcuuaucaguguuucaguauacuaccucaaagcucuacccacauuagacuggccuuuaggaacauguacugcaucgacauuuauugucgaucccgcggggucguggcaauccgggacggcgcuuacucacuuuucgauaauaguaagcucguugagggauuuuauccagcccccggccugaaaacuuucuugaacauguuuguggacagcaaucaggaugcaagaaggcguucgguaaacgaagacgauaauccuccguccccaauagggggagacaugauggauucucugaucagccaguuacagcccccuccacaacagcagcccuucccuaagcagccggguacaucaggcgccuacccccucaccaguccaccuacauccuaucauucuacugucaaccaaagccccuccaugaugcacacccagucaccagggaaucugcacgcugcgagcaguccuucuggagcccuucgcgcacccuccccagcuagcuuugugccgacgccucccccaucgucacauggcauuucuaucggucccggggccaguuucgccuccccucacggcacccuggacccaagcucucccuacacaauggugagcccuuccggacgggcuggcaacuggccggggucaccacaggucaguggacccagcccugcagccagaaugcccggcaugucuccagcgaacccuuccuugcauucacccguuccagaugcuagucacagcccuagggccgguacuuccucucagaccaugccgacaaauaugcccccaccucgaaagcucccccaacggucgugggcagccagcauuccaacuauccugacccauucagcucuaaacauacugcuucucccuucccccacgccggggcuggugccaggauuggcaggcaguuacuuaugcucuccucuggagcgcuuucucgguagcguaauuaugagaaggcaucugcagcggaucauccagcaggaaacacuucaacugauuaauuccaacgagcccggcgugaucauguucaaaaccgacgccuugaagugucgagucgcgcuaucaccaaaaacuaaucagacacugcagcucaaggugacccccgagaacgcugggcaauggaaaccugaugaacugcagguucuugagaaguuuuucgaaacuagaguggccggaccgcccuucaaggcaaauaccuuaauugccuuuacaaaacugcucggcgcuccaacgcacauauugcgcgacugcguccacaucaugaagcuggaacucuucccugaucaggccacccagcugaaauggaacgugcaauuuugucuuacuauucccccuucugcaccacccaucgcuccuccagggacacccgccguugugcuuaagagcaaaauguuguucuuucuacagcugacccagaagacaagugucccgccucaggaaccaguauccauuaucgugcccauaaucuaugacauggcgagcggaacuacccaacaggccgacauuccuaggcagcaaaauucuucaguugcagcuccaaugaugguguccaacauccucaagcguuucgccgagaugaaucccccgcggcagggcgagugcacgauuuuugcugcagucagagauuuaauggccaaccugacacuuccucccggugggaggccauga

SEQ ID NO: 58935 - RNA, 2367 nt, Artificial Sequence
  derived and/or modified sequence opt3 from MED15__Homo_sapiens__NP_001003891
auggacgugagcggccaggagaccgauuggagauccacagccuucaggcaaaagcuggucucucagaucgaagacgcuaugcggaaagcagggguugcccacucaaagaguagcaaagauauggagucccauguguuucucaaggcgaaaacucgcgacgaauaccuuucucugguagcucgauugauuauacacuuccgugauauccauaacaagaagucgcaggccucagugagcgaccccaugaaugcauuacagagucugacgggagguccugccgcuggcgcagccgggauuggaaugccaccgagaggccccggucaaucccuagggggaaugggcucucucggcgcuauggggcagccuaugagccuguccggacagccacccccugguaccucaggcauggccccacacaguauggcggucgugagcacagcaacuccccagacccaacuucagcugcagcagguugccuugcaacagcagcaacagcagcagcaauuucagcagcagcaacaggcugcccuccagcagcaacagcagcagcaacagcagcaacaguuccaggcacagcaaucugcuaugcagcagcaguuucaagccgugguccagcagcagcaacagcugcagcaacagcagcagcaacagcagcaucugaucaaacuccaccaccagaaccaacagcagauucagcaacagcagcagcaauuacagaggaucgcgcagcugcaacuucagcagcagcaacagcagcagcaacagcagcagcaacagcagcaacaggccuugcaggcacagccuccaauacaacagccgcccaugcagcagccucaaccacccccuucccaggcucugccacagcagcuacaacagaugcaucacacacagcaucaccagcccccgccucaaccccagcagccaccuguggcccaaaaucagcccucacagcucccaccccagagccaaacccagccucugguaagucaggcucaggcccuuccagggcaaaugcuguauacucagccgcccuugaaguucguucgggcaccuauggugguccagcagccacccgugcaaccucaggugcagcaacagcagacagccguccagaccgcucaagcggcacagaugguugccccaggagugcagaugaucacggaggcucucgcccagggcgguaugcacauucgcgcaagauuucccccgacuaccgccguaucugcuaucccuuccagcucgauuccacuggggaggcaacccauggcccaggugucucaguccucauuaccuaugcugaguagccccuccccaggacagcaaguccagacaccucagucuaugcccccaccgccucaacccagcccacagcccggccagccuucaagucagccaaacuccaaugugagcucuggccccgcaccuucaccgaguagcuuccucccaucccccucuccucaaccaucgcagagccccguuacugcgcggaccccucagaacuuuuccgugccgucacccgggccacuuaauacaccugucaaccccaguucugugaugagcccagcuggauccucacaggccgaggaacaacaguaccuggauaaauugaagcagcuaagcaaauauaucgagccucugcgccgaaugauaaauaagauugacaagaacgaagauaggaaaaaggaccucucuaaaaugaagucccugcuugauauccugaccgaccccaguaaaagaugcccauugaagacgcuccagaaaugugagauugcacuggaaaaguuaaagaaugauauggccguaccgacuccucccccacccccuguuccacccacaaaacaacaguaccugugccagccucuacucgacgcugugcuggccaacauccggagcccggucuucaaucauucucuuuaucguaccuuugugccagcaaugacugcuauccacggucccccuauuacagcccccgucguguguacccgcaagagaagguuggaggacgaugagcggcaguccauaccaucaguucugcaaggcgaaguggcgcgacucgacccuaaauuccugguaaaccuugaucccagucauugcagcaauaacgggacgguccaccugaucuguaaguuggacgauaaagaccucccaucggugccuccgcuggaguuauccguucccgccgauuacccagcucagucuccucuguggauugaccgccaguggcaauaugaugcaaaccccuuucuacagagcgugcauagaugcaugaccucaaggcuccugcagcuuccagacaagcacagugucacagccuugcugaauacuugggcucaguccgugcaccaagccugucucucugcagcguga

SEQ ID NO: 58936 - RNA, 2634 nt, Artificial Sequence
  derived and/or modified sequence opt3 from MED16__Homo_sapiens__NP_005472
augugcgaccugagaaggcccgccgcuggcgggaugauggaucucgcauacgugugugagugggaaaaguggagcaaauccacccacugcccuucugucccacuugccugugcguggucaugccggaaccugaucgcuuucacaauggacuugcgcagugaugaccaggauuuaacucgaaugauucauauacuggacacggagcacccgugggaucuacauagcauccccuccgaacaccaugaggccauuaccugucucgaaugggaccaaucuggaucgcgucugcuuucagcagaugccgacggucagaucaagugcuggagcauggcugaucaccuggcaaauaguugggaguccucuguuggcagcuugguggagggggacccuauuguagcccucuccuggcugcacaacggagugaaacuggcucuccaugucgaaaagucaggcgccaguagcuuuggugagaaauucucuagagugaaguuuuccccaucauuaacacuguucgggggaaagcccauggaaggcuggaucgcgguuacugugagcggccuugucaccgugaguuugcugaaaccuucugggcagguacuaacauccaccgagagccucuguaggcugcggggacgcguugcacuugccgauauagcuuuuacugguggcgggaauaucguggucgccacagcagacggaucgucugcuuccccagugcaguucuauaaggugugcgucucaguugugagugagaaauguagaauugacaccgaaauccugcccagcuuguuuaugaggugcacgacugaucucaaccggaaggacaaauucccugccauuacccaccugaaguuuuuagcgcgcgauauguccgagcaaguacugcucugugccucuagccagacaucaaguaucguggaaugcuggucccuucgaaaggagggccugccagucaauaacauauuccagcagauuagcccggugguuggugacaaacaacccacuaucuugaaguggagaauuuugucugcaaccaaugaucuggacagggugucagcugucgcccucccuaaacugccaaucagucuuacaaacaccgaucugaagguggcuagcgacacgcaguuuuaccccggguugggacucgcccuggcauuccaugauggcuccguacacaucguucaccgguuaucucugcagacuauggccguguuuuauucgagcgcugcgccucguccagucgacgaacccgcaaugaaacgcccgagaacagccggcccugcugugcaucuaaaggccaugcagcucuccuggaccucacuggcacuugucgggauugauagucacggaaaauugucugugcugaggcucagccccuccaugggucauccacuggagguuggccuugcccugcggcaccuacucuuccuguuagaguacugcauggugacuggguaugacuggugggacauacugcuacauguacaaccuucaaugguccagagccucguggaaaagcugcacgaggaauacacacgacagaccgcugcccuucaacagguuuugucuacgcgcauccuggcaaugaaggcgucccucuguaaacugagucccugcaccgugacaagagucugugauuaucacacuaaguuauuccugauugcuaucagcucuacccuuaaauccuugcucaggccacauuuucugaauacacccgacaagucaccuggagaucggcuaacugagauaugcaccaaaauuacagacguggauaucgacaagguaaugaucaaccugaagaccgaagaguucgugcucgauaugaauacucugcaggcccuucagcaauugcugcaguggguuggcgacuuugucuuauaccuccuggcaagucuuccaaaccaggguagccuguugcgcccggggcacucguuccucagagauggcacgucccugggaaugcuaagggagcugaugguggugauucguaucuggggccuccugaaacccucuugucuuccugucuacacagccaccagcgacacucaggauucaaugaguuugcuguuucgguuacucaccaagcuguggauuugcugucgagacgaagggccagcuuccgagcccgaugaagcccuuguugacgagugcugucugcuaccuucucaacuccugauacccagcuuggacuggcugccagcauccgauggauuagugucaagacuccagccgaaacagccucugaggcuucaguucggucgcgcuccaacacugcccggcagcgccgcgaccuugcaacucgacgggcuggcccgggcuccuggacagcccaagaucgaucaucuaagaaggcugcaccuuggcgcaugcccaacugaagaguguaaagccugcacacgcugcgguugugugacgaugcucaagaguccuaaucgaaccacugcuguaaagcagugggagcagcgguggauuaaaaacugccuggccgucgaagggcguggccccgacgcaugugugacaucuagagcguccgaggaagccccagcuuuuguucaauugggaccgcagagcacccaccauucgccuaggacaccccgcucacuggaucacuuacauccagaggaccggcccuga

SEQ ID NO: 58937 - RNA, 1956 nt, Artificial Sequence
  derived and/or modified sequence opt3 from MED17__Homo_sapiens__NP_004259
augagcggcgugagagccgucaggaucuccauugagucugcuugcgaaaagcagguucacgagguggggcuggacggaaccgaaacauaccuucccccucucucaaugagucaaaaccuggcacgguuggcccagcgcauagauuucagccaggguuccggcucugaggaagaggaggcggcugggacugaaggagacgcccaggaguggccaggcgcagguucgucagccgaucaagacgaugaagaggggguagugaaauuucagccgagcuuauggcccugggacaguguccgaaauaaccugcguuccgcucuaacggagaugugugugcucuaugauguucugucuaucgugagagacaagaaauucaugacccuugauccugucagccaggacgcacugccacccaagcagaauccucaaacauugcagcucauuuccaaaaagaagucacuggccggagcugcccagauccugcucaaaggcgcggaaagguuaacuaagagugugaccgagaaccaggaaaauaaacugcaacgggauuuuaacagcgagcuuuugcgccugagacagcauuggaagcuaaggaaaguaggcgacaagauucucggggaucugucuuaccgguccgcaggaucacuuuucccacaccaugguacauuugaaguuaucaagaauaccgaccuggacuuggauaaaaagauacccgaggacuauugcccucucgaugugcagaucccaagcgaccuggagggcagugccuacauuaaagucucuauccaaaagcaggcuccggauauuggggacuuaggaacugugaaccuguucaaacgcccccucccuaaguccaaaccaggcagcccccacuggcagacaaaacuugaagccgcacagaaugugcuguuguguaaggagaucuuugcucaacuaucgcgagaagccguccagauaaaaucucagguuccucauauugugguaaagaaccagaucauuucccaaccauuccccucacugcagcucaguaucagccugugccacuccucuaaugauaaaaagagccagaaauuugcgaccgagaagcaguguccggaagaccaccuuuaugugcuggagcauaacuugcaccuccugaucagagaguuccauaagcaaacguuaucaaguauuaugaugccucaccccgccuccgcaccauuuggucacaaaaggaugcggcugagcgggccucaggcuuucgauaagaaugaaauaaacucucuacagucaagugagggacuccuggaaaagaucauuaagcaggccaaacauaucuuucuucguagccgcgcugccgcaacuauagacuccuuggccucuagaauugaggauccccaaauccaggcucacuggucgaauaucaacgacgucuacgaaagcuccgugaagguucugauuaccucacagggcuaugagcaaaucugcaagaguauucagcuccagcugaacauaggcguggagcagaucagggucgugcaucgggacgggcgaguaauuacacuuucuuaccaagaacaggagcugcaggauuucuugcucagccagaugucccaacaccagguucaugcggugcagcagcuggcaaaagucaugggauggcaaguguuaucauucagcaaucacgucggucugggcccaaucgaaucuaucgggaacgccuccgcuauuacuguggccagucccagcggagacuacgcaauaucuguucgcaauggcccugaguccgguucaaagaucauggugcaguuuccaagaaaccaguguaaagaucuaccgaagagugacguacuccaagauaauaaauggagccaccugagggggcccuucaaggagguccaguggaacaagauggaaggccggaauuuuguguauaaaauggagcuuuugaugucggcccuguccccuugccuccuguga

SEQ ID NO: 58938 - RNA, 636 nt, Artificial Sequence
  derived and/or modified sequence opt3 from MED19__Homo_sapiens__NP_703151
augaagaucaccaacggcagacacggggacagcgccggagcugaggguacaauggaaaauuucacugcacuguuuggcgcccaggcggaucccccuccaccgcccacggcucucggguucggaccuggcaaaccacccccuccacccccuccaccggccggugggggacccggcaccgcaccuccacccacagccgcuacugcaccuccaggcgccgacaaguccggggcuggaugcggucccuuuuaccuuaugagggagcugccgggcucuaccgaauugacagggucaaccaacuuaauuacucauuauaaucuggagcaagccuacaacaaauucuguggaaagaaagugaaggaaaagcuaaguaauuuucucccugaucugcccggcaugauagaccuuccagguagccacgauaacuccucucugcggucguugaucgagaaaccucccauucucucaagcaguuucaauccaaucacagggaccaugcuggcgggauuucgccugcauacgggcccccucccugagcagugccgauuaaugcacauucagccaccgaagaaaaagaacaaacauaagcacaagcagucccguacucaagaccccgucccuccaggcaaacccucuuga

SEQ ID NO: 58939 - RNA, 4746 nt, Artificial Sequence
  derived and/or modified sequence opt3 from MED1__Homo_sapiens__NP_004765
augaaggcccagggcgagaccgaagagagcgaaaaacuguccaagaugucuucacuccuugagagacugcacgcuaaauucaaccaaaauaggcccuggagugaaacaaucaaguuggugcggcaggucauggagaaacgcguugugaugagcuccgggggacaucagcacuuaguaucuugccuggagacucuacagaaggcacucaaggugacgucgcugccugccaugaccgaccgacuugaaucaauugcgcgucaaaacggucugggcagccauuugagugcuuccgggacagaguguuacauaacuucugauauguuuuaugucgaagugcagcucgacccagccggacagcugugcgauguuaaaguggcacaccauggcgagaauccggucagcugucccgagcuggugcagcaacucagagaaaagaacuucgacgaguuuuccaaacacuuaaagggucugguaaaucuuuacaacuugccuggggauaauaaacugaagaccaagauguaucuagcccuccagucacuggaacaggaccuuaguaaaauggcuaucauguacuggaaggcaacaaacgccggaccacuggauaaaauuuugcacggcagcguuggcuaucucacccccaggucugggggacaucugaugaauuuaaaguacuauguguccccuucagaccugcucgaugacaaaacugcuagcccaaucauucuucacgagaacaaugucagucggucucuggguaugaacgccuccgugacaaucgaaggcaccagcgcgguguacaaguugcccauagcaccucuaaucauggggucgcauccagucgauaauaaauggacgccgucuuucuccucaauuaccagugccaacagcguugaccugcccgcuugcuuuuuccucaaguuuccucagccaauccccgugucccgcgccuucguacaaaagcugcagaauuguaccggcauuccucuuuuugagacacagccaacuuacgcaccccuguaugaguugaucacccaauucgaacucucuaaagauccggacccuauaccccugaaccacaacaugagauuuuacgcugccuuaccaggacagcagcacugcuauuuccugaauaaggacgcgccucuacccgaugguaggagccuccaggggacacuggugucaaaaauuaccuuucaacauccaggacgggucccccuuaucuugaaccugauucgccaccagguggccuacaauacgcucaucggcaguuguguuaagcgaacuauccugaaagaggacuccccuggccuucugcaguucgaagugugcccauugagcgagucuagauucucagucaguuuucagcauccggugaacgauagccucguauguguugugauggacguccaagauuccacacacgugucuugcaagcuguauaagggguuaucggacgcacugauuuguaccgaugacuucauagcuaaagucgugcagaggugcaugagcauccccguuacuaugcgggccauucgucgcaaggcugaaacaauccaggccgauaccccugcacuaucccucauagccgagacgguggaggacauggucaaaaagaaucugccacccgcuucaaguccuggauacgguaugaccacaggcaacaauccaaugucugggacuaccacacccacuaacaccuuuccgggaggcccuauuacaacccuuuucaauaugagcauguccaucaaagauagacaugaaucaguaggucacggggaggacuuuagcaaggugucucagaacccaaucuugacuucccugcuccaaauuacgggcaauggaggcaguacaaucgggagcucucccaccccuccccaccauacuccaccucccguuuccucaauggcgggaaacaccaagaaucacccaaugcugaugaacuuacugaaagacaauccggcacaggauuucaguacacuuuaugguagcucgccuuuggaaaggcagaacuccucuagcggcucaccccggauggagauuugcaguggguccaacaagaccaaaaagaaaaagucuagccgacucccacccgaaaagccuaaacaucagacugaggacgauuuucaacgcgagcuguucuccauggacguggauucacagaauccaauauuugacgucaacaugacagccgauacgcuagacacuccccacaucacuccugcuccgagccaguguaguacaccacccaccacauacccucaaccagugccccacccucagccgucuauucagagaaugguaaggcuguccagcucggauucaaucggacccgacgugacugauauccucucugacauugccgaagaggcaaguaagcugccauccaccagcgaugacugcccugccauaggcacgccccuucgggacucuagcuccucaggucauagucagagcaccuuguucgauucugacguuuuucaaacaaauaacaaugaaaacccauacacugauccugcugaccugaucgccgaugcagcggggucccccucaagugacagcccaaccaaucacuucuuucaugauggcgucgacuucaacccggauuuacucaauucccagucucagucgggauucggcgaggaguauuuugacgaaagcucacaguccggggauaacgacgauuucaaaggauuugcuagucaagcccugaauacacuuggugugccuaugcugggcggggacaacggagagacuaaguucaaaggcaauaaccaggcagacaccguggauuuuucuauuaucagcgucgccgguaaggcuuuggcccccgcagaccucauggaacaccauuccgggucacagggcccacugcuaacgacaggagaucugggcaaagagaagacccagaagcgcguuaaagaagggaauggaacuucuaacagcacacucaguggccccggucuggacuccaagccugggaaaagaagcaggaccccaucuaacgauggaaagucaaaagacaagcccccuaagcguaaaaaggcugauacugagggcaaauccccgagucacagcucgucuaaucggccauucacacccccuaccuccacggguggcagcaagucacccgggagugccggacgaucucaaaccccaccuggcguggcgacucccccaauuccuaaaaucacaauacagaucccgaaggggaccgugaugguaggaaagcccuccagccacucacaguacacaaguagcggcuccgucucuagcuccgguucaaaaucucaucacagucauucgagcuccucuucaagcuccgccaguacuucugggaagaugaaaagcucaaaguccgagggaaguagcagcuccaaacuuucaagcucgauguauucuagucaaggcuccagcgguucaucccagucuaagaacagcagucaguccggcgggaagccaggaagcucuccuauuaccaaacacggcuugucaaguggguccagcucuacgaagaugaaaccccagggaaagccaucgucacugaugaauccuagcuuauccaaacccaacaucaguccgucucauagcagaccaccuggcgguuccgacaagcucgcuucacccaugaaaccagugcccgggacaccuccgaguucuaaggcaaagagccccauuuccucaggaagcggcgguucucacauguccggcaccaguagcucguccgggaugaaaucuucaagcggacugggcaguuccgggucucuuagccaaaagacuccaccuucauccaauaguuguaccgccucuucuucauccuuuagcucuaguggaucguccaugagcucaucucagaaccagcacggcagcuccaaagguaagagucccucaaggaauaaaaagccuucucugacagcuguuaucgauaagcuaaaacaugggguggucacuagcggaccaggcggcgaagacccccucgaugggcagaugggaguguccaccaacaguagcucccacccuaugucuucaaagcauaauaugagcgguggcgaguuccaagggaaacgcgaaaagucggacaaagacaaguccaagguuaguacaucuggaagcucaguggauuccucuaaaaagacgagugagagcaaaaacguaggcuccaccggugucgccaagauaauuaucucaaaacacgacgggggaagcccaucuauuaaggcaaaggugacucugcagaaacccggcgaaaguuccggcgagggguugcggccgcagauggcgagcucaaagaauuacggaucuccucugaucuccgguucgacaccaaaacacgagagaggcagccccagucauucuaaguccccugccuauaccccacagaacuuagauagcgaaucagagaguggguccagcauagcugaaaaaucuuaccaaaauucacccagcuccgacgauggaaucaggccgcucccugaguauucuacugaaaagcacaagaaacauaagaaagagaagaaaaaggugaaagacaaggaucgcgaccgagaucgggacaaggaucgugacaaaaagaaaagucacucgauuaagcccgagagcugguccaaaucaccaaucucuagcgaucagagucuguccaugacaucaaacaccauucuuucugccgacagaccuagcaggcugucccccgacuuuaugaucggcgaagaggaugacgauuugauggacgucgcacucauagguaauuga

SEQ ID NO: 58940 - RNA, 603 nt, Artificial Sequence
  derived and/or modified sequence opt3 from MED22__Homo_sapiens__NP_598395
auggcccagcaaagagcucugccccagagcaaggagacccuccuucaguccuacaacaaaaggcugaaggacgauaucaaaucuauuauggacaauuucacagaaauaaucaagacugcaaaaauugaggaugaaacccaggugucacgggccacgcaaggcgagcaggacaacuaugaaaugcacguccgcgcggcuaauaucguucgagccggggagaguuugaugaaguuagugagcgaucugaagcaguuucuaauucucaacgacuucccuuccguaaaugaggcaaucgaucagcguaaccaacagcugagaacacuucaggaagagugcgacaggaaacugauaacuuugcgggaugaaaucucuauugaccucuacgagcuggaggaagaguauuacucgucaagcaguucccugugugaagccaaugaucucccauuaugcgaggcuuauggacgccuggaccuugauaccgacucugcagacgguuugagcgccccgcugcuagcuucccccgaaccuucagccggcccacuccagguggcggcacccgcccauagucacgcugggggaccuggcccaacagagcaugccuga

SEQ ID NO: 58941 - RNA, 4095 nt, Artificial Sequence
  derived and/or modified sequence opt3 from MED23__Homo_sapiens__NP_001257451
auggagacccagcugcaaagcaucuucgaagagguggucaagacagaaguuauugaggaagccuuucccggcauguucauggacacuccugaggaugagaaaacgaagcucauauccugccuuggggcuuuuagacaguucuggggaggucugucucaggaaucacacgagcaguguauccaauggauugugaaauuuauccauggccagcacaguccaaagaggauuagcuucuuguacgacugcuuagcaauggccguagaaaccgggcugcuaccgccccggcucgugugugagucccugaucaacucugauacacuugagugggaacgcacucagcugugggcguugaccuuuaaacucguccgaaagauaaucggaggcguggacuauaaggguguucgugaucugcugaaagugauucucgagaagaucuuaacaauuccuaauaccgucucgucagcugugguacagcaacugcuugccgcaagagaaguuaucgccuacauauuggagaggaacgcuugccugcuaccagcauauuucgccgugacugaaauucggaaacucuaccccgaggggaagcugccucauuggcuucugggaaauuuggucagcgacuuuguggauacauuccgcccaaccgcuagaaucaacaguauuuguggccggugcucccuccugcccguggucaauaacucuggcgccaucuguaauagcuggaaauuagacccugcgacgcugcgguuuccacucaaggggcuucugccguaugauaaggacuuguucgagccccagacugcacuacugcgcuacguucucgaacagccuuauucccgagauauggugugcaacaugcugggacuuaauaaacagcacaagcaaagauguccaguacuggaggaccaguugguggaucucgucguguacgccauggaaaggucagagaccgaagagaaauuugacgacgguggcacaagucagcuguuauggcaacaucugagcucucagcuaaucuucuucguucucuuucaguucgcuuccuuuccccacauggugcugucacuucaccagaaguuggccgggcggggacugauuaaaggccgugaucaucucauguggguccugcuucaauucauaagcgguaguauccagaagaacgcacuggcugacuuuuugccugugaugaaacucuucgaucuguuauacccagagaaggaauauauucccguaccggacaucaauaagccucagucuacucacgccuuugcgaugaccugcauauggauucaucugaaccgcaaagcccagaaugauaacuccaagcuacaaauccccaucccacacagccucagacugcaccaugaguuccuucagcagucguugaggaauaaaucucugcagaugaacgacuacaagauugcacuccuguguaacgcuuauuccacaaauucagaaugcuuuaccuuaccuaugggggcccugguugagacgaucuacggaaacggcauuaugcggauaccccuuccaggcacuaauugcauggcuagugggagcaucacacccuugccuaugaaccuccuggauucccuaaccgugcacgccaaaaugucucugauucauagcaucgcaacucgagucaucaagcucgcccacgcuaagucaaguguggcgcuggcaccagcccuugucgaaacauauucccgcuugcugguguacauggagauugagagcuuaggaauaaaagguuucaucucucaacuccugccgaccguuuuuaagucacaugcuuggggcauucuucacacgcuguuggaaauguucaguuauagaaugcaccauauccagccccacuacagggugcagcuccugagccaucuacacacccuggccgcaguagcccagacaaaucaaaaccagcuccaccugugugucgaguccacugcucuuagguugauuaccgcccuggggucuucggaagugcagccucaauuuacacgcuucuuaagcgacccaaaaacuguucucuccgcagagucagaggaacugaauagagcgcuuauccugacccuagcuagggccacacaugugaccgauuucuuuacuggaagugacucuauacagggcacguggugcaaggauauccuccagacaauuaugagcuucacuccccacaacugggcaucccauacccugucauguuuuccugguccauugcaggccuucuuuaaacaaaauaacgucccccaggagagccguuucaaucugaagaagaacguggaagaggaauaccggaaauggaagucuauguccaaugagaacgacaucauuacccacuuuaguaugcaggggagcccgccuuuauuccucugccugcuuuggaaaaugcuguuggagacagaccauaucaaucagauaggcuaucgaguacucgaaagaauuggagcuagggcccugguggcacacguucgcaccuuugcugauuuccuagucuacgaguuuucuacuuccgccggcgggcaacagcugaacaaguguaucgaaauucuuaacgacaugguguggaaauauaauaucgugacacucgaucggcugauauugugccuggcgaugagaucacacgagggaaacgaagcccaggucuguuacuucaucauucaguuacuccugcuuaagccaaaugacuuuaggaaccgcguuagugauuucgugaaggagaauagccccgagcauuggcugcaaaacgacuggcacacgaaacauaugaauuaucacaagaaauacccugaaaaguuguauuucgagggucucgcugaacagguggaucccccaguacagauccaaucgccuuaccugcccauuuacuuuggcaacgucugccuacgauuccugccaguguuugacaucguuauacaucgguuccuugagcuccugccgguguccaaaucuuuggaaaccuuacuggaucaccucgggggacuguauaaguuucacgaccguccugucacuuaccuuuauaauacacugcauuacuaugagaugcacuugagagauagggcauuccuaaaacgcaagcuggugcaugccauuaucggcagccucaaggacaaccggccccaggguuggugucugucagauaccuaccuuaaaugcgcuaugaaugccagagaggaaaacccauggguucccgacgacacauauuacuguagguuaaucgggcgacugguggauacuauggcaggcaagaguccuggaccauuucccaauugcgacuggcgcuucaacgaguuuccuaauccggcggcccacgcucuccacguaaccugcgucgaauugauggcccuggcaguguccggcaaagagguggggaacgcucuccugaacgucguucuuaagucucagccacuggugccccgggagaauauuacggccuggaugaacgcaaucggauugauuauaaccgcccuaccugaaccauacuggaucguacugcaugauagaauugugagcgucaucuccucacccagccucacaagugagacugaauggguggguuauccuuucagguuauuugacuucaccgcuugucaccagucuuacuccgagaugagcugcucguauacacuggcgcuugcccaugcaguuuggcaccauucaucuauuggccaacugagucucaucccgaaauucuugacugaagugcugcuccccauagucaagaccgaguuucagcugcuuuacguguaucaccuaguugggccauuccugcagcguuuucagcaagagcgcacgcgguguaugaucgaaauuggaguggcuuucuacgauauguuguuaaaugucgaccagugcuccacacaccugaacuauauggauccuaucugugacuuucucuaccauaugaaguacauguucaccggcgauagcguaaaagaacagguggagaagauuaucugcaaucugaaacccgcccuuaagcugagacucagguuuauaacucacauuucuaaaauggagccagccgcuguuccuccccaggcaaugaacagcgguuccccagccccgcaaucaaaucagguggacacauugaccuga

SEQ ID NO: 58942 - RNA, 2931 nt, Artificial Sequence
  derived and/or modified sequence opt3 from MED24__Homo_sapiens__NP_001072986
augaagguggucaaccugaaacaggccauccuccaggcuuggaaggagagauggagcgacuaccagugggcaauuaauaugaaaaaguucuuucccaaaggcgccaccugggauauacuuaaccuggcggacgcuuuguuagaacaggccaugaucgggccuuccccaaauccgcugauucuaucuuaucucaaguacgcaaucucaagucaguucgaugacuuuagcagggaucugugcguucaagcccuucuggacauuauggauauguucugugaccgguuguccugccacggaaaggcugaggaauguaucggucucugccgcgcacugcugucugcccuccauugguuacugcgauguacagcugccucggcggagcgucuuagagaaggcuuggaggcagggacucccgccgcuggagagaaacagcuggccaugugccuacagaggcucgaaaagacgcugucaagcaccaaaaaccgggcacuucugcacauagcuaaguuggaggaagccaguuccuggacagcgaucgagcauucucuccugaaauuaggcgagauucuggccaaucucagcaacccucagcuucgcucccaagcagaacagugugguacucugaucagaucaauuccaaccauguugagugugcacgcugagcagaugcauaagacaggguuucccaccguacacgccgugauccuacuggaaggaacuaugaaucucacaggcgagacccagagccuggucgaacaacuuacgauggugaagaggaugcagcacauaccuacuccacuguucguuuuggagauuuggaaggcuugcuuugugggccucaucgagucucccgaagggaccgaggaacugaaguggacagccuucacuuucuuaaaaauuccucagguccuggugaagcuaaagaaguauucccauggagauaaagacuucaccgaggauguaaacugugcauuugaauuucuccugaaacuuacaccauugcuggacaaggccgaucaacggugcaauugugacugcaccaacuuucuccugcaggagugcgguaaacagggccuucugucagaggcuagcguuaauaacuugauggcgaagcgcaaagcagaccgagaacacgccccgcagcaaaagaguggggagaaugcuaacauccagcccaauauccagcucauucugagagccgaaccuacggugacuaacauauuaaaaacaauggaugcagaccauucuaaguccccagagggacugcuaggcguccucggucacaugcugagcgggaagucgcuugauuugcugcucgccgcugccgcagcgaccggaaaacugaagucuuucgcuaggaaauucaucaacuuaaaugaauuuacuacauacggcuccgaggagucaaccaagcccgccagugugcgggcacugcuuuucgacauuagcuuuuugaugcucugucacguggcccagacguauggcuccgaagucauccugucugagagccguaccggggcugaaguuccuuucuuugagacauggaugcaaacuugcaugccagaggaaggaaaaauacuaaaccccgaucauccguguuuccgcccugacucaaccaagguggagagucugguagcccuccugaauaacuccagcgaaaugaaacuugugcagaugaaauggcacgaggcaugcuugucuauuucagcugccauccuggaaaucuuaaaugcgugggagaacgguguccucgccuuugagaguauucagaagaucacagauaauauuaaaggcaagguguguagccuggcuguuugcgcaguggccuggcuugucgcucaugugagaaugcugggguuggacgaaagggagaaaucccuccagaugauacggcaacuggccggaccccuauucucugaaaacacucugcaguuuuacaaugagcgaguaguuaucaugaacucgauucucgaacgcaugugugcagaugugcugcagcagaccgcgacacaaaucaaguucccaagcaccggcgucgacacuaugccuuauuggaaucuuuugcccccaaagagacccaucaaagaggugcugacggauauuuuugccaaggucuuagagaaagguuggguggacuccaggucaauacacaucuucgacacacuccugcauaugggcgggguuuacugguuuugcaacaaucuuauuaaggaacugcuaaaagagacccggaaggaacacacucuccgcgcuguggagcuguuguacaguaucuucugucuggauaugcagcagguaaccuuaguccuccugggacacauucuuccuggccuguugacagacucuagcaaauggcauucccucauggauccaccggggaccgcccuggcaaagcuagcuguguggugcgcccugucaagcuauucuucccacaagggacaagcaaguacuagacagaaaaagaggcaucgugaagacaucgaggauuacauaagccuuuucccccucgacgauguucagccuucuaaacugaugcgguugcuguccucaaacgaggacgaugccaauaucuuaaguagcccaacagaccgaucgauguccucuagccucucagcuagucagcugcacacggugaacaugagagauccccuuaacaggguccuggcgaauuuguuucuccugauuuccucuauccuagguagccgcaccgccggcccucacacucaauucgugcagugguuuauggaagaguguguagacugccuggaacaagggggacggggcuccgugcuucaguucaugccauuuacaaccguuucagagcucgucaaggugagcgcaaugaguucucccaaagugguccuggcuauuacagauuuguccuuaccgcuggguagacaaguugccgccaaggcuaucgcagcccucuga

SEQ ID NO: 58943 - RNA, 2244 nt, Artificial Sequence
  derived and/or modified sequence opt3 from MED25__Homo_sapiens__NP_112235
auggugcccggcagcgaggggccugccagagcuggauccgucguugcagacgugguauucgugaucgaagguaccgccaaccugggcccauacuuugaggggcucaggaagcacuaucuucugccggcgauugaauacuucaauggagggcccccugcugagacagauuuugguggggacuauggaggcacucaguacucuuuggucguguucaacacgguugauugcgccccagaaucauaugugcaaugucaugcacccaccaguagcgccuacgaguuugucacaugguuagacggcauaaaauucaugggcggagguggcgaguccugcucucugaucgcugaagggcuaucgacugcacuccagcuguuugaugacuucaagaaaaugcgggagcagauuggacagacccaccgcgugugucuucugaucugcaauucaccuccauauuugcuccccgccguagaaagcacaaccuacaguggcuguacuacagagaaccugguucaacagauuggugagcgagggauccauuuuuccauagugucuccucguaagcugccagcucucagauuacuguucgaaaaagccgcgccgcccgcacuuuuggagccucugcagccacccaccgaugucagccaggacccuaggcacauggugcuagugcggggacucguccugccaguuggcggcggguccgcccccggaccgcuucaaucaaagcagccugugccccugcccccugcugcccccaguggugcaacguugagcgcugccccacagcagccccucccuccaguaccgccccaauaccaggugccuggcaaucugucugcggcccaggucgcagcucaaaacgccguggaagcugccaagaaucagaaagcaggguuaggaccacgcuuuucccccaucacuccucugcagcaggccgcuccaggcguuggucccccguucucacaagcgccugcaccacagcuucccccugggcccccaggcgccccuaagcccccaccggcuagccagccuagucuugugucuaccgucgcccccggauccggccuggcaccaacagcccagcccggggcuccuagcauggccggaacuguggcaccagguggcguaucggggcccucuccugcgcaauugggagcuccggcccuaggcggucagcaguccguuucaaacaaacugcucgcauggaguggggugcuggaguggcaggaaaagccaaaacccgccagcgucgaugcuaauaccaagcucacaagaucccugccuugccaaguguaugucaaccauggcgagaauuugaagaccgagcaguggccacagaaacucauuaugcagcugaucccccaacaguuacugacgacucuaggaccucucuuuaggaacucucggauggugcaguuccacuucacaaauaaggaccuggaaagccuuaaaggcuuguaccgcauuauggggaacggauuugccgguuguguucacuucccgcauaccgcacccugcgaggugcgaguacugaugcuccuguauucaaguaagaaaaagaucuuuaugggccuuauaccauacgaucaauccggguucgucaauggaauuagacaggugaucacuaaccacaaacagguucagcaacagaagcuggaacagcagcaaaggggcaugggugggcagcaggcuccucccggcuugggaccaauucucgaggaccaggcccggccuagccaaaaccuguuacagcugcgucccccacagccgcaaccucagggcacagugggggcgucuggagccaccggccagccccagccacaagguacggcucagcccccuccaggggcaccccagggaccuccgggcgccgcuucagguccacccccucccggcccaauccuacgcccucagaaucccggggccaacccacaacucagaagucugcuuuugaauccuccgcccccacagaccggagucccucccccacaggcaagccugcaucaccuccagccucccggcgcgccggcccuguuaccaccuccccaccaagggcugggacagccacagcuuggcccaccuuugcuccauccgcccccagcucaguccuggccugcccaacugcccccuagggcaccacuacccggucagaugcugcucucugggggaccucggggcccagugccccagccgggucugcaaccuucgguaauggaagaugacauccuuauggacuugauuuga

SEQ ID NO: 58944 - RNA, 537 nt, Artificial Sequence
  derived and/or modified sequence opt3 from MED28__Homo_sapiens__NP_079481
auggccgcuccccugggcgggauguucagcggacagccuccagguccgccccaagcaccuccaggccuccccgggcaggccucccuucugcaggcggcuccuggagccccaagacccucuucaaguaccuugguggacgaguuagaaagcuccuuugaggcaugcuucgccucucuggucucgcaggauuacguuaacggcacagaccaagaagagaucaggacugguguggaucaguguauucagaaguuucuagacauagcucggcagacggaaugcuucuuucuccaaaaacgccugcagcuuucaguacagaagccugaacaggugaucaaagaggaugucagcgagcugcgaaaugaguugcaacguaaggacgcacucgugcagaaacaccugaccaagcugagacauuggcagcaaguucucgaagauauuaacgugcagcacaagaaaccagccgacaucccgcaggggaguuuagcuuaucuggagcaggccuccgcgaauauucccgcaccucuuaagccaacauga

SEQ ID NO: 58945 - RNA, 666 nt, Artificial Sequence
  derived and/or modified sequence opt3 from MED29__Homo_sapiens__NP_060062
augcucaagagcaacggcgagagaaggucccggaaugcccugcccgcuguguacgcacgcaaaauggccgcgucucagcaacaggcuucagccgcaaguagcgccgcuggggucuccggaccuucuucggccgguggcccagggccgcagcagcaaccccagccuccagcacagcuuguuggacccgcucagucaggccuguugcaacagcagcagcaagacuucgauccugugcagcgauauaagauguuaaucccacagcugaaagaaagccuacaaacccucaugaagguagccgcgcagaaccugauucagaauacaaacauagacaauggucagaaaaguuccgaugggcccauccaacguuuugacaagugccuugaggaguucuacgcacugugugaucaguuggaacucugccugagacuggcccacgaaugucucucucagagcugcgacuccgcuaagcauucaccuacuuuagugccaacggccaccaaaccggaugcaguccagcccgacagucugccuuauccacaauaccuugcugugauuaaggcccagaucagcugugcgaaagauauucacacagccuugcuggacugcgcaaacaagguuacuggaaaaacccccgcuccuccagccggccccggcgggacacuauga

SEQ ID NO: 58946 - RNA, 537 nt, Artificial Sequence
  derived and/or modified sequence opt3 from MED30__Homo_sapiens__NP_542382
augagcacacccccucuggccgcuuccggcauggcaccagggccguucgccggaccccaggcgcaacaggcugccagagaggugaacaccgcaucucucugcaggaucggucaggaaacuguccaggacauuguuuaccggacgauggagauauuucaacuucugcgcaauaugcaguugccuaacggcgugaccuaucacacagggacuuaccaggaucgauuaaccaagcugcaggacaaucuacgucaacucucaguacuguucagaaaacuuaggcugguguaugauaaguguaacgaaaauugcggaggcauggacccaauccccgucgagcaguugauuccuuacguggaagaggaugguaguaaaaacgacgaucgggccgggccaccccgcuuugcuagcgaggaaagaagggagaucgcagaaguuaauaagaaacucaagcagaagaaccagcaacugaaacagauuauggaccagcugcggaaucucaucugggauauaaacgccauguuagcuaugcgcaauuga

SEQ ID NO: 58947 - RNA, 675 nt, Artificial Sequence
  derived and/or modified sequence opt3 from MED4__Homo_sapiens__NP_001257558
augcuggccaucagcagaaaccagaagcuccuucaagcuggcgaggaaaaucaggugcuggaguuguuaauucacagggacggggaguuccaggaacugaugaaacuagcacucaaccagggaaagauacaucacgaaaugcaaguccuggagaaagagguugaaaagcgggauuccgacauccagcagcuucagaaacaacugaaggaggccgaacagauuuuggcgaccgcuguguaccaggccaaggagaaacucaagucuaucgagaaagcacgcaagggugccauuucaagugaagagaucauaaaauaugcucaucgaaucagcgcauccaaugccguaugcgcuccccugacaugggugccuggcgauccacguagaccguaccccacugaccuggaaaugaggucugggcucuuaggacagaugaacaauccuucgacgaacggcgucaauggucaucugccaggggaugcccuugcggcaggacgguugcccgacgugcuggccccucaauauccauggcagucaaacgauaugagcaugaauaugcuacccccuaaccacaguuccgacuuucuccuggagccaccgggccacaauaaggaaaacgaggaugacguugagauuaugucuaccgauagcuccucaaguagcucugaauccgacuga

SEQ ID NO: 58948 - RNA, 762 nt, Artificial Sequence
  derived and/or modified sequence opt3 from MED6__Homo_sapiens__NP_001271138
auggccgcuguggacaucagagauaaccugcucggcauuagcugggucgacuccucuuggauacccauccuuaauucagggaguguucuggauuacuucagcgagagguccaacccuuuuuaugaccggaccugcaauaacgaagugguaaagaugcagcgcuugacauuagagcaccugaaucaaauggugggaauugaauacauccuacuccaugcacaggagccaauucuguucaucauacgaaaacagcagcgucaaucuccggcccaggucaucccccuugcggauuauuacauuaucgcuggugugauuuaucaggccccugaccugggcucgguuaucaacucaagagugagcuuguuuaguuucuacaagcucacugcaguccacgggauacaguccgccuuugaugaagcuaugucuuauuguagguaccauccaagcaaaggauacugguggcacuucaaggaccaugaggagcaagauaaagugcggcccaaggcaaagcgcaaagaggaaccuuccucaauuuuucagagacagaggguagacgcccugcugcucgauuuacggcagaaguucccacccaaauuuguucaacugaagccuggcgaaaaaccagugccggucgaccagacgaagaaggaggcugagcccaucccugaaaccgugaaaccagaggaaaaggagacaacuaaaaaugugcagcaaaccgucagugccaagggucccccugaaaaacgcaugcgacuucaguga

SEQ ID NO: 58949 - RNA, 441 nt, Artificial Sequence
  derived and/or modified sequence opt3 from MED9__Homo_sapiens__NP_060489
auggccagcgcuggcguggcagccgggagacaggcggaggacguccugcccccuaccuccgaucaaccacucccggacacaaagccccuuccuccaccccagccuccacccguuccugcuccacagccgcagcaaucucccgccccuaggccacagucacccgcacgggcccgcgaagaggaaaacuacaguuuccugccuuuggugcacaauaucauuaaaugcauggauaaggacagcccagagguacaucaggauuuaaacgcucugaaauccaaguuucaggaaaugcgaaaacuaauaucuacuaugcccggaauccaccucucgccggagcaacagcagcagcaacugcagucacuucgugaacaggugagaacgaagaaugagcuguugcaaaaguauaaaagccucuguauguucgagauuccuaaggaauga

SEQ ID NO: 58950 - RNA, 1500 nt, Artificial Sequence
  derived and/or modified sequence opt3 from MEF2A__Homo_sapiens__NP_005578
augggcagaaagaaaauccagauuaccaggauaauggacgagcggaaccgccaagugacauucacuaagcgaaaauuugggcugaugaagaaagccuacgaacucagcguccuuugcgauugugagaucgcucugauuaucuucaauuccucuaacaaguuguuucaguaugcaucaacggacauggauaagguuuuacugaaauacaccgaauauaaugagccccacgaaagucguacaaacagcgacauuguggaggcccuaaauaagaaagagcauagaggaugcgauuccccugacccagauacuucuuacguacucaccccgcacacagaagagaaguauaaaaagaucaacgaagaguucgacaauaugaugaggaaccauaagauagcgcccggucugccuccacagaauuuuucgaugucagugaccguccccgugacuagcccuaacgcucuuaguuacacaaauccaggcuccucucugguuagccccuccuuggccgcaucaaguacccucacggauagcucuaugcuguccccuccacagacuacccugcaccggaacgugucaccgggggcuccccaacgcccuccaagcacaggaaaugccggcgguaugcucaguacuaccgacuuaacaguccccaacggggcaggaucuuccccugugggcaauggcuucguaaacagcagagccucgccaaaccugaucggggcuaccggagccaauucucuugguaaaguuaugcccacgaaguccccgccucccccaggcgggggaaacuugggcaugaauagcaggaaaccugaucugcggguggucauucccccaaguagcaaggguaugaugcccccucuaaacacucagcgcaucuccucuagccaggcgacacagccacucgcaaccccgguggugucagucacuacacccagucugccuccacaagggcuuguuuauuccgccaugcccaccgcuuacaauacggacuacagccugaccucugccgauuugucagcacuccagggauuuaacaguccuggcaugcugagcuuaggccagguguccgcuuggcagcaacaucaccuggggcaggccgcgcucucuucgcuuguagccggaggucagcugagccaaggcuccaauuugucaauuaacacaaaucagaacaucaguauaaaaucugagccaauuucacccccgcgagacagaaugacuccuuccggguuccagcagcaacagcagcagcaacagcagcagcaaccacccccucccccacagccucagccccagccaccgcaaccucagcccaggcaggaaaugggacggucaccaguggacagccuaucuuccaguucuagcuccuaugauggcucagaccgugaggauccccgcggugacuuucacaguccuaucguccuggggagaccacccaauaccgaagauagggagagcccuucggugaagcggaugcgaauggacgcauggguuacauga

SEQ ID NO: 58951 - RNA, 1107 nt, Artificial Sequence
  derived and/or modified sequence opt3 from MEF2B__Homo_sapiens__NP_001139257
augggcagaaagaaaauccagauuagcaggauacuggaccaacggaaccgccaggugaccuucacaaagcgaaaauuugggcucaugaagaaagccuacgagcuuuccguccugugcgauugugaaaucgcuuugauuaucuucaauucugcaaaccguuuauuucaguaugccucaacugacauggauagaguucugcuaaaguacacggaguauagugaaccccacgagagcaggaccaauacagacauucucgaaacucugaagcggcgcggaaucggucuugauggcccugagcuggagccagacgaagggccggaggaacccggagagaaauucagaagguuggcgggcgaggguggggauccugcucucccacggccccgccuguacccugccgcaccagccaugcccuccccugacgugguauauggagcucugccaccgcccggcugcgauccuucuggccucggggaagcauuaccagcccagucgcgacccucaccuuuuagaccagcugcccccaaggcgggaccgccuggucuggugcauccccuuuucagcccaagucacuugaccuccaaaacaccucccccacuguaccuacccaccgagggcaggcggucugaccucccugggggacuggcaggcccacguggugggcuuaacacuagccgcucccuguauucaggauugcaaaauccguguaguacagccacccccggcccuccacucggcagcuuucccuuccugccugggggaccacccgaauacgguuuaggcgauccgccuccacccccugggcugcuccagcccccaacgcuugcuccuuggcagcccucuagaggagacggcccaccggccgucuccucacagccuagcggugggaggagucugggcgaggaaggacccccaacucggggcgcaucucccccuaccccacccguguccauaaagagcgagcgauugucgccugcuccagggggaccgggugauuuucccaaaacauucccuuacccacuacugcucgcccgcucucuggcggagccccuuagaccuggcccggcccugaggcgguugccccucgcagacggguggccacgcuga

SEQ ID NO: 58952 - RNA, 1098 nt, Artificial Sequence
  derived and/or modified sequence opt3 from MEF2BNB-MEF2B__Homo_sapiens__NP_005910
augggcagaaagaaaauccagauuagcaggauacuggaccaacggaaccgccaggugaccuucacaaagcgaaaauuugggcucaugaagaaagccuacgagcuuuccguccugugcgauugugaaaucgcuuugauuaucuucaauucugcaaaccguuuauuucaguaugccucaacugacauggauagaguucugcuaaaguacacggaguauagugaaccccacgagagcaggaccaauacagacauucucgaaacucugaagcggcgcggaaucggucuugauggcccugagcuggagccagacgaagggccggaggaacccggagagaaauucagaagguuggcgggcgaggguggggauccugcucucccacggccccgccuguacccugccgcaccagccaugcccuccccugacgugguauauggagcucugccaccgcccggcugcgauccuucuggccucggggaagcauuaccagcccagucgcgacccucaccuuuuagaccagcugcccccaaggcgggaccgccuggucuggugcauccccuuuucagcccaagucacuugaccuccaaaacaccucccccacuguaccuacccaccgagggcaggcggucugaccucccugggggacuggcaggcccacguggugggcuuaacacuagccgcucccuguauucaggauugcaaaauccguguaguacagccacccccggcccuccacucggcagcuuucccuuccugccugggggaccacccgucggugcugaagccugggcaagaagggugccgcagccugcugccccaccccggcgaccuccccagucugcguccucauuaagcgccagucugcgcccaccuggcgcacccgcuacguuucucagaccaucuccgauaccuugcuccagccccgggccauggcagucgcuuuguggacugggucccccuugcgccggcuguccauggcccacugcugggccuggcaggcggucuccgggaggcaccuccccagagcgcucacccgggacagccagagcaaggggagauccuaccaguuugcaagccagcuccgaaaagacucagcaguga

SEQ ID NO: 58953 - RNA, 1392 nt, Artificial Sequence
  derived and/or modified sequence opt3 from MEF2C__Homo_sapiens__NP_001124477
augggcagaaagaaaauccagauuaccaggauaauggacgagcggaaccgccaagugacauucacuaagcgaaaauuugggcugaugaagaaagccuacgaacucagcguccuuugcgauugugagaucgcucugauuaucuucaauuccacgaacaaguuguuucaguaugcaucuaccgacauggauaagguuuuacugaaauacacagaauauaaugagccccacgaaucacguacuaacagugacauuguggaggcccuaaauaagaaagagaacaagggaugcgaaagcccugauccagacuccucuuacgcgcucaccccgagaacagaggaaaaauauaagaagaucaaugaggaguucgauaacaugauaaaaucgcauaagauccccgcuguaccuccacccaauuuugaaaugccugugucaauuccagucagcagucacaacucccugguguacucuaaucccguuagcucccuugguaacccuaaucuguugccacucgcccauccgucacugcagaggaacaguaugagccccggcgugacccaccggccuccaucugcagggaauacuggaggccugauggguggggaccucacauccggagccggcaccucagcuggcaacggguauggaaacccccgcaauagcccugguuuacuggucaguccaggcaaccuuaauaaaaacaugcaggcaaagucucccccgccuaugaauuuggggaugaacaauagaaaacccgaucugagggugcuaaucccaccuggauccaagaacacgaugcccagcguaaaucaacggauuaacaauucgcagucugcccagucccucgcuacuccaguugugucagucgccacccccacacugccuggccaggguaugggaggguacccaagugcgaucagcacuaccuacggcacagaguauucccuuucuagcgcagaccugucaaguuuguccggcuucaacaccgccagcgcucuccaucuggggucugugacgggauggcaacagcagcacuuacacaauaugccgcccucagcccugagucagcucggugcauguacuagcacacaucuuucccaaucuucgaaccugagcuugccuuccacccagucacuaaauauaaaaagugaaccagugucucccccucgcgaucgaacuacaaccccaagcagauacccccagcacacgaggcaugaggcuggccgguccccggucgacucacugagcucuugcuccaguagcuaugaugggucugaccgugaagaccaccgcaacgaguuucacuccccuauuggacucaccagaccaucacccgaugagagggaaaguccuagcguuaagcggaugcgacugucggagggcugggccacauga

SEQ ID NO: 58954 - RNA, 1566 nt, Artificial Sequence
  derived and/or modified sequence opt3 from MEF2D__Homo_sapiens__XP_005245226
augggcagaaagaaaauccagauucaaaggauaaccgacgagcggaaccgccaggugacauucacuaagcgaaaauuugggcugaugaagaaagccuacgaacucagcguccuuugcgauugugagaucgcucugauuaucuucaaucacuccaacaaguuguuucaguaugcaucuacggacauggauaagguuuuacugaaauacaccgaauauaaugagccccaugaaucacguacaaacgccgacauuaucgagacucuaagaaagaaaggauucaaugguugcgauaguccugagccagacggcgaagauagccucgagcaguccccgcugcuugaagacaaguacaggcgggcgucugaggagcuggauggguuguuucgcagauauggaucgaccgugcccgcuccuaacuucgccaugccaguaacagugcccgucucaaaucaaagcagucuccaguuuuccaacccuucuggcagccuggugaccccaucccugguuacuucaagucucacagaccccagguuacugagcccucagcagccagcacuucaacgcaauucuguguccccggguuugccccagcggccugccucagcuggggcaaugcugggaggcgaucuaaacagcgccaauggcgcuuguccaagucccgucgggaacggauacgugucugcccgagcguccccuggucuccugccaguagcaaauggcaacagccuuaauaaaguuauacccgccaagucgccgccucccccaacccacucuacgcagcugggggcuccuuccagaaagcccgacuugagggugaucacuucacaggccggaaaaggccucaugcaucaccugaccgaagaucauuuagaccugaacaacgcacaacggcucggugucagucagagcacacacucccuuacuaccccaguggugucugucgcuacacccagccuguugucacaggggcuaccuuucaguuccaugccaaccgccuauaauacggacuaccaacugacuagcgcggagcucucuucacugccggccuuuaguagccccggaggccuuucccugggcaacguuacagcauggcagcagccucagcaaccacagcagccccagcaaccucagccaccccagcagcaaccgccucagccacagcagccccaaccucagcagccccaacagccacagcagccuccccaacagcagucucacuuggugccaguaucgcucagcaaucugauuccgggguccccuuuaccccaugugggagcugcccugaccgucacuacacacccacauaucucaauuaagagugaacccgugucuccuagccgugagcgcuccccagcucccccuccgccagccguuuuccccgcagccagaccugaaccaggugauggccuaucaagccccgcugggggaucuuacgagaccggcgacagggaugacggucgaggggauuuuggcccuacgcucggacugcuucggccggcgcccgagccagaagcagagggcuccgccgugaaacgcaugagauuggacaccuggacacugaaguga

SEQ ID NO: 58955 - RNA, 2346 nt, Artificial Sequence
  derived and/or modified sequence opt3 from MEFV__Homo_sapiens__NP_000234
auggccaagacccccagcgaccaucugcucuccacacuugaggaacuggugccuuacgauuucgagaaauuuaaguucaaauugcagaacacuucuguccaaaaggaacacucaagaaucccaaggagucagauucagcgggcucgcccgguuaaaauggcaacguuacuggugaccuauuacggcgaggaauaugccguacagcuaacacuccaagugcugcgagcgauaaaucagcgucuucuggcugaggaguugcacagagccgcaauccaggaauacagcacucaggagaacgggaccgacgauuccgccgcuucuucgucacucggagaaaauaagcccaggagccugaagacaccugaccauccagaggguaacgagggcaaugggccccggccuuauggaggcggugcagccagucugcgcugcucccaaccagaagcugggagaggacucucuaggaaacccuuaagcaagcggcgcgagaaagccuccgaaggccuggaugcgcagggcaagccucgaaccagaucaccagcacuuccgggcggaaggagucccgguccuugucgggccuuggagggcgggcaggcugaaguccgucugcgcagaaacgccagcucugcaggaaggcuacagggccucgcugguggggccccaggacaaaaagagugccggcccuuugagguguaccugccuuccggcaagaugcgaccacgcucacuugaaguuacuauuagcacaggcgagaaggcgcccgccaauccggaaauccuguugacccucgaggagaaaacggcagcuaaccuggacagugccacugaaccuagagcuaggcccaccccagaugggggagccucugcagacuuaaaggaggguccuggcaaucccgaacacuccgugacagggcggccacccgauacugccgcuagcccucgcugucaugcgcaggagggagacccagucgaugggaccugcgugagagacucguguucuuucccggaagcaguauccggucacccccaggccucagggaguaggagcccuggcugcccacguugucaagauucccacgagcggaaaucucccggaagccugucaccucagccacucccccagugcaagcgacaucuuaaacagguucaacuguuguuuugugaagaccacgacgagccgauuugccuaaucuguagucugucccaggagcaucagggccacagagugaggccuauagaagaggucgcucucgaacacaagaaaaagauccagaagcaacuggagcaucuuaaaaagcugcgcaaaagcggggaggaacagcggucuuauggagaggaaaaggccgugucauucuugaaacagacagaggcacucaagcagagagugcaaaggaagcuggaacaggucuacuacuuuuuagagcagcaggagcacuucuuuguugccagucuggaagaugugggucaaaugguaggccagauucgcaaggcuuaugacacccgagugagccaggauaucgcccuacucgacgcacugauuggggagcuugaagcgaaagagugccaauccgaaugggaguugcugcaggauaucggagacauacuccaucgggcuaaaacggucccagugcccgagaaguggacuacaccucaggaaauuaaacagaagauccaacugcuucaccagaagucugaguucguugaaaaaucgaccaaguacuuuagcgagacucugcguuccgaaauggagauguucaacgugcccgaguugauuggcgcccaggcacaugccgucaaugugauccucgaugcugaaacagccuauccaaaccugaucuuuucagacgauuuaaaaaguguaagacuggguaauaagugggagaggcuaccugacgggccccagcgcuucgauucuugcauuauaguucucggcagcccauccuuccugucaggacggagauacugggaaguggaggucggcgacaaaaccgcauggauccuuggggcuuguaagacgagcauuucuaggaagggaaacaugaccuuguccccggagaaugguuauuggguggucaucaugaugaaagaaaacgaguaccaagccaguagcgugccucccacacgacugcucauaaaggaaccacccaaacgcguuggcauuuuuguggacuaucggguagggucuaucuccuucuacaacgucacugcgagaucacacaucuacaccuuugccaguugcagcuucucgggaccucugcagccaaucuuuucccccggcacaagggauggugggaagaauacugcuccuuuaaccauuuguccggugggcggacagggcccagacuga

SEQ ID NO: 58956 - RNA, 3423 nt, Artificial Sequence
  derived and/or modified sequence opt3 from MEGF10__Homo_sapiens__NP_115822
auggugaucagccugaacuccugccucucuuucauuugucuucuguugugccacuggauaggcaccgccucacccuuaaaucuggaggacccuaacgucuguagucauugggaaagcuacuccguuacagugcaggagucuuauccacacccguuugaucaaaucuacuauacuucgugcacggacauucuaaauugguucaaguguaccagacauaggguaucauaccggacagcuuaucgccacggggagaaaacuauguaccgacguaagagccagugcugucccggauuuuaugaaaguggugaaaugugcgugccucauugugcagauaaaugcguccacggcagauguaucgccccaaauaccugccagugcgagcccggguggggaggcacaaacuguuccucugcgugcgacggugaucacugggggccucauuguaccucuaggugccaguguaagaacggagcucucugcaauccaauuacuggcgccugucacugcgcagccggcuuccggggguggcgcugugaggacagaugcgaacaaggaacauacgguaacgauugucaucagaggugccagugccagaauggcgcuaccugugaccacgugacgggggagugccggugucccccuggauacacuggcgcauuuugcgaagaucuguguccaccggguaaacacgggccccaaugcgagcagcgcuguccuugccagaacggaggcguuugucaucacgugaccggcgagugcuccuguccaucaggguggaugggaacagucugcggucagcccugcccugaaggccgauucgggaagaauuguagucaagagugccagugucauaacggaggcacuugcgacgccgcuaccggucagugucacugcagcccaggguauacaggcgaaagaugucaagaugagugccccgugggaaccuacggcguacuuugugccgaaacgugccaguguguuaaugggggaaagugcuaucaugugucuggugcgugccugugugaggcaggcuuugccggggagaggugcgaagcucgguuguguccggagggacucuacggcaucaaaugcgacaagcguuguccuugccaccuggaaaacacucacuccugucaucccaugucaggugagugcgccuguaaaccaggguggagcggccuguauugcaaugaaacauguaguccuggauucuacggcgaggcaugccagcagauaugcucuugucaaaacggggcugauugcgacuccgucaccggaaaguguacuugcgcccccgguuuuaaaggcaucgacuguagcacaccaugcccccucgggaccuauggaauuaacuguucgucucgcugcggcuguaagaaugaugcggugugcuccccuguggacgguucauguacgugcaaggccggguggcacggcgucgauugcaguaucagauguccaagcggaaccuggggcuucgggugcaacuuaacaugucagugccugaauggaggcgcauguaacacucuugacgguaccugcacaugugcuccgggguggaggggagagaaaugcgaauugcccugucaggauggcacuuacggucugaauugcgccgagcggugugacugcucccaugcugauggcugucacccuaccacagggcacugccgaugccuaccaggauggucuggcguucauugugacagcgugugcgccgaagggcgcuggggacccaacuguucacucccuugcuacuguaagaauggcgcaaguugcuccccagaugacgguauuugugagugcgcccccggguuuagaggaaccacuugucagaggaucugcagcccgggcuucuauggucaccgguguucucaaacgugcccucagugcguacauucaaguggcccaugucaccauauaacagggcugugcgauugucuucccggauuuaccggcgcucugugcaacgaaguguguccuagcgggcgcuucggcaaaaauugcgcgggaauuuguacuugcaccaacaaugguacauguaaccccaucgacagauccugccaguguuacccaggguggauuggaucugacugcucgcagccuugucccccagcacacuggggcccgaauugcauccauaccugcaacugucacaauggugccuucugcagcgcuuaugauggcgaguguaagugcacuccuggguggacaggauuguacuguacgcaaaggugcccccucggcuuuuaugggaaagacugugcccugaucugccagugucagaacggagcagauugcgaccacauuuccggccagugcaccugucguacugguuucauggggcggcauugcgagcaaaaguguccaucaggaacauacggcuauggcugccgacagauaugugauugcuuaaacaauaguaccugugaccacaucacagggacuugcuacuguucucccggauggaaaggugccagaugcgaucaggcuggcgucauuaucguggggaaccugaauagccucuccaggaccucaacggcccuuccugcagacagcuaccaaauaggagcgauugcuggcaucaucauucugguuuuggugguccuauuucugcucgcccuguucaucauuuaucgccauaagcagaaggguaaagaaucuuccaugccagcagugaccuacacacccgccaugcggguaguuaacgcugauuauacuauaagugggacccuuccucacagcaauggaggcaacgccaauucucacuacuuuacaaacccguccuaucauacucugacccagugugcaacgucaccacacgugaauaacagagacaggaugacagucaccaagaguaaaaauaaccaguuguucgugaaucucaagaacgucaaucccggcaaacgcgggccugugggagauugcacugguacacugccagcugacuggaagcauggcggguacuuaaacgagcugggagccuuuggccuagaucgaagcuauauggguaagucgcucaaagaccuggggaagaacuccgaauacaauucuagcaacugcucacuuaguuccucugagaaucccuacgcgaccaucaaagacccuccgguuuugauucccaagagcuccgaguguggauauguggaaaugaaaucaccagcccggcgugauagcccuuacgcugagaucaacaauaguacuucugcaaacagaaauguauaugaagucgagcccaccguguccguugugcaaggcgucuucagcaacaauggcaggcugucgcaggacccauacgaucucccuaagaacucacacauccccugccacuaugaccugcuuccagugcgcgauucuaguuccagcccgaagcaggaagacucugggggaagcuccucaaauaguagcagcuccucagaguga

SEQ ID NO: 58957 - RNA, 3135 nt, Artificial Sequence
  derived and/or modified sequence opt3 from MEGF11__Homo_sapiens__NP_115821
auggugcugagccucaccggccuuaucgccuucuccuuucugcaggcuacauuggcauuaaaccccgaggacccuaaugucugcucucacugggaaucauacgccguuacugugcaagagaguuaugcgcauccauucgaucagauuuacuauacgagauguaccgacauacugaacugguuuaagugcacaaggcaccggaucagcuacaaaacugcuuaucgccgagggcuacguaccauguacagaaggcggucccaguguugcccgggauauuacgaaucuggugauuucuguauuccccucugcacagaggaauguguacauggccgcugcgugucgccugacaccugucacugcgagccaggguggggaggccccgauuguucaagcgguugcgacagugaucauugggggccucacugcuccaauagaugucagugccaaaacggagcccuguguaauccaaucacuggcgcaugcgucugugccgcuggcuuuaggggguggcggugcgaggaacuuugugcacccggaacacacgguaagggcugccagcugccuugucagugccgccauggggccucuugugacccacgagcuggagagugcuugugcgccccgggcuacaccgguguguauugugaggaacucugucccccugggagccacggagcgcauugcgagcugagaugcccaugucagaacggcggcacgugccaccacauuacuggggaaugugcaugucccccuggauggaccggugccguuugcgcucaaccaugucccccgggcacauucgggcagaauugcucccaggauugcccuugccaucacggaggccagugugaccaugugacuggucaaugccacuguaccgccggguacaugggcgauaggugccaggaggaaugucccuuuggaucauucggcuuucagugcagucaacauugugacugccacaacgggggacaguguagcccaacaaccggugcaugcgagugugaaccuggcuauaaagggccccggugccaggagcgucugugcccagagggacuccacggccccgguuguacguuaccuugcccaugugaugcugacaauacuaucucuugccauccggucacaggggccuguaccugccagcccggcugguccggacaccauuguaacgaaucaugcccugugggcuacuauggggacggaugucaacugccaugcacuugucagaauggugcggauugccacagcauaacaggcgggugcaccugugcccccggauucaugggcgagguaugcgcaguuaguugugcugccgguacguacgggccuaacuguucuuccaucugcagcugcaauaacggcggaaccuguucgccaguggacggcucuugcacauguaaggaaggguggcagggacuugauugcacuuugcccuguccguccggcaccuggggucugaauugcaacgagucaugcacaugugcuaacggggccgcaugcaguccuauugacggaagcuguuccugcacuccaggcuggcuaggugauaccugugaacuccccugcccugacggcacauuugggcugaauuguucugagcacugcgauuguagccaugccgacggaugcgaucccgucaccggccacuguugcugucuugcuggguggacuggaauccgcugcgacucaacgugcccaccuggcagauggggucccaacuguaguguguccugcagcugugagaaugggggaucuugcucaccagaagauggcaguugugagugcgcgccggguuucaggggcccucugugucagcggauuugucccccaggguuuuauggacauggcugcgcacaacccugcccuuugugugugcacagcucccgaccaugccaucacaucucugggauaugcgaaugucuccccggauucucgggcgcccugugcaaccaggucugugcugguggguacuucggacaggacugcgcccaguuauguagcugcgcaaauaacggcacauguuccccuauugacgguucaugccaauguuuuccgggcuggaucgggaaagauugcagucaggccuguccacccggauucuggggcccugcuugcuuucacgccugcucuugucauaauggggcaagcugcuccgcggaggacggagcuugucacugcaccccaggcuggacuggucuguucuguacccagcgcugccccgccgcauuuuucgggaaggauuguggaagaguuugccagugucaaaacggcgccucaugcgaccauauuagcggcaaguguacaugcaggaccggguuuacuggacagcacugcgaacagcggugugcuccugguacauucggcuacgggugccaacagcucugugagugcaugaauaacucuacgugugaucaugugaccggaacuugcuauuguuccccgggcuuuaaagguauccgcugcgaccaggccgcacuuaugauggaggaacugaaucccuacacaaagaucaguccagcuuugggggccgagagacacagcguaggagcggugaccggcauuaugcuacuccuguuccugauagucgugcuucugggcuuguuugccuggcacaggcgucggcagaaagaaaaggggcgagaucucgcuccuagaguuucuuauacacccgcaaugaggaugacuuccaccgacuacucacugaguggagccugugguauggaucgccggcaaaacacguauaucauggacaaaggcuucaaggauuacaugaaggagagcgugugcucguccucuaccuguagcuuaaauucaagugagaacccauaugcuacaauuaaagacccucccauccugacuugcaagcuaccagaauccucuuacgucgagaugaaaagcccggugcauaugggguccccuuacaccgauguacccucacucagcacaaguaauaagaacauauaugaaguugagccaacugugucugucgugcaggaaggaugcggccacaacuccagcuacauucagaaugccuaugaccugcccagaaacucgcauaucccuggucacuacgaccuuuugccagucaggcagucacccgcaaaugggccuucucaagauaaacagaguuga

SEQ ID NO: 58958 - RNA, 8538 nt, Artificial Sequence
  derived and/or modified sequence opt3 from MEGF8__Homo_sapiens__NP_001258867
auggcccugggcaaggugcucgcuauggcccuuguccuggccuuggcgguuuuagggucacugucccccggagcucgagccggugacugcaaaggccagaggcaaguguugcgggaggcgccuggguucgugaccgauggagccggcaacuacucugugaaugguaacugcgaauggcucaucgaggcuccaucaccgcagcaccgcauucugcuugacuuucuguucuuggauacugaaugcacuuaugacuaccucuuugucuaugauggggacaguccccgaggaccucugcuggccucucucuccggcucuacgcguccacccccuauagaggccucgucaggcaagauguuacugcaucuuuucucugaugcuaauuacaacuugcugggguuuaaugccaguuucagauuuucccuguguccaggagguugccagucucacggccagugucaacccccuggggugugcgcgugugaaccaggauggggcgguccggacugcgggcuccaggaguguagcgcuuauugcggaucccauggcaccugugccucaccccugggcccuuguaggugcgagccaggguuccuuggacgggcuugugaucugcacuugugggaaaaccagggugccggcugguggcauaauguuagugcucgcgaccccgcuuuuagcgccagaaucggggcggccggagcauuccucucuccuccaggccuguuagcuguguuuggugggcaggaucugaacaaugcccucggcgaccuuguccuguacaacuucuccgcuaauacuugggagucaugggauuugagccccgccccggcagccaggcacagucacguggcuguagcgugggcaggaucucuaguucugaugggcggggaacucgccgacggaucccugacuaacgacgugugggcuuuuagcccucuuggucggggccauugggagcuguuggcaccaccggcaucgucuuccucagggccucccggacucgccggccacgcugccgcacuggucgaugacgugugguuauaugugaguggugggcgcaccccacaugaucuguucagcuccggccuauuccgauuuagacucgacucuacaagcggaggcuacugggagcaagucauucccgcagggggaaggccuccagcugccaccggucacucaaugguuuuccacgcaccgagucgggcccugcuugugcauggcgggcaccgucccuccacugcucgcuuuagcguaagaguaaauucuacagaauuguuccaugucgauaggcacguguggaccacgcugaaaggacgggacggccuccaggguccucgagagcgcgccuuucauacugcaucaguucuggggaacuacaugguggucuauggcggaaaugugcacacccacuaccaggaagagaagugcuaugaagauggcaucuucuuuuaccaucuugggugucaccaguggguaaguggagcugagcuggccccacccggcacaccugaggguagagcggccccacccagcgggagguauucccauguugcugcaguguugggaggcucuguccuccugguggccgguggcuacucggggcggccgcgcggagacuuaauggcuuauaaagucccuccauucguguuucaagcccccgcaccugauuaccaccuggacuacugcagcauguauacugaucacuccguuuguucaagagaccccgaaugcaguuggugucagggcgcgugccaggccgcuccaccucccgggaccccacuaggagccuguccggcagcuucuugccucggccuggguaggcuuuugggggacugucaagccugccuggcauucagcuccccuacagcacccccacguggacccggcacccucgguuggugcgugcauaacgagucaugucugccucggccagaacaggcucgaugcagaggcgagcagauuagcgggacgguaggaugguggggccccgcgccugucuuugugacuucuuuagaagccuguguuacacaguccuuccugccggggcuucacuugcucaccuuucaacagccacccaacacaagucagccugauaaggugagcaucgucaggucuacaaccauaacgcugaccccauccgcagagacagacgugagccugguuuaccgcggauucaucuaucccaugcugccuggcgguccaggcgggcccggggcugaggauguggccguuuggacucgggcccagagacuccauguccuggcuaggauggcacgcgguccagacaccgaaaauauggaggaagugggccgauggguggcccaccaagagaaggaaacacggcgucuucagagaccugggagugcgagguuguucccccugccaggacgcgaucauaaauacgcugucgagauucagggccaguuaaacgggagcgccggaccuggccacucggagcucacucugcuuugggaccggaccgguguucccgggggauccgaaaucagcuuuuucuuucuggagccauauagaagcucaaguugcacauccuacucuagcuguuugggcugccucgcagaucaaggcuguggguggugccugaccuccgccacuugucaccuaaggcagggaggugcucauugcggcgacgauggggcaggaggcucacugcucgugcuggugccgacgcuuuguccuuugugcgaggaacaccgagacugccaugccuguacacaggaucccuucugcgaguggcaccagagcaccagucgcaagggugacgcggcuuguucucggagagggaggggacguggcgcccugaaauccccagaagagugucccccuuuauguagccaacgccucacuugcgaagauugucuggcaaauucgucacagugcgccuggugucagucuacccauacaugcuuucuuuucgcugccuaucuggcacgguacccacacggcggguguagaggaugggacgacaguguacacuccgagcccaggugccgaagcugcgaugguuuucuaaccugucaugaaugccuccaaucucacgaguguggcuggugcgggaacgaggacaauccuacucugggacgguguuugcagggcgauuucagcgguccgcuagggggaggcaacugcuccuuaugggucggcgaagggcucggacugccaguggcacuucccgcccgcugggcguacgccagauguccugacguugaugagugcaggcuggguuuggcacggugucauccccgagcuacaugccucaauacgccacugucauaugaaugucacugccagagaggcuaccagggggacggaauuagucacugcaaccgcaccugucuagaggauugcggccaugguguguguagcgggccucccgacuuuacuugcgucugugaucugggauggacaucugaccuuccaccuccgacccccgccccaggcccucccgcuccaaggugcucccgugauuguggcugcucauuccacagucauugucggaagagagggccuggauuuugcgacgaaugucaagauuggacauggggugagcacugcgagaggugccgccccggcagcuucgggaaugcaacuggaucccgaggcuguagaccgugccaguguaacggucauggggacccacggaggggacacugcgacaaucucucuggccuguguuuuugccaggaucacaccgaaggcgcccauugucaguugugcucgccuggguauuacggagacccccgcgccgguggcagcuguuuccgugagugcgggggaagggcacuguuaacgaacgugucauccguugcgcucggcagucggagggugggugggcugcuuccacccggcggaggcgcagcccgcgcugggccuggacugucuuauuguguaugggucgugagcgccaccgaagaguugcaaccgugcgcacccgguacacucuguccaccucugacucuaaccuucucccccgauucaucuacaccuugcacucugagcuacgugcuugccuuugacggcuucccacgauuucucgauaccggggucguucagagugacagaucccugaucgcugcguucugcggacagcggagggaucgccccuugacggugcaggccuuaagcggccugcucguacugcacugggaagcaaaugguucuucauccuggggguuuaacgcuagugugggcagcgccagauguggaucgggcgggccuggaucuugcccagucccccaagagugugugccgcaggacggugcagccggcgcugggcuuugcagaugcccucagggaugggccggcccacauugccggauggcgcugugucccgagaauugcaacgcacacacaggugccgggaccuguaaccaauccuugggcguuugcauaugugcugaaggauucggcgggccugauugcgccacuaaacuagacggaggccagcuggugugggagacacucauggauagccgucugucagcugacaccgcaagucgcuuucuucaccgauuaggucauacuauggucgacgggccagaugccacccuguggauguucggaggccucgguuugccccagggccugcucgggaaucuguauagauacucuguguccgaaaggcgguggacacagaugcuugcuggagccgaggacggcgggccgggaccuagcccccgcucauuucacgcagcggccuacguuccagcuggcagaggugccauguaucugcuagggggacuaacggcaggcggugugaccagggauuucuggguccugaaccucacuacauuacaauggcggcaggagaaggcuccucagaccguagaacugcccgccguggcaggccauacacuuacugcccgaagagggcugagucucuugcugguuggaggcuacagcccagagaauggguuuaaccagcaacuccuggaauaucagcuugcuaccggaacguggguguccggcgcgcagucugguacacccccuaccgggcuauacggacacagcgccgucuaucaugaggcaacugacucccuguacguguucggcggcuuccgcuuucacguagaauuggcugccccaucaccggaguuauauucucugcacugccccgauaggaccuggagucuccuggccccuucgcagggggcaaagcgggaccguaugagaaaugugaggggaagcucccgcggucuuggccaagucccaggggagcagcccggaucuuggggcuuccgggaaguuaggaaaaagauggcucugugggccgcgcucgcugguacagggggauuuuuggaggaaauuucaccucaucugaaagagccaagacccagacuauuccacgccagcgcacugcucggcgauacuaugguggugcuuggcgggcgcuccgacccugaugaauuuaguucugacguccuguuauaccaggugaacuguaaugccugguugcugccggaucucacccggagcgcuucaguuggaccacccauggaggaguccguagcacaugccguggcggcugucgguaguagacuguacaucagcggcggguucggaggcguggcccuuggucgucugcucgcauugacacugccucccgacccaugcagguuacuaucuuccccugaagccuguaaccagucaggggcuugcacguggugucacggagccugccugagcggcgaucaagcacaccggcucggcugugggggaucgcccugcucuccaaugccgcgcaguccugaggaaugucgaagacuuaggaccugcuccgagugucuggcucggcauccccgcacuuugcagccaggugacggcgaagccagcacacccagaugcaaguggugcaccaauuguccugagggggcgugcauuggaaggaacggcucauguacuuccgagaaugacugccgaaucaaccagcgggaaguauuuugggccgguaauuguucugaggcagcuugcggggccgcagauugugaacaaugcacacgugagggaaaauguauguggaccagacaguucaagcgcacgggcgagacuaggcggauccugagcgugcagccaaccuaugacuggacaugcuuuagucacucccuccugaacgucagccccaugccuguggaaucuucaccgccacuucccuguccuaccccaugccaucuccugcccaauugcacaaguuguuuggauuccaaaggcgcugacgggggauggcagcacugcguauggagcagcucgcugcaacaguguuuaucaccuagcuaccuaccccugagaugcauggccgguggcugugggcgccuccuuaggggaccagaguccugcagucugggcugugcccaggcgacacagugcgcuuugugucugcgacggccgcauugcgguuggugugcauggggaggacaagauggcggcgggagaugcauggaaggaggucucucuggcccuagggacgggcugaccugcggacgccccggcgccagcugggcuuuccuuuccuguccaccugaggaugaaugcgccaacggucaccacgacuguaacgagacacagaauugccaugaucagccccacggguaugaguguucaugcaagacuggauacaccauggacaacaugacgggcuuaugucguccagucugcgcacagggcugugugaaugggaguugcguugaaccugaucauugucggugccacuuuggauucguggguagaaacugcucuacagaguguaggugcaaucgccauagcgaaugugccggcgucggggcucgagaccacugccugcucugucggaaccacaccaagggaucccauugcgagcaauguuugccccuguuugugggcucagcgguuggugggggcacuugcagaccgugucacgccuucugcaggggaaauagccauauuuguauaucucgcaaagaacuacagauguccaagggcgagcccaaaaaguauagucuggauccugaggaaaucgagaacugggugaccgaagggcccagcgaggacgaagcagucugcgugaauugccagaacaauucguacggagagaaaugugaguccugccuccaagguuauuuccuucuggacggcaaguguacaaagugccaguguaacgggcacgcugauacuugcaaugaacaggacggaaccggcuguccaugccagaacaauacggagacagguaccugucaagggucuucacccagcgauagacgggacugcuacaaauaccagugugccaagugcagggaaaguuuucacggcuccccuuugggaggccagcagugcuaucgucugauuucuguagagcaagaguguugccucgauccgacuagccagacaaacuguuuccaugaaccaaaacgacgcgcacuggggcccggaagaaccguguuauuugguguucagccuaaguucacuaacgucgacauccggcuuacacuggaugugaccuuuggcgccguggaccucuacgucucaacguccuaugauacuuucguagugaggguugcucccgacaccggggugcacacaguccauauacagccaccucccgccccaccuccgcccccaccucccgcggauggaggcccacgcggugcaggcgacccugggggagccggcgcuaguagcgggcccggagccccggcagagccaagagugcgggaaguuuggccuaggggccuaauuaccuacgugacagucacugagcccucugcugugcugguagugcgagguguucgugacagauuggucaucaccuauccacacgaacaucacgcccugaaaucaucccgcuuuuaccuccuucuguugggggugggagaucccagcggcccuggugcuaauggcucugccgacagucaagggcuacucuucuuucggcaggaucaggcacacaucgacuuauucguguuuuucucggucuuuuucuccugcuucuuucuguuccuuagccuguguguucuacucuggaaggcgaagcaggcccuggaucaaaggcaggagcagagacgccauuugcaagagaugacgaaaauggcuucacggcccuuugccaaggugacaguaugcuucccaccugacccgacugcacccgcuucugccuggaaaccagcaggacugccucccccagccuuuaggcgaagcgaaccuuuccucgcgccccuucuguuaaccggcgcugggggaccguggggcccuaugggugggggauguugcccacccgccauuccugcaacaaccgccggccugagagcugguccaaucacuuuggagcccaccgaagauggcauggccgggguggcaacacuccugcuacagcuuccuggaggcccacacgcucccaacggggccugucugggauccgcgcucgucacgcugcggcauagguugcacgaguauugcggcggugggggaggcgcuggcgggaguggacacgguacuggcgccgggcgcaagggacugcucucacaggacaaucuuaccucuaugagccuguga

SEQ ID NO: 58959 - RNA, 1809 nt, Artificial Sequence
  derived and/or modified sequence opt3 from MEGF9__Homo_sapiens__NP_001073966
augaacggcggggccgagagagcuaugaggagccugcccucccucggaggucuugcacuguugugcugugccgcggcugccgcagccgcugcaguggccucugcugccucagcgggcaaugucaccgggggaggcggugcagccgggcagguugacgcuaguccuggaccaggcuuacggggcgaaccgagccaccccuucccucgcgccacagcaccaacugcucaagcgccccgaacggggccuccacgugccaccgugcauagaccccuggccgcaacauccccugcucagucuccagagacuaccccgcuaugggccacagcuggacccucgucaaccacuuuucaggccccucucgguccaagccccacaaccccuccagcagccgaaaggacgaguacuaccucccaggcucccacacggccggcgccuacuacccugucuacaaccacgggccccgcaccaacuacaccuguagccaccacugugcccgcuccaacaacgccccgcaccccuaccccagaucuuccgagcuccucaaacaguagcguccugcccacaccuccagccacugaggcacccucuuccccuccacccgaauacgugugcaauuguucaguuguggggagcuugaacgucaauagaugcaaccaaaccacaggacagugugagugcaggccgggcuaucagggucuccacugugagacuugcaaggaaggguucuaccugaauuauaccaguggacugugucagccuugcgacuguucuccacauggcgcccucuccauccccugcaacagcucgggcaaaugccaauguaagguggggguaauuggaucuauaugcgaucggugucaggacgguuacuauggcuuuuccaaaaaugggugcuuaccuugucagugcaacaaucgcucagcuaguugugaugcccugacaggagcaugccuuaacugucaggagaauagcaagggcaaccacugcgaagaguguaaagaggguuucuaccaaucccccgacgcgaccaaggaaugcuugcgaugcccauguucugcuguuacuagcacggggucaugcaguaucaaguccagcgagcuggaaccugagugugaucagugcaaagacggcuauauuggacccaauuguaacaagugcgaaaacggcuacuacaauuuugauucuaucuguagaaaaugccagugucaugggcacguggacccagucaagacaccgaaaauuugcaagccugagucaggagaguguaucaacugccuacacaauaccacugguuucuggugcgaaaacugucucgagggcuaugugcaugaucuggaagggaauugcauaaagaaagaggugauccuucccaccccagaaggaaguacaauucuggucagcaacgccuccuugaccacuucuguucccacaccugugaucaauucgacguuuaccccaacuacacuccaaaccauuuucagcguauccacaucagagaacaguacuucugcacuggccgacgugagcuggacccaguuuaauaucauaauuuuaacggucaucauuaucgugguugugcugcucaugggcuucgucggugcuguguacauguauagggaguaccagaaccggaaacuuaaugcccccuuuuggaccaucgaacugaaggaggauaacauuuccuucucaagcuaucacgacucuauaccuaaugcagacguauccggguugcuagaagaugacggcaacgagguugcuccgaauggacagcugacacucacuaccccaauccauaacuacaaggccuga

SEQ ID NO: 58960 - RNA, 3825 nt, Artificial Sequence
  derived and/or modified sequence opt3 from MEI1__Homo_sapiens__NP_689726
auggccgugagacaggcugcaaccgccggcacacccgggccuaggcgggaggaagaggcggcucugcuguucgaacgcgcccacuaccgacaugacccacguuggcuucugccggucacucccagauugugcuuagcaugugcccuggagcuacucccugauccaggaguuagccuggugaggaagaaacacaugcuuuccugcuuucaagacgcucugguacggcauacgucuuuggugacccagcucgucucacaggaucagcgcguguguauccacuucauuaguguucuguuuggucugcucugcagcauggaagacggcuccgugacagauuuauguauagagguccugauccaaauuacuacccagcuuaaguuggagcagacaaucagaugccugcuagacgaaugucauaaagagcucugcaacaugcccucuaugagggggucgcuggcaacccuuacucuguugggaaagcucguggaugccauuccugcucuggccgacgaauuaguaauggagcacggcaaucugauggagcaccuccuucggggucugguuuauccaucagaagggauccaggcgagcguguguuacuuguauggaaaacuauacaguucccccgucgcagccgagaugcugucuggccauuuccgcgaaaagcucuuuccucuguuccuuagcauacuggauggcgcucaaacaaaggaguugcagaucaacugccucgggcuguuacgacagcugcuaaaauaugaccucuuuguguccaugauuaugaaucaggauggacugggugaaucagccaagaacaucgagggcaguagcgggaauaccucucuuccauuggugcugaaaaagcuccugcuuuccagagacgagacgcugcaagucgcaucagcucacuguauuacugccguuuuggugcauagcccggcgaaacacgccagugcauucauccacgcugauauacccgaauuucucuucgagcaucugucuuccagcucggaaguauuaguguggucuuccugcaacugccugacccuacucgucgaggaaccucuguuuuucucaaagugucacacaguguacggaauugaggccguugugaggagucuucagggcagcuugaagaugaauaacaucgagcugcauaaacagggucuccuguuauuugcugaaauucugacucggcaaccagaggaaaucaaacuuuucaccuccucugccaugugccgugacgcagggcgcgccuugcaggaggcugucagcucacccgugcucgaaguagcggcagaggcccugaaagcuacaagugccuuccuaagaaaggaccaccaguccaccccuccaguucaguauggagagcugcaagcacuccuggaagccaugcuuaauaggugugcugaguuuagccagacguugcugucucggcgacccuuaggccaugccucaagucgcgauagcgaaaaagcaauccuccagagaggcaaguuccugcuuuccacucuggagggguuuaggucugcgugccgguuggcuauugaguuccagucggaaccgagcgcccaagagaacccuuuuacagcacccuccgccaaaaaggaagacacccucgaggcuuucucagaauuucugcuaagugccugugauucucugugcauaccaauggugaugcgccaccucgagcagacuacacacccugcacugauggaggucuuccuuagcaucuugcauaaucuguuugugauugucccccacaugaaggaaaaauucuccaagaaauuagcuucaagcucuuuuaucagacucacccuggagcuuaaggccagguucuguuccggacugagucauagcgcgcuaaaccaggugugcucuaauuuucucuacuacaugugucugaacuugcuguccgccccagaaaagacgggucccccuucaaaggaggaauuaagugcuguuagcgagcuccugcagcacggccuuccacaaauaucgucccguucuccggagagccuggcauucuugucagaccggcaguauauggaaggggccgcucgacagagacaguacugcauucuccugcuauucuaucuggccuacauccacgaggauagguuugugagugaagcagagcuuuucgaagcgguacaauccuuucuccugucuuugcaggaccagggagagcggcccccucuggucguguucaaggccagcaucuauuuacucgcuauuugucaagauaaagacaauacccugcgcgagacaaugguuuccgccaucagaaaguuucuugaaggcauuccagaucugcaguugguguacacucaucacccccuccugcuaagguucuuucugcuuuauccugagcucaugucacgcuacggucaucgaguccuggaauugugguucuuuugggaggagagcaguuacgaagaguuagacgaugugaccucugcagggcagccagcucugcccgccucccucguagugcuguuccagcuucugcggagcauaccgucgaucuugcuaauucugcucgaccugaucuauucaucuccuguugacacagcacacaaaguccuuaucaguuuacguacuuuucugagaaggaacgaagauauucaagugggcggacucauacgcggccauuucuugcugauccuccagcggcugcuuguggagcacggggccuccccaagcggagcuucugguaaccugcccuugcuacugagccucuuaucccugaugcagcuuagaaaugucucagaacaggagcuggacaguguugcgaugaagcucuugcaccaagugagcaaacugugcggcaagugcucuccuaccgauguggacauucuccagcccuccuuuaacuuccuguacuggucacuucaucagacaaccccaaguagccagaagagggccgcagcuguacuacuguccucuacuggguugauggaguuacuggagaaaaugcucgcccugacgcuugccaaggcugauucgccucgaacagcacugcucuguagcgccugguugcugaccgcgucauucuccgcucaacagcacaaaggaagucuacagguccaucaaacucugucuguggaaauggaccagguucucaaggcccuuagcuuucccaaaaagaaggcagcccuguuauccgcugcaaucuugugcuuccugcgcaccgcccuccggcagucauuuucuagcgcgcugguggcucuugucccaaguggcgcccagccgcugccugcaacaaaagauaccgugcucgcccccuugagaaugucccaaguuaggagccuggugauugguuuacagaaucuacugguacagaaggacccacuccuuucucaggcuugugucgggugccuggaagccuugcuggauuaucucgacgcacguucacccgauaucgcucugcacguggccucccaaccuuggaaccgcuuccuucucuuuacucuguuggacgcgggcgagaauaguuuccugcggccagaaauauuaagacuaaugacacuguuuaugagguaccgaagcucgucugugcucucccaugaggaggucggagauguucuucagggcguggcccuggcagacuugagcacgcugucaaacaccacucuccaggcucugcacggguucuuucagcaacuucagaguaugggacacuuagccgaccauucuauggcucagacacugcaggcaucccucgaagguuugcccccuagcaccucaaguggccaaccgccacugcaggauaugcuaugucucgggggaguagccgugagccucucccacauccggaauuga

SEQ ID NO: 58961 - RNA, 1173 nt, Artificial Sequence
  derived and/or modified sequence opt3 from MEIS1__Homo_sapiens__NP_002389
auggcccagagauacgacgaucugccccacuauggcgggauggacggaguggguaucccuagcaccauguacggcgauccacaugcugcaagguccaugcaaccgguccaccaucucaaccacgggcccccucuucauucucaccaguauccacacacagcccauacuaaugcgauggcucccucaaugggaaguagcguuaacgacgcccugaagcgggauaaagacgcaauuuacggccacccuuuguucccauuacuggcccuaauauuugagaagugcgaacucgcuacguguacaccccgcgagccugguguggcagggggagauguaugcuccucugaaucguucaaugaggacaucgccguguuugcuaaacagauucgagccgaaaagccacuguucucaagcaacccggagcuugauaaucugaugauccaggcgauucaagucuugcguuuucaucuccuggagcuggaaaaagugcacgagcucugugacaacuucugccacagauauaucaguuguuuaaagggcaagaugcccauagaucugguuaucgacgauagggaaggcggguccaaaucugacagcgaggacauuacccgguccgcaaaucuuacugaucagccuucauggaaccgcgaccaugaugacaccgccaguacaagaagcggagguaccccaggccccucuuccgggggacacacuucacauagcggcgauaauaguucugagcagggugacggguuggauaacuccguggcuagcccuucgacaggagacgaugacgauccagacaaggacaaaaagaggcacaaaaagcggggcaucuuucccaaggucgccaccaauauuaugcgcgcauggcuguuccagcaucuaacgcacccguacccuucugaggaacagaaaaagcaacucgcucaggauacuggccugaccauccuucaggugaacaauugguuuauaaacgcccgaagaaggauuguacaacccaugaucgaccaguccaaucgggcgguuucacaggggacaccauauaacccugauggacaacccauggguggcuucgugauggacgggcagcagcacaugggcauucgugccccaggacccaugagugguauggggaugaacaugggcauggaaggacaguggcauuacauguga

SEQ ID NO: 58962 - RNA, 1146 nt, Artificial Sequence
  derived and/or modified sequence opt3 from MEIS2__Homo_sapiens__NP_002390
auggacggcguggggguccccgccagcauguacggagauccucacgcuccaagaccgauucccccuguucaucaccugaaccaugguccaccccuccacgcaacccagcauuauggcgcccacgcgccucacccaaaugugaugcccgcuuccauggggucugccguaaacgacgcacuuaagagggauaaagacgccaucuacggacauccucuguucccauuguuagcucugguguuugagaagugcgaacuagcaacauguacuccgcgggagcccggcgucgccgguggggaugugugcucaagugacagcuucaaugaagauauagcuguuuuugccaaacaagugcgcgcggagaagccucucuucuccucuaacccagaacuggacaaucuuaugauccaggcaauucagguccugcgauuucacuugcucgagcuggagaaagugcaugaacugugugauaacuucugccaccguuauaucucgugucucaagggaaagaugcccauugacuuaguaaucgaugagagagacggcucaagcaaaagugaucacgaagaacuguccggcucuagcacgaaucuugccgaccauaacccuuccucauggagggaccacgaugacgcuaccaguacacauagcgccgggacuccaggacccucuuccgguggccacgcaucacagagcggggauaauaguucugagcaaggagacggcuuggauaacuccguugcuagcccggguaccggggacgaugacgauccugacaaggauaaaaagcggcagaaaaagcgcggaauauuucccaagguggccacaaauaucaugagagcguggcuguuccagcaucuaacccacccauacccuucggaggagcagaaaaagcaacucgcccaggacacuggccugacaauucuucaggucaacaauugguuuaucaacgcaaggcggcgcauugugcagcccaugaucgaccaaucuaaucgagcugugucccagggcgccgcuuauucaccagaagggcagcccaugggaaguuucguccuggauggucaacagcacaugggcauaagaccugccgggccaaugagcggaaugggcaugaacauggguauggacgggcaguggcauuacauguga

SEQ ID NO: 58963 - RNA, 1833 nt, Artificial Sequence
  derived and/or modified sequence opt3 from MELK__Homo_sapiens__NP_001243614
augaaggacuacgaugagcugcucaaauauuacgaacuucacgagaccaucggcacagggggauucgccaaggugaaacuggcuugccauauuuugacuggugaaauggucgcaauaaagaucauggacaaaaacacguuaggcagcgaucugcccagaauuaagaccgagaucgaagcccuaaagaaucucaggcaccagcauauuugucaacuguaucacguucuugagacagcgaacaaaaucuuuauggugcuggaguacugcccugggggagaauuguucgacuauauaaucucccaggaucggcucucugaggaagagacucgcguaguguuucgacagauugucucagcuguggccuacguucauagucagggcuaugcacaccgugaccugaagccagagaaucuccuguucgaugaauaccacaaauuaaagcugaucgacuuuggucuuugugccaaaccgaaggggaacaaggauuaccauuugcaaaccugcuguggaagccuggcuuaugcagcccccgagcuaauucagggcaaauccuaccucggcucugaagcugacguguggucgauggggauccugcuuuauguccugaugugcggauucuugccuuuugaugacgauaaugugauggcccucuacaagaaaauaaugagagguaaguaugacguaccaaaauggcugucacccagcaguauuuuacugcuccagcagaugcuucaaguugacccuaagaaaaggaucuccaugaagaaccuguugaaucacccauggauuaugcaggauuacaacuaucccguggaguggcagucuaagaauccuuucauccaucuagacgaugacugugucacagaacugagcgugcaccaccggaacaaucgccagaccauggaggaucucaucucccuguggcaauacgaccaucuuacugcgacauaccuguugcuccuggccaaaaaggcaagaggcaaaccagugagguuacggcugucaaguuuuagcugcgggcaggcuucugccaccccguucacggauauuaaguuuacuaaauauuggaccgaguccaacggagucgaaucaaagagccuaacacccgcacucugucgcacuccugcuaauaagcugaaaaacaaggagaauguuuacaccccaaaaagugccgugaagaacgaagaguauuucauguuucccgaaccuaaaacaccaguaaacaagaaucagcacaagcgagagauacuuaccacgcccaacagauacacuacaccgucuaaagcgaggaaucaaugcuugaaggagaccccuaucaaaauucccgugaacuccacuggcacagacaagcugaugaccggugucaucagcccagaacggcguugucgcucgguggagcucgaucugaaucaggcccauauggaagagacgccuaaaagaaagggggcaaagguuuucggaucucuugaaaggggccuggacaaagugauaaccgucuugacacgguccaagcgaaaaggcucagcucgcgaugggcccagaaggcucaagcugcacuauaacgugacuaccacacgguuaguaaauccagaccagcugcuaaacgagauuaugaguauccuccccaaaaagcauguugacuucgugcagaaaggauacacucugaagugccaaacccagagcgauuuugguaaggucacaaugcaguucgagcuugaagugugccaguugcaaaaaccugacgucgugggcauccgcagacagaggcugaagggggaugccuggguuuauaaacgucucguggaggacauucuguccucuuguaagguauga

SEQ ID NO: 58964 - RNA, 825 nt, Artificial Sequence
  derived and/or modified sequence opt3 from MEMO1__Homo_sapiens__NP_001131074
augagcaacagaguggucugcagggaggccucccacgcuggcucuugguacaccgcaucagggccccagcugaaugcccaacucgaaggauggcuuagucagguucagagcacaaagcggccugcgcgcgcuaucauugccccacgacguauauucauccuggguccgucccaucacgugcccuugucuagaugugcauuaucgucaguagacauuuauaggacuccucuguacgaucuacggaucgaccagaaaauuuauggcgagcucuggaagacggggauguuugaacgcaugagccugcaaaccgaugaggacgaacauaguaucgagaugcaccuuccauacacagccaaagcuauggagucccauaaggaugaguucacuauaauccccgugcuggucggagcauugucugaaagcaaagaacaggaguuuggcaaacucuucuccaaguaucuggccgacccuucaaaccuguuugugguuaguagcgauuucugccacuggggucagagauuuagguacucuuauuacgacgagucccagggggaaauuuaccggucaaucgagcaccucgauaagaugggaaugagcauuaucgaacaauuagacccagugaguuucucuaauuaucugaagaaauaccauaacaccauauguggccgccaccccauuggcguccuuuugaaugcuaucacagagcugcagaagaacgggaugaauauguccuuuagcuuccuaaacuaugcccagucgucucagugccgaaauuggcaagauuccucagugaguuacgcggcaggagcccucaccguacauuga

SEQ ID NO: 58965 - RNA, 1833 nt, Artificial Sequence
  derived and/or modified sequence opt3 from MEN1__Homo_sapiens__NP_570711
augggccugaaggccgcucagaaaacccucuucccccuuagaagcaucgacgauguggucaggcuguuugcagccgaguuggggcgggaagaaccugacuuaguucugcuaucccucgugcugggauucguagaacacuuucuugcggugaaccgcgucauuccaacaaaugugccggagcugacuuuccaacccucuccugcuccagaucccccugguggcuugacguacuuuccaguugccgaccucucaauaaucgcagcccuguaugcucgauucaccgcacagauucguggggccguggaucugagucucuaccccagagaaggaggcgucagcuccagggaguuagugaagaaaguaucugacguuaucuggaacucgcugucacggagcuauuuuaaggaucgcgcucauauucagagucuuuucuccuuuaucacagguacuaaauuggacucuagcgggguggccuucgcggucgugggagcaugccaggcccugggccuaagagaugugcaccucgcucuguccgaggaccaugccugggucguuuuuggcccuaauggggaacaaaccgcagaggugacauggcacggaaaggguaacgaagauaggcggggccagaccguaaaugcugggguggccgagcgcucauggcuuuaccugaagggaaguuauaugcgaugugacagaaaaauggaggucgcguucauggugugcgccauaaacccaagcaucgauuugcauacugacucucucgaacuguuacagcugcagcaaaagcuccuuuggcuguuguacgaccuaggccaccuggagagguauccgauggcacucgguaaucuggcugaucuugaagaacuggaacccacaccugggcggccagaccccuugacccucuaccacaaaggaauugccuccgcuaagacguacuaucgugaugagcauaucuacccuuauauguaccuggccggcuaucacugucgcaacagaaauguuagggaggcauuacaggccugggcugacacugcgaccgugauucaggauuacaacuauugccgggaagacgaggaaaucuacaaagaguuuuucgaagucgcaaaugaugugauaccaaaccugcuaaaggaggccgcuucacuccuggaggccggcgaggagcgacccggggaacagagccaaggaacacagagucaggguucugcacuucaagacccggaguguuucgcccauuugcugcgcuuuuacgauggcauuugcaagugggaagagggguccccuacucccguacuccacguuggaugggcuaccuuccuggugcagagccuuggcagauuugagggucaggucaggcagaaagugcggaucgucucgcgcgaagccgaggcagcggaagcugaggagccauggggcgaagaggccagagaaggcaggcgucggggaccucgaagagagucuaagcccgaggagccacccccuccgaaaaagccagcacuggacaaaggcuuggggacaggacaaggugccguguccgggcccccuaggaagccacccgggaccguugcuggaacggcccgcggcccugagggugggucaacugcacaggugccagcucccgccgcgaguccgccuccagaaggccccguacucacauuccagagcgagaaaaugaagggaaugaaggaacuguuagucgccaccaaaauuaauuccucugcuaucaagcugcagcuaacugcacaaagccaggugcagaugaaaaagcagaaaguuucaacaccuagugauuauacccucuccuuucugaagcggcaaagaaagggccuuuga

SEQ ID NO: 58966 - RNA, 420 nt, Artificial Sequence
  derived and/or modified sequence opt3 from MEOX1__Homo_sapiens__NP_001035091
augggcaccagcucccuggggcucguggacacaacuggaggucccggcgaugacuacgggguccuuggaucuacggccaacgagaccgaaaagaaaucaaguagaaggcggaaggagagcuccgauaaucaggaaaaccgcggcaaaccugaggguucuucgaaggcucgaaaagaacguacagcauucacuaaggagcaacugagagaguuggaagccgaguuugcgcaccauaauuauuuaaccaggcugcggcgcuacgaaaucgcuguuaaccuagaccucucagagagacaggugaagguaugguuccagaauaggcggaugaaauggaagcgcgugaaagggggacagccaauuagcccgaacggccaagaucccgaggacggcgauaguacagccuccccuucuagcgaauga

SEQ ID NO: 58967 - RNA, 915 nt, Artificial Sequence
  derived and/or modified sequence opt3 from MEOX2__Homo_sapiens__NP_005915
auggagcacccccuguucggcugccucagaagcccucaugccaccgcucaggggcuucacccauuuucccaaucuucacuggcauugcauggaaggagugaccacaugagcuacccggaauuauccacaucuucgucaagcuguaucauugccgguuaucccaacgaggaaggcauguucgcgagucagcaucaccgggggcaccaucaccaucaccaccaucaccaucaccaucaccaccagcagcaacagcaucaggcucugcagacuaauuggcaccuaccucaaauguccucuccacccagcgccgcacgccauucccucugccugcagccugauucaggaggcccacccgagcuugguaguagcccuccagugcuguguucuaacuccagcucauuggggaguucuacgccgaccggagccgcuugcgcacccggcgacuacggccgacaggcccucuccccugcugaagccgagaagcguagcgggggaaaaagaaagucggauucuuccgacucacaggaggguaauuauaaaagugaagucaacagcaagccaaggaaagagcggacagcguuuacuaaggaacaaauacgcgagcuggaggcagaguucgcccaccacaauuaccugaccagacucaggcgguaugaaaucgcuguuaacuuagaucugacagaacgccaggugaagguaugguuucagaaucgaagaaugaaauggaagagggugaaaggcgggcaacagggagccgcagcucgggagaaggaacuugucaacgugaaaaagggcaccuugcugcccuccgagcuaucugguauuggggccgcgacucuccagcagacaggagacagcaucgccaaugaggauucacaugacagugaucacuccagcgaacaugcacaccuguga

SEQ ID NO: 58968 - RNA, 2241 nt, Artificial Sequence
  derived and/or modified sequence opt3 from MEP1A__Homo_sapiens__NP_005579
auggccuggaucagaaguaccugcauucuguucuuuacacuccuuuucgcucacauagcagccgugcccaucaaguaccugccugaggaaaacguccaugacgcggauuuuggcgagcagaaagacauuuccgaaaucaauuuggcugccggguuagaucuguuccaaggagacauucuacuccagaagucuaggaacggucugcgggauccaaauacucgcuggacguuuccgauccccuauauacuugcagacaaccugggcuugaaugccaaaggggcuauccucuacgcauucgagauguuucgacugaagucauguguugauuucaaaccuuaugaaggagagaguagcuacauuaucuuucagcaguucgacggcugcugguccgaggugggugaucaacacguagggcagaacauuucuaucggacagggcugugccuauaaggcuauaauugaacaugagauccugcacgcccucggcuuuuaccaugaacagucgcguaccgacagagaugacuaugugaauauuuggugggaucaaaucuuaucaggguaccagcacaacuucgacacauacgacgauagccugaucacugaccuuaauaccccauaugauuacgagaguuugaugcacuaucagcccuuuuccuucaacaagaaugcgucugucccuacaauuaccgcaaaaauaccagaguucaacagcaucauuggacagaggcuggacuuuuccgccaucgaucuagaacggcucaaucgcauguacaacugcacuacaacccauacgcugcuugaccacuguacuuucgagaaggcuaauauaugcgguaugauucaaggcaccagagaugacacagauugggcccaucaggacucagcacaggcuggggaaguggaucacacucuguugggacaauguaccggcgccgguuauuuuaugcaguucaguacaagcucuggguccgcggaggaagccgcacuccuggagucaaggaucuuauaccccaaacggaagcagcagugccugcaauuuuucuauaaaaugaccggaagcccuagugaccgccucguuguguggguccgaagagacgauucuacgggcaacgugaggaaacuuguaaagguucagacuuuucagggcgacgaugaccacaacuggaagaucgcucaugugguccugaaggaggaacagaaauuccgguacuuguuucaagggacaaagggagauccacagaacuccaccgguggcauuuaccuagacgauaucacucugacagagaccccgugucccacggggguguggaccgugcguaauuucagccagguccucgaaaauacaucgaaaggagacaagcugcagucuccucgcuuuuauaacuccgagggcuacgguuucgggguuacucuuuauccaaauucaagagaaaguagcggcuaccugagguuggccuuucacgugugcuccggagagaacgaugcuauucucgaguggcccguagaaaaucggcaagugauaaucaccauucuggaccaggagccugauguccgaaaccgcaugucuagcucaaugguguucacaacuagcaaaucccauaccagcccagccaucaaugacacaguuaucugggauagacccucuagggugggcaccuaucacacugacuguaacugcuuccggucaauugacuuaggguggaguggauuuauaagccaucagaugcugaagcgcagauccuuccuaaagaaugaugaccucaucauuuuugucgauuucgaagacaucacgcaccugucucagacagaggugccgaccaaagguaagaggcuuucgccucaaggcuugauucugcaggggcaggaacaacagguaagcgaggagggauccggcaaagcaaugcucgaagaggcccugcccguuucacuuagucagggucagccaucucgucaaaagcggagcguggaaaacacugggccucuggaggaucacaauuggccccaguacuuucgagacccaugcgaucccaacccuugucagaaugacggcaucugcgucaacgugaaaggaauggcuuccuguagaugcauaucaggccaugcguucuuuuauaccggggagaggugucaggcaguccaagugcacggaagcguuuuggguauggugaucggcgggacagccggaguaauuuuccucaccuuuucuaucauugcuauccugucccagcgcccacggaaguga

SEQ ID NO: 58969 - RNA, 1578 nt, Artificial Sequence
  derived and/or modified sequence opt3 from MEPE__Homo_sapiens__NP_001171623
augagaguguucugcgucggccugcuccuuuuuagcguuaccugggccgcucccacauuccagccucaaacugagaagacgaaacaguccuguguggaagaacagaggcaggaagagaagaacaaagacaauaucggguuucaccaucugggaaagcggauuaaccaagaauugucuucaaaagagaauauaguacaggagcgcaagaaggauuuaagucugagcgaagcauccgagaacaaagguucuucgaagucacagaauuacuucaccaaccgacagcgucuaaauaaagaauauagcaucaguaacaaggagaauacacacaacggccucagaauguccauuuacccaaaaucuacugggaauaagggauuugaggacggcgaugacgccaucagcaagcugcaugaucaagaagaguauggugcggcucuuauuaggaacaauaugcagcacaucauggggccggugaccgccauaaaacuguugggagaagagaacaaggaaaauacaccccggaacguccucaacaucauuccugcauccaugaauuacgccaaagcucauucaaaggacaaaaagaaaccacagcgcgauagucaggcacaaaagagccccgugaagucuaaauccacccacagaauccagcacaacauugacuaucugaagcaucugucaaaaguuaagaaaaucccuagcgauuucgagggcaguggcuacacugaccuccaggagaggggagauaaugacauaucuccauuuuccggggauggucaacccuucaaggacauuccuggcaagggggaagccacaggaccagacuuagagggcaaagauauccagaccgguuuugcugggccgagcgaagccgagucgacgcaccuggacacuaagaaacccggauauaacgaaauuccugagcgggaggaaaauggcggcaacaccaucgggacacgcgaugagacugcgaaggaagcagacgccguggaugucucucuuguggagggauccaaugacaucauggguucaaccaacuucaaagaauugccaggccgagaggggaauagaguagaugcuggaagucagaacgcccaucagggcaagguugaguuucacuaucccccugcaccaagcaaggagaaaaggaaggaggguuccucugacgcugccgaaagcacaaauuacaacgagauucccaaaaaugggaagggcucaacccggaaaggaguggaucacaguaaccguaaucaagcgacgcugaacgagaagcagcgcuucccguccaagggcaaaagccaggggcuaccuauacccucuagaggacucgacaacgaaaucaagaaugagauggauucauuuaacgguccaagucaugaaaauauuaucacucacggcaggaaauaccauuacgucccucaccggcagaacaauagcacacgaaacaaggggaugccccaaggaaaaggcuccuggggucgccagccacauucuaauagaagguucucgagccggcgcagagacgacuccucagagaguucugauagcggguccucaagcgaaucugacggcgauuga

SEQ ID NO: 58970 - RNA, 3000 nt, Artificial Sequence
  derived and/or modified sequence opt3 from MERTK__Homo_sapiens__NP_006334
augggccccgccccucugccacuccuucugggguuguucuuaccggcucuguggagaagggcaaucaccgaggcccgggaagaggcgaagcccuacccucuauuuccaggacccuucccugguagccuccagacagaccacacuccacugcuuucccugccccaugcuucuggcuaucaaccugccuugauguuuucaccaacgcagccggggcgcccccacaccggaaacguggcaauuccucaggucacaaguguugaaagcaaaccacuucccccucuggccuucaagcauacugugggccacauaauccuguccgagcauaaagguguaaaguuuaauugcucuauuucggugccaaacaucuaccaggauaccacaauuucaugguggaaagacgggaaggaacucuuaggagcucaccacgcaaucacccaauucuaucccgaugacgaggucacugccauaaucgcuagcuuuaguauuacauccgugcagcgaucugauaauggcagcuacaucuguaagaugaaaauuaacaaugaggaaaucguuuccgacccgauauauauugaggugcagggccugccucauuucaccaagcagcccgaaucaaugaacgucacgcguaauacugccuuuaaccuuaccugccaagcgguggggccaccugagcccguaaauaucuucuggguucagaacaguagcagagugaaugagcagccagaaaaaucucccuccgucuugacagugccuggacugacugagauggcaguguuuucaugugaagcccacaacgauaagggucuaaccgucagcaaaggcguucagauuaauaucaaggcuaucccaaguccgcccacagaggugucuauuaggaacuccaccgcccauagcauacucaucucguggguaccuggguucgacggauacucuccauuucggaauugcuccauucaagugaaggaagcagauccccugucaaacggcagugucaugaucuucaacacgagcgcccuuccucaccuguaucagauaaaacaguugcaagcucucgcgaauuacuccauuggugugucuuguaugaacgagaucggguggagcgccguuucaccauggauccuggcaaguacuacagagggagcucccuccguggccccguuaaaugucaccguguuccugaacgaaagcucugacaauguagauauucgcuggaugaagccuccaacuaaacagcaggacggcgagcucguuggcuacagaaucucacacguguggcagagugcugggauuagcaaggaacuucuggaggaagucggacaaaacgguuccagggcccggauaucugugcagguccauaaugcaacaugcaccgugcgcaucgccgcuguuacgcgaggcggggugggacccuuuucggauccuguaaaaauuuucauccccgcgcacggcugggucgacuaugcaccaagcuccaccccugcccccgguaacgcugacccaguguugaucauuuuuggguguuucugcggcuuuauacuaaucggacugauucucuacaucucacuggccauuagaaagaggguucaggagacaaaauucggcaaugcauuuacugaggaagauagugagcuuguggucaacuauaucgccaagaagucuuucugucggcgugcuauagaacugaccuugcauagccucgggguguccgaggaacugcagaauaaauuagaggacguagugaucgaucgcaaccugcuaauucucggaaagauccugggugagggcgaauuugggucaguuauggagggaaaucuuaaacaagaagacggcacaucauugaaggucgccgugaaaacuaugaagcuggauaacucuucccagagagagauugaggaguuccucagugaagcagcgugcaugaaggacuuuagccacccgaaugugaucaggcugcuuggugucuguauagaaaugucuucccaggggauuccuaaacccaugguuauccugccauucaugaaguacggcgauuugcauaccuaucuccuguacucacgguuagagacaggacccaaacacauuccucugcagacccuacucaaguuuaugguggacaucgcucugggcauggaauaucuuaguaaccgaaacuucuugcaccgcgaucuggccgcaagaaauugcaugcucagggacgauaugacugugugcguagccgacuucgggcugagcaaaaagauauacucgggagacuacuaucggcaaggucgcaucgcuaagaugccagucaaauggauugccaucgaguccuuagcagauagaguguacacgucuaagagcgacguuugggcuuuuggcgugacaaugugggagauugccaccagggggaugacucccuauccuggaguccagaaccaugaaauguacgauuaucugcuucacggccaucguuugaaacagccggaggacugucucgaugaacuguacgagaucauguauucaugcuggcggaccgacccacuagaucgacccacauucagugugcugagacuccagcuggaaaagcucuuggagucccugccugacguuaggaaucaagcggaugugauauacguaaacacccaguuacucgagucuagcgaaggucuggcccagggguccacucuugcuccacuggacuugaauauugaucccgacucaaucaucgcaagcuguacaccucgcgccgcuauuagugucgugacggccgaggugcacgauucuaaaccgcacgaaggccgguacauccucaacggaggcuccgaggaaugggaggaccugaccagcgcacccucggcggccgucacugcugagaagaauagcguucuaccaggggaaagacuggugaggaacggaguaucuuggagucauuccagcaugcucccucugggcucuagccuucccgacgaguugcuguuugccgaugacuccucagaagguagugagguguuaauguga

SEQ ID NO: 58971 - RNA, 1089 nt, Artificial Sequence
  derived and/or modified sequence opt3 from MESDC1__Homo_sapiens__NP_072088
auggccagcggcuccgcugggaagcccaccggagaggcagccucuccugcgccagcuucagccaucgguggcgcaaguagccagccgagaaaaaggcugguguccgucugcgaccacuguaaggggaaaaugcaacucguugccgaucuucuguuguuaucuucggaagcucggcccgugcuguucgagggaccugcaucaagcggcgccggugcugaaaguuuugagcagugccgcgacacaauuauagcccgaacuaaggggcuauccauccucacgcaugauguacagucucagcugaacaugggacguuucggcgaagcgggcgacagccuuguggagcugggggauuuggucgugucccucaccgaguguucagcacacgccgcuuaccuggccgcaguugcuacaccaggagcccaacccgcgcagccuggucugguggacagauauagggucacucggugccgccaugaaguggagcagggcugugccguacucagagcaaccccauuagcugauaugacaccccagcugcuuuuggaaguuagucaagggcugagcaggaaucuaaaauuucucaccgacgccugcgcucuggccucugauaagucccgggaccgcuucucacgagagcaguuuaaacuuggagugaaguguaugagcacaagugcaucugcccuguuggcuugcgucagagaggugaagguggcgccuuccgaacucgcaaggagccggugugcccuguucucgggcccauuaguccaggcuguuucugcccugguggguuuugcaacugagccgcaguuccucgggcgugccgcugccguauccgcagaaggaaaagcggugcaaaccgcuauucuuggcggcgccaugucagucgugagugcaugcguucuguugacgcagugucuacgcgaucuggcccagcaccccgacgggggagcuaagaugagcgaucauagagagaggcuccggaacuccgccugcgcagugucugaagguugcacucugcuuagccaagcucugcgagagcgcucaaguccuagaaccuugccacccgucaauuccaacagcgugaauuga

SEQ ID NO: 58972 - RNA, 705 nt, Artificial Sequence
  derived and/or modified sequence opt3 from MESDC2__Homo_sapiens__NP_055969
auggccgcuagcagaugggcaaggaaggccgugguccugcucugcgcguccgaccuucuguuguuacugcuacuccugcccccuccaggcucuugugcugccgaggggucaccgggaacccccgaugaaaguacaccuccaccccggaaaaagaaaaaggacauccgcgauuacaacgacgcagauauggcccgacuucuggagcagugggaaaaagacgaugacauugaggaaggugauuugccugagcacaagcguccaagcgcucccguugacuucuccaagauagauccuucuaaaccagagucgauccucaagaugacuaaaaagggcaaaacgcugaugauguuugugaccguaucagggagcccgacagaaaaggagacugaagagauuaccagucuguggcaaggaucccucuucaaugcaaacuaugacgugcagagauuuaucgucggcucugauagggccauuuucauguuacgggacgguagcuacgcuugggagaucaaggacuuucugguggggcaggaucgcugcgccgacguuacacuugaaggacagguguaucccggcaaaggcgggggauccaaggagaaaaauaagaccaaacaagauaaggguaaaaagaagaaagaaggcgacuugaagucaagaaguagcaaagaggaaaacagggcggggaauaagcgggaggaucuguga

SEQ ID NO: 58973 - RNA, 1194 nt, Artificial Sequence
  derived and/or modified sequence opt3 from MESP2__Homo_sapiens__NP_001035047
auggcccagagcccuccuccacaaucccugcucggccacgaccauuggaucuucgcucagggguggggaugggcaggucacugggauucuaccucaccggccaguagcuccgacucuucgggcucaugccccugugauggggcgagaggacuuccucagccacagcccccuagcugcaguuccagggcugccgaggcagccgcuacaacuccacggcgcgcacgaacgggccccgccggugggcaacgucagucugcuagcgaaagagagaagcugaggaugcggaccuuggcccgcgcguuacaugaacugagaagguuucuaccuccaucccucgcaccggccggacagucacugacaaaaauugagacucuucggcuggcuauacgcuacaucggccacuugagugccgugcucggccugagcgaagagucucugcagugucgaagaaggcaacguggggacgcaggaucccccugggguugcccucucuguccagaucggggccccgcugaggcccagacccaggcggaagggcagggacaaggccagggucaggggcaaggacagggccagggccaggggcaaggacagggucagggccaggggcaaggacgcagaccuggcuuagucucagccguucuggcagaggcuagcugggguaguccaucugccugccccggggcucaggccgcaccggaaaggcuuggccggggagugcaugacacagauccuugggccacucccccauauuguccuaagauucaguccccacccuacagcucgcagggcaccacaucugacgcuuccuuguggacgcccccucaagggugcccauggacccagucaaguccggagccccgaaacccuccaguacccuggacugcggcacccgccacccuggagcuagcugccguguaucagggacucagcgucuccccagaacccugucugucucuuggugcaccgagccuguugccucacccaucaugccagcgccuccaaccccagacaccuggcagauguuggagucacuccgccgaggugguucccaauagcgaagaucaggggccaggagcugccuuccaacugucugaggcaucaccuccccagaguagcggcuuaagguuuuccgguugcccagaacuguggcaggaggaccucgagggggcgcggcuuggcaucuucuacuga

SEQ ID NO: 58974 - RNA, 879 nt, Artificial Sequence
  derived and/or modified sequence opt3 from MEST__Homo_sapiens__NP_001240831
augagagaguggugggugcaggucggccugcucgccguuccccuucuggcugcauacuugcacaucccuccaccgcaauuaagccccgcccugcauuccuggaagucuucagggaaauucuuuaccuauaagggacuaaggauuuucuaccaggacaguguggguguagugggcagcccugaaauagucgugcuccugcacggguuuccaacauccucuuaugauugguacaaaaucugggagggacuuacucugcgguuccaucgcguuauugcguuggacuuucucggcuucgguuuuucggauaagccccgaccucaccauuauucaaucuucgaacaggcuagcauuguggaggcccugcugcgucaccucggguuacagaacagaaggaucaaucugcuuagucacgacuacggagauauagucgcacaagaauugcuguaucgguacaaacagaaccgcuccggcagacuaacgaucaagucucucugccugagcaauggcgggauuuuuccagagacccauaggccccuucuguugcagaagcuccugaaagacggagguguguuauccccuauccugacacggcucaugaacuucuuuguauucucacgcggccuucugcaguacauuaaucaacgaaagaaauuuagaaggcgguggguuggggccuuggcuagugugacuaucccaauacacuucauuuauggaccgcuagaucccgucaacccuuacccagaguuccuggaacucuaucguaagacccugccccgcagcacagugucuauccuugacgaucauauuucccacuacccucagcuggaggacccaaugggcuuuuugaaugcauauauggguuucaucaacucauuuuga

SEQ ID NO: 58975 - RNA, 1008 nt, Artificial Sequence
  derived and/or modified sequence opt3 from METAP1D__Homo_sapiens__NP_954697
auggccgcucccagcggcgugcaucugcucgucagaagggggucccaccggaucuucucuucaccucuuaaccacauuuaccugcauaagcagaguagcucccaacagcgccgaaacuuuuucuuucguagacagagggacauaucucacucgaucguuuugccagcagccgugucaagcgcgcauccgguacccaaacacauuaagaaaccugauuaugugaccacaggaaucgucccagacuggggugauaguauugaggugaagaaugaagaccagauccaaggcuuacaccaggcuugccagcuggcccggcauguucuacuccuggcagggaaaucccuuaagguggauaugacuacggaggaaauagacgcccugguccaccgcgagaucauuucucauaaugcuuaccccagcccuuugggauauggcgguuucccaaaguccguguguaccucaguaaacaauguucucugccacgggauccccgauaguagaccucugcaggacggagauauuaucaacauagacgugacagucuacuauaauggcuaccacggcgauacuagcgaaaccuuucugguggggaacguggacgagugugguaaaaagcucgucgagguugcaaggcggugccgcgaugaagccauugcugccugucgagcgggagcaccauucucugugaucggcaauacaauuucccauaucacccaccaaaacggguuucagguaugcccgcauuucgugggacacggcaucgguucauauuuucaugggcaccccgagauuuggcaccaugccaaugacagcgacuuaccuauggaagagggaauggcuuucacuauagagccaaucauuacagaaggcagucccgaguuuaaaguccuggaagaugccuggaccgugguuucucuugacaaccagagauccgcacaguucgagcacacgguguugaucacuagcaggggcgcucaaauacugaccaagcuaccucaugaagccuga

SEQ ID NO: 58976 - RNA, 1161 nt, Artificial Sequence
  derived and/or modified sequence opt3 from METAP1__Homo_sapiens__NP_055958
auggccgcuguggagaccagagucugcgaaacagacggcuguagcuccgaggcaaagcugcagugccccacuuguaucaaacucgggauucaaggaucuuacuucugcucacaggaauguuuuaaggguaguugggccacgcacaaacuucugcauaagaaagcgaaggaugagaaggcuaaaagggaaguuagcuccuggaccguggagggcgacauaaacacagauccuugggccggguaucgguacacuggaaaguugcgcccacacuauccguuaaugcccacccgaccuguaccaucuuacauccagcgucccgacuaugcagaucauccucugggcaugucggagucagaacaggcccuaaaagguacaagccaaauuaagcuccugaguuccgaggacaucgaagggaugagacuugugugcaggcuggcucgggaggucuuggauguggcagccggaaugauuaaaccaggcguuaccacugaggaaaucgaccacgcugugcaucucgccuguauagcgcgcaauugcuaccccucuccucugaacuauuacaauuucccaaagagcuguugcacauccgucaacgaggugaucugucacggcauuccggauagaaggccccugcaggaaggggacaucguaaauguugauauuacccucuaccggaacggauaucacggugacuuaaaugagacguuuuucgugggcgaagucgaugacggggcacgcaagcuggugcagacuaccuacgagugccuuaugcaggccaucgacgcugugaaaccuggaguccgauauagagaguugggcaacauaauucaaaagcaugcccaggcaaaugguuuuucaguugugaggaguuacugcgggcacggaauccauaaacuguuccacacagcuccaaacguaccccacuaugccaagaauaaagcggugggcgucaugaaaagcggccauguguuuacuauugaaccuaugaucugugaagggggauggcaggaugagaccuggccagacgguuggacagccguuacccgggauggcaagcguucugcacaguucgagcacacgcuacucgugacugacacagggugcgaaauccugacccgcagacuugauuccgcuaggccccauuuuaugucacaauucuga

SEQ ID NO: 58977 - RNA, 1437 nt, Artificial Sequence
  derived and/or modified sequence opt3 from METAP2__Homo_sapiens__NP_006829
auggccggcguggaggaagucgcugcaagcgggucccaccugaacggagaccucgaucccgacgauagagaggaaggugccgcgucuaccgcugaggaagccgcaaagaaaaagaggcggaaaaagaaaaagucaaagggcccuagugccgcuggggagcaggagccagacaaagaaagcggagcauccguugaugagguggcccgccaacuugaacgaucugcucuggaggacaaggagcgugaugaagacgaugaggacggcgauggugacggggauggagccacaggcaaaaagaaaaagaagaaaaagaaaaagagaggcccgaaaguacagacugaucccccuucggugccaaucugcgacuuguaccccaauggggucuucccuaagggacaggaaugugaguauccacccacgcaggacgguaggaccgcggcauggcggacaacuucagaagagaaaaaggccuuagaccaagcuagcgaggaaauuuggaacgauuuucgcgaggccgcagaagcucauagacaggugaggaaguacguuaugaguuggauaaaaccuggcaugaccaugaucgagauuugcgaaaagcuggaggacuguucccggaaacuaaucaaggagaaugggcucaacgccggacuggcguucccaacaggcugcucucuuaauaacugugccgcacacuauaccccgaaugcuggugauacuacagugcugcaguacgacgauauuugcaaaaucgacuuugggacccauauaagcggacgcaucauugauugugccuucacggucacuuuuaaccccaaguaugacaccuugcucaaggcugugaaagaugccacaaauacuggcaucaagugcgcaggcauugacguacgacugugugacguuggggaagccauccaggaggugauggaauccuacgaggucgaaauagauggaaaaaccuaucaagugaagccuauuagaaaccugaauggucacucaaucggccaguacaggauucaugcugggaaaacagugccaaucgucaagggaggcgaggcgacccggauggaggaaggugagguuuacgcaaucgaaacguucgggaguacuggcaagggagugguacacgacgauauggagugcagccacuauaugaaaaacuuugacgugggccauguccccauucgucucccucgcacaaagcacuuacugaaugugauaaacgagaauuucgggacccuugccuuuuguagaaggugguuggaucggcugggagaaucuaaauaccuaauggcucucaagaaccugugcgaccuugguaucguugauccauaucccccgcugugcgacauuaaaggcuccuacacugcccaguucgagcauacaaucuugcuccgaccuaccuguaaggaaguggucucacgcggggaugacuauuga

SEQ ID NO: 58978 - RNA, 4173 nt, Artificial Sequence
  derived and/or modified sequence opt3 from MET__Homo_sapiens__NP_000236
augaaggcccccgcugugcuggcaccuggcauccucguccuucuguucaccuugguucagagaagcaacggggagugcaaagaagccuuagcgaaguccgagaugaaugugaacaugaaauaccaacugccaaauuuuacagcugaaacuccgauucagaacguaauacuacacgagcaucacaucuuccucggagccacgaauuauauuuacgugcugaacgaagaggaccuucagaaggucgcagaguauaaaaccggucccgugcuggaacauccugauuguuuuccaugccaggacuguucuucaaaggccaauuugaguggcgggguuuggaaggauaacaucaauauggcucucguggucgacacauacuaugaugaccaacugauuagcugcggauccgugaacaggggcacuugucagcggcacguauucccccauaaucacaccgcagauauccagucugagguucacugcauauuuucgccucagaucgaggaaccaucacaaugucccgacugcguggucagcgcccugggugcuaaagugcucaguuccgugaaggaucgcuucauuaacuuuuucgucgggaauacaaucaacucuagcuacuuuccugaccauccauuacacuccauuucaguucgacgucugaaagagaccaaggauggauucauguuucuuacugaccagaguuauaucgauguguugccggaauuuagagacagcuaccccauaaaauacguacaugccuuugagucuaauaacuucauuuauuuccugacagugcagagggaaacccuagacgcgcagacguuucacacucggaucauucgcuucuguuccaucaacucaggccuccacagcuacauggagaugccucuggaaugcauccuuaccgagaagagaaagaaaaggaguacaaagaaagaggucuuuaauauucugcaagcagccuaugugucuaagccaggcgcucaguuggcccggcagauaggggcaucccucaacgaugacauccuguucggaguuuuugcucaaagcaaacccgauucggccgaaccuauggaccgcucugcgaugugugccuucccaauuaaguacgugaaugauuucuucaacaaaaucgucaauaagaacaaugugcgaugcuuacagcauuuuuauggucccaaccacgagcauugcuucaauagaacucugcucaggaacuccucaggcugugaagcacggcgugacgaguaccgcaccgaauuuacaaccgcccuucagagaguagaucuguucauggggcaguuuagugagguuuugcuaacgagcauauccacuuucauuaagggagaccugacaaucgcuaaucucggcaccucugaggguagguucaugcaaguggucgugagccggucagggccgaguacuccucacgucaacuuucugcuugauucccaucccgugagcccagaaguuaucguggagcacacacugaaucagaacggauauaccuugguaauuacgggcaaaaagaucaccaaaauuccucucaauggccuggggugccgacacuuccagucuuguucacagugcuuaagugcucccccauuuguccaauguggauggugccaugacaagugugugcgcagcgaagagugccuguccgguacauggacucagcagauaugucuacccgccaucuacaaaguuuucccuaacucugcaccacucgaaggcgggaccagacugacaauuugcggaugggauuuuggcuucaggcggaacaauaaguuugaccuuaagaaaacucgcguguugcuggguaacgagucguguacccucacacugagcgaguccaccaugaauacucuuaagugcacggucgggccggccaugaacaaacacuucaauaugucaaucaucauuaguaacggccauggaacaacccaguacucuacuuuuagcuauguggaccccguaauaaccuccaucucaccuaaguacggcccaauggcugggggaacacuguugacccucacugguaauuaucugaacagcggcaauucuagacacauuuccaucgggggaaaaacaugcacguuaaagagugugagcaacucuauucuggaauguuacacccccgcgcaaacuaucuccacagaguucgcaguuaagcuaaaaauagaucucgccaauagggaaaccucaaucuuuaguuaucgugaggacccuauugucuacgagauccacccaacaaagagcuucauuucgggcgguuccacuaucaccggggugggcaaaaaccuaaauucugugagcgucccccggaugguuauaaacgugcaugaagcuggacgaaauuuuacgguggccugccagcacagaucaaacagugagauuaucuguugcaccacaccgucccuucagcaguugaaccugcaacucccucugaagacuaaagcauucuucauguuagauggcauucugucuaaguauuuugaccuuaucuacguacauaauccagucuucaagcccuuugaaaaaccugugaugauaagcauggggaacgagaauguuuuggaaaucaagggaaacgauauugaccccgaggccgugaaaggugagguccucaaggugggcaauaaauccugugaaaacauccaucugcacucagaggcuguucuaugcaccgugccaaaugaucugcucaagcugaacagcgaacuuaauauugaguggaaacaggccaucaguucuacaguauuggggaaggucauagugcagccugaccaaaacuucacuggacugauugcaggcguggucuccaucagcaccgcguuacuccugcuucugggguuuuucuuguggcucaagaaaaggaagcagaucaaagaucuggguucggaacugguucgcuacgacgcucgggugcacacgccccaccuggauagacucguaucagccaggucugugaguccaacaaccgagauggucuccaaugagagcguggacuaucgcgcaacuuuuccggaagaucaguucccuaacucuagccagaauggcuccugucgacaaguucaguacccccugacagacaugucaccaauucuuaccaguggagacagcgauaucucuucccccuugcugcagaacacugugcauauugacuuaucagcccucaauccugagcugguccaggcugugcaacacguugugauaggcccaaguagccuuaucguccauuuuaacgaaguaauugggcggggacacuucggcugcguguaucaugguacccugcuagauaacgacgggaagaaaauccacugugccguuaagucccucaaucguauuacagauaucggagaggugucucaguuucugacggaaggcauaaucaugaaggacuucucgcaccccaacgucuugagccuguuagguauuugccucagaucagagggcuccccucuggugguacuuccguacaugaaacauggggaucugaggaauuucauccgcaacgagacccacaauccaacugugaaggacuugauuggauuuggccuccaggucgcaaaagggaugaaguaucuggcuaguaaaaaguucguucaucgggaucuagccgcgagaaacuguaugcuggacgaaaaguuuacagugaaaguggccgauuucggacuugcuagggacauguacgauaaggaguauuacucuguccacaauaaaaccggcgcaaagcuccccgugaaauggauggcccuggaaagccuacagacacaaaaguuuacuaccaaguccgacguuuggucauucgguguacuguuaugggagcucaugacgcgaggggcuccuccauaccccgacgugaacacauuugauaucaccgucuaucugcuucagggacgccggcuguugcagccugaguacugcccggacccccucuaugaagugaugcugaaaugcuggcacccaaaggccgagaugagaccuucuuucagcgaauugguuaguaggauauccgcaauuuuuagcacuuucaucggcgagcauuacgugcacgucaaugcgaccuaugugaacguaaaaugugucgcccccuacccaucucugcuuucauccgaagauaaugcugacgaugagguggacacacguccugccaguuuuugggagacuagcuga

SEQ ID NO: 58979 - RNA, 882 nt, Artificial Sequence
  derived and/or modified sequence opt3 from METRN__Homo_sapiens__NP_076947
augggcuuccccgccgcugcacugcucugcgcccuuuguugcgggcuguuggcgccugcugccagagcaggauacagcgaggaaagguguuccuggcgggguucuggcuuaacccaggagccagggucagugggacaacuggcccuagcuugcgcagaaggcgccgucgaguggcucuauccggcuggugcccugcgccuuacacugggagggcccgacccucgagcgcguccaggcaucgcauguuugagacccguuaggccuuuugccggcgcucagguguucgccgaacgggcagggggagcucucgagcugcugcucgccgaggguccaggccccgccgggggacgcugcguaagauggggcccuagggaacggcgcgcguuauuucugcaggcaacuccacaccaggauauuagucgaagaguggcugccuucagguuugagcuucgggaagacggucguccggaguugcccccucaagcucaugggcugggagucgauggcgccugucgcccaugcagcgacgcagagcuacuccuggccgcuuguacguccgauuucgugauacacggcaucauucaugggguuacccacgacguggaacuucaggagucugucaucacagugguagcggcaagaguucugaggcagacucccccuuuguuucaggccggacggucgggugaucaaggccucaccucaauucgaacaccacugcgcugcggggugcaucccggaccgggcaccuucuuauuuauggguuggagcagauucggggaagcuaggcugggcugugccccucgguuucaggaguuccgcagagcauacgaagccgcuagggccgcacaccuccaccccugcgaggucgcgcuucauuga

SEQ ID NO: 58980 - RNA, 1632 nt, Artificial Sequence
  derived and/or modified sequence opt3 from METTL13__Homo_sapiens__NP_001007240
augaaccugcuccccaagagcuccagagaguucggcucuguggacuacugggaaaaauuuuuccagcaaagggggaagaaagccuuugagugguauggaaccuaccuugaacugugcggugucuugcacaaguauaucaaaccucgggagaagguuuuagugauuggcuguggaaauucagaacugagugagcagcuauacgauguaggguaucgcgacauagugaacaucgauauuagcgaggucgugaucaagcagaugaaagaaugcaaugcuacacgacguccacagauguccuuccucaagauggacaugacucaaauggaguuuccggaugcaucuuuccagguugugcuggacaaaggcacgcuugaugccguccugaccgacgaagaggagaagacauugcaacagguggauagaaugcucgcggaaguagguaggguucugcaggggcgggagacugaauggcuguuuggaauggacgagggccgcaaacagcucgcugccucggcaggcuucagaagguuaauuaccguggcccugcaucgggggcagcaguacgaaucaauggaucacauccaagcugagcuuagcgcacgcgucauggaguuggcccccgcuggaaugccuacacagcagcaagugccauuucugaguguggguggcgacauagggguccgaaccguucagcaucaggauuguucuccccuauccggagacuaugugaucgaagacguacagggcgaugacaagagauacuucaggcggcucauuuuucugagcaaccguaaugugguccaauccgaggcccgccuucugaaggaugugucacacaaagcgcagaagaaaagaaagaaagacaggaagaaacagcggccugcagaugccgaagacuugccagcugcccccggucagaguaucgauaagagcuaccucugcugugagcaucacaaggcaaugauugcugggcuggccuuacugcgaaacccugaacuccuucuggagaucccauuggcgcuacugguugugggacucggcggcgggucucugccgcuuuucguccacgaccauuuucccaaauccugcauagaugccguggagauugacccuucaaugcuggaaguagcaacucaaugguucggauucagccagagugaucgcaugaagguucacaucgcugacgguuuggacuauauugccucucucgcuggcgggggagaggccagaccauguuacgaugugaucauguuugacgucgauuccaaagaccccacacugggcaugagcugcccuccacccgcauucguggaacagucguuuuuacagaaggucaaaucuauccugaccccggaggguguguucauucuaaaucucguuuguagggaucuggggcuuaaggacuccguguuggccggccugaaggcuguauuuccucuccuguauguccggcgcauagaaggagaggugaacgagauccuuuucugccaacugcaucccgaacagaaauuggcgacgccagagcuccuggaaacugcacaggccuuagagagaacccugaggaagccuggccgugggugggaugacacauacguucuaucagauaugcucaaaacugugaagauugucuga

SEQ ID NO: 58981 - RNA, 1689 nt, Artificial Sequence
  derived and/or modified sequence opt3 from METTL16__Homo_sapiens__NP_076991
auggcccugagcaaguccaugcacgcuagaaacagguacaaagacaagcccccugauuucgcauaucucgccucuaaauacccagacuuuaagcagcaugugcaaaucaaucuuaacggccgggucucacugaauuucaaagauccggaggcgguucgcgcuuugaccugcacauuacugcgagaagacuuugggcuaaguauugauauaccccucgagcgucugaucccuacugugccacuuagacugaacuauauucacuggguagaagacuugaucggacaucaggauagcgacaaguccacgcucaggcgggguauugauaucggcaccggggccucuuguauauacccccugcugggagcaacacucaauggcugguauuucuuagccacugagguggacgauaugugcuuuaacuacgcuaagaaaaaugucgaacagaacaaucugucggaccuuaucaaggugguuaaagugccucagaagaccuugcugauggaugcacuaaaagaggagucagaaauuaucuaugacuucuguaugugcaacccacccuuuuucgccaaucaacucgaggcuaagggugucaacagccgcaauccuagaaggccaccgcccaguuccgugaacacagggggaauuaccgaaaucauggccgagggcggcgagcuggaauuuguaaagcggauaauucacgacucucuucagcugaaaaagcgcuugcgaugguacagcuguaugcucgggaaaaagugcucccuggcgccuuuaaaagaggaacugagaauccagggaguuccaaaggugacuuacacagaguucugucaggguaggaccaugcggugggcacucgccuggucauuuuaugaugacgucacggugcccaguccuccaagcaaacgucgcaaacuugaaaagcccagaaaaccgauuacuuucgugguccuggcuucuguuaugaaggaguugucccuaaaagccucaccucugaggagcgagaccgcagaaggcaucgugguagugacaacuuggaucgagaagauucucaccgaucugaaaguccaacauaagcgggugcccugcgggaaggaagagguuagucuuuuucugacagcuauagaaaauucuuggauccacuugcgacgcaaaaagagagagagggugcggcagcuccgcgaggucccaagagccccugaagacgugauucaggcgcuggaggaaaagaagcccaccccaaaagaguccggaaacagccaggaauuagccaggggcccccaagagcguacgccuugugguccagcacugcgggagggggaagcugccgcuguagagggaccgugccccucgcaggaaucucuaucccaggaggagaacccugaaccaacugaggaugaacgaucagaggaaaagggcggcguugaggugcucgagaguugucaagggagcuccaauggagcccaggaccaggaagcaucugagcaguucgguagccccgucgccgaaagaggcaagaggcugccugggguggcuggacaauaccuuuucaaaugcuugaucaacgucaagaaagagguggaugacgcgcugguugaaaugcacuggguggagggccagaaucgcgaucucaugaaccagcugugcacauauauacggaaucagauuuuuagacuuguagcagucaacuga

SEQ ID NO: 58982 - RNA, 1437 nt, Artificial Sequence
  derived and/or modified sequence opt3 from METTL17__Homo_sapiens__NP_001025162
auggccgcugcacugaagugccuccuuacccugggcagauggugucccggguugggaguggccccucaggcgagggcuuuagccgcacuggucccagguguuacacaaguggacaacaaaagcggcuuccuacagaagcggccgcaccgccagcaucccgggauccucaaacugccucacguacgacuuccacaggcccuggcuaauggagcacaauugcuccugcugggcuccgccggucccacuauggagaaccaggugcagacgcucaccucuuacuuauggucacgucaucugccugucgaaccagaggaacuucagagaagggcucggcacuuggagaagaaauuucuggaaaaucccgaucuaagucaaacagaggagaagcuccgcggggccgugcugcaugcgcuuagaaagacuaccuaucacuggcaggaacugagcuacacagagggauugucccucguuuauauggcagccaggcuggacggcggcuucgcugccgugucucgggcauuucacgaaauucgcgcucgaaacccugccuuccagccacagaccuuaauggauuuugggucgggaacugguucagucacaugggcggcccauagcauauggggccaaagucugagagaguacaugugcguggacagguccgcagcuaugcucguacuugccgagaaacuguugaaagggggaucugaaagcggcgagccguauauccccgguguuuucuuucggcaguuccuaccuguguccccaaagguccaguuugaugugguggucucagcuuucagucugagcgaacuccccucuaaggccgaccguaccgagguugugcaaacgcuguggcgcaaaacugggcacuuucuuguacugguggaaaauggaaccaaggcaggccauuccuugcucauggaugccagagaccuggucuuaaagggcaaagagaagucaccucuggauccaaggcccggguucguguuugcuccguguccucacgagcuacccugcccacagcucacaaaccuggcguguagcuucagucaggcauaccacccuauucccuucucuuggaauaaaaagccaaaagaagagaaguuuuccaugguuauccuugcccggggaagccccgaagaggcucaucgauggccucgcauuacucagccaguguugaaaagaccgaggcacguccauugccaccuguguugccccgacggucauaugcaacacgccgugcucaccgcacggcgccacggcagauaugggggaugugaucagaaccagugggacguagccggcucgugcucuccuaggcagcaucuguucccacaagguuuuguuucccuuugucccugccagcuguuggggcguucauucacaugcgcuuacagugugugugucagcuccaucuacggcucuggaagccucuga

SEQ ID NO: 58983 - RNA, 1119 nt, Artificial Sequence
  derived and/or modified sequence opt3 from METTL18__Homo_sapiens__NP_001307130
augaccuuccaguuuaacuucacaaucgaggaccaccuggaaaaugagcucacucccauuagagauggcgcccuuacgcuggacagcuccaaggaauugucugugucagagagucaaaaaggggaagagagggaucggaagugcagcgcugagcaguuugacuuaccucaggaucaucugugggaacacaaauccauggagaacgcagccccaucucaggacaccgauucgccgcuaucagcggcuagcaguucccgcaaucucgaaccccauggaaagcaaccuucucugcgagccgcaaaagagcacgccaugccaaaggaccuuaagaaaaugcuggagaacaaggucauagaaacauugcccgguuuccagcauguuaaacucagcgugguaaagacuauccugcugaaagagaauuuuccuggcgaaaacauuguguccaagucauucaguagccacucugaucucaucaccggggucuacgagggaggcuuaaagauuugggaauguacauuugaccugcuugcuuauuucaccaaagcaaaggugaaauuugccgguaagaaaguuuuggaucuggggugcggauccggccuacucggcaucacugcuuucaaagggggaucaaaggagauacacuuucaggacuacaauagcauggugaucgaugaggucacacugccaaacgugguagccaauaguacccuugaagacgaggaaaacgacguuaaugagcccgaugugaagcguuguagaaagccuaaagucacgcagcuguauaagugcagguucuuuucuggugaaugguccgaguucuguaaauuggugcucagcucggagaagcuguucgugaaauacgacuuaauucugacuucugaaaccaucuauaacccagauuacuauuccaaucuccaucaaacauuucuucggcuguugucaaagaacggccgcguccuacuggcgaguaaggcacacuacuucgggguuggaggcggugugcaucucuuucagaaauucguagaggaaagagacguguuuaagacuaggauucugaaaaucauagaugaggggcuuaagcgguucauuaucgaaauuaccuuuaaauucccgggauga

SEQ ID NO: 58984 - RNA, 831 nt, Artificial Sequence
  derived and/or modified sequence opt3 from METTL1__Homo_sapiens__NP_005362
auggccgcugagaccagaaacguggcaggcgccgaagcgcccccuccacagaagagguacuaucggcaacgcgcucacagcaauccgauggccgaccauacacugcgauaccccgucaaaccugaggaaauggauugguccgagcucuauccagaguucuuugcaccccuuacucagaaccagucucacgacgauccuaaggacaaaaaggaaaaacgugcccaggcucaaguugaguucgcagauaucgggugcggauacgguggccuguugguggaauuaucaccacuguuucccgacacgcuaauucucgggcuggagauaagaguaaaggugagugauuauguccaggacaggauccgggcccuucgcgcugccccugcgggaggcuuccagaauauugcaugucugagaagcaacgccaugaagcauuugccaaacuuuuucuacaaaggucagcucaccaagauguuuuuccuguuuccggauccccacuucaaaaggacaaagcauaaauggcggaucauuuccccuacucugcucgcugaauaugccuacguguuacgcguugggggacugguguacaccaucacagacguccuugaguugcacgauuggaugugcacccacuuugaggaacauccacuguucgagcgagugccccuagaagaccucucugaggauccuguaguuggccaccugggcacuucgacagaagaggggaagaaggugcuuagaaauggagguaaaaauuuuccagcaauauucaggcggauccaagaccccguccugcaggcugugaccucacagacgagcuugccgggccauuga

SEQ ID NO: 58985 - RNA, 657 nt, Artificial Sequence
  derived and/or modified sequence opt3 from METTL21A__Homo_sapiens__NP_660323
auggcccuggugcccuacgaggaaaccacagaguucggccuccagaaguuucacaaaccucuugcuacuuucagcuuugcaaaccauacgauccaaauuagacaggacuggaggcaccugggggucgccgcgguugugugggaugcugccauaguauuguccaccuauuuagaaaugggagcaguggagcugcggggucgcucugccgucgaacuaggcgcugggacaggacucgugggcaucguugcagcccugcuuggugcucaugugacuauuaccgaccgaaaggucgcccuggaguucuugaaaucaaaugugcaggcgaaccucccaccgcacauccagacaaagaccguaguuaaagagcugacuugggggcaaaaucugggaaguuuuagccccggcgaguucgaucucauuuuaggcgcagacaucauauaccuggaagaaacauuuaccgaucuuuugcagacgcuggagcaucuaugcuccaaccacucugugauccuccuggccugucguauuagauaugagagggacaauaacuuccuugcuaugcuggaacggcaguuuacuguccgcaaggugcacuacgauccugagaaggacgugcauaucuaugaagcccagaaaagaaaucaaaaggaggauuuguga

SEQ ID NO: 58986 - RNA, 681 nt, Artificial Sequence
  derived and/or modified sequence opt3 from METTL21B__Homo_sapiens__NP_056248
auggccgaccccggcccugauccagagagcgaauccgagucuguguucccgagagaagucgggcuguuugcugacucauacagugaaaagagccaguucugcuuuuguggacacguucucaccaucacacaaaacuucgguuccaggcuuggcguggcagcccggguaugggaugcggcucugucuuugugcaauuauuuugagucgcagaacguggacuuccgcgggaaaaaggucauugaguuaggagccggcacugguauaguggggauccuggcagcccuacagggaggcgauguuacgauuaccgaccucccccuggcucuugagcagauccaaggcaaugugcaggcaaacgucccugccgggggacaggcucaggugcgagcccugucaugggguauugaucaucacguauuuccagcgaauuacgacuugguucucggcgcagauaucguguaucuggaacccacauucccucugcucuuagggacucugcaacaucuuugucguccacacggaaccauauacuuggccagcaaaaugagaaaggagcauggcacagaaaguuucuuucagcaucugcuaccccagcacuuucagcucgagcuggcucaaagggacgaggaugaaaacgucaauaucuaucgggcccgccacagagagccuaggccagcauga

SEQ ID NO: 58987 - RNA, 795 nt, Artificial Sequence
  derived and/or modified sequence opt3 from METTL21C__Homo_sapiens__NP_001010977
auggacgugugccugagcuccgcccagcaacccggcagaaggggagaggggcucucuucaccugguggcuggcuugaagcugagaagaaaggggcaccacagaaggauaguaccggaggcguccuggaagagagcaacaaaaucgaaccguccuugcacucuuuacagaaguucguucccacagacuacgccucguauacucaggagcauuaccgguuugcggguaaagagauugugauacaagaaucaaucgagagcuauggggcuguaguguggccuggagccauggcacugugucaguaccuagaggaacacgccgaggaacucaauuuccaggaugcuaagauucuggagaucggcgcaggcccagggcuugucaguauuguggccuccauccugggagcucagguuacggccaccgacuugcccgaugugcucgguaaccugcaauauaaucugcucaagaacacauuacagugcacugcgcaucugccugaagucaaagagcuuguguggggcgaagacuuggauaagaauuuuccaaaaucugcauucuacuaugacuacguacuggccagcgauguuguguaccaccauuauuuucuagacaagcuccugaccacaauggucuaccuuucccagcccgggaccgugcuguugugggcuaacaaauuccgcuuuucaacugauuaugaguuccucgacaaguuuaaacagguguucgauacaacccuguuagccgaguacccugaaaguagcgucaagcuguuuaagggaauacucaaaugggacuga

SEQ ID NO: 58988 - RNA, 1101 nt, Artificial Sequence
  derived and/or modified sequence opt3 from METTL24__Homo_sapiens__NP_001116836
auggccagagagaggcccccuggccgggggugcggagugcugcgccgaugucuccuuggugcuguccuguuguucggcuuacgucugugcgcagaacuaagaagggccgggccaggaagcccgacccgguccgcgcccccuggcccagcuuggcgacccccugguccacaccucccucccgccccagggcagccgagaggagcaucuaggcggcaaguuacauacgugcgcucaggccgcagagcucccccuggcgggggagguaguggcacuccagagcccggguguugcgccccuaggggacggccacgucgcaagggccccagauggcauaucgaccugcagccgugggcagguagcgcccagucccuugaugaagaggcuuggagguuucugcgguauauuucuacgacccagauagccuguaaccacaugaauacagacucguuggcgacugauucaagcccuacccauaaacccuggaguguaugccucgacgaucgauucaaccuggcacaccaaauccgcaauaagcaguguagacuguacucccucggguuaggaucugacgauacacauuuugaagugagcauggccaacaauggcugcgagguccacagguucgacccauccgugaaaucagcucacauucuggagagucagcaucuuugguaucaccgguugagcaucgauuggcgcgacccucaucccgccguugcagcucagaagccacacucuaacaccagaaaacugggcuccauucuaaaugaauuugggcaccauaagaucgaugugcucaaggccgaccuggagucagcggaauggaaaguccuugagaaccugauauuggaggaugugcucgaacaaaucggacagcugauuuucgagauccacuuacauuggcccgguuuugaaguaagcggcagugacucuuccguugugagguucugguacagccugcucaaggagcuugaacagaaagacuuucgucuguuccacucguauaaggauuugucuaaaccucagcuauuucugaagaaggacauuuucaaugccuccucauguuacacucucaguugggucaacacacgguggaaauga

SEQ ID NO: 58989 - RNA, 723 nt, Artificial Sequence
  derived and/or modified sequence opt3 from METTL6__Homo_sapiens__XP_005264927
auggccagccugcagagaaagggccuccaagcuaggauccuuaccuccgaggaagaggaaaaacugaagcgggaccagacauuggugucugauuucaaacagcagaaguuagagcaagaagcacagaaaaacugggaccuguuuuacaagcgcaauucaacuaacuucuuuaaggaucgacacuggacgacccgugaguucgaggaacuaagaaguugcagggaguuugaagaccagaaacucacaaugcuggaggccggguguggagucgguaauugccuuuucccccuguuggaggaagauccuaacauuuuugcguaugcuugugacuucagcccacgggccauagaguacguuaagcagaauccgcucuaugauacugaacgcugcaaaguguuucaaugugaccugaccaaggaugaccugcucgaucauguacccccugaguccguggacgucgugauguuaaucuucguucugucugcagugcacccagauaaaaugcaucuugucuugcagaacauuuacaagugccacggcuguucgucagaacugagacagcccugggacaaggacgauuuugccgugacaugggacccuuggagcccagcuaucaggguacuacucugccauagugggugguccgcaguugccuggaccuggcugacugcugccucuacaagcugggcgcaggcagugcuucccccucaaccacugaaauga

SEQ ID NO: 58990 - RNA, 735 nt, Artificial Sequence
  derived and/or modified sequence opt3 from METTL7A__Homo_sapiens__NP_054752
auggagcugaccaucuucauucucagacuugccauauacauccugacauuucccuuguauuuacugaacuuccuaggccucuggagcuggauuugcaagaaaugguuuccuuacuuccuggugagguuuacugucaucuauaaugaacagauggcuuccaagaaacgggagcuuuucucuaaccugcaagaauuugcagggccaucaggaaaguugagucuccuggagguugguuguggcacgggggccaauuucaaauuuuacccgcccggaugccgcgugaccuguauugacccuaacccaaauuucgaaaaguuucugaucaagagcauagcggagaaccgacaccuccaguucgagcguuuuguaguggcugccggcgaaaauaugcaucaggucgcagaugguuccguggacguuguggucugcacauuagugcuguguucuguuaaaaaccaggagagaauccuuagggaaguaugccggguguugcgccccgggggagccuucuauuucauggagcacgucgcugcagaguguucgacuuggaauuacuuuuggcaacaggugcuggauccugccuggcaucuacucuucgacggcugcaaccugaccagagaaucauggaaggcucuugagagggccagcuuuaguaaacugaaguugcagcacauucaggcgccacucuccugggaacuggugcggccccauaucuauggcuacgcagucaaauga

SEQ ID NO: 58991 - RNA, 954 nt, Artificial Sequence
  derived and/or modified sequence opt3 from METTL9__Homo_sapiens__NP_001070648
augagacugcucgccggcuggcuuugccugagcuuggcuuccgugugguuagcaaggcggauguggacccugcgcucuccccuaacacgaucacucuacgucaacaugacgagugggccuggagguccagccgcggcugccggcgggcguaaggagaaucaccagugguauguuuguaacagagaaaaacugugcgagagccuucaagcaguguucguacaguccuaccuggaccagggaacucagaucuuuuugaauaacucuauugaaaagucgggcuggcuguucauacaacucuaucauucauuugugagcagugucuucucccuguuuaugucuaggaccagcaucaauggucucuuagggcggggauccauguucguguuuucaccggaucaguuccagcgccugcuuaaaauuaaccccgacuggaagacacacagauugcuggaucuaggcgccggcgacggggagguuacuaaaaucaugaguccucauuuugaagagauuuacgcuaccgagcucagcgaaacaaugaucuggcagcugcaaaagaagaaauauagggugcuuggaauaaaugaguggcagaacaccgguuuccaguacgaugucaucucuugucugaauuugcucgaccggugcgaucagccacugacuuuacugaaggacauucgcuccgugcucgaacccacacgaggcagaguaauccuugcacugguuuugccuuuucacccauauguggagaacgggggaaaaugggagaagcccucagaaauucuagagaucaaaggccaaaauugggaggaacaggucaacagccugccugaaguguucaggaaggccgguuuugugauagaggcuuucacccggcucccauaccugugugagggggauauguacaaugacuauuacguccuugaugacgccguuuucgugcugaagccgguauga

SEQ ID NO: 58992 - RNA, 1710 nt, Artificial Sequence
  derived and/or modified sequence opt3 from MEX3B__Homo_sapiens__NP_115622
augcccagcucccuguucgccgaccucgagagaaacggcucugggggagguggcgggggaucaaguggcgguggggaaacccuugaugaccagagggcucugcaauuggcauuagaucagcugagccuacucggacuggacuccgaugagggcgccucucuuuacgacucggaaccucggaagaaaucagugaauaugacagagugcgucccaguuccgagcagugaacacguggcggagaucguaggccgccagggguguaagauuaaagcucugcgagccaagacuaacacguauauaaaaacccccgugcguggagaggaaccugucuuugugguuacagguagaaaggaggauguggcaauggccaggcgggaaaucauuuccgcugcagagcauuucucuaugauccgcgccagcagaaauaagaacacugcuuugaauggcgccgucccagggcccccuaaccucccaggacagaccacaauucaagugaggguacccuaccggguugugggccuggucguggguccuaaaggggcgaccaucaagcgcauacagcagcagacucacacauauaucgugaccccaucccgagacaaagagccggucuuugaaguuacgggaaugcccgagaauguggauagagcaagggaagagauugaagcccauaucgcucugcggacuggcggcauuaucgagcucaccgacgagaacgauuuccacgccaaugggacagacguaggauuugauuuacaucacgguucaggcgggaguggaccuggcagccuguggucuaagccaacucccuccauaaccccuacaccaggucguaaacccuucucaagcuaccgcaacgacaguucuuccagccuugggucggcaucuaccgacuccuauuuuggcggaggcacgucaaguagcgcugccgcgacucaaagauuggccgauuacuccccgccuucucccgcacugagcuucgcucacaaugggaacaauaacaauaacggaaacgguuauacauacaccgccggcggggaagcuagcgugccaaguccugacggaugccccgagcuacagccaacuuuugaucccgccccugcaccaccgcccggcgccccucucauuugggcucaguucgaaagguccccaggugggggccccgcggcaccugucucaucuucauguaguagcuccgccucuucgagcgcuuccucaaguucugugguuuuuccaggaggcggggccagcgcacccuccaaugccaaccugggacuucuggugcaucggcgauugcacccggguacaucaugcccucgccucagcccaccccugcauauggcuccuggcgccggggagcaccacuuagcaagaaggguccggucugaccccggaggcggugggcuggcguacgcugccuaugcaaauggccucggagcccagcuuccaggccugcaaccuuccgauaccagugggucuagcuccucaaguagcucguccucuagcucaaguuccucuagcuccggauugcgcagaaagggcucaagggacuguagcgugugcuucgaaagugagguaaucgcugcccuaguucccuguggucauaaccuguuuugcauggagugugcaaaucguauuugcgaaaagucugagccagaauguccggugugccacacggcugucacccaggccauccggaucuucuccuga

SEQ ID NO: 58993 - RNA, 1980 nt, Artificial Sequence
  derived and/or modified sequence opt3 from MEX3C__Homo_sapiens__NP_057710
augcccagcggcuccucugccgcucuggcacucgccgcggcuccugccccacuuccgcagcccccuccacccccuccacccccuccaccgccccugccuccacccucagggggaccugaguuggaaggugacggcuuacugcuaagagagaggcucgcagcccuggggcuugaugacccaagucccgcugaaccgggagcacccgcccugcgggcucccgccgcggcagcccaaggccaggcucgccgagccgcagaguugagcccagaagaacgugcuccucccgguagaccaggggcccccgaggcggccgaacucgagcuggaagaggaugaggaagagggagaagaggcagaacuggacggcgaucucuuagaggaggaggagcuggaagaggcugaagaggaggacagguccucucuuuugcugcuaucgccuccagccgcuaccgccucacagacacagcaaaucccgggcgggagccucggaagugugcugcuucccgcagcccgguucgaugcucgcgaagcggcagccgcugccgcagccgcugguguccuguacggcggggacgaugcccagggaaugauggcagcgauguugucccacgcuuauggcccuggugggugcggagccgcagccgcugcccucaacggcgagcaggcagcucuguuaagaaggaagucuguuaauacuacggaaugugugccaguacccagcuccgagcauguggccgaaauugucggccggcaggggugcaaaauaaaggcgcugcgcgccaaaaccaacacauacaucaagacuccugugcgaggagaggagccaauuuuuguugugaccgguagaaaagaagacgucgcuauggcaaagagggagauccucucagccgcugaacacuucaguaugauucgggccagccguaauaagaacggccccgcacuugggggacugucuuguuccccgaauuugccuggccaaacaaccgugcagguacgcguuccauauagaguggucggucuagugguggggcccaaaggcgcgacuaucaagaggauacagcagcaaacacauaccuacaucgucacgccuucacgggauaaagagcccguuuuugaggugacuggaaugccagaaaacguagaccgagcccgcgaggaaauugagaugcacaucgcuaugagaaccggcaauuauauugaacugaacgaggagaaugauuuccauuacaacgggacagacgugagcuuugaaggagguacucucggcagugccuggcugucuuccaauccugucccuccaagcagggcacggaugaucucgaacuaucgcaaugacucuuccucaagucuugggagcggauccaccgauucuuacuucggcagcaacagacuggcugacuuuucaccgacaaguccuuucuccaccgguaauuuuugguucggggauacguugcccagcgugggcucugaggaccucgccguugauucaccagcauuugacagucugcccacuagcgcccagacaauauggaccccuuucgaaccagugaaccccuuauccggauuuggcucugauccuucggggaacaugaagacucagaggcguggaagccaaccguccacaccacggcugucacccaccuucccugagaguauugaacacccacuagcucgaagagucaggucugaucccccuagcacggguaaucacgugggccucccgaucuacauucccgcguucuccaacgggaccaauucauauagcagcuccaacggaggcaguacaucuucuuccccaccugagucacgccggaaacaugacugcguaaucuguuuugagaaugaaguuaucgccgcacuggugcccugcggucacaaccuuuucuguauggagugcgcuaauaagauuugugaaaagagaacuccaaguugcccugucugucagaccgccgugacacaggccauacagauccauagcuga

SEQ ID NO: 58994 - RNA, 2001 nt, Artificial Sequence
  derived and/or modified sequence opt3 from MEX3D__Homo_sapiens__NP_001167589
augcccagcucccugggccagccugacgggggagguggcgggggaggcggugggggaggcgugggcgccgcuggggaggauccaggaccgggucccgcaccuccacccgaaggcgcccaagaggcggcuccugccccaagacccccuccagaaccggacgaugcagccgcugcacucaggcuugcccuggaccaguugucugcuuuagggcugggaggcgccggugauaccgacgaggaaggggcggcaggagauggcgccgcugccgcaggcggggcugacggaggugccgcgcccgagccugucccacccgauggcccugaggccggggcaccacccacacuagcuccggccguugcuccuggaucacucccccugcuugacccaaacgccaguccucccccacccccuccaccgcggcccagcccuccagauguguucgcaggcuuugcuccccacccugccgcgcuggguccacccacuuugcucgcagaccagauguccguaaucgggucucgcaagaaaucggugaauaugacggaaugcgucccggugccuucaagcgagcauguugccgaaauugugggccgacagggauguaagauaaaagcucugcgugccaagaccaacacauacaucaaaacuccagucagaggcgaggagcccguguucauuguaaccgggaggaaggaagauguugagauggcaaagcgggaaauccugagugccgcugagcacuuuuccauuauccgcgccacaagaucuaaagcaggaggucucccuggcgcggcucaagggcccccaaauuuaccuggacagaccacuauacaggugaggguccccuaucggguggugggccuggucguugguccaaagggggccacaaucaaacgcauucagcaacgaacccauacguacaucgugacuccgggcagagacaaggaaccuguauucgcagugaccggaaugcccgagaacgucgacagggcccgggaggaaauugaggcucacaucacacuucguacuggcgccuuuaccgaugcagggccagacagcgauuuccaugcuaauggaacagacgugugcuuggaucugcuaggugccgcggccucccucugggcuaaaacccccaaccagggccgcagaccuccaacggcaacugccgggcugaggggagacacagcucuuggcgcccccucagcaccugaagcguuuuaugccgguagucgagggggcccgagcguuccagaucccggaccugcuucuccauacuccggcucagggaauggaggcuucgccuuuggugcagaggggcccggagcuccugugggcaccgccgcaccggacgauugugacuucgguuuugauuucgacuuucuggccuuggaccucacuguccccgcugcggccacaauaugggcaccauucgaacgggcugccccucugcccgccuucagcggcugcaguaccgugaacggggcuccaggaccucccgcagccggcgcgcgcagaucuuccggggcuggaacgccaaggcacagcccgaccuuaccugagcccggcggucugcggcucgagcuuccacugucgcgcagaggggcccccgauccuguaggagcauugucuuggaggccaccccagggcccuguuuccuuuccggguggcgccgcuuucucaacagcaaccagucuaccaagcucccccgccgcggcugccugugcaccucuggacucuggggccagcgaaaauucacguaagcccccaagugcuuccagcgccccugcacucgcucgggagugcguggucugugccgaaggagaggugauggcggcccugguccccugcggccacaaccuguuuuguauggauugcgcagugcgaauuugugggaagucugaaccagagugcccugcuugcagaaccccggccacacaggcuaucaggguugagacugaaacuccccaaccaggaggcgcaucagcccuucagcgccaguauuga

SEQ ID NO: 58995 - RNA, 651 nt, Artificial Sequence
  derived and/or modified sequence opt3 from MFAP3__Homo_sapiens__NP_001128509
augagcguguacuauaugaucgucugccugauugccuucaccauaacacucauccuuaacguuacuagacuguguaugauguccucucacuugaggaagacggagaaagcuauuaaugaauuuuuccggaccgagggcgcagaaaaguuacagaaagccuuugagaucgcgaagcgcauucccaucauaacaucagcuaaaacucuggaacuagccaaggugacccaauucaagacaauggaguuugcacgauacaucgaggaacucgcccguaguguaccucugccaccgcuuauucugaacugcagagcuuucguggaggaaauguuugaggcagucaggguggacgaucccgacgauuugggggagcggaucaaagaacgcccugcccucaaugcucagggagguauuuauguuaucaacccagagaugggcagaagcaauucccccgggggagacucugaugacggcucgcugaacgaacagggucaggagauagccgugcaagucucagugcaucugcagagcgaaaccaagaguauugauacugagucccaggggucuagccacuucuccccuccagacgauaucggaucagcggagaguaauuguaacuacaaagacggcgcauaugaaaauugccagcucuga

SEQ ID NO: 58996 - RNA, 840 nt, Artificial Sequence
  derived and/or modified sequence opt3 from MFAP4__Homo_sapiens__NP_001185624
augggcgagcugagcccccuccagagaccucuugccaccgaagggacaaugaaggcucaaggagugcuguugaaauuagcacugcuagcccucccacugcuucuguugcucuccacuccgcccugcgcgccucaggucucugguaucaggggcgacgcucuggagcgguucugucugcagcagccacucgauugcgacgauauuuacgcccaaggguaucagucagacggaguuuacuuaauauaucccaguggcccuagcgugccaguacccguguuuugugauaugacgaccgaaggugggaaguggacagucuuccagaaacgcuuuaacggauccgugucuuucuuucgaggcuggaaugacuacaagcugggcuucgggcgugcagauggagaguauuggcuugguuugcagaacaugcaucugcuaacucucaaacaaaaguacgaacugagaguugaccuugaggauuuugagaauaacaccgccuaugcuaaguacgcagacuucucgaucucaccuaaugccgugagcgcugaagaggauggcuacacacuguuugucgccggguucgaagacggaggcgcgggugauaguuuguccuaucacucugggcagaaauuuagcaccuucgacagggaccaggaucucuuugugcagaacugcgcagcccuguccucaggagcuuucugguuccggaguugucacuuugccaauuuaaacggcuucuaccugggcgggagccaucucucuuaugcaaauggaauuaacugggcucaauggaaggguuuuuacuauucccuuaaacgcacugagaugaagaucagaagggccuga

SEQ ID NO: 58997 - RNA, 492 nt, Artificial Sequence
  derived and/or modified sequence opt3 from MFAP5__Homo_sapiens__NP_001284638
augagccugcucggccccaaggugcuucuguucuuggccgcuuuuaucauuaccuccgacuggauaccuuuaggggucaacucucagagaggagaugacguuacacaagcaacuccagagacguucaccgaagauccgaaucuggugaacgaccccgccacagaugagacuguacuagcggugcucgcugacaucgccccuucaaccgaugaccuggaaugcugggaugagaaauuuacauguaccaggcuuuacaguguccaccggccagugaagcagugcauucaucagcuguguuucacuagcuugcgccgaauguauaucguuaauaaagaaauuugcucccgucucguguguaaggagcacgaggcaaugaaagacgaacugugcagacagauggccggucugcccccuaggcggcuccgcagaucuaacuacuuuagguuaccacccugugagaaugucgaucugcaacggccuaacggccuuuga

SEQ ID NO: 58998 - RNA, 1008 nt, Artificial Sequence
  derived and/or modified sequence opt3 from MFGE8__Homo_sapiens__NP_001108086
augcccagaccuaggcugcucgccgcucuuugcggcgcacuguugugugccccgagcuuacugguggcgcuagacaucugcuccaagaacccaugucacaaugggggacucugcgaggaaauuucucaggagguccggggugauguuuuccccucauacaccuguacaugccugaaaggcuaugcugggaaccauugugaaacuaagugcguggagccucuuggacuggaaaauggcaacauagccaauagucaaaucgcagccagcuccguacgcgugacguuuuugggucuccagcacugggucccagagcuggcucgacugaaccgugcagggauggugaaugccuggacccccucuucgaacgacgauaauccuuggauucagguuaaccucuuaagaaggaugugggugacaggagucgugacucagggcgcuucacggcuggccagccaugaguaccuuaaagcguucaagguagcauauaguuugaauggccacgaauuugacuucauccaugauguuaacaaaaagcacaaggaguuuguggggaauuggaacaaaaaugccguccacgugaaccuguucgaaaccccaguggaggcucaauacguccgccuauaucccacauccugucauaccgccugcacucucagauuugagcugcuuggaugugaacugaacgguugcgcaaauccuuugggccucaagaacaauucuauuccagacaaacagaucacagcuagcuccucauacaagaccugggggcugcacuuauucaguuggaacccgagcuaugccaggcuggauaaacagggaaauuuuaacgcguggguugccggcucuuacgguaaugaccaguggcuccaaauauuccccgggaacugggauaaucauucccacaagaagaaccuuuuugagacgccuauccuggcacgguacgugcgcauuuugccaguagcuuggcacaaucgaaucgcccuaagacuggaacuccugggaugcuga

SEQ ID NO: 58999 - RNA, 3159 nt, Artificial Sequence
  derived and/or modified sequence opt3 from MFHAS1__Homo_sapiens__NP_004216
auggccggcauggacagcgggaaccugaagaccgcuagacucuggagggaugcagcccuucgggcgcgcaaacugcgauccaauuugcgucaguuaacacugacugcugccggagcaugccccggugccggcgcugacgcacuagagucuccugccucaccacaacucgugcugccggcuaaccuuggggauaucgaagcccugaauuugggaaacaauggccucgaggaaguccccgagggucuggggagugcgcugggaagccucagaguuuuagugcugaggcggaaccgcuucgcaagacuuccuccagccguagcugaauugggccaccaucugacggagcuagacgugucccacaauaggcucaccgcccugggcgcagaggucgugucugcccuucgggaacugcgcaaguugaaccucucgcauaaucagcugcccgcuuuaccugcgcagcugggggcccucgcacaccuugaggaacuggauguuucauuuaaccgauuggcucaucuaccagacagccugaguugucucuccagacugaggacacuugauguggaccacaaucagcugacugccuucccccggcaauugcuccagcuggucgcuuuagaggagcuggaugugucuagcaaccgucuacgcggacucccugaagacauuuccgcccugagagcacuuaaaauauuguggcugucaggugccgagcucggcacccugccagcuggguuuugcgaacuugcgagucuggagagcuugaugcucgauaauaacggacugcaggcauuaccggcccaguucucuugucugcaaaggcuaaagaugcucaaucuguccucaaaccuuuuugaagaguuccccgcugccuugcugccucucgcaggccuggaggaauuauaccugagccggaaccagcuuacaaguguaccaucuuugaucuccggucucgggcgacugcuaacccuguggcucgacaauaaccgcauuagauaccugcccgauagcaucguugagcuuacuggauuggaggaacugguguuacagggcaaucagauugccguccucccugaccacuuuggccaacugucgaggguggggcuuuggaaaaucaaggacaacccacugauacagcccccguacgaagugugcaugaagggaaucccuuauauugcugccuaccagaaagaguuggcacauucucaacccgcgguccagccacggcucaagcugcuacugaugggucacaaagcugccggcaagacacuccugcgccauugucuuaccgaggaaagaguugaggggugcccuggaggcggugauaaagaaaaguguuaucccccaucacccccuccaguguccaaggggaucgagguaacgaguuggacugcagacgccagcaggggcuugcguuucauuguguacgaucuggcuggagacgaauccuaugaggucauccagccguuuuucuuaucucccggcgcccucuacgugcugguugugaaucuugcaaccuacgagccucggcacuuuccaacaacugucgggagcuuccugcaccgagugggagcuagaguaccccaugccguugugugcauagucgguacccacgcggaucuauguggcgaaagggagcucgaagagaaaugccuggacauucaucgccagaucgccuugcaagagaagcacgaugcugaagggcugucacgguuagcaaaaguggucgacgaggcccucgcuagagauuuugaacugaggagugccuccccucaugcagcguauuacggagugagcgacaagaaccuucgccgacggaaagcccacuuccaguaucuguugaaucaccgucuccagauucugucuccaguucuacccgugucauguagagauccgaggcaucugcgccggcuuagagacaagcuccugaguguagcugagcacagggaaaucuucccuaacuugcaucgaguccugccacgcagcuggcaaguguuagaggagcuccacuuucagcccccucaggcccagcggcuguggcuuuccuggugggacucugcaagacugggcuugcaggcuggucucacagaagauaggcugcaaucggcccuaagcuaccugcacgaguccgggaaacuucucuauuucgaagacucacccgcacugaaggagcauguuuuucacaauuugacccguuuaaucgauauucugaacguguucuuucagcgcgacccaagucuccugcuucauaagcuguugcuaggcacgucuggagaaggcaaagccgagggggagagcuccccucccauggcucggucaacuccaagccaggaacugcucagagcgacacagcugcaccaauacgucgagggauuccuuuuacauggucugcucccggcccacgugauaagguugcugcucaagccucacguacaggcacagcaagaucugcagcuucuguuggaacuacuggagaaaaugggccucugcuauugcuuaaauaagcccaaagggaagccacugaacggaucuaccgcuugguacaaguuucccuguuacgugcagaaugaaguuccucaugccgaggccuggaucaacggcacuaaucuugcuggucaguccuucgucgcagagcaacugcagauugaauauaguuuuccauucacauuuccccucggguuguucgcccgauacagcgugcagaucaacucucacgugguccaucgguccgacggcaaauuucagauauucgcguaucgcggaaagguuccuguggugguaucauacagaccggcuaggggcguccugcaaccagauacccucaguauugccagccacgcaucgcugcccaacaucuggacggccuggcaggcuaucaccccucuuguggaggaacuaaauguucuguugcaggaguggccaggguuacauuauacagugcacauucugugcuccaaaugucucaagcggggaucucccaacccucacgcauucccgggcgagcugcuuagccagccccgaccagaaggugucgccgagaucauuugcccuaaaaaugggucagaaagagugaacguugcgcugguguaucccccaacuccuaccguaauaagucccuguuccaagaagaaugucggagagaaacaucgcaaccaauga

SEQ ID NO: 59000 - RNA, 2217 nt, Artificial Sequence
  derived and/or modified sequence opt3 from MFI2__Homo_sapiens__NP_005920
augagaggccccagcggggcccuguggcuccuucuggcuuugaggaccguguuaggagguauggagguccgguggugcgcaacauccgacccugaacagcacaaguguggcaacaugucugaggccuuccgcgaagcggggauccaaccaucacugcuaugcguucgaggaacuucagcugaucauugugugcagcucauugccgcacaggaggccgacgcuauaacgcuggauggcggugcaaucuacgaagccgggaaagagcacggacuuaagccgguagugggcgaggucuaugaccaggaagugggcaccagcuacuaugcuguugccgugguccguagauccucucaugugacaauugauacucugaaagggguaaagucgugccacaccggaaucaauaggacaguugguuggaacgugcccgucggcuacuugguggagucagggcggcucagcgugaugggaugugacguccugaaagcgguuagugauuauuuuggcgguuccugcgugccuggggcaggagaaaccucuuacagcgagucccugugucgccucugcagaggcgacucaaguggcgaggggguaugugauaagagcccauuagaaagguauuacgacuacucuggagccuuccggugccuggcugagggugccggcgauguggcauuugucaagcauuccacugugcuugaaaauacagacgggaaaaccuugcccucauggggacaagcucugcuaagccaggauuucgagcuccugugucgcgacggcagucgagccgacguuacggaauggagacagugccaccuugcgagggugccugcccacgcagucgugguacgggcugauacugacggugggcugauuuuucguuugcucaacgagggccagcgccuguucucucaugagggauccagcuuucaaauguucucgucugaagccuauggccagaaggauuuacuguuuaaagacuccaccucagagcucguuccaaucgcuacacagacuuacgaagccuggcuugggcacgaguaucugcaugcaaugaagggauugcuaugcgaucccaauagacugccuccauaccucagguggugugugcugaguaccccggaaauacagaaaugcggugacauggccgucgcuuuccggcgacaacgccuuaagcccgagauccagugugugagcgcgaaguccccucagcacugcauggagaggauucaagcagaacaggucgaugccgugacacugucuggcgaggacaucuauaccgcugggaaaacguacggauugguuccagccgcaggcgaacacuaugcccccgaggauagcucaaacaguuacuacgugguagcugucgugagacgggacuccagccaugccuuuacucucgaugaacugcgcgguaagagaucuugucacgcaggguucggcaguccugcgggaugggacguuccagugggcgcuuuaauucagaggggguuuauccgucccaaagacugcgauguccugacagccgugagugaguucuucaaugcaagcuguguaccggugaacaauccuaagaacuaucccuccucucuaugcgcccucuguguuggagacgagcagggucggaauaaaugcgucggcaacucgcaagaacgauacuauggguacagaggagcuuuuaggugucugguggagaaugccggcgauguggcauucguccgccauaccacuguuuuugacaacacaaauggucacaacagcgaaccaugggcugccgagcuucgguccgaggauuaugaauugcugugcccuaacggggcgagagccgaggugucacaguucgcugcaugcaaucucgcccagauacccccacaugcugugaugguaaggcccgacaccaacauuuuuacggucuacggccugcuugauaaggcccaggaccuguucggagaugaccacaauaaaaacggcuuuaagauguucgauaguucuaauuaucacgggcaagacuugcucuuuaaggaugcaaccgugcgcgcgguuccugugggagagaaaacaacuuaccgaggcuggcuggguuuagacuacgucgccgcucuggaagggaugagcucccagcaguguucaggagccgcagcuccagccccgggcgcaccccuacucccucugcuuuugccagcccuggcugcgcggcuccugcccccugccuuauga

SEQ ID NO: 59001 - RNA, 2226 nt, Artificial Sequence
  derived and/or modified sequence opt3 from MFN1__Homo_sapiens__XP_005247653
auggccgagcccgugagcccucugaagcacuucguccucgcuaaaaaggcaaucaccgccauuuuugaccagcuucuggaguucguuacagaaggcucccauuuuguggaagcgacuuacaaaaacccagaguuggauagaauagcuacggaagacgauuuaguagagaugcaaggguauaaggacaaacugucuaucauuggagaggugcuaucaaggcggcacaugaaggucgccuucuuuggucgcaccaguagcggcaaguccucugugaucaaugcaaugcucugggauaaaguucugccgucggggauuggacauaucacaaacugcuuccuuucaguggaaggcacugacggugauaaggccuaccugaugaccgaggggagcgacgaaaagaagagugucaaaacagugaaucaguuggcucacgcacuccauauggauaaggaccugaaggccggaugucugguacgaguauuuuggcccaaagcuaagugcgcccucuuacgugaugaccuggugcuugucgauuccccuggcaccgacgugacuacagaguuggacucuuggauagauaaauucugucuggacgcggauguguuuguccuaguugcaaacagcgaguccacccucaugaauacggaaaagcacuucuuucacaaagugaacgagagacugucaaagccaaauaucuucauucuuaacaauaggugggacgccagugcuagcgaacccgaguauauggaagauguacggcgccagcauauggagagaugccugcacuuuuugguggaggaacucaaagucgugaacgcccuggaggcacagaauaggaucuucuucguuucugcuaaggaaguguuauccgcccggaagcaaaaagcgcagggcaugccugagucaggggucgcccuggcagaaggauuucaugcucgccuccaggaguuccagaacuuugagcaaauuuucgaagaguguaucagccagagugccgugaagacuaaauuugaacagcacaccauacgagcuaagcagauucuugccacaguuaaaaauaucauggacucuguuaaccuggcagccgaggauaagagacacuacuccguggaagagagggaggaccaaauugaucgguuggacuucauccguaaucagaugaaccuacugacucucgaugucaagaaaaagaucaaagaagugaccgaggaagucgcuaacaaggugagcugcgcgaugacagacgagauuugucgccugucgguucuuguggacgaguuuugcucugaguuccauccaaaucccgauguacugaaaauauauaaguccgaauugaacaagcacaucgaagacgguaugggcagaaaucucgcagauagguguaccgacgaggucaacgcccugguguuacagacgcaacaggaaauuaucgagaaucugaaaccucuacucccagcugggauacaggauaagcugcauacucuuauuccgugcaaaaaguuugacuugucauacaaccugaauuaucacaaacucuguagugauuuccaggaggacaucguuuuucgguucagccugggaugguccucucuugugcaucgauuucugggcccccgcaacgcccaaagagucuugcucggucugagcgaaccuaucuuccaguuaccaaggucacuggcaaguacacccaccgccccuacuacaccagcuacccccgauaaugccucccaggaggaacuaaugauuacgcucgugaccgggcuggcaagcguaacaucucggacuucaaugggaaucauuauagugggcggcguuaucuggaagaccauuggguggaaacuuuugagugucagccugacaauguacggagcgcucuaccuguaugagcgcuuauccuggacuacccacgcuaaagaaagagccuucaagcagcaauuugugaacuacgcaacagagaaacugaggaugaucgugucuucgaccagcgccaauugcucccaccaggucaagcagcagaucgcuacuacguucgcccgucuuugccaacagguugacauuacacagaaacaguuggaggaagagauagcacggcucccgaaggaaaucgaucaacuggagaaaauucagaacaauucaaagcuacugcgaaacaaggcugugcagcucgaaaaugagcuggagaacuuuaccaaacaauuccuuccuaguucuaacgaagagagcuga

SEQ ID NO: 59002 - RNA, 1740 nt, Artificial Sequence
  derived and/or modified sequence opt3 from MFRP__Homo_sapiens__NP_113621
augaaggacuucagcgaugugauccugugcauggaggccaccgaauccucuaaaacagaguuuuguaaccccgcuuucgaaccugagucaggcccaccgugucccccuccagucuuucccgaagacgcaaguuacagcguuccugccccauggcacgggagaaggccccggggacuccgcccugauugccgauucuccuggcuuugcgugcuguuguuaucuucgcugcuacuccugcuucuggguuugcucguagcgauuauacuggcucagcugcaagccgcaccaccgucaggcgccagccauaguccccucccugcugggggauuaacuacgaccacaacuaccccaacaaucaccacuucccaggcagccggcacacccaagggucagcaggagucuggggugagcccuuccccacaaucaaccuguggaggccugcuuaguggcccccguggguuuuucagcucuccgaauuauccugaccccuacccaccuaacacgcacugcgucuggcauauucagguggcuacugaucacgccauccaguugaaaauugaggcgcuguccaucgaaucaguugcaagcugucuauuugacagacucgagcugagucccgaaccagagggaccccuucugagggugugcggucgggucccuccaccgaccuugaauacaaacgccucucaucuccuggugguauucguuuccgauagcucgguggagggcuuuggguuccacgcuugguaucaggccauggcacccggacgcggcucuugugcucacgacgaauuuagaugcgaucaauuaauaugucugcucccugacuccgucugcgaugguuucgccaauugcgcggacgggucagaugagacuaacuguagugccaaguuuagcggaugcggcggcaaucuuaccgggcugcagggaacauucuccaccccaucuuacuugcagcaguauccccaucaacuacuguguacguggcacaucagcgugccugcaggucauucaauugaacuccaguuccacaacuuuagucuggaggcucaggacgaaugcaaauucgacuacguggaggucuaugagacuuccagcucuggcgccuuuucacuucuggggagguucuguggagcugaaccacccccgcacuugguuaguagccaucacgagcucgccgugcuguuucggacagaucauggcaucuccucugguggguucucggcaaccuacuuagccuuuaaugcuacugaaaacccuugcggcccaagcgagcuguccugucaagcgggaggcugcaaggggguacaguggaugugugacauguggcgcgauugcacagacggaucagaugacaauuguagugguccccuauucccucccccagaacucgcaugcgagccugugcaggucgagaugugccugggccuuucuuacaacaccacggccuuucccaauauuuggguggggaugaucacccaggaagagguuguggaagucuugagcggauauaagucccugacaucacucccauguuaccaacacuuccgaagacugcuuugcggccuguuggugccgagguguacuccucucgguagcguacugcccccaugccggucuguuugucaggaggcugaacaucagugccaguccggguuagcccugcuaggcacccccuggccuuuuaacuguaaucgucucccagaggcagccgaucuggaggcuugcgcccaacccuga

SEQ ID NO: 59003 - RNA, 1194 nt, Artificial Sequence
  derived and/or modified sequence opt3 from MFSD11__Homo_sapiens__NP_001229466
augagccccgaguccaagaaacuguucaacaucauuauacucggcguggccuuuauguucauguuuaccgcuuuccagacaugcgggaaugucgcacaaacuguuaucagaucucuuaacaggacggacuuucacggaucagguuacaccaguauggccauuaucuauggcguguucagcgcguccaaucugauuacaccuucuguaguggcuaucgucgggccacaguugucgauguuugccucaggauuauucuacagcauguauauagcaguguuuauccagccguuccccuggaguuuuuacacugccuccguuuucauuggcaucgcugcagccgaaucugaucggcgcaccguguuuauugcucugacagucaucagccuaguggguaccguacucuucuuccugauacgaaagccugacuccgagaacguucuuggggaagaugagucaagugacgaucaggacauggaagugaaugagagcgcccaaaacaaucugacuaaagcggucgaugcauuuaagaaaucuuucaaguugugugugacaaaggagaugcuccugcuguccauuaccacggccuauacuggacucgaauuaaccuuuuucucaggcguguacggcacaugcaucggggcuacuaacaaauuuggagccgaggaaaagagccugauuggucuuaguggcaucuucaucgggauuggagagauauugggcgguucucuguuugggcuacucuccaaaaauaaccguuucggaagaaauccagucguucugcuuggcauccuggugcauuuuauugcauucuauuugaucuuucucaacaugcccggcgacgcuccuauagccccaguaaaggggaccgauagcucggcguacauuaaaucuuccaaggagguggccauccuguguucauucuuacugggacucggugacaguugcuuuaauacacagcuucugagcaucuugggcuuccuauacuccgaagauucugcacccgcuuucgccauuuuuaaguucguccagagcaucugugcugccguggcauuuuucuauucaaacuaccugcuccugcacuggcagcuucugguuauggugauuuuuggguucuuuggaaccauaaguuucuuuacggucgagugggaagccgcugcguucguggcaaggggcuccgacuaucggagcaucuga

SEQ ID NO: 59004 - RNA, 1443 nt, Artificial Sequence
  derived and/or modified sequence opt3 from MFSD12__Homo_sapiens__NP_778148
augggccccgggccuccagccgcuggagcagccccgagccccagaccucugucccucguggcgaggcuuucuuacgcugucggucacuuccugaacgacuugugcgccucaaugugguuuaccuauuuacugcuauaccuccauaguguucgggcauauagcucccgcggcgccgggcugcuucuguugcucggacagguggcugauggccuguguacaccacugguagguuacgaggcagaccgagccgcuucuugcugugcccguuaugggcccagaaaggcguggcaccucgugggaacugucugcguguuacugucguucccuuuuaucuucucaccaugucuuggcugcggcgcagccacgcccgaaugggcugccuugcuguacuaugggccuuuuauuguuauauuccaauuuggaugggcaagcacccagaucagucaucuaucccucauuccagagcuggugacaaaugaucacgaaaaagucgagcuuacugcucugagguacgccuucaccgugguagcgaacaucacaguuuacggugccgcaugguugcuccugcauuuacagggcucuagccggguggaaccgacccaggacauuuccaucucagaucaacucgggggacaggacguccccguguuucgcaaucugagucuucugguggucggcguuggugcuguguucagcuugcuauuucaccuggggacuagagagaggcggcgcccucacgccgaggaaccaggagagcauacaccccuccuggcuccugccaccgcacagccacuucuguuguggaagcacuggcuccgagaacccgccuucuaucagguaggcauacuguacaugacgacuagauuaaucgugaaccugucucaaaccuauauggcuauguaccuaacauauucccuccaucugccgaaaaaguuuauugcgacuaucccucuugucauguacuugucaggcuuccugagcaguuuccucaugaaacccauuaauaaguguaucgggaggaacaugaccuauuuuucuggacugcuugugauacuggcauucgccgcuuggguugccuuggcagagggucucggcguggccgucuacgcugccgcagugcuguuaggggcgggaugcgcuacaauucugguaaccucccuagccaugacggcagaucucaucggcccacacacuaauagcggugccuuuguuuacgggucgaugucuuuccuggacaagguggcuaacggccuugccgucauggcaauucaguccuugcacccuugucccucagagcugugcugucgggcuugcgugaguuuuuaucauugggccauggucgcggugacaggaggcguugggguggccgcugcacucugccuguguagcuuacugcuuuggccaacccguuugcgcagaugggauagggacgcccggcccuga

SEQ ID NO: 59005 - RNA, 1545 nt, Artificial Sequence
  derived and/or modified sequence opt3 from MFSD1__Homo_sapiens__NP_073573
augggcguggcccugagagaccuccccgggaggcacgucagcucccggucucauguuaccgcugugcuuacaguauuccacggacgcugcuuucugccugguuucggcguggucacuacguuuccaucaccgagucccgcaggggccauggaggaagaggaugaagaggcgcgagcuuuguuagccggaggcccugacgaagcagaucguggugccccagcugcacccggggcccugccugcucuaugugacccaagcagacucgcccauaggcugcuugugcuguugcucaugugcuuccugggauuuggcuccuacuucuguuaugauaaccccgcggcacugcagacccaaguuaagcgggacaugcaagugaauacaacuaaauuuaugcucuuauacgccugguauucuuggccuaacgucgugcugugcuucuuuggcggguuccuuaucgaucgcguauuuggaauuagaugggguaccauaaucuucucguguuuuguuugcauuggccagguggucuucgcuuugggaggaaucuucaaugccuuuuggcugauggaguucggcagguuuguguucgguauugggggagagucacuagcaguggcucagaacacauacgccgucagcugguuuaagggcaaagaacucaaucugguuuucggccuucagcugaguauggcgcggaucggguccaccgugaacaugaauuugaugggauggcucuauucuaagauagaggcccuguuagguagcgcaggccacacuacacuggggaucacccucaugauuggaggcaucacguguauucuuucccugaucugcgcuuuggcccuagcuuaccuggaccagcgcgccgaacgaauacuccauaaagagcaggguaagacuggggagguaauuaagcugaccgaugugaaagacuuuucacuuccacugugguugaucuucauuaucugugucugcuauuacguggcaguuuuuccguucaucggccucggaaagguguuuuucacagaaaaauuuggcuucaguagccaggccgcuucugcgauuaacuccgucguguacguaauaucagcacccaugagcccuguuuucgggcuguuaguggauaagacugggaaaaauaucauuuggguccugugugccguggcugccacccuagucagucacaugaugcucgcauuuacaauguggaacccauggaucgccaugugccugcuugguuugucuuauucccugcucgcuugcgcccuguggcccaugguggcauucguugugccugagcaccaacuuggcaccgcguacggguuuaugcagagcauacagaaucugggauuggcuauuaucucgaucauugccggcaugauccucgacucuagagguuaucuguucuuagaaguauuuuucauugcaugugucucccugucacuacucagugugguucugcuuuacuuggugaacagggcccaagggggcaaucugaacuauagcgcucggcagcgugaggaaauaaaguuuucccauacggaguga

SEQ ID NO: 59006 - RNA, 2376 nt, Artificial Sequence
  derived and/or modified sequence opt3 from MFSD6__Homo_sapiens__NP_060164
auggccgacgauaagguggcuauccugaccgacgaugaggaagaacagaaaagaaaguacguccucgcagaccccuucaacggcauuagcagggaaccugagccaccguccaaugaaacacccucuucaacugagacgagugccauaccugaggaagagaucgauuggauugaaaaacacugcguuaagaucaacaaugaccuucugauuagcaaaguguuuuauuucuuuuucuacuccgcguaugggucuuuguacccauuacugcccguauauuacaagcaacuaggaaugucgccuucacagagcggucuccuggugggcauccgguauuuuauagaguucuguagugcuccauuuuggggagucguggccgaucgcuucaagaaagggaagaucguucuucuguuuuccuugcucugcugggugcuguucaaccugggcauugguuuugucaaacccgcaacccuccgaugugugccuaagauccguccaacaacucauccgaccaaugccucucaccaguuaacaauucugcccaccaacagcuccuucacuucauuucuuacaaucaguccuaaaaugagagagaagaggaauuugcuggaaacccggcuaaacguaagcgacacgguuacucucccaaccgcucccaauaugaacucugagccuacacugcagccacaaacuggggaaauaaccaaucgcaugauggaucuuacacugaacuccucaaccgcaacgcccgugagcccgggaagugucacuaaggagacaaccacugugauugugacaaccacgaaaucuuugccuuccgaccaggucaugcucguuuacgaucagcaggaaguggaggccaucuuccugguaauuuuaguggucgugaucaucggcgaguucuuuagcgcuucgucuguuaccauuguggacacagucacucugcaauaccucggcaagcauagagauagguaugggcuucagcggauguggggaucccuggguuggggcuuggccaugcuaucaguggggauaggaaucgacuacacccacauugaaguacugaucgacggcaaagguugcaagcccccagaguaucgcaauuaccagauaguuuucauuguguuugggguccucaugacaauggcgcugaucguggcaacucaguuccgauuuagauauaaccauuucaaaaaugaugacaguaagggaaaagaagucgagaucccucaaguggaaaggaacaacagcaccgaguccucugaggaaacacccaccacuacgagccacucacaggccuuuaauuucugggaucuuauuaagcuguuguguaguguucaguacggcuccgugcucuuuguagcuugguucaugggcuuuggguauggauucgucuuuacauuccuguacuggcacuuagaggaccugaacgguaccacuacccuauucggcgugugcagcguucucucucaugugucagaacugacagccuacuuuuucagucacaaacuuaucgaguugauugggcauauacggguccuguauaucggacucgcauguaauaccgcucguuacauuuauaucagcuaccuggaaaacgccuggacugugcuuccaauggagguacugcaaggcgugacacacgcggccaucugggcagcuugcauuuccuauuugucugccgcuguucccccugagcuccgcacgucggcccaggguauacugcagggguuacaccugggccuaggaagaggcuguggggcaaugaucggagguguccucgugaauuacuuuggcgccgcugcgaccuucagggggauuggaauggcaugccuggugauccuuuugcuguuugcccucauucaguggcuggcugucccagaugaagaggaagacaagacuauguuagccgagcggaucccgguucccagcuccccugugccaauagcaacaaucgaucuggugcaacagcagaccgaggacguaaugccccgaauugaaccucgccuuccacccaagaaaacaaagcaucaggaggaacaagaggaugucaacaaaccggccuggggcgugucaaguucuccuuggguuacuuucguguaugcuuuguaccagaucaaggaaaugaugcagcucaccagagacaauagggccagcgagauucagccacugcaagguacgaacgagaaucgggaaaacucccccgcagggcgcgcgcagccuguccccugugagacccacucagauccaagcagaaaucagccuucucccgacgcugccgcaucccagacacaaaccaguccagcccauccgagcguggacccuugcacugaagagucugaggagcagcaggcucaacuagccgcaggcggacacuga

SEQ ID NO: 59007 - RNA, 1683 nt, Artificial Sequence
  derived and/or modified sequence opt3 from MFSD7__Homo_sapiens__NP_001281270
auggccggccccaccgaggcugaaacagggcuggcagagccuagagcccucugcgcgcagaggggacaccggacuuacgcucgccgauggguguuccuucuggccaucagcuuguuaaacuguuccaaugcaacgcuguggcuaucuuuugccccagucgcugacguuauugcagaagaucucgugcugucaauggagcaaauaaacuggcuuagucugguauauuugguggucagcaccccguucgguguggccgcuaucuggauucucgacuccguuggccugcgugccgcgacaauccugggggcauggcucaauuuugccggaucuguguuaagaaugguccccugcauggugguaggcacucagaacccuuucgcuuuucugaugggugggcagucgcuuugugccuuggcacagucacugguuauuuucagcccagcuaagcuagccgcgcucugguuucccgaacaucaaagggccaccgcaaauaugcuggcuacaaugaguaacccucuuggagugcuggucgccaauguguuguccccagugcucgucaaaaagggcgaggauaucccccugauguuaggcguuuacaccauaccugcuggggugguaugccugcucucuacuaucugucuuugggagagcgugccaccgacacccccuuccgccggagcagccucaaguaccagcgaaaaauuccuggacgguuugaagcuacagcugauguggaacaaggcuuaugucauucucgcggugugccugggcgggaugaucggaauuucugcauccuuuucagcccuucuggagcagaucuugugugcuagcggccacaguucugguuucuccgggcucugcggagcccuguuuauaacguucggcauuuuaggcgcacuggcccuagggccauacguugaucggacuaaacauuuuaccgaagcuacaaagaucggacucugucuguucagccuugccugcgugcccuucgcauuggucucgcagcugcaaggucagacucucgcgcuggcugccaccuguucucuucugggcuuguuuggguucuccgugggaccuguagcaauggagcucgccguugagugcucauuuccagugggcgaaggugcugccacagggaugauuuucguccugggccaggcagagggaaucuuaaucaugcuggcuaugaccgcccuaacggugcgcagaagugaacccagccucuccacuugccagcaaggcgaggacccgcuggauuggacagucucucuuuugcugauggcggggcucuguaccuuuuucagcugcauucuggccguguuuuuccacacuccuuauaggcgguuacaggcugaaucaggagagcccccaaguacacgcaaugcaguugguggcgccgacuccgggccuggaguggaucgaggcggugcugggagagccggcguacugggacccagcaccgcaacgccagaguguaccgcgaggggcgccucucuugaagacccccgggggccuggaucaccacauccggcuugccaccgugccacaccccgcgcacaggguccugcugccacugaugcaccaaguagacccggcagguuggccgggcggguccaagcuagccgauuuauagacccugcgggaucccacucuucguucagcuccccaugggugaucaccuga

SEQ ID NO: 59008 - RNA, 1557 nt, Artificial Sequence
  derived and/or modified sequence opt3 from MFSD8__Homo_sapiens__NP_689991
auggccggccugagaaacgagagcgaacaggagccccuccuuggggacaccccuggauccagggaaugggauauccuggagacagaggaacacuacaagucucgguggcgcucaauucgaauauuguauuuaacuauguuccugaguagcguggguuuuuccgucguuaugaugucuaucuggccauaccuacagaaaauugacccgacggcugauaccucguuccucggcugggugaucgcaucauauagccuggggcaaaugguagccagucccauuuuuggacuuugguccaauuaccguccuagaaaggagccacugaucgugucuauauugaucagcgucgcggcuaacugccucuaugccuaccugcauauucccgcaucccacaauaaauauuacaugcugguggccaggggccucuuagguaucggggcuggaaacguugcagugguccggucauacacagccggcgcuaccagucugcaggaacgcacuagcucuauggccaauauuuccaugugucaggcgcuuggcuucaucuuggggccuguguuucaaacaugcuucaccuuucugggagagaaggguguaacuugggacguuauaaaacuacagauuaacauguauacaaccccagugcuccugucagcauuccuuggcauccugaauauuaucuugauccucgccauucugagagaacauagggucgaugacagcgggcggcaguguaagaguauaaacuuugaggaggcuucuacggaugaagcccaggugccccaaggaaauaucgaccagguggcagucguugcuauuaacguguuauucuuuguaacucuguucaucuuugcccucuucgagaccauaauuacaccucuuacuauggauauguacgcguggacccaggaacaggccgugcuguauaauggcaucaucuuggcagcucuaggugucgaggccgugguuauuuuccugggggugaagcuccuguccaaaaagaucggagaacgcgcuauucuucugggcggcuugauagucguguggguaggguuuuucauccuccugccauggggaaaccaauuuccgaaaauucagugggaggacuuacacaauaacagcauccccaauacaaccuucggugagaucauuauaggccuguggaagucgccuauggaagaugacaacgagcgaccaacggggugcucuaucgaacaggccuggugucuauacacucccguuauucaucucgcacaauuucugacauccgccgugcuuaucggauugggcuauccugucugcaaccugaugucauacacccucuauaguaaaauucuggguccaaagccccaggggguguacaugggcuggcuuacugcuagcggauccggcgcgagaauccuggggccgauguucauaucucaggucuacgcacacuggggaccuaggugggccuuuagcuuggugugugguaucauuguucucacaaucacccuguuaggcgugguauauaagcggcugauugcucuaucaguccguuacgggcgcauccaggaguga

SEQ ID NO: 59009 - RNA, 8571 nt, Artificial Sequence
  derived and/or modified sequence opt3 from MGA__Homo_sapiens__NP_001074010
auggaagaaaagcagcaaaucauucuggccaaccaggacggcgggaccguggcuggagcagcccccacauucuuugucauacucaaacagccugguaauggcaagacugaucaggggauccuuguuacgaaccaagacgcgugcgcucuggccuccuccgugucuucaccaguaaaaaguaagggaaaaauuuguuugccggcagauugcaccgugggcgguaucacagucacuuuagacaauaacagcauguggaaugaguucuaccaccgauccaccgaaaugauucugacaaagcaggggaggcggauguuucccuauugucgcuacuggaucaccggacuagauucuaaccucaaguauauacuggugauggacaucucgccuguugauaaucaccgauacaaauggaacggccguuggugggagccaucaggcaaggccgaaccccacgugcuugggagagucuucauucauccugagagcccaaguacuggacacuauuggaugcaucagcccguguccuuuuacaaacugaaguugacaaauaacacccucgaccaggagggucacaucauucugcacucuaugcauagguaucugccucggcuccacuuaguaccagcugaaaaagcaguugaggugauccaacugaauggcccggggguccauacguucacuuuuccccagaccgaguucuuugccgugacagcuuaccagaacauacagauuacucaacuuaagaucgauuacaauccuuucgccaagggauuucgcgacgauggcuugaacaauaaaccacagagagacgguaagcagaaaaacagcuccgaucaagaggggaacaauauuucaaguagcucuggacacagggugcggcugaccgagggccagggcuccgaaauccagcccggggaccuagacccucucucacgcggacacgagacaagcgguaagggccuggagaaaacaagucuuaacaucaagcgagauuuccugggguuuauggacacggauucugcguuguccgaggucccacagcucaaacaagaaauuagcgagugccugauagcaucgucuuucgaggacgauuccagaguugccucacccuuagaccagaauggaaguuucaacgugguaaucaaggaagaaccgcuggaugacuaugauuacgaacucggcgaguguccugaaggugugacugucaagcaggaggagacagacgaagagaccgauguguauagcaauuccgacgacgaucccauucuugaaaaacagcugaagaggcauaacaaaguugacaauccagaggcugaucacuugucuagcaaguggcuaccuucaagucccuccgggguggccaaagcaaagauguuuaagcuggacacuggcaaaaugccagucguguaccucgaacccugcgcuguaacacggagcaccguuaagaucucugagcugccugauaacaugcuuucaacgagucguaaagacaagagcuccaugcuggccgaguuggaauaucucccaaccuacauagaaaauucuaacgaaacagcguucugucugggaaaagagucggagaauggcuuacgcaagcauagcccggaucugagagugguccaaaaguauccccuacucaaagaaccucaguggaaguacccagacauuuccgauucaaucaguacugagaggauccuggacgauucuaaagacagcgugggggauucccuuucaggaaaggaagacuugggucggaaacgaaccacaaugcugaagauugccacugcagcuaaggucgugaacgccaaucagaacgcuagccccaauguuccuggcaaacgcgggagaccaaggaagcucaaacugugcaaggccggacggcccccgaaaaacaccggcaagucucuuaucuccaccaaaaacaccccugugaguccagguagcacuuuucccgacguaaagccugaucuggaggacgucgaugggguguuguucguuucuuuugaauccaaggaggcacucgacauucacgccguggauggcacgacagaggaaucaaguagccugcaggcuucgaccacuaaugacuccggauaccgcgcgagaauaucucaauuagagaaagaacugaucgaggaucuaaagacccucaggcauaaacaggucauucaccccggccugcaggaaguggggcuuaaguugaacagcguagacccaacaaugucaaucgaucugaaauaucucggagugcagcugccuuuagcacccgccaccaguuucccauuuuggaaucugacugguacaaacccggcuuccccugacgccggcuuccccuuuguuucucguacggggaagaccaaugauuucacuaagaucaaaggauggcggggcaaguuucacagcgcauccgccucacgaaacgagggugggaauagcgagaguucucuuaaaaacagauccgcuuucuguagcgacaaguuggaugaauaccucgagaaugaaggcaaacugauggagacaucgaugggauuuucaucuaacgccccaaccagucccgucguguaucaacuaccuacaaaguccacuagcuacgugaggacccuggacucuguccucaagaaacagagcacgauuuccccaucaaccaguuauagccugaagccccauucuguuccuccggugucccgcaaagcaaagucacagaaucggcaagcgacauucaguggcagaacuaaaagcuccuacaagucuauacuuccauaucccgugucgccuaagcagaaauacagccacguaaucuugggggacaaggucaccaaaaacucauccggaauuaucagugaaaaucaggcuaacaauuucgugguuccaacacuggaugagaacauuuuucccaagcagaucucuuuaaggcaagcccagcagcagcaacagcagcagcaaggcagccgcccuccgggucucuccaaaucacaggugaagcugauggaccuugaggauugcgcacugugggaagggaaaccccgaacuuacauaaccgaggaacgggccgacgucucuuugacgacacuccugaccgcucaggccagccuaaagacuaagccaauccauacaauuauccguaaaagagcaccucccuguaacaaugauuucugcaggcugggaugcguguguaguucccucgcucuggagaagcgccaaccagcccacugccggagaccugacuguauguuuggcugcaccugucuuaaaaggaagguuguguugguaaaagguggcagcaagacuaagcacuuccagcgaaaagcggcccaucgcgaucccgucuuuuaugacacccugggggaggaagcucgggaggaagaggaaggaauuagagaggaggaagaacaguuaaaggagaaaaagaaaaggaaaaagcucgaguacacaaucugcgaaacggagccagagcagccggugcgucacuauccucugugggugaaagucgaaggcgagguugaucccgaaccaguguacauacccaccccuucuguaauugagccaaugaagccccuucugcuaccucaaccggaagugcucucaccaacugucaaagggaagcuguugacaggaaucaaaagcccccgcaguuauaccccuaagcccaacccagugauucgggaggaggacaaggauccuguuuaccuguauuucgaaagcaugaugacaugugcaagagugagggucuacgagaggaaaaaggaagaccagcggcagcccucgucuuccagcucaccaaguccuucuuuucagcaacagacuuccugccauagcucaccggagaaucacaacaaugccaaagagcccgacagugaacagcagccauuaaagcaacucaccugugaucuggaggacgauagcgacaaacuucaggaaaaguccuggaagucuagcugcaacgagggcgaauccucaucuacgaguuacaugcaucagcgcucgccuggugggcccacaaaacugaucgagauaaucagcgauuguaauugggaggaagacagaaacaagauuuuguccauccucucucagcacauuaauucaaacaugccacaaagccugaaagugggauccuucaucauagagcuagcuagucagaggaagucucggggcgagaaaaauccucccguuuauagcucacgagugaagauuuccaugccgaguugccaggaucaagacgauauggccgagaaaagcgguucugaaaccccagacggcccucugucccccgggaagauggaggauaucucaccaguccagacugacgcacuugauagcguaagagagcgccuccacggaggcaaggggcugcccuuuuacgcgggauugucgccugccggcaaacugguggcuuauaagaggaaaccgucuaguuccaccagcgguuuaauccagguugccucaaacgcaaagguggcugccucccguaaaccccggacacuccugccaucuacuagcaauaguaagauggcauccagcucugggaccgccacaaacagaccuggaaagaaucuuaaggcuuucguccccgcgaagaggccuauugaaaacgccgcacagaucccaguggcuacgccccaaguaucaccuaacaccgugaaacgcgccggcccacgacuguugcucauucccguccagcaggguaguccgacucugagaccuguuuccaauacacagcuacaaggccaucggauggugcugcagccagugaggagccccucugggaugaaccuuuuucgccacccuaauggacagauaguccagcuccugccauugcaucaauuacguggcucgaacacccagcccaaucugcagccggugauguucagaaacccugggucaguuaugggaauccggcuccccgccccaagcaagccuuccgagacucccccaaguucuacaagcuccucagcuuuuaguguaaugaaucccgugauucaagcagucggcucuagcuccgccgugaacguuaucacccaggcgccuucacugcuuagcucuggugcuuccuucgugagucaggccgggacgcugacuuugaggauuagcccaccggaaccccagucguucgcauccaaaaccggaucugagacaaagaucaccuacucaagcggcggccaaccugucgggacugccagucuaauaccacugcaguccggaucuuuugcucuccugcagcuucccggucagaagccugugccaagcucaaucuuacaacacguagcaucccugcagaugaaacgcgaaagucagaaucccgaccagaaggacgagacaaacagcauuaaacgagagcaagaaaccaagaaaguccuccagucugagggcgaagccguggauccugaggcgaauguuaucaagcagaacucaggggcugccacauccgaggaaacuuugaaugacagccuggaggauagaggagaccaucucgaugaagagugccugccggaagagggcugugcaaccgugaagccaucugagcacaguugcauuacggguucgcacacagaccaggauuauaaagacgucaacgaagaguacggggcccggaauaggaaguccagcaaagaaaagguggcuguucuugaggugcgcaccaucucagaaaaagccucuaacaagacuguccaaaaucugagcaaagugcagcaucagaaguugggagauguaaagguggagcaacagaaaggcuucgacaaccccgaggaaaacuccagugaguuuccuguuaccuucaaggaagagucaaaauuugaacuaucuggcagcaaggucauggagcagcaguccaaucugcaacccgaggcaaaagaaaaggaguguggggauagucucgaaaaggacagagagagguggcggaaacacuuaaagggaccacugacacguaaaugcgugggugcuagccaggaguguaagaaagaagccgaugagcagcuuauaaaggaaacuaagaccugccaggagaacuccgacguguuccaacaggaacagggcauuucugaccugcucgggaaaucaggaaucacggaggaugcgcgcgucuugaagacagagugugacagcuggucgcgaaucuccaauccuagugccuuuucuauuguacccagaagggcagcuaaaagcucacggggcaacggucauuuccaggggcaucugcuccugccaggagaacaaauacagccgaagcaggagaaaaagggcggccgcuccucugccgauuuuaccgugcuugaccuagaagaggaugacgaagaugacaaugagaagacugaugacaguaucgaugagauuguugacguggucagcgacuaucaauccgaagagguggaugacguugagaaaaacaauugcguggaguacaucgaagaugacgaggagcacgucgauauugaaacaguggaggaacugucagaggagaucaacguagcucauuugaagaccacugcagcccacacacagagcuucaaacagccuucuuguacccauauaagugccgacgaaaaggcugcggagagauccaggaaagcacccccaauccccuuaaagcugaaaccugauuacuggagcgacaagcuccagaaggaagccgaggcuuuugccuauuaccggcgaacgcacacugcaaaugaaagacgcaggcguggggaaaugcgggaucuguucgagaaacuuaagauuacccugggacucuugcauucaucuaaaguguccaagucgcugauccuaacaagagccuucagcgaaauucaaggucugaccgaccaggcugauaaacucaucggccagaagaaccuucugacaaggaagcgcaauauauuaauucggaaaguuaguucuuuguccgggaagacugaggaagucgugcugaaaaagcucgaguauaucuacgcgaaacagcaagcccuggaagcacagaagcgaaagaaaaagaugggaagcgacgaguuugauaucucaccaagaauuaguaaacagcaggagggcuccagcgcuucuucaguggaccuuggucaaauguucaucaacaauaggcgcgggaagccccugauacucagccggaaaaaggaccaggccaccgaaaacacguccccuuugaauacaccgcacacuucugcaaaccuggucaugaccccacagggacaauuacuaacacugaagggcccccucuuuaguggcccuguuguggccguaucgccagaucuucuggagagcgacuugaaaccccagguggcuggguccgccgucgcgcugccugaaaacgaugaccucuucaugaugcccagaauugugaauguuaccucacuggcaacugagggaggucuuguggauaugggcgggucuaaguauccacacgaagucccggacagcaaaccuagugaucaucucaaggacaccguacguaacgaggauaauucccuggaggacaaaggaaggaucucaucucggggcaaccgcgauggucgagugacauuggggcccacgcagguuuuucuggccaauaaggacagcggauacccacagauuguggacgucuccaacaugcaaaaggcucaggaguucuuaccuaaaaagaucaguggcgauaugagaggcauacaguauaaauggaaggagagcgaaucuagaggggaacgggugaaaucaaaggacuccagcuuucacaaacuaaagaugaaggaucugaaagacaguucuauugagauggaacuccgcaaggucacuuccgccaucgaggaagcugcacuugauucgagcgagcuguugaccaauauggaagacgaggaugacacagaugagacccugacuucacuccugaacgaaaucgccuuccuuaaucagcaauuaaacgacgauuccgugggacuggcugagcuccccucuaguauggacacagaauuuccaggugaugccagaagggcauucauuagcaaaguuccucccggcucacgagcgaccuuucagguggagcauuuggggacgggacugaaggaacuaccggacguacagggcgaguccgacagcaucucuccacugcuccuucaccuggaggaugacgauuucagugaaaaugagaaacaguuggccgaaccugcuuccgagcccgacgugcugaagauugucauagauagcgaaaucaaggacucacuccugucuaacaaaaaggccauugauggugggaaaaauacuucgggcuuaccagcagagcccgagagcguuuccaguccuccgacacuucacaugaagaccggacuggaaaacucuaauucaaccgacacucucuggcggccaaugcccaaacuagcuccucugggcuugaagguggccaaccccagcuccgaugcagacgggcaaagucugaaggucaugccaugccucgccccuaucgcugcgaaagugggaucuguaggucauaagaugaaccuuacaggcaaugaucaggaggggcgugaaagcaaagugaugcccacccuggccccaguuguggcaaaguugggaaacuccggcgcuucaccuagcucugccgguaaauga

SEQ ID NO: 59010 - RNA, 5574 nt, Artificial Sequence
  derived and/or modified sequence opt3 from MGAM__Homo_sapiens__NP_004659
auggcccgaaagaaacugaagaaauucaccacacucgagaucgugcuuagcguccuguuguuaguucuguuuauuauauccaucgugcugauugugcuccuggcuaaggaaucucuuaaaucaacugcacccgacccuggcacgaccgggacaccagauccggggacuaccgguacacccgacccuggcaccacugggacaacccacgccaggacgacuggaccacccgauccuggcaccacagguacuaccccagugagugcggagugccccgucgugaaugaacuggagcggaucaauuguauuccugaccagccaccgacaaaggcuaccugcgaucaacgcggguguugcuggaacccccagggagccguuagcgugccuugguguuacuauuccaagaaucauucuuaccacgucgaaggcaacuuggugaauacgaacgcaggcuucacugcccgacucaaaaaucugccaucgucacccguauuugggagcaacguugacaaugugcugcucacagcugaguaucagaccaguaaccguuuccauuuuaaguuaacugaucagacaaauaacagguucgaggucccucacgaacaugugcaauccuuuucuggaaaugcagccgcuagccugaccuaccagguggagaucuccaggcagccauucucaauaaaagucacgcggcgcaguaacaauagaguucuuuuugacagcucuaucggucccuugcuguucgccgaucaguuucuucaacucuccaccaggcugccgucaacaaacguguauggccuuggggaacacguacaccagcaguaccggcaugacaugaacuggaagacuuggccuauuuucaaucgcgauaccacacccaacggaaauggcacuaaccuguauggugcgcagaccuuuuucuugugccucgaggacgcaagcgggcugaguuucggaguguuuuuaaugaacucuaacgccauggaggucgugcugcaaccagcuccugccaucacauaccgaaccauuggcggcauccucgauuucuacguuuuucuugggaauacucccgaacaggugguccaggaguaucuggaauugauaggaagaccagcacuacccuccuacugggcucuggguuuccaccucagcagguaugaguacggcacgcuggacaacaugcgggaagugguagagcguaaucgcgccgcgcaacuuccuuaugacguucagcaugccgauauugacuacauggaugagagaagggacuuuacauaugauucgguggacuucaaaggguuuccagaguucgucaacgagcugcacaauaacggacagaaguuggugaucauugucgauccggcaaucucuaauaacuccucaaguagcaagcccuacggcccuuacgaccgggguuccgauaugaaaaucuggguaaauucuagcgacgggguuaccccacucauuggcgaaguguggcccggacagacuguauuuccugauuauaccaacccaaacugugcugucugguggacaaaggaguucgaacuguuucacaaucaaguggaguucgacggcauauggaucgacaugaacgagguuucaaauuuuguggaugggagugucuccggaugcagcaccaacaauuuaaacaaucccccguucacuccucgcauucuggacgguuaccuauucuguaaaacacucugcauggaugccgugcagcauuggggcaagcaguaugacauccacaaccuguacggguauucuauggcuguagccacggcagaagccgcuaaaaccguguuuccaaauaagagaucauucauacuuacuagaaguacauuugcgggaagcggcaaauucgcagcccauugguugggugauaacaccgcuacaugggacgaucugaggugguccauucccgggguucucgaguuuaaucuguucggcaucccuauggucggacccgacaucuguggcuuugcccuugauacuccagaagaacugugccggcgcuggaugcaguugggggcauucuacccuuuuucuagaaaccacaauggacaagguuauaaggaccaggaucccgccucguucggcgcugacagccuccuguuaaacuccucaaggcauuaccugaauauucguuacacccuacucccauaucuguacacgcuauuuuuccgggcccacagucgaggggauaccguggcaagaccguugcugcacgaauuuuaugaggacaacucuacaugggacgugcaucagcaguuccucuggggaccuggccuguuaaucacucccguccuggaugagggugcggaaaagguuauggcuuacgugccagacgccgugugguaugauuacgagaccgggagccaaguaagguggcgcaaacagaaggucgaaauggagcuucccggcgacaaaauuggauugcaccuccggggcggguauauauucccuacacagcagccaaacacuaccacgcuggcauccagaaagaauccccuaggacugaucauugcccucgaugagaacaaagaagcuaagggcgagcuguuuugggacaauggugaaacaaaggauaccguggccaacaaaguuuaccuuuugugcgaguucucagugacucaaaauaggcuggaagucaacaucagccagucuacauacaaggacccuaauaacuuagcauuuaaugagaucaaaauucucgggaccgaggaaccguccaacgugacuguuaagcauaauggagugccaagucagaccagccccacaguaacguaugauucuaaccugaaagucgcuauaaucaccgacauugaucuucuguugggcgaggccuacacuguggaaugguccaucaagauucgcgacgaggaaaagaucgauuguuauccugacgagaauggugcgucagccgagaacugcacagcucgaggcuguauaugggaagcaaguaauagcucgggggugccauucugcuacuuugucaacgaccucuauuccguuucugaugugcaauacaacagccacggagccaccgcugacaucucacugaaaaguuccguauaugccaaugcauuccccucuacaccugugaacccgcuacggcuggaugucacuuaccacaagaaugagaugcuccaguuuaaaauuuacgaccccaacaagaaucguuaugaagugccaguuccucugaacauccccagcaugccauccucaaccccugagggccagcuuuacgauguguugauuaaaaagaaucccuucgggaucgaaauaagaagaaagagcacgggaacaauuaucugggacagucagcuguuaggcuuuaccuucucugauauguuuauucgcaucuccacucggcucccaagcaaauaucuguacgguuucggggagaccgagcauagaucguauaggcgagaccuugaauggcacacauggggaauguucucacgcgaucaaccgccuggcuacaagaaaaacucuuaugguguccaucccuacuacaugggccuggaggaagacgggagugcgcacggagugcuacuccuaaauuccaacgccauggauguuacuuuucagccauugcccgcucugaccuaucggacaacgggcgggguguuagacuucuacgucuuucucggaccuaccccagagcugguaacucagcaguauacagagcuuauaggcagacccgugaugguuccuuacuggagccuggguuuccaauuguguagguauggguaccagaaugacucugaaaucgccagccucuaugaugagaugguggcagcucagauuccguacgacguccaguacuccgauaucgacuauauggaacgucaacuggauuuuacccuaucaccaaaguucgccggauuucccgcacugauuaaccgcaugaaagccgacggcaugcgggugauccuuauacucgauccugcuauuagugguaaugagacucagcccuacccagcguucacaagaggcguagaagacgauguguuuaucaaguauccuaacgacggggauaucgucuggggaaaaguuuggcccgacuucccagaugugguggucaauggcagccuggacugggacucucagguggaguuguacagggccuauguugcauuuccugauuucuuucgaaacuccaccgcuaagugguggaagcgggagauugaggaacuguacaauaacccgcaaaaccccgaacgcucauuaaaauucgacgggauguggaucgauaugaaugagccaaguagcuucguaaacggagccguguccccuggcugcagagacgccucucucaaucaucccccauauaugccucaccuggaaucgagggaucggggucuuagcucaaagacgcuguguauggagucccagcagauuuugcccgacgggagucucguccagcacuacaacgugcauaaucuguacggauggucucaaacucgaccgaccuaugaggcuguucaggaagugacaggccagagaggcgucgugauaacccgcagcacuuuuccauccucagggaggugggcaggacacuggcuaggugauaacacagccgcgugggaccagcugaaaaagucuaucauuggcaugauggaguucagccuuuuugggaucaguuacaccggagcugauauuugcggcuucuuucaagacgccgaauaugagauguguguacguuggaugcagcucggugcauucuacccuuuuucccggaaucauaacacaaucgggacuagaaggcaggaucccgucagcugggacguggccuucguuaauauaucucgcaccgugcugcagacgcgauauacauuguuaccauaccuguauacccucaugcacaaagcucauacugaaggagucaccgugguuagaccccugcuucacgaguuugugucagaucaagucacaugggacaucgacucccaguuccuguugggcccugcauuucuagugaguccgguacuggagcggaacgccaggaaugugacugcguacuucccccgcgcucguugguacgauuauuacaccggcguugacauuaacgccagaggggaauggaagacgcucccagcaccucuggaucacaucaaucuucauguccggggagguuauauuuuacccuggcaggagccugcccugaacacacaccucagcaggcagaaguuuaugggcuucaaaaucgcuuuggacgaugaagggaccgccggaggcuggcuguucugggacgauggucaaucgauagacacuuacgggaagggacucuauuaccuggcaucuuuuuccgcuagccagaauacaaugcagucacauauuaucuucaacaacuauaucaccggcacuaauccacuuaaacugggcuacauugagauauggggagugggaagugugcccgucacaucuguauccaucagcgugucagguaugguuauuaccccuaguuuuaacaaugauccaacgacucaaguguugagcaucgacgucaccgaucgcaacauuucccuacacaauuucacaucucugaccuggaucagcacacucuga

SEQ ID NO: 59011 - RNA, 723 nt, Artificial Sequence
  derived and/or modified sequence opt3 from MGARP__Homo_sapiens__NP_116012
auguaccugagaagggccgugagcaagacccucgcacuuccccugcgggcuccuccaaacccggcccccuugggcaaagacgcguccuuacgccgaaugucuucaaaucguuucccugggaguagcggauccaacaugaucuauuaccuggucguuggugugacaguaucugcuggcggguauuacgccuauaagacugugacgucggaucaggcaaaacacaccgagcauaagacaaaucuaaaagaaaagacuaaggccgagauucacccauuucaaggagaaaaagagaacgucgcugaaaccgagaaggcaucaagcgaggcccccgaggaacucauaguggaagcugagguuguggacgccgaggaaaguccuuccgcgacagucgugguaaucaaagaggcaucugccugcccaggccauguugaagcugcccccgagaccacugcagugagcgcugaaacagguccugaggucaccgaugccgcggccagagagacgacugaagugaauccagagaccacaccggaagugacuaacgcagcucuggacgaggccgucaccauugauaaugacaaggauacaaccaaaaacgaaacguccgacgaguacgcugagcuugaagaggaaaauucacccgccgagagugaaagcucugcaggggaugaccugcaggaggaggccuccguuggaucagaagcugcgagcgcacagggcuga

SEQ ID NO: 59012 - RNA, 1338 nt, Artificial Sequence
  derived and/or modified sequence opt3 from MGAT1__Homo_sapiens__XP_011532865
augcugaagaaacagagcgccggccucgugcuuuggggagcuauccuguucgucgcauggaacgccuuguuacugcuauuuuucuggaccagacccgcgccuggaaggccaccguccguuucugcucucgacggugaucccgccucacugacacgggaggugauucgccuugcacaagacgccgaaguagagcuggaacgacagcguggcuugcuccagcagauaggggaugcucugaguagccaaagaggaagggugccuacugcagccccacccgcucagccucgggucccagugacgcccgccccugcgguuaucccaauucuggugaucgcaugcgaccgcuccaccgucagaaggugucucgauaaguuacugcacuaccggccgucugccgagcuuuuucccauuaucgugucgcaggacugcggccaugaagagacagcucaggccauagcaucauaugguagcgcuguaacucacauccgccaaccugauuugaguuccauugccguuccacccgaccaucgaaaauuccagggguacuauaagaucgcgagacacuacaggugggcccugggacagguguuucggcaguuccguuuuccugcagcugucgugguggaggaugaccuagaagucgccccagauuucuuugaguauuuccgcgcuaccuacccccuccugaaagccgacccgucucuuugguguguuagcgcauggaaugauaacggcaaggaacaaaugguggacgccuccagaccugagcuguuguauaggacagacuuuuuccccggccucggguggcuguuacuggcugagcucugggcggaacuugagccaaaguggccuaaagcauuuugggaugacuggaugcggcgacccgaacagcgccaggggagagccugcauuaggccagagaucucacggaccaugacuuucggucgcaagggcguaagucaugggcaauucuuugaucagcaccugaaauucauaaaguugaaucagcaguuugugcacuucacacaacuagaccugagcuaccuccagagagaggcuuacgauagggacuuucuggcccgugucuauggagcaccccagcuucagguggaaaaaguucggaccaacgaucgaaaggagcugggcgaagugagaguccaauacacggguagggacucuuucaaggccuuugcuaaagccuugggggugauggaugaccucaaguccggaguaccucgcgcaggcuaucggggcauuguuacuuuccaguuuagagggaggcgcgugcaucuggcgccaccguuaaccugggagggauacgaucccucauggaauuga

SEQ ID NO: 59013 - RNA, 1344 nt, Artificial Sequence
  derived and/or modified sequence opt3 from MGAT2__Homo_sapiens__NP_002399
augagauucaggaucuacaagcggaaagugcugauucucacccuugucguugccgcuugcggcuuugugcuguggagcuccaacgggcgccagcgaaagaaugaggcauuggcgcccccuuuacuggacgccgaaccagcucguggagccgguggcagagggggagaucacccgucuguagcagugggcauaaggcgggucucaaacgugagugccgcuagccuaguucccgcagugccucaaccagaggccgacaaucucacacugcgcuauagaucccuugucuaccagcugaacuucgaucagacuuugaggaauguggacaaagcugguacgugggcgccccgggaacucguacugguugugcagguccauaaccgcccugaguaucugcgacucuuacuggauucucuuagaaaggcccaagggaucgacaauguguuggugaucuuuucgcacgauuucuggucaaccgaaauuaaccagcugauugcaggagucaauuuuuguccaguucuacagguguucuuucccuucagcauccagcucuacccuaacgaguuuccaggcagugacccgagggauugcccccgggaccugccuaaaaaugccgcucuuaagcugggcuguauaaacgccgaguauccagauuccuucgggcauuaccgugaagcaaaguuuucucaaacaaaacaccauuggugguggaaguugcacuucguaugggagcgcgugaaaauccucagagacuaugcuggacugauuuuauuucuggaagaggaucacuaccucgcccccgacuucuaccaugucuucaagaaaauguggaaacuuaagcagcaggagugcccugaaugugacgugcugagcuuggguacuuauuccgcgucaaggaguuuuuacggcauggccgauaagguugacgugaagaccuggaaaagcacagagcacaauauggggcuagcacugacccggaacgcuuaucagaagcucaucgaaugcacugauacauucuguaccuacgacgauuauaauugggacuggacgcugcaauaccuuacugucucuugccugccaaaauuuuggaagguguugguaccccagauuccgcgaaucuuccaugccggagauuguggcaugcaccacaaaaagaccugccgcccuuccacacagucagcucaaauagagagccuccugaacaacaauaagcaguauauguuucccgaaacuuuaaccauuagugagaaauucacaguuguggccaucucuccaccuagaaagaacgguggguggggagacauuagggaucaugagcuguguaaauccuaccggcgccuacaguga

SEQ ID NO: 59014 - RNA, 1602 nt, Artificial Sequence
  derived and/or modified sequence opt3 from MGAT3__Homo_sapiens__NP_001091740
augaagaugagaagguacaaacuguuccucauguuuugcauggccggccuuugucugaucagcuucuugcacuuuuucaagaccuuauccuaugugacauuuccccgggagcuggcuucucuaucaccuaaccucgucaguagcuucuuuuggaauaacgcaccaguuacuccgcaggccucccccgaaccugggggaccagaccugcuucgcacgccccuguacucucauucgccuuugcuccaaccacugcccccuucaaaagcggcugaggaacugcaccgaguggaucucguauuaccagaggacaccacagaauauuucgugcguacuaaggccgguggcgucugcuuuaaaccggggaccaagaugcuggagagacccccuccaggaaggcccgaggaaaagccugagggcgcaaaugguagcagugcccggcgcccacccagauaccuuuuguccgcuagggaacggacagggggacgcggcgcacgaagaaaauggguggaguguguuugccugccgggcuggcaugggccuucuuguggagugcccaccgucgugcaguauagcaaccuaccaacuaaggagaggcucguaccucgggaaguuccccgucgcgugauuaaugccauaaacgucaaucacgaguucgaucugcuugacgugagauuucaugaacugggugauguggucgacgcuuucguugugugcgaguccaacuuuacagccuacggcgaaccaaggcccuugaaauuccgggagaugcucaccaaugggacguucgaguauauccgacacaagguacuguacguguuuuuagaucacuucccuccaggaggccgccaggacgguuggauugcggaugacuaccugagaacuuuucucacccaggauggggucucaaggcuucggaaccugcgcccggacgauguguucaucauugacgacgcagaugaaauccccgccagagacggaguuuuguuucuaaaacuguaugauggcuggacagagccuuucgcuuuucauaugaggaagagucucuacggcuucuuuuggaagcaaccagggacucuggaaguggucagcggauguaccguggacaugcuucaggccguauauggucuggauggcauacguuugcggcgaagacaguacuauacaaugcccaauuucaggcaguacgagaaccgcaccgggcacauccucguucaauggucucugggauccccuuuacauuuugcaggcuggcacugcucaugguguuucacgccagaagguauuuauuuuaaacuggugagcgcucagaauggggacuucccccgguggggcgauuacgaggacaagagagaucuaaacuacaucaggggacucauucgcacuggcgggugguucgacggaacacagcaggaguauccgccugccgauccaagugaacacauguacgcgcccaaauaucugcuuaagaauuacgaccgauuucauuauuugcuggacaacccuuaccaagagccccggucuaccgccgcugguggcuggcgucacagagggccagaaggaaggccucccgcacgcggcaaacucgaugaggccgaagucuga

SEQ ID NO: 59015 - RNA, 1272 nt, Artificial Sequence
  derived and/or modified sequence opt3 from MGAT4A__Homo_sapiens__NP_001153626
augaacuacagcaucaccguguccauugucaugggcauacccacaguuaagagagaggugaaaucuuaucugaucgaaacucuccacucacuuauugacaaucuguacccugaggaaaaguuggauugcguaaucguggucuucauuggggagacggacaucgauuaugugcauggaguuguggccaacuuagaaaaagaguuuaguaaggagauaagcuccggucuggucgaagugaucucuccaccggagucguacuaucccgaccuaaccaaucucaaagaaacauucggcgauucaaaggagaggguacgguggcgcacuaagcagaaccuggacuacuguuuucuuaugauguaugcucaagagaaagggauuuacuacauccagcuggaagaugacauuaucguuaagcagaauuauuucaacaccauuaaaaauuuugcauugcagcucagcagugaggaauggaugauacuggaguucucccaacugggauuuaucggcaagauguuccaggccccugaucucacauuaauuguggaauuuaucuucauguuuuacaaagagaagccaaucgacuggcugcuugaucacauuuugugggucaaggugugcaaccccgagaaagacgcgaagcauugugaucgacagaaagcuaaucugcguauaagauucaggccuucucuauuucagcacgugggucuccauagcucccugucagggaagauccaaaaacuuaccgacaaggacuauaugaaaccacuguugcucaagauucacgucaaucccccugccgaaguuaguacuagccugaagguguaccagggacacacauuagagaaaaccuauaugggcgaagauuucuucugggcaaucacgccaauagccggcgacuacauucuguuuaaguucgauaaaccgguaaacguggagucuuaucucuuucauuccgggaaccaggaacaccccggagacauccuucugaauacuaccgucgagguguugccuuucaagucagagggucuagaaaucagcaaagagacaaaggauaagcggcuggaagacggcuacuuucgcauugggaaauucgagaacggaguugcugaaggcaugguggauccaagucucaaucccaucucugcauuuagacuguccgucauucagaacagcgccgugugggcuauacuuaacgagcaaaggguauucucggguugguggcagaagucucgggacaaagccgaggggccucaggcgccacuguuguuuuga

SEQ ID NO: 59016 - RNA, 1647 nt, Artificial Sequence
  derived and/or modified sequence opt3 from MGAT4B__Homo_sapiens__NP_055090
augagacugaggaacggcaccuuccucacacuucuguuguuuugcuuaugugccuuccugagccuauccugguacgcugcacucucugggcagaagggagacguggucgauguuuaucaacgggaguuucuggcccuucgcgaccgacugcacgcggcugaacaggagucauugaaacguaguaaggaacucaaucuggugcuggaugagaucaaaagagccguaagcgaaaggcaggcacuccgggacggugauggcaaccgcacuugggggagauuaacggaggaccccaggcugaagccuuggaauggaucccaucggcacgugcuucauuugccaaccgucuuccaccaucugccgcaccuacucgccaaagagucuucgcugcagcccgcugugcgcguuggccaaggucgaacaggggugucagucgugaugggcauuccuagcguaagaagggaaguucacaguuaccuuacugauacccugcauuccuugauaucugagcucagcccacaggaaaaggaggacuccgugaucgucgugcugauugcagagacagauucacaguauaccagugccgugacugaaaacaucaaggcuuuauuucccacagagauucacagcggacugcucgaagucaucucuccuuccccacauuucuaccccgacuuuucacggcuucgugagagcuucggcgauccuaaagaacgcguuagauggaggaccaagcagaaucuggacuauugcuuuuugaugauguacgcccaaaguaaagggauauauuacgugcagcuagaggaugacaucguagcgaagccaaacuaccugucuacgaugaaaaauuucgcacuccagcagccguccgaggacuggaugauucuggaauuuagccaacuuggauucaucgguaagauguuuaagucgcuggauuugucucucauuguggaguucauccugauguucuaucgggacaaacccauagauugguuacuggaccacauucuaugggucaagguguguaacccugaaaaagaugccaagcacugcgaccgacagaaagcuaaucuccgcaucagauuuaagccaucccuguuccagcauguuggcacucacucaagucuugccgggaaaauucaaaaguugaaggauaaagacuuuggaaagcaggcacugaggaaagagcaugugaaucccccugcugaagucagcaccucccucaagacauaccagcacuucacucuggagaaagccuaucuucgggaggacuuuuucugggcguuuaccccagccgcaggcgauuucauccgcuuuagauucuuucagccccugagguuggaacguuucuuuuuccggucugguaacaucgagcauccggaagauaaguuauucaacacaagcguggagguacugccuuuugacaauccccaaucagacaaggaagcucuccaggaggggcgaaccgccacgcugagauacccaaggaguccugauggauaucuacagauuggcuccuucuacaaaggcguugcugagggggaaguggaccccgccuuuggaccacucgaggcacugcgccuuagcauacagacugauucucccgucugggugaucuugucagaaauuuuccugaagaaagccgacuga

SEQ ID NO: 59017 - RNA, 1437 nt, Artificial Sequence
  derived and/or modified sequence opt3 from MGAT4C__Homo_sapiens__NP_037376
auguucaaguuucaccagaugaaacauaucuucgagauucuggacaagaugagaugccucaggaaacggagcaccguguccuuucuuggcguccugguuauauucuuguuauuuaugaaccuguacaucgaagauucuuaugugcuagagggggacaagcaacucauucgcgaaacaucaacucaccagcugaauagugagcgauacguacauacguucaaagaucuuagcaacuuuuccggagccaucaaugugaccuaucguuaccuggcugcaacacccuugcagagaaagagguaucucacuauuggucugucuucggucaagcggaaaaagggcaacuaccugcucgaaaccaucaaaucaauauucgagcagagcaguuaugaggaauuaaaggagaucuccgugguugugcaccuggccgacuuuaauucuagcuggcgcgaugcgaugguccaagacauuacacagaaauucgcucaucacaucauugccgggagacuuauggugauccacgcaccugaagaguacuacccaauauuggauggacugaagaggaacuauaaugacccggaggaucggguaaaguuucgcuccaaacagaacguugacuacgccuuccuacucaauuuuugugcuaacaccucagauuauuacgugaugcuggaagacgauguccgaugcaguaagaauuuccuuacugcaauuaaaaaggugaucgccagccuggagggcacauauugggugaccuuggaguucucuaaacucgguuacauugggaagcuguaucauucccacgacuuacccagacuggcucauuuucuccuuauguucuaccaggaaaugccuugugacuggcuguugacgcacuuuaggggacuacuggcccagaaaaacgucauccgguucaagccaucacucuuucaacacaugggcuacuauagcaguuacaagggcacugaaaauaaacugaaggaugacgauuucgaggaggaaucuuuugacauccccgauaacccuccagcgucccuuuauaccaauaugaacguuuucgagaacuacgaagcaagcaaagccuauucgucuguggacgaguacuuuugggggaagcccccuuccacaggagauguauucgugauugucuuugaaaauccaauaaucauuaaaaagaucaaggugaacacugguaccgaggaccgucagaaugauauacugcaucacggcgcuuuggacguuggggagaacgugaugccgucaaaacagcgcagacaaugcaguacauaucucaggcugggagaguucaagaauggcaacuuugaaaugagcggugucaaucagaaaauucccuucgauauccauuguaugcggaucuacgugaccaagacgcagaaagaaugguuaauuauccgauccauuucuauauggacuagcuga

SEQ ID NO: 59018 - RNA, 2379 nt, Artificial Sequence
  derived and/or modified sequence opt3 from MGAT5B__Homo_sapiens__NP_001186101
augaucaccgugaaccccgacggcaagauuauggucagaaggugccugguuacacuccggccuuuccgccuuuuugugcuggggauaggauucuuuacuuuguguuucuuaaugacgagccuggguggccaguuuuccgcccgacgucuaggggauucuccauucaccaucagaacagagguaaugggaggcccggaaucaaggggugugcuccggaaaaugagugaccugcuugagcugauggucaagcgcauggaugcuuuggcaagacucgaaaauagcuccgagcugcacagggccgggggagaccugcauuuucccgcggaucggaugccuccaggcgcuggccucauggaacgcauucaagccaucgcacagaacgugucugacauugccguuaaaguggaucagaucuuacgacacucgcugcuuuugcauucaaaggucagcgaggggagaagggaccagugcgaggcucccagugauccuaaauucccagacuguuccggaaagguggaauggaugcgggcacguuggacuucugaucccugcuacgccuuuuucgguguagacggcaccgaguguagcuuucugauauaucuauccgaaguugagugguucugcccuccacucccguggcgcaaucaaacagcugcccagagagcgcccaagccucugccaaaagugcaggcagucuuuaggucaaaccuuagucaccuguuggaucucauggggagcggaaaggagucucugaucuucaugaaaaagcggaccaaacgauuaacugcccagugggcucuggccgcacaacgccucgcucagaagcugggcgccacacagagagaccagaagcaaauucuggugcauaucgguuucuugaccgaagaguccggggacguguuuucacccaggguccuaaaaggaggcccucugggcgaaaugguucagugggcggauauucucacggcccuguacgugcuugggcacggacugcggguaacugugagcuugaaggagcuccagaguaaucugggugucccacccggccgcgggucuuguccguuaaccaugccucugcccuucgaccuaaucuauacagauuaccacggacuccaacagaugaaaagacauaugggccuguccuuuaagaaauauaggugccguauacgggugauugacacuuucgguaccgaaccagcauacaaccacgaggaguaugcuacacuucauggguaccgaaccaauuggggcuacuggaacuugaauccuaagcaguuuaugacgauguucccccacacuccagauaacagcuuuaugggauucguuucggaggaacugaaugaaacagagaaaagacucaucaagggcgggaaggccucuaacauggcuguggucuauggaaaagaagccuccauuuggaagcugcaggguaaagagaaguuucuuggcauccugaauaaauacauggagauccacgggaccguguauuacgaaucacaaaggcccccugagguaccagcauucguuaagaaccauggauugcucccgcagcccgaauuucagcagcuguuacgcaaggccaaacuguucauuggcuuugguuucccuuaugaggggccagcuccccuagaagcgauagcaaauggcuguaucuuccuccaaagucgguuuagcccuccacacuccucucugaaccaugaguucuuuagaggaaagcccacuagcagggagguguucucacagcacccguacgccgaaaacuuuauuggcaaaccucaugucuggacaguggacuauaauaacagugaggaauuugaggcugccaucaaggcaauaaugcgcacccaggucgauccauaccuucccuacgaguauacgugcgaagggauguuggagcggauucacgccuacauccagcaccaagacuuuugucgagcuccugaucccgcccugccagaagcacaugcgccucagucccccuucgugcucgcuccaaaugccacccaccuggagugggcacguaacacaagccuggccccgggagcuuggccucccgcccaugcacugagagcuuggcuugccguuccagguagggcgugcacugauaccugcuuggaccacggccucaucugugaacccucuuucuucccuuuucuuaauucacaggacgccuuccuaaaauuacaggugccaugcgacaguacagagagcgagaugaaccaccucuaucccgcuuuugcacaaccugggcaggaauguuaccugcagaaggagccgcuuuuguucuccugcgccggaucuaauacuaaguaucgccggcuguguccaugcagagauuucaggaaaggccaaguagcuuuaugucaggguugccucuga

SEQ ID NO: 59019 - RNA, 2226 nt, Artificial Sequence
  derived and/or modified sequence opt3 from MGAT5__Homo_sapiens__XP_011509505
auggcccuguucacccccuggaagcucagcucccagaaacuuggcuuuuuccuggugacauuuggguucaucuggggaaugauguuguuacacuuuacuauucaacagagaacgcagccugagucuucaaguaugcugagggaacagauacuagaccucagcaagcgguacaucaaagcucuggcagaggaaaaccgcaaugucguugaugguccauaugccggcgugaugaccgcguacgaccuuaagaaaacacuggcuguauugcucgauaacauucugcaacgaaucgggaagcuggaguccaagguggacaaucucgucgugaacggaacuggcaccaauucuacaaacucgaccacugccguuccgucauuaguggcacuggaaaagauuaaugucgccgauaucauaaacggugcucaggagaagugcgugcuucccccuauggacggguauccacauugugagggaaaaaucaaguggaugaaagauauguggcguagcgaccccugcuacgcagauuauggcguagacggcaguacauguuccuucuuuauuuacuugucugaaguugagaauuggugcccucaucugccauggagagccaagaaccccuaugaagaggcugaucacaauagccuagccgagaucaggaccgacuucaacauucucuacuccaugaugaagaaacacgaagaguuucgguggaugcgccugagaaucaggcggauggcggaugcauggauacaggccauuaagucacuugcugaaaaacagaaucuggagaagcgcaaacgaaagaaaguguugguccaucucgggcuguuaacgaaggaaaguggauucaagaucgccgagacugcauuuagcgguggcccucugggggagcucgugcaauggucugaccuuauuaccucccuguacuugcuaggacacgacaucagaaucucagcuagccuggccgaacucaaagagauuaugaagaaaguggucggcaacaggagugguuguccaacaguuggggaucggauaguggaacugaucuauauugacaucguaggacuugcgcaguucaagaaaacucugggcccgucuugggugcacuaccagugcauguugcguguccucgauuccuuuggcaccgagcccgaguucaaucaugccaacuaugcacagagcaaggggcacaagacaccuuggggaaaauggaaccugaauccacaacaguucuacaccauguuuccccauacgccugacaacucguucuuagguuuugugguugaacagcaccuuaauucuuccgauauacaccauauuaacgagaucaagcgccaaaaucagagucuaguguauggcaaagucgacaguuucuggaagaacaaaaagaucuaccucgauauuauccacacuuauauggaagugcaugcuacaguauacgggagcuccaccaagaauauuccaucuuacguuaaaaaccacggaauacugagcggcagagaccuucaguuuuugcugagggagacuaaacucuucgugggucugggguuucccuaugaaggcccggccccucuugaggcuaucgccaauggaugugcauuccugaaccccaaauuuaauccaccuaagucaaguaaaaacacagauuucuuuauuggcaagcccaccuugcgggaacucacgucccagcauccauacgccgaggucuucaucgggcgaccccacguguggaccgucgaccugaauaaccaagaggaaguggaggaugcuguuaaggcgaucuuaaaucagaaaauugaaccuuauaugccauacgaguuuacaugcgagggaaugcugcagcgcauaaacgcauucaucgaaaagcaggacuucugucacggucaagugauguggccgccccuaagcgcccuccagguaaaacuggcugagccuggccagucuugcaagcaggucugucaagaaucacagcuuauuugcgagccaucauuuuuccagcauuugaacaaagacaaggauaugcugaaauauaaggugacuugccagagcuccgaacucgccaaggacauccugguucccucuuuugauccuaaaaauaagcacuguguguuccaaggggacuuacugcuguuuucgugcgcaggagcccauccaagacaccagagggucugucccugccgggauuucauuaaaggccagguggcuuuguguaaggacugccucuga

SEQ ID NO: 59020 - RNA, 2592 nt, Artificial Sequence
  derived and/or modified sequence opt3 from MGEA5__Homo_sapiens__NP_001135906
auggugcagaaggagagccaagccacccuggaagagagagaauccgagcucucuucaaaccccgcugcaagugccggcgcgagccuugaaccuccagcugccccggcacccggggaggacaauccugccggagcugguggcgcagccgucgcuggggccgcgggaggcgcaaggcgguuccugugcgguguuguggagggguuuuacggacgcccauggguaauggaacagcgaaaagaguuguuccguagauuacagaagugggaacugaacacauaucuauacgcccccaaagaugacuauaagcacaggauguuuuggcgggagauguacuccguggaggaagcugagcagcucaugacucugaucucugccgcacgcgaauaugagauugaauuuauauacgcuaucucgccuggccuugauauuacguuuucaaauccaaaagaggucagcacccugaagagaaaguuggaccaagugagucaguucggcuguagguccuuugcccuccuguucgaugacaucgaucauaacaugugcgcggccgacaaagagguuuucucuagcuucgcacacgcucagguguccauuacaaaugaaaucuaucaguaccugggggagcccgaaacuuuucucuucuguccuaccgaguacugcggaacauuuuguuauccaaacgucucacaaaguccguacuuacggaccgugggugaaaagcugcuucccggcauagagguauuguggacugggccuaaaguugugagcaaggagaucccagucgaaucuauugaggaaguguccaaaaucauuaagcgcgcccccgugaucugggauaauauacaugcuaacgacuaugaucagaagcgacuguuccuaggaccuuacaaaggcagaucaacagagcucauuccaaggcugaaggguguccuuaccaaucccaacugcgaguucgaagccaauuauguugcaauccacacgcuggccacuugguacaaaagcaacaugaauggggugcggaaggacguagugaugagucgucaggucgcucauucuggagcgaaagcauccgugguugauggcaccccguugguggccgcuccuagccucaacgccacaacugucgugaccacaguauaucaggagcccauuaugucgcaaggcgcagcccugucuggggaaccaaccacguuaacuaaggaggaagagaaaaagcagccugacgaggaacccauggacaugguuguggagaagcaggaagagacagaucacaaaaaugacaaccaaauccuguccgaaaucgucgaggcuaagauggccgaggaacucaaaccaauggauaccgacaaggagucaauugcagaaaguaaaagccccgagauguccaugcaggaagauuguauaucugacaucgcgccuaugcagacugaugagcagacaaacaaggagcaauuugugccaggaccgaaugaaaagccccuuuacaccgcugagccugucacgcuggaagacuugcagcuacuggccgaucucuucuaccugccauaugagcacggucccaaaggcgcacagaugcuucgcgaauuucaguggcugagagccaacagcucagugguuagugugaauugcaaggggaaagacuccgagaagauugaggaauggaggagccgggcugccaaauucgaggaaauguguggauugguaaugggcauguuuacccgacucucuaacugcgcaaaucgcacaauccuguacgauauguauucauacgucugggacauaaagaguauuaugagcauggugaaguccuucguucaaugguuagguuguagaucucauucgagcgcucaguuucugaucggggaccaggagccuugggccuucaggggcggacuagcgggcgaguuucagcggcuccugccaaucgauggggccaacgaccuuuucuuucaacccccgccuuugacuccaaccuccaaaguguauacaauucgccccuacuucccuaaggaugaagcuagcgucuauaaaaucugcagagagauguacgacgauggagugggucugcccuuucagagucagccagaccucauuggcgauaagcugguagggggacuucugucuuugagccucgacuacugcuucgugcuggaagaugaggacggcauaugugguuaugcauuagggacuguugaugucaccccuuucaucaaaaagugcaagauuuccuggauccccuuuaugcaggaaaaauacacaaagccaaauggcgacaaagagcugucagaggccgaaaagaucaugcuaucauuccacgaggaacaagaggugcucccggaaaccuuucuggcuaacuucccuucucuuauuaaaauggauauacauaagaaagugacugaccccuccgucgccaagaguaugauggcauguuugcugagcucucucaaggcgaauggauccaggggcgccuuuugcgagguucguccagacgauaaacggauccuggaguucuauucaaaguuaggguguuuugaaauugcuaaaauggagggauuccccaaggacguggugauccugggucgaagucuuuga

SEQ ID NO: 59021 - RNA, 912 nt, Artificial Sequence
  derived and/or modified sequence opt3 from MGLL__Homo_sapiens__NP_001003794
augcccgaggaaagcuccccuagaaggaccccacagucuaucccguaccaagaccugccccaccucgugaacgccgauggccaguaucuuuucugccgguacuggaagccuacagggacuccaaaagcucugauuuuugucucacauggagccggugagcacaguggccgcuaugaagaguuggcacgaauguuaauggggcuggaccuacucguuuucgcgcaugaucacgugggacauggccagagcgaaggugagcguaugguaguguccgacuuucacgucuucgugagagauguucugcagcacguggacucuaugcaaaaggauuaccccgggcuuccugucuuucuguugggacauucgaugggcggcgcuauagccauccucacggcagccgagaggccagggcacuucgcuggaauggugcugauuucaccccugguacucgcaaauccugaaagcgccaccacauuuaaaguuuuagcugccaaggugcugaaccuugucuugccaaaucugagucuagguccgaucgacuccucugugcucagccggaacaaaacugagguggauauuuauaauuccgacccccugaucugucgcgcgggccuuaaggucugcuucgggauacagcuguugaacgcaguuucaagaguggaaagggcccucccuaagcugaccguaccauuuuuacugcuccagggaagugcugaucggcuuugugacagcaaaggcgccuaccuguugauggagcuagcaaagucucaggauaaaacacugaagaucuaugagggugcuuaccaugugcuccacaaagaacugcccgaggucaccaauuccguguuccacgaaauuaacauguggguuucacaacgcacugccacagcggggaccgccagcccuccauga

SEQ ID NO: 59022 - RNA, 1035 nt, Artificial Sequence
  derived and/or modified sequence opt3 from MGME1__Homo_sapiens__NP_443097
augaagaugaaacuguuccagaccaucugcagacaacucaggagcuccaaguuuucuguggagucagccgcucuugucgcauucaguacaagcuccuacucuuguggccggaaaaagaaaguuaaccccuaugaagagguggaccaggaaaaguacucgaaucugguacagucaguguugagcagucgcggggucgcccagacuccuggauccguggaggaagaugcguuacugugcgguccaguuucuaagcacaaacuaccgaaccaaggcgaggaccgacgugugccccagaauugguuuccuauuuucaacccagagagaagcgauaagcccaaugcuuccgacccuucagucccacucaaaauaccccugcagaggaacgugaucccuaguguaacgcggguucuucagcaaaccaugacaaagcaacagguguuucuguuggaacgcuggaaacagagaaugauucucgagcugggggaagauggauucaaggaguauacuagcaaugucuuucugcagggcaagagguuccaugaggcccucgaaucuaucuuauccccacaggagacccugaaagaacgggacgagaaccuuuugaagucagguuacauugaaagcgugcagcacauccugaaagaugugagugggguccgcgcacuagagucugccguucaacaugagacacucaauuauauaggacugcuugacuguguggcugaauaccagggcaagcugugcguaaucgauuggaaaaccuccgagaagccgaaacccuuuauucagagcacuuucgacaacccucuccagguggucgcauauaugggcgccaugaaucacgauacaaacuacucguuucaagugcaguguggguugaucguuguggcuuacaaggacggaucuccagcccauccccacuucauggaugcggaacugugcucccaguauuggaccaagugguuacugcgacucgaggaauacacggagaaaaagaaaaaucagaacauucaaaagccugaguauucagaauga

SEQ ID NO: 59023 - RNA, 717 nt, Artificial Sequence
  derived and/or modified sequence opt3 from MGMT__Homo_sapiens__NP_002403
augcugggccagcccgccccucucgagagauucgcuagcaggcggccacaagugcuugcaguccgcaccguuugcgaccugguguuggggaagauggauaaagacugugaaaugaagcgaacaacuuuagauuccccgcugggaaaacuagagcucucugguugcgaacagggccugcacgagaucaagcugcuggggaaaggaacgucagccgcggacgcuguagaagugcccgccccugcagccgucuugggcgguccagagccccucaugcaguguaccgcuuggcugaacgcauacuuucaucagccugaggccauugaagaguucccagugcccgcucugcaccauccuguuuuucaacaggaaaguuucacacgucaggugcucuggaaguuacugaaggucgugaaauuuggggagguaauaagcuaucagcaacuugccgcguuggcaggaaauccaaaggccgcuagagccguuggcggcgcaaugagggggaacccggugcccauccugauuccuugccaccgggucguguguuccucuggagcuguggguaauuacucgggcgggcuagccgucaaagaguggcuccuggcgcaugaaggacaccgccuuggcaagccaggucuugggggaucaagcggcuuggccggcgcauggcucaaaggggcuggagccacuuccgguagucccccugcuggcagaaacuga

SEQ ID NO: 59024 - RNA, 312 nt, Artificial Sequence
  derived and/or modified sequence opt3 from MGP__Homo_sapiens__NP_000891
augaaaagccugauccuccuugccauucuggcugcauuggccguggucaccuuaugcuacgagucccacgaaucuauggagucauaugaacugaaccccuucauaaauagaaggaacgcgaauacauuuaucaguccucagcaacgguggcgcgcuaagguucaggagcguauucgagaaagaagcaagccagugcaugagcuaaacagggaggccugugacgauuaccggcucugcgaacgcuaugcaaugguauacggcuauaaugccgcuuacaacagauauuucaggaaacggcgcgggacuaaguga

SEQ ID NO: 59025 - RNA, 1665 nt, Artificial Sequence
  derived and/or modified sequence opt3 from MGRN1__Homo_sapiens__NP_001135761
augggcagcauccuguccagaaggauugccgggguggaggacauagauauccaggcuaacucugcauaccgguaucccccuaagucaggaaauuacuucgccagucacuuuuucauggguggcgaaaaauuugacaccccacauccggagggguaucucuucggagaaaacauggaucuuaauuuucugggcagccgccccguccaauucccuuacguuacaccagcgccccacgagccugugaagacuuugcgauccuuaguaaacauucguaaagacucucugagacuggugagguauaaggaugacgcugauucgccaacggaagacggugauaaaccccggguccucuacucacuggaguuuaccuucgacgccgaugcacgcguggccaucacaauuuauugccaggcuagcgaggaauuucuuaaugggagagcaguuuacaguccuaaguccccaucucugcagagcgagacugugcauuacaagaggggagucucccagcaauucucauugccgaguuuuaaaaucgacuucagcgaauggaaggaugacgagcucaacuuugaccuggaucggggcguguuccccguaguuauacaggccguggucgacgagggcgaugugguggaagucaccgggcacgcucauguucugcucgccgcguucgagaaacacauggacggaucuuuuuccgugaagccuuuaaaacagaagcagaucguagaucgcgugucauaucugcuucaagaaauuuacgguaucgagaauaagaacaaucaggaaacaaaaccaagcgacgaugagaacagugacaauucuaacgagugugucgugugcuuguccgaucugcgagacacccuaauucuccccuguagacaccugugccuuuguacuagcugcgcagauacacugagguaucaggccaauaacuguccuaucugccgguugccauuccgugcucuccugcagauacgcgccguuagaaagaaacccggcgcauuaucgccggugucuuuuuccccuguccuggcucaaucacucgaacaugacgagcacaguaauagcgacuccgugcccccaggguacgaaccuauuucucuucuggaggccuugaacggacuaagggcgguaagccccgccaucccaucagcaccccuguaugaagagauuaccuacaguggcaucuccgauggucucagccaggcuucuuguccucuggccgcuaucgaccauauucuugauucaagucggcagaaggggcgaccacaaagcaaagccccggacuccacgcugcgcucucccucgagcccuauacacgaggaagaugaggaaaaguuguccgaggacguugaugcaccacccccucucggaggcgccgaacuggcuuuaagagagucaaguucuccagagagcuucaucacugaagagguggacgaauccucaagcccccagcagggcaccagggcggcaucuauugagaacguccugcaggauuccaguccggagcacugcgggcggggaccuccagccgacaucuaucuacccggucgcccuacaagcauggaaacugcucauggccucgccaccacaucucccaccuggccaccucuagggggacccuccccagauccgucagcagccgagcuuacgccuuuguga

SEQ ID NO: 59026 - RNA, 468 nt, Artificial Sequence
  derived and/or modified sequence opt3 from MGST1__Homo_sapiens__NP_001247440
augguggaccugacccaggucauggaugacgagguuuucauggccuuugcuagcuacgcaacaaucauucucuccaagaugaugcuuaugucuacugccacggcguucuauagacugaccaggaaaguguuugcuaaccccgaagauugcguagccuucggcaagggggagaaugcaaagaaguacuugcggacagacgaucgcguggaacgaguccguagagcccacuuaaacgaccuggagaauauaaucccuuuucuaggaauuggucuccuguauucacuuaguggcccagauccgagcacugcuauccugcauuucagguuguuugugggggcacggauuuaccacaccaucgccuaucucacaccccugccucaaccaaaccgcgcucuguccuucuuuguuggauacggcgugacccucucuauggccuauagauuacugaaaucgaaacuuuacuuguga

SEQ ID NO: 59027 - RNA, 444 nt, Artificial Sequence
  derived and/or modified sequence opt3 from MGST2__Homo_sapiens__NP_001191295
auggcaggcaacucuauccugcucgcugcaguguccauucuuucugccugccagcaaucauacuucgcgcugcaggucgggaaggcuagauugaaauauaagguuacacccccugccgugaccggaaguccagaguuugaaaggguauuccgggcacagcagaauuguguggaguuuuacccgauauucaucauuacuuuauggauggccgguugguauuuuaaccaagucuucgcuacgugccugggccuaguguacaucuaugggcgccaccucuacuuuuggggauauagcgaagcagccaaaaagcgaauuaccggcuuccgucugucccuugguauccuggcuuugcucacacugcugggggcccucggaauagcgaauagcuuuuuagacgaguaccuggaucuuaacaucgccaaaaaguugagaaggcaguucuga

SEQ ID NO: 59028 - RNA, 459 nt, Artificial Sequence
  derived and/or modified sequence opt3 from MGST3__Homo_sapiens__NP_004519
auggccgugcugagcaaggaguacggcuucguccuccuuaccggggcugcauccuuuaucaugguugcccaccuggcgauuaacgugucuaaagcuagaaagaaauauaagguagaauaccccauaauguauucaacagacccugagaauggacauaucuucaacugcauucagagggcccaccaaaauacuuuggaaguguacccaccguuuuuauucuuucuggcagucgguggcguguaucauccccggaucgccagugggcuaggacucgcuuggauuguuggccgcgugcuguacgcauaugguuacuacacgggggagccuagcaaacgaucccguggagcccuuggcucuaucgcucuguugggccucgucgggaccacaguguguucggccuuccagcaccugggauggguaaagucaggucugggcagcgggccaaagugcugucauuga

SEQ ID NO: 59029 - RNA, 1965 nt, Artificial Sequence
  derived and/or modified sequence opt3 from MIA2__Homo_sapiens__NP_473365
auggccaaguucggcgugcacagaauccugcuccuugcuauuagccugaccaaaugcuuggaguccacaaaguuacuggcagacuugaaaaaguguggggaucucgaaugcgaggcccugauaaacagggucucugcgaugcgggacuaccgcggacccgauugucgauaucuuaauuuuacuaaaggugaagagaucucaguuuacgugaagcuggcuggcgaacgugaggacuugugggccgggaguaagggaaaagaguucggcuauuuuccuagagaugcaguacagauugaagagguguucaucagcgaagagauucaaauguccacgaaggagucugacuuucucugccugcugggugucucguacaccuucgauaacgaagacucagagcucaauggggauuauggagaaaacaucuacccauaugaggaagacaaagaugaaaagagcaguauauacgaguccgacuuucagaucgaaccgggcuucuacgccacauaugagucuacuuuauuugaagaucaggugcccgcucuggaggcaccugaagacauuggcagcaccuccgagucaaaagacugggaggaaguuguggucgagaguauggaacaggauaggaucccagaggugcauguacccccuagcucugccguuuccggggugaaggaaugguucggacuugguggcgagcaagcugaggaaaaggccuuugagucagucauugaaccagugcaggagagcaguuuccggucucgcaaaaucgcgguggaggacgaaaaugauuuggaggaacugaacaauggggagccccagacagaacaccagcaagaguccgagagcgaaauagacucggucccuaagacccagucugagcuagcauccgaaucagagcauauuccaaaaccgcagaguacuggaugguuuggcgguggguucacaagcuaccucggauucggcgaugaagacaccggccuggagcuuaucgccgaggaauccaaucccccucugcaggauuuuccaaacucuauuagcucagacaaggaggcuacgguucccuguacugaaaucuugaccgagaaaaaggauacaaucacuaacgacagucucucccugaaaccuagcugguucgauuuuggguucgccauuuuaggauuugcauaugcuaaggaagacaagauaaugcuggacgauagaaagaaugaggaggacgguggcgccgaugaacacgagcauccacucaccucugaacuugaccccgagaaagagcaagaaaucgagacaauuaaaaucauagaaaccgaggaucagauugacaagaaaccggugucagaaaagacggaugagagugacacuaucccuuaccugaagaaauucuuguauaacuuugauaaucccuggaacuuccagaauaucccaaaggagacagaacuaccuuuucccaaacaaauucuggaccagaacaacguaaucgagaaugaagagaccggggaguucagcauugauaacuacccaacugacaauacaaaggugaugauauuuaaauccucuuauucgcucagcgauauggucuccaacaucgagcugcccaccaggauucacgaggaaguguacuucgagccuucaaguucuaaggacagcgacgaaaauuccaagccaucaguugauacggagggaccggcgcuuguggaaaucgaccggagcgucgagaacacccugcuaaauucucagaugguguccacagauaacagucucagcucucagaauuacaucucccaaaaagaggacgccucagaauuucagauucugaaguauuuauuccagauagauguauacgacuucaugaacagugcauuuagccccaucguuauucugacugagcgcgugucgcuaccuuucaaaccauuugcuaucauucuccccauccugcuuaauauacgagucgccaccaaguauguguga

SEQ ID NO: 59030 - RNA, 2358 nt, Artificial Sequence
  derived and/or modified sequence opt3 from MIA3__Homo_sapiens__NP_001287796
auggacagcgugcccgccaccgucccuuccaucgcugcaacaccaggcgauccggagcugguugggccccucucugugcuuuacgccgcguucauugcuaagcuguuggaauuaguagccacucugccugacgaugugcagccaggacccgacuuuuauggucuaccuuggaaaccagucuucauaacggcauuucucggcaucgccucauucgcuauuuuucuguggagaaccgugcuuguugugaaggauagggucuaccaagugacagagcagcagaucagugaaaaacugaagacuauuaugaaagagaacaccgaauugguacagaagcucagcaauuaugagcaaaagaucaaagaguccaagaaacacguucaggaaacacggaagcagaacaugauacugucugacgaggcaaucaaauacaaggauaagauuaaaacccuggaaaagaaucaggagauccucgacgauacugccaaaaacuuacgcgugaugcuggagucggaacgagagcaaaaugucaagaaccaggaccuuauuucagaaaauaaaaagagcaucgagaaauugaaggaugugauaaguaugaacgcuuccgaguucucugaagugcagauugcccugaaugaggcgaagcuaagcgaagagaaagucaaguccgaaugccaucguguucaggaggaaaacgcaagacucaaaaagaaaaaggagcaacugcagcaggagaucgaagacuggucaaaacuucacgccgagcugagugaacaaauuaagagcuuugagaagucucagaaagauuuggaaguggcucucacacauaaggacgacaauaucaacgcccugaccaauuguaucacgcaguuaaaccugcucgagugcgaguccgaaucagaggggcagaauaaaggaggcaacgauagcgacgaacuugcaaacggugagguagggggagauaggaaugagaagaugaagaaccaaauuaaacagaugauggacgugagucggacucagaccgcuauaucugucguggaagaggaucugaaguugcuacagcugaaacuccgcgccuccguuagcacaaaguguaaucuggaagaccaagugaaaaagcuggaggaugacagaaacucgcuucaggcggccaaggcaggcuuggaagaugagugcaaaacucucaggcagaaggucgagauccugaaugaauuauaucagcaaaaagagauggcucugcagaagaaacuaucucaggaagaguacgaacggcaggagcgcgagcaccgacucuccgccgcugacgaaaaggccgugucagcagccgaggaaguaaaaaccuauaagagaaggauugaggaaauggaggaugagcugcaaaagacagaacggaguuucaaaaaccagaucgcuacccaugagaagaaagcgcacgaaaauuggcuuaaggcacgugccgcugagcgcgccauagcagaggagaaaagagaagccgcuaacuugaggcacaagcugcucgaacugacgcagaagauggccaugcuucaagaggaacccguuauugugaaaccuaugccaggcaagccgaauacucagaaucccccucggcgagggccacugagccagaauggauccuuuggucccucuccugucagcggcggggaguguucaccacccuugacaguggagccgccuguccgcccccucagugcaacccugaacagaagggacaugccacgguccgaauuuggaagcguggacggcccuuuaccccauccacgcuggucugcggaggcuucagguaaacccaguccuagcgauccaggguccggaacugccacaaugaugaacucuucgagcagaggcuccucaccgaccaggguucuggacgaaggcaaggugaacauggcacccaaagggccuccacccuucccuggaguaccacuaaugaguacgcccauggguggcccggucccuccacccauccguuacgggccucccccacagcucugcggaccuuucggcccccggccacugccgccucccuuugguccagggaugcgacccccucuuggcuugagagaguucgccccaggagugcccccuggcaggcgcgaucugccgcuccacccacggggguuccugcccggacaugcuccuuuuagaccauuagguucucugggccccagggaauacuucaucccugggacccgccuuccgcccccaacacacggaccucaagaguaucccccaccucccgccguucgagacuugcucccaagcggcucccgggaugagccgccucccgcaucacagagcacuucucaggacuguucccaggcucugaagcaaaguccauga

SEQ ID NO: 59031 - RNA, 396 nt, Artificial Sequence
  derived and/or modified sequence opt3 from MIA__Homo_sapiens__NP_001189482
auggccagaagccuggugugccucggcgucaucauucuucuguccgcuuucucugggcccggaguuagggguggcccuaugccaaaguuggcagaccggaaauuaugugccgaucaggagugcucacacccgauaaguauggcgguggcucugcaagacuacauggcccccgauugucgcuuucuaaccauccaucgagggcagguaguguaugucuucagcaagcucaaaggacguggcagacuguuuugggguggguccgugcagggagacuacuauggcgaucuugcagccaggcugggcuacuucccuucuucgauuguucgggaagaccagacauugaagccagggaaaguggaugucaagacugacaagugggauuuuuauugccaauga

SEQ ID NO: 59032 - RNA, 3021 nt, Artificial Sequence
  derived and/or modified sequence opt3 from MIB1__Homo_sapiens__NP_065825
augagcaacuccagaaauaacagggugauggucgagggcguuggggcccgggugguacgcggacccgacuggaagugggguaaacaggauggcggggaaggacacgugggcaccguccgaucuuucgagucaccugaagaggugguuguggucugggacaaugguacagcugcaaacuaccguugcaguggggccuaugaucugagaauccucgacagcgcgccaacuggaauuaagcaugauggcacgaugugugauaccugcaggcaacagccgauaaucggcauucgguggaaaugugcugaaugcacaaauuacgaccuuuguacugugugcuaucacggggacaagcaucaccuucgccauagauuuuacaggaucaccacacccggauccgagcggguauuguuagagucucgccgaaaaucgaagaagauuaccgccagagguaucuucgcaggcgccaggguugugcguggggucgauuggcagugggaagaccaggauggaggcaacggucggcgcgggaaagugacugagauacaagacuggucagcuagcaguccucacuccgcagccuaugugcugugggauaauggagcuaagaaccuauacagagucggcuuugaaggcaugucugaccucaaauguguucaggacgccaagggagggagcuucuauagggaucacugcccagugcugggugagcagaauggcaaccggaaucccgggggacuucagaucggcgaccugguaaacauugauuuggaccucgagaucgugcaaucccugcagcauggucacgggggcuggacagauggaauguuugaaacccugacgacuaccggcacagucugugggauugacgaggaucaugacaucgugguucaguacccuucaggaaaucgauggacuuucaacccagcggugcucaccaaagcaaauauaguccgcaguggugaugccgcucagggcgccgaagggggaacaagccaauuucaggugggcgacuuaguacagguuugcuacgaucuggagagaauuaagcuguugcaaaggggucacggggaaugggcagaggcuaugcugcccacccuaggcaaggugggacggguccagcagaucuauucugacuccgaccucaaaguggaggucuguggcacgucauggacuuacaacccugccgcggugagcaagguugccagugcagggucugcuauuuccaacgccagcggagaacgccugucgcagcuucugaaaaaguuguucgagacacaagaaucuggugaucucaaugaggaacuggugaaagcugccgcaaacggcgacguagccaaggucgaggauuuacugaaaagaccagacguggauguuaaugggcagugcgcuggacacaccgcgaugcaggcagccucccagaacggccauguggacauccucaagcugcuguugaagcaaaaugucgauguggaggcugaagacaaagauggugacagggccguacaccaugcagccuuuggggaugagggcgcugugaucgaaguucuacaccguggaucagccgaccugaacgcacggaauaagcgaagacagacuccgcuccauauugcggucaacaaaggccaccuucagguggugaagacacuucuggauuucgggugccaccccaguuugcaggacagcgagggagacaccccucuccaugaugcuauauccaaaaagagggacgauauccuggccgucuuacuggaagcaggcgccgacguuacgauuaccaauaacaaugguuuuaacgcucuacaccaugccgcacuccgcgggaauccaucugcuaugcgggugcugcuuagcaaguugcccagaccuuggaucguggaugagaaaaaggacgauggauauacagcccugcaccucgcggcccugaacaaucacguagaggucgcugaacuucuggugcaucaaggcaacgcaaacuuggacauacagaauguuaaccagcagacugcccuccaccuggcuguggagaggcaacauacccagauuguccgcuuacuggugcgagccggugcaaaacuagauauccaggacaaggauggcgacacaccacuccacgaagcgcugcggcaucacacucuuucacaauugcgucagcugcaggauaugcaggacguugggaaaguggacgccgcuugggagcccaguaagaauacccucaucaugggacugggcacacaaggggccgagaagaaauccgcagcuagcauugccuguuucuuagcagccaacggagcugaucugucuaucagaaauaagaaaggccagucaccgcuugacuugugcccugaucccaaccucuguaaggcgcuggccaaaugccacaaggaaaagguaaguggucaggucgggagcagguccccaucuaugauuucgaaugacagcgagacccuagaagaguguauggugugcuccgauaugaaacgcgacacucuguuuggaccuuguggccauauagcaacgugcucacucuguaguccccgggugaagaaaugccugaucuguaaggaacagguccaaucuagaacaaaaauugaggagugcguugugugcagcgauaagaaagcugccguacuuuuccagccauguggucacaugugcgccugugaaaacugcgcuaauuugaugaagaagugugugcagugcagggcagucguggagcgacgcguucccuucaucauguguugcggcgggaaauccucagaagacgccaccgaugacaucagcucuggaaacauuccugugcugcagaaggauaaagacaauacuaacgucaaugcggacgugcaaaaguuacagcagcaacuccaggauauaaaagagcagaccauguguccaguuugccuggaccggcuuaagaacaugaucuuucuguguggccaugggacaugccaguugugcggagauagaauguccgaauguccgauuugcaggaaggcuaucgagcgucgcauucuccuguacuga

SEQ ID NO: 59033 - RNA, 3804 nt, Artificial Sequence
  derived and/or modified sequence opt3 from MIB2__Homo_sapiens__XP_011539035
auggccggcgcucugagaagggggcgggcacucggaagccgccccuccgguccuaccgugucuucacgacguaguccacagugcccggucgcccaagagggccuuggggcgagaagcaggccccggguugcuccucgcucccuggccagauguggaccaucuucgagguugauggugcgggcaggcgccgacuuacugcccuggucaagcgcuccuaguccaucccgcucuccccuauggcagaacgcaagcgccguacgauucccucucccacuggcucagcagccgagagccggucuuggggugggauccgcgagggauggccugggcuugcgggcacaacgucgcagaggggccucaugggaacucuggaguggacaccccagggguacuccugcuccaggccggccccgagccgcacgcgggcagagaagguggggacggcgcuggggcagaaggccuggucgugucgggugcggagcucggcaggcccuguggccaggccuggcggccgcagagcagagcggccccguugggggacucgaacgaagagacaggccgacagaugguuuagcuggcgggccugcucccccaucuggagcuggcgguacggagaccuccggggugggcagcccugcccgccuggaagcaucacccaaggugagucggcaucaaggauguucuccaggcgccuccagaaggcccgggggacgccuugacggucgaacaggcccugagcagccagggccgcccuggacuccuuugccaaccggacccgagcagccucggccaacauggacccagacuccccguagagcuuguaggugggcgugcggcuggugcgcagccuggacagguagcggggcuucgcgcaccgccgcacgggccgcuugggccagaugguggucucuggcagcgacggcugccccgaggcacccuacugcacaaugguccuguucaggcacccgagcccgcgcuccaacaacugcccccgcaacccgggcuagaacaaccugcuguugcgucaggcauccuaauaucauuugugauugcugcaaaaagcacggacuacguggcaugcgcuggaaaugucgggugugccucgacuacgaucuguguacgcagugcuauaugcauaacaagcacgaacuugcccacgcguuugacagauacgagacugcccauaguaggcccguaacacugagcccacgacagggguugccucggauaccccuccgcggaaucuuccaaggugcuaaaguugugagaggcccagauugggaaugggggucccaggacggaggcgaggguaagccggggagggucguggauauucggggcugggacguggagaccggacgaucugucgcaagcguuacuugggccgauggcacaaccaauguguauagaguagggcacaagggaaaaguggaccugaagugugucggcgaagcugccgguggguuuuacuauaaagaccauuuaccucgccugggaaagcccgcagagcuccagaggcgugugucagcggauagucagccauuccaacacggcgacaaaguuaagugccuucuggauacggacguguugcgggaaaugcaggagggucacggcggguggaaccccagaauggccgaauuuaucggacagaccggcacaguccauaggauuacugaucgcggggacgugcgaguacaguucaaucacgagaccagauggacauuucauccuggagcucuaacuaaggauacccggaaagccggccaacugaggggucgcgaagggggaggcugggcaaagaugcuccugcaccauuccuucuggguuggugacgugguccgugugaucggcgaucuugacacagucaaaagacugcaggcugggcacggagaauggaccgaugacauggccccagcauugggccggguggggaagguugugaaaguauuuggagacggcaaccucagggucgccguggcuggucagcgcuggacuuucagccccucuugucugguugcguaccgaccugaggaagaugccaauuuagacguggcagagagagcucgggaaaacaagucaagucugagcgucgcccuagauaaacucagggcccagaaguccgacccggagcacccagggcgccuggugguagagguggcucuuggaaaugcagccagagcguuggaucugcucaggcggcgucccgaacaaguugacacgaagaaccagggccgcacagcucugcaggucgccgcauaucuuggucagguggagcugauacgauugcuccugcaagccagagcuggcguggauuuaccugacgaugaagggaauaccgcacugcauuacgccgcgcuaggaaaccagccagaggcuacuaggguccuccugucugccggcugccgggcagacgccaucaauucgacccagagcacagcccuucacguugccgugcaacgcggguuuuuggaagugguaagagcacugugugagaggggaugcgaugucaaccuccccgacgcucauuccgauaccccucugcacucagccauuagugcgggcacuggugccucugggaucguggagguuuuaacagaagugccgaauauugacgucacggcaaccaacagccagggauucacucugcuucaccaugcuuccuugaaaggccacgcccucgcugugcggaagauccuggcacgagccagacagcuaguugacgccaaaaaggaggauggcuuuacagcucugcaucucgcggcacugaacaaucaccgcgaaguggcccagauacuuauuagggaggggcggugugacguaaacguccguaauagaaaauugcaaucaccccugcauuuagcugugcagcaggcccacgugggacucgucccacugcuuguugaugcagguugcagcgugaacgccgaggacgaagagggcgauaccgcucugcacguagcguugcagaggcaucaacuccugccucuaguggccgacggggcaggaggcgaucccgguccacugcagcuccugucucgcacauggggagcugggugcuggggcugucaggucccuggcgacgccucccuugggcccgcaccagccccggcuuugacuggagugugcccugccgcgcagcugcaagcaagugguuuacccggcagcgccgaacucaccguuggggcugccguggcuuguuuccuggcacuugagggagccgaugucucuuacacgaaucaccggggccgauccccacuggaccuagcugccgaagguagagugcucaaggcacugcaggggugcgcgcagagguuccgcgagcggcaagccggaggcggcgcugcccccgggccuagacagaccuugggaacaccaaacacuguuaccaaucugcaugugggugcagcucccggcccugaggccgcagaauguuuagucugcucagagcucgcccugcuuguacuguuuaguccgugucagcaccguacagugugcgaagagugugcuaggcggaugaagaaaugcauccgcugucagguuguggucagcaagaaauugcgaccagaugggucggaaguggcguccgccgcacccgcuccuggacccccaagacaacucguagaggagcugcagucuagguaucggcagauggaggagcgcauuacuugcccuaucugcaucgacagccauauuaggcuaguguuccaguguggccacggugccugcgcccccugugggucagcacugagugcuugcccaauauguagacaaccuauccgagaucggauucagaucuuugucuga

SEQ ID NO: 59034 - RNA, 1152 nt, Artificial Sequence
  derived and/or modified sequence opt3 from MICA__Homo_sapiens__NP_000238
augggccuggggcccguguuccuccuucuggccggaaucuuuccuuucgcuccaccgggugcagccgcggagccccacagcuugagauacaacuuaaccguccuguccugggacggcucuguucagucaggguuucuaacagaagugcaucucgauggacaaccuuuccugaggugcgaccggcagaagugucgcgcuaaaccacagggccagugggccgaggauguacuugguaauaagacuugggaccgagaaacgcgugaucugaccgggaacggaaaagacuugagaaugacacucgcacacauuaaggaucaaaaagagggccugcauagucugcaggaaauaagggugugcgagauccacgaggacaauagcacucgguccucucagcauuuuuauuacgauggcgaacucuucuuaucgcagaaccuggagaccaaggaauggacaaugccccaaucaagccgcgcccagacccuugcuaugaaugucagaaacuuuuugaaggaggacgcaaugaaaacuaagacacacuaucacgccaugcaugcugauugucugcaggagcuaaggcgguaccucaaaaguggggugguucugcgccgaaccgugccuccaauggucaaugugacgagauccgaagccucugagggaaacauuacuguaaccugcagggcgagcgguuucuaucccuggaauaucacacuuuccuggcggcaggacggcguuucacugagucacgauacucaacaguggggagacguguugccugacgggaacggcaccuaccagacaugggucgcaacccguauuugucaaggugaggaacagcgcuuuacgugcuauauggaacauagcgggaaucacucuacucacccagugccguccggaaaggugcucguccugcagucacauuggcagacauuccacguuagcgccguggcugccgcagcuaucuuuguaauaaucauuuucuacgugagauguugcaaaaagaagaccagugccgcggagggccccgaguuagucucucugcaagugcucgaucagcauccuguuggcacuuccgaccacagggaugccacacagcuuggguuucagccacugaugagcgacuugggaucgaccgguucuacggaaggcgcauga

SEQ ID NO: 59035 - RNA, 3375 nt, Artificial Sequence
  derived and/or modified sequence opt3 from MICAL2__Homo_sapiens__NP_001269592
augggcgagaacgaagacgagaagcaggcccaagcuggucagguguucgaaaauuuuguccaggcaagcacaugcaaaggaacccugcaggccuucaacauccucacuagacaccuugaucuggaccccuuggaucauaggaauuuuuacuccaaguuaaaaucuaagguuacgaccuggaaagcgaaggcucugugguauaagcuagacaaacgggguucacacaaggaguacaaacgcggcaagaguuguacaaacacuaaaugccucauuguagggggaggcccuuguggucugcgaaccgccauagaacuugcauaucugggggccaaggugguggucguggagaagcgugauagcuucuccagaaauaacguuuugcaucucuggccauuuacaauccacgaccugaggggacugggcgcuaaaaaguucuacggcaaauuuugcgcagggucuauugaucauaucucgauucggcaacuccaguuaauccuguucaagguggcccuuauguugggagucgagauacacgugaauguagaauuuguuaaagugcuggagccgcccgaagaccaggagaaccagaagaucgguuggcgcgcugaguuccuaccuaccgaucacucacucagcgaauuugaguucgacgucauuaucggcgccgaugggagaaggaauacucuggaaggauuucggcgcaaagaguuccgaggcaaacuugcgauugcaaucacagccaacuucauaaauagaaacaguaccgcugaagccaagguggaggagauuuccgguguggcauuuaucuucaaucaaaaguuuuuccaggaccugaaggaagagacggggauugauuuggaaaacaucgucuauuacaaagacuguacucauuauuuuguuaugaccgcuaagaaacagucucuccuggacaagggagugaucauuaaugauuacauagacacagagauguuacugugcgccgaaaacguaaaccaggauaaucuccuuagcuacgcgagggaggccgcagacuucgcuacuaacuaucaacugccauccuuggauuuugccaugaaucacuacggccagcccgacguggcuauguucgauuuuaccuguauguaugccucagagaacgcagcccuaguccgggaacgucaggcucaucaacugcucguggcgcugguuggcgacagucuucuggagccuuucuggccaauggggacaggaugcgcacgcggguuuuuggccgcuuucgauaccgccuggauggucaagagcuggaaucagggcacgcccccucucgaacuguuagcagagagagaaucucuguacaggcuacucccacagacuacaccggagaacaucaauaaaaacuuugagcaguauacccuggaccccgggacucgguacccuaaucuuaacucccacugugugcgaccacaccaagugaagcauuuguauauuacaaaagaacuggagcacuacccccucgaacgccugggaucaguaagaaggagcguuaaucuuagucggaaggagucugauauccgcccuuccaaacuguugaccuggugccagcagcagacggagggcuaccaacaugugaacgucaccgaccucacaacuagcuggagaucgggucuggccuuaugugcuauaauucacagguuccguccagaacugaucaauuucgacucucuaaacgaggaugacgccguggaaaauaaccagcucgcauuugaugucgcggagcgggaauuugggauucccccggugaccacaggcaaggagauggcuuccgcccaggagccugacaagcugucaaugguuauguaucuuaguaaauuuuacgaauuguuccgaggaacuccccugagaccaguggauagcuggaggaagaacuauggcgagaaugcagaccucucccuggccaaaucuagcaucucaaacaauuacuuaaaccugaccuuuccucgcaagcggacacccagaguagaugggcagaccggagaaaaugacaugaacaaaaggcgccgaaaggguuucacuaaucuugaugagccaaguaacuuuuccagccggucuuugggcucaaaucaagaaugcgggaguagcaaggagggaggcaaccagaauaaagucaaguccauggcuaaccagcuccuggccaaauucgaggaaucuacgcguaaucccucgcuaaugaagcaggagagaagggugagcgguaucgggaaaccuguucugugcuccucaaguggcccaccggugcauucuuguugccccaagccugaagaggcaacaccaagccccuccccuccacucaaacgccaauuucccucagucgugguaaccggacacgugcugcgggaacuuaagcagguuagcgcuggcucugaguguuuguccagaccguggagggcccgagcgaagagugaccugcaguuagggggaacugagaacuucgccacccucccuagcacacgcccacgggcucaagcacugucugguguccuuuggagacugcaacagguggaagagaaaauuuugcagaagagggcccagaaucucgcuaaccgugaauuucacaccaaaaacauaaaggagaaagccgcacaucuggcguccauguucggccacggggauuuuccccagaauaagcuacugucaaagggacucagucauacucacccucccagcccaccuucgcgccugcccuccccagacccggccgcuucuagcucaccuaguacaguggauuccgccucucccgcacggaaagagaagaaaagcccauccggcuuccacuuccaucccucacaccuuagaacgguccauccucaguugaccguugguaaggugagcagugggaucggcgcugccgcagaagugcugguaaacuuauauaugaaugaccacaggccaaaagcccaggcuacuucucccgaccucgaguccaugcgaaagagcuuuccucugaaccuuggaggcucggauacaugcuacuucuguaagaaacgggucuaugugauggaacgccugucagcggaggggcauuucuuccacagagaaugcuuuagguguucuauuugcgccaccacacuacggcucgcagcuuacacuuucgacugugaugagggaaaguuuuacugcaaaccgcacuucauccauuguaagaccaauaguaaacaacgaaagagacgcgccgagcugaagcagcagagggaagaggaagccacguggcaggagcaagaagcuccacgucgggacacccccacagaguccagcugcgcaguugccgcgaucggcacuuuggaggguucuccuccagugcacuuuagccugcccgucuuacauccucuccugggguga

SEQ ID NO: 59036 - RNA, 2088 nt, Artificial Sequence
  derived and/or modified sequence opt3 from MICALCL__Homo_sapiens__NP_116256
augagcccucccaaggacccauccccgucucugccccucccuucaaguagcucccacucuucgucaccacccagcaguuccucuaccagcguguccggcaacgccccugaugggucaaguccaccccagaugacagcuagcgagccucuuucucaagucuccagaggacauccaucaccgcccacuccuaauuucaggcggcgcgcaguugcccagggugcgccacgagaaaucccccuguacuugccucaccauccaaaacccgagugggcugaauauugcuuagugagcccgggcgaggacgggcugagugauccugccgaaaugacgucugacgagugucagcccgcagaggccccacuaggagauauuggcuccaaccaccgugacccucaucccauaugggguaaggauagaagcuggaccgggcaggaacucucgccacuggcuggagaggacagggaaaaaggcucuacaggcgcacggaaggaggaggaagggggacccguacuugugaaagagaagcuggguuugaagaaacucguccugacucaagaacagaagaccaugcugcucgauuggaaugacuccaucccugagucagugcacuuaaaagccggcgaacgcauuagucaaaagagcgcugagaacgggagaggaggcaggguucugaaaccagugcggccgcuuuugcugccccgcgccgcgggugagccucuaccaacacagcgaggggcacaggaaaagaugggaacccccgccgagcaggcucagggcgaaagaaaugucccuccacccaaguccccgcucaggcugaucgccaacgcaauucggcguucucuugagccucuguugagcaauucagaaggcgggaaaaaggcuugggccaaacaggagaguaagacucucccagcgcaagccugcacacgcuccuuuagccugagaaaaaccaacucuaauaaggauggagaccagcacucacccgguaggaaccagaguagcgcauucuccccucccgauccagcuuuacggacgcauucucugccuaaucgacccucgaaaguguuuccagcccuccgcagcccgccuuguuccaagaucgaggacguacccacucuucuggaaaagguuucauugcaagagaacuucccagacgcuaguaaacccccuaagaaaagaauaucucuauuuagcucccugaggcucaaggauaaaucauucgagagcuuucugcaggagucucggcagcgcaaggacaucagagaucuuuucggcuccccaaagaggaaagugcugcccgaagacagugcccaggcauuggagaagcuccugcaaccuuuuaaaagcaccucuuuacgucaggccgcuccgccacccccuccacccccuccgcccccaccucccccaccuacagcagggggagcggauuccaagaauuucccccugcgggcccaggucacugaggcuucaaguagcgccucguccaccucuagcucaagugcagacgaagaguuugauccacagcuaucccuccaacugaaagaaaagaagacacuucgaagaaggaaaaaguuggagaaagccaugaagcagcuggugaaacaggaggaacucaagcgccuguacaaggcucaggccauucaacggcagcuugaggaaguggaggaaagacagagggcaucugagauccagggcguccgccuggagaaagcguugcgaggugaagcugacagcgggacccaagaugaggcccagcuccugcaggaaugguucaaguuaguucuggagaaaaacaagcuaaugcgguaugaauccgagcuccugauuauggcacaagagcuugaauuggaggaccaccagucacgucuggaacagaaacucagagagaagaugcugaaagaagagagccagaaggaugagaaggacuuaaaugaagaacaagaaguguuuacggagcugaugcagguaaucgagcagagggacaaacuuguggauaguuuggaggaacagcgcauacgggaaaaggccgaggaccaacauuucgaaucuuucgucuuuuccagaggcugccagcucagcaggacuuga

SEQ ID NO: 59037 - RNA, 1023 nt, Artificial Sequence
  derived and/or modified sequence opt3 from MICB__Homo_sapiens__NP_001276090
augggccuggggagagugcuccuuuuccuggccgucgcuuuucccuucgcaccuccagccgcggcugccgagccgcacagcuugagguacaacuuaaugguucugucccaggacggaucugugcaaucagguuuucuagcagaaggccaucucgaugggcagcccuuccugcgguaugaccgccagaagcgacgugccaaaccucagggacaaugggcugagaauguacuuggcgcaaagaccugggauacagaaacugaggaccugacggaaaacggucaggauuugagaaggacccucacacacaucaaagaccagaagggggugccacagaguagccgggcccaaacucuggcuaugaaugucaccaacuuuuggaaagaggaugccaugaagacaaagacccauuaccgcgcgaugcaggcagacugccugcagaaacuccagagauauuuaaaguccggaguggccauuaggcggacuguucccccuauggugaaugucacauguucugaggugucggaaggcaacauaaccguaacgugccgcgcuagcucauucuacccacgaaauaucacucugaccuggagacaagauggcguuagucuuucccacaacacacagcaguggggagacguguugcccgaugggaaugguacuuaucaaaccugggucgccacaaggauucggcagggcgaggaacagcguuuuaccuguuacauggagcauucugggaaccacggaacgcacccugugccaagcggcaaagcacuggugcuacagucccaacgcacugacuucccguaugucucagcugccaugcccugcuuuguuaucauuaucauacucugugugccuugcuguaagaaaaagacaagugcggccgaggguccagaacugguaagccuucaggugcuggaucagcaucccgucgggaccggagaccacagagacgcagcucaguugggcuuccaaccucucaugucugccacuggcuccacagggucaaccgagggaacguga

SEQ ID NO: 59038 - RNA, 1431 nt, Artificial Sequence
  derived and/or modified sequence opt3 from MICU1__Homo_sapiens__NP_001182447
auguucagacugaacagccucuccgcccuugcugagcuggcagugggcucuaggugguaccacgggggaucacagcccauccaaauucggcgccgauugaugauggucgccuuuuuaggugcgagugcuguuaccgccagcacaggccugcuauggaagcgugcacaugccgaauccccuccaugcguggacaaucucaaaucugauauaggggacaagggcaaaaacaaggaugagggagacguauguaaucacgagaaaaagacugcugaucuggcaccgcaucccgaagaaaagaaaaagaaaagaucggguuucagggaccggaaggugauggaguaugagaaccgcaucagagccuacucaacgccugauaaaauuuuuagguauuucgcuacccuuaaggucaucagcgaaccaggggaggccgaaguguuuaugacacccgaggacuucguucggaguauuacuccuaaugagaagcagccagaacaccugggauuggaucaguacaucauaaaacgcuuugacggcaagaaaaucucccaggagcgagaaaaguucgcggaugagggcucuaucuuuuauacccucggggaaugcggacugauuagcuucuccgacuacauuuuucugacaaccgugcucucaacuccccaaagaaacuucgagaucgcauuuaaaauguucgauuuaaauggugacggcgaggucgacauggaagaguucgaacaggugcagaguauaauuaggagccagacaucuauggggaugcggcaucgugaucgcccuaccacgggaaacacucugaaguccggccuuuguucagccuugaccacauacuuuuucggugcugaccugaaagggaagcuaacuaucaagaauuuucucgaguuccaaagaaaacugcagcacgauguacuuaagcuggaauuugagaggcacgacccaguugauggacggauuaccgagcgacaguucggcggcauguugcucgccuauagcggggugcagaguaaaaagcugacagcaaugcaacgccagcugaaaaagcauuuuaaggaaggaaaagguuuaaccuuccaggaggucgaaaacuuuuucacguuucucaagaauaucaacgacguggauacugcucuuucuuucuaccacauggccggcgcgucccuggacaaagugacaaugcaacaggucgccagaaccguugcaaagguggaguugagcgaucauguaugcgacguggucuuugcucuauucgauugugacgggaauggagaacugucgaacaaagaguucgugucuaucaugaagcagaggcucaugcggggccuggagaagccgaaagacauggguuuuacucgccuuaugcaggccauguggaagugcgcucaagaaacagccugggauuucgcacugcccaaacaguga

SEQ ID NO: 59039 - RNA, 1593 nt, Artificial Sequence
  derived and/or modified sequence opt3 from MICU3__Homo_sapiens__NP_859074
auggccgcucugagaaggcuccuuuggcccccuccacgggugagcccgccccugugcgcacaccagccuuuguuaggcccaugggggcgccccgccgucaccacacugggacuaccuggucgaccauucuccucucgugaggacgaagagagagcgguugcugaagccgcauggaggcggcgcagaagguggggcgagcucucaguggccgcugcagccgggggaggccugguaggucuuguguguuaccaacuguauggggauccccgggcuggaaguccugccacuggccgcccaagcaaguccgcggcaacggaaccggaggaucccccucgaggcagagggauguugccaauccccgucgccgcugccaaagagaccguggcaauuggaaggacagacauagaagaccucgaucuguacgcuacuucucgggagcgucgcuuuagacuguucgccucgaucgaaugcgagggucagcucuuuaugaccccuuaugacuucauuuuagcgguuacaaccgaugagccaaagguggccaaaacuuggaagucacugagcaaacaggaacuuaaccagauguuggcagagacacccccggucuggaagggcaguuccaagcuguuuaggaaucuaaaagaaaagggggugaucucuuacaccgaguaucucuuccugcuuuguauucugacgaaaccucaugcuggauuucggaucgccuucaacauguuugacacugauggcaaugaaaugguagacaagaaagaguucuugguucuccaagagauauuucgaaagaagaacgaaaaacgcgagaucaagggugaugaagagaaaagagcuaugcugagguuacagcuguacggguaucacagccccaccaauuccgugcucaagacagacgccgaggaacuugucucacggaguuacugggauacucugcgcagaaacaccagccaggcauuguucucugaccuagccgagagggcugacgauauuacaucccuggugaccgacacgacucuccuggugcauuucuucggcaaaaagggaaaagcggaacuuaauuucgaggauuuuuaccguuucauggacaaccugcagacagaagucuuggagaucgaauuucucucauauagcaauggcaugaacaccauuagugaggaggauuucgcacacauccuguuacgguacacuaauguugaaaacacaucuguguuucuggagaauguacgauauuccauaccagaagagaaggggauuaccuucgacgaguuuaggagcuucuuucaauuccuaaacaaucucgaagauuuugccaucgcucugaacauguacaacuucgccucgagaucuauuggacaggacgaguuuaagcgcgcaguguaugucgccacgggucuuaaauucuccccucauuuggugaauaccguuuucaagaucuuugauguggacaaagaugaccagcugucauacaaggaauuuaucggcauuaugaaagaccggcuccacagaggguuuaggggauauaagacaguccagaaguaccccacuuucaaaaguugccugaagaaagagcuucacagccgcuga

SEQ ID NO: 59040 - RNA, 2004 nt, Artificial Sequence
  derived and/or modified sequence opt3 from MID1__Homo_sapiens__NP_001180206
auggagacccuggaaagcgagcucacaugccccaucugucuugaacuguucgaggacccuuuguuacugccaugcgcccacucccuauguuuuaacugcgcucauaggauucucgugucucacugugcaacuaaugaaucagucgagaguauaacggccuuccagugcccgaccuguagacauguuaucacacugagccaacggggccuugaugggcugaagcgcaacgugacuuugcagaauauuaucgaccgauuucagaaagcguccguaucuggacccaacucgccuucagagacccguagagaaagggcuuucgaugccaauacaaugaccagcgcagagaaggugcucugccaguuuugugaccaagauccagcccaggacgcugucaaaacuugcgugacaugugaaguuaguuacugcgaugagugccugaaggcaacccaccccaacaaaaagccuuucacgggucaucggcugauugagccaauccccgacucccacauacgcggccucauguguuuagaacacgaggaugaaaaggugaauauguauugcgucacugacgaucagcugaucugugcccuuugcaaauugguggggagacauagggaccaccagguagcugcccugucugagcgguacgauaagcuaaaacaaaaccucgaaagcaaucugaccaaccuuauuaagcgcaauacagagcuggagacuuugcucgcgaaacugauccagaccugucagcauguugaagugaacgcaucccgacaggaggccaaguuaacagaagagugcgaccugcucauugaaaucauacaacagagaaggcagauuaucggaaccaagauuaaagagggcaaggucaugcggcuucguaaacuggcucaacagaucgccaauuguaagcagugcaucgagcgcucagcaaguuugauuagccaggcugaacacucucuaaaagagaacgaccacgccagauuucugcaaacggcgaagaauauaacugaaaggguguccauggccacagcaucaagccaggugcucaucccugagauuaaccugaacgauaccuucgacacuuuugcucuugauuucagucgggagaaaaagcuguuggaaugucucgacuaucugacagccccaaauccgcccaccauccgagaggaauuaugcacggcuucuuacgauaccauaacaguccauuggacuuccgacgaugaguuuagcguugugucguaugaacugcaguacaccauuuucacaggucaggccaacguagugucucuauguaauuccgcagacucauggaugaucgucccuaacaucaagcaaaaucacuauacugugcaugggcuccagaguggaaccaaauacauuuuuaugguuaaggccaucaaccaggcuggcagccgcuccucugagccaggcaaacugaagacaaauagccagcccuucaaacuugauccuaagucagcgcacagaaaguugaaagugagucaugacaaccugaccgucgagagggaugaauccagcucuaagaaaucacacacuccagagcgguucacgagucaagggagcuacggaguggcagguaauguauuuauugacuccggccgccacuauugggaaguugugauaucugggucgacaugguacgccaucggacucgcuuauaagagcgcccccaaacaugaguggauuggcaagaacuccgcaucaugggcccugugcagaugcaauaacaauugggucgugaggcacaacaguaaggaaaucccgaucgagccugcuccccaucuucgucgggucgguauucuguuggacuacgauaaugggucuauagccuucuaugacgcacucaacagcauccaccuguacaccuuugauguggcguucgcucagccaguuuguccuacuuuuaccguguggaacaaaugcuuaacaauuaucaccggacugcccauuccagaccaccuagauuguacugagcagcuccccuga

SEQ ID NO: 59041 - RNA, 2208 nt, Artificial Sequence
  derived and/or modified sequence opt3 from MID2__Homo_sapiens__NP_036348
augggcgagagccccgccuccgugguccugaacgcuucugggggacucuucucacuuaagauggaaacccuggagagugaauugacaugcccuaucuguuuagagcuguuugaagacccacuacuccugccgugcgcacacagccuuuguuucuccugcgcccauaggauucugguuucuucguguucaagcggugagaguauagagcccaucacugcguuucagugcccuacguguagauacgugauuuccuugaaucaccggggccucgaugggcugaaacgcaacguaacccugcaaaauaucauugaccgauuccagaaggcuucugugagcggaccaaacucccccucagaaagucguagagagaggacauaucggccuacuaccgccaugagcucugaacgcaucgcaugccaguuuugugagcaggauccacccagagacgccgucaaaacaugcauaaccugugagguguccuacugcgauaggugccuccgggcuacucauccuaauaagaaaccauucacaucacaccgcuuaguugaaccggugcccgacacccaucugcgaggcaucacgugucuugaucacgagaacgaaaaggucaauauguauugcgugagcgacgaucaauugauuugugcacugugcaagcuaguagguagacacagggaccaucagguugccagucucaacgaucgguuugagaaacugaagcagacucuugaaaugaaucugaccaacuuggugaaacguaauucugagcucgagaaccagauggcuaagcugauccaaauuugucagcaggucgaagugaauacagccaugcacgaggcgaaauuaauggaagagugcgacgaacugguggagaucauacagcaacgcaagcagaugauugcagucaagaucaaagagacuaagguuaugaaacucagaaaacuugcccagcaaguggcuaacuguaggcagugccuggaacgguccaccguauugauuaaucaggccgagcauauccuaaaggaaaacgaucaggcacgauuccugcaaagcgcuaagaacaucgccgagcgcguggcgauggccacagcaucgucucagguccucauuccugacauaaauuuuaacgacgcuuucgaaaauuuugcccuggauuucuccagagagaaaaagcugcuugagggguuggacuaccucaccgcuccaaaucccccuucaaucagggaggaacuguguacggccagucacgauacuauuacagugcacuggaucagcgacgaugaauuuuccauaucuagcuaugaguuacaguacaccauuuucacuggacaggcaaacuucaucucaaagaguuggugcuccuggggccuguggccagagauccggaaauguaaggaagccguuagcugcucucgccuagcuggcgcgcccagagggcucuauaacucaguggacaguuggaugauugucccgaauaucaaacaaaaccauuacacagugcacggacugcagagcgguaccagguacauuuuuauaguaaaggcaaucaaucaggccggcucccguaacucugagccuacgcggcuuaaaaccaauucgcagcccuucaaguuggauccaaagaugacacauaaaaagcugaaaauuagcaacgacgggcuccaaauggaaaaggaugaguccucacugaaaaagagucacacuccugaacgauuuucuggaaccggcugcuauggugcugccgggaauaucuucaucgacagcggaugucauuacugggagguugugaugggcuccucaacaugguaugcaauuggcauagccuacaagagcgcucccaaaaacgaguggaucgggaagaaugccucuuccugggucuuuaguagaugcaacagcaacuucguggucaggcacaauaacaaagaaaugcuuguggauguuccaccccaccugaagcgcuugggagugcuccuggacuaugacaauaacauguuaucuuuuuacgauccugcaaauucccugcaucuacacacuuucgacguaaccuuuauucucccagucuguccgacauucaccaucuggaacaaaucacugaugauucuuagugguuugcccgcgccugauuuuaucgacuauccagagcggcaggaaugcaauuguagaccccaggagagcccuuacgugucgggcaugaagacuugccauuga

SEQ ID NO: 59042 - RNA, 348 nt, Artificial Sequence
  derived and/or modified sequence opt3 from MIEN1__Homo_sapiens__NP_115715
augagcggcgaacccgggcagaccuccguggccccuccaccggaagaggucgaacccggaucugguguuagaaucgugguagaguacugcgaaccuuguggcuucgaggcuacauaucuggagcucgcaucagccgugaaggaacaauacccagggauugagauagaaaguaggcuuggaggcacuggugcguuugagaucgagauuaacgggcagcuggucuucagcaaauuggaaaauggaggcuuucccuaugagaaggacuuaaucgaagcuauucggcgcgccuccaacggcgagacgcuggagaaaaucaccaauucucgaccuccaugcgugauacuauga

SEQ ID NO: 59043 - RNA, 1638 nt, Artificial Sequence
  derived and/or modified sequence opt3 from MIER2__Homo_sapiens__NP_060020
auggccgaggcuagcucccugggcagacagucucccaggguggucucaugccucgaacacagucuuuguccuggggagccaggacugcaaaccacagcaguugugagcauggguuccggcgaccaucaguucaacuuggccgaaaucuuaucucagaauuacucgguacgcggggagugcgaagaggcgucacgguguccggauaagcccaaagaggaacuggagaaggacuuuauuagccagaguaacgauaugccuuucgacgaacuacucgcucuguauggauacgaggccuccgauccaauaucugaccgagagagcgaaggcggugauguggcacccaaucuuccugacaugacucuggauaaagagcaaaucgccaaggacuugcucuccggggaagaggaagaggagacgcagucaagugcugaugaccugaccccaagcgucacaucucacgaagcauccgaucuguuucccaaccguucaggaagcagauuccucgccgacgaggacagggaaccuggcaguucugcuuccagcgauacugaggaagacucguuaccagccaauaaaugcaagaaggagauuauggugggcccgcaguuucaggcggaucugucuaaccuucauuugaaucggcacugugagaaaaucuaugaaaacgaggaccaacugcuaugggaucccuccguucucccugaacgcgagguggaagaguuccuguacagagcagucaagaggcgguggcaugagauggccgggccacagcuucccgaaggagaggcugugaaagacucagaacaggcccuguaugaguugguaaagugcaauuuuaacguugaggaagcacuccgccgacugagauucaaugugaaagucauuagggaugguuuaugugcuuggagugaggaagagugccggaacuuugaacacggcuuccgugugcacgggaagaauuuucaucugauccaggccaacaaggugcgcaccagaagcgucggagaguguguugaguacuauuaccucuggaaaaaguccgaaagguacgacuauuucgcgcaacagacacggcuuggccgacgcaaauacgugccuucugguaccacugaugccgaccaggaucuggacgggagcgacccagauggacccggcagaccgaggccugagcaagacacauugaccggcaugcggacggauccccuaucaguagacgggacugcaggaggucuggaugaaccaggcguggcuagugacgggcucccuuccagcgagcccggaccaugcucuuuucagcagcuggaugaaucacccgccgucccucuuagucaccgcccaccggcucuggccgaccccgcaagcuaucagccugccgugaccgcuccagagcccgaugcguccccuagauuggcaguugacuucgcccucccaaaggagcugcccuuaauaucuucgcauguggaucugagcggcgacccggaagagacagucgcuccugcccaaguggcacuauccguaacugaguucggucucaucgggauuggcgauguuaauccauuucuggccgcucaccccaccuguccugcccccggacuucacucagaaccauugagucauugcaacgugaugacaugcuga

SEQ ID NO: 59044 - RNA, 1653 nt, Artificial Sequence
  derived and/or modified sequence opt3 from MIER3__Homo_sapiens__NP_001284528
auggccgaggcuagcuucggcuccucuucacccguggggagucugagcuccgaagaccacgauuuugacccuaccgcagagaugcucguccaugauuacgacgaugaaagaacacuugaggaagaggagaugauggacgaaggaaagaacuucucuucggagaucgaagaucuggagaaagaggguacuaugccauuggaagacuuacuggccuuuuauggcuacgagccgacgauucccgcgguugcuaauucaagcgccaacaguuccccuucugaacuagcagaugagcucccagacaugacccuggauaaggaagagauagccaaagaccuucugagcggggaugacgaggaaacacaguccucagcugacgauuugacucccagugugaccagccacgagacaucugacuucuuuccuaggccacuccgguccaauaccgcaugcgauggagacaaggaaucagagguagaagauguggagacugacagcggcaacagucccgaggaucugcgcaaagaaaucaugauuggucugcaauaucaggccgagaucccuccauaccucggggaauaugacggaaaugagaaggucuacgaaaacgaggaucaguuacugugguguccggacgugguucuugagucuaaggugaaagaauauuuggucgagacaucccugcgaaccggcagcgaaaagauuauggaucguaucucggcuggcacgcauacuagagacaaugagcaggcccuauacgagcuccugaaaugcaaccacaauauaaaggaagcgaucgagagguacuguugcaacgggaaagcaucucaagaaggaaugaccgccuggacagaggaagagugucgguccuucgagcaugcucuuaugcuguuugguaaggacuuccacuugauucagaagaauaaagugcgcacuagaaccguagccgaaugcguugcauuuuauuacauguggaagaaaucagagagguaugauuacuucgcucagcagacacgguuuggcaagaaacgcuauaaccaccaucccggggugaccgacuacauggaucgacucgucgacgaaacggaggcccugggaggcacugugaaugcgagugccuuaacaagcaacagaccugaaccaauccccgaucaacagcugaauauucucaacuccuucaccgcaucugaccuuacugcucugacaaacagcguggccaccgucugugauccuacggacguuaauugcuuggaugacucauuuccaccccuagguaacaccccgaggggacaggugaaucacguaccuguggucacagaggagcugcucacucugcccaguaacggggaauccgauuguuucaaucuuuucgagaccggcuuuuaucauagcgaacugaacccaaugaauaugugcucugaggaaucagagcggccugcuaagcguuugaaaaugggcaucgccgugcccgagaguuucaugaacgaaguuagcgugaauaaccucggggucgacuuugagaaucacacacaccauauaacuuccgcaaagauggccgugucuguagcugauuucggaucgcugagcgcgaacgaaaccaaugguuuuauuuccgcacacgccuuacaucagcacgcugcccugcauucagaguga

SEQ ID NO: 59045 - RNA, 348 nt, Artificial Sequence
  derived and/or modified sequence opt3 from MIF__Homo_sapiens__NP_002406
augcccauguucaucgugaacaccaaugucccuagagccagcguuccagacggcuuucuguccgagcucacacagcaacuugcucaggcaacugggaagccgccccaguacauugccgugcacguagugccugaucagcugauggcguucggagguucuucagaaccaugcgcuuuguguaguuuacauagcauaggcaaaaucgggggagcccaaaacagguccuauucuaagcugcuaugcggccuccuggcagagcggcuucgcauuucgcccgaccgagucuacaucaauuauuacgauaugaacgccgcuaauguggguuggaacaauucaacguuugcauga

SEQ ID NO: 59046 - RNA, 1158 nt, Artificial Sequence
  derived and/or modified sequence opt3 from MILR1__Homo_sapiens__XP_011522929
augcagaccagcuccaagcccucugacuuccugaaccucgccaaaaagaaaagaaaguuuucagagcuucugacaacuguggucuuguuaugccugcuaacgccuaguuggaccagcacaggcaggauguggucccaccucaaucggcugcuuuucuggucuaucuuuucgucaguuacuugucgcaaagcugugcuggauugcgaagcaaugaagaccaacgaguucccaagcccguguuuggacaguaagacaaaaguagugaugaaggggcaaaaugucuccauguuuugcucucauaaaaacaagagccuccagauuaccuacucccuguuccgacguaaaacucaccugggaacacaggaugguaagggcgaacccgccauauuuaaucucucaaucaccgaggcgcaugaaagugggccuuauaaguguaaagcucaggugacgagcugcucuaaguacuccagagacuucucauuuacuauuguugauccagugaccagccccgucuuaaacaucauggugauucaaacagagacugacaggcacaucacccugcauugucuuaguguaaauggaucuuugccuauaaacuauacauucuuugagaaucacguugccaucuccccagcaauuagcaaauacgaucgggaacccgccgaguucaaccugaccaagaaaaauccuggcgaagaggaggaauaucgcugcgaggcuaagaacagacuaccaaauuacgcaacguauucgcacccggugacuaugcccucuacagguggggacuccuguccuuuuugccucaaacugcuucugccaggauugcuccuguuacuggucgugaucauucucauccuugccuucugggugcugcccaaguacaagaccaggaaagcuaugcggaacaaugucccucgcgaucgaggcgacacugccauggaaguuggcauauacgcgaacauuuuggagaagcaggcaaaagaagagucagugccagagguagggaguagacccugugugagcacagcccaggaugaagcuaagcauucccaggagcuacaauaugccaccccggucuuccaggaaguggcaccuagggagcaggaggcuugcgacucuuacaaaagcggauauguuuacucagaacugaacuuuuga

SEQ ID NO: 59047 - RNA, 1395 nt, Artificial Sequence
  derived and/or modified sequence opt3 from MINA__Homo_sapiens__NP_116167
augcccaagaaagccaagccuaccggcagcgggaaagaggaaggaccagcuccgugcaagcagaugaaacuggaggcagccgguggccccuccgcgcucaauuucgacucuccuucaagucuuuuugaaagccugaucuccccaauuaagacagagacuuucuuuaaggaguucugggaacaaaaacccuuguuaauacagagagaugacccugcucuggccacguacuaugggucucuauuuaagcucaccgaucugaaaucgcuuuguucaaggggaauguacuauggccgggacgugaaugucugccgcuguguuaacgguaagaaaaaggugcugaauaaggaugggaaagcacacuucuugcagcuccgaaaggacuuugaucagaaacgugccacaauccaauuccaucagccacagagauuuaaggacgagcuguggaggauucaggaaaaacuggagugcuacuucggaagccucguaggcaguaacguguauaucacucccgcuggcucccaaggguuaccuccacacuacgaugacgucgaaguguuuauucugcagcuugagggagagaagcauuggcgguuguaucacccgaccguuccccuggcacgcgaauacucuguggaggccgaagagagaaucgguaggccuguccaugaguucaugcuaaaaccaggcgaucuccuguacuuuccccgggggacaauacaccaggcugacaccccugccggacuugcgcacagcacucaugugacaaucuccaccuaucagaauaacucauggggcgauuuccuguuggacacgauuaguggucucguauucgacacugcaaaggaagauguugagcugcgcaccgggaucccacgacaauuacugcucguggaaagcacaacugucgccaccagaaggcuuucuggauuucugcggacauuggcugaccgucuagagggcaccaaggaacugcucuccucagauaugaaaaaggacuucauuaugcaccgccugcccccguacagcgccggcgauggggcagagcuuaguacgccuggagguaaacugcccagauuggacucuguggugaggcuccaguuuaaggaucauaucguccugacuguuuuaccagaccaggaucaauccgacgaagcucaggagaaaaugguguauauauaccacagccugaaaaauucgcgggagacacacaugaugggcaacgaagaggaaaccgaguuccaugggcuacgauuuccucucucucaccuggaugcccuuaagcagauuuggaacucccccgcgaucucaguaaaggacuugaagcugacuacagacgaagagaaagagagucucgugcugagccuuuggaccgaaugucugauucaggucguguga

SEQ ID NO: 59048 - RNA, 3939 nt, Artificial Sequence
  derived and/or modified sequence opt3 from MINK1__Homo_sapiens__NP_001020108
augggcgaccccgccccugcuagaagccuggaugacaucgaucucuccgcacuuagggacccagccgggauuuucgagcugguggaagucguuggaaacgguaccuacggccagguguauaaggggcggcacguaaaaacaggacaauuggcggcuauaaaggugauggaugucacugaggacgaagaggaagagaucaaacaggagauuaauauguuaaagaaauacucucaucaccgcaacaucgccacguauuacggcgcauuuauuaagaagucaccgcccgguaaugaugaccagcuguggcuagugauggaguucugcggggccggaaguguuaccgaucucgugaaaaacacaaagggcaaugcucugaaagaagacuguaucgcauauauaugccgagaaauccuucguggccuggcccauuugcacgcucauaaggucauucacagagauaucaaagggcagaacgugcuccugacugagaaugccgagguaaagcugguugacuuuggagugagcgcgcaacucgauaggaccgucggucggcgcaacacauucauuggcaccccuuacuggauggcaccagaagugaucgccugugacgagaaucccgacgcuacuuaugauuacagauccgacauauggucuuuagggauuacagccaucgaaauggcagagggagcuccuccacugugcgauaugcaccccaugagggccuuguuucuuauuccucggaacccaccgccccgccugaagucgaaaaagugguccaaaaaguucaucgacuuuaucgauaccugucuaauuaaaacguaccucagccgaccuccaacugaacagcugcuuaaguuccccuuuauaagagaccagccuaccgagcggcaagugaggauccagcugaaagaucauauugaccguagucgcaagaagagaggcgagaaagaagagacagaauaugaguacuccgguucugaagaggaggaugacagccacggggaagagggagaaccauccucaaucaugaauguccccggcgagaguacuuugaggcgggaguuccuccgacugcagcaggaaaacaagagcaauucugaggcguuaaaacagcaacagcagcugcaacagcagcagcaacgcgauccggaagcccauauaaagcaccuccuucaccagagacagaggcggauugaggaacagaaagaggagcgcagaaggguugaggaacaacagcgucgggaacgagagcagagaaagcugcaggaaaaggagcaacagaggcgcuuggaggacaugcaggcacuacggagagaagaggaaaggcgccaggcugagcgagaacaagaguauaaacggaagcagcuggaggaacagcgucaauccgagagacuccagaggcagcugcagcaagaacaugccuaccuuaaaucacugcagcagcagcaacagcagcagcaauugcagaagcagcaacagcagcagcuccugccuggcgaccgcaaacccuuauaucacuacgggcggggaaugaacccagcugauaagccugccugggcaagagagguggaagagaggacccgaaugaauaagcaacagaacagcccccuggccaaaaguaagccagguucuacaggccccgagccuccaaucccgcaggcuucccccgggccuccaggaccccuaagccagaccccuccaaugcaacgccccguagaaccgcaggagggcccucauaaaucgcuccaggaccagccaacgcggaaccuggcggcauuucccgccucucacgauccugaccccgcuaucccagccccuacugcaacacccuccgccagaggugcugugauuaggcaaaauucagauccaaccagugaagggccgggcccuagccccaacccacccgccuggguccguccugacaaugaggcaccacccaaggugccucagcgcacuuccucuaucgcgacagcucuuaacaccagcggagccggcgggucacggccggcacaggccguuagagcuaggccacgaaguaauuccgccuggcagauuuauuugcaacggcgcgcagagagaggaacgcccaaaccuccaggucccccugcucagccgcccggcccaccuaacgccagcucuaaucccgaucugaggcggucagacccagggugggaacgaagugauagcgugcucccugcgucccauggacaucugccccaggccggcucucuugagagaaaccgcgucggugugucgagcaagccagacuccucaccgguacugaguccugggaauaaggcuaaacccgaugaccacaggucucguccaggccggcccgcagauuucguuuugcucaaggaaagaacccuggacgaggccccuaggccacccaaaaaggcuauggacuacagcuccucaagcgaagagguggagucuuccgaagaugacgaggaagagggagaaggcgggccugccgagggaagucgcgauacaccggguggccgaagcgacggggauacugacucugucuccaccauggugguccacgauguggaggaaauaacaggaacucaaccacccuacggcggugggaccaugguugugcagagaacaccugaggaggaacggaacuuacugcacgcagacucaaauggcuauaccaaccuacccgauguaguccagccaagucauagcccuacugaaaauucgaaaggacagucacccccaucuaaggacggcagcggggauuaccaaucaaggggacucgugaaagcgccuggcaagaguuccuuuacgauguucguugaccuggguaucuaucagcccgggggaucuggcgauagcauuccgaucacagcccuuguggguggcgaggggacccgcuuggaccagcugcaguacgacguccguaagggauccgugguaaacgugaauccaacuaacaccagagcucacucagagacaccugaaauccggaaauauaagaaaagguucaacagcgagauucucugcgccgcacuguggggcguuaauuuacuggucgggaccgaaaacggacuuauguugcucgaucgcaguggccaagguaagguguacgggcugauaggacgaagacgguuucagcagauggacgugcuagagggccugaaucuccugaucacuauuucugguaaaaggaacaaacuucgcgucuauuacuuguccuggcugagaaauaagaucuuacacaacgaucccgagguugagaagaagcagggcuggacaacggugggggacauggaaggauguggccauuacagggugguaaaauaugaacggauuaaguuccucgucaucgcucugaaaagcucgguggagguuuacgccugggcaccaaagccuuaucacaaguuuauggccuucaaaucauuugcugaucuuccccaucguccgcuguugguggaccucaccgucgaagaggggcaacgccugaaggugauauacggaucuagugcgggcuuccacgccguugauguggacuccgguaauagcuaugauaucuacauuccaguacauauccagucucagauuacuccucacgcaaucauauuucuacccaacacagacgggauggagaugcugcucugcuaugaagaugagggagucuacgugaauaccuacggccgaauuaucaaagacgugguccugcaauggggugaaaugccaacaagcguugcuuauauuuguuccaaccagaucaugggcuggggagagaaggccauagaaaucagaucaguggagacugggcaccuugacggcguauucaugcauaaaagggcccagcgguugaaguuucugugcgagcgcaaugauaagguguucuuugcuagugucagaagcgggggaucuucccagguguacuucaugaccuuaaacaggaauuguauuaugaacugguga

SEQ ID NO: 59049 - RNA, 939 nt, Artificial Sequence
  derived and/or modified sequence opt3 from MINPP1__Homo_sapiens__NP_001171588
augcugagagcccccggcugccuccuuaggaccagcguggcuccugcagccgcgcuggcugccgcauuguuauccucucuggcccgguguucacuacucgagccacgcgacccggucgcuaguagccugucccccuacuucgggacaaagacucgauaugaagauguuaacccugugcuucugucuggaccagaggcacccuggcgugacccugaauugcucgaggguacgugcaccccaguacagcugguggcccugaucagacacggcacaagguaccccacugucaaacaaauucggaagcuccgccaguuacaugggcugcuucaggcuagaggaucgagggauggcggugccucaagcaccgggagucgggacuugggagcggcacuggccgauuggccucuaugguaugcugacuggauggauggccagcucguggaaaaaggccgccaagacaugcgacagcuggcccuuagacuggcauccuuguuuccagcucucuucucuagggagaauuacgggcggcugcguuuaauaacaagcuccaagcaccgcuguauggauucaagugccgcguuucugcagggacucuggcagcauuaucacccgggucuucccccuccagacguugccgauauggaguucgggcccccuaccgugaacgacaaacugaugagauuuuucgaucauugcgaaaaguuuuugacugaggucgaaaagaaugcaacagcucuauaccacguggaggccuucaaaaccggcccagagaugcaaaacauccugaagaaaguagcugccacgcuccagguucccgugaaugaccugaacgcaggacuuagccaguuucuguugcagucuuccucaagccucgucaugcaaaggcuguucuuucacuguuucuuaaguugggccacuucuaagacccggaauccguga

SEQ ID NO: 59050 - RNA, 858 nt, Artificial Sequence
  derived and/or modified sequence opt3 from MIOX__Homo_sapiens__NP_060054
augaaggugaccgucggccccgacccuagccugguuuacagaccagauguggacccggagguagccaaagauaaggcuuccuucaggaacuauacaucugggccccuccuugaccggguguuuacuacguacaaacugaugcacacccaucagacagucgauuucgugcgcucaaagcacgcacaauuuggagguuucaguuauaaaaagaugacuguuauggaagccguggacuuguuagauggccuggucgacgagagcgauccugacguggauuuuccaaauuccuuccaugcguuucagaccgcugaagggauccgaaaggcccaccccgacaaagauugguuccaucuaguaggacuccugcacgaccuuggcaagguucuggcauuguuuggugagccucagugggccguggucggggacacauucccagugggaugccguccccaggcuucuguggucuuuugugauucgaccuuccaagacaacccugaucuccaggacccaagauacucaacugaacugggcauguaucagccgcacugcggccuggauaggguucucaugagcugggggcaugacgaguacauguaucaggugaugaaauuuaauaaguucaguuuacccccugaggcauucuacaugauucgguuucacuccuucuacccauggcauacaggacgcgauuaucaacagcuguguucucagcaggaccuugccauguugcccuggguaagagaauuuaacaaauucgaucuguacaccaagugcccugaccuaccagauguggacaagcucaggcccuauuaccaaggucugauagacaaauauuguccgggcauccuuagcugguga

SEQ ID NO: 59051 - RNA, 2142 nt, Artificial Sequence
  derived and/or modified sequence opt3 from MIPEP__Homo_sapiens__NP_005923
augcugugcgugggcagacucgggggacuuggugccagggcugcagcccugcccccucggcgcgcgggccgagggagcuuggaggcuggaauccgugccagaagggucuccaccucuuggucaccaguuggcgcagccuucaacgugaagccgcaggguagucgguuagaccuguuuggggaacgcagaggacuauucggcguacccgagcucagcgcuccugaaggcuuucacauugcacaagagaaagcccugaggaagacagaacuucugguggaucgggcuuguuccacuccacccgggccucagacggucuugauauucgacgagcucucugauucgcugugccgcguggccgaccuggcggauuuuguuaaaaucgcacauccagagcccgccuuccgagaagcugccgaggaagcauguagaucaauuggaaccaugguggagaagcucaauacaaacgucgacuuauaccagagccugcagaaacuuuuggcugauaagaagcugguggacagucuagauccugagacuaggcggguagccgaacucuuuauguucgacuuugagaucuccgguauucaccuggauaaagaaaagcguaaacgcgcgguugaccuuaaugugaagauccuggauuugucuagcaccuuccucaugggcacaaacuuuccaaauaaaauagagaagcaucuguuaccggaacacaucagaaggaacuucaccuccgccggggaccauauuaucauugacggacugcacgcagagucacccgaugaccucguccgggaggcugccuauaagaucuuucuuuacccuaaugcuggccaacugaaaugcuuggaggaacuacugaguagccgagaucuccuggccaaacuuguggguuauucuacuuucucccaccgcgcacugcaggggacaauagccaagaacccagaaaccgugaugcaguucuuggagaagcucucagacaaacugagcgaaagaacguuaaaggauuuugagaugauuaggggaaugaaaaugaagcugaauccccagaacagugaggucaugccuugggacccacccuacuauucuggcguuauccgggcugaacgcuacaauauugagccgucccuauauuguccuuucuuuagccucggcgcgugcauggaagggcugaacauccuuuugaauagacugcucggaaucucgcuguacgcagagcaacccgccaagggugaaguguggucugaggauguaaggaaacuugcugugguccaugaguccgaaggccuguugggguacauuuauugugacuucuuucagcgugccgauaagccacaccaggacugccauuucacuauacggggaggccgacucaaagaggauggugacuaccagcugccugugguuguguuaaugcugaaccuacccagaucaaguaggagcuccccaacccuccugacacccgggaugauggaaaaucuuuuucacgagaugggccacgcaaugcauucuauguugggacgcacucgguaucaacacgucaccggcacaagauguccuaccgacuucgccgaggugccaagcauccugauggaauacuuugcuaacgauuauaggguaguuaaccaguucgcccgccauuaccagacggggcaaccgcuccccaagaauauggugucacgacugugcgagaguaaaaaggucugugcagcggcugacaugcaguuacagguguuuuaugccacucuggaucagauuuaccacggaaagcauccucuucggaacuccacaaccgacaucuugaaagaaacucaagagaaguucuacggucucccauauguccccaauacagcauggcagcugcguuuuagccaccuagugggcuacggggccagauauuacucuuaucugaugucaagggcuguugccaguaugguguggaaagaaugcuuccuccaggauccuuucaaccgcgcagcuggagagcgguacagaagggagaugcuggcccacggcggugggcgagaaccaaugcuuaugguagagggcauguugcagaagugccccagcgucgacgauuuuguguccgcgcugguuucugacuuagaucucgacuucgaaaccuuucugauggauucggaguga

SEQ ID NO: 59052 - RNA, 792 nt, Artificial Sequence
  derived and/or modified sequence opt3 from MIP__Homo_sapiens__NP_036196
augugggagcugagaagcgccuccuucuggagggcuaucuuugcagaguucuuugccacccucuucuacguguuuuucggccuugggucuucacugcggugggcgcccggaccuuugcacgucuuacagguugcuauggccuuuggucuggcacuagccacacucgugcaaaguguaggccauauuagcggggcucacgugaacccagcagucacuuucgccuuucuggugggaucccagaugucucuucugcgcgcuuucugcuauauggccgcgcaguugcucggcgcaguugccggugcugccgugcuguacucggucacgccgcccgcagugcgagggaaucuggcucucaacaccuuacauccugccguaucaguuggacaggcgacaacuguggaaauauuucugacccuucaauucgucuuguguaucuuugccacauaugacgaacguagaaauggccagcugggcagcguggcacuagcugugggguucagucucgcccugggacaccuuuucgguauguacuauaccggcgcugggaugaacccagccagguccuuugcacccgccauucugacuggaaauuucacaaaccauugggucuacuggguuggcccuaucauuggugggggauugggcucucuccuguaugacuuuuuacuguucccacggcucaagagcaucuccgagcgccuuucagugcugaaaggcgcuaagcccgauguaaguaaugggcagccugaagugaccggagagccagucgaguugaacacgcaggcgcuauga

SEQ ID NO: 59053 - RNA, 1329 nt, Artificial Sequence
  derived and/or modified sequence opt3 from MIPOL1__Homo_sapiens__NP_620059
auggagaacuggagcaaggacaucacccacuccuaccuggaacaggagacaacuggcauuaauaaaucuacgcaacccgaugaacagcucaccaugaacucagagaagaguaugcauagaaaaagcacagaacuugugaaugagauaacuugcgagaacaccgaauggccugggcagagguccacaaauuuccagaucauuucuucguauccagacgaugagucagucuacuguaccacugaaaaguauaacguuauggagcaccggcauaaugacaugcacuacgagugcaugacaccgugucaagugaccagcgauagugacaaagaaaagacgaucgccuuucuguugaaggaguuagauauucugcgcacuuccaacaaaaagcuacagcagaaacucgcuaaggaagacaaagagcagcgaaagcugaaguucaaacuugaacugcaagagaaggagaccgaagcaaaaaucgccgagaagacagcggcuuugguagaagagguguauuuugcccagaaagaacgugaugaggcagucaugucuagacuccagcuggccauagaggaaagggacgaggcuaucgcacgggccaagcauauggaaaugagccugaaagugcucgagaauauuaaccccgaagagaaugauaugacuuuacaggagcugcuuaaccgcaucaauaacgcugacaccggaauugccauccaaaagaauggugcgauaauuguugauagaaucuacaagacaaaagaaugcaagaugaggauuaccgcagaggaaauguccgccuugaucgaggagcgggacgcugcccugucaaaauguaagcgccuagaacaggagcuccaccacgugaaagaacagaaccaaacgagugcaaacaauaugcgacaucugacugcugagaacaaucaggaaagagcccuuaaggcgaagcuguugagcaugcagcaggccagggagacagcaguccaacaguauaaaaagcucgaggaagagauccagacccugcggguguacuacucuuuacacaaaucccugucacaggaagagaaccucaaggaccaauucaauuauacucuuagcacauacgaagaggcucugaaaaaccgugagaauauuguaaguauaacccagcagcagaacgaagaguuggccacgcaacuacagcaggcucugaccgaacgcgccaauauggagcuccagcugcaacaugcaagagaagccucucagguugcuaacgagaaggugcagaaacuugagaggcuggucgauguguugcggaagaaggugggcacagggacuaugcgaaccgucaucuga

SEQ ID NO: 59054 - RNA, 354 nt, Artificial Sequence
  derived and/or modified sequence opt3 from MIR1-1HG__Homo_sapiens__NP_848558
augcccagcugcuccugugcccugauggcuccuugcggcccagcagccgggccggcggcuguggagagaacccagcaagucgccaggggagaacccgguucugcacggggccagcuccagguuucaccugagaugaguaucacacacaaggaaaaagagaacgcccaucuuaaggaaauucuguuguucgugaaugcugaggcauuuagccagccacaaccccacuccgccccuguaugugaggggcagcaguuaacuggaaaauucucuacgucggugcugacccgcgcuggcggugacgccucaccaugcagcugggaacgacuacucuguuacggguggagucauugcuga

SEQ ID NO: 59055 - RNA, 3399 nt, Artificial Sequence
  derived and/or modified sequence opt3 from MIS18BP1__Homo_sapiens__XP_005267890
augaucgccacaccccugaagcacagcagaauuuaccucccuccagaggcuuccucucagaggcggaaccuuccgauggacgcaauauucuuugauucaauccccaguggcacccugacuccugugaaagacuuggucaaguaucaaaauagcuccuuaaaacugaacgaucauaagaaaaaucaguuccuaaagaugacgaccuuuaacaauaagaacauuuuccagucuacaaugcucacugaagccaccacaucaaauucgagccuggacaucagugcgauuaaaccaaacaaggaugggcuuaaaaauaaggcuaacuacgagucccccggaaaaaucuuucugcgcaugaaggaaaagguuuugcgagacaaacaggagcaaccuucucguaauagcucccuccuggaaccacagaagucagguaacaaugagaccuucacucccaacagaguggagaaaaagaaacugcagcacacauaucucugcgaagagaaggaaaauaacaaaaguuuucagagcgaugacucuuccuuaagggccucaguacaaggcgugccucuggagagcaguaacaaugauauauuccuuccagucaagcagaagauccagugucagcaagagaaaaaggcaccguugcauaaccugaccuacgaacuacccacgcucaaucaggagcaggaaaacuuucuggccguggaggcucggaauaaaacucuuacccgcgcacaacuggccaagcagauuuuccacucuaaagaauccaucguugcuacaacuaagagcaagaaagacaccuuuguguuggagucggucgauucugccgacgagcaguuccagaacacaaaugcggaaacccucuccacgaacugcauuccuaucaagaaugggucacuguuaauggugagugauagcgagagaacuacagaaggaaccucccaacagaaaguaaaggagggcaacgguaaaacuguuccaggggaaacaggacugcccggcucuaugaaggacaccuguaagauagugcucgcaacgccuaggcuucauauuaccaucccacggcgcagcaaacgaaauauuucaaagcugagucccccgagaaucuuucagacagucacuaacggcuugaaaaagaaucagguggugcaacuacaggaguggaugaucaaauccauuaacaauaacaccgccauaugcgucgaggggaagcugaucgacguuacaaacauuuauuggcacagcaaugugaucauagaaaggauugagcacaacaagcuccggacuaucucuggaaauguauacauccugaaagguaugauugaucagaucucaaugaaggaagcuggcuauccuaacuaccuuauucguaaauucauguucggguuucccgagaauuggaaggaacauauagacaacuuccuggagcaguugcgcgccggagagaaaaauagagaaaagaccaaacaaaagcagaagacaggcaggagugugcgggauauccgaaaaagcaugaagaacgacgcacgcgagaaucagaccgauacugcucagagagccacgacaaccuacgacuuugauugugacaaccucgaacugaaauccaauaagcacucugagucgccaggugcgacugaguuaaacaugugccauagcaauugucaaaacaaaccuacccugagguuccccgaugaccaggucaauaacacaauucagaacgggggaggcgaugaccuauccaaucaagaacucaucggcaagaaggaguauaaaaugucaaguaagaaacugaagaucggggaacggaccaacgagcgcauuauaaaaucucagaagcaggaaacuacagaggagcuugacgugagcaucgauauuuugacguccagagaacaguuuuucucagacgaggaaaggaaguacauggccaucaaucaaaagaaggcauauauucugguuaccccacucaaaagccguaaggugaucgagcagcggugcaugcgauacaaccugucugcuggaacuauaaaagccgucacagauuuugugauccccgaaugucagaagaaguccccuauuaguaaaagcauggguacccuugagaauacauucgagggccacaagucuaaaaacaaggaagacugcgaugagagagaccuguugacuguaaauaggaaaaucaagauuuccaaccucgaaaaagagcagaugcugaccucagauuuuaagaagaauacgcgcuuacugccaaaacuaaagaaaaucgaaaaccaaguugcuaugaguuucuauaagcaccagagcucgccggaccucuccucugaggagagcgaaaccgagaaagaaauaaagcggaaggccgaggugaaaaagacaaaagcagggaauacuaaggaggccgucgugcaucugagaaaaucaaccaggaacacaaguaauauucccgucauccuugaaccugagacugaagaguccgaaaacgaguuuuacauuaagcagaagaaagcucgcccaucugugaaggagaccuugcagaaaagcggaguucgaaaggaauuucccaucacggaggcggugggcuccgauaaaacaaaucggcacccucuggaaugucucccaggucugauacaagacaaggaguggaacgaaaaggaguuacagaaacugcauugcgcauuugccucacuucccaagcacaaaccgggguucuggagcgagguagcugccgcagucggcagucguucuccugaagagugccagagaaaguauauggaaaacccaaggggaaaaggcucccaaaagcaugugaccaagaaaaagcccgccaauagcaaagggcagaacggaaagcgcggugaugcugaccagaaacagacuaucaagauuacagccaaaguuggcaccuugaagcggaagcaacagaugagagaguuccucgaacagcugccuaaagaugaccacgacgauuucuucucgacuacaccccuacagcaccaaaggauccugcucccaucauuucaggacucugaggaugacgaugacauucugccuaauauggauaagaaccccaccacgccaaguuccgugaucuucccgcuugucaaaaccccucagugucagcaugugagccccgggauguugggaucuauaaaucgaaacgacugcgauaaguacguauuucgcaugcaaaaauaccacaagagcaauggcgguauugugugggggaacaucaagaaaaagcugguugagacugacuucuccacaccaacaccccggagaaaaaccccuuuuaauacugauuuaggcgaaaacucaggaaucggcaaacucuucaccaaugcagucgagagucuggacgaagaggagaaagauuauuacuuuagcaacucugacuccgcguga

SEQ ID NO: 59056 - RNA, 1260 nt, Artificial Sequence
  derived and/or modified sequence opt3 from MITF__Homo_sapiens__NP_000239
augcuggagaugcucgaauacaaccacuaucaggugcaaacccaucuugagaaucccacaaaguaccacauccagcaggcccagagacaacaggucaaacaguaucugagcacuacguuggcuaacaagcaugcaaaucagguuuuaucccugccuugcccaaaccaaccgggcgaccacgugaugcccccuguaccagggucuucagcccccaauaguccuauggcgaugcuaacccucaacagcaauugugaaaaagagggauucuacaaguuugaggaacagaacagggcugaguccgaaugcccagguaugaauacacauucucgggccucguguaugcagauggaugacgugauugaugacauaaucucacuggagagcaguuauaacgaagagauucuuggccugauggaucccgcauugcagauggccaauacucucccugucuccgggaaccugaucgaccuguacggaaaucaaggccucccaccgcccgguuuaaccauuucuaacagcugcccugcuaaucugccaaacaucaaacgcgagcuuacagcauguauauuccccaccgaauccgaggcccgagcuuuggccaaggaacgucagaagaaagauaaccacaaucugaucgagagaaggcggcgcuuuaacauuaaugacagaaucaaggaacuagggacucucauuccuaaaucaaacgauccagacaugagguggaauaagggaacaauccugaaagcgaguguggauuauauacggaaacuucagcgcgagcaacagcgagcaaaggagcuggaaaacagacagaagaaguuggagcacgccaauaggcaucuccuguuacggauucaggaacuggagaugcaagcucgugcccacggccucagccuuauccccucuaccggccugugcuccccggacuugguuaaccgcauuaucaaacaggaaccugugcuagagaauuguucacaggaucugcuccagcaucacgcagaccugacgugcacuaccacacuugaccugacugaugggaccaucacauucaacaauaacuugggaaccgguacggaggcuaaucaagccuacagcguccccacuaagaugggcaguaaacucgaagacauucugauggaugacacauuaucuccaguggggguaaccgauccucugcuauccagcguuucgcccggagcgucuaagacuuccucaagaaggaguagcauguccauggaggaaacagagcacaccuguuga

SEQ ID NO: 59057 - RNA, 723 nt, Artificial Sequence
  derived and/or modified sequence opt3 from MIXL1__Homo_sapiens__NP_001269331
auggccaccgcugagagcagagcacugcaguucgccgaaggcgcggcuuuucccgccuacagggcaccucacgccgggggagcucuccuuccaccgcccuccccugcagccgcucuguugccagcgcccccugccgguccaggccccgcaacauucgccggguuuuuaggacgggacccuggcccagcuccgcccccuccagccucucuggguucacccgcaccuccaaagggggcugccgcgcccagugccagccaacgccgaaaacguacuuccuucucugcagagcagcuacagcuccuggaacuuguguuuagaaggacgcgguauccggauauucaucugcgcgagagauuggcugcccucacccugcugccugaaucgaggauucagcucuuauucucaccccuguuucaagucugguuccagaaccggcgcgcuaagagccgaagacagaguggaaaauccuuucagccacuugccaggccugagauaaucuugaaucacugcgcacccggcacagagacuaagugucugaaaccacaacuaccccucgaaguugacgugaacugccugccugagccaaauggcguagggggagguauuucugauagcuccucacagggccagaacuucgaaaccuguaguccgcuuagcgaggacaucgggucuaagcuggauuccugggaggaacauaucuuuucagccuucggaaauuuuuga

SEQ ID NO: 59058 - RNA, 8691 nt, Artificial Sequence
  derived and/or modified sequence opt3 from MKI67__Homo_sapiens__NP_001139438
auguggcccaccagaaggcuggugacaaucaagcggagcggcgucgacgggccucacuucccacucucccuuucuacuugccuguuuggacgcgguauugagugugauauacgaauccaauugccgguugugucaaagcaacauugcaagauugaaauccacgagcaggaagcaauuuuacauaacuucaguagcacgaaucccacccagguaaacggcuccgugaucgacgagccuguccgucugaaacacggggaugugauaacaaucauugacagaucuuuuagguacgaaaaugagucgcuucagaacggacggaagucaacugaguucccacgcaaaaucagagaacaagagcccgcuaggcggguuagccgcaguuccuuuucuagcgauccugacgaauccgagggcauuccacucaagcgaagaagggugucauucggugggcaucugcggcccgagcuuuuugaugaaaaucugccuccaaacaccccguugaagcguggagaggcacccacaaaacgcaagagucucgucaugcacaccccuccagugcugaaaaagaucauaaaagaacagccccagccuagcggcaagcaggagucuggcuccgaaauucacguagagguuaaggcccaaucacuggugaucagcccacccgcgccgaguccuagaaaaacucccgucgcuucugaccagaggcggcgauccuguaagacagccccagcaagcucgucuaaaucccagaccgaggugccuaagcgcgggggaagaaaaucagguaaucuccccaguaagagggugagcauuucccggucucagcaugauaucuuacaaaugaucugcagcaaacgcagaucaggcgccagugaagcuaaccugauugucgcaaaguccugggccgacguugugaaacuuggggcuaaacagacgcagacuaagguaauaaaacacggaccacaaaggagcaugaauaagcgucagcggcgacccgccaccccuaaaaagccagugggcgagguccauucucaguucucaacaggucacgcgaacaguccguguacuaucauuaucgggaaggcacacaccgaaaaagugcauguucccgccagaccuuauaggguguugaauaacuuuauaagcaaucagaagauggauuucaaagaggaccuguccggaauugcugaaauguuuaagacaccagucaaagagcaaccccagcugaccucuacgugccacaucgccaucucgaacagcgagaaucuccugggcaagcaguuccagggcacugauuccggggaagaaccucuucugccaacaucagaaaguuuuggagguaacguguucuucucugcacaaaacgcugccaagcagcccagcgacaaauguuccgcgucaccgccuuugcgccggcagugcauuagagagaauggcaacguagccaagaccccaaggaauacuuacaaaaugacaagccucgaaaccaagacgucugacaccgagacagagcccuccaaaacuguuaguaccgcaaaccgcagcgggcgaucuacagaauuucggaauauccagaagcugccuguggaguccaagucagaagagacuaacaccgagauugucgaauguauauuaaaacguggacaaaaggcuacacugcuccagcagagaagggagggcgaaaugaaagagaucgaacgccccuucgagaccuauaaggagaauauugaacuuaaagagaacgaugaaaagaugaaagccaugaagcggaguagaacuuggggucagaagugcgcuccaaugagcgaccugacggauuugaaaucgcuaccugacacagagcugaugaaggauaccgccagggggcaaaaucuccugcagacucaggaccaugcaaaagcccccaaguccgaaaaaggcaagaucaccaagaugccaugucaaucucuucagccggagccuaucaacacacccacccacacuaaacagcagcugaaggcuagcuugggaaaagugggcgucaaggaggaacuccuggcgguggggaaauuuacacgaacgucaggagagaccacucauacacaccgcgaaccagccggugauggcaagaguauucggaccuucaaggagucccccaaacaaauauuagacccugccgcuagaguuacagggaugaagaaauggccaaggacucccaaggaagaggcccagucucuggaggaucuagcaggauuuaaagaacucuuccagaccccuggcccgagcgaggaauccaugacggacgagaagaccacaaagaucgccugcaaaucaccacccccugagagcguggauacuccaaccaguacaaagcaguggcccaaacguucucugcgcaaggcugacguagaagaggaauuucuugccuugcggaaacugacuccuuccgcagguaaggcgaugcucaccccgaaacccgcugggggcgacgagaaggauauuaaggccuucaugggaacgccaguccaaaaacuggaccuugcaggcacacugccugggagcaagagacaguugcagacccccaaagaaaaggcccaggcucucgaggaucuggccggauuuaaagaguuauuccaaacuccaggucacacagaagaacugguggcagcuggcaagaccacuaagaucccuugcgacucgccccagucagauccaguugacaccccgacaucuacgaaacagaggccuaagcgaaguauucggaaagccgauguggaaggggagcuacucgcgugucgcaaucugaugcccuccgccggaaaggcuaugcauaccccaaaacccagcgucggcgaagagaaggacaucauaaucuuuguggguacuccuguacaaaaacuugauuugacagagaaccugaccgggucuaaaagaaggccacagacacccaaggaagaggcacaggcccucgaagaccugacuggcuucaaagaguuauuucagaccccuggacacacggaagaggcuguggccgcaggcaagacaaccaaaaugccgugcgagagcuccccacccgaaucagcggauacuccuaccaguacacggcgacaacccaagacuccacuggagaagagagacguucagaaagaacuuagcgccuugaagaaacucacccagacaucuggggagacgacccauacugauaaggucccuggaggcgaggacaaauccauuaaugcuuuccgcgaaacagccaagcagaagcuggaccccgcagcuucagugaccgguaguaaaaggcacccaaagacuaaagagaaggcccaaccucuagaagaucuggcagggcucaaagagcuguuccagacaccgguguguaccgacaagcccacgacucacgagaagaccacaaagaucgccugccguagccagccagauccugucgacacccccacuuccucuaagccacagucgaaacggagccuuagaaagguugauguggaggaggaauuuuucgcuuugaggaaacgcacaccuucagcgggaaaggccaugcauacccccaaaccggcaguguccggcgagaagaacauuuacgcuuuuauggguacaccaguacaaaagcuggacuuaacugaaaaucucaccggcaguaaacgaagacugcagacgccuaaggagaaagcccaggcccuugaagaucuggcuggguucaaggaguuguuucagacacggggacacaccgaggaaucuaugacuaacgacaaaaccgcaaaggucgccuguaagagcucccaacccgauccagacaaaaaccccgcgucaucuaagaggcgccucaaaacaagccugggcaagguggggguuaaagaggaacuacuggcugugggaaagcucacucagaccaguggcgagacgacacauacccacacugaaccuacaggugaugggaaguccaugaaagccuucauggagagcccgaagcagauccuggacucugcagccucacuuaccggauccaaacgucaauugagaacucccaagggcaaaagugaggucccagaagaucuggcugguuuuauagaguuauuccagacaccuagccauaccaaggaaucgaugacgaaugagaaaacuaccaaggugucuuaucgggcaucccagcccgaccucguugacacaccuaccagcucaaagccacagcccaaaaggagucugcgcaaggccgauacagaggaagaguuucuugcguuccgaaaacaaacuccuucugcuggcaaggccaugcacaccccaaaacccgcagugggggaagagaaggacauuaacacguuucugggaacaccgguacagaagcuagaucagccuggcaaucucccaggguccaacagacggcugcagacuaggaaagaaaaggcccaggcuuuggaggagcugaccggauuccgcgaauuauuucagacacccugcaccgacaauccuacuaccgaugagaaaacaacgaagaaaauccucuguaagagcccacagucagaccccgccgauacuccgaccaacacaaagcagagaccuaaaaggagucugaagaaagcagacgucgaagaggaguuccuugcuuuccggaagcugacccccagcgccggcaaagcgaugcacacuccaaaggccgcagugggugaggagaaggauauuaauacauuuguggggaccccugucgaaaaauuggaccuccugggaaaccuacccggcuccaagcgucgcccacaaacgcccaaagagaaggcuaaagcccuggaagaucuugcugguuucaaggagcucuuucagacuccuggccauacagaagagucuaugaccgacgacaaaaucaccgagguuagcugcaaguccccacagccggaucccgugaagacuccuacaucaucuaaacaacgacugaagauaaguuuggggaaaguaggagugaaggaagagguccugccagugggcaaauuaacccagacaucggggaagacuacgcagacccacagagaaacagcaggagacggcaagagcaucaaagccuucaaggaguccgccaaacagaugcucgaucccgcuaauuacgguacugggauggagagguggccucggaccccaaaggaagaggcgcaaucucuggaagaccuugcaggauuuaaagagcuguuccagacacccgaucauaccgaagagucaacuacggacgauaagaccacaaagauugccuguaaaagcccuccgccagaguccauggacacucccaccaguacacgcagaaggccuaagacccccuugggcaaacgggauaucguugaggaacucucugcucugaagcagcuaacucagacaacgcacaccgacaaagugccaggcgaugaagacaaggggauuaacgucuuucgagagacugccaagcaaaaacuggauccugcagccagcgugacaggaucaaagagacagccccgcaccccaaaagguaaggcucagccgcuugaagaccucgcgggccugaaagaguuguuccagaccccuaucugcacagacaagcccacuacgcaugagaagaccacaaaaauagccuguagguccccacaacccgauccuguugggacuccaaccauuuuuaagccccagaguaaacggagcuuacguaaggcagacguggaagaggaaucucuggcucucagaaaaaggacaccuuccgucggaaaggccauggauaccccgaaaccagcaggcggugacgagaaggauaugaaggccuucauggggacucccguacagaaacuggaccuuccuggaaaucugccaggcucaaagcgcuggccccagacgccuaaagaaaaggcucaagccuuggaggaucuagcgggcuuuaaagagcuguuccagacacccgggaccgacaagccaacuaccgaugaaaagacaacuaaaaucgcaugcaagagcccgcagccugaccccguggauaccccagccucgacaaaacaacggccuaagcgaaaccucagaaaagcugacguugaggaagaguuccuggcccuuaggaagcgcacgcccucugcuggaaaggcaauggauaccccaaaaccugccgugagugacgagaagaauaucaacacuuuugucgaaacacccgugcagaaauuagaccugcucgguaauuugccgggcuccaagcggcagccacagaccccuaaagagaaggcugaagcccuggaggaucucguaggguucaaggaacuguuucaaacucccggacacacagaggagagcaugaccgacgauaaaauuacggaagugucaugcaaguccccacagcccgagucuuucaaaaccagcagaaguuccaagcagcgucuuaaaaucccucuggucaagguugacaugaaagaggaaccguuggcagugagcaagcuaacaaggacuucuggcgaaaccacacagacucacaccgagccaacaggugauucaaagaguauuaaagcguuuaaggagucccccaaacaaauacuggacccugccgcuagcgugaccgggucucggcgccagcuccgaacuagaaaggaaaaagccagggcauuagaggaucuggucgacuucaaggaacuauuuucggcucccggacauacggaggaaucaaugacaaucgauaagaacaccaaaauuccauguaagagcccucccccagagcugacugacaccgccacauccacgaaacggugcccuaagacccgcccgagaaaagaggugaaggaggaacucagugcaguugaaagguugacucagacaucuggccagagcacccacacucauaaggagcccgccuccggcgaugaggggaucaaaguacugaagcaacgagcuaaaaagaaaccaaacccuguggaagaggaacccucacggcguagaccacgcgcgccuaaggagaaggcccagccccucgaagaccuggcaggauucacagagcuuagugagaccucuggucacacacaggaaagccuaacugcuggcaaagccaccaagauuccgugugaguccccaccucuggaagucguggacacgaccgccucaacaaaaaggcacuugcggacuagaguucaaaaggugcaggucaaagaggaacccagcgcagugaaguuuacccagacaucuggggagacuaccgaugcugacaaagagccagccggagaagauaagggcaucaaggcguuaaaagaguccgcuaagcagacgcccgccccugcagccaguguaacagguagccgcaggcgaccccgggcuccaagagaaucggcacaagccauagaggaccuggcgggguucaaagauccugcugccggacauaccgaagaguccaugacugacgauaagacaaccaaaaucccgugcaagucuucacccgagcucgaagacacugcaaccagcaguaagaggcgcccacguacacgggcccagaaagucgaggugaaggaggaacugcuugcuguuggcaaacugacgcagaccuccggcgagacuacacacaccgauaaggaaccugugggggagggaaaagguacuaaggccuuuaagcagcccgcaaaaagaaagcucgacgcugaagaugucauuggcucuaggcgccaaccacgagccccuaaagagaaggcgcagcccuuggaagaccuggccagcuuccaggagcuaucacagacaccggggcauaccgaggaacuggcaaauggagcugccgauuccuuuacgagugcaccuaaacaaacaccagacagcggcaagccccucaagaucucucggagagugcuuagggcuccuaaaguugagccagugggugacgucgugucaacccgcgaucccguaaagucccagagcaaaucuaacaccagucugccuccauuacccuucaagagagggggaggcaaagacggcucggugacugggacaaagcgguugagguguaugccggccccugaagagauuguugaggaacugcccgccuccaagaaacagcgugucgcgccacgagcucgcggaaagagcucagagcccguggugaucaugaaaagaucucuccggacuagcgcaaagaggauagaaccugccgaggaacuaaauuccaacgauaugaaaaccaauaaggaggaacacaaacuucaagacagugucccagagaacaaggguauuucacugcgcucuagacggcagaauaagacagaggcugaacagcagaucacggagguauucgugcucgccgaaaggaucgagauuaaccgaaaugagaaaaagcccaugaaaacuagcccugaaauggauauacaaaacccagacgauggcgcacguaagccgauccccagagacaaaguuaccgagaauaagcgcugcuugcgguccgccaggcagaacgaaaguagccagccuaagguggcugaggaauccgggggacagaaaucugcgaagguccugaugcaaaaucagaaaggcaagggugaggccgggaacucagauagcauguguuuaagaucgcgcaaaacaaagucccagccagcagcuaguacccuagagucuaagagcgugcagcggguuacuaggucagugaaacgaugcgccgaaaaucccaagaaagcagaggacaacgucugugugaagaaaauuagaacacggucccauagggauucugaagacaucuga

SEQ ID NO: 59059 - RNA, 1713 nt, Artificial Sequence
  derived and/or modified sequence opt3 from MKKS__Homo_sapiens__NP_061336
augagcagacuggaggccaagaaacccucccucugcaagucugaaccucuuaccacagagagggugcggacuacgcugucagucuugaaacgcaucguuaccaguuguuacggcccaagcgggcgauuaaagcagcugcacaacggauucgguggcuaugugugcacaacuucccaaucuucggcucuacucucacaucugcuuguaacccacccgauucugaaaauauugacagcaagcauccagaaucaugugaguuccuuuucugacuguggacucuucaccgccauucugugcuguaaccugaucgaaaauguccagcgucucggguuaacucccacaaccgugauuagacugaacaagcaccuuuugagccugugcaucuccuaccuaaagucagagacguguggcugcaggauaccuguugauuuuaguagcacucagauccuccugugucuugugcggucuauucugaccuccaaaccagcgugcauguugacacgcaaggaaacugagcaugucucagcucucauccugagagccuucuuacugaccauucccgagaaugcagaaggucacaucauacucgggaaaagccuuauugugccucugaagggacaaaggguaaucgacaguacaguuuugccaggcauucuaaucgagaugucugaagugcagcugaugcggcuccugcccaucaaaaaguccaccgcccuuaaggucgcucuguuuuguacgacuuugagcggcgauacaucggacaccggggagggaacugugguggucucuuaugguguuucccucgagaacgcagugcuggaucaguuacugaaucuaggccgccagcucauuucagaccacguagaucuggugcuuugccaaaaagucauacauccuaguuugaagcaguuccugaacaugcaccgaaucauugccaucgacagaauaggggugacacucauggaaccacugaccaaaaugacgggaacccagccgauuggcagccuugguuccaucugccccaauucuuacgggagcguuaaggauguguguacagcuaaauuuggaucaaagcauuucuuucaccugaucccuaacgaggccacuauuugcaguuugcuccuguguaauaggaacgacaccgcgugggaugaauuaaaacugacaugccagacugcacuacacguccuccaacugacccuuaaggagccaugggccuugcugggcggcggguguacagaaacccaucucgcugccuauauccggcacaagacucauaaugaccccgaguccauucugaaagaugacgagugcacgcagacagaauuacagcugauagcagaggcuuucuguagcgcccuugaaucugugguaggaucauuggagcacgacgguggcgaaauccucaccgauaugaaguacgggcaucuguggaguguucaagcggacagcccuugcguggccaacuggccagaucuacugucccaguguggaugcggccucuauaauucucaggaggagcugaacuggucguuucuucguagcacucgcagacccuucgucccgcaguccuguuugccucacgaagcaguggguucagcuaguaaccugaccuuagacugccucacagccaaacugucugggcuucaagucgcuguggagaccgccaaucugauuuuggaucucagcuacguuaucgaagacaagaacuga

SEQ ID NO: 59060 - RNA, 2796 nt, Artificial Sequence
  derived and/or modified sequence opt3 from MKL1__Homo_sapiens__NP_001269589
augcccccucucaagagcccagccgcuuuccacgagcagagaaggucccuggaacgggcacgcaccgaggacuaccuuaaacgaaagauccguucuagaccggaaaggucagagcuggugcggaugcauauuuuggaagagacaagugccgagcccagcuuacaagcgaaacagcugaagcuaaaacgcgcuagacucgccgaugaccugaacgaaaagauagcacagaggccuggcccaauggagcuugucgaaaagaauauccugcccguugaguccucuuugaaagaggccauuaucguggggcagguaaacuauccuaagguggcugauucgagcagcuuugacgaagauaguuccgacgcacucucuccagagcaacccgccagccacgaaucccagggaucagucccuaguccacuggaggcucgggugagcgaaccgcugcucucugccacuuccgcgucacccacgcagguugugagccaguuaccuaugggucgcgauagucgagagaugcuguuccuugcagagcaaccacccuugccuccacccccgcugcuaccucccucucucaccaauggcacaacuauuccaaccgccaaauccacaccuacccugaucaagcagagccagcccaaaucggcuucugaaaagucccagagaucaaagaaagccaaggagcuuaaaccaaaggucaaaaagcugaaauaccaucaauauauacccccugaccagaagcaggauaggggagcaccaccgauggacaguagcuacgcuaagaucuugcaacagcagcagcucuuucugcaauuacagauucugaaccagcagcaacagcagcaccauaauuaucaggccauccuccccgcgccuccaaaauccgccggggaagcacuuggcucuagcgguacucccccugugcggucacugaguacaaccaacuccucaucuucaaguggggcuccaggacccugcggcuuggcccgucaaaauagcacgucccuaacuggcaagccgggggcucugccugccaaccucgaugacaugaaaguagcagagcugaagcaggaacuuaaacugcgcucuuugccaguuucgggaaccaagacagagcucauugagagacugagggccuaccaggaucagaucagccccgugccuggugcucccaaggcgccagcagccacuuccauauuacacaaagcuggcgaagucgugguggccuucccugcagcccggcugucaaccgggcccgcucuagucgccgcaggacucgcgccagcugagguugugguagccacaguggcaaguucuggcgucgugaaguuugguagcaccggguccacgccgccuguuucacccacuccaagcgaacgaucucugcuuuccacaggagacgagaauaguacccccggcgacacuuucggcgaaauggugacaagcccuuugacccaacugacgcuccaggccucuccacugcagauucuugucaaagaggaggggccccgcgcuggauccuguugccugucaccugguggcagagccgaauuggaggggagggauaaggaccaaaugcuccaggaaaaagauaagcagaucgaggcacugacccggauguuacgccagaagcaacagcugguggagagacuaaaacuccagcuggaacaggagaagagggcucaacagccggccccagcgcccgccccucuuggaacaccaguaaaacaggaaaacaguuuuagcucgugucaguugucccaacagccccugggcccugcucacccguucaaucccucucucgcagccccagcuacuaaccauauugacccuugcgccguugcacccgguccaccuagcguggucgugaagcaggaggcgcugcaacccgaaccagagccggucccugcaccccaguuacugcuugggccacagggccccucauugaucaaaggaguggcuccuccaacccucaucacagauaguacuggcacccaccugguucuaacagugaccaauaagaacgccgacucccccgggcugucuagcggauccccucagcaaccgucaagccagccagguagucccgccccugcucccucugcccagauggaucucgagcauccacugcagccucuuuuuggcacucccacguccuugcugaagaaagaaccaccuggguaugaggaagcaaugagccaacagccgaagcagcaggagaauggaucgucaucucaacagauggacgauuuauucgacauucucauacagaguggcgaaaucuccgccgauuuuaaagagcccccaagccugccugguaaggagaaacccucuccaaagacaguaugugggagcccucuugcugcgcagcccuccccgucagccgaacugccacaagcagcuccucccccacccggcaguccuagcuugccgggacgucucgaggacuuccuggaaucuuccaccggccuaccccugcucacuucagggcacgacggaccagagccucugagucuuauugaugacuugcacagccagaugcuguccucuaccgccaucuuagaucaucccccuucgccaauggacacaagcgaacuccacuuuguccccgagccuucauccaccaugggucuggaucuugccgacggccaucuggauaguauggacuggcuagagcucucuagcgggggaccagugcuguccuuggcuccccugucaacuacagcaccgucuuuauucagcacggauuuccucgacggccacgaucugcagcuucauugggacaguugccuguga

SEQ ID NO: 59061 - RNA, 3150 nt, Artificial Sequence
  derived and/or modified sequence opt3 from MKL2__Homo_sapiens__NP_054767
auggaccacaccggcgccaucgauacagaggacgaaguggggccccuggcucaucucgcaccuagcccacaguccgaggccgucgcgcacgaguuccaagagcuuucucugcagucaagucagaacuugccgcccuuaaaugaaagaaagaacguucugcagcuaaggcuccaacagcggcgcacucgagagcagcugguggaucagggaauuaugccuccacuuaaaagccccgcugccuuucaugagcaaauaaagucccuggaacgugcaagaacggagaauuucuugaaacacaagaucaggucucggccugaccgcucggaacucguaagaaugcauauucuggaggagaccuuugccgaaccaucacugcaggcuacacagaugaaacucaagagggcacgguuagccgaugaccugaacgagaagaucgcucagcgccccgguccuauggaacuuguggagaaaaauauuuugccagucgauagcagugugaaggaagccaucauaggcguugggaaagaggacuacccgcacacucaaggagauuucuccuuugacgaggauucuagcgacgcgcugucccccgaucagccugcaucacaggaaagucaaggcagcgccgcuucuccauccgagcccaaggugucagaaagcccuaguccagucaccacaaacacccccgcccaguucgcaucuguguccccgacuguaccugaguuucuaaaaacacccccaaccgcugaccagccucccccacgacccgccgcgccuguucucccaacgaauacugugagcucggccaagccgggucccgcacuggucaagcagucucacccuaaaaacccaaaugacaagcauagauccaaaaagugcaaagaucccaagccuagggugaaaaagcucaaguaucaccaauacaucccacccgaccagaaaggggaaaagaacgagccgcagauggauucaaauuaugcucggcuguugcagcaacagcagcuuuuccugcaguuacaaauucugagucagcagaaacagcauuacaacuaucaaaccauccucccugccccauuuaagccccuuaaugacaaaaacagcaauuccggaaacucugcucugaacaaugccacaccuaacacuccccgucagaauaccagcacaccagugcgcaagccuggccccuugccaucaagucuagaugaccugaaggucuccgagcucaaaaccgaacugaaacuuagaggccugccgguuagcgggacgaagccugauuugauugagaggcucaagcccuaccaggaagugaacucuucaggacuggcagccgguggcaucguagcugugaguagcuccgcgauagucacuucuaauccagaggugacaguugcauuacccgugaccacucugcacaacacagucaccucgagcguguccacgcuaaaagccgaacucccuccaaccgggacaucaaaugcuacucggguagagaacguucacaguccccugccuauuucuccgagcccauccgagcaaucaagccuuucuaccgacgauacaaauauggccgacacuuucaccgaaaucaugacaaugaugucccccagucaguuuuugagcagcuccccucugcgaaugaccaacaaugaggauucacucaguccaacuagcucgacgcuguccaaccuugaacuggacgcagccgagaaggaccgcaaguugcaggagaaagaaaagcagauugaggaacucaaaagaaagcuggagcaagaacagaaauuaguggagguccugaagaugcagcuagagguggaaaagaggggacagcaacagcggccccucgaggcucagccuucugccccgggccauagcgucaaaucagaucagaagcacgguagucugggguccucuaucaaagacgaagcaagccuucccgauuguuccucaagccgccaaccaaucccuguggcgagucaugcuguuggacagcccgugucuacaggcggccagaccuugguagccaagaaagcagucgugauuaagcaagagguuccaguggggcaggccgaacagcaguccgucgugagccaauucuauacuucgccucaggcuggaaugcagacccagccccaaauagccacagcagcucagaucccaaccgccgcgcuggccucaggucucgcuccgacuguaccucagacacaggacacguuuccccaacacgugcugucucagccacagcagguuagaaaagucuucaccaauagugcauccagcaacacuguguuacccuaccaaaggcauccugccccagcugugcagcagcccuucauuaauaaggccucuaacagcguccugcaaucccguaacgcaccucuuccgucauugcagaauggcccaaacacacccaauaagccuaguucucccccaccuccccagcaguuuguugugcaacacucucucuucggguccccaguggcgaaaaccaaggauccuccgcgguacgaggaggccaucaaacagacacgaucaacucaggcuccccugccagaaauaaguaacgcccacagccagcaaauggacgaucuauuugacauucugaucaaguccggagagaucucucucccuauuaaagaagaacccucgccaaucagcaagaugagaccuguaaccgcaucaauuacgaccaugcccgucaauacagugguuuccaggccgccaccucaggugcagauggcucccccagucagucuggaacccaugggcucucuuagcgccuccuuggagaaccagcuggaggcauucuuagaugguacucucccuucagccaaugaaauaccgccccugcaaucuagcagugaggaccgcgaaccauuuucccuuaucgaggaucugcagaacgacuugcucagccauucugggaugcuggaucacucacauuccccuauggagaccagugaaacacaguucgcugcgggcacucccugccuaagccuggaccucucggacucuaaucuggauaacauggaguggcuugacauuaccaugccuaauuccagcucaggauugacgccacugaguacaaccgcccccucuauguuuuccgcagauuucuuagacccucaagaucucccacugcccugggacuga

SEQ ID NO: 59062 - RNA, 2208 nt, Artificial Sequence
  derived and/or modified sequence opt3 from MKLN1__Homo_sapiens__NP_037387
auggccgcuggcggggcaguggccgcggcucccgagugcagacugcucccuuacgcccuucacaaguggagcuccuucucuucaaccuaucugccagaaaacaucuuggucgacaaaccgaaugaucagaguuccagguggagcucugagucgaacuaucccccucaauacuuaauucugaagcuagaacggccagcaauaguucagaauaucacauuuggaaaauacgagaagacucauguguguaaccucaaaaaguucaagguauuugguggcaugaaugaagagaacaugacggagcugcuuucaagcgggcugaaaaaugacuauaacaaggaaaccuucacauugaaacacaagauugaugagcagauguuucccugccgcuucaucaaaauugugccucuccugaguuggggaccauccuuuaauuucucuaucugguacgucgaacugagcggcauagacgaucccgacaucgugcagccuugucucaacugguauuccaaguaccgagagcaagaggccauucguuuaugccugaagcauuuuagacagcacaauuacacugaggcuuucgagucacuucagaaaaagaccaaaaucgcauuggaacauccaaugcugacagauauucacgacaagcuaguucucaaaggugauuuugacgccugugaggaacugaucgagaaggcugugaacgaugggcuuuucaaucaguauauaagucaacaggaguacaaaccgagguggagccagauuauccccaagucuaccaagggagacggcgaagauaaccggccuggcaugcgcgggggacaccagauggucauugacgugcaaacugagacaguauaucuguuugguggcugggacgggacccaggauuuggccgacuucugggcguacuccguuaaagaaaaucaguggacgugcaucucaagagauacugagaaggaaaacggaccaagcgcaaggaguugucauaaaaugugcaucgacauucaacggcgccagauauauacccucggccgauaccuggauucuuccgugagaaacagcaagucguuaaaaucugacuucuauagguacgauaucgacacaaauacuuggaugcugcucuccgaggauaccgccgcugacggugggcccaagcucgucuuugaucaccagauguguauggacucagagaagcauaugauuuacacauucggaggccggauccugaccugcaacggcaguguggacgauagccgugccuccgaaccucaguuuucuggguuguucgcauuuaauugucaaugccagacguggaaacuacugcgcgaggacagcugcaacgcuggaccagaagauauacagucaagaauuggucacuguaugcuuuuccacaguaagaauaggugccuguauguguuuggcgggcagcgguccaaaacuuaccuuaacgacuucuuuagcuaugaugucgacucugaucauguugacaucaucucagauggaacaaagaaagacaguggcauggugcccaugaccgguuucacucaacgagccacaauugauccggagcugaaugaaauccacguauugagcgggcucuccaaggacaaggagaaacgcgaggaaaacgugagaaauucuuuuuggauuuacgauauagucaggaacucguggagcuguguguauaagaaugaccaggcggccaaagacaacccuaccaagucccugcaggaggaagaacccugcccacgguucgcacaucaguuaguuuacgaugagcugcacaaagugcauuaucuauuuggcggaaauccuggcaagucauguagucccaagaugcgccucgacgauuucuggucucugaaacuuugcagaccaagcaaggacuacuugcugaggcacuguaaauaccucauccguaagcaccgguucgaagagaaagcucaagucgauccccuguccgcccuuaaguaucugcagaacgacuuguacauuacgguggaucauucagacccugaagagaccaaagaauuucagcuccuggcuagcgccuuauucaagucuggguccgauuuuacagcacugggauucagugacguagaucacacuuaugcccagcgaacccaacuauuugacacacucguuaauuucuuuccagauagcaugacuccgcccaaggguaaccugguggaccuuaucaccuuguga

SEQ ID NO: 59063 - RNA, 990 nt, Artificial Sequence
  derived and/or modified sequence opt3 from MKNK1__Homo_sapiens__XP_011540651
auggccaagagcaugcccuccaaaucuucaagaaacaagcagggcaccgugggggucggaugcuucgagagguggcggcgcuguaucaguguucgagaaacaagcuccauucuggcucacauacaaaaacagaagcauuuuaaugagcgugaagcaucuagagugguaagggacguggccgcggcucucgauuuccuucacacuaaagguaucgcccaucgggaccugaagccugagaacauuuugugcgaaucgccagagaaggucucaccggugaaaaucugugauuuugacuuaggcagcgggaugaagcugaauaacaguugcacgcccauuaccacaccugagcuaacuaccccauguggauccgcagaauacauggcccccgagguuguggaagucuucacagaucaggcuaccuuuuaugacaaacgcugcgaucucuggucucugggcgugguacuuuacaucaugcugagcgguuauccuccauucguugggcacuguggagcagacugcggcugggauagaggcgagguguguagggucugccagaauaaguuguuugaguccauacaagaagggaaauacgaguuccccgacaaggauugggcccauaucucaagugaagcuaaggaccucauuagcaaacugcuggugcgggaugccaagcagcgccucucugcggcacagguguuacagcacccuuggguccaaggacaggccccagagaaaggucugccgacuccccagguucuucagcgaaacuccucaacaauggacuugacccuguuugcugccgaagcaaucgcucuaaauagacaacucagccagcacgaggagaacgaacuggccgaggaaccugaggcgcuugccgacggccuguguaguaugaaguugucuccacccugcaaauccaggcucgcacggcgucgcgcucuggcccaggcugggagaggagaagauaggagcccuccaacggccuuauga

SEQ ID NO: 59064 - RNA, 1245 nt, Artificial Sequence
  derived and/or modified sequence opt3 from MKNK2__Homo_sapiens__NP_060042
auggugcagaagaaacccgccgagcugcaaggcuuccacaggagcuuuaaggggcagaacccuuucgaacucgcuuuuucccuugaccagccagaucauggagacucugauuucggucugcagugcucagcaagaccggacaugcccgccagucaaccuaucgauauuccagacgcgaaaaagcggggcaaaaagaagaaacgcgggcgagcuaccgauagcuuuuccggacguuucgaggacgucuaccaguugcaggaagauguuuuaggcgagggugcccacgcaagagugcagacauguauaaaucugaucacuucucaagaauaugccguaaagauuaucgagaaacagcccgggcauauuaggucgcggguguuucgcgaggucgaaaugcuauaccagugccagggacacagaaacgugcucgagcugaucgaguucuuugaagaggaagacagguucuaucuuguuuuugagaagaugcggggcggcucaauacugagccauauccacaaacgccgacacuucaaugaauuggaggcuaguguggucgugcaagauguagcauccgcccucgacuuucugcauaacaaggggauugcucacagagaucugaagccugaaaauauccucugugagcauccaaaccagguuucucccgugaaaauuugcgacuucgacuuaggaagcgguaucaagcugaauggcgauuguuccccuauaucaacgccagagcuuuugaccccgugcgggagugccgaauacauggcgcccgaggucguggaagcauucagcgaggaagccucuauuuaugacaaaaggugugaucuguggucccuaggagugauccucuacauucugcuuucaggcuauccuccauuugucggucggugcgggagcgacuguggaugggaucguggcgaggcuugccccgccugucagaacaugcuguucgagaguauccaagaaggcaaguacgaguuuccugacaaagauugggcacacaucucuugcgcugccaaggacuugauuuccaaacuccugguucgcgaugcgaagcagagauuaagcgccgcacaggugcugcagcacccauggguacaagggugcgcucccgaaaauacacucccgacuccuauggugcuucagaggugggacucgcauuuccuguugcccccacacccuugucggauacauguccgacccggaggucuagugcgcaccguuacagugaacgaguga

SEQ ID NO: 59065 - RNA, 990 nt, Artificial Sequence
  derived and/or modified sequence opt3 from MKRN1__Homo_sapiens__NP_001138597
auggccgaggcugcaacccccggcacaacugccacgaccagcggggcgggagcugccgcagccacagcugcagccgcuuccccuacuccaaucccgaccgugacagcccccucucugggugcgggcgggggaggcggugggucagacggaaguggcggcggguggaccaagcaggucacuugcagauacuucaugcacggaguuuguaaagaaggugauaacugcagguauagccaugaccucuccgauucuccuuacucggugguauguaaguauuuucaacggggcuacugcauuuauggggaccgcugucgauacgagcacucaaaaccacuuaagcaggaagaggcaacagccaccgaacugacgacuaaaagcaguuuggcugccuccucuagcuuauccucaauagugggaccccuggucgagaugaauaccggcgaggcagaaagucguaacagcaauuucgcuacagugggugccgggucugaggauuggguuaacgcgaucgaauuugugccuggacagccauauugcggcagaacugcccccuccuguaccgaggcaccucuacagggcucagucacaaaggaggaaagcgagaaggaacaaaccgcuguggagacgaaaaagcagcucugcccauacgccgcuguaggggaauguagguacggagagaauugcguuuaucugcauggugacaguugugauaugugcggccuucaggugcugcacccgauggacgccgcacagcggucucaacauauuaaauccugcaucgaggcccacgaaaaggauauggaguugagcuucgcuguccagcgcucgaaagacauggugugugggauuugcauggaaguggucuacgagaaggcgaaccccucugaaagaagguuuggaauccucuccaauuguaaccacacuuauugccugaaguguauacggaaauggcgcucagcaaagcaguucgagaguaaaaucauuaaguga

SEQ ID NO: 59066 - RNA, 1524 nt, Artificial Sequence
  derived and/or modified sequence opt3 from MKRN3__Homo_sapiens__NP_005655
auggaggaacccgccgcuccuagcgaggcacacgaagccgcgggcgcucaggccggggcagaggccgcuagagaaggaguguccgguccagaccugccggucugcgagcccucuggcgagucagcagccccugauagugcucucccacaugccgcgagggggugggcacccuucccuguugccccagugcccgcucaccuucggcgcggaggccugcgaccugccccagcaagcggugggggagcuuggccgucccccuugccuucucguucgucaggcaucuggaccaagcaaauuauauguagauacuauauccauggccagugcaaagaaggggagaacuguagguacagccacgacuuaaguggacggaagauggccacagaagguggcguauccccacccggggcgucugccggaggcgguccuagcacugcagcucauauugagccacccacgcaggagguggccgaagcuccgccugccgcauccucacugagucuacccgucaucgggagcgccgcugagcgcggauuuuucgaagcggagagagauaaugcagacaggggcgccgcuggcggggccggaguggaaucuugggcagaugccauugaguuuguuccaggucagccuuaucggggccgcuggguggcuuccgcccccgaggcaccacuccaaucaagcgaaaccgagcgaaaacagauggcggucgggaguggacugagauucugcuacuaugcuucuaggggcguguguuuucggggugaauccugcauguaccuucacggggacaucugugauaugugcggccugcagacauugcaccccauggacgccgcacagcgugaggaacauaugcgcgccuguauagaggcucacgagaaggauauggaacucagcuucgccguacaaagaggaauggacaaaguuugcggcaucuguauggagguggucuaugaaaaggcaaacccuaaugauaggcgguuugggauucugucgaacugcaaucauucuuucugcauccgauguauucgcagauggagguccgcucggcaguuugagaaccgcaucgugaagucaugcccacaguguagagugaccagugaacuggucauaccgagcgaguucuggguugaggaagaggaagagaaacagaagcucauucaacaguacaaagaggccauguccaauaaggcgugcagguacuuugccgaaggacgugguaacugucccuucggcgacacuugcuuuuauaaacacgaguacccugaaggguggggagaugagccacccggcccuggugggggcucuuucagcgcuuauuggcaccaguuaguggaaccaguacggaugggagagggcaauaugcuguacaagucaaucaagaaagagcuuguggucuugcgacuggcaagucuacucuucaagagauuucugucccuuagggacgaacugcccuucagcgaggaccaaugggauuugcuccauuaugaacuggaggaauacuuuaacuuaauucuguga

SEQ ID NO: 59067 - RNA, 1650 nt, Artificial Sequence
  derived and/or modified sequence opt3 from MKS1__Homo_sapiens__NP_001159399
auggccgugcccgucagcuccuucgcucagagaaccaggucucgguuucgcguucaucugcaacgaaucacaucaaguaacuuccuccacuaccagccugcagccgagcuuggcaaggaccugauugauuuggcgacuuuucguccacagccgacggcuagcgggcacagacccgaagaggacgaagaggaagagauagugaucggauggcaggagaaauuauucucccaauuugaaguagaucuguaucagaaugagaccgccugccagucuccucuagacuaccaguauaggcaagaaauucucaagcuggagaacucggguggcaaaaagaaucggcgcaucuucacauacacugauucagacagauauaccaaccuugaggaacauugucagaggaugacaaccgcagccagcgaggugccaaguuuucuggucgaacggauggcuaaugugcgccgaagaaggcaggaucggcgugggauggagggaggcauuuugaaaucccgcaucguuacuugggaacccucugaggaguucgugagaaacaaucacgucauaaacacaccucuccagaccaugcauaucauggcagaccuggguccauacaagaagcugggguauaaaaaguacgaacacgugcucugcacguuaaaaguagauagcaauggaguuauuacugugaagcccgacuuuaccggccugaaaggcccuuacaggaucgagacagaaggggagaagcaagaacuuuggaaguauacuauugauaacgucuccccacacgcccagccggaggaggaggaacgggaacgacgcguguucaaagacuuguacggaagacauaaggaguaucugucaagucuaguggguaccgauuuugaaaugacaguccccggcgcucucaggcuguucguuaauggggaggugguaagcgcccagggauacgaguaugacaaccuuuacgugcacuuuuucgucgaacugccuaccgcgcauuggucuuccccagcauuccaacaguugucaggcgugacgcagacuuguacaaccaaaagccucgccauggacaagguugcucacuuuaguuaucccuucacuuuugaggccuucuuucugcacgaagaugagucuuccgacgcauuaccugaguggccagugcuguacugcgaaguccucagccuugauuucuggcagcgguaccgcguggaggguuauggggcuguaguucugcccgccacaccgggaucgcauaccuugacggugucuaccuggagaccugucgaacuaggcacaguggcggagcugaggcgguuuuucaucggcgggucccucgaacuggaggaccuuucauacguccguauacccggaaguuuuaaaggugagcgacugagcagauucggcuugaggacugaaaccacagggacugugaccuuucgccuccacugucugcaacagucccgggccuucauggagucuagcucauuacagaagagaaugaggaguguucuggaucgccuagaaggauuuucccagcaaagcucuauucauaaugugcucgaggcauuccgacgggcucguagaaggaugcaggaagcccgcgagucacugccacaggaccuuguaaguccuagcggcacauuggucuccuga

SEQ ID NO: 59068 - RNA, 357 nt, Artificial Sequence
  derived and/or modified sequence opt3 from MLANA__Homo_sapiens__NP_005502
augcccagagaggacgcccacuucaucuacggcuauccuaagaaagggcauggacacagcuacaccacagcugaagaggcagccgguauuggcauacugacugugauccucgggguccuucuguugauuggaugcugguauuguaggcggcgcaacggcuaccgagcguuaauggauaagucccugcauguugguacgcagugcgcucuaacccguagauguccacaagaaggguuugaccacagggauucuaaagugucacuccaggagaagaauugcgaaccgguagugcccaacgccccuccagcauaugagaaacugagugccgagcagagcccucccccauacucccccuga

SEQ ID NO: 59069 - RNA, 1134 nt, Artificial Sequence
  derived and/or modified sequence opt3 from MLC1__Homo_sapiens__NP_631941
augacccaggagcccuucagagaagaacuggccuacgacaggaugccuacacucgaacggggccgccaagauccagcuagcuaugcaccggacgccaagcccuccgaucuucagcugucuaaacgauugccuccaugcuuuucacacaagacuuggguguucagugucuuaauggggagcugucugcuaguuacguccggauuuucucucuaccuggguaacguguuccccgcggagauggacuaucuucguugcgcugccggcucguguaucccuucagcaauugugagcuuuaccguaaguagaaggaaugccaacgucauaccaaauuuccagauccuguuuguguccacauucgcuguuacuaccacaugcuugauuugguuuggguguaaacucgugcugaaccccucugcaaucaauauuaacuucaaucugauccucuuacugcuuuuggaacugcuaauggccgcuaccgucauaaucgccgcgcggagcuccgaggaggauugcaagaaaaagaagggaucaaugagugacagcgcaaacauucucgaugaagugccuuuuccagcccgcguacugaaaucuuacuccguuguggaggucaucgcuggcauuucagccgugcuuggugggaucauagcacugaauguggacgauagcgucaguggaccgcauuugucuguuacuuucuuuuggauucucguggcuuguuuccccuccgccaucgcgagccacguagccgcagaaugcccuucgaagugucugguggaggucuuaauugcuaucucuucccugacaucaccacuccuuuucaccgccaguggcuaucugagcuuuuccaucaugagaauuguggagauguucaaagacuaucccccugcuauaaagccaucuuacgauguuuugcuacugcuccugcuucugguguugcuccugcaggccggcuuaaacacggggacugcaauccaaugcgucagguuuaaagugagcgcccggcugcagggagcuucaugggacacccagaaugguccccaggaacgccuagcgggcgagguagcacgaaguccgcucaaggaguucgauaaggagaaagccuggagagcuguugugguccaaauggcccaguga

SEQ ID NO: 59070 - RNA, 879 nt, Artificial Sequence
  derived and/or modified sequence opt3 from MLEC__Homo_sapiens__NP_055545
augcugggcgccugggcuguggaggggaccgcagucgcccuccuuagacuguuguuacugcuacugcccccugcgaucaggggaccaggucucggcguugcugggguggccggagcagccggcgcuggucuuccggaaagcguaauuugggcagugaacgccgggggagaggcucacgucgacgugcauggcauacacuuccggaaggauccccuggaaggccgcguugggcgagccuccgacuacggaaugaaauugccuauccuccguucuaauccagaggaucagauucuguaucaaacagaaagauacaacgaggagacuuuugguuaugaagugcccaucaaggaggaaggcgacuacguccuggugcucaaauucgcggagguauauuuugcacagucacagcagaagguuuucgaugugagguuaaaugggcaugucguggugaaagaccuggauauuuuugaccgggucggacacaguacggcccaugaugagaucauaccuaugagcauccgcaagggcaaacuuuccguucaaggugaagugucuaccuucacagggaaauuguacauugaguuuguaaagggauauuacgacaacccaaaagugugcgcucuguacaucauggccggcacugucgaugacgugcccaagcuacagccucacccaggccucgaaaagaaggaggaagaggaggaagaggaagaguaugaugaagggucgaaucugaagaaacagaccaacaagaauagaguucagucaggaccgaggacacccaacccuuacgcaagcgacaauaguucccuuauguucccaauucugguggcuuuuggugucuucauccccaccuuguuuugucucugccggcuguga

SEQ ID NO: 59071 - RNA, 732 nt, Artificial Sequence
  derived and/or modified sequence opt3 from MLF1__Homo_sapiens__NP_001123629
augagacagaugaucaggagcuucuccgagcccuuuggccgggaccugcucucuauuucagauggccgcggacgagcccacaaccguagaggucauaaugacggcgaagauagucuuacccacacagacgugagcuccuuccaaacuauggaucagauggucucuaacaugaggaauuacaugcagaagcuggagcggaacuuugggcaguugucgguugacccuaauggacauucauucugcagcaguuccgugaugacguauucuaaaauaggcgaugaaccaccgaagguauuucaagcuagcacccagacacgcagagcacccggugggaucaaagagacuaggaaggccaugcgggacuccgauucaggauuagagaaaauggcgauuggccaccauauccacgaccgcgcucacgugauuaagaagaguaaaaacaagaaaaccggcgaugaagaggucaaucaggaguucaucaacaugaaugaaagcgacgcccaugcauuugaugaagaguggcagucugaggugcugaaguacaaaccugggcgacacaaccuaggaaauacaagaaugagguccguuggucaugaaaacccaggcucacgggagcucaagcgucgcgaaaagccccaacagagcccugccauagagcacgggagaaggaguaaugugcugggagacaaacuucacaucaaggggucuuccgucaaaagcaacaagaaauga

SEQ ID NO: 59072 - RNA, 747 nt, Artificial Sequence
  derived and/or modified sequence opt3 from MLF2__Homo_sapiens__NP_005430
auguucagauuuaugagggacguggagcccgaagauccuauguuccugauggacccauuugccauccaccggcagcauaugagccgcaugcucuccggcggguucggauacucuccguuucuuucaauuaccgaugguaacaugcccggcacacgaccugcuagucguagaaugcaacaggcaggggccgucagcccauucggaaugcugggcauguccgguggguuuauggacauguucggaaugaugaaugauaugauaggcaacauggagcacaugacugcgggcgggaauugccagacguuuucuucgucaaccguuaucagcuauaguaacacaggagacggugcucccaagguguaccaggaaacuuccgagaugaggucugccccuggcgggauucgggaaacccgcagaacaguaagggauagcgacuccggauuggagcaaaugucaaucggccaucacauucgggaucgcgcacauaucuuacagcgaaguagaaaucacaggaccggugaccaggaggaacggcaggauuauauaaaccuggacgagagcgaagccgcugcauucgaugacgaguggcgucgcgagacuucuagauuuaggcaacagcggccacuagaguuccgacgccucgaauccucaggggccggaggcagaagggcugaagggcccccucggcuggccauccagggcccagaggacagcccgagucgccagucuagaagguacgauugguga

SEQ ID NO: 59073 - RNA, 2271 nt, Artificial Sequence
  derived and/or modified sequence opt3 from MLH1__Homo_sapiens__NP_000240
augagcuucguggccggcgucaucagaaggcuggacgagaccguugugaaccggauugcugcaggggaaguaauacagcgccccgccaaugcgaucaaggagaugauugaaaacugccucgaugcuaaauccacaucuauccaagugauugucaaggagggaggucuuaaacugauccagauacaggacaauggcacugggauccgaaaggaagauuuggacauugugugugagcguuuuacgaccucaaaauuacagaguuucgaggaucuggccagcaucuccacauacggauuuagaggcgaagcacuagccucuauuucgcacguugcucaugugacuaucaccacaaagaccgcagacgguaagugcgccuauagggcuucauacagcgaugggaaacucaaggccccuccaaaaccgugugcgggaaaccaaggcacucagauaacagucgaggaccuguucuauaauauugcaacccggcgcaaggcccuuaaaaaccccagugaagaguacggcaagauccuggaggugguagggagauauuccguucacaaugcuggaauuucuuuuagcgugaagaaacagggugaaacggucgccgaugugaggacuuugccuaacgcauccaccguggacaauauccggucaaucuucggcaacgcugucagucgcgagcucauugaaauagggugcgaggauaagacacuggccuuuaaaaugaauggauacaucagcaacgcgaauuauucuguuaagaaauguauuuuccugcucuuuaucaaccaucgauuaguggaauccacuucacugagaaaggccauagagaccguauacgcagcuuaccuuccaaagaauacacaccccuucuuguaucugagccuagagauuaguccucagaacguggacgucaacgugcauccaaccaagcacgaaguucacuuucuccaugaggaaucuauccuggagagggugcaacagcacaucgaauccaaacuucugggcagcaauucgucucggauguacuucacgcagacuuugcuccccggucuggccgggccuuccggagagauggucaaaucaacaaccaguuuaacuagcuccucuacaagcggcucaagugauaagguguaugcucaucagaugguacguaccgacucccgcgagcaaaaacuggacgccuuucuccagccacuuagcaagccgcugucuucacagccccaagcaauuguuacggaagauaaaaccgacaucaguagcggcagagccaggcagcaggaugaggaaauguuggagcuaccugcuccagcggaaguggcagccaagaaccagucccuggagggggacacaacuaagggaaccucugagaugucggaaaaacggggucccacaagcuccaauccucgaaagcgccacagagaggauucagacgucgaaaugguggaggaugacaguaggaaagagaugacugcugccugcaccccacggcgcagaauuauaaaccucacaucuguccugagccuucaagaagagaucaaugaacagggccacgaggugcugagggaaauguugcauaaccacuccuucguugggugugugaauccccagugggcacucgcccagcaucaaaccaagcuguacuuacugaacacuacgaaacuaucagaggaacucuucuaucagauucugaucuacgauuuugcuaauuucggaguacuucguuugagcgagccggccccucuguuugaccucgcaaugcuggcgcuugauucucccgaguccggcuggacagaagaggacgguccaaaggaagggcuggcugaguauaucgucgaguucuugaagaaaaaggccgaaaugcucgcagacuacuuuagucuggagauugaugaagagggcaacuuaauaggacugccucuacucaucgacaauuacgugcccccacuggaaggccuucccauuuucaucuugcggcuggccaccgagguuaacugggaugaggaaaaagagugcuuugaaagccucucuaaggagugugcuauguucuauuccauucgaaaacaguacaucucagaggaaaguacucugagcgggcagcaaucggaggugccuggauccauaccaaauucuuggaaguggaccgucgaacacaucguguauaaggccuuaagaagccauauucugccgcccaaacacuuuacagaggacgguaacauccuucaguuggcaaaucucccugaucuguacaagguauucgaaaggugcuga

SEQ ID NO: 59074 - RNA, 4290 nt, Artificial Sequence
  derived and/or modified sequence opt3 from MLH3__Homo_sapiens__NP_055196
augaucaagugccugagcguggagguccaggccaaacucagauccggccuugcuauuucuucacuggggcaauguguugaagaguuggcauuaaacaguauagacgccgaagcgaagugcguggcuguaagggugaauauggagaccuuccagguccaggugaucgauaacggauuugguaugggcagcgacgauguugaaaaaguggggaaucgguacuucacauccaagugucacucuguccaggaccuggagaacccccgcuuuuauggauuccgaggcgaggcccuagcaaauauugccgauauggcuucggcaguggaaaucucaagcaaaaagaaccguacuaugaagacguuuguaaaacucuuccaaagugguaaggcccugaaggcuugcgaggccgacguuaccagagcguccgcagggacaacugugaccgucuacaaucuguuuuaucagcugccugugaggcggaaguguauggauccacgcuuggaguucgaaaaagugagacagaggauugaggcccucucucugaugcauccgagcaucuccuuuucacugcggaacgacgucaguggaagcaugguucuccaguuacccaagacaaaggaugugugcucucgcuucugucaaauauacggccugggcaaaucccagaaacuucgagaaaucucauuuaaauauaaggaguucgaauugagcggguacauuaguucugaggcucacuauaauaaaaacaugcaguuucuguucguaaauaagaggcuagugcucagaaccaaacugcauaaacuuaucgacuuccuguugcggaaggaauccauuaucugcaaaccuaagaacggaccaacuagccgucagaugaacucgucucuccgccacagauccacacccgagcuguacgguauauacgucauuaaugugcaaugucaguuuugcgaguaugauguuuguauggaaccugccaaaaccuuaaucgaguuccagaauugggacacgcugcucuuuugcauucaagaaggcgugaagauguuccuuaaacaggagaagcuguuugucgaauugucaggggaggauaucaaggaguucagugaagacaacggauuuagccuauucgacgcaacucugcagaaaagggugaccuccgaugagcggucuaacuuucaggaggcuugcaauaacauccucgacagcuacgaaauguucaaucugcaaucaaaggccguaaaacgaaagacaacugcggaaaacguuaauacccagaguucccgcgauagcgaggccacaagaaagaacaccaaugacgcauuucuuuauauuuacgagucuggcgguccagggcauucaaagaugacggaacccagucugcagaacaaggauagcuccuguucugagucgaaaauguuggaacaggagacuauaguggcuagcgaggccggagaaaaugagaagcacaaaaaguccuuccucgaacacucaagucuggagaacccuugcggcacaucuuuagaaauguuucugagcccauuccaaaccccgugucauuucgaggaguccggccaggaccuagaaaucuggaaagagucaacuacagucaaugggauggcugccaacauucucaagaauaacaggauccagaaucagcccaagcgguuuaaagaugcaaccgaagugggaugccaaccucugccauucgccacgacccuuugggguguccacagcgcucagacagagaaggagaaaaagaaagaaucuuccaacuguggccgcagaaacguguuuaguuaugggaggguuaaguugugcagcacuggauucauaacccaugugguacagaaugagaaaacaaagucuacugaaaccgagcacuccuuuaagaacuacguccgucccggcccuacacgggcgcaggaaaccuucgguaaucgaacuagacacucaguggagacgccagacauuaaagaucuggcaaguacacucagcaaggaaucggggcaacugcccaacaaaaagaauuguaggaccaacaucuccuauggccuugagaaugagccgacugccaccuacacaauguuuucugcuuuccaggaaggaagcaaaaagucacagaccgacugcauccugagugauacuuccccuucuuuucccugguaccgccauguuagcaacgacucccggaagacagacaaauugauuggcuucucaaagccaaucgugaggaaaaagcucagccugaguucucaauuagggucccuggagaaauuuaagagacaguauggaaaggucgaaaauccucuagauacggagguggaggaaagcaacgguguaaccacuaaucucucgcuucagguggagcccgacauucuuuugaaagauaagaaccgccuggaaaauucagacguuuguaaaauaacaaccauggagcacucugauagugacuccagcugccagccagccucucauauccucaacagcgaaaaguuccccuuuuccaaagaugaggacugucuggagcaacagaugccuucauuacgagaaaguccaaugacacugaaggagcuuagcuuguucaaucggaagccgcucgaucuggaaaaaucuuccgagucacuagcaaguaagcugagccgucucaaaggcuccgaaagagagacucagaccauggggaugaugucuagguucaacgagcugcccaacucggacagcucacgcaaggauuccaaacuuugcagugucuugacgcaggacuuuugcaugcuguucaauaacaagcacgagaaaaccgaaaauggagugauuccuacaucugauagcgccacucaagacaacuccuuuaauaagaacucaaagacccauucuaauagcaacacaacugaaaauugugugaucagugagaccccauuaguccuccccuacaacaauuccaaaguuacgggcaaggacagcgaugugcugauccgggcuucugaacagcagauugguucacuugacuccccuagugggaugcugaugaacccaguggaggaugccacaggcgaccagaauggaauaugcuuccaaagcgaggaaucgaaagcaagagcguguucugagaccgaagaguccaacacuugcuguagcgauuggcagaggcacuuugacguagcuuugggccgaauggucuaugugaauaagaugacagggcucucaaccuucaucgcccccacugaggauauucaggcagccugcaccaaagaccugacaacgguugcuguggaugucgugcuagaaaacggaagucaauaccgcugucagccguuucggucugaccugguucucccuuuccugccaagagccagggcagagcguaccgugaugcgccaggauaaccgggacacuguagaugacacagucuccagcgaaucacuucagaguuuguuuagcgagugggacaaucccguguucgcuagauauccugaaguggccgucgauguuuccucuggucaagcggagagccuggccgugaagauccacaacauuuuauaccccuauagguuuaccaagggcaugauccauuccaugcagguacuccaacagguggacaauaaauucauagcuugccugaugucaacaaagacugaggaaaacggggaggcagauucuuacgaaaaacagcaggcccagggaaguggccgaaagaaacuucugucgagcacccuaaucccaccucucgagauuacggucacagaggaacagcggcgccuguugugguguuaccacaagaaucuggaggacuuaggucucgaguucguguuucccgauaccuccgacucucugguucuuguggggaaggucccacugugcuucguggaaagagaagcuaacgaguugaggcggggccgaucaacuguuaccaaaagcaucguggaagaguuuauuagagagcaacucgaacugcuacagacaacuggaggcauccaggggacccugccgcuuacaguccagaagguacucgccucccaagcaugucauggagcgauaaaauucaaugauggccugaguuugcaggagucuugccgccugauugaagccuuaagcucaugccagcucccuuuucaaugugcucacgguaggcccuccaugcugccacuugccgacaucgaucaccuggagcaggagaagcagauuaaacccaacuugacgaagcuccguaagauggcacaggcuuggcggcuguucgggaaagccgaaugcgacaccagacaaagucuacagcagagcaugccuccaugugagcccccuuga

SEQ ID NO: 59075 - RNA, 792 nt, Artificial Sequence
  derived and/or modified sequence opt3 from MLKL__Homo_sapiens__NP_001135969
auggagaaccugaagcacaucauuacccucggccaggugauacauaaaagaugcgaagagaugaaguacuguaaaaagcaaugcaggcggcuugggcaccgcguccugggauugaucaaacccuuagaaaugcugcaggaccaggguaagcgaagcguuccuuccgagaagcuaacaacugccaugaaucguuucaaagcugcacucgaagaggccaacggcgagauugaaaaguuuucuaauagaucaaacaucuguagguuccugacggcgagucaggauaaaauucuuuuuaaggacgugaaucggaaacugagcgauguauggaaggaguugucccuccugcugcaaguggaacagcgcaugccagucucuccgaucucgcagggggcuucaugggcccaggaggaccaacaggaugcagacgaggauagaagggccuuccagaugcuccggcgcgacaacgaaaagauagaggcuagcuuacgaagacuggaaaucaauaugaaagagauuaaggaaacccuuaggcagaguuuggaguccucuagcggaaaaucaccccuggagaucucccgguuuaaggugaaaaacguuaagacaggcagugcaagcgguugcaauucugagaaaauucguaagcuaguggccgucaagcgccaacaggaaccucucggggaagauuguccauccgagcugagagaaaucauagacgagugcagggcucaugaucccucagugcggccuagcguagacgagauucuuaaaaagcugaguacuuucucuaaauga

SEQ ID NO: 59076 - RNA, 3207 nt, Artificial Sequence
  derived and/or modified sequence opt3 from MLLT10__Homo_sapiens__NP_001182555
auggugagcuccgacagacccgucucucuggaggaugaaguuucacacaguaugaaggagaugaucggcgggugcugugugugcagcgacgaaaggggaugggccgagaacccucucguauacugugauggucauggcugcuccguggcuguccaccaggcauguuaugggauugugcaaguuccaaccggaccgugguucugccggaaaugugaaucucaggagcgcgccgcgcgagugcguugcgagcuuuguccccauaaggacggcgcucugaaaagaacagauaauggugggugggcccacgucgugugcgcauuguacauaccugaaguacaguuugccaacguuucgacuauggagccaaucguguuacagucagucccccaugacagguauaauaagacguguuacauuugcgaugaacaaggacgggagagcaaagcugcaaccggcgccugcaugacauguaacaagcacggcugccgccaggcuuuccacgugacuugugcccaguuugcggggcugcuaugcgaggaagagggaaauggugcagacaacgugcaguauuguggcuacugcaaguaucauuucaguaaacucaagaaauccaagagagggucuaauaggagcuacgaucaaucccugucagacaguagcucucacucccaggauaaacaucacgaaaaggagaagaaaaaguacaaagaaaaggacaaacacaagcagaaacauaagaagcagccugagccaucacccgcccuugucccuagccugaccguuacaaccgagaaaacuuauacaaguaccucuaacaauuccaucagcggaucguugaagcggcucgaagauacgacugcucgcuuuaccaacgccaauuuccaagaggugucugcacacacauccucaggcaaagacguaagugaaacucgagguagcgaggggaagggcaaaaaguccucugcucauagcucaggccagagaggcaggaagccagggggaggucggaacccgggcaccacagugagugccgcgucccccuuuccucaggggagcuucucuggaaccccaggcucagucaaaaguagcuccgguucuucggugcaaagcccccaggacuuucuguccuucacggauucagaccugcguaaugauaguuacucucacagccagcaguccucagccacuaaggacguucauaaaggggaaagcggcucucaagagggaggcgugaacuccuuuaguacacucauuggguuaccuagcaccucugcagucacuucccagccaaagucauucgagaauagucccggagaucuggguaacagcucgcuuccgacagcuggcuauaaacgcgcccagaccuccgggaucgaagaggaaacggugaaggagaagaaaagaaagggaaacaaacagucuaagcacggcccugguaggcccaaagggaauaagaaccaagaaaauguaagccacuugucaguuaguuccgcuucuccaaccagcuccguggccucagcagccggcagcauaacaaguucuucccugcaaaagagcccuacucuacuccggaacggaucgcugcagucacuuucugucggcaguucccccguggggagcgagaucucuaugcaguaccgacaugacggagcuuguccaaccacaacuuuuagcgagcuguugaaugcgauucacaacgguaucuauaauuccaacgaugucgcagugucauuccccaauguugugaguggcagcgggucuuccaccccuguaucaaguagccaucucccacaacaguccucuggacacuugcagcaggucggcgccuuaucgccgagcgcugugucauccgccgcacccgccguugcuacaacccaagccaacacucugagugguucuagccucucccaggcaccuucacacauguacgggaaucgcucuaacagcaguauggcggcucuuauugcccaguccgaaaauaaccaaacggaccaggaucugggcgacaauagcagaaacuuggugggaaggggaucuucaccacgggggucccuaaguccccgcagcccugucucgucucugcagaucagauaugaucagccaggaaacuccagccucgagaaucugcccccgguggcagccucaauagaacaacuucuggagaggcaguggagugagggccagcaguucuugcucgaacaagguacaccuucugacauucuggggauguuaaaaucccugcaucagcuacagguagagaaccgucggcucgaggaacagaucaagaaucugaccgcuaaaaaggaacgacuucaauugcugaacgcccagcucagcgugccauuucccacuauuaccgcaaauccuucacccagucaccagauccauacauucagcgcucaaaccgccccaacuacagacucccugaacucuagcaaauccccucacaucggaaauucauuucuucccgauaacucucugccaguuuugaaucaggaccucacgaguucgggccagagcaccuccucuucaagcgcgcuguccacuccgccucccgccggucagaguccagcucaacagggcucuggggucagcggagugcaacaggugaacggcgucacaguuggggcauuagccucaggaaugcagcccgugaccuccacaauuccugcugugagugccguaggcgguauaaucggggcacugccaggaaaucagcuagcgauuaacggcaucgucggugcccucaauggcgugaugcagacucccguuaccaugagccagaacccuacgccgcugacccauacaacugugccacccaaugcuacccacccuaugccagccacacuuacuaacucugcauccggguugggacugcucucagaucaacagagacagauacugauucaccagcaacaguuccagcaauuacugaacagccagcagcuuacccccgagcagcaucaggcuuuucuguaccagcucaugcagcaccaucaccagcaacaucaccagccugagcugcagcagcuacaaaucccgggccccacgcagaucccaauuaauaaccugcucgccgggacacaggcaccuccccugcacaccgccacuacaaauccauuccuuaccauccauggagacaacgcuucgcaaaaggucgcgagguugucugauaaaacuggcccuguggcccaggaaaagaguuga

SEQ ID NO: 59077 - RNA, 1680 nt, Artificial Sequence
  derived and/or modified sequence opt3 from MLLT1__Homo_sapiens__NP_005925
auggacaaccagugcaccgugcaagucagacuggagcucggccacagggcccagcuucggaagaaacccacaacugaaggguucacgcaugauuggaugguuuuugugcgcggaccugagcagugugacauccagcacuucguagaaaagguggucuuuuggcugcaugauagcuucccaaaaccgcgacgugugugcaaggagcccccuuacaaaguugaagaguccgguuaugcuggcuuuauuaugccaauagaggugcacuucaagaauaaggaggaacccagaaaagucuguuuuaccuacgacuuguucuuaaaccuggaagggaauccuccagugaaccaucuaaggugcgagaagcucacauuuaauaaccccacuaccgaguuccgguauaaacugcuucgcgcaggaggcguaaugguuaugccugaaggugccgauacagugucuagaccaucaccggacuaccccaugcugccuaccaucccauugagugcguuuagcgaucccaagaaaacuaagccuucccacgggucuaaggacgcuaauaaagagucgucaaagacaagcaaaccacacaaggucaccaaagaacauagggagcggccccgcaaggauagugaauccaaaucuagcuccaaggagcucgagcgagaacaagccaagucaaguaaagacacgagcagaaagcugggagagggcaggcugccgaaagaagagaaggcaccucccccaaaagccgcuuucaaggaaccuaagauggcacucaaagagacuaaguuagagucuaccucccccaaaggcgggccacccccuccaccgcccccuccaccccgggccucaagcaagcguccugcuacagccgauaguccaaaacccucugcgaagaagcagaaaaaguccagcucgaaaggaucucgcuccgcaccggguacuucaccuagaaccaguagcuccucuagcuuuucagacaagaaaccagccaaggauaagaguuccacaaggggcgaaaaagugaaggcugagagcgaaccccgggaggccaaaaaggcacuggaaguggaggagucuaacucagaagacgaggcuaguuucaaaagcgaauccgcccagucuucgccuagcaauuccucaaguucuagcgacuccucaagcgauucugacuucgagcccucccagaaccacagucaagggccacuucgaagcauggucgaggauuugcagucugaagaguccgacgaagaugacucaaguagcggagaggaagcggccggcaagaccaauccuggucgcgauucgagacuguccuuuucugacagcgagucagauaacagugcagacuccucucuacccagcagggagccaccgccuccccagaaaccacccccuccaaauuccaagguuucagggcggcgcagccccgaaaguuguucuaagccugagaaaauucucaagaaaggaacguaugauaaggcuuacacugacgaacugguggagcuucauagaaggcugauggccuugcgugaacggaacguacuccagcaaaucgugaaucugauugaggagacaggccacuucaacgucaccaacacuacauuugacuucgauuuauuuucccuggacgaaaccacggugcgaaaacuccagagcugccuugaggcuguugccaccuga

SEQ ID NO: 59078 - RNA, 1698 nt, Artificial Sequence
  derived and/or modified sequence opt3 from MLLT3__Homo_sapiens__NP_001273620
augugcgccgugcaggucaagcuggagcucggccacagagcucaaguuaggaaaaagcccaccguggaaggguucacacaugacuggaugguauuugugcggggaccugagcacagcaacauccagcauuucgucgaaaaagugguuuuucaccuucaugaguccuucccacgcccgaagcgaguguguaaagaucccccuuacaaggucgaagagucugguuaugcaggcuuuauucugccaauagagguguacuucaagaauaaagaagaaccccguaagguaagauuugacuaugauuuguucuuacaccuggaagggcacccuccaguuaaccaucuaaggugcgagaaacucacuuuuaauaaccccacggaggacuuccggcgcaagcugcuuaaagccggaggcgauccuaauagaucaauccacaccaguagcuccucuucgucaagcaguuccucuagcuccucaaguaguucuuccucaagcaguucuuccagcucgucuuccucaaguagcuccucuagcucaaguuccucuagcucaaguagcuccucuacaucguuuagcaagccacauaagcugaugaaagaacacaaggagaaaccguccaaggacucaagggaacacaaaagugcguucaaggagcccucucgggaucauaacaaaagcuccaaggaaucaagcaagaaaccuaaggagaauaaaccauugaaggaggagaaaauugugcccaagauggcuuuuaaggagccuaaaccaaugucuaaggaacccaaaccggacuccaaccuccugacuaucaccaguggucaggauaagaaagccccuagcaagcgacccccaauuucugacuccgaggaacugucagcaaagaaacgcaagaaaaguagcucggaggcccucuucaaguccuucucuagcgcuccucccuuaauccugacauguucagcagauaaaaagcagauaaaggacaaaagucacgucaagauggggaaagugaagaucgaguccgaaaccucugagaaaaagaaaagcacucuuccacccuuugaugacauuguggacccuaaugauuccgacgucgaagagaacaucucaagcaagagugauucugaacaaccauccccggccagcucgucaucuaguuccagcucuagcuucacacccucccagaccagacagcagggaccuuugaggucaauuaugaaggaccugcauagugaugacaaugaggaggaaagcgaugagguugaagacaacgauaaugacucugagauggagcggccagugaaccguggcggcucccgcucaagaaggguaagucuaagcgauggguccgacucugaaucgagcucagcuuccaguccccuccaccaugagccuccacccccgcugcuuaaaacgaauaacaaccaaauccuggaagugaagucuccuauaaaacagagcaaguccgacaaacagauuaagaauggagagugcgauaaggccuacuuggacgaacucgucgagcugcaccggcgauuaaugacucugcgcgagagacacauccuccagcaaauugugaaccuuaucgaagagaccggucauuuucacaucacaaauacuaccuucgauuuugaccuguguucauuggauaaaacaaccguuaggaagcuacagucuuaucuggaaacgagcggcacuagcuga

SEQ ID NO: 59079 - RNA, 4956 nt, Artificial Sequence
  derived and/or modified sequence opt3 from MLLT4__Homo_sapiens__NP_001035089
augagcgccggcgggagagacgaggaaaggcggaagcuggcugauaucauucaccauuggaacgcaaaucgccucgaccuuuucgagauaucccagcccaccgaagaucuggaguuucacggagugaugcgauucuacuuucaagacaaagccgcggguaacuucgcuacaaagugcauccgugucucuucaacugccacgacccaggauguuauugaaacauuggcagagaaauuuagaccugacaugaggauguuaaguagcccaaaguauucccuguacgaggugcauguaucuggcgaacggcgccuagauaucgacgagaaaccgcucgugguccagcugaauuggaacaaggaugacagagaagggagguucgugcuuaagaaugagaacgaugccauucccccuaaaaaggcucagucgaauggaccagagaaacaagaaaaggagggcguuauccagaacuuuaaacggacucugucaaagaaggagaaaaaggagaaaaagaaacgcgaaaaggaggcauugcgacaggccagcgacaaagaugacagacccuuccagggugaggacguggaaaauaguaggcucgcugccgaggucuauaaggauaugccugaaaccuccuuuacacggaccauaucuaacccagaggugguaaugaagcgucgcagacaacagaaacuggaaaagaggaugcaggaguuccggagcuccgacgggcgacccgauucaggaggcacucugcgcaucuacgcggacagucucaaaccuaauauuccauauaagacaaucuuacugagcaccacggauccggcagacuuugccguugcugaggcccuugaaaaauacggcuuggagaaggaaaaccccaaggauuauuguauugcaagagugaugcugccuccaggggcucagcacucugacgagaaaggagccaaggaaaucauacuagaugacgaugagugcccccuccaaauuuucagggaguggccuuccgacaaagguauccuggucuuucagcuuaagcggcgcccacccgaccauauuccgaaaaagacuaagaaacaccuggaaggcaagaccccuaaagggaaggagagagcggauggaucaggcuacgguagcacauugcccccagaaaaacucccuuaccugguggaguuaagucccgggaggcguaaucacuucgccuauuacaacuaucauacuuacgaggacggaucugauucccgggacaagccaaagcuguaucgacuccagcuuagcgugaccgaagucggcacagagaaacuggaugacaauucgauccaauuguucggccccgggauccagccucaccauugugaucuaaccaacauggacggaguugugacgguaacuccaagaucuauggaugcagaaacauacguggagggucagaggauuuccgaaaccacuaugcugcagucaggcaugaagguccaauuuggggcuagucacguguucaaauuuguugacccgagccaggaucacgcccucgcuaagcgcuccguggacggaggccugauggucaaagguccccggcauaagccugggauagugcaggagacaaccuucgaucuuggcggagacauccacucuggcacggcccugccaaccagcaaaucaacaacuagauuggacagugauaggguauccagcgcaucuucaaccgccgagcgcgggaugguuaagcccaugauucgaguggaacagcaaccugacuaucggcgucaggagaguagaacacaggaugcuagcggaccagaacucauccugcccgcguccauagaguuuagggaaucuucggaggacagcuucuuauccgcaauuaucaacuacacuaauucaaguaccguccauuuuaagcugucuccgacauacgugcuauauauggccugccgcuacguccucagcaaccaguaucggccugauaucuccccaaccgagagaacucacaaagugauugcuguugugaauaagaugguaucaaugauggaaggugucauccaaaaacagaagaacauugccggcgcacuggccuucuggauggcuaaugccagcgagcuuuugaacuuuauaaaacaggacagggaucugucucgaaucacgcucgacgcacaggaugugcuggcgcaucuuguucaaauggcuuucaaguaccuggugcacuguuugcaguccgaacucaauaacuauaugcccgccuuucuggacgauccugaggaaaauaguuuacagcgccccaagauugacgauguccugcacacacuaaccggggcaaugagccuccugcggagaugcagggugaacgccgcucuuacuauccaauuguucucucagcuguuucauuucaucaauauguggcuguucaaccgucugguaaccgacccagacuccggauuauguucacacuacuggggcgccauuauacgccagcagcugggucauaucgaggcaugggcugagaaacaagggcuugaauuggccgcggauugccaccucagucggauugugcaggccacaacccugcuaacuauggacaaguaugcuccugaugacauccccaauauuaacagcacauguuuuaaacucaauucgcuccagcugcaggcacuuuugcaaaacuaccacugcgccccagaugagccguucaucccuacggaccugauagaaaacguugucaccguggcugagaauacugccgaugaguuagcaagauccgacggcagggaagugcagcucgaggaagaucccgaccugcagcuuccauuucuguugcccgaggauggauacucuugugacgucguucgaaacaucccuaauggccuccaggaguuccuggacccacuaugccaacggggguuuugccgccugauuccccauacaagaagcccuggaaccuggacaaucuauuucgaaggugcggauuacgagucacaccuccugagggaaaacacugagcuugcccagccguugcggaaggaaccagagauuaucaccgugacgcugaaaaagcagaauggcaugggguuaaguauaguggcugccaagggagcaggccaagacaaacucgguauuuauguaaaguccgucgugaaagggggcgcugccgauguugacggacgacuggcagccggcgaucagcuucugucuguggacgggagaagccuagucggacucucccaggaacgcgcugcggagcugaugaccaggacaucaagcgugguuacuuuggagguggccaagcagggcgcaaucuaccauggucuggcuaccuuacucaaccaacccaguccuaugaugcagcguauuucugaucggagaggguccggaaaaccaaggcccaagagcgaaggcuuugagcuguauaauaacucgacacagaaugguucaccugaaucuccgcagcuucccugggccgaguacagugaaccaaagaaacugccuggcgacgaucgcuugaugaagaaccgagccgaccacagauccagccccaauguagcuaaccaaccaccuucucccgggggaaaaagcgcauaugccuccggcacuaccgcgaagaucacgucagucaguacagggaaucucuguaccgaggagcagacuccaccgccucggcccgaggcuuacccaauacccacacagaccuacacuagggaauauuucaccuuuccugccagcaaaucucaggaucgcauggcaccaccccaaaaccaguggccuaauuacgaagagaagccgcauaugcacacagacuccaaccacucaaguaucgccauucagcgugugacgagaagccaggaggaacugcgggaggauaaggcuuaucaacuagaaaggcaucgcaucgaggcagccauggaccgaaaguccgacucugauauguggauuaaccagucgagcucacuggacuccaguaccucuagccaggaacaccuuaaucauuccucaaagucugugacuccagcgagcacacucaccaaaaguggacccggcagauggaagacuccugcugccauccccgcaacaccagucgccguuucccaaccuauacggaccgaucugcccccaccuccgcccccaccucccgugcacuacgcuggugacuucgaugggaugagcauggacuugccacugccucccccgccaucugccaaccagauuggauuaccuucagcacagguagcugccgcggagaggcgcaaaagagaggaacaucagaggugguaugagaaggaaaaagcccggcucgaggaagaacgugagcgcaagcgaagagaacaagagaggaagcugggccagaugcggacgcagucccuuaaucccgcaccauuuaguccccugacagcucagcaaaugaaaccugaaaagccgagcaccuugcagcgcccccaggagacugugaucagagaacuccagccacaacagcagccuaggaccaucgagcggcgagaucugcaauacauuacagucucgaaagaggaacuaucuuccggugacagccugucacccgauccuuggaagagagacgccaaagagaaacuugaaaagcagcagcagaugcacaucguggauaugcucaguaaagagauucaagagcugcagucuaagccagaccgcuccgcugaagagagcgauagguugcggaaauuaaugcuggaauggcaguuccagaagcgucuccaagagucaaaacagaaggacgaagacgaugaggaggaagaggacgaugacguugauacuaugcugauaaugcagagacuugaagcagagaggcgcgcccgggacgaggaacgaagaaggcagcaacagcuggaggaaaugcgcaagcgggaggccgaagauagagcucgucaggaggaagagaggcggcgccaggaggaggaacgaaccaaaagagacgcggaagagaaggugauggucuuguga

SEQ ID NO: 59080 - RNA, 3282 nt, Artificial Sequence
  derived and/or modified sequence opt3 from MLLT6__Homo_sapiens__NP_005928
augaaggagauggugggcgggugcugugucugcagcgacgaaagaggaugggccgagaacccccugguuuacugugauggucacgcuugcuccguggcaguacaucaggccuguuauggcaucgugcaagucccuaccgggccaugguucugcaggaaaugugaaucucaggagcgggcggcucgcgugcgaugcgaacucuguccgcacaaggacggagcccuuaaacguacagauaauggcgguugggcacauguugugugcgcccuguacauucccgagguccaguuugcuaacguguugacuauggagccuauaguauuacaguauguuccacacgacagauucaauaagacguguuacaucugcgaggaacaagggagggaaucaaaagcagccaguggagcuugcaugaccuguaaccggcauggcugccgccaggccuuucacgugacaugugcgcagauggcaggccugcuaugcgaggaggaaguccucgagguggauaaugugaaguauuguggguacugcaaguaucacuucagcaaaaugaagacuuccagacauucuucgggagguggcgggggaggcgccggugggggaggcggcucaaugggaggggguggcagcggguuuauuaguggaaggcggucccgcucugcuagccccuccacccagcaagaaaaacacccuacacaucacgagcgaggccagaagaaaucaagaaaggacaaggaaaggcugaaacagaagcacaaaaagcggccagagagucccccuagcauccuuaccccaccggucguucccacugccgauaaagugucuuccucagcaagcaguucuucccaucacgaggcuagcacacaggaaaccucggagucuucccgugaaucaaaggguaaaaagaguagcucccauucucugagccacaaggggaaaaaguugucaaguggcaaaggaguauccagcuucacgucugccucaaguagcuccucuucgagcuccucaaguucuggcgggccuuuucaaccagcggugagcucccuccagucaagccccgacuucucugccuuuccuaagcuggagcagccagaagaggauaaauacuccaagcccacugcaccggcuccuagugcacccccaagcccuucugcucccgagccacccaaggccgaccuguucgaacaaaaagucguguuuuccggauucgguccuauuaugcgcuuuucaaccacaaccaguagcucgggcagagcaagggccccauccccgggggauuacaagucuccccauguuaccggaagcggcgcuucagcggguacacacaaacggaugccugcacucagugccaccccagugcccgcugacgagacgccugaaacuggguuaaaggagaaaaagcacaaggccuccaaacgaucucgccauggcccaggaagacccaagggcagcaggaacaaagaagggacaggagguccggcagccccuucccugccaucagcucagcuugccggcuucaccgcaacugcggcuagccccuucagugggggaucuuuggucuccagcggccugggugggcuaucgucacggacauuuggcccuucuggaagucuccccucccugagccuugagucuccacuguugggcgccgggaucuauaccagcaauaaggauccuauaucccacucaggaggcaugcuccgcgcaguguguaguacgccccugagcagcuccuuacuggguccaccggggaccucagcccucccuagacuuaguaggagccccuucacauccacucugccaucuucgagcgcuucaaucuccaccacacagguauuuaguuuggccggaucuacuuucagccuacccuccacccauauuuuuggcacaccuaugggugcaguuaacccacugcucucacaggcugagucuagccacaccgaacccgaccuggaggacugcaguuuccguugucggggcacuuccccucaagaaagccuuucuucaauguccccgaucaguagccugccagccuuguuugaucagacggcgucggcccccugcgggggaggccagcucgacccugcugcaccagggacaaccaauauggagcagcuguuagagaaacaaggagauggcgaagccggugugaacauugucgagaugcugaaggcucuacacgcccuccagaaggaaaaucagcgacugcaggagcaaauccuuucuuugacugcaaagaaggaaagacugcagauacucaacgugcagcuguccguccccuucccugcgcuuccggccgcucugcccgccgcaaaugggccagugccuggacccuacggcuugccaccucaggcugguagcucagacagucucucuaccuccaaaucucccccaggcaagucaagucugggguuagauaacagccuguccacaucuagcgaggacccgcauuccggauguccuucaaggucuaguucgagccuauccuuucacucuacucccccaccccucccucugcuucaacagucaccagccacuuugccccuggcacucccuggcgccccggcuccacugcccccucagccccaaaauggguuaggacgcgcgccaggcgccgcaggucugggggcuaugccuauggccgagggacuuuugggcggucucgccggcagcgggggacugccccuaaacggccugcucgggggacugaacggcgcugcagccccaaauccugcgucccuuagucaggcugguggggccccgacauugcagcugcccggaugcuuaaacucucucacggaacagcaacggcaucugcuucagcagcaggagcaacagcugcagcaguugcaacagcuccuggcaagcccacagcuaaccccugaacaccaaacuguuguguaucagaugauucagcagauccaacagaaaagagagcugcagaggcuccagauggccggcggcucacaacugcccauggcuucccuuuuggcagggaguagcacaccacuguuaucugccggaaccccuggucuccugcccacagcguccgcuccgccacuucugccugccggcgcccuaguagcccccucacucgggaauaacacuagccugauggcugccgcagcugccgcggccgcagucgcugccgcuggaggcccacccguguugaccgcacagacgaauccuuuccugucguuaucuggugccgaagggaguggaggcggcccgaaagggggaaccgccgauaaaggugcuuccgcgaaccaggagaagggcuga

SEQ ID NO: 59081 - RNA, 345 nt, Artificial Sequence
  derived and/or modified sequence opt3 from MLN__Homo_sapiens__NP_001035198
auggugagcagaaaggccgucgcugcacugcucguugugcacguagccgcgaugcuugcuucccagaccgaggccuucgugcccaucuuuacauacggcgaacugcaaaggaugcaggagaaagaacggaacaaggggcagaaaaagucuuugucagucuggcagcgcaguggagaggaagguccuguggacccagcagagccgauucgagaggaagagaaugaaaugauaaaauuaacugcuccccuggagaucggcaugcguaugaacagcagacaacuagagaaguauccugccacgcucgaagggcugcuuuccgagaugcugccacagcaugcaaaguga

SEQ ID NO: 59082 - RNA, 1239 nt, Artificial Sequence
  derived and/or modified sequence opt3 from MLNR__Homo_sapiens__NP_001498
augggcagccccuggaacggguccgacggaccugagggugccagagaaccaccguggcccgcucugccuccaugcgaugagaggcgguguucucccuucccucucggcgcacuugugccagucaccgccguuugccuguguuuguuugugguaggggugucaggaaaugucgugacaguuauguuaaucggccgcuaccgagacaugcguacuacgaccaaccuguaucuagguaguauggcggugagcgaucuccugauucuucugggguugcccuucgaccucuacagacuguggaggucccggccuugggucuuuggaccacugcucugccgcuuaucucuguaugugggcgaaggcuguacauacgcuacucuuuugcacaugaccgcccugucgguagagagauaucuagcaauaugcaggccgcuccgggcccgcguucuggugacacgaagaaggguccgggcucuuaucgcagugcugugggccguggcuuugcucucagccgggcccuuccuguuuuuagucggaguugaacaggauccugguauuagcgugguaccaggccugaaugggaccgcgcguaucgcaaguucuccccucgccuccagcccuccacuuuggcugucccgcgcucccccgccuucacccccaaguggaccugagacugccgaggcagcugccuuguucagcagagaauguaggcccucuccagcgcaacuaggcgcccugcgggugaugcucugggucacaaccgcauacuuuuuccugcccuuucuuugccuguccauuuuguauggucucaucgggcgagagcuguggucaagccgcagaccuuuaaggggaccagcugccaguggccgggaacgcggccauagacagacggugaggguucugcuaguggucgugcucgcuuucauaaucuguuggcugccguuucacguagggcguauuaucuacauuaacacugaggacucucggaugauguacuucucccaguauuuuaauaucguugcccuucaguuguucuaccugagcgcaucgauaaaccccauucucuauaaucugaucucuaagaaauaccgagccgcugcguucaaacuucuguuggcaagaaaguccaggccucgcggauuucaucggucaagagauaccgccggugagguggcuggcgacacagggggagauacugucggcuauaccgaaacaagugccaacgugaagaccauggguuga

SEQ ID NO: 59083 - RNA, 1719 nt, Artificial Sequence
  derived and/or modified sequence opt3 from MLPH__Homo_sapiens__NP_001035932
augggcaagaaacuggaccucagcaaacuuaccgaugaggaagcccagcacgugcuggaggucguucaaagagacuucgauuugaggcggaaggaagaggaacgcuuagaggcucugaaggggaaaaucaagaaggaguccucuaaacgagaacuacucucagacacagcacaucugaacgagacucacugcgcccguugucuucagcccuaccagcuguuggugaauaguaagagacagugccucgaauguggacuguuuacgugcaaaagcugugguaggguacauccugaggagcaaggcuggauuugcgauccaugucaccuggcgcggguggucaagauagggucccucgaaugguauuacgagcaugugaaagcucgcuucaagagauuuggaucugccaagguuaucaggucguuacacggccggcugcaggguggggcaggaccggaacuuauuucagaggaacgcagcggcgacagugaucagaccgacgaggauggcgagcccggguccgaagcccaggcucaagcacagccuuucggaucuaaaaagaaacgauugcugagcgugcacgacuuugauuucgagggugacuccgaugacucaacacagccacagggccauagucuacaccucagcucuguccccgaagccagagacuccccucaaucacugacugaugagagcugcagugaaaaggcugccccacauaaagcggaggggcuugaggaagcagacaccggagccucuggcugucacucccaccccgaggaacagccuacaagcaucucgccaucuaggcauggugcucuggccgaguugugcccgcccgggggaucccaccggauggcacucggcaccgcugccgcgcugggcucaaacgugauucguaaugaacaguuaccucugcaauaucucgccgauguagacacuagcgaugaggagagcauccgcgcacauguuauggcuucccaccauucuaagagaagggggcgggccagcucagaaagucagggacuuggugcuggcgugcgaacagaggccgacgucgaagaggaggcacugcgcagaaaauuggaagaacuaaccuccaacgugagcgaucaggaaacgucuucagaggaagaggaggccaaggacgaaaaggcugagccaaauagggauaaaaguguggggccccugccucaggcggacccagaagucggaacugcagcccaccaaaccaaccggcaggagaagaguccccaggauccgggcgacccuguucaguacaaucgcacaacugacgaggagcucuccgagcuggaagauagaguggcuguaaccgccucugaggugcaacaggcagaaucggaggucagcgacauagaauccaggaucgccgcccuucgugcugcaggucugacagugaaacccucagggaagccacggcgaaaaaguaacuugccuauuuuucuccccagaguugcgggcaagcugggaaagaggccagaggaucccaaugcugacccuucuagcgaggccaaagcaauggccgugccauauuuacugcgccggaaguucuccaacucacuaaaaagccagggcaaggaugacgauucuuuugacagaaaauccgucuacagggggagucucacccagcgcaauccgaacgcucgaaagggaauggccagccacacguucgcaaagcccgugguagcucaucaaucuuga

SEQ ID NO: 59084 - RNA, 981 nt, Artificial Sequence
  derived and/or modified sequence opt3 from MLST8__Homo_sapiens__NP_001186102
augaacaccagccccggcacagugggguccgacccugucauccuggccacugcuggauacgaucacacgguuagauucuggcaggcacauucugguauuugcaccaggacagugcaacaccaggacucacagguaaaugcccucgaggugacuccagaucggaguaugauagcggcugccggcuaucagcauauccgcauguacgaccuuaacagcaauaacccgaaucccauuaucuccuaugauggggucaacaagaauauugcaucugugggauuucacgaagacggccgauggauguacaccgguggggaggauuguacagcccguaucugggaccugagaucgaggaacuugcaaugccagcggauauuccagguuaaugcuccuaucaacugugugugcuuacauccaaaucaggcagaacugauugucggagaucaaucaggcgccauccacauuugggaccuaaaaaccgaucacaacgagcagcucauccccgaaccugaggugagcauaacaagugcucauauugacccagaugccuccuauauggcggcaguaaauucuacuggcaacuguuacguuuggaaucugaccgggggaaucggugacgaggugacgcagcuuauucccaagacuaaaaucccugcccacacccgcuaugcucugcagugcagauuuagcccagacuccacauugcucgccacuuguucagcagaucaaaccugcaagaucuggaggacaaguaacuucagccugaugaccgaacugucuauuaaauccggcaacccgggggagucaagccggggauggauguggggcugugcuuuuaguggugacucucaguacauagucacggccuccagcgauaaucucgcgcgcuuauggugcguggaaacuggggagaucaagcgagaguacggaggccaucagaaggccguggucugucuggcauucaacgacucgguucuuggcuga

SEQ ID NO: 59085 - RNA, 897 nt, Artificial Sequence
  derived and/or modified sequence opt3 from MLX__Homo_sapiens__NP_733752
augaccgagcccggcgccagcccugaagacccaugggugaaggcuuccccggucggggcacacgccggagaggguagagcgggcagggcucgggcccgccgaggggcaggacguagaggcgccucucugcucucacccaaaaguccuacacuuagcguuccaagggguugccgggaagauuccucucaucccgcuugugcaaagguggaguacgccuauucggacaacucacuggauccuggguuguucguagaaagcacucgcaaaggaaguguggucuccagagcuaauucuaucggcagcacguccgccucaagugugccaaacaccgacgaugaggacagcgauuaccaccaggaggcguauaaggaaucuuacaaagacaggcggcgccgagcacauacacaagccgagcagaagagaagggaugcuauuaagcggggcuaugacgauuuacagacuauaguuccuaccugccagcaacaggacuuuuccaucgggucacagaaacugagcaaggccauugugcuacagaaaacaaucgauuacauucaauuccuccacaaggagaaaaagaagcaggaagaggaagucaguacccugcguaaagacgugacugcacuuaagaucaugaaaguaaauuaugagcagauaguuaaggcucaucaggacaacccccacgaaggagaggaucaagugucugaccaggucaaauuuaauguguuccaggguaucauggauucccuguuucagagcuucaacgccucgauuucuguggcguccuuucaagaauugucagccugugucuucaguuggaucgaggagcacugcaagccacagacacuccgcgaaauuguuaucggcgugcugcaucagcugaaaaaucaacucuacuga

SEQ ID NO: 59086 - RNA, 2760 nt, Artificial Sequence
  derived and/or modified sequence opt3 from MLXIP__Homo_sapiens__NP_055753
auggccgcugacguguucaugugcagccccagaaggccucggucccgcggccgacagguccugcucaagccacaaguuucugaggaugacgaugacucagauaccgacgaaccgagucccccuccagcaagcggggccgcgacacccgcucgugcccacgcauccgccgcuccuccacccccuagagcaggaccagguagggaggaaccgccccggcgccagcagaucauucauucuggccacuuuauggugucgucaccucauagagagcacccacccaaaaagggguacgauuucgacacuguaaacaaacagacgugucaaaccuauagcuuuggaaagacaaguuccugccaucuuucuauagaugccagccugacuaaauuguucgaauguaugaccuuagcuuacuccggcaagcuggugucaccuaaguggaaaaauuuuaagggucuaaaacuccaguggagggacaagauccggcugaacaaugccauuuggcgcgcgugguauaugcaguaccuugagaaacgaaagaacccagucugccacuucgugacaccccuggaugggaguguugacguggaugagcacagaaggccggaagcaaucaccacugagggaaaguauuggaaaagccggauugaaaucgucauacgugaguaccauaaguggcgcacauauuuuaaaaagagauugcagcaacacaaagacgaggaccucucuucccuggugcaggaugacgauaugcuguacuggcauaagcacggcgacggcuggaaaaccccuguacccauggaagaggauccacucuuagacacggauaugcugaugucagaguucagcgacacucuuuuuaguaccuugucuucccaccagccuguugccuggcccaauccaagggagaucgcucaucuggggaacgccgauaugauucagcccggacuaaucccucuccaaccaaaucuggacuucauggauacauuugaaccguuccaggaccuuuuuagcucgucucgguccauuuucgguucaaugcugcccgcaagugcuagcgccccugugccagaccccaacaauccuccagcgcaggaguccaucuugcccacuaccgcccucccgacagucucucugccugauagcuuaauagcaccacccaccgcuccuucacuggcccacauggacgagcaaggcugugaacauacgagucgaacugaggaucccuucauucagccaacagacuuugggccuuccgaacccccacucagcgugccgcagccuuuccuucccguguuuaccaugccacuguugucucccucaccagcuccacccccuaucaguccgguccuaccacugguucccccuccagccacugcacucaaucccccugccccgcccacauuccaccagccacaaaaguuugcuggagugaacaaggcgccuagcguaauuacccauacggcauccgccacccugacacacgaugcucccgccacuaccuucucucagucgcagggccuugugaucacaacucaccauccagcaccuagcgccgcucccugcggucuggccuuguccccagucacccgcccgccucagcccagacucacauuugugcacccaaaacccguuucacugaccgggggaaggccuaagcaaccacauaaaaucgugcccgcaccuaagccggagccagucaguuuagugcugaaaaacgcgcggauugcucccgccgcauucucuggccagccucaggccguaauaaugacuagcggcccccuaaagcgcgaagggaugcucgcuuccacgguuucacagagcaauguggucaucgccccagcagcuauugccagagcgccuggagugcccgaguuucacucuuccauccuggucacagaccuuggucacggcaccaguagcccuccugccccggugucuagguuguuccccuccacugcucaagauccacuggggaagggagagcagguuccucuccauggcgguucaccccaggugaccguaacagggccaagucgugacuguccuaacagcggccaggcaucgcccugcgccuccgaacaaucuccgagcccacagucaccucagaauaacuguaguggaaaauccgaucccaagaacgucgcugcccugaaaaaucggcaaaugaagcacauaucugcagagcagaaacgaagauuuaacauuaagaugugcuucgacaugcuuaauagccugaucuccaacaauucaaaguugaccagccaugcgaucacucuccagaaaacaguggaauacauuacgaagcugcagcaagagaggggccagaugcaggaagaggcccgccgguuaagagaggaaaucgaggaacugaacgcuaccauuauaaguugucagcaacuacucccagccacugggguucccgugacaaggcgccaguuugaucacaugaaagacauguucgaugaguaugucaagacccgaacacugcagaauuggaaauucuggaucuuuucuauuaucaucaagccucuuuucgaguccuuuaagggaauggugagcacuucgucauuggaagaacugcaucggaccgcacucucuuggcuggaccagcacugcaguuuaccgauucugcgucccaugguacuuuccacguugagacaacucagcaccucuacaagcauacugacugacccagcucagcuaccugaacaggccuccaaagcagugaccaggaucgguaagcgccugggcgagucauga

SEQ ID NO: 59087 - RNA, 2559 nt, Artificial Sequence
  derived and/or modified sequence opt3 from MLXIPL__Homo_sapiens__NP_116569
auggccggcgcucuggcagggcucgccgcgggacuucaggugcccagagucgcuccuagcccagacuccgauucugacaccgauucagaggacccgagucugaggcggagcgccgguggcuuguuacgcucccaaguuauccacucugggcauuucauggugucgucaccccacagcgauagucugccucgacguagagaccaggaaggauccguaggcccaucugauuuuggucccaggagcauugacccuacacuaacucgccucuucgagugccugucccuugcauacucagggaagcuggugaguccaaaauggaagaacuuuaaaggauugaagcuccugugucgggauaaaauaagacugaauaacgccaucuggagggcuugguauauucaguacgucaagcggcgcaagagccccgugugcggcuucguuacgccucuccagggcccagaagcagacgcccaucgaaaaccggaggcuguggucuuagaagggaauuauuggaagagaaggaucgaggugguaaugcgggaguaccacaaauggcguauuuauuacaagaaacgccugagaaagcccucuagggaagaugaccuuuuggccccuaagcaagcggagggacgguggccacccccugaacagugguguaaacagcuguuuuccucaguugugccaguccuacucggugaucccgaggaggaaccgggcgggcgacagcugcuugaccugaacugcuucuugagcgacaucagugauacccucuuuacaaugacucaaucuggaccuuccccacugcaguuacccccugaggacgcauaugugggcaaugccgauaugauacagcccgaccugaccccacuccagcccagccuugaugacuucauggauaucucggacuuuuucacaaacucucgccugccucaaccaccgaugcccuccaauuuuccugaaccacccucauucaguccuguggucgauagcuuguuuuccucugguacccuagggccagagguucccccggcuagcucagccaugacucaucugaguggacacuccagacuccaggcaaggaacagcuguccuggcccacuggacucuucagcuuuccuuaguagcgauuuccuguugcccgaagacccuaagccccggcucccaccucccccagugccgccuccccuguuacacuacccacccccugccaaaguaccaggccuggagcccugcccuccgccacccuuuccuccaauggcgcccccuacagcccuacuccaggaggaaccgcuguucuccccacgcuuucccuucccuaccgugcccccagcaccuggggucucuccccuuccagcuccggccgcuuuuccucccacgccacaaucggugcccagcccugccccaacucccuucccuauugaguugcugccgcucggauacuccgaaccagcauuuggucccuguuucucaaugccuagaggcaagcccccagccccuagucccagggggcagaaagcuagcccaccuacccuggcgccggcaacagccucucccccaacuaccgcuggauccaauaacccuugccuuacacagcuguugaccgccgcaaagcccgagcaggcccucgaaccaccucugguuucaagcacguuacugcguucucccggcuccccgcaagagacugugccagaguuuccuuguacauuccuacccccaacccccgcuccuacuccgccccggccaccucccgguccugccacacucgcaccaagucgaccccugcuugucccuaaagcggaaagauugagcccacccgcuccgucuggguccgagaggcgccugucaggcgaccucaguagcaugccuggaccaggcacccugucggugcggguaucucccccucagccaaucuuauccagagggaggcccgauagcaauaagacggaaaaccgccgaauuacccauaucucagccgagcagaagcggcguuuuaauauaaaacugggauucgacacacuucacgguuugguuaguacucucuccgcacagccgucucugaaggugagcaaagccaccacacuacaaaagacugcugaauauauucugaugcuccagcaggagagagccggccugcaggaggaagcacaacagcuuagggaugagaucgaagaguugaacgcugccauuaaucugugccagcagcaauuaccugcgaccgggguccccaucacacaucagcgcuuugaccagaugcgggauauguucgacgauuacgugagaaccaggacucuccacaacuggaaauucugggucuuuuccauccugauucgaccacuuuucgagucauuuaacggaauggugagcacggccaguguucacacacugcgccaaaccucuuuggcuuggcucgaccaguauuguucccugccugcacuacggcccacugugcugaauagccucagacagcugggcaccucgacaucaauacuuaccgauccagguaggauccccgaacaggccacucgugcuguaacagaggggacguugggcaagccucuguga

SEQ ID NO: 59088 - RNA, 1482 nt, Artificial Sequence
  derived and/or modified sequence opt3 from MLYCD__Homo_sapiens__NP_036345
augagaggcuucgggcccggacugaccgccaggcggcuccuuccucugcgcuugccaccgcgacccccugguccacguuuagcuagcggccaggcagccggggcgcuggagagagcuauggacgaacuacucaggcgggccgugcccccuacaccagcauacgagcugcgcgaaaagacucccgccccugcugagggacaaugcgcagauuuugucuccuucuauggcggucuugccgaaacggcucagagagccgagcuguuggggaggcucgcgcggggauuuggcguugaccacggccagguggcagagcagucugccgggguacugcaucugcgccaacagcagcgagaagcugccgugcucuuacaggcagaggauagacugagguacgcucuugucccacgguaucguggauuguuccaccauaucucaaaacuggacgguggcgugcgcuuucuaguucaacucagagccgaucugcuugaagcgcaggcccugaaguugguggaggggccggacgucagggagaugaacggagugcucaaaggcaugcugagugaaugguucagcuccgguuuucugaaucuggagcggguaaccuggcacucucccugugaaguucuccagaagauuucggaggcagaagcugugcauccugucaaaaacuggauggauaugaagcgacgcguggggccauacagaaggugcuauuucuuuucacacuguagcacacccggagagccucuugugguccugcacguugccuugacuggcgacauaaguuccaauauccaggcuauugugaaggagcauccacccucugaaaccgaggagaaaaacaagaucacagccgcaauuuucuacagcaucucccuaacccaacagggccugcaggggguagaacucggaacuuuucugauaaaacggguggucaaggaacuucaacgcgaguucccgcaccuggguguguuuucaaguuugagcccuauccccggcuucacaaaauggcuccugggguuauuaaauucucagaccaaggagcauggaagaaacgaacuauucacggauuccgagugcaaggaaauuucagagaucacuggcgguccaauuaaugaaacccucaaacugcuuuugagcaguucugaguggguucaguccgagaagcuggugagggcccuccagacaccucugaugcgucuuugugcuugguaucuguacggggaaaaacaccggggcuacgcguugaaccccgucgcaaauuuucaccuccaaaacggagccgugcuguggcgaaucaauuggauggcugacguuagcuuaagaggcauaacugggucgugcggacugauggccaacuauagguacuuccuagaggaaaccgguccaaauucuacauccuaucucggcucaaagauuaucaaagcaagugagcagguacugagccuuguggcccaguuucagaagaacuccaaauuguga

SEQ ID NO: 59089 - RNA, 1257 nt, Artificial Sequence
  derived and/or modified sequence opt3 from MMAA__Homo_sapiens__NP_758454
augcccaugcugcucccucacccacaucagcacuuccuuaagggccuguugagagccccguuuaggugcuaccauuucaucuuucacagcuccacccauuuagggucugggauucccugugcucaaccuuucaacucacugggucuacacugcacaaaauggaugcuccugagugacggccuuaagcggaaacugugugugcagacuacguugaaggaucacaccgaggggcucagcgacaaagaacagcgcuuugucgauaagcuguauacaggacugauacagggccaacgagcaugccucgccgaggcgaucacuuuaguugaauccacccauucucguaagaaagagcuggcucaggugcuuuugcagaagguacugcuauaccacagagaacaggagcaaucgaauaaagguaagccacucgccuucaggguggggcugucaggacccccuggcgcaggcaaaagcacauuuauugaguauuucgggaagaugcuuaccgaacggggacauaagcugagugucuuggccguggacccauccucuuguacuagcgguggcucccuccugggggauaaaacacgcaugaccgaguuaucaagagacaugaacgcuuacaucaggcccaguccuacgcggggaacucugggcgguguuacccgcacaacuaaugaagcaauucuccuuugcgagggggccggauaugauaucauacugaucgagaccgugggcgucggccagagcgaauuugcuguggccgacaugguagauauguucguuuugcuacugccaccggcgggaggagacgagcuccaggguauuaagcgaggcaucauugaaauggcagaucugguggccgucacaaaaucugacggggaucuuaucgugcccgcuagaaggauacaggccgaguacguguccgcacugaaguugcuccggaaacguucacaagucuggaagccuaaaguuauucgcaucagcgcuagaaguggagaaggcauuucugagaugugggacaagaugaaggacuuucaggaucugauguuagccuccggugagcugaccgcgaaaaggcggaagcagcaaaaaguguggauguggaaccuaauccaggaaagcguacucgagcacuuccgaacgcacccaacugugcgcgaacagaucccccugcuugagcagaaggucuugauuggggcccugucgccuggccucgcagcugacuuucugcuuaaagccuucaagucuagagauuga

SEQ ID NO: 59090 - RNA, 753 nt, Artificial Sequence
  derived and/or modified sequence opt3 from MMAB__Homo_sapiens__NP_443077
auggccgugugcggccuggggagcagacucggacuugguuccaggcugggcuugcggggguguuucggagcugcacgcuuacuguacccccgauuucagucucguggcccucaaggugucgaggacggggauagaccacagccgucaaguaagacccccaggaucccuaaaauuuauacaaagacuggagacaaaggcuucagcuccacguuuaccggcgaacggcgcccaaaggaugaccagguuuucgaggccguggggacaacugaugaacuaucuucggcgauaggauuugcucucgagcugguaaccgaaaaaggucacacauucgccgaggagcuucagaagauccaaugcacccugcaggacgugggcucagcauuggccacucccuguagcagugcuagagaagcacaucucaaguacacaaccuuuaaagccgggccuauucuggagcuggaacaguggaucgauaaguauacgucccagcucccacccuuaacugcuuucauucugccuucuggaggcaaaaucagcuccgcccuucacuuuugcagggcggucugucggcgcgcagagcgaagagugguuccauuggugcaaaugggugagaccgacgccaacgucgcuaaguuccugaauaggcuaucagauuaccucuuuacacuggcccgguaugcagcuaugaaagaagggaaccaggagaagauauacaugaagaaugacccgagugccgaaagcgagggacuuuga

SEQ ID NO: 59091 - RNA, 891 nt, Artificial Sequence
  derived and/or modified sequence opt3 from MMADHC__Homo_sapiens__NP_056517
auggccaacgugcugugcaauagagcuaggcucgucagcuaccuucccggcuucuguucccugguuaagcgggugguaaacccuaaagcauuuucuaccgccgggucaaguggaagcgacgagucccacguggcggcugccccaccggauaucugcucucgcacagucuggcccgacgaaacuauggguccuuucggcccacaggaucaacgauuucaguugcccgggaauauuggauucgacugucauuuaaacggcacggcaucgcagaagaaaucacuggugcacaagacccuaccugauguucucgccgagccacugagcagugaacgucaugaguuugugauggcucaguaugucaaugaguuccaagguaacgacgcacccguggaacaggagauaaauuccgccgaaacauacuuugagucugcuagaguagaaugcgccauccagacuuguccugagcuucugaggaaagauuucgagagcuuguuuccagaaguugcgaacgggaagcucaugauucugaccgugacacagaagaccaaaaaugacaugacugucugguccgaggaaguggagaucgaacgggaggugcugcucgagaaguucauuaacggagcaaaagaaaucugcuaugccuuacgcgcugagggcuacugggccgauuuuauagacccgucaaguggccuggcauucuuugggcccuauacaaauaacacccuuuucgaaacggaugagagauacaggcacuugggauucagcgucgacgaucuggguuguugcaagguuauccggcauucucuauggggcacucacgugguagugggguccauuuuuaccaaugcuacaccugacucacacaucaugaaaaagcucagcggaaacuga

SEQ ID NO: 59092 - RNA, 813 nt, Artificial Sequence
  derived and/or modified sequence opt3 from MMD2__Homo_sapiens__NP_001094070
auguucgcccccagacugcucgacuuucagaagaccaaauacgcuagguucaugaaccaccgggugccugcacauaagcgcuaucaaccaacagaguacgaacacgccgcgaauugcgcuacucaugccuuuuggaucauuccgagcauacuuggcuccucuaaccuguauuucuugucagaugacgauugggagacgaucagugcauggauuuacggguuaggacuguguggucuauuugucguuagcaccguguuccacacaaucuccuggaaaaagucucaucuccgaaugguagaacacugccugcacauguuugaccguauggugauuuauuucuuuaucgccgcuucguacgcacccuggcuuaaucugagagaguugggcccuugggccucacauaugagguggcucgucuggauaauggcuagcguggggacuaucuauguuuucuuuuuccacgaacggaccggaaguugugugcaguuucugcgcggcgaggccugcccaaaagcggguacagcaugucugcccgccagauacaagcucgucgaguuacugugcuacgugguaaugggguucuucccugcucuuguuauuuuguccaugccaaacaccgaaggaaucugggagcuggugacuggcggcgucuuuuauugucuagggaugguguucuuuaagucugauggaaggauucccuucgcccaugcaaucuggcaccucuuuguggcuuucggugccggcacacacuacuaugcgauauggcgguaccuguaucuuccuagcacccugcagacgaaagucuccaaguga

SEQ ID NO: 59093 - RNA, 717 nt, Artificial Sequence
  derived and/or modified sequence opt3 from MMD__Homo_sapiens__NP_036461
augagauucaagaacagguuucagcgguucaugaaucaccgcgcccccgcuaacggccgauacaaaccuaccugcuaugagcaugcagccaauuguuacacacacgcguuucugaucgugccagcuauugucgggagcgcccuccuucaucgucuguccgacgauugcugggaaaagauaacugcauggaucuauggaauggguuugugugccuuauucauuguuucuacgguguuucacaucguaucauggaaaaagagucaucugagaaccguggagcacugcuuccacaugugugacaggauggucauuuacuuuuucaucgcugcaagcuaugccccguggcuaaaccuccgggaacugggcccccuugcuucccauaugcgcugguuuauauggcugauggccgcagggggaacaaucuacguguucuuguaucacgagaaauacaagguuguggaacucuuuuucuaccugacuaugggcuuuucuccugcgcuggucgugaccucgaugaauaacacagauggucuccaagaguuagccugcgggggacugauuuauugucuuggcguaguuuucuucaagucagacggcaucauuccauuugcucaugccaucuggcacuuguucguggcaaccgcugccgcgguccacuacuaugccauauggaaauaccuguauagaagccccacugauuuuaugaggcaucuauga

SEQ ID NO: 59094 - RNA, 2253 nt, Artificial Sequence
  derived and/or modified sequence opt3 from MME__Homo_sapiens__XP_011511160
augggcaagagcgagucccagauggacaucaccgauauuaacacacccaaaccuaagaaaaagcaaagauggacuccacuggaaauaucucucucagugcuuguccuguuguuaacgaucauugccguuaccaugaucgcucuguacgcaacauaugacgaugggauuugcaaaaguagcgacuguaucaaguccgccgcgaggcuaauacagaauauggaugcuacuaccgagccgugcacagacuucuuuaaguacgccuguggagguuggcucaaacggaacgugauccccgaaaccucuucgcgcuauggcaauuucgauauucugcgagacgagcuugaaguagugcugaaggaugucuugcaggagccuaaaacugaggacaucguggcaguucagaaggccaaagcucucuaccguucaugcauuaacgaaagcgcaaucgauaguagagggggagagccacugcugaagcucuuacccgacauauauggcuggccuguggccacagaaaauugggagcaaaaguacggugcuuccuggaccgccgagaaagcgauugcacagcugaacucuaaguaugggaaaaagguccuuaucaauuuguuugugggaacggaugacaaaaacagcguaaaucacguuauucauaucgaccagccaaggcugggccuacccucccgggauuacuacgaauguacuggcaucuauaaggaggccugcaccgcuuacguggacuucaugauuucagucgcccgccucauaagacaggaagagaggcugccuaucgaugaaaaccaacuugcacuggagaugaauaaagugauggaguuggaaaaggagauugcuaacgccacagcgaagccagaagaccggaaugauccgaugcuccuguauaacaaaaugacuuuagcccagauccagaauaacuuuagucuggagauaaacgggaagcccuucagcuggcucaauuuuaccaacgaaauuaugucuacagugaauaucuccaucaccaacgaggaggacgucguuguguacgcaccugaauaucuuacgaaacugaagccaauuuugacuaaauacucagcucgcgaucuacagaaucugaugagcuggcgauucaucauggaccucguaaguucucuguccagaacauauaaggagagcaggaacgccuuucggaaggcucuuuacggaaccacuucggaaacagccaccuggcgucgcugugcaaauuacgugaacgguaauauggagaacgccgucggcagacuguauguggaagcugcguucgcaggggagucuaaacacguuguggaggauuugauugcccaaauaagggaagucuuuauccagacgcucgacgaucugaccuggauggacgcugagacaaagaaacgggccgaagagaaggcauuagccauuaaagagcgaaucggauaccccgacgauaucguguccaaugacaacaagcugaauaacgaauaucuagagcucaauuacaaggaagaugaguauuucgaaaacauuauacagaaccugaaauuuucacaaaguaagcagcuuaaaaaguugcgcgagaaaguagacaaggaugaguggaucagcggcgcugccguugugaaugcauucuacuccucugguagaaaccagauugucuucccugcggggauccugcagccacccuuuuucagcgcucaacagucaaauagucucaacuauggaggcauuggcauggugaucgggcaugaaauaacucacggauuugacgauaaugguaggaacuucaauaaggacggcgaucuggucgacugguggacccagcaguccgccagcaacuuuaaagagcaaucucagugcaugguguaccaguacgggaauuucucaugggaucuugcaggaggccagcaucugaacgguaucaauacauugggggaaaacauugccgacaauggcggacucggccaggcuuaucgggccuaccaaaacuauaucaagaaaaauggggaggaaaagcuguuaccgggacuggaucuaaaccacaaacagcucuuuuuccugaacuuugcacagguuuggugugguacuuaccgcccugaguaugcugugaauaguauuaagaccgacguacacagccccggcaacuucagaaucauagggacacuucaaaauuccgccgaguuuucugaagcguuccauugcaggaaaaacucguacaugaauccagagaagaagugucgugucugguga

SEQ ID NO: 59095 - RNA, 1206 nt, Artificial Sequence
  derived and/or modified sequence opt3 from MMEL1__Homo_sapiens__XP_011540425
augggcaagagcgaggggcccgugggaauggucgaauccgccgguagagcuggccagaaaaggccuggguuccuggagggaggccuccuucuguuguuacugcuaguuaccgcagcccucguggcgcuggguguacuuuacgcugaccggcgcgggaagcaacugccacgauuggccucucgucucugcuuucugcaggaagagagaacauucgugaaaaggaagccgcggggaauccccgaagcacaggaggucucagagguguguacuacgccuggcugcguuauugccgcugcacgcauacugcagaacauggauccaaccacagaacccugugacgauuuuuaucaauucgccugcggcggguggcucagaaggcacgugaucccugagacuaauagucgguacagcauuuuugacgucuuacgcgaugaacuggaggugauccuuaaagcuguauuggagaacuccaccgccaaggaccgaccagcgguugaaaaggcaagaacacuguauaggucuuguaugaaucagucggugauugagaaacggggaucacagccccuacucgauauccuggaagucguggguggcuggccuguggccauggaccguuggaacgagaccgucgggcuugaaugggagcuggagcgccaguuggcucucaugaauagccaauucaacagaaggguucugauagauuuauuuaucuggaaugacgaucagaacaguucccggcauauuaucuacgugcgagccgcaccaguaggacgcgacagaccggcucaccugggccaugcccuccccagggugcuucugcagcggcgccagcaaccugaagagaauagcuugggugcgauggucgccgaagcaacucagcuaugcccagcuagcuucgggcccggagccggcucccugccugcugugcacggcguuucagggcauguggccgcaggagguuguaagccagcccagggccaacuccccggggcuggaggccacggugcgggggcaggcgccggagauacagcuggccaggggcacggaaccccggguggcgagacgagaaggcaucgucuggucccucccgacgggacuggaggcgccgcaaaaccaguguggccugaagguaguggggccggcgagggacagaagucuggcguaaccucuaaaacaugccagaaggcucggaagggggccggauga

SEQ ID NO: 59096 - RNA, 1431 nt, Artificial Sequence
  derived and/or modified sequence opt3 from MMP10__Homo_sapiens__NP_002416
augaugcaccuggccuuccucgugcuucugugcuugcccgucuguagcgcuuacccuuuauccggcgcagccaaggaggaagacucuaacaaagaucuggcgcagcaauaucuagagaaguacuauaaucucgaaaaagacguuaagcaguuuagaaggaaagauucaaaccugaucgugaagaagauucaggggaugcagaaauuccuuggacuggagguaaccgguaaguuggacacagauacucucgaagugaugcggaaaccacgcugcggcgucccggacguggggcauuuuaguagcuuccccggaaugccuaaguggcgaaaaacgcaccugaccuaccguauaguuaauuauacaccagaucugcccagagacgcuguggauuccgccaucgagaaggcacucaaggucugggaggaagugacuccuuuaaccuuuucuaggcuguacgagggcgaagccgacauuaugaucucguucgcuguaaaagagcauggugauuuuuauucauucgacgggccaggacacagccuugcacaugccuaucccccuggcccaggcuuguacggggauauucacuuugacgacgaugagaaguggacagaagacgcuaguggaaccaaccuguuccuaguugccgcgcacgagcucggucauucccugggccuuuuucacucugcaaauacugaagcccugauguacccguuguacaacagcuucacagagcucgcucaauuucggcugucccaggaugacgugaaugggauccagucauuauauggacccccuccagccaguaccgaggaaccccuggucccuacgaaaagcgugccaucuggcuccgagaugcccgcaaagugugauccggcucucucauucgacgccauaagcacucuucgcggugaauaccuguucuuuaaagauagauauuucuggaggcggagucauuggaacccugagcccgaauuucacuugaucucugcguucuggccaucccuaccuagcuaccuggacgccgcauaugaggucaauucgcgcgauaccguguuuauuuucaaggggaacgaauuuugggcuauccgaggaaaugagguucaggccggcuaccccagaggcauucacacacucggguucccacccacuaucaggaaaauagacgcugccgugucugauaaggagaagaaaaagaccuacuuuuucgcagccgacaaauauuggcgguuugacgaaaacucccaaucaauggagcagggauucccucgucugauugcugaugacuuuccagguguagaaccgaagguggaugcgguccuucaggcauucggcuucuuuuacuucuuuagugggagcucccaguucgaguuugaccccaaugcccgcauggugacacauauccugaaaucuaacagcugguugcacugcuga

SEQ ID NO: 59097 - RNA, 1467 nt, Artificial Sequence
  derived and/or modified sequence opt3 from MMP11__Homo_sapiens__NP_005931
auggcccccgcugcauggcugagaagcgccgcggcuagggcccuccuuccuccaaugcuguuguuacugcuacagccgcccccucuccuggcacgggcccuuccacccgacgcucaccaucugcacgcagagcgccgaggcccucaaccauggcaugccgcuuugcccuccucuccugccccagcgccggcaacccaggaagccccucguccugcuucaagucucagaccacccaggugcggggugccugauccaagcgacggacuguccgcccggaaccgccagaagagauucguccugucuggugggaggugggagaaaacagaucucacuuaccggaucuuacgcuuucccuggcagcugguucaagaacaggugcgacagacgauggcagaggcucuuaagguauggucggacgugaccccguugacauucacugaaguccacgagggcagagccgauauuaugauagacuuugcgagguauuggcauggagaugaccugccuuucgauggccccggugggauccuagcccacgcauuuuucccaaaaacccaccgggagggagacgugcauuuugauuacgacgaaacauggaccauuggcgaugaccagggcacugaccuccugcaaguugcugcccacgaguucgggcaugugcuuggacugcagcacacaaccgcugccaaggcauugaugucagccuuuuauacguuccguuacccucucagccugagucccgaugacugucgcgguguccagcacuuauauggccagccauggcccacugugaccuccagaacacccgcucuggggccacaagcgggaaucgauacuaaugaaauugcaccgcucgagcccgacgccccuccagaugcuugcgaggccucuuuugacgcaguaagcaccaucaggggcgaacuuuucuuuuucaaagccgguuucguuuggcggcugcgagggggacaguugcagcccggcuacccugcucuagccucccgccauuggcaaggccugccaucacccguggaugcagcguuugaggacgcucaggggcacauaugguucuuucagggagcccaguauugggucuacgauggugaaaagccggugcucggcccugcaccacugacagagcuugggcuggugagauuccccguccaugccgcuuugguuuggggaccugaaaagaacaaaaucuacuuuuucaggggccgggacuauuggcgcuuucaccccaguaccagaaggguggauagcccaguaccucgucgggccacggacuggcgaggugugcccucugagauugacgcagcuuuccaagaugccgacggguacgcguauuuucucagaggcaggcuguacuggaaguucgauccagucaaagugaaggccuuagagggauuuccgcgccugguuggcccugacuucuuugggugugcugaacccgcaaauacuuuccuauga

SEQ ID NO: 59098 - RNA, 1413 nt, Artificial Sequence
  derived and/or modified sequence opt3 from MMP12__Homo_sapiens__NP_002417
augaaguuccugcucauccuucuguugcaggccaccgcuagcggcgcauuaccccugaacuccucuacaucacuagagaaaaauaacgugcucuuuggggaaagauaccuggagaaguucuauggacuugaaauuaauaaacugccugucacuaagaugaaauacagugguaacuugaugaaggagaagauacaagaaaugcagcacuuucucggccugaaaguuacggggcagcuggacaccagcacacucgagaugaugcaugccccaaggugcggagugccggauguacaccauuuccgggagaugcccggcgguccuguguggcgcaagcacuauaucacuuaccgaauuaauaacuauaccccagacaugaaucgugaagaugucgacuacgcgaucagaaaggcuuuucaggugugguccaacguuacacccuuaaaguucucuaaaauuaauaccgggauggccgauauccugguggucuuugcaaggggagcccauggcgacuuccacgcuuuugauggcaaagggggaauacuugcacacgccuucgguccuggcucggggaucggaggcgacgcucauuuugaugaggacgaauuuuggacuacacacucaggugggaccaacuuguuucugacggccgugcaugagauuggacacagccuaggccucggccacaguuccgauccaaaggcgguaauguuccccacuuauaaauacguugacaucaauaccuuccggcugucugcagaugacauucgcgggauccaaagccuuuacggagacccuaaggagaaccagagacugccaaauccggauaacuccgaacccgccuugugugacccuaaucucucauuugaugcugugacaacugucgguaacaaaauauucuuuuucaaggacagguuuuucuggcugaaagugagugagcggccaaagaccagcgugaacuuaauuucuucccuguggcccacacucccuucaggcaucgaagccgcauaugagauugaagcucgcaaucaggucuuucuuuucaaagaugacaaguacuggcugaucagcaacuugcgaccagagcccaauuauccgaagaguauccauucuuuuggguucccuaacuuuguuaaaaagauugaugccgcgguguucaaucccagauuuuacaggaccuauuucuucguagacaaccaguacuggcgguaugaugagcgucgccaaaugauggacccaggauacccuaaacuaauaacgaagaauuuucagggcaucggucccaaaauugaugccguguucuacuccaagaacaaguauuacuauuucuuccaggggagcaaucaguuugaauacgacuuccugcuccaaagaaucacuaaaacacugaagucgaacucuugguuuggcugcuga

SEQ ID NO: 59099 - RNA, 1416 nt, Artificial Sequence
  derived and/or modified sequence opt3 from MMP13__Homo_sapiens__NP_002418
augcaccccggcgugcuggccgcuuuccucuuucuuagcuggacccauugcagagcacugccuuugccauccgggggagacgaggaugacuuaucugaagaggaucugcaguucgccgaaagguaccuacggucauauuaccacccgacaaaccucgcggguauccugaaggagaaugcugccaguagcaugacugaacgccuucgagagaugcaauccuuuuucggccuggaggucacggggaaauuggacgauaacacccucgacguuaugaagaaaccccguuguggagugccugauguaggcgaauauaauguguuuccaagaacacugaaguggucuaaaaugaaccugacuuacaggauugucaauuauacccccgacaugacacauucggagguggaaaaggcauucaagaaagccuuuaagguuuggucagaugugaccccucucaacuucacucgguuacacgacgguauagcugauaucaugauuagcuuugggaucaaagagcauggagacuucuacccauuugauggccccaguggccugcuugcacacgccuucccuccagggccgaauuauggaggugacgcucacuuugacgaugacgagacauggaccuccucuagcaagggcuacaacuuguuccuggucgccgcgcaugaguucgggcacucccuaggacucgaucauucaaaagaccccggcgcacugauguuuccuauuuacacguauacugguaagagucacuucaugcuuccagaugacgaugugcaggggauccagagccuguacggacccggcgacgaagauccuaauccaaagcaccccaaaaccccggacaagugcgauccuucuuugucccucgacgccauaacaucacugcgcggcgaaacuaugaucuuuaaagacagauucuuuuggagguuacauccccagcaaguagaugcugagcuguuccucaccaagagcuuuuggccagaacuuccuaaccggauugacgccgcauaugagcaccccagucaugaucugaucuucauuuuucgcgggcgaaaauucugggcuuugaauggauacgacauccuagaggguuauccaaagaaaauaucugaacugggccuccccaaggagguuaagaaaauuuccgccgcggugcacuuugaagauacagggaagacccugcuuuucagcggaaaccaggucuggagauacgacgauacgaaucauaucauggacaaagauuauccuaggcugauugaggaagacuuuccaggcaucggugauaagguggacgccguguacgagaaaaacggguacaucuauuucuucaauggcccgauucaguuugaguacucgauauggucuaaccggaucguccguguuaugcccgcaaacuccauuuugugguguuga

SEQ ID NO: 59100 - RNA, 1749 nt, Artificial Sequence
  derived and/or modified sequence opt3 from MMP14__Homo_sapiens__NP_004986
augagccccgccccuagaccaccgaggugccugcuccuuccccuguugaccuuaggcacagcucuggcaucccuagggucugcccagucaaguagcuucuccccugaggcguggcuccaacaguacggauaucugccacccggugaccuucggacucacacgcagcgcucuccucagucgcugucagcugccaucgcagccaugcaaaaguuuuacggccuccaggugaccgggaaagcugaugcagacacaaugaaggccaugcgacguccaagauguggaguccccgauaaauucggcgcugaaauuaaggccaacguuaggcggaaacgcuaugcgauacaggguuugaaguggcagcauaaugagaucacuuuuugcauucaaaacuacaccccuaaggugggggaauaugcaacauacgaggccaucagaaaggcuuucaggguaugggaaagcgccaccccacugcgguuucgcgaggugccguaugcauacauucgagagggacacgaaaaacaggcugacaucaugauauucuuugccgagggcuuccauggcgauaguacucccuuugacggggaaggagguuuccuggcgcacgccuacuuuccuggcccaaauaucgggggagauacacauuucgacuccgcagagcccuggaccgucagaaacgaggaucucaauggcaacgacaucuuuuuaguggcuguucacgaacugggucacgcccuuggguuggagcauucuagcgauccuuccgcuauuauggccccauucuaucaguggauggacacggaaaauuucgugcugcccgaugacgacaggcggggcauucagcaacuauacggaggcgagucaggguuuccgacuaaaaugccuccccagccacguaccacaagucgcccuagcguccccgauaagcccaaaaacccaacuuauggaccuaauaucugugacgguaacuucgauaccguggcaaugcucagaggcgaaauguuuguauucaaggagaggugguuuuggcggguucgaaauaaccaggugauggacggguacccaaugccgauaggacaauucuggcgcggccugcccgccucuauuaauacagcuuaugagagaaaggaugguaaauuugucuucuuuaagggggacaaacacuggguguucgaugaagcgucccuugagccuggcuacccaaagcauaucaaagaacugggaaggggcuugcccaccgacaagauugaugcagcccucuuuuggaugccuaacgggaaaacguauuucuuucggggaaauaaguacuaccgcuucaacgaggaacugagagcuguggacucagaguauccaaagaacaucaaagucugggaggguauccccgaaagcccgaggggcaguuucauggggucugaugagguuuuuacuuacuucuauaagggaaauaaauacuggaaguuuaacaaucagaaauuaaagguggaaccuggcuauccaaaguccgcccugcgugacuggauggguugccccagcgggggccggccugacgagggaacagaagaggagaccgaaguaauuauaaucgagguggaugaagagggcgggggagcagucucggccgcugccgugguucuccccgugcuucuguugcuacugguccucgcagugggucuggcgguauucuuuuuccgaagacacggcacuccaaggcgccuucuguacugucagcggucuuugcucgacaaaguuuga

SEQ ID NO: 59101 - RNA, 2010 nt, Artificial Sequence
  derived and/or modified sequence opt3 from MMP15__Homo_sapiens__NP_002419
augggcagcgaccccuccgccccugggagaccaggauggaccgguucucugcucggcgauagggaggaagcugcacggccgcgccuucugcccuuguuacuggugcuacucgggugccugggacuuggcgucgccgcggaggacgcugaaguucacgccgagaacuggcugcgauuguacgguuaucucccucagccaucacgucauaugaguacaaugagaagcgcacaaauccuggccuccgcucuggcagaaaugcagagguucuacgggauucccgugacuggaguacucgaugaggagacgaaggaauggaugaaacggccucgcuguggcgugccagaccaguuuggcgucagagugaaggccaauuuaaggcggcgccgaaaaagauaugcucugaccgggaggaaguggaacaaucaccaucuuacauucucuauacagaacuacacugagaaauugggaugguaucacucgauggaagccguucggcgugcguuucgcgugugggagcaagcaacaccccuggucuuccaggaggugccuuacgaagauaucagacuaaggcggcagaaggaggccgacauuaugguacucuuugcuucagguuuccauggcgauagcaguccauuugacgggaccggaggcuuccuggcccacgcauauuuuccgggucccgggcuuggaggcgauacccacuucgacgcugaugaaccuuggacuuuuuccucuacagaccugcauggcaauaacuuguuccucguugccgugcacgagcuggggcaugcguuaggacuggaacacagcuccaauccaaacgccaucauggcacccuuuuaccaguggaaggaugucgacaauuucaaacucccugaggacgaucuucgagguauucaacagcuguacggcaccccagacgggcagccccagccgacgcaaccuuugcccacugugaccccacgcagaccuggaaggcccgaucaccggccaccccgcccuccacagccgcccccuccaggcgguaagcccgagagaccuccaaaacccgggccgccugugcagccaagggcuacagaacgucccgaccaauauggcccuaacaucugcgauggagacuucgauacugucgccaugcuacggggcgagauguuuguuuucaaggggcgaugguuuuggagagugaggcauaaucgcguacuggacaacuaccccaugccaauaggacacuucuggcggggucucccuggcgauaucucagcugccuaugaaagacaggacgggagguuuguguucuuuaaaggagaucgcuacuggcuguuccgagaggcaaaucuugaacccggcuauccacagccgcugaccaguuacgguuuggggauuccuuaugaccggaucgacacagccauuuggugggagcccaccggccauacguuuuucuuucaggaggaucguuacuggagauucaacgaagagacucaaaggggagacccaggcuaccccaagccuaucagcgucuggcaggggauaccagcuucucccaagggagcguuucucuccaaugaugcagccuauacauacuucuauaaagguaccaaguacuggaaauucgacaacgaacgccugcggauggagccuggcuauccgaagucaauuuuaagagauuuuauggggugucaggaacacguggagccaggacccagguggccugacguugcucgaccacccuucaacccucauggcggugccgagccgggggcagauagcgccgaaggcgacgugggagauggcgacggggauuuuggagcuggcgucaauaaagacggugggagucgcgugguaguucagauggaggaaguggcccggacugucaacguggucauggugcugguuccccuacuccugcuuuugugcgugcugggacucacauacgcacugguacaaaugcagagaaagggcgcgccaaggguccuucuguauuguaaacguucuuugcaggaguggguguga

SEQ ID NO: 59102 - RNA, 1824 nt, Artificial Sequence
  derived and/or modified sequence opt3 from MMP16__Homo_sapiens__NP_005932
augauccugcucaccuucagcacaggcagaaggcuugacuuugugcaccauuccggggucuucuuucugcagacuuuguuauggauucugugcgccacgguuuguggaaccgagcaauacuucaacguggaaguauggcuacagaaguaugguuaccugcccccuacagauccacggaugucugugcuccgcucagcugagacuaugcagagugcacuugccgcgaugcagcaauuuuauggcauaaauaugaccgggaaagucgaccgaaacacaaucgauuggaugaagaaaccgcguugcggagugcccgaccagaccagaggcagcuccaaguuccacauuaggcggaaacgcuacgcucugacuggucagaaguggcagcauaagcacaucacauauucuauuaaaaauguuaccccuaaggugggggauccagaaacgagaaaagccaucaggcgggcauuugacgucuggcaaaacgugacucccuugaccuucgaggaaguaccuuacucggagcucgagaauggaaagcgcgauguugacauaacaaucauuuuugccucaggcuuccauggcgauagcaguccauuugacggggaaggagguuuccuggcucacgcauauuuucccggcccugggaucggaggcgauacucacuucgacuccgaugagccauggacccuggguaacccgaaucaugacgggaacgaccucuucuuaguggccguccacgaacugggacaugcucuuggcuuggagcacucuaaugaucccacagccauuauggcgccuuuuuaccaguacauggagaccgacaacuucaaacugccaaaugaugaccuacagggcauccagaagauauaugggcccccugauaagauuccacccccgacgcgaccucuccccacugugccaccucacagaagcauucccccagcagaccccaggaaaaacgaucggccuaagccaccgcgucccccuacaggacgcccauccuaccccggugccaaaccuaauaucugugacggcaacuuuaauacccuggcuauccuuagaagggaaauguucguguuuaaggaucaaugguucuggcggguccgaaacaaccgcguuauggacggguauccaaugcagaucacuuacuuuuggagaggacugcccccgucaauugaugccguguaugagaauagugacggcaacuucguauuuuucaaagguaauaaguacuggguguuuaaagacacaaccuugcagccuggguauccacaugaucucauaacgcugggcagcggaaucccuccccacggcauugacucugcaaucuggugggaagaugucgggaagaccuacuucuuuaagggagacagguacuggcgguauuccgaggaaaugaaaacaauggaucccgguuacccaaagccuauaacuguguggaaaggcauucccgagucaccacaaggggcuuucguucauaaggagaacggauucaccuauuuuuacaaaggcaaggaauauuggaaguucaauaaccagaucuuaaaaguggagccggguuacccucgcagcauccugaaggacuuuauggggugcgauggccccacagacagagucaaagaaggacacaguccacccgaugacguggauauuguaaucaagcucgacaauacugccucuaccguuaaagcgauugccauagugaucccuuguauucuugcacugugcuugcuaguccugguguauacagucuuccaguuuaagaggaagggcaccccacgucauauccucuacuguaaacgguccaugcaggaguggguguga

SEQ ID NO: 59103 - RNA, 1812 nt, Artificial Sequence
  derived and/or modified sequence opt3 from MMP17__Homo_sapiens__NP_057239
augagaaggcgggccgcucgcggccccgggccuccaccgcccggaccuggucugagccgacucccacuuccccuguuguuacugcuagcacucggcacccgugggggaugcgccgcgccugcuccagcccccagagcagaggaccugucccuuggcguggaauggcugucuagguucgguuacuugccuccagccgauccgacaacugggcagcuccaaacgcaggaggaacugucaaaggcuaucaccgcaaugcagcaguuuggaggccuggaggccacaggcauucucgacgaagcuacuuuagcccugaugaaaacaccccgguguagucuuccugauuugccaguccugacccaagcgcgcagaaggcggcaggcacccgccccuaccaaguggaacaaacgcaaucuaagcuggcgaguuagaacuuucccaagggacucuccccucgggcacgauacagugcgggcucugauguauuacgcccuuaagguaugguccgacauagcaccgcugaacuuucaugagguggcuggaucggccgcggauauccagauugacuucucaaaagccgaucacaaugacgguuauccuuuugauggccccgggggaaccgucgcacaugcuuucuuuccaggccaccaucacacggccggugacacucacuucgaugacgacgaggcuuggaccuuucguagcagugaugcccaugggauggacuuguucgcaguggccguucacgaauuuggacaugcuaucggccucucccacguggcggcagcccacucuauuaugcgcccuuacuaucagggccccgucggggauccacugagauacggauuacccuaugaggacaaggugaggguauggcaacuguacgguguucgggaaagcguguccccuacagcucagccagaggagccgccccuccuuccugaaccacccgauaaccgaucaagugccccuccacgcaaggacgucccccauagaugcagcacucacuucgaugcaguggcccagaucaggggcgaggccuuuuucuucaaagggaaguacuuuuggcggcugacccgcgacagacauuuggugucucuacagccggcucaaaugcacagguucuggcguggacugccucuccaucuggauuccgucgacgcaguuuaugaacggacaucagaucacaaaauaguguuuuucaagggcgaccgauacuggguauuuaaagacaauaacguggaggaagguuauccaagacccgucagcgauuucagucuuccucccgggggcaucgacgcggcuuuuucuugggcccacaaugauaggaccuacuucuuuaaggaccagcuguauuggcgcuacgaugaccauacgcggcacauggauccaggauauccugcacagucccccuuguggagaggcgugccaagcacucucgacgaugccaugagguggucggacggggcuucuuacuucuuucgcggacaagaguacuggaagguucuggauggugaguuagaaguggccccgggcuauccucaguccacagcacgagacuggcuggucuguggggauucacaggcugacggaaguguggccgcgggcguagacgccgcugaggguccccgggcaccacccgggcagcaugaucaaagccguuccgaagacggcuacgagguuugcucuuguaccagcggagccucaaguccuccaggcgcucccgggccucuaguggccgcaacuaugcuccugcuuuugccgccacugucccccggagcgcucuggacagccgcucaggcccugacccuuuga

SEQ ID NO: 59104 - RNA, 918 nt, Artificial Sequence
  derived and/or modified sequence opt3 from MMP19__Homo_sapiens__NP_001259030
augaacugccagcagcuguggcucggcuuccuucugcccaugaccgugagcgggagagucuugggauuagccgagguugcuccuguggacuaccugucccaguaugguuaccuacagaagccacucgaaggcucuaauaacuuuaaaccggaggauaucacagaagcacugagggccuuccaggaggcgucagaacuucccguaagugggcaacuggacgaugcuacucgggcccgcaugcgacagccucguuguggauuggaggacccauuuaaucagaagacgcucaaauaucugcugcucggcagauggaggaagaaacacuuaaccuuccggauucugaaccuucccagcacauugccuccacauacugcacgcgccgcucugagacaggcauuucaagauugguccaauguggcuccccuaaccuuccaggagguccaggccggugccgcggacauaaggcucucuuuucacgggcggcagucgucauacugcagcaacacauucgauggaccuggcaagaagaguccagugauccgcgacgaagaggaagaggagaccgaacugccgacuguucccccugugccaacagagcccuccccuaugccagaucccuguucuagcgaacuugacgcaaugaugcugggcgaggccccgccuuugcaagcugucgggcgaagauggggacagcccgccgauccagaagcauggaccaaugguuccgacaugggccuccagcaugagcaauggagggcuccuugggaggaucugugcuuucaagggggauuauguguggacugcauucgguuccguacgggcccccugguaccaucaguuuguccccucgguggggccccucgcaaaccaggaugcuguugccuucuggcgaguaacacuauggacagcuugcuauga

SEQ ID NO: 59105 - RNA, 1410 nt, Artificial Sequence
  derived and/or modified sequence opt3 from MMP1__Homo_sapiens__NP_002412
augcacagcuuucccccucugcuccuucuguuguucuggggcguggucucccauucuuucccagccaccuuagagacacaggaacaagacguugaucuggugcagaaguaccuagagaaauauuacaaccucaagaaugacgggagacagguagagaaaaggcggaacucaggaccgguggucgaaaagcugaaacagaugcaagaauuuuucggucuuaaggugacuggcaagcccgaugcugagacgcugaaaguuaugaagcagccucgcugcggggugccagacgucgcacaguuuguguugaccgagggaaauccccgaugggaacagacacaccucacuuaucguaucgagaacuacaccccugaucugccaagagccgacguagaucaugcgauugaaaaggcuuuccaacuguggaguaauguuacaccccucaccuuuacuaaagugagcgagggccaggccgacauaaugaucuccuucgucaggggugaucaccgggacaacucuccuuuugaugggccaggaggcaauuuagcacaugccuuccagccgggccccgggauuggaggugacgcucacuuugaugaggacgaacgcuggacaaacaauuucagagaguauaaccugcacaggguggcagcccaugaacuuggccacucguuggggcugucacauagcaccgacaucggagcucuaauguacccuaguuauacguuuuccggcgaugugcagcucgcccaagacgauauugacgguauccaggcgauauacgggcggucucagaauccaguccaacccaucggaccucagacuccaaaagcaugugauagcaagcugaccuucgacgccauuacaacuauccgcggcgagguuauguucuuuaaggaucgauucuacaugagaaccaaccccuuuuauccggaaguggagcuuaauuucauuuccguauuuuggccucagcugcccaacggcuuggaggcugccuacgaguucgcagacagggaugaagugcgguuuuucaaagggaauaaguauugggcuguccagggacaaaacgugcuccacgguuacccaaaagacaucuauucaaguuuuggcuucccucguacaguuaagcacauagaugccgcgcugagcgaagagaacaccgggaaaacguacuuuuucguggccaauaaguauuggcgcuacgacgaauacaaaagaucuauggaccccggauauccaaagaugauugcacaugauuuucccggcaucggucacaaggucgacgcuguguucaugaaagauggguucuuuuacuucuuucauggcacuaggcaguauaaguucgacccuaaaacaaagcggauuuuaacccugcagaaagccaacuccugguuuaauugccgaaagaacuga

SEQ ID NO: 59106 - RNA, 1452 nt, Artificial Sequence
  derived and/or modified sequence opt3 from MMP20__Homo_sapiens__NP_004762
augaaggugcugcccgccagcggccucgcugucuuccuuaucauggcacugaaauuuuccaccgccgcgccuucuuugguugcugccucaccaagaacauggaggaacaauuaccgguuagcacaggccuaucuggacaaguacuauacuaacaaagaggggcaccaaauuggagaaaugguggcucgcgguaguaauagcaugauacgaaagaucaaagagcuacaggcauucuuuggccuccagguaacggggaagcuggaucagaccacaaugaacgugauuaagaaaccgcguugcggaguccccgacguggccaauuacagacuuuucccuggcgaaccaaaguggaaaaagaacacucugaccuauaggaucuccaaauacacacccucuaugucgucaguugagguggauaaggcugucgaaauggccuugcaagcguggagcagugcagugccucucuccuuuguacggauuaauucuggugaggccgacaucaugauaucauucgagaacggggaucauggagacuccuauccauuugauggcccccgcggcacccuggcucacgccuucgcaccuggggaaggacuggguggcgacacucauuuugauaaugcugagaaguggacaauggggaccaacggauucaaucucuuuacgguugccgcgcacgaguucggccaugccuuaggucuggcacacucaacugacccaagugcucuuauguacccgaccuacaaauauaagaaccccuacggguuucacuugccuaaagaugacgugaagggaauccaggcccuguauggcccaagaaaagucuuccuaggcaagcccacacucccucaugcuccacaccauaaacccagcauuccggaucugugugacucuuccagcagcuucgacgccgugacuaugcuugggaaggaacuguugcucuuuaaggauaggaucuucuggcggcgccaggugcaucugcgaaccggaauuagaccuaguacaaucaccucuuccuuuccccaguuaaugagcaaugucgacgcagccuacgagguugcugaaagggguacggcguauuucuuuaaaggcccacacuacuggauaacucggggguuccaaaugcagggaccuccccguacaauuuaugauuuuggcuucccacgccacgugcagcagaucgacgcagccguauaccugagagagccccaaaagacccucuuuuucgugggugaugaauacuauucguacgacgagaggaaacggaagauggaaaaagauuauccuaagaacacugaggaggaauuuucuggggucaauggccagauugacgcugccguggagcuuaacggauacaucuauuucuuuuccggcccaaagacauacaaauaugauaccgaaaaggaggacguugugucagucgugaaaaguagcuccuggaucgggugcuga

SEQ ID NO: 59107 - RNA, 1710 nt, Artificial Sequence
  derived and/or modified sequence opt3 from MMP21__Homo_sapiens__XP_011537559
augcuggccgcuagcaucuucagacccacccuccuucugugcugguuggcagccccuuggccaacacagccggaguccuuauuucacucuagggaccggucagaucuggaacccaguccucuacgccaagcgaagccaauugcugaccuccaugccgcacagcgauuccugagccguuacggcugguccggggugugggccgcuuggggacccucuccugaggguccacccgaaacuccuaaaggcgcagcccuugcugaggccgucagaagguuucagcgggcgaacgcacugccagccucgggggaauuggaugcugccacgcucgcagcuaugaaucgcccgagauguggaguucccgacaugaggccuccacccccuucagccccacccagcccgccuggucccccaccucgggcgcgcagucgaagaucccccagggccccacugucucugagccggcguggcuggcagccccgcggguauccugauggaggcgcagcucaagccuucuccaagagaacccucucauggagguuacugggcgaggcucuuaguagccaguugucuguggccgaccagcggcgaauaguagcacuggccuuucgcaugugguccgaggugacaccacuagauuucagagaagaccucgcugcgccgggggcagccgucgauaucaaacugggauuugguaggggccggcaccuugggugcccccgcgcuuucgacggaucaggccaggaguuugcccaugcauggagacugggugauauucacuucgacgaugacgaacauuuuacuccuccaaccagcgacacagggaucaguuugcucaagguggccguucacgagauuggacacgugcugggcuuaccccauaccuacaggacuggcucuaucaugcaaccuaacuauauaccacaggagcccgcuuucgaacuggauugguccgaccguaaagccauccagaagcucuacgggagcugugagggaucguuugauacagcauucgacuggauucggaaggaacgaaaucaguauggugaggucauggugagauucucuaccuacuuuuucaggaacuccugguauuggcuuuacgaaaaucgcaacaaucggacgagauacggcgauccgauccaaauucugacuggguggccuggaaucccaacccacaacauagacgcguuuguacauauuuggacauggaaaagggaugagcgcuauuucuuucagggcaaucaguacuggcgauaugacucagauaaggaccaggcuuugacugaggaugaacaagguaaaaguuaccccaagcuaaucagcgagggguucccuggcauucccuccccacuggacaccgccuuuuaugaccggcgucagaaacucaucuacuucuuuaaggaaucucugguuuucgcauuugaugugaacagaaauaggguccuuaacagcuauccuaagcgcaucacagagguguuccccgccgugauuccacagaaucacccguuucggaacauagacucagcuuacuacaguuaugccuacaauuccaucuucuucuuuaaaggaaacgcauauuggaaggucguuaacgauaaagacaagcaacagaauagcuggcugccugcuaacggcuuguuccccaaaaaguuuauuucugaaaaaugguucgaugugugcgacguacacaucucaacccucaauauguga

SEQ ID NO: 59108 - RNA, 1938 nt, Artificial Sequence
  derived and/or modified sequence opt3 from MMP24__Homo_sapiens__NP_006681
augcccagaagcaggggcgggcgggccgcuccuggaccaccgcccccuccacccccuccaggucaggcaccccgcuggucccgauggcgugugccuggcagacugcuccuucuguuguuaccagcccugugcugucuaccgggggcggcuagggccgcagccgcugcagccggagcuggcaaccgggccgcggucgcaguugccguggcucgcgccgacgaggcagaagcucccuucgccggucaaaauuggcucaagucuuacggguaucugcuuccuuacgauucaagagcgagugcccugcacagcgcaaaagccuugcaguccgcuguaucuaccaugcagcaguuuuauggaaucccagugacaggcguccucgaccaaacuacgauugaguggaugaagaaacccaggugcggcgugccugaucauccacaccugucgcggcgccgaagaaacaagagguacgcucugaccgggcagaaauggcggcagaagcauauaacauauucaauccacaauuacacucccaagguuggagaacucgacacccguaaagccauucgccaggcauucgauguguggcaaaaggucacaccguuaaccuuugaggaagugccuuaucaugagaucaaaagcgacagaaaggaggccgauauuaugaucuucuuugcuagugguuuccacggcgacuccucucccuuugauggggaaggaggcuuccuggcgcacgcauacuuuccagguccugggauaggaggcgacacucauuucgauagcgacgagcccuggacacuuggcaacgccaaucacgaugggaacgacuuguuucugguagcuguucaugaacuaggacacgcccucggucuggagcacuccucagacccaagugcaaucauggcccccuucuaccaguauauggagacccauaauuuuaaacuuccucaggaugaccugcagggcauucaaaagaucuacgggccaccggcugaacccuuggagccuacgaggccacuccccacucugccugugcggcgcauucacagcccaucugaacgaaagcaugagagacagcccaggccgccucggccacccuuaggagaucgcccuuccacccccggcacaaaaccaaacaucugugacgguaauuucaacacugucgcccuguucagaggggaaauguuuguguucaaggauaggugguuuuggcgucuccggaauaaccgagugcaggagggcuauccuaugcaaauagagcaguucuggaaaggacuucccgcaagaauugacgcggcuuacgaaagggccgauggccgcuuugucuucuuuaagggggacaaauauuggguuuucaaggaggugaccguagaaccaggauacccgcacucacugggugaguugggcagcugccuaccucgggaagggaucgauacagcacugagaugggagcccgugggaaaaaccuacuuuuucaagggcgagagguauuggcgcuacagugaggaacgacgggccacggacccagguuaucccaagccuauuacugucuggaaagggaucccacaggcuccccagggcgccuuuaucucuaaggaaggauacuauacauacuucuauaaaggccgugauuacuggaaguuugacaaucaaaaacucuccguggagccuggguauccgagaaacauucugagggacuggaugggauguaaucagaaggaaguugagcgccggaaggagagaaggcuuccacaggaugacguggauauaauggucaccaucaacgacgugcccgguagcguaaacgcaguugcuguggucauuccuugcauccugucguuguguauacucgugcuggucuacacuauuuuccaguucaaaaauaagacaggcccacaacccgugaccuacuauaaacgaccuguucaggaauggguguga

SEQ ID NO: 59109 - RNA, 1689 nt, Artificial Sequence
  derived and/or modified sequence opt3 from MMP25__Homo_sapiens__NP_071913
augagacugaggcuccggcuucuggccuuguuacugcuacuccuggcucccccugcacgcgccccaaagccgagcgcgcaggacgugucccuuggcgucgauuggcugacccgauacggguauuugcccccuccacaccccgcucaagcccagcuccagucuccugagaaacugcgugacgcaaucaagguuaugcagagauucgccggacugccagaaacagguaggauggaucccggcacuguggcuacgaugcggaaaccucgcugcucacucccagacguauuagggguggcaggacuggucagaaggcggcgccgauacgcccuuaguggcagcguguggaagaaaagaaccuugacauggaggguucgguccuuuccgcaaucuucgcagcugucacaggagacugugcguguccuaaugagcuaugcucucauggccugggguauggaaagugggcugaccuuccaugagguggauucuccccagggacaagaaccugacauucuuauagauuuugcgcgcgcauuccaccaggacuccuacccauuugauggccugggcgggacauuggcccaugcuuucuuucccggagagcacccuaucagcggugacacccauuucgaugacgaggaaacuuggacauuuggcuccaaggauggggagggaaccgaccucuucgccguagcaguucacgaauuuggccacgcucuggguuuagggcauucaagugccccaaacagcauuaugagacccuucuaucagggaccggugggcgacccugauaaguacaggcugucucaggacgaucgggacggccuccaacagcuuuaugggaaagcgccccagacgccauacgauaagccuacucgaaaaccccuggccccacccccucaaccaccggcaucccccacccacucaccuagcuuuccaauccccgaccgcugugagggaaauuucgaugcuauugccaacaucagaggugagacauucuuuuucaagggcccuugguuuuggagguugcagccaagugggcagcuagucucuccccggccggcucgccugcauagauucugggaaggacucccugcccaggugagggugguccaagcagccuacgcucgucaccgggacggccgaauacugcuguuuuccgguccacaguucuggguuuuucaggauagacagcuugaagggggcgcgaggcccuugacugagcucggacugccucccggcgaggaaguggacgcaguauucagcuggccacaaaaugggaaaaccuauuuagugcgcggacggcaguacuggagauaugaugaggccgcugccaggccugaccccgguuacccacgcgaccugucgcuaugggagggcgcaccgccuucucccgaugacgucacaguguccaacgccggggauaccuacuuuuucaagggagcucacuauuggcgauuuccaaagaacucaaucaaaacggaacccgacgccccucagccaaugggccccaauuggcucgauugcccugcaccgaguagcgguccacgggcgccccguccuccaaaggcuacucccguuuccgagacaugugacugccagugugaacugaaucaagccgcagggagauggccugccccgauuccccuuuugcugcucccacugcuugugggcggagucgcuucuagguga

SEQ ID NO: 59110 - RNA, 786 nt, Artificial Sequence
  derived and/or modified sequence opt3 from MMP26__Homo_sapiens__NP_068573
augcagcuggugauccucagagucaccauuuuccuucccuggugcuuugccguuccugugccaccggcugcagaccacaagggcugggauuucguagagggguacuuucaucaauucuuucugaccaaaaaggaaagccccuuguuaacucaggagacgcagacccagcugcuacaacaguuccacaggaacggaacagaccuccuggauaugcagaugcaugcccuucugcaccagccucauuguggugugccagacggcuccgauacuucuauaucacccgggcggugcaaauggaauaagcacaccuugacauaucgcaucauuaacuacccucacgacaugaaaccaagugcggucaaggauagcaucuauaaugcuguguccauuuggucuaacguuacaccccucaucuuucaacaggugcagaauggagacgccgauauaaaggucucguucuggcagugggcacaugaagacggcuggccuuuugaugguccagggggaauccugggccacgccuuccugccgaacucaggcaaucccggggugguacauuuugacaaaaacgagcacuggagcgcuagugauacuggauacaaucucuucuuaguugcaacacacgaaauuggucauucccugggccuucaacacucugggaaccagagcuccaucauguauccuaccuacugguaucaugacccacgaacguuucaguugucagccgacgauauucaacguauccagcaccuguacggagagaaguguaguagcgacauacccuga

SEQ ID NO: 59111 - RNA, 393 nt, Artificial Sequence
  derived and/or modified sequence opt3 from MMP28__Homo_sapiens__NP_001027449
augguggccagagucggccugcuccuuagggcucugcaguuguuacugugggggcaccuagacgcacaacccgccgagcggggaggucaggaacuccgcaaggaggcggaggcuuuccuggaaaaauacggcuaucuuaacgaacagguuccuaaggccccaaccagcacacgauuuuccgaugcaauccgugccuuccagugggugucucaacugccgguaucagggguguuggacagagcuacucucaggcagaugacgcggccccgcugcggagucaccgauacaaauaguuacgcagccugggcugagagaauuagcgaccuguuugccaggcaucggacuaaaaugcgccgaaagaaaagauucgcgaagcagggcgagcacuguuga

SEQ ID NO: 59112 - RNA, 1833 nt, Artificial Sequence
  derived and/or modified sequence opt3 from MMP2__Homo_sapiens__NP_001121363
augcaguaccugaacaccuucuauggcugccccaaggagagcuguaaucucuuugugcuuaaagacacacugaagaaaaugcaaaaguucuuuggguugccucagacuggagauuuagaccagaacacgaucgaaaccaugagaaaaccaaggugcgguaauccggaugucgccaacuacaauuucuuuccccggaagccuaagugggacaaaaaccagauuacauaucgcauaaucggcuacacuccagaucuggaccccgagaccguugaugacgcuuucgcacgagccuuucaagugugguccgauguaacaccucuacguuucucucggauucacgacggggaagcggauaucaugauuaauuuuggaaggugggagcauggcgacgguuauccauucgaugggaaggacggacuccuggcucacgccuuugcacccggcaccggcgucgggggagacucacauuucgaugacgaugaacuuuggacucugggugagggccagguggugcggguuaaauacgggaacgccgacggagaguauuguaaguuuccuuucuuguucaauggcaaagaauacaacaguugcacagauaccggucgcagcgacggguuucucugguguuccacgacuuacaauuucgagaaggauggaaaguauggcuuuugcccacacgaagcucuguucaccaugggcgggaacgcagagggacagccguguaaauuucccuucagauuucaggguacaucuuacgacucgugcacuaccgagggcaggacagauggguaucggugguguggaaccacggaagacuacgaucgcgacaagaaauauggcuucugcccugagacugccaugucaacagugggugggaauagcgaaggcgcuccaugugucuuucccuucaccuuucugggaaacaaguacgagaguugcacuuccgccggccgaucugacgggaaaauguggugcgcgacaaccgcaaauuaugaugacgauagaaaguggggauucuguccugaccaagguuacagccucuuuuuaguggccgcucaugaguucggccacgccauggggcuggaacacucccaggauccaggagcacuuauggcucccaucuacacguauaccaaaaacuucagguugucacaggacgauauaaagggcauccaggagcuguacggugccaguccggacauugaucuagggacaggcccuacucccacccucggaccaguaacaccugaaaucugcaagcaagacauuguuuuugauggcaucgcgcagauaagaggggagauuuucuuuuucaaagaccguuuuaucuggcgcacugugacccccagagauaagccaaugggaccccugcuugucgccacauucuggccugaacugccagagaaaauugacgcaguguaugaagcuccgcaggaggagaaggccguguuuuucgcugguaacgaauacuggaucuauagcgccucuaccuuggagaggggcuaccccaaaccucucacuucccugggguuaccacccgacguccaacggguugaugcagccuuuaauuggucaaagaacaagaaaacguauaucuucgcuggagacaaguuuuggcgauacaaugaagugaaaaagaaaauggauccuggcuucccaaagcugauugcggacgcauggaacgccauacccgauaaucucgacgcuguaguggaucuucagggugggggccauagcuacuuuuucaagggagccuauuaccugaaauuggagaaccagagucuaaagucugucaaauucggcuccaucaagagcgacuggcugggguguuga

SEQ ID NO: 59113 - RNA, 1434 nt, Artificial Sequence
  derived and/or modified sequence opt3 from MMP3__Homo_sapiens__NP_002413
augaaaagccugcccauccuccuucuguugugcguggccgucuguuccgcuuacccuuuagacggcgcagccagaggggaggauaccucuaugaaccugguucagaaauaucuagaaaauuacuaugaccucaagaaagaugugaagcaauucguaaggcggaaagacucaggaccaguggucaagaagauucgcgagaugcagaaauuucugggucuugaagugacaggcaagcuggauagugacacuuuggagguuaugcgaaaaccgcguugcggggugcccgaugucggacacuucagaacguuuccuggcauaccaaaguggaggaaaacccaucucacauaccggaucgugaacuauacucccgaccugccuaaggaugcgguagacagcgcuguugaaaaggcccugaaagugugggaggaggucaccccacucacauucucccgcuuauacgaaggugaggcagauauuaugaucucuuuugccgugagagaacacggggacuucuaucccuuugauggaccuggcaaugugcuggcucaugcauacgccccaggcccggggauuaacggagacgcucacuucgacgaugacgagcaguggaccaaggauacuacagguaccaauuuauuuuuggucgccgcgcaugagaucggccacucgcuggggcuauuccacucagcaaacacggaagcccucauguacccccuguaucauagccuuacugaccugaccagguuucgguugagucaggaugacauaaauggaauccaaucccucuacggcccuccacccgauucuccugagacaccacugguucccacugaaccggugccucccgagccagguaccccugcuaacugugaccccgcccuuagcuucgaugcaguauccacacugcgcggggaaauucucaucuuuaaagaccgacacuucuggagaaagucacuuaggaaacuggagccagaguugcaucuaauuaguagcuucuggcccucucugccuuccggaguggaugcugccuaugaagucaccucaaaggaccucguguuuaucuucaaaggcaaucaguuuugggcgauacggggcaacgagguucgugccggguacccacgcgguauucacacgcugggauucccgcccacugugagaaagaucgacgcagcuauuagcgauaaggaaaagaauaagacauacuuuuucgucgaggacaaauauuggagguuugaugaaaagcggaacaguauggagccuggcuucccaaaacagaucgccgaggacuuucccgggaucgauucuaagauugacgcuguguucgaagaguuuggauucuuuuauuucuucaccggcuccagccagcuugaauuugauccuaaugccaagaaaguaacucacacacugaagucgaacucuugguugaauugcuga

SEQ ID NO: 59114 - RNA, 804 nt, Artificial Sequence
  derived and/or modified sequence opt3 from MMP7__Homo_sapiens__NP_002414
augagacugaccgugcucugcgccgucugucuucugcccggcagcuuggcuuuaccucugccacaggaggcagggggaauguccgaacuacaaugggagcaggcccaggacuaccucaagagguucuaucuguacgauucugaaacaaagaacgcuaauucacuugaggcgaagcugaaagaaaugcagaaguuuuucgguuugccgaucacuggcaugcucaacagucggguuauugagauaaugcaaaaaccccgcugcggggugccugacguagccgaguauagccuguuuccaaauucccccaaguggacgucuaagguggucaccuaccgaaucgugucguauacacgugaucugccucacauuacuguugacagacucgugucaaaagcauuaaacauguggggaaaggaaaucccacugcauuucaggaaagucguguggggcaccgccgauauuaugaucgguuuugcucgcggggcacacggagacagcuaccccuucgauggcccuggcaauacacuugcccaugcuuuugccccagggaccggauuggguggcgacgcgcacuucgaugaggacgaacgguggacugaugggaguucccugggaauaaacuuucuauaugcagccacacaugagcucggccacucucuggguauggggcacagcuccgacccgaaugcuguaauguaccccaccuacggaaacggcgauccucagaauuucaaacuuucacaggacgacaucaaaggcauucagaagcuguaugggaagagaaguaacagcaggaaaaaguga

SEQ ID NO: 59115 - RNA, 1404 nt, Artificial Sequence
  derived and/or modified sequence opt3 from MMP8__Homo_sapiens__NP_002415
auguucagccugaagacccuccccuuucuucuguuguuacacgugcagaucuccaaagccuucccugucucuucaaaggagaaaaacacaaagacuguucaagacuaccuggaaaaauuuuaucagcuaccaaguaaucaguaccagagcacgagaaagaacggcaccaaugugauuguagagaagcucaaagaaaugcaaagguucuuugggcugaacgugacaggaaagccgaaugaggaaacucuugauaugaugaaaaagccccggugcggugucccugacuccggcggguucaugcugaccccaggaaaccccaaaugggagcgcacaaauuugaccuaucgaauacguaacuacacuccucagcucucugaggcugaaguggagagagcaaucaaggaugccuuugaacuguggucgguugcgucaccacugauuuucacaaggaucagccagggcgaggcugacauuaauaucgccuuuuaucagcgggaucauggugacaacagucccuucgaugggccuaauggaauacucgcacacgccuuucaaccaggccagggcaucgggggagacgcucauuucgaugcagaggaaaccuggacgaacacuuccgccaauuacaacuuauuucugguggcugcccacgaguucggucauucucuuggcuuggcgcacagcuccgacccgggggcacugauguaucccaauuacgccuuccgcgaaaccucaaacuacagucuaccucaggaugacauugauggaauccaggcuauuuauggccucagcucuaacccaauccaacccacagguccuuccacuccaaagcccugugacccgucacugaccuuugacgccauaacaacccuuagaggggagauucuguucuuuaaagauagguacuucuggcggcgccacccucaguugcagcgagucgaaaugaauuuuaucagccucuucuggcccagucugccaacgggcauucaagcagcuuaugaggacuuugauagagacuuaaucuuccuguuuaagggaaaccaguacugggcccucucuggcuaugauauccuucagggguacccuaaagacauuuccaauuauggauuccccagcucggugcaggcgauagaugccgcaguauuuuacaggucuaagacuuacuucuuuguuaacgaccaauucuggcgguaugauaaucagcgucaguucauggagccagguuaccccaaauccaucucaggcgcuuuuccugggauugaaaguaagguggacgccgucuuccagcaagagcacuuuuuccauguguuuagcggaccacgcuauuacgcuuucgaucugaucgcccagagagugacaagggucgcacggggcaacaaaugguugaauugccgauaugguuga

SEQ ID NO: 59116 - RNA, 2124 nt, Artificial Sequence
  derived and/or modified sequence opt3 from MMP9__Homo_sapiens__NP_004985
augagccuguggcagccccucgugcuuguccuguugguuuuaggcugcuguuucgccgcuccuagacaaaggcaguccacccuggugcuauuuccaggggaccuccggacaaaccugacugaucgccagcuugcagaggaauaccuguaucgauacggauauacgcguguagccgagaugagaggugaaucuaaaucauugggcccggcgcuccugcugcuccagaaacaauuaagucugcccgagaccggggaacuugacagcgcuacauugaaggccaugaggacuccucggugcggagugccagaucugggccgcuuccagaccuuugagggugaccuaaaauggcaccaucacaauaucacauacuggauucagaacuauuccgaggaucuccccagagcagucauagacgaugccuucgcuagggcauuugcccuguggucugcugugaccccucuuacuuucacacggguuuacucgcgcgacgccgauaucgugauucaguuuggggucgcggaacauggagacggcuauccauucgauggcaaggacgggcuguuggcacacgccuuucccccuggaccagguauccaaggcgaugcucauuucgacgacgaugagcucuggucacuggggaaaggagugguaguuccgacccgauuuggcaaugccgacggugcagcuugucacuuccccuuuauuuucgaagggagaagcuacagugccugcacgacugauggaagguccgacggcuuaccuugguguucuaccacagcgaacuacgauacugacgaucgguucggcuuuugcccaagcgagcgucuguauacccaggacgggaaugccgauggaaagcccugucaguucccuuuuaucuuccagggucaauccuacucagcaugcacaaccgacggccgcagugauggguauagauggugugcuacgacugccaacuacgacagggacaagcucuuuggauucugcccaacacgggcugauagcaccgugaugggcgguaauucugccggggagcuuugugucuuucccuucacuuuucugggcaaagaauauuccacaugcaccucagagggacgaggcgacgggcgcuuguggugcgcaacgaccagcaacuucgauagugacaagaaauggggauuuuguccggaucaggguuacucucuauuccugguggccgcucacgaauuuggccaugcgcucgggcuggaccacuccagcgugccugaggcacuuauguaucccauguacagauucacagaaggaccaccucugcauaaggaugacgucaauggcauaaggcacuuguacgguccccggccagagcccgagccucgcccaccgacuaccacaacuccccagccuaccgccccacccacaguuugcccuaccgggccacccacugugcacccgucggaaagaccuacggcuggcccaacaggacccccuucugccggccccaccgggccaccuacugcaggacccuccaccgccacaaccguaccacucucaccgguggaugacgcuuguaacgucaauaucuucgaugccauugcagagaucgguaaccaacuguauuuauuuaaagacggcaaguacuggagguucagugaagggcguggaagccggccucagggccccuuucugauugcggauaaguggccagcucuaccccgaaaacucgacuccguguucgaggaaagacugucuaagaaauuguuuuucuuuagcgguaggcagguuuggguguauacuggggccucaguccuuggcccucgccggcuggacaagcucggacugggcgcagauguggcccagguaacaggggcucuuagaaguggaaggggcaaaaugcuguuguucuccggucgccgacucuggcgguuugacguuaaggcccaaaugguggauccacguagcgcaucugaggucgacagaauguuccccggggugccucuggauacgcaugacgucuuucaguacagggagaaggcuuauuucugccaggaucgcuuuuacuggcgggugucaaguagaagcgaauuaaaucagguugaccaagugggauauguaaccuacgauauccugcaguguccggaggacuga

SEQ ID NO: 59117 - RNA, 3687 nt, Artificial Sequence
  derived and/or modified sequence opt3 from MMRN1__Homo_sapiens__NP_031377
augaagggcgccagacuguucgugcuccuuagcucccuguggucugggggaaucgguuugaacaauucaaaacacaguuggaccauucccgaggacggcaacagccagaagacaaugccuuccgcuucugucccaccgaauaaaauacaaucguuacagauccugcccacuacgaggguuaugucagcagaaauugccaccacaccugaggcgcggacuagcgaagauagucuacucaaguccacccugccacccucugagacaagcgcuccugccgaaggggugcgcaaccagacccuuacuuccacagagaaagcagagggaguagugaagcugcagaauuugacccucccaacgaacgccucaaucaaguuuaaucccggcgcugaaagugucgugcugagcaacucuacucugaaauuccuccaauccuuugcacgaaagucaaaugagcaggccaccagcuuaaacacaguuggugggacuggaggcauuggcggggugggagguaccggcggggucggaaaucgugcuccuagagaaacauaccugaguaggggcgacucuuccagcucgcagcggaccgauuaucagaaaucuaacuucgagacgacucgcgguaagaauuggugcgccuacgugcauacaagacuuuccccaaccguaaucuuggacaaccaaguuacuuaugugcccgggggaaaaggcccguguggcuggacagggggaucaugcccucagaggagucagaagauaagcaauccagucuaccggaugcagcacaagaucgugaccucccuggauuggcgcuguugccccgguuauucuggcccuaaaugucaacuacgagcgcaggagcagcaaagccucauucauacgaaccaggcagaaucacacaccgccguggggagaggagucgcugagcagcagcaacagcagggcugcggugacccagaaguuaugcagaagaugacagaucaagugaacuaccaggccaugaaacugacucuucugcagaagaaaaucgacaauauuaguuugaccguaaacgaugugaggaauacauauuccagccucgaggggaaggucucugaagacaaaucacgggaguuucagagucuguuaaagggccucaagagcaaauccaucaacgugcucauacgugauauuguucgcgagcaauucaagaucuuucagaaugacaugcaggaaacuguggcacagcuuuucaaaaccgucucuucgcugagcgaggauuuggaauccacaagacaaauuauccagaaggugaacgagucaguaguuaguaucgcugcccagcaaaaauuugugcuaguccaggaaaauaggcccacccugacugacauuguggagcuccggaaccauauagucaaugugcgacaggagaugacgcugacaugugaaaagccgaucaaggagcuugaaguuaaacagacccaccuggagggagcguuggaacaagagcacucucgcagcauucucuacuacgagucccugaacaagacuuuaucaaaacugaaggaagugcaugagcagcuacucagcaccgaacagguaucugaccagaaaaaugccccugcagcugaguccgucaguaacaaugugacagaguauaugagcacccugcacgaaaacaucaagaagcaaucucuuaugauguugcagauguucgaggaucugcauauacaggaauccaaaauuaauaaccucacuguuucacuggagauggaaaaggagagucuuagaggcgagugcgaagacaugcugagcaaauguaggaacgauuuuaaguuccaguugaaagacacagaggaaaaucuccacgugcugaaccaaacguuagccgagguccuguuucccauggauaauaagauggacaagaugucggaacagcuaaacgaucucaccuacgacauggagauccugcagccacuuuuggagcaaggggcuucccugcggcagacuaugacauaugaacagccuaaagaggccaucgugauucgcaagaaaaucgaaaaucucaccucugcaguaaacagccugaauuucauuauaaaggaguuaacaaaaagacacaaccugcuuaggaaugaagugcagggacgugaugacgccuuggagcggcgaaucaacgaguacgcucucgaaauggaggauggucugaauaagacuaugaccauuaucaacaaugcgaucgacuucauucaagacaacuaugcacuaaaagaaacgcugucaaccauaaaggauaauagugagauccaucacaagugcacauccgacauggagacuauucucaccuuuaucccccaguuccauagacugaacgauucuauucagacacuuguuaacgacaaucagagguacaacuuugucuugcaaguggccaaaacucuggcuggcaucccacgcgaugaaaaguuaaaucagagcaacuuccagaaaauguaucagauguuuaaugagaccacgucccaagugcggaaguaccagcagaacaugucacaccucgaagagaaacugcuucugacaaccaagauaagcaagaauuucgaaacuagauugcaggacaucgagaguaaagucacacaaacccucauucccuacuauaucucuguuaagaaaggguccguggugacuaacgagagggaucaggcccugcagcuacaaguacugaauagccgcuuuaaggcacucgaagccaaaucgauucaucugucaaucaacuucuuuucucuuaauaagaccuugcacgagguccugacaaugugucacaacgcuaguacguccgugagcgaauuaaaugccaccauaccuaaguggauuaaacauucucucccagacauccagcugcuucagaagggacugacugaguucguugaaccgauuauccagauaaaaacacaagcagcgcuaagcaaccugaccugcugcaucgaucgaucccugcccggcucauuggcuaauguggucaagagucagaaacagguuaagagccugccuaagaaaauuaacgccuuaaagaaaccaacagugaaccucacuaccgugcugaucggucggacgcagcguaauacagacaacauuaucuaccccgaggaguauucuuccuguucaagacacccuugccaaaaugggggcaccuguauaaacggaaggacuagcuuuaccugcgcaugucgccauccauucacaggcgauaauugcacuauuaaacuuguagaagagaacgcccuggcucccgacuuuagcaagggguccuaccgguaugccccgauggucgcauucuucgcuucucacaccuacggaaugacaaucccugguccaaucuuguuuaauaaccucgaugugaauuauggcgccucguacacgcccagaaccgggaaguucaggauuccuuaccugggaguguaugucuuuaaauacacuaucgaaaguuucucagcgcacauuuccggcuuucuaguuguggacgguauagacaagcuggccuucgagagugaaaacaucaauucugagauucauugugaucgaguacuuacaggggacgcucuccuggaguugaacuauggccaggaaguguggcugcgcuuagcaaagggaaccauccccgccaaauuuccaccugucacuacauucagcggcuaccuccuguaucggaccuga

SEQ ID NO: 59118 - RNA, 2850 nt, Artificial Sequence
  derived and/or modified sequence opt3 from MMRN2__Homo_sapiens__NP_079032
augauccugagccuccuuuucucccugggcgggcccuugggaugggguuuacugggcgccugggcucaggcaucuucaaccagucuaagcgaccuccaauccucuagaacaccugggguguggaaggccgaggcggaagauacuggaaaagacccagucggcaggaacuggugcccguaccccaugucgaagcugguuacgcuucuggcuuuguguaaaaccgagaaguuucucauucacucacagcagccuugcccacagggugcccccgauugucaaaaagugaagguaauguaucggauggcacauaagccuguguaccaggucaaacagaaggugcugacaagccuggccuggcgcugcuguccaggguauacuggacccaauugcgaacaccaugacaguauggcuauaccugagccagcagauccgggcgacucccaccaggaaccccaagauggcccuguuucuuucaaaccagggcaucucgccgcugugaucaacgaggucgaggugcagcaggaacagcaagagcacuuacugggagaccuucagaaugauguacaccgaguugccgacagcuugcccggucuguggaaggcgcuaccuggcaaccucaccgcagccgugauggaagcuaaucagacagggcaugaguuuccagaucguucccuggagcaaguccuucugccccacguggacaccuucuugcagguacauuuuucaccgauuuggagaaguuucaaccagagccuccacucucugacucaggccaucaggaauuuaucccuggaugucgaagcaaaccggcaagcuauuucacgcguucaggacagcgccguggcgagagccgacuuucaggagcucggagcaaaauucgaagcuaagguacaggagaauacacaaagggugggccagcuucggcaggaugucgaagaccgccugcacgcccagcauuuuaccuugcaccgaaguaucucugagcuacaagcugauguggacacgaagcugaaaagacuccauaaggcccaggaggcaccugguacuaacgggucccugguucuugccacccccggagcuggcgcgaggccagaaccugauagccugcaggcacgguugggccagcuccaacguaaucugucggaguuacacaugacaacugcccgcagagaagaggaacugcaguacacccuagaggacaugagggcuacacucacccggcauguggaugagauaaaagaacuguauucugaguccgacgaaacguucgaucagaucucaaaggucgagcgacaaguggaagaacuucagguaaaccacacugccuugcgcgagcugagaguuauucucauggagaaaagucugaucauggaggaaaauaaggaggagguggaaaggcagcuucuggaguugaaccucacacugcagcacuuacaagggggacaugcagaccugauuaaauacgucaaggauuguaauugccagaagcuauaucucgaccuggacgugauccgggaaggucagcgcgaugccaccagagcucuugaggaaacucaggucagcuuggacgagaggcgucaacuggauggcuccucucuccaggcccugcagaacgcaguggacgcgguuagcuuagcuguggaugcccacaaagcagagggggaacgggcccgagcugccacaucaagacugaggagucagguacaagcacuugacgaugaggucggagcuuugaaggccgcggccgcugaagcacgccaugaggugcggcagcuccacuccgccuuugcugcccugcuagaagacgcacugagacacgaggcgguucucgccgcucuguucggcgaggaagugcuugaggaaaugagcgagcagacccccgguccauugccccugucuuacgaacaaauaagggucgccuuacaggaugcagcuucagggcuccaggagcaggcccugggcugggacgagcuugcagcccgcgugacggcucuggaacaagcgagugagccuccacgaccggccgaacauuuggagcccagccacgaugcaggacgggaggaagcugccaccacagcccucgcuggccuggcacgugagcuacagucccugucuaacgacgugaaaaauguggggagauguugcgaagccgaggcgggagcuggugccgcaucgcucaacgccagccugcauggccuucacaaugcuuuguuugcaacucagaggucccuggaacagcaucaacgcuuauuccacucacucuucgggaacuuucagggacugauggaggccaauguuagucuugaucugggcaagcuacagaccaugcucucucggaaagguaagaagcagcaaaaagaccuggaggcgccuagaaagagggacaaaaaggaagcugagccauuggucgauauucgagugacagggcccgugccuggcgcccugggagcagccuuaugggaagcuggcagcccagucgccuucuacgcauccuuuucagaggggacugcugcccuccagaccguuaaauucaacacaaccuauaucaauauuggaagcucuuacuuucccgaacacgguuauuuccgcgcgccggagcggggcguguaccuguuugccguguccguagaguucgggccuggaccaggcacuggucagcuugucuuugggggccaucacagaacgcccguguguacaaccggacagggcagugggagcacugcaaccguuuucgcuauggccgaacugcaaaagggagagagggugugguuugaauugacacagggcucuaucaccaagcguucccucucagguacugcuuucgggggauuucugauguucaaaacauga

SEQ ID NO: 59119 - RNA, 2964 nt, Artificial Sequence
  derived and/or modified sequence opt3 from MMS19__Homo_sapiens__NP_001276332
auggccgcugcagccgcgguggaggcugccgcacccaugggcgcccugugggggcucguccacgacuucguugugggacagcaagaagguccugcugaucagguagcagccgacgugaagucaggcaacuacaccguccuucaggugguugaggcucugggguccucuuuggaaaauccagagccgagaacaagggcccgggcgauccaguuacugucacaagugcuacuccauugccacacucugcuucuggaaaaagaggucgugcauuugauucucuuuuaugagaaccgccugaaggaucaccaucugguaauacccaguguucuccagggauuaaaagcacugagccuuuguguggccuugccuccaggccuggcugucuccgugcuaaaggccaucuuccaggaagugcacguccagucucucccccaaguugaccgacacacgguguacaauauuaucaccaacuuuaugcguacaagagaggaagguccuuucguagaggagcuguuugaagugacuucgugcuauuucccaauugauuuuaccccucccccaaaugacccgcaugggauccagagggaggaucuuauacugucauugcgggcaguccucgcuagcacaccccgcuucgccgaauuucuguuaccucugcucaucgagaaaguggacagugaaguucuuuccgcgaagcuggauucuuugcagacccuaaacgccuguugcgcaguguacggacagaaggagcugaaagacuuccucccaagccugugggcuuccauuagaagggaggucuuucaaacugccucagaacggguggaggcugaaggccuugccgcacugcacaguuugacagccugucucagccgcucuguacugcgagcugaugcggaggacuuacuggauuccuuccuaucaaauauccuccaggacugcagacaucaccugugugaacccgacaugaaacuuguuuggccuagcgcaaaguugcugcaggccgcugccggcgcaagugccagggcuugcgauucugugaccuccaacguccucccacugcuucuggagcaauuucacaagcauagccagucgucucagcggcguacgauuuuggagaugcuccugggguucuuaaaacugcagcaaaagugguccuaugaagacaaggaucagcgcccccuaaauggauucaaagaccagcucuguucacugguguuuauggcccuuacugauccgaguacccaguugcaacuggucgguaucagaacacucacugugcugggcgcacagccugacuuacugagcuacgaggaucuugaauuggcgguugggcaccucuauaggcuguccuuccuaaaggaggacucucagagcugccggguggcugcccuggaagcaucaggaacccucgccgcucuguaccccguagccuuuaguucccaucuugucccaaaauuggcagaggagcugcgagugggcgaaagcaacuuaacaaauggugaugagccuacccaguguucucgccaccucugcugccugcaagcucuuucagccguuaguacgcaucccagcauagugaaggaaacucugccauugcuccugcagcaccuauggcaggucaacagagggaauaugguggcgcaguccucugacguaauugccgugugucaaucgcugaggcagauggcugagaaaugccagcaagaucccgagagcuguugguacuuccaccagacagcaaucccuugccuccuggcccuugcuguucaggccuccaugccagaaaaggagccgucagucuugcggaaagugcuguuagaagacgaggugcucgcagcgauggucaguguuauuggaaccgccacuacacaucugucucccgaacuugcugcccagagcgugacccacaucgugccucuguuucuagacggcaacguauccuuccucccagagaauagcuuucccagccgcuuccaaccuuuucaggaugggucuuccggccagagaaggcugaucgcauugcugauggcuuucgucuguaguuuaccacguaacguggagauuccccagcucaaccaacugaugcgggaacuucuggaguugagcugcugucauucuugcccguuuuccucaacggccgcagccaaguguuucgcuggacuccugaauaagcacccugcgggucagcagcuagacgaauuucugcagcuugccguugauaaaguggaggcaggccucgggaguggaccaugccgaagccaggcuuucacccuguugcugugggucacaaaggccuuagugcucagauaucacccccugucguccugucuuacugccaggcugaugggcuugcucucugacccugaacugggucccgcugcagccgauggguucagccuacugaugucagacugcaccgauguucuuacacgcgcgggccaugcugaggugcggauaauguuuagacaaagguucuuuacugacaacguaccagcccucguccagggauuccacgcagccccucaagaugugaaacccaauuaccugaagggcuugagucauguguuaaaccgccugccaaaaccgguccuccugccugagcuucccacccuguugucccuacugcucgaagcucugucuugcccagacuguguugugcagcuuagcacauuauccugccugcagccccucuugcuggaggcaccucagguaaugucacuccacguggauacccuggucacuaaguuucuuaaucugagcaguucuccauccauggccgugcgaaucgcggcuuugcaauguaugcaugcccuaacgcggcugcccacaccuguucucuuaccguauaagccacaggugauucgugcacuggccaaaccccuugacgauaagaaaagacuggucaggaaggaagcugugagcgcccgcggggagugguuccucuugggaucgccugguucauga

SEQ ID NO: 59120 - RNA, 3732 nt, Artificial Sequence
  derived and/or modified sequence opt3 from MMS22L__Homo_sapiens__NP_940870
auggagaacugcagcgccgcuuccaccuuccugacagacucucucgaacuugagcugggcacugaaugguguaagcccccuuacuuuucaugcgcaguggauaauagagggggagguaaacacuucaguggcgagagcuauuuguguuccggggccuuaaagaggcugauccuaaaccucgacccacugccgacgaauuuugaagaggauacccuugagauuuucggaauacagugggucacagaaacugcgcugguuaacucuucgcgggaguuguuucaucucuuccgccaacagcuguacaaucuggaaacccucuuacagucaagcugcgacuuuggcaaagugaguacacugcacuguaaggcugauaacauccgacagcaaugcguacuuuucuugcauuaugugaaagucuuuauuuuccguuaccugaaggugcagaaugccgagucccacguucccgugcauccuuaugaggcacuagaagcccagcucccaucuguccugaucgacgagcuucacggucuguugcucuacauugggcaccugagcgaauuacccuccgugaacaucggagcuuuuguaaaucagaaccaaauaaagcuguucccuccaucauggcaucuccuucaucugcacuuggauauccacuggcuaguucuggagauucucuauaugcugggcgaaaaacuuaaacagguggucuacggccaccaguuuaugaaucuggcaagugacaacuugaccaauaucagccucuucgaggagcauugugaaacucuguuaugcgaucugauuucucuaucccucaacagauacgacaaggugaggucaagcgagagucugaugucugaucagugucccugccuuuguaucaaggaauugugggugcugcucauacaucugcuugaccaccgguccaaaugguucgucagcgagucguuuuggaauuggcugaacaaguugcucaagacacuguuagaaaaaucuuccgaucgcagaaggucaaguaugccuguuauucaaagccgggacccacugggguucuccugguggaucauuacccacguggccucuuuuuauaaguucgaccgccauggaguaccggaugagaugcgaaaaguggagagcaacuggaauuuugucgaagaacuacucaagaaaucaaucagugugcaggguguuauccuggaggagcagcuuagaauguacuugcacugcugccugacgcucugugacuucugggaacccaacauugcuauagugacuauccugugggaguauuacuccaagaauuuaaacagcucuuuuucaauuaguuggcugccuuucaaaggccuugccaauaccaugaaaagcccauuguccaugcucgagauggucaagacaugcuguugcgauaagcaagaccaggaacuguauaagucuucgagcuccuacacuaucuuucuauguauacuggcgaaagugguaaagaaagcaaugaagucaaacgggccccacccuuggaagcagguuaaaggaaggauuuauaguaaguuccaucagaaacggauggaggaacucaccgaggugggccugcaaaacuuuuucucuuuguuuuugcuguuagccgcugucgccgagguggaagaugucgcaagccacgugcucgaccugcuuaauuuccugaagccagcuuucguuacaucccagcgugccuugaucuggaaaggucauauggcguuucuccugauguacgcccagaagaaucuagauaucggggugcuggcagagaaguucucaugcgcuuuucgcgaaaaagccaaggaguuccucguaagcaaaaacgaagagaugguccagagacaaaccauuuggacgcugcuuucuaucuacauugacggagugcaggagguuuuugaaacuuccuauuguuuguaccccagucacgagaagcuguuaaaugauggcuucagcaugcuccugagggcuugccgggaaucugagcuucgaacagugcuguccuuucuacaggccguccucgcacgcauaagaucaaugcaccagcaacugugucaggaauugcagagggacaacguggaucuguucguacagaguagcuuaucggccaaagagcggcaucucgcugcgguggcauccgcccuguggcgccacuuuuucucuuuucuuaagagccaaagaaugucacagguugucccguucagucagcuggcugacgccgcagccgacuuuaccuugcucgcuauggauaugccuuccacugcccccucugacuuccaaccacagccugugaucagcauuauccagcuguucggcugggaugacaucauuugcccccagguggucgcaagguaucuaucccauguucugcaaaauucaacacuuugugaggcgcucagccacaguggguacgugucuuuucaggcucugaccgugcguuccuggauacggugcguauugcagauguauaucaagaaccugagcggaccagaugacuuacucauugauaaaaaucuggaagaggccgucgaaaaggaguacaugaaacagcuugugaagcugacgcgacuucucuucaaccugucggaaguuaaaucaaucuuuucuaaggcacaaguggaguaucuaaguauuuccgaggaccccaaaaaggcccuggucagauucuuugaagcuguggguguuaccuacggcaacgugcagacacuuagcgauaagucugccaugguaacuaaaagccucgaguaccugggggaagucuugaaguauaucaaaccuuacuuaggaaagaaaguguucuccgcaggccugcagcucaccuaugguaugauggggauacuggugaagucaugggcucagaucuuugccacaaguaaggcgcaaaaacuucuguucaggauuaucgacugcuugcuacugccacaugccguccuccagcaggagaaggagcugccggcucccaugcuuagcgcaauucaaaaaucuuuaccucuguaccuccagggcauguguaucguuugcugucagucccagaauccaaacgccuauuugaaucaacugcucggaaacgugauagaacaguacauuggccgcuuucugcccgcuucaccuuauguaagugaucuugggcagcacccagugcuguuggcccuacggaauacugcaaccauucccccgaucagcucccugaagaaaugcaucguccaggugauaagaaagucuuaccucgaguacaagggaucgagcccuccacccagguuagcgucaauccuggccuucauucuucaacuguuuaaagaaacaaacaccgacaucuaugagguugaacucuugcugccugguauucucaagugucuggugcuugucuccgagccccaggugaaacgccuagcuacugagaaucugcaguacaugguuaaggccugccaggugggcagugaagaggaaccaucuagccaauugacguccgucuuccgacaguucauccaggauuaugggaugcgguacuauuaccagguauauucaauauuagagacaguggcaacccuggaccaacagguugugauucaccucaucucuacucugacccagagccuuaaagacagugaacaaaaguggggacugggccguaacaucgcucagagagaggccuacuccaagcucuugagccaucugggucagauggggcaggaugagaugcaaaggcuagaaaaugacaacacauga

SEQ ID NO: 59121 - RNA, 3963 nt, Artificial Sequence
  derived and/or modified sequence opt3 from MN1__Homo_sapiens__NP_002421
auguucggccuggaccaguuugagccccaagugaacagcagaaaugccgggcagggagaaaggaacuucaaugagaccggucucuccaugaacacacacuuuaaggcuccugcauuccauacuggcgggccaccgggacccgucgauccugccaugucugcgcuuggcgaaccacccauccuggguaugaauauggagccuuacggguuucacgcucggggacauucagaauugcacgccggcggcuuacaggcacagccaguucauggguucuuuggaggucaacagccccaccacggccauccugggagucaccauccacaccagcaccauccgcacuucggaggcaacuuuggugggcccgacccuggagccagcugccugcauggcggccgccuacucggguauggaggugcugcaggcgggcugggaucccagccacccuucgccgagggcuacgagcacauggcugaaucucaagguccugagucguuugggccacagcgacccggcaaucuuccggauuuccauucaagcggagccaguucccacgcggugccugcacccugucugccauuggaccagucuccuaaccgugccgcuagcuuucacggccuccccuccucaagugggagcgauucucauucccuggaaccaagaaggguaacgaaucagggagccguggacucacuggaguauaacuaccccggugaggcaccuagcggccacuucgauauguucaguccaucugacuccgaagggcaacucccgcauuaugcugccggacggcagguccccggcggugcguuuccuggggccagcgcaaugccacgcgcugccggcauggugggauuaucgaaaaugcacgcucagcccccucaacagcagccacagcaacagcagcagccccaacagcagcagcaacagcacggcguuuucuuugagagauucucuggggccaggaagaugccggugggacuggaaccuuccgucgguucacggcauccacuuaugcagcccccucagcaagcacccccaccuccccagcagcaaccaccgcagcagccuccccagcaacagccacccccuccacccggcuugcuggugcgccagaauaguugcccuccggcccuaccacgaccccagcaaggggaggcuggaaccccuagcggcggucuccaggaugggggcccaaugcugcccucccagcacgcgcaguuugaauacccuauucauagacuugagaacaggucuaugcacccguauagcgagcccguauucucaaugcaacauccaccuccccagcaggcaccaaaucaacggcugcagcacuuugacgccccucccuacaugaacguugcuaaacguccacgcuucgauuuuccgggaagugccggcguggacagaugugcauccuggaaugggagcaugcacaacggagccuuggauaaccaucucucuccuucagcuuaccccggccugccaggugaguucacacccccugucccagacaguuuucccagcgggccuccguuacagcacccagcccccgaccaucagucccugcaacagcagcagcaacagcagcagcaacagcagcagcaacagcagcaacagcagcagcaacagcagcagcaacagcagcagcaaaggcagaaugcagcgcucaugauaaagcagauggcuucucggaaccaacagcagcgacuucgccagccuaaucuggcccaauugggacaccccggcgaugugggucagggcgggcuagugcauggaggcccagucgggggacuggcacagccuaacuucgaaagagaaggcgguucgacuggggccggaaggcucggcaccuuugagcagcaagcuccccaccuggcccaggaaagcgcaugguucuccgguccacacccuccgcccggcgaccuucugccacggcgcaugggagggucaggcuugccugcugauugcgggccccaugacccaagucucgccccucccccgccaccuggaggcucugguguucuguucagagggcccuuacaggagccaaugaggaugcccggagagggccacgugccugcgcugccgagccccggucuacaguuuggcgggucccucggaggccuggggcaacuucagucaccaggagccggcguagguuugccuagcgcugcaucugaacgucggcccccuccacccgauuucgccacauccgcucuugggggacagccuggcuuuccauucggcgccgcagggcgacagaguacuccccauagcggaccgggugugaacucuccuccauccgcgggcgggggaggcgguucaagugggggaggcggcgggggaggugccuaucccccucaaccagacuuucagcccagccagagaaccucggcuuccaaacucggcgcccugucucuugggagcuucaacaagccgucaaguaaggauaaucuguuuggacaauccuguuuggcagcucucucuacagccugccagaacaugaucgcaagccugggcgccccuaauuuaaacgucaccuucaauaaaaagaaucccccagaggguaaaaggaagcugucccagaaugaaacggacggggcugcgguggccggaaacccuggcucagauuacuuucccggcgggacugcaccaggagcucccgguccuggcgggccaagcggaaccaguucuuccggcagcaaagccucggguccgcccaauccuccagcccagggggacggaacaucacuaucucccaacuauacucucgagaguaccuccggcaacgauggcaagccuguuagcgggggagguggccgcgggcggggaagaaggaagcgcgacucuggccacgugagcccagguacauucuuugacaaauacuccgcugcacccgauucagggggagccccuggcgucaguccgggccaacagcaggcgagcggggcugccgugggagguucuuccgcaggcgaaacccgaggggccccaacgccccacgagaaggcucugacuucaccuaguuggggaaaaggcgcagagcuuuugcugggugaccagcccgaucucauugggagccuggacggcggagccaaguccgauucuucgagcccaaauguaggcgaguucgcgucagacgaaguuuccacaaguuaugcuaacgaagaugaggugucuagcuccucagacaauccucaagccuuagucaaagcaucucggagcccccuggugaccgggaguccaaagcugccgccucguggagucggugccggcgagcaugggcccaaagcuccacccccugccuugggacucggcaucauguccaacagcacuucuacaccagauucauacggugggggcggaggccccgggcacccuggaaccccgggucuggaacaggugagaacgccaaccuccaguagcggcgcacccccuccagacgagauucauccccuagaaauccugcaggcucagauacaacuccagaggcagcaauuuucgaucucugaggaucagccucuggggcuuaagggaggcaagaaaggugaaugugccguuggggcguccggcgcccagaauggagacagcgaguugggcucaugcuguagugaggcagugaagucugcuauguccacaauugaucuggacagcuuaauggccgaacacucagcugcaugguauaugcccgccgacaaagcccucguagauagugcugacgaugacaagacucuggcgccaugggagaaagcaaagccgcagaacccuaauagcaaggaagcccaugaucuucccgcuaacaaagccuccgcaucucaaccagggagccaucugcagugcuuguccguccacuguaccgacgaugugggagacgccaaggcucgcgcgucaguuccuacauggcggucucuccacagugauaucucgaauagauucggcacuuucguggccgcacugaccuga

SEQ ID NO: 59122 - RNA, 804 nt, Artificial Sequence
  derived and/or modified sequence opt3 from MNAT1__Homo_sapiens__NP_001171434
auggacgaucagggcugccccagauguaagaccacaaaauacaggaacccuagccugaagcucauggugaaugucugcgggcacacucuuugugaguccugcguugaccuguuguucgugcggggagccgguaacuguccagaaugcggcacgccguuacgcaaaucuaauuuucgaguacaacuguucgaggaucccaccguggacaaggaagucgagauccguaaaaaggugcuaaagauuuauaacaaaagagaagaggauuuuccuucacucagggaguacaaugacuuccuggaagagguugaagagauaguguuuaaccuuacaaauaacgucgaucuggacaauacuaagaaaaagauggagaucuaucagaaagaaaacaaggaugugauucagaagaauaaauugaagcucacccgggagcaggaggaacuggaagaggcucuggagguagaacgccaagagaacgaacagagaagguuauucauccagaaagaggaacagcuccaacagauucugaagcggaaaaauaagcaggcauuucuugacgaguuggggcagcauaucagucuggccccaauacacaaacuagaggaagcgcucuacgaguaucaaccccugcagaucgaaacauacggaccucauguuccagagcuugaaaugcugggccgcuuggguuaucucaaccacgugcgagcugccagcccccaggaucuggcagggggauacaccuccucuuuagccugucauagagcucugcaagacgcauucucgggccucuuuuggcagccuucauga

SEQ ID NO: 59123 - RNA, 1224 nt, Artificial Sequence
  derived and/or modified sequence opt3 from MNDA__Homo_sapiens__NP_002423
auggugaacgaguacaagaaaauccugcuccuuaagggcuucgaacugauggacgauuaucacuuuaccagcauuaaauccuuguuagcauacgaccuggggcuaacaacuaagaugcaggaggaauauaauagaauaaaaaucacggaucucauggagaagaaguuccaaggagucgcuugccuggacaaacuuauugaacuggcaaaggauaugcccucuuugaaaaaccucguuaauaaccugaggaaggagaaaucaaagguggccaagaaaaucaagacccaggagaaagcgccuguaaagaaaauuaaucaggaagaggugggucuggcugccccagcaccgacagcccggaacaagcucaccagugaagcucgcggccgaauccccgucgcacagaaacguaagacuccuaauaaggagaaaacagaggccaagagaaacaaagugagccaagaacaguccaagccacccgggccuucuggagcuucgaccucagccgcgguugaccauccacccuuaccucagacuagcaguuccacaccaucuaauaccagcuuuacgccgaaccaggagacucaagcacagagacagguggaugcccggcgcaaugucccccagaacgacccugugaccguaguugugcugaaagcuacagccccauucaaguacgaaucccccgagaauggcaagucaacuauguuucacgcaaccgucgcuaguaaaacacaauauuuccaugugaagguguuugauauaaaccuuaaagaaaaguucgucaggaaaaagguuaucaccauuagcgacuacucugaguguaagggugugauggagaucaaagaagccuccucaguaagcgauuuuaaucagaacuucgaggugccuaacaggauuaucgaaauagcgaauaagacgccaaaaauuagucaguuguauaagcaagccucugggacuauggucuacggacuguuuaugcuacagaaaaaguccgugcacaagaaaaacacaaucuacgagauucaggacaauaccggcagcauggauguugugggcucggggaaguggcauaacaucaaaugcgaaaagggagacaaacuccggcuguucugucuucagcugcgcacugucgaccgaaaguugaaacucgugugcgguucucacuccuuuaucaagguaauuaaggccaaaaagaauaaagagggccccaugaacguuaauuga

SEQ ID NO: 59124 - RNA, 1488 nt, Artificial Sequence
  derived and/or modified sequence opt3 from MNS1__Homo_sapiens__NP_060835
augggcagcaagagaaggaaccuguccugcucugagcggcaccagaaacucguggacgaaaauuacuguaagaaacuucauguccaagcccugaagaacguuaauucacagauccgcaaccagauggugcagaaugagaacgauaaucgaguacaacguaaacaguucuugagauuacugcagaacgaacaguuugagcuagacauggaagaggcuauucaaaaggcagaggaaaauaagaggcucaaagagcugcagcuuaagcaggaagagaaacuggccauggaguuggcgaagcucaaacacgaaagucugaaggaugagaagaugcggcagcaagugcgcgaaaacagcauagagcugagagaacucgagaaaaaguuaaaagcugccuauaugaauaaggagagggcagcccagaucgcugaaaaagacgcaauuaaguacgagcagaugaaacgggaugccgaaaucgcuaagaccaugauggaggaacauaagcgcauuaucaaagaggagaacgccgcggaagacaagcgaaauaaagcaaaggcccaauauuaccuggaucuugagaaacaguuggaagaacaggaaaagaagaaacaggaggcuuaugagcaacugcuaaaggaaaaacucaugauagacgagaucgucagaaagauuuacgaagaggaucagcuggagaaacagcagaaacuugaaaagaugaacgccaugaggcgguauaucgaggaguuccaaaaggagcaggcacuguggcguaagaaaaagcgcgaagagauggaggaagagaauagaaaaauuaucgaauuugcuaacaugcagcagcaaagggaggaagaccggauggccaaggugcaggagaacgaggaaaagcgauugcagcuccagaaugcgcugacacaaaaauuagaggaaaugcugcgccagagagaggaucucgaacagguuaggcaagagcuuuaccaggaggaacaggccgagauauacaaguccaaacugaaggaagaggcagagaaaaaguugcggaaacagaaggaaaugaagcaagacuucgaggaacagauggcucuaaaagagcuggugcuccaggccgcuaaggaagaggaggaaaacuuucgcaaaacuaugcuggccaaguucgcagaggaugacagaauugaacuuaugaaugcccagaaacaaaggaugaagcagcuggagcaccgucgggcugucgaaaaguugaucgaggagcgaagacagcaguuucucgcggacaaacaaagggaacuggaggaauggcaguuacagcaacgccggcagggguucauuaacgcaaucaucgaggaagagagacugaagcuacucaaagagcaugccacgaaucugcuuggauauuugcccaaggguguguuuaaaaaggaagaugacauugaucugcucggcgaggaguucaggaagguauaccagcagcgcucugaaauaugcgaggaaaaauga

SEQ ID NO: 59125 - RNA, 1749 nt, Artificial Sequence
  derived and/or modified sequence opt3 from MNT__Homo_sapiens__NP_064706
augagcaucgagacccugcucgaagccgcuagauuccuugaguggcaggcacaacagcagcagagggcccgggaagaacaagaacgccugcgauuggagcaggagcgugaacaggagcagaagaaagcgaacuccuuagcuagacuggcccacacacuacccguggaggagccuaggauggaggcaccaccgcucccccugucuccuccagccccuccuccagcucccccuccaccgcuugcaacucccgccccucugacggucauuccaauacccguugugaccaauucaccucaaccauugcccccgccucccccacucccugcugccgcgcagccccugccacuggcaccccggcagccugcccucguaggcgcuccaggguuaaguaucaaggaaccggcaccccugccuagccgcccacaggugcccacacccgccccacuuuugcccgacuccaaagcuacuauuccgccuaacggaucuccaaagccccugcaaccucuacccaccccaguccucacaaucgccccucaucccggugugcagccacagcuggcgccgcaacagccucccccacccacccuuggcacucugaaauuggccccugcagaggaaguuaagucgucagagcagaagaaaagaccagggggaauuggcacaagggaagugcacaauaagcucgagaaaaaccggcgcgcucaucugaaggagugcuuugaaaccuuaaaacgaaauauccccaacgucgaugacaagaagacgagcaaucugagugugcucagaacugcccuuagguacauacagucccugaaacggaaggagaaagaauaugagcacgaaauggagcguuuggcucgcgagaagaucgccacccaacagagacuagcagaacugaaacaugagcucucucaguggauggauguacuggaaauugacaggguucuucggcagacaggucaaccugaggaugaccaggccagcacuuccaccgcuucagaaggggaggauaacaucgacgaggauauggaagaggaccgagcgggacugggcccgccaaaguugagucaccgcccccagccugaacuccugaaaagcacauuaccacccccuucuaccacgccggcaccccugccaccucacccccauccacacccucauuccguggcccuacccccagcucaccucccgguccagcaacagcagccucagcaaaagacuccccugccagcacccccuccacccccugccgccccggcucagacacuugugccagcccccgcacacuugguggcgaccgcuggcgggggaucaacugucauugcccauacagcaaccacgcacgccagcguuauccagaccgugaaucauguacugcaagguccuggcgggaagcacauagcucauauugcccccagugcaccaucuccugcugugcagcucgcccccgcgacaccaccuaucggacacauuacuguccacccggccacccugaaccauguggcucaccuuggcucccagcugcccuuguacccacagccuguugcagugagccauaucgcccacacacucucgcaccaacaggucaaugguacugcugggcugggacccccagccaccgugauggcaaaaccugcgguaggcgcccagguugugcaucacccccaguuagucggccaaacagugcugaacccggucaccauggugacuaugccaucuuucccuguuuccacgcuaaagcucgcuuga

SEQ ID NO: 59126 - RNA, 570 nt, Artificial Sequence
  derived and/or modified sequence opt3 from MNX1__Homo_sapiens__NP_001158727
augggcgggcugagcaccgugggagccugccccgguauccucggcgcucagcaagcacaggcccaguccaaccuucuggggaaguguagaaggccucggacagcguucacuucucagcaauuguuagagcuggaacaccaguuuaaacuaaauaaguaccucucacgcccaaaacgauucgaggucgcuacgagucugaugcuuaccgaaacacagguuaagauuugguuucagaaccguagaaugaaauggaagaggagcaagaaagccaaggagcaagcagcccaggaagcugagaaacagaagggaggcggugggggagcaggcaaaggcggggccgaggaaccgggagcugaggaacuguugggucccccugccccaggcgacaagggguccggacggcgccucagagaucugagggacucugaucccgaggaggacgaagaugaggacgaugaagaccauuucccuuauucgaauggcgcgucagugcacgcagccagcagugauugcuccucugaggacgauagcccacccccucggccaucccaucagccggcuccccaauga

SEQ ID NO: 59127 - RNA, 1056 nt, Artificial Sequence
  derived and/or modified sequence opt3 from MOAP1__Homo_sapiens__NP_071434
augacccugagacuccuugaggacuggugcaggggcauggauaugaacccccggaaggcccuguugaucgcugggauuagccaguccuguucuguggcagaaauagaggaagccuuacaagcgggacuggcuccucuaggugaguaccgccuccugggccgaauguuccguagagacgaaaauaggaaagucgcccuuguugggcugacagcagagacuucacacgccuuggugccaaaggagaucccgggaaaaggcgguauuuggcggguaaucuuuaagcccccugauccagacaacacguuccucagucgccugaaugaauuucuggcuggggagggaaugaccgugggcgaacucagcagagcauuaggccaugagaacgggucccuggaucccgagcagggaaugauuccugaaaugugggccccaaugcuugcucaggccuuggaggcgcugcagcccgcacuacaaugccucaaauauaagaagcugagggucuucucuggucgggaaucgccugagccaggcgaagaggaguuugggcgcuggauguuccacacaacucagaugaucaaagccuggcaagugccggacguugaaaagcgaagaaggcuucuggagucauugcggggacccgcucucgaugugauacguguccugaaaaucaauaacccuuuaauuaccguggacgaaugucugcaggcccucgaggaaguauuuggcguuacagauaauccacgcgagcuucaggugaaguaccugaccacuuaucagaaagacgaggaaaaguugagcgcauacguccuaagacuggagccccuccugcagaaacuugugcagaggggugcuaucgaacgggaugccgugaaccaagcgcgacuggaccaggucauugccggggcaguucauaagacaauccgcagagaguugaaucucccugaagauggaccagcucccggcuuccugcaguuacuggugcuaauaaaggacuaugaggccgcugaggaagaggaagcccuccugcaagcaauucuugagggcaacuuuaccuga

SEQ ID NO: 59128 - RNA, 651 nt, Artificial Sequence
  derived and/or modified sequence opt3 from MOB1A__Homo_sapiens__NP_060691
augagcuuccuguuuuccucuagaucaaguaagaccuucaaacccaagaaaaacaucccugagggcagccaccaguacgaacuccuuaagcaugccgaggcuacacugggguccggaaauuugaggcaagcagugauguuaccagaaggugaggaccugaacgaauggauugccgucaauacuguugacuuuuucaaccagauaaauaugcuauauggcacgaucaccgaguuuugcacagaggcgucuuguccggugaugucggcugggccccgguacgaauaucacugggccgauggaacuaacauuaaaaagccuaucaagugcucagcaccaaaauacauugauuaucucaugaccuggguacaggaccagcuggaugacgagacacuuuuccccagcaagaucggcgugccuuuuccaaagaauuucaugagugucgccaagaccauacugaaacgcuuguuucgaguguacgcucauaucuaucaccaacauuucgauuccguuaugcagcuccaggaagaggcacaccugaacacuucuuuuaagcacuucaucuuuuucgugcaggaguucaaucugauugaccguagagaacucgcccccuuacaagagcugauugaaaaacuugguagcaaagauagguga

SEQ ID NO: 59129 - RNA, 651 nt, Artificial Sequence
  derived and/or modified sequence opt3 from MOB1B__Homo_sapiens__NP_775739
augagcuuccuguuuggcuccagaucuucaaagaccuucaaacccaagaaaaacaucccugaggggagucaccaguacgaacuccuuaagcaugccgaggcuacacugggaagcgguaauuugaggauggcagugauguuaccagaaggcgaggaccugaacgaaugggucgccguuaauacuguggacuuuuucaaccaaauuaauaugcuauaugggacgauaaccgauuuuugcacagaggaguccuguccgguaaugucugcgggacccaaauacgaauaucacugggcugauggcacuaacaucaagaagccuauuaaaugcucggccccaaaguacaucgacuaucucaugaccugggugcaggaucagcuggacgaugagacacuuuuccccucaaaaauuggugucccuuuuccaaagaauuucaugagcguggcaaaaaccauccugaagcgguuguuucgcguuuacgcccauauauaucaccagcauuucgaccccgugauccaacuccaggaagaggcucaccugaacacaaguuuuaagcacuucaucuuuuucguccaggaguucaaucugauugaucgacgugaacucgcaccuuuacaggagcugauugaaaaacuuacuuccaaggacagauga

SEQ ID NO: 59130 - RNA, 807 nt, Artificial Sequence
  derived and/or modified sequence opt3 from MOB2__Homo_sapiens__NP_001165694
augcugggcgaccacugcagccuccccgaggaucaggccagaccugggcaaucccuucagucuggacuguguugcaagaugguguugcaggcugucucaaaaguuuuaaggaagaguaaagcaaagccaaacgguaaaaagccggccgcggaagaacggaaggcuuaccuggaacccgagcauaccaaagcccgcaucacagacuuccaguuuaaggagcuagugguacucccucgagagauugaucugaaugaguggcuugcaagcaacacuacgaccuucuuucaccauauaaaucugcaauauuccacaaucucugaguucuguacuggcgaaaccugccagacaauggccguguguaacacccaguacuauugguacgacgaacgugggaaaaaggucaaaugcacugcuccacaguauguggauuuuguuaugucgucagugcaaaaguuggucacagacgaggauguguuccccaccaaguacggaagagaguuuccuagcaguuucgaaucccucguaaggaaaauuugucggcaccuguuucauguucuggcacacaucuauugggcccacuucaaggagacgcucgcuuuagaacugcauggccaccuuaauacuuuguacgugcauuuuauucuguucgcccgcgaguuuaaccuacucgacccaaaagaaaccgcgaucauggaugaccugacagagguccuuugcucuggugcagggggagugcacagcggcggcuccggggauggagccgguucaggcgggcccggagcucagaaucacgugaaggagagauga

SEQ ID NO: 59131 - RNA, 651 nt, Artificial Sequence
  derived and/or modified sequence opt3 from MOB3B__Homo_sapiens__NP_079037
augagcaucgcccugaaacagguguucaacaaggacaagaccuuuagacccaaaaggaaguucgagccuggcacacaacgguuugaacuccacaaacgcgcucaggcaucccuuaauucuggggucgaucugaaggccgcgguucaguugccaucaggagaggaccagaacgauuggguggcuguacauguggucgacuucuuuaaucgaauuaacuuaauauacgguacuaucugcgaguucuguacggaacguaccugcccggugaugaguggcgggcccaaguaugaauacagauggcaagaugaccugaaauauaagaaaccuacagcccuaccagcaccccaguacaugaaucuccugauggauuggauugagguucagaucaacaaugaggaaauuuuuccuacuugugugggagucccauuccccaagaacuuucuucagaucugcaaaaagauacuguguagguuguuccggguguuuguacacguuuauauccaucacuucgaccgcgugauugucaugggcgccgaggcucaugugaauaccugcuacaagcacuuuuauuacuucgugacagaaaugaaccucaucgauagaaaagagcuggagccucugaaggaaaugaccagcaggaugugucacuga

SEQ ID NO: 59132 - RNA, 615 nt, Artificial Sequence
  derived and/or modified sequence opt3 from MOB4__Homo_sapiens__NP_001094289
auggugauggccgagggcaccgcuguccugagaaggaaccggcccgggacaaaggcacaguacauccaacagaauauucgcgccgacugcagcaacauagauaaaauccucgaaccuccagagggacaggacgaagguguuuggaaguaugagcaccuucgacaguucugucuggaauugaauggcuuagcggugaaacugcaauccgagugccauccggauacuuguacgcagaugaccgcuacagagcaguggauuuuucuaugcgccgcacacaagacucccaaagaauguccugccaucgacuacacccgucauacacucgauggggcugcaugccugcuuaacucuaauaaguauuucccaucaagaguaaguauuaaggagagcuccguggccaaacugggaucugucuguaggcggaucuaccgcauauuuucgcacgcuuauuuccaucacagacagaucuuugacgaauacgagaacgagaccuucuugugccacagguuuacuaaguucgugaugaaauauaaucucaugucaaaggauaaccugauuguucccauccuggaagaggaagugcaaaauagcgucaguggcgaguccgaagccuga

SEQ ID NO: 59133 - RNA, 621 nt, Artificial Sequence
  derived and/or modified sequence opt3 from MOBP__Homo_sapiens__NP_001265251
augagccagaagcccgccaaagagggcccuagacuguccaagaaccaaaaauacucugaacacuucucaauccauugcuguccaccguuuaccuuccucaauaguaagaaagagauuguggacaggaaguauagcauaugcaaguccggguguuuuuaccagaaaaaggaagaggauuggaucugcugugcuugccagaaaacaucuucgugucagcggcgccuuucaagccgaggagaacccuggcugccuccacccgcaaguuucgguccuuugcguacuuccagaagggccaagucuccacaacggcccaaacagcagccugcggcuccaccggccgucguucgcgcacccgccaagccuagaagcccacccagguccgagcggcagccucgcucaccaccccgaagugagagacaaccgaggagcccuccccggucugaacgucagccacgcuccccucccagaucagagaggcagccacggccccgaccugaagugcgcccaccgcccgcuaagcagagaccuccacagaaaagcaagcaacagcccaggaguucuccuuuacggggcccaggggcaucccgcggaggcagccccguaaaagccucgagauuuuga

SEQ ID NO: 59134 - RNA, 2667 nt, Artificial Sequence
  derived and/or modified sequence opt3 from MOCOS__Homo_sapiens__NP_060417
auggccggcgcugcagccgagagcgggagagaacuguggaccuucgcgggauccagggaccccucugcuccucggcucgccuacgguuauggcccagggucacuucgcgagcugcgagcacgugaauuuaguagauuggccggaacaguguacuuagaucacgcuggcgcaacucuguucagccagucccaacuagagucuuuuacgucggaccucauggaaaacaccuaugguaauccgcauucacagaacaucagcaguaagcugacacacgauacugucgagcagguuagguaccggauucuugcccauuuccacaccacagcugaggacuauaccgugauauuuacugccggguccacagcggcacugaaauugguagccgaggcuuuccccugggugucucagggaccugaaagcuccggcucacgcuuuugcuaccucaccgauagucauacgagcgucgugggcaugagaaauguuacuauggccaucaacgugauuucuaccccagucaggcccgaagaccugugguccgcagaggagcggucagcuagcgccaguaauccugauugucaacugccacaccucuucugcuaucccgcgcagucuaacuuuuccggggugcgcuacccuuuaagcuggaucgaagagguaaagucgggacgacugcacccaguuucuacaccggguaaaugguucgugcuuuuggacgccgcauccuacgucucaaccaguccccuggaucuaagcgcucaucaggccgacuuugugccuauuuccuucuauaagaucuuuggcuucccaacugggcucggagcucugcuugugcacaauagagccgcaccccuguugaggaaaacauacuucggcggugggaccgccucugcuuaucucgcgggagaagauuuuuacauaccucggcagagcgucgcacaacguuucgaggacggcacgaucucauuucuggauguuauugccuuaaagcauggcuucgacacucuggaacgccucacagggggaauggagaacaucaagcagcacaccuuuacucuugcucaguauacauacguggcccugaguuccuugcaguauccaaauggugcacccguagugagaauuuacagcgacucugaguucucaaguccggaaguccaaggcccuaucauaaacuuuaaugugcuagaugacaaagggaacauuaucggauacagccagguugauaagauggccucccuguauaauauucaccucaggaccggcuguuucugcaacacgggugcuugucagcggcaucuggggaucucuaaugagauggugcgaaaacacuuucaagccggccaugucugcggagacaacauggaucuuaucgacggccagcccaccgggucggugcgcauuagcuucggauacauguccacacuggaugacguacaggcauuuuugagauucauaaucgauacuaggcuccacucaaguggugacuggccaguuccucaggcgcaugcugauaccggcgaaacaggggcccccucugcagacagccaagccgacgugauuccagcugucaugggacggcgcucccugucaccccaggaggaugccuuaacuggcagcagaguguggaacaauucuuccaccgucaacgcagugccuguugcuccaccggugugugacguagccaggacacagcccaccccuagugaaaaggcggccgguguccuggagggggcucuaggcccacacgugguuacuaaucucuaucuguaccccaucaaaagcugcgcagccuuugaggugacgcguuggccugucggaaaccagggccuuuuguaugaucggucuuggauggugguaaaucacaacggggugugucugucccaaaagcaggaaccacgacucugccugauacagcccuucauugaccuuagacagaggaucaugguuaucaaggcuaaaggaauggagccgauugaagucccucuggaggaaaauucagagcgcacacaaauccggcagaguagagugugugccgauagggugagcaccuacgacugcggugagaagauuucguccugguugucuacuuucuuuggccgcccaugccaucucauaaaacagagcucaaacagucagcgaaaugcaaagaaaaagcacgggaaagaucaacugcccggaaccauggcgacauuaucccuggucaacgaagcccaguaucuacucaucaauaccucuagcauucuggagcuucaucggcaguugaacacuuccgacgaaaauggcaaggaggagcuguucucacucaaggaucugagcuuacguuuuagagcuaacaucaucauuaaugguaaaagggccuucgaagaggaaaagugggacgagauaaguaucgggucucugcgcuuucaaguucuuggcccuugucaccggugccagaugauuuguaucgaucagcagacaggacaaagaaaccagcacguguuccagaaauuguccgaaagcagggagacgaaggugaacuuuggcauguaccucaugcaugcaucgcuggaccuaucaucucccugcuuccugaguguagggucccagguccucccagugcugaaagagaauguugaaggacacgaucuuccugcuagcgagaagcaucaagacgugaccucuuga

SEQ ID NO: 59135 - RNA, 1158 nt, Artificial Sequence
  derived and/or modified sequence opt3 from MOCS1__Homo_sapiens__NP_001068566
auggccgcuagaccccugagcaggaugcuccggcgccuucugcgauccucugcacguucaugcaguagcggcgccccugugacccagccauguccgggggaguccgcgagagcugccucugaagaggucucgaggcggcgccaauucuugagagaacacgcagcccccuuuucagcuuucuuaacagacagcuuuggaaggcagcauaguuaccugcggaucucccuaacugagaagugcaaccuccgcugucaguauugcaugccugaagaggguguuccacugacgcccaaagcaaaucuucugaccacagaggaaauuuugacucucgcccgacuguucgugaaggagggcauagauaaaaucagacugaccgggggagaaccucucauuaggccagacguaguggauaucgucgcucaguuacaacggcuggagggccuucguacaauuggugugaccacuaacgggaucaauuuggcccgccugcuaccccagcuccagaaggcgggacugucugcaauaaacaucagccuugacacacugguuccugccaaauuugaguucauugugagaaggaagggcuuucacaaggucauggaaggcauccauaaagcuauugaguugggguacaauccagugaagguaaacuguguugugaugcggggacucaaugaagaugagcuguuagacuucgccgcacugaccgaaggucucccgcuugauguccgauuuaucgaguauaugcccuucgacggcaacaaauggaauuuuaagaaaaugguguccuacaaggagaugcuggauacggugcgccagcaauggccugaauuggagaaggucccagaagaggaaucaaguacugcuaaagccuucaagauacccggguuucagggacagauuagcuucaucaccucuauguccgagcacuucugcggcacauguaacagacuaaggauuacugcggacgguaaucugaaaguuugccucuuugggaacucagaggugagccugcgggaucaucuucgcgccggagcaagugaacaggagcuguugagaaucaucggcgcugccguaggcaggaagaaacgucaacacgcugggauguucucuauuucccagaugaagaaucggccuaugauacucaucggagguuga

SEQ ID NO: 59136 - RNA, 567 nt, Artificial Sequence
  derived and/or modified sequence opt3 from MOCS2__Homo_sapiens__NP_004522
augagcucccuggagaucucuucaaguugcuucagccucgaaaccaaacuuccccuguccccuccauugguggaggacucugccuuugaaccgucgagaaaagauauggacgaggucgaagagaagucaaaagauguuauuaacuucacagcugagaaguuaagcguggacgaaguaagucagcuggugauaucuccccuauguggcgcaaucucccucuuugucgggacuacgaggaauaacuucgagggaaagaaggugauuagccuggaauacgaggccuaucuuccuauggcggagaaugaaguucggaagaucugcuccgauauucgccaaaaauggccagugaagcacaucgcugucuuucaucgacuggguuuggugcccguaucagaggccaguauaaucauugcaguuagcucugcccaccgugcugcaucccucgaagccgugucauacgcuaucgacacccugaaagccaaggucccuauuuggaaaaaggagaucuaugaagagagcaguacauggaagggcaacaaagaguguuucugggcgucuaauuccuga

SEQ ID NO: 59137 - RNA, 1008 nt, Artificial Sequence
  derived and/or modified sequence opt3 from MOGAT1__Homo_sapiens__NP_477513
augaagguggaguucgcuccccugaacauccagcucgccagaaggcuucaaaccgucgcaguucugcaguggguguugaaauacuuacugcuaggcccuaugagcauugggauaacaguaaugcucaucauucacaauuaucuguuucuuuacaucccauaucugaugugguuguacuucgacuggcauacuccggaacggggaggucgccgauccucuuggauuaagaacuggacgcucuggaaacacuuuaaggauuauuuccccauccaucugauaaaaacccaggaccuggauccuucacacaauuacaucuuuggcuuccauccacacgggauuauggccgugggagcguuuggcaacuucagugucaauuauagcgacuuuaaggaucucuuccccgguuuuacauccuacuuacacgugcugccucuuugguucuggugcccaguuuuucgugaguacgugaugucugucggguuggugucgguaucaaagaaaagcguuaguuauaugguguccaaggaaggaggcggcaacaucucugucauugugcuagggggagcuaaagagagccuggacgcccaucccgguaaguucacucucuucaucagacagaggaaaggcuuugugaagauagcacugacccacggggccucccuugucccuguugugucauucggagaaaaugagcuguuuaagcaaacagauaacccagagggcaguuggauucggaccguacagaauaaauugcagaagaucauggguuucgcucucccgcuguuucaugcacgcgggguguuccaguacaacuuuggauuaaugacuuauagaaaagccauucacacagucgugggcaggcccaucccuguucggcaaacccugaauccaacgcaggaacagaucgaggaacuccaccagacuuacauggaggagcuucgcaagcuguucgaggaacauaaaggcaaguaugggauucccgaacacgagaccuuggugcuaaaauga

SEQ ID NO: 59138 - RNA, 1005 nt, Artificial Sequence
  derived and/or modified sequence opt3 from MOGAT2__Homo_sapiens__NP_079374
augguggaguucgcuccccuguuuaugccuugggaaagaaggcuccagacccuugccguccugcaauucguuuuuagcuucuuggcauuagccgagaucugcacagugggcuuuauugcgcugcuauucacucgguuuuggcuccugacgguacuuuacgcugccuggugguaucuggaccgcgauaagccacgacaagggggacgucacauacaggcaaucagauguuggaccauuuggaaauacaugaaggacuauuucccgaucuccuuggugaaaacagccgaacucgaucccucuaggaacuacauugcugguuuucauccucacggcguccuggcagugggggccuucgcuaaucugugcacugagucaaccggauuuaguagcaucuucccaggcauacggccccaucucaugauguuaacacugugguuucgcgccccuuucuucagagacuauaucauguccgcgggucuuguuaccucugaaaaggagucggcagcccacauuuugaacaggaaagggggaggcaaucugcuaggcaucauugucgggggagcucaggaggcccucgaugcacggccagguucauuuacucugcuucugcgcaaccgaaagggcuucgugagauuggcucucacacauggggcgccccuggugccuaucuuuagcuucggagaaaaugacuuauuugaucagauaccaaacaguuccggcucuuggcugagguacauucagaaucggcuccagaagaucauggguauuagccuuccgcuguuccacgggcguggaguauuucaguauuccuucggcuugauccccuaccgcagaccuaucaccacgguugugggcaaaccaauugagguccaaaagacucuacaccccucagaagaggaggugaaccagcugcaucagagguacauaaaagaacucuguaaucuguuugaggcccacaaacuuaaguucaacaucccugccgaccagcaucuggaauuuugcuga

SEQ ID NO: 59139 - RNA, 846 nt, Artificial Sequence
  derived and/or modified sequence opt3 from MOGAT3__Homo_sapiens__NP_001274076
augggcguggccaccacacugcagcccccuacuacgagcaagacccuccaaaaacagcaccuugaggcugucggggcauaccaguauguucugacauucuuguuuaugggaccauucuuuuccuuacugguguucguacuacucuuuacuucucuguggccguucucaguguuuuaccuugucuggcuguauguggacugggauacccccaaccaggguggcagaaggagugaauggauccggaaucgcgccauuuggcgacaauugcgugacuacuauccuguuaagcucgugaaaacagcggagcugccacccgauagaaacuacguccugggggcucauccucacggaauaaugugcaccggcuuccucuguaauuuuagcacugaauccaacgguuucucucaguuauuuccagggcugaggcccuggcuugccguguuggcaggacuguucuaucuaccuguauaccgggacuacaucaugucguuuggccucugcccaguuucacgccagagccuggauuucauucuuagucagccgcaacugggccaggccguggucaucauggucgggggagcucaugaggcauuguauuccgugcccggugaacacugucucacacugcagaagagaaaaggcuucgugagguuagcccugcggcaugggggaccuccacacccccgcccuccagcucccccgccucaccgaggcgguucucagagccucuccagaccccuucaugacgggccaggagccgcgcugaggggcgcacaaggcaaguugugggggccucgguuucaccuaccccaucugcaccucggacuggccgcugccuuccguuga

SEQ ID NO: 59140 - RNA, 675 nt, Artificial Sequence
  derived and/or modified sequence opt3 from MOG__Homo_sapiens__NP_001008229
auggccagccuguccagacccucucucccuucaugccuuuguaguuuccuguuguuacugcuacuccaggugagcuccucuuacgcuggccaauuuagggucaucgggccacggcacccgauucgcgcacugguuggagacgagguggaacuucccugccgaauaucgccugguaagaacgccaccggcauggagguagggugguaucguccacccuucucaagagugguccaucuguacaggaauggaaaagaucaggacggcgaucaggcgccugaauaucggggucgcacagaguugcucaaggacgcuaucggggaaggaaaagugacucugagaauuaggaacguucgguuuagcgaugagggcggcuucacgugcuuuuuccgcgaccacaguuaccaggaggaagccgcaauggagcugaagguggaagauccauuuuauugggucucccccggggugcucguauuacuggccguucuuccuguguugcugcuacaaaucaccgucggacucauuuuccugugucuucaguaccgacugagagguaaauugagggcugagaucgagaaucuccaucggacauuugaaucuuucggcgugcuggggccacaggugaaggagccgaagaaaacuggacaguuuuuagaggaacugcguaaccccuucuga

SEQ ID NO: 59141 - RNA, 2196 nt, Artificial Sequence
  derived and/or modified sequence opt3 from MOGS__Homo_sapiens__NP_001139630
augaagaccagaagccccaaaccucugcucacaggccuuaugugggcccagcaagggacuacgccaggaaccccgaagcugaggcacacaugcgagcagggugacggcguggggcccuacggaugggaauuucaugauggcuuguccuucggucggcagcacauccaggacggggcuuuacgccugacuaccgaguucgucaaacgaccuggaggccaacauggcggggauuggucuuggcguguuacaguggaaccacaggacucaggaaccagugcacuaccccucguaagccuguuuuucuauguggucacugaugguaaggaggugcuucugccugaaguuggcgccaaagggcaguugaaguuuauuuccggacacacaucugagcucggcgacuucagauuuacccugcugccacccacgucgccuggugauacugcgccaaaguacgggucauauaacguguucuggaccagcaauccgggacuccccuuacugacagagauggucaaaaguaggcuuaacuccugguuucagcaucggccuccaggcgcucccccugaacgcuacuugggccugccagggucucuaaagugggaggacagaggacccagcggucaaggccaggggcaguuccucauacagcaagugacucugaaaaucccgauuuccaucgaauuuguauucgagucaggaagugcccaggcaggcgguaaucaggcccuuccuaggcuggcugggagcuugcucacccaagcacuggagucucacgccgaaggcuuucgggagcgcuucgaaaagacauuccaguuaaaagagaagggacuguccucaggcgaacagguucucgggcaggcugcccuuagcggacuguuggguggcauuggguauuuuuacggacaaggccuagugcugcccgauaucggugucgaggggagugagcagaagguggacccagcguuguucccucccgugccacuguuuaccgcaguccccucucgauccuucuuuccuagaggcuuccuuugggaugaaggauuucaccagcugguugugcagaggugggacccaagccucacgcgggaggcccucggccauuggcugggguuacugaacgcugauggauggauaggucgugaacaaauccuaggcgacgaggcccgcgcaagaguaccgcccgaguuccucgugcagagggcuguccacgccaauccuccaacucugcuuuugcccguggcgcauaugcuggaaguuggggacccugaugaccucgccuuucugcggaaagcacuuccacgacugcacgcuugguucucgugguugcaccagucucaggccggaccccucccgcuguccuaucgcuggagaggcagggauccugcuuuaccaacacugcuaaaccccaagacccucccuucaggucuggacgauuacccccgggccagucauccaagcgugacugagcgccaccuugacuugagauguugggucgcacugggggccagggugcucacacgucuggcugaacauuuaggcgaggcggaaguagcagccgagcugggaccucuugcugccuccuuggaagcagccgagucucucgaugagcugcacugggcucccgaacuaggcguuuuugccgacuucgggaaucauaccaaagcagugcaacugaagccacggccgccucagggacucguccgaguggucggcagaccccagccacagcugcaauacguggaugcgcuugguuauguuagcuuguuuccccuguuacucaggcugcuugacccuacgucaagucgccuggggccauugcucgauauucuggcugacucccggcaccuauggagccccuucggacugagaucucucgccgcaucaaguagcuucuacggccagaggaacuccgagcacgacccuccguauuggcgcggugccguguggcugaauguaaacuaccuugcuuugggcgcccugcaucacuaugggcauuuagaaggaccacaccaggcacgagcugccaaacuccacggcgagcugcgggcgaaugucguggggaacguuuggcgucaauaccaggccaccggauuucuuugggagcaguauucugauagagacggcagggguauggggugccgccccuuccauggauggacaucgcuggugcuacucgcuauggcagaagauuacuga

SEQ ID NO: 59142 - RNA, 1260 nt, Artificial Sequence
  derived and/or modified sequence opt3 from MOK__Homo_sapiens__NP_055041
augaagaacuacaaagccaucggcaagauuggggagggaaccuucagcgaagugaugaaaaugcagucccugagagacgguaauuauuacgcuugcaagcaaaugaaacagagguuugagucuauagaacaggucaacaaucuccgggagauccaggcacuucgccgacugaacccccacccuaauauuuugauguuacaugaaguuguguucgaucguaagucaggcagucuggcccuaaucugugagcucauggacaugaacauuuaugagcugaucagagggaggcgguacccacuuagcgaaaagaaaauaaugcacuauauguaccaacugugcaaguccuuggaucauauccaccgcaauggaauuuuucauagagacguaaaaccggagaacauccucauuaagcaggaugugcugaaacugggcgacuucgguucuuguaggucggucuauucaaagcagcccuacacagaauacaucagcacucggugguaucgcgcgccugagugccucuuaacggauggguuuuacaccuauaagauggaccuguggagugcuggauguguguucuacgagauagccucccuucagccauuguuucccggcguuaaugaacuggaucaaauuucuaaaauccacgacgugauuggcacuccugcacagaagauccuaacaaaauucaagcagagccgagccaugaacuuugauuucccauuuaaaaagggguccggaaucccccuccugaccacaaaucuuucaccucagugccugaguuugcuccacgcuauggucgcauaugacccagaugagagaauugccgcucaucaagcccugcagcacccguacuuccaggaacaaaggaaaaccgagaagcgggcguuagguagccaucguaaggcaggcuuucccgaacacccuguggccccagagccccugucuaacuccugucagauaucaaaagaggggcgcaagcagaaacagagccucaagcaagaagaggacagaccuaaaaggcggggaccagcuuauguaauggaacuucccaagcugaaguugaguggcguugugcgacuaucuuccuacagcucgccgacucugcagucuguccucgguuccgggacaaauggacgcgugccugugcugagaccccuuaaaugcaucccagccucaaagaaaaccgacccucagaaggaucugaaacccgcaccacagcaauguagguugcccacgauuguccggaagggcggccgcuga

SEQ ID NO: 59143 - RNA, 1473 nt, Artificial Sequence
  derived and/or modified sequence opt3 from MON1A__Homo_sapiens__NP_001135973
augcaccccggcgggggaccuagcagagccgagaggcuggaacucggucuuggccgggagcgcccagcuaaggcaaucuuccugcaucgacguccgggggaaggaggcgguagagagaggugcuugcggugugggcacgugugcguccgcagaggacccggcccuagggaagccguuccauccggccggccccgcccugacaccuuaacaccacccugggugcgacagagagcgguaacugggacguuuugugcuucuuggaccccucugaggaaccggcgugcccaacgcauggcaacagauaugcagagaaaaaggucaagugagugccuagacggaacucucaccccaagcgauggucaguccauggagcgggccgaaucuccgacacccggcauggcucaggggauggagccugacggauacaagguggucuucgugcgacgcucgccacugguucuuguggcagucgccagaaccaggcaaucagcucaggaacuggcccaggaguugcucuauauuuacuaucagauacugagccugcucacuggcgcgcaauuaagucauaucuuucagcagaaacagaauuacgaucugcggcgccuuuuguccgguucugagagaauuacagacaaccugcuacaacucauggcaagggaucccagcuuccugaugggggccgcucguugucuuccucuggccgcagcugugcgggacaccguauccgccucauugcagcaggcgcgagccagaagucucguuuuuagcauccuguuagcaaggaaucaacugguggcucucguccgccggaaggaucaguuccuucacccaauugaccugcauuugcuauuuaaccugaucucuuccucaagcaguuucagagaaggagaggccuggacgcccgugugccucccgaaauuuaaugcugccggcuucuuucacgcacacauaucuuaucuggaaccugauacugaccuuugucuguugcucguguccaccgauagggaggacuucuuugccgucagcgacugccgccgacgguuccaggaacgucugagaaagaggggcgcucauuuagcgcugcgcgaggcacuacggacacccuacuauucgguugcccagguggggaucccagaucucagacacuuccuguacaagucuaaauccucaggacuuuuuaccaguccugagauugaagcucccuacacuagcgaggaggaacaagaaagguugcugggucucuaucaguaccugcauucccgagcccacaacgcaucucgcccacuuaagacaaucuauuacaccggccccaaugagaaccuguuggccuggguaacgggggcuuucgagcucuauauguguuacagcccucugggaacuaaagccucagcagugagugcgauucacaaguuaaugcgguggaucagaaaagaagaggacaggcuguuuauacuaacaccacucaccuauuga

SEQ ID NO: 59144 - RNA, 1317 nt, Artificial Sequence
  derived and/or modified sequence opt3 from MON1B__Homo_sapiens__NP_001273568
auggaggugggcggggacaccgccgcucccgcaccuggaggugccgaagaucuggaggacacacaguucccaagcgaagaggcgagagaaggcgggggaguccacgcuguuccgcccgauccugaggacgagggccucgaagagacugaagaucauaaacuuguguuucugcaacaggguccauuguuacugguagccauguccaggacgucucagucagcagcccagcuacgcggggagcuccuggcugugcacgcacaaaucgucaguacccuuacacgggccagcguggcucgaauuuucgcccauaagcagaacuacgaccugcguagauugcucgcgggauccgagaggacucuggaucggcugcucgacucuauggaacaggaucccggcgcauuacugcuuggcgccguucgcugcgugccuuuggcuagaccacugagggacgcccuaggggcacuccugcggcgcuguaccgcucccggacuugcccugucggucuuggcgguggguggccgacucauaacagccgcacaggagagaaauguacuggcugaaugcagguuagauccugccgaccugcaacuccuucuggauuggguuggggcuccagccuuugcagccggagaggcuugggcgccgguguguuugccccgguucaacccugacggcuuuuucuaugcauacgucgcccgucuagacgcuaugccagugugccugcuccugcuugguacccagcgcgaagccuuucacgcaauggccgcuuguagaaggcugguggaggaugggaugcaugccuugggagcaaugcgggcgcucggcgaggcugccucauucagcaaugcaaguuccgccucugcucccgccuauagcguccaggcaguuggcgcuccugggcugcgacacuuuuuauacaagccacuggacauccccgaucaccaucgccagcuaccgcaauucacuuccccugaacucgaggcccccuauucaagagaagaggaaaggcagcggcugagugaccuuuaccaccgcuugcaugcgagacugcacagcacaucuaggccacuccgucugauuuaucacguggccgagaaagagacccuucuggcuuggguaacguccaaguuugaauuguacacuugccucucaccucuggugaccaaagcaggagccaucuuagucgugacaaagcugcuacgguggguuaagaaagaggaagaucgacucuucauuagauaucccccaaaguacagcacucccccugcuaccaguacagaccaggccgcacauaacggucuguuuaccggccuuuga

SEQ ID NO: 59145 - RNA, 5028 nt, Artificial Sequence
  derived and/or modified sequence opt3 from MON2__Homo_sapiens__NP_001265398
augagcggcaccuccucucccgaggccgugaagaaacugcucgaaaacaugcagucagaccuuagagcucugaguuuggagugcaagaaaaaguucccuccagucaaagaagcagccgagagcgggaucauuaagguuaagacaauagcggcuaggaauacugaaaucuuagccgcacugaaagagaacuccucugaggugguacaaccguuucuaaugggaugugguacgaaggaacccaaaauuacccagcucugccuggccgcuauccagcggcuuaugucgcacgagguggucucagaaacagcagccggcaauauuaucaacaugcuguggcaguugauggagaauagccucgaggaacugaagcugcuccaaacuguguuaguucugcuuaccacaaacaccgugguccaugaugaggcuuugaguaaagccauagugcuguguuuccgccuacacuuuacuaaggacaauaucacaaacaauaccgcggcagccacgguacgacagguugugacugucguguucgaacguaugguggcugaggaugaaagacauagggacauuaucgagcagccuguccucguucaggggaacuccaaucggcgcucugugagcacccugaagccaugcgccaaagaugcauacaugcuuuuucaagaccugugucaguugguaaacgcugaugcccccuauuggcucgugggaaugacagagaugacuagaaccuucggccuggaauuacuggaguccguccucaaugacuuuccucagguguuccuucagcaccaagaauuuucauuccuguugaaggagaggguuugcccacuagugauuaaacuguuuagucccaacaucaaguuccggcaggguagcucuacauccucaagcccugcgccagucgaaaaaccguacuuucccauauguaugcgccuccugcgagugguaaguguucuuauuaagcaguucuauucucuguuggugaccgagugcgagaucuuccucucccuguuagucaaauuucuggaugccgacaagccucaauggcuaagagcaguggcugucgaaagcauucauagguucugugugcagccacagcuccugcggucguuuugccagucuuacgauaugaagcaacacuccacgaaaguuuuccgugacaucgugaaugcccuugggucauuuauccagaguuuguuccugguacccccuacuggaaacccagcuacaagcaaccaggccggcaauaacaaucucggcggguccgucucugcacccgccaacagcggaaugguggguauuggcgggggaguuacccugcuuccggcuuuugaguaucgcggcacuuggauaccuauccugacaauuaccgugcaggguucagcgaaggcaacguacuuggaaaugcucgauaaagucgagcccccaaccaucccugaaggguaugccaugaguguggcuuuccacugucuguuagaccugguaagaggaauaacauccaugauugagggcgagcuaggcgaacucgagacugaaugccaaaccacaacugaggaggggagcucucccacccagucaacagaacagcaggaccugcaaaguaccagcgaucagauggacaaggagaucguguccagggccguuugggaagagauggucaaugcaugcugguguggacuuuuggccgcucugucucuccuguuagaugccucgacugacgaagcagcgacggagaacauccugaaagcugagcuuacaauggccgcauugugcggucggcucggccuggugaccagccgagaugccuuuauuacugcuaucuguaaggggucccuaccaccccauuacgcccugaccgugcucaauacaaccacugcagcuacacugucaaacaagaguuacucuguccagggacagagcguuaugaugauuuccccuucaagcgaaucucaccaacaggugguggccguaggccagccacuugcgguccaaccgcaggguacggugauguugaccuccaaaaauauacagugcaugcgcacucuguuaaaccucgcccauugucacggggcuguucugggcacaaguuggcagcuugugcuggcaaccuugcaacaccucgucuggauccugggacuaaagcccagcucuggcggggcccugaaaccuggaagagcuguggaggguccauccacaguucucacuaccgccgugaugacggaccugcccguaauuucaaauauccuuaguagguuguucgaaagcucgcaguaucuggaugacgucuccuuacaucaccucaucaacgcacugugcucucuuagccuggaggcgauggauauggccuacggcaauaacaaggaaccuucacuauuugcuguggccaaacuccuggagaccggguuggugaauaugcaucggauugagauacuguggcgcccauuaacaggacaccuccuggaagucugucagcaucccaacaguagaaugagggaguggggcgcagaagcucuuacuucccugaucaaggccgguuugaccuucaaccacgacccgccucucucucagaaucaacgucugcagcuacugcuucucaacccacugaaggagaugagcaauauuaaccaccccgauauccgguugaaacagcuggaaugcguuuuacagauucuccaaucccagggggacucacugggcccuggauggccccuugugcugggcguaaugggggcaauccgaaaugaccagggagagagcuugauaagaacagccuuucaaugucuccagcugguggucacugauuuccuaccaaccaugccuugcacgugucugcagaucgugguugacguggcugguaguuucggccuucauaaccaggagcucaauauuucucugacauccaucggguuguuauggaacauuagcgauuauuuuuuccaaaggggagaaaccaucgagaaggaacugaauaaagaggaggcggcccagcagaagcaggcagaagagaaaggcgucgugcucaaccgccccuuucacccagcuccgccuuucgacugccuguggcuuugccuguacgccaaguugggugaacuauguguugauccccggccagccgugagaaagucggcugggcaaacucuguuuucaacaauaggcgcacauggaacccuccugcagcacucuacuuggcacaccgucauuuggaaaguacuuuuccauuuacuggacagggugcgcgagaguuccacaacggccgauaaggaaaaaaucgagagcggcgggggaaauauucucauccaccauucucgagacaccgcggagaagcagugggcugaaacuuggguuuugacacuggccggcguggcacggauauuuaacacccguagauaucuccugcagccccuuggugauuucagcagggccugggacguccuguuggaucacauccaauccgcugcacuaucaaaaaauaacgaggugagucuggccgcgcucaagagcuuucaggaaauuuuacagaucguaucuccugugcgcgacuccgauaaaccagagacacccccugucguuaaugugccggugccaguccugauugggcccaucucaggaaugagucggccuuucgugagaacugacagcauaggcgaaaagcuugguagguacuccucuucggagccacccauuguuaccgacgagcuggaagaucucaacuuguggugggcugccuggaacacgugguaucgaaucggcagcgagucaacaaagccuccgaucaccuuugacaaacugacuuucauucccucccagccauuucucaccgcacugauccaaauuuucccugcccuuuaccagcauauaaagacaggguucaauauggaugaccuacagaaacugggaguaaucuugcacagugcuauuucugugcccaucagcuccgaugccucaccauuuauuuuaccuucuuacacugaagcaguccugaccagccuccaagaggcugugcugacagcccuugacguucugcagaaggcgaucugcgugggccccgaaaacaugcagauaauguauccagccaucuucgaucagcucuuggcauuugucgaguucaguuguaaaccgccucaauacgggcagcuggagacgaagcacauugcuaaugccaaguauaaccagauccagcuauuugcucccgcagaauggguggcccugaauuacguaccauucgccgagcgcucccucgaagucgugguugaccuuuaucaaaaaaccgcuugccauaaggcgguggucaacgagaaagugcugcagaauauuaucaagacuuuacggguucccuugagccugaaauacucuuguccuucagaguccacauggaagcucgcagugaguagccugcuuagaguccugucgauaggacucccaguggccaggcagcacgcuucuuccggcaaguuugauagcauguggcccgaauuggccaacaccuucgaggacuuucuguucacuaaaucaauuccuccggauaauuuaaguauccaggaauuucaacguaacgagaauaucgacguagaagugguucagcuaauuucuaacgagauacugccauaugcaaauuucauccccaaggaguucgucggucagauuaugacaaugcucaacaaaggguccauccauagccaaucaaguagcuuuaccgaagccgagauugauauccgccuucgggaagaguucuccaagaugugcuuugaaacgcuguugcaguucucuuuuagcaauaaagugacuaccccucaggagggauacauauccagaauggcucugucagugcuccugaagaggucucaggacguccuucaccgauacaucgaggacgaacggcucaguggcaaguguccccugccacgccaacagguaacagagauuaucuucguguugaaagcgguuucgacccugauugauagcuuaaagaaaacucagccugaaaacgccugcaucucccuauuugguauacccccauauuucuga

SEQ ID NO: 59146 - RNA, 2820 nt, Artificial Sequence
  derived and/or modified sequence opt3 from MORC3__Homo_sapiens__NP_056173
auggccgcucagcccccuagagggaucaggcugagcgcacucugcccaaaguuccuucacaccaacuccacaucucauacuuggccguuuucagccguggcggagcugauugacaaugcuuacgaucccgacgucaacgccaaacaaauauggaucgauaagacgguuauuaaugaccacaucuguuugaccuucacagauaacgggaauggaaugacaagugacaaauuacauaagaugcugagcuuugguuucuccgauaaagugaccaugaacggccacguaccuguggggcuauauggaaauggcuuuaagucugguucgaugcggcucgggaaggacgcaauugucuucacuaaaaacggagaaucaaugagcgugggccugcuuagucagaccuaccuggagguuaucaaggccgaacauguggucgugccaauaguagcuuuuaauaaacaccgccagaugaucaacuuggcagaguccaaggccucucucgcugccauucuggaacacagccuguucuccacugagcagaaacucuuagcggagcuggaugcaaucauuggcaagaaggggacacgaaucauaauuuggaaucuucguucauauaaaaacgccaccgaauuugacuucgagaaggauaaauacgacaucaggauucccgaagauuuggacgagaucacgggaaagaaagguuauaagaaacaagagagaauggaccagaucgcuccugaaagugauuacagccugcgggccuauugcucuauucuauaccucaagccacgcaugcagauaauccugagaggccagaagguuaaaacucaacuuguguccaagucacuggcauacauugagagggacgucuaucggcccaaauuuuugagcaagaccgugcgcaucacauucggguuuaauugucgaaacaaagaucauuacggaauaaugauguaucacagaaauaggcucauuaaggcuuacgaaaaggugggcugccagcugcgggccaacaacaugggugucgggguugugggaaucaucgaguguaauuucuuaaaaccuacucauaacaagcaggacuucgauuauaccaaugaauaccgucugacaauuaccgcgcucggcgagaaacuuaacgacuauuggaaugagaugaaggucaaaaagaacacggaauacccacugaauuugccgguggaggauauccagaagcgccccgaccaaacuuggguccagugcgaugccugucuaaaauggagaaagcugccugacggcauggaucagcucccagaaaaaugguacugcaguaacaaucccgacccucaauuuaggaacugugaggugccagaggagcccgaggacgaagaucugguucacccgacauaugagaagaccuacaaaaagacuaauaaggaaaaauuccggauucgacagccugagaugauaccccgcaucaacgcagaacuucuguuuagaccaacagcuuugucuaccccuuccuucagcucgcccaaggagucugugccaaggcggcaccucuccgaggggaccaauucauaugccacgcgccuguuaaacaaucaucagguacccccucagagugaaccagagagcaacucccugaaaagaaggcuaucuacacguagcucaauucucaacgcuaagaaucggcgacugaguucccaauuugaaaacagcguguacaaaggagacgaugacgaugaggacguaaucauccuugaggaaaauucuacuccgaagcccgccguugaucacgacauugauaugaaaucagagcagagucauguggaacaggguggcguccagguggaguucgucggggacagcgaaccuugcggacaaaccggcuccacaucuacuucgagcuccagaugugaucaggguaacaccgcagccacacagaccgaggugccaucauugguugugaagaaggaggaaacuguagaggacgaaauagaugucaggaaugacgcugugauccugcccaguugcguugaggcggaagcaaaaauucacgagacgcaggagacaaccgacaagucugccgaugacgcugggugccaacuccaggaacugcgcaaccagcuucuguuggugacugaggaaaaagagaauuauaagcggcagugucauauguuuaccgaucaaaucaaaguccuccagcagaggauucuggaaaugaacgacaaguacgugaagaaagagacaugccaccaaagcaccgagacugaugccguauucuuacuggaauccaucaauggcaagucagagagcccugaccacauggugucucaguaucagcaggcacuagaagagauagagagacucaaaaagcaauguuccgcccugcagcauguuaaagcugaaugcagucaguguagcaacaaugagucuaaguccgaaauggaugagauggccguccagcuugacgauguguuucgccaauuggacaagugcucaaucgaacgagaucaguacaaaagugagguggagcugcucgaaauggaaaagagccagauucggucgcagugugaggaacugaaaacagaagucgagcaauuaaaguccacgaaccagcagaccgcaacugacguuucuacaagcucaaauaucgaggaaagugugaaccacauggauggagagucccugaaacuucguucuuugagagugaauguaggccaacuccuggcgaugauugucccagaccuagaccugcaacaggugaacuacgauguugacguggucgaugaaauccucggccaggugguugagcagaugagcgaaauauccucaaccuga

SEQ ID NO: 59147 - RNA, 708 nt, Artificial Sequence
  derived and/or modified sequence opt3 from MORF4L1__Homo_sapiens__NP_001252534
augagaggcgccgcucccgggaagaaaaccagcggacugcagcaaaagaacguggaggucaaaacaaagaaaaauaagcagaagacuccugguaacggcgacgggggauccacgucugaaaccccacagccgcccaggaaaaagcgggcacgcguugauccuacaguggagaaugaagagacuuucaugaaccgaguagaagugaaagucaagaucccagaggagcucaaacccuggcuuguggacgauugggaccugauuacccgucagaagcaauuguuuuacuuaccugccaagaaaaauguugauucaauacuggaagacuaugcgaacuacaagaaaaguagaggcaauacagauaacaaggaguaugcugugaaugaagucguggccgguaucaaagaguacuucaacguaaugcuagggacccagcuccuguauaaguuugagaggccacaguacgcagaaauucuugccgaccaccccgaugcuccuaugagccagguuuauggagcaccacaucuguugcgccucuucgugcggaucggcgccaugcuggcuuacacuccgcuggacgagaaaucccucgccuuacugcuuaauuacuugcacgauuuucugaaguaucuagcgaagaacucugcaacacucuucucggccucagacuacgaagucgcucccccugaguaucauagaaaagccguguga

SEQ ID NO: 59148 - RNA, 1053 nt, Artificial Sequence
  derived and/or modified sequence opt3 from MORN1__Homo_sapiens__NP_001287989
auggccgcugcaggcgaggggacccccagcuccagaggaccuaggcgggacccaccgcgccgacccccucguaacgguuacggcguguaugucuacccaaauucuuucuuuagauaugaaggggaguggaaggccggaaggaaacacggccaugguaagcuccuguucaaagaugggucauacuaugaaggagcguuuguugacggcgagaucacaggcgaagggcggcgccacugggcuuggaguggagauacuuucagcggucaguuugugcuuggcgagccccaaggguacggaguaauggaguauaaggccggcgguugcuacgaaggggaggugucccauggaaugagagaaggccacggcuuccuggucgacagggauggacagguguaccaggggucuuuucaugacaacaaacggcacgguccuggccagauguuguuccaaaauggggauaaguaugacggagauuggguucgcgaccgaagacagggccacgguguguuaaggugugcagaugggucgacguacaagggccaguggcauucagacgucuuuagcggacugggcaguauggcccacugcuccggggugaccuauuacggacuauggauuaacggucauccagcugagcaggcaacacggauaguaauccucggccccgagguuauggaaguggcccaagggucuccuuucagcgucaaugugcagcugcuucaggaucacggagagauugcuaaauccgaaucaggccgugugcugcagaucagugccgguguccgcuauguucaauugagcgcguacucugaggugaacuuuuucaagguagacagagacaaucaggaaacucucauucagaccccauuuggguucgaguguaucccguaucccguguccagcccugcagccggcgucccaggacccagggcugccaaaggcggggcagaggcugaugugccucugccacggggagaccuggaacuccacuuaggugcccugcauggccaagaggauacacccgggggacuuuugggcucaagucuguucuga

SEQ ID NO: 59149 - RNA, 240 nt, Artificial Sequence
  derived and/or modified sequence opt3 from MORN2__Homo_sapiens__NP_001138922
augaacggcuucgggagacuggagcacuuuagcggagccguguacgaaggucaguucaaggacaauauguuucauggccucgggaccuauacauuccccaacggagcuaaauacacuggcaauuuuaacgagaauagggucgaaggugagggggaauauacggauauccaaggacuugagugguccggcaacuuccacuuuaccgcagccccugaccugaaguugaaauuacauauguga

SEQ ID NO: 59150 - RNA, 486 nt, Artificial Sequence
  derived and/or modified sequence opt3 from MORN5__Homo_sapiens__NP_940871
auggaguacaccggcagcaaguauaucggggaauacguggacggaagaauggaggguaaagccaaguauauucugcccacagaaacuauauacgucggcgagaugaaagaugggauguuccacggagaaggcacgcucuauuuuccuuccgguucucaguacgacgcuaucugggagaacgggcuugcaauuaagggaaccuauacauucucagauggccugcauuacgacgagaaaaauuggcacuacugcgauggcuaugacaggcgguuuuacacugaaaucuugaacggguuaaagccagccggaauggcgcaacugaccaauauggauccgccccgcaagauuccuaaagguuauuacgacuguggcgauggguucuauaacccaguuacacgagugguaaaggacuaccguaauagauuucuaaggaacgcugaugacgaugagcaugaauggaucacccggacuugccgcaaaggauga

SEQ ID NO: 59151 - RNA, 1041 nt, Artificial Sequence
  derived and/or modified sequence opt3 from MOS__Homo_sapiens__NP_005363
augcccagcccucuggcccucagaccauaccuuagguccgaguucucuccgucaguggacgcucggcccugcaguagcccuuccgaacugccagcaaaguuguuacugggcgccacccuaccccgcgcgccucgacucccacguagacuggcuugguguucuaucgauugggagcaggucugccuucugcaaagguugggggccggagguuuuggcucgguuuauaaagcaacauaccgcggggugcccguagccauuaaacaggugaacaaguguacuaagaaucggcucgcuucaagaaggagcuucugggcagaacugaacgucgcccggcugcgccacgacaauauagugcgaguuguggcugccaguacgagaaccccugcgggauccaacucucucggcacaaucauuauggaguuuggugggaaugucacuuuacaucaggugaucuauggagcagccggccacccagaaggcgaugcuggggagccgcauugcaggaccggaggucagcugagccuuggcaaauguuugaaguacucccuggacguaguuaacgggcuacucuuccugcacucacaaaguauugugcaucuugaucugaagcccgccaauaucuugauaagcgagcaggacgucugcaaaaucucugauuuuggauguuccgaaaagcucgaggaccuguuaugcuuccagacaccuucauauccacugggcgguaccuacacucaccgggcacccgaacuccuuaaaggggagggagugacaccuaaggcugauauuuauagcuuugccaucacccuguggcagaugacgacuaaacaagcgccauacaguggcgagcgucagcacauuuuguacgccguggucgcauaugaccuacgccccucucuguccgcugccguuuucgaagauagccucccgggccagagacugggggacgugauccagagguguuggcggccuucggcugcccaacgacccucugcacgccuucuguugguagaucucaccucccugaaggccgaguuaggauga

SEQ ID NO: 59152 - RNA, 3498 nt, Artificial Sequence
  derived and/or modified sequence opt3 from MOV10L1__Homo_sapiens__NP_001157576
augcugagccucgccgcuaagcugguggcauucuuuuggagaaccgccgacacacccagggaggaagcgggccagcuggagccugaauuggcugagggggauacuaaauuaaagacgguccggggaguugugacccgcuacugcuccgacuaugguaugaucgaugacaugauuuacuucucuucagaugccguaacaagucgagugcugcuaaacgucggccaagaagugauagcaguuguggaggagaauaaagucagcaacgggcucaaggccauccguguggaagcuguauccgacaaaugggaggaugacucuagaaaucacggaucgccaucagauuguggcccgaggguucugauugguugcgugacuagccuugucgaaggggcaggauguaucagucagaccacauauuuuucccuggagucugugugcgagggcuucgaacccuguaagggcgacuggguggaggccgaauaccggauucgcccugggaccuggagcuccgaggcuacuucagucaagccauugagauauaaaaggguugauaaggugugcaucaguagccucuguggacggaacgguguacuggaagagucuauauuuuucacacuggacucccucaaauuacccgauggcuacaccccucgccgaggggacguggucaaugccgugguuguggagucaagccagaguugcuaugucuggagagcgcuguguaugacgcuugugaagaggcgggacgcagccccaguacaugaagcuacucacuuuuacggaaccaucuugcugaaaaacaagggcgauauugagguuacacaggugacucauuucgguacccuaaaggaagggcguucuaaaacaauggucaucuggauugagaauaagggagacaucccccaaaaccucguguccugcaaacuggccggcugggauaagagcaaacaguuucgcuuccagaugcuugacaaggaucagauguguccugucgugucguuuguuucugugccagaaaaagaaaauuccucagacgagaacauaaauagucugaacagccacaccaagaauaagacgucccaaaugucugaaagcucauugguaaacaauagaggcauuaguccgggggauugcacuugcaaaggagagaacggugaaaaggacaacauccucuccaggaaacagaugacagagcccgaaccuggcgggcuggucccacccggaggcaagaccuucauugugguuaucugugaugguaaaaauccugggcggugcaaggaguuacugcuccuuuguuuuagcgacuuccugaucggccgauacuuggaggugaacgucauuucuggagaagagucacuaauagcagcucgcgaaccauucaguuggaagaaacuuaagagcucccaggcccucacuucugcgaaaacaaccgugguagugacggcccagaagagaaauucgaggcggcaacugcccagcuuucuuccgcaguauccuauccccgaucgccugagaaaaugcguugagcagaagauugacaucuugaccuuccaaccacuccuggcagaguuacugaacauguccaauuacaaggaaaaauuuucaacacuacucuggcuggaggaaauauaugcugagauggaacuuaaggaguacaacaugaguggcauuaucuugaggcguaauggggaccugcucguccuggaggugccuggacuugccgaaggucggcccucucuguaugcuggcgauaaauugauccucaagacucaggaguacaacgggcaugccauugaauauaucagcuacgugaccgagauucacgaagaggacgucacacugaaaauaaauccagaguucgaacaggcauacaacuuugagcccauggauguugaguucacuuauaaucgaaccacauccagaaggugucacuuugccuuagagcaugugauccaccugggagugaagguacuauucccugaagagauuauccuccagucaccacaagucaccggcaacuggaaucaugcucaggacacuaagagcucuggucaguccacgaguaaaaagaaccgcaaaacaaugaccgaucaggcggagcacgggacugaagaacggagagugggcgacaaggaucugccgguucuugcacccuuuaccgccgaaaugagcgacuggguggaugagauccaaacaccuaaagcuaggaagauggaguucuuuaauccagucuugaacgaaaaccagaaacuggccgugaagcgcauucucucuggagacugccgaccccugccuuacauauuauucggcccacccgggaccggaaagacuguuacaaucauugaggcagugcugcagguacacuuugcccuuccggauucccggaucuuggucugugcuccuucaaauagugccgcagaccucgugugccugcgucuacaugaaagcaaagugcugcagccagcgacgauggucagaguuaacgcuaccuguagguucgaggaaauugugaucgaugccguaaagcccuauugccgcgacggugaggacauauggaaagcaucgcgguucagaaucauuaucacuacauguuccucuagcggccucuuuuaccaaauuggggugagggucggacacuucacccauguguuuguugaugaggccggccaggcuucagaaccugagugccugaucccccuugguuugaugagugacauauccgggcagauugugcuggccggcgauccaaugcaguuaggaccugucaucaagucucgacucgcaauggcuuauggccugaaugugagcuuccuugaacgccugaugucccggcccgccuaccaaagagacgagaacgcguuuggggccugcggagcucacaauccauugcucguuacaaaacuggugaagaacuauaggucacaugaagcacuacugaugcucccgagccgucuguucuaccaccgcgagcuugaggucugugccgauccuacuguagugaccaguuugcugggcugggaaaaguuacccaaaaaggguuuuccacucauuuuccacgggguucggggaucugaggcuagagaaggcaaaucccccagcugguuuaauccugccgaggcagugcagguccugagguacugcugucuucuggcgcauucgaucucaucucaggugagugccuccgacauagguguaaucacgccauaucgaaagcaaguggagaaaauucggauccuacuccgcaacgucgaucugauggacauuaagguuggcagcguggaggaguuccaggggcaggaauacuuggugaucauaauuucuaccgaucccugcuuuggagcucuguuagaguauagcaucacaaauggcgucuacauggggugugaccucccuccggcccugcagucccuucaaaacugcggagaaggcguggcagauccaucauaucccguuguaccugagaguacugguccagagaagcaccaggaacccagcuga

SEQ ID NO: 59153 - RNA, 201 nt, Artificial Sequence
  derived and/or modified sequence opt3 from MPC1__Homo_sapiens__NP_001257808
augaagaaaagccccgagaucauuuccggcagaaugaccuucgcccugugcuguuacucucucacauuuaugagguucgcuuauaaggugcagccucggaacuggcuucuguuugcaugccacgccacuaaugaagucgcgcaguugauacaagggggacgcuuaaucaaacaugagaugacgaagaccgcuucagccuga

SEQ ID NO: 59154 - RNA, 384 nt, Artificial Sequence
  derived and/or modified sequence opt3 from MPC2__Homo_sapiens__NP_001137146
augagcgccgcuggcgcaagagggcugagggccaccuaccaccggcuccuugacaagguggagcugauguugcccgaaaaauuacgcccucuguauaaccauccagcgggaccgcgaacagucuucuuuugggcucccaucaugaaguggggucuaguuugcgccggccucgcagauauggcccguccugcugagaaacuguccacugcacagucugccgugcuuauggcuacgggguucauuuggucaagauacagucugguaauaaucccaaagaauuggagcuuguuugccgugaacuucuuugucggagcggcaggcgccucccaacucuucaggauuuggcgguauaaucaggaacugaaagcuaaggcccacaaguga

SEQ ID NO: 59155 - RNA, 744 nt, Artificial Sequence
  derived and/or modified sequence opt3 from MPDU1__Homo_sapiens__NP_004861
auggccgcugaggcagacggcccccugaagagacuccuugugccuauccuguugccagaaaaaugcuacgaucaguuauucguccaaugggaccugcuacacguuccgugucucaagauucugcuuagcaaagggcugggauuggguauaguggccggcucccuccugguaaagcugccccagguguuuaaaauccucggggcgaagucugcugagggauuaucacugcagagugucaugcuugaauugguggcccugaccggcacaaugguuuauagcauuacuaacaauuucccuuuuuccucuuggggugaggcacuauuccucaugcugcagacgaucaccauuugcuuucuugugaugcauuacagggggcaaacagucaagggaguggccuuccuggcuuguuauggcuugguacuccugguuuuacugucgccacucacuccccuuaccguggucacacuguugcaggcaucaaacgugccugccguggucguuggccggcuacugcaggcugccaccaauuaccacaacgggcauacuggacagcucagcgcgaucacaguguuucugcuuuucgguggcagucuggcacgcauauuuaccuccauccaagaaacgggggauccauugauggccggaacuuucguagugucuagccucugcaauggccugauugcugcccaguuacuguuuuauuggaacgcaaaacccccucacaagcagaaaaaggcucaguga

SEQ ID NO: 59156 - RNA, 6114 nt, Artificial Sequence
  derived and/or modified sequence opt3 from MPDZ__Homo_sapiens__NP_001248335
augcuggaagccaucgacaagaacagagcucuccacgcagccgaaaggcuucagaccaaacugcgggagcgcggcgauguggcgaaugaagacaaguugagcuuacugaaauccguccuacagucuccccucuucucacagauucugagucuucagacauccguucagcagcugaaggaucaggugaacauagcuacuuccgccacgucuaauaucgaguacgcacauguaccucacuugucgccagccgugauuccgacccuccagaacgaaucauuucugcugagccccaauaacgggaaucucgaggcuuuaacaggaccugguaucccacauauuaacggcaaacccgcaugcgacgaguucgaucagcugaucaagaauauggcccaagggcgacacgucgaaguguuugagcuuuugaagccuccaaguggaggccuggguuucuccguuguggggcuacguucugaaaacagaggagagcucggcauauuuguccaggagauccaggaaggcagcguggcucauagggacgggcggcugaaagagacugaucagauucuugccaucaauggacaagcgcuggaccagaccauuacacaccagcaagcaaucuccauauugcagaaggccaaagauaccguacagcucguuauugcucgcgguucacugccccaguuagugaguccuaucgucagcagaucuccauccgccgcaucaacuauuagcgcucacaguaacccggugcauuggcaacacauggaaacaaucgagcuggugaaugacggcucugggcucggauucggcaucauuggugggaaggccaccggagucauaguuaaaacgauccuucccggcggcguggcggaucagcaugggaggcuguguuccggagaccacauuuugaagaucggugauacugaccuagccggcaugagcucggaacagguagcacaggugcugcggcaaugcgggaaccgcgucaagcucaugauagcucgaggagccauugaggagagaaccgcuccuacagcccugggcaucacucuuucuuccucaccaaccaguacacccgaacugaggguggacgcaagcacccagaaaggugaggaauccgagacguuugauguugaauugacuaagaaugugcaggggcucggcaucacaauugccggauauaucggcgacaaaaagcuggagccuucugggauuuucgucaaaagcauaaccaagucaagugcuguggagcacgauggacggauccagauuggugaccaaaucaucgcgguagauggcacuaacuuacagggguuuacaaaccagcaggcaguugaagugcugcgucauaccggacaaacgguccuacucacccugaugcgcagaggcaugaaacaggaggccgaacuuauguccagggaggacgugacaaaggaugcugacuugagcccagucaaugccucuauuauaaaggaaaacuacgagaaagaugaggacuuccugucaaguacucggaauaccaacauccuccccacagaagaggaagguuauccgcugcuuagcgcagagauugaggaaaucgaggaugcccagaagcaagaagcugcccuguugacuaaauggcagcgaauuauggggaucaauuacgagauagugguugcacacguguccaaguuuucugaaaacucgggccucggaaucagccuggaggcgaccguaggccaucacuucauucgcuccgucuuaccugaggggcccgugggacauucagguaaacuguuuaguggcgacgaacuacucgagguuaaugggaucacacugcuuggagaaaaccaccaggacguggucaauauuuugaaggagcugccaaucgaagugaccaugguauguugcagaaggacugugccucccacgacacagucugagcucgauagccuggacuuaugugauauagagcugaccgaaaagccacacguugaccuuggcgaguucauugguuccucagaaacugaggaucccgucuuggcuaugaccgacgccgggcaaagcacagaagaggugcaggcaccucucgccaugugggaggcuggcauccagcauauugaacuggagaaaggaucuaagggccuaggguucuccauccuggauuaucaggacccaauagauccggccaguaccgugaucauuauccggagccucguccccggaggcauugcagaaaaagacggucgccugcuuccuggggauagauugauguuuguuaacgacgugaaucuggagaacucuuccuuagaggaagcuguggaggcccucaagggagcgccaucaggcacuguaaggaucggugucgccaaaccccugccucuuaguccagaagagggcuacgugagcgcuaaggaagauucguuccuguaucccccgcacuccugcgaggaggcaggguuggccgacaagccucucuuucgugcugaccuggcccuaguuggaacaaaugaugcagaccugguggaugaaucuacguucgagagcccauacucacccgaaaacgacaguauauacuccacccaagcgucuauucucagccugcauggcuccucauguggggauggacuuaauuauggcagcaguuugccuucuucgcccccaaaagacgucaucgagaacagcugcgauccugugcuggacuuacacaugagccucgaggaacuguacacucagaaccuucugcagcggcaggaugagaauacacccucaguugacaucucuauggguccagccaguggguuuaccauuaacgauuauacaccggcuaaugccaucgaacaacaguacgagugugaaaacacuauuguguggaccgagucccaccuaccuagcgaaguaauaucuagcgcagagcuccccuccguccugccagacucagcuggaaagggcagugaguauuugcuggaacagagcucuuuagccugcaaugcagagugugugaugcuccaaaacguguccaaagaaucauucgagcgaacgaucaauauugccaaggguaacaguagccugggcaugaccgucuccgcuaauaaagaugggcuuggaaugaucguuagaucuauuauccauggcggggcgauaucgagggacggacgcaucgccauuggcgacugcauccugagcauuaacgaggaaucaacaaucuccgugacuaaugcacaggcucgggccauguugagaaggcacagucucauaggucccgauauuaagaucaccuacguaccugccgagcaucuggaagaguuuaagaucucucuagggcagcagagcggacgcgugauggcucuggacauuuucuccucauauacaggccgagauauaccagaacuucccgagcgggaggaaggugagggcgaagagucugaacuccaaaacacugcauacagcaauuggaaccagccucguagagucgagcuguggagggagccgaguaaauccuuggggaucagcauugugggaggccgcgggaugggaucucggcugucaaauggcgaaguuaugagagguaucuuuauuaagcacguguuagaggacuccccagccgggaaaaacggaacccucaagcccggcgauaggaucgucgaaguggacggcauggaucugcgagacgcgagucaugagcaggcuguugaagccauacgcaaagcagggaacccuguggucuucaugguacagagcaucauuaaucggccaagagcccccucgcaaucugaguccgagccugaaaaggcuccgcuuugcagcgugcccccaccucccccaucagcauuugccgagaugggaagugaucacacgcagucuuccgcgagcaaaaucucacaggacguugauaaggaagacgaguucgguuacaguuggaagaacauuagggagcguuauggcacacugaccggggaauugcacaugaucgagcucgaaaaaggacauagcggccugggucuaucccuggcugggaauaaggaccgcucucggaugagcguguuuauagucggaauugauccuaacggcgccgcaggcaaagacgggagacuucagaucgccgaugagcuccuggaaaucaauggacaaauuuuguacgguaggucccaccagaacgcuucaucuaucauaaagugugcccccaguaaagugaagauuaucuucauucgaaauaaggacgcaguaaaccagauggcugugugcccaggcaaugccgucgagccguuaccuucgaacagcgagaaucugcagaacaaagaaacugagcccacaguuaccacuuccgaugcggccguggaccucucuucauucaagaaugugcaacaucuggaacuuccaaaagaucaagggggacugggcaucgcaauaagcgaggaagacaccuuguccggugucauuaucaagagucuaacagagcacgggguggcugccacggauggacggcugaaaguuggcgaccagauccucgcuguagaugacgagauuguggucggcuaucccaucgaaaaguuuauuucucugcuuaagaccgcaaaaaugacugugaaguuaacaauacaugccgagaacccugauagccaagccguuccaucagcugcgggggcagccuccggagagaaaaagaauaguagccagucucugauggugccccaguccgguucaccugagccggaaagcauccgcaacaccucgagaucuaguacaccagcuauuuucgccuccgaccccgcaacuuguccuaucauccccggcugcgagaccacgauugagauaagcaaagggaggacaggacucggcuugucaaucgucgguggguccgacacccugcucggagccauuaucauucacgaaguguacgaggaaggcgcugcguguaaggauggccggcugugggccggggaccagauccuugagguaaacggaauagaucugcgaaaggcaacucacgacgaggcuaucaaugucuugagacaaaccccacagcgcgugaggcuaacacuguaucgugaugaagccccuuacaaagaggaagagguuugcgacacucucaccauugaauuacagaagaaacccgguaagggccuggggcuuucuaucgugggaaaacggaacgauacaggcgucuuugugagcgacauuguuaagggugggaucgcagaugccgacggaagacugaugcagggcgaucaaauacucauggugaauggcgaggacgucaggaacgcuacgcaggaggccguggcggcauugcugaaauguagucucgggaccguaacucuggaagugggacgcauuaaggccgguccauuccauuccgagcgaagaccuagccagucuucacagguuagugaaggcucccuuagcucuuuuacauucccgcuaucggggucaagcaccuccgagagucuggaaucuagcuccaagaaaaaugcuuuggccucagagauccaaggauuacggacugucgagaugaagaaaggccccacagauagucuggguauuucuaucgcugggggcgugggaagcccacucggcgacgugccuauauuuaucgcaaugaugcaccccaccggggucgccgcucagacgcagaagcugaggguaggagaccgcauugugacuaucugcgguaccuccacagaaggcaugacccauacucaagccguuaaccuucugaaaaaugcaucagggagcauugagaugcaaguggucgcgggaggcgaugugucuguugugacaggucaccagcaggaaccagccuccaguagccucucguucaccggguugacauccucuucaaucuuucaagacgaucugggcccuccccaguguaagagcauaacucuagagcguggaccggacggccugggguucaguauugucggagguuauggcuccccacacggggaucucccuaucuacgugaagaccguauuugcuaaaggagccgcaucugaagacggcagacuuaagcggggugaucagaucauugcugugaacgggcagagccuggagggcguuacgcaugaggaagccgucgcaaucuuaaaaaggacaaagggaaccgugacuuugauggugcugucauga

SEQ ID NO: 59157 - RNA, 2151 nt, Artificial Sequence
  derived and/or modified sequence opt3 from MPEG1__Homo_sapiens__NP_001034485
augaacaauuucagagccaccauccuguuuugggcugcagccgcgugggcuaagagcggcaaacccuccggggagauggacgaagugggaguccagaagugcaaaaacgcccucaaacuuccuguucuggagguguugccagguggcgggugggauaauuuaaggaacguagacaugggacgggugauggaacugacauacucuaauugucgcacuacggaggauggccaauauauuauaccggacgaaaucuucaccauuccccagaaacagucaaaccuagagaugaauagugagauccucgaaagcugggcaaacuaccaguccucuacaucguauucaauuaauacugagcugagccuuuuuaguaaggucaacgguaaguucuccaccgaauuucaacgaaugaaaacacuccaggugaaggaucaggccaucaccacucguguucaggugagaaauuuggucuacacagugaaaauaaacccuacccucgagcugucuagcggguucaggaaggagcugcucgacaucuccgaucgguuagaaaauaaccaaacgcgcauggcuacuuaucuggcagagcuuuugguacugaauuacggaacccacguuacaacuucaguggacgccggcgcugcccuaauucaggaagaucaucucagagcgaguuuucugcaggacagccagucuuccaggucagcagucaccgccagcgcuggccuugccuuccaaaacacagugaacuuuaaauucgaggaaaauuauaccagucagaacgugcugacgaagucuuacuuguccaaucggacuaacagccgcguccagucgaucgggggaguuccauuuuaccccgguauuacacuccaagcauggcagcagggcaucaccaaucaccugguggcuauagaucgaucuggguuaccucugcauuucuuuauuaacccaaauaugcuccccgaccuuccuggaccacugguaaagaaaguguccaagacugucgagacagccgugaaaagauauuacaccuucaacacguauccgggcugcaccgaucuaaauucacccaacuucaauuuucaggcgaacacagacgacgguaguugugaggggaagaugacuaauuucagcuuuggaggcguuuaccaagaaugcacccaguuguccggcaacagggaugugcugcucugucagaaacuggagcagaagaauccucuuacaggggacuucucuugcccaagcggauauucacccguccaccuguugagucaaauccaugaagaggguuacaaccaccucgaaugucaccggaaaugcacucuguuaguguuuuguaagaccguaugcgaggauguuuuccagguggccaaggcagaguuucgugcuuucuggugugucgccuccagccaggugccugaaaacucuggccugcuauuugggggacucuucucaaguaaaagcauuaauccaaugacaaacgcucaguccugccccgccggcuauuuuccgcugcgccuuuucgagaauuugaaggucugcgugucucaagacuacgaacuggguucgagauuugcaguuccuuucgggggcuucuuuagcuguaccgugggaaacccccucguagauccagccaucuccagggaccugggcgcuccuucacuuaaaaagugccccgggggauucagucagcauccagcgcugaucucugaugguugucaggucagcuacugcgugaaauccggcuuguuuacugggggaucacugcccccugcacggcugccaccguucacgcgacccccuuuaaugagccaggccgcuacaaauaccguuauugugacuaacucugagaaugcccgcuccuggauaaaggacagucaaacccaccaguggagacugggcgaaccaaucgagcuaaggcgggcaaugaacgucauucauggugaugggggcggacucagcggcggggccgcugccggagugacaguaggugugaccacuauccuggcaguugucauaacacuugcgauuuauggcacgcgcaaguuuaaaaagaaggcuuaccaggccaucgaggaaagacaaucuuuggugcccgggaccgcagccacuggagacacaaccuaucaggagcagggccaguccccugcuuga

SEQ ID NO: 59158 - RNA, 882 nt, Artificial Sequence
  derived and/or modified sequence opt3 from MPG__Homo_sapiens__NP_001015052
augcccgccagaagcggcgcucaauucugcaggcggauggggcaaaagaaacagcgcccugcacgagccggacagccacacuccucuucagacgcggcucaggccccggcagagcaaccccauaguagcuccgaugccgcucaggcaccuuguccacgugaaagaugccugggucccccuaccacaccaggccccuacaggucuaucuauuuuucgucaccuaaggggcaccucacucggcuuggacuggaguucuuugaccagccagccgugccguuggcucgcgccuucuuaggccagguccugguuagaaggcuacccaacgguacggaacuccgggggcgcauuguggagaccgaagcguaccugggaccugaggaugaggcagcccauagccgaggcggcagacaaacaccaaggaaucgggggauguuuaugaaacccggaacucuuuauguauacauaaucuaugguauguacuucuguaugaacauuaguucccagggcgacggggcuugcgugcuguugcgugcccucgaaccucuggagggacuggaaaccaugcgccagcucagaucuacauuaaggaagggcaccgcaagccggguccugaaagaucgagagcuuuguuccgguccaucaaaguugugccaggcucuggccaucaauaagaguuuugaccaacgcgaucuagcgcaggacgaggccguguggcucgaaagagggccccuggagccgagcgaaccugcaguuguggcugccgcuagggucggagugggccacgccggcgagugggcacggaaaccccuucgcuucuauguaagagggucuccauggguuuccguggucgauaggguggccgaacaggacacucaggcuuga

SEQ ID NO: 59159 - RNA, 2046 nt, Artificial Sequence
  derived and/or modified sequence opt3 from MPHOSPH10__Homo_sapiens__NP_005782
auggcuccccagguguggagaaggcggacccuggagcgcugccucacagaagucggcaaggccacugggcgaccugaguguuuccuuacgauccaagaaggacuggcaagcaaauuuaccuccuugacaaagguuuuauacgacuucaacaaaauucuggagaauggucguauacacggcucuccacuacagaagcucgugaucgaaaacuuugaugacgagcagauuuggcagcaacuggagcuucagaaugaaccgauccugcaguauuuccagaacgccguaucagagacuauuaaugaugaagacaucaguuugcuccccgagagcgaggaacaagagagagaagaggauggguccgaaauagaggcggacgauaaagaggaccuggaagaucuggaggaagaggaagugucugacaugggaaacgaugacccugagaugggcgagagggcugaaaauucgucaaagagcgaucuccggaagaguccagucuuuuccgacgaggacucugauuuagacuucgauaucagcaaacuggaacagcaguccaaggugcagaacaaaggucaagggaagccccgcgagaaaucaauuguugacgauaaguuuuucaaacuuagugaaauggaggccuacuuggagaauaucgaaaaggaggaagagagaaaggacgauaacgacgaggaagaggaagauauugacuuuuucgaggauaucgacagcgacgaagaugagggaggccuguuuggcucuaaaaagcuaaaauccgggaagucaagcaggaaucucaaauauaaggacuucuuugauccuguggagagugacgaagauauaaccaacguccaugacgaugagcuggacucuaauaaggaagaugacgagauugcagaagaggaggccgaggaacuuuccaucagcgaaacagaugaggacgaugaccugcaggaaaacgaggacaauaaacagcacaaggagucguugaaacgggugaccuucgcucucccagaugacgcagaaacugaggauacaggaguacugaacguuaagaaaaacucugacgaagugaaguccucauucgagaagcgccaagagaaaaugaaugaaaagauugccaguuuagagaaagaacugcucgagaagaaacccuggcagcuucagggugaagucaccgcucagaagcgaccugagaacagccuguuggaggaaacgcuacauuuugaucacgccgugagaauggcgccagugaucacugaggaaaccacacugcaacucgaggacaucauuaagcagaggauacgggaucaggcaugggacgaugucguucguaaagaaaagccgaaagaggacgccuacgaguauaagaaacgccugacucuugaucaugaaaaguccaagcugucuuuggcugagaucuacgaacaggaguauauuaaacucaaucaacagaagaccgccgaagaggagaaccccgaacacguggagauccagaaaaugauggacagccuguucuuaaagcuggaugcacuaucaaauuuucacuucauaccuaaaccacccguaccugaaauuaagguggucaguaaccucccagcuaucacaauggaggagguggcccccguuuccgugagcgacgcggcccugcuugcaccggaagagaucaaagaaaagaauaaggcuggcgacauuaaaaccgccgcugagaagacggccacugauaaaaagagagaaaggcggaaaaagaaguaccagaaacgaaugaagaucaaagagaaggagaaacgcagaaaguugcuggaaaagucuucagucgaccaagcagggaaauacaguaagacaguggccagcgagaaacucaagcagcugaccaaaacuggaaaggcuuccuuuauuaaggaugaaggcaaagacaaggcgcuuaaaucuucgcaggcauucuuuagcaagcugcaggaucaaguaaaaaugcagauaaacgacgccaagaaaacagagaagaagaaaaagaaaaggcaggauaucuccguucauaaguugaaacucuga

SEQ ID NO: 59160 - RNA, 483 nt, Artificial Sequence
  derived and/or modified sequence opt3 from MPHOSPH6__Homo_sapiens__NP_005783
auggccgcugagagaaagaccaggcugagcaaaaaccuccuucggaugaaguucaugcagcgcggccuggacuccgaaacuaaaaagcaauuggaggaagaggaaaagaaaaucauuucugaggagcacugguacuuagaucugcccgaacuaaaggagaaagaaucauuuauaaucgaggagcagaguuuccuccugugcgaagaccuucuguaugggcgaaugagcuuucguggauucaauccugagguggaaaaguugaugcuccagaugaacgcaaaacauaaggccgaggaagucgaggaugagacaguugaacuggacguguccgaugaggaaauggcgagaagguacgagacgcugguagguaccauuggcaaaaaguuugcucggaagcgcgaccacgccaauuaugaagaggaugagaacggggacaucacaccaauuaaagcaaagaaaauguuccucaagccgcaggauuga

SEQ ID NO: 59161 - RNA, 2583 nt, Artificial Sequence
  derived and/or modified sequence opt3 from MPHOSPH8__Homo_sapiens__NP_059990
auggaacagguggccgaaggcgcuagagucaccgcaguucccgugagcgccgcggacuccacagaggaacuggcugagguagaagagggggugggagucgugggugaggauaacgacgccgcagccaggggcgcugaagcauucggggauucugaggaagacggagaggauguuuuugagguggaaaagauccucgacaugaaaacugagggcgguaagguccuuuacaaagugcgguggaagggguauacgucagaugacgauaccugggaaccugagauucaccuggaagacugcaaagagguauuguuagaguuccgcaagaagauagccgaaaauaaagcuaaggccguucgaaaagauauccaacgucugagucuaaacaaugacauuuuugaggcgaacagcgauuccgaccagcagucugaaacaaaggaggacacuucgccgaaaaagaagaaaaagaaacucagacagagggaagagaagucaccagaugaccugaaaaagaaaaaggcaaaggccggaaaacuuaaggauaaaagcaagcccgaccuggagaguuccuuggaaucucucguguucgaucugcggaccaaaaagcgcaucagcgaggcuaaggaggagcugaaagaauccaagaaaccuaagaaagacgaggucaaggagacaaaggaacucaaaaaggugaaaaagggcgagauuagagauuuaaaaaccaagacuagggaagacccaaaggagaaucggaaaacaaagaaagagaaguuuguggaaucacaagucgagagugaaagcucuguucugaacgauucccccuucccugaggacgauucagaaggccuucauagcgacagucgcgaggagaaacagaauaccaagucugcccgagaaagagcagggcaggacaugggauuggagcacgguuuugaaaaaccacuggauuccgcuaugagcgccgaggaagacacggaugugaggggccggcguaagaagaaaacuccccgcaaggcggaggacaccagagagaacaggaaacuagaaaauaagaacgccuuccucgagaaaaagacaguaccuaagaaacagcggaaucaagaucgaucgaagucugcagcugaacuggagaaacuuaugccaguguccgcccagacuccgaaggggcgcagacugucaggagaagagaggggcuuguggaguaccgacagcgcugaggaagauaaagagacaaagcggaacgaauccaaggagaaauaccagaagcgccaugacucugauaaagaggaaaaggguagaaaagagcccaaggggcucaagacccugaaagaaaucaggaaugccuuugacuuauucaagcugacgccugaggagaaaaacgaugucagcgaaaauaaccguaagcgggaggaaauaccacucgacuuuaaaacuaucgaugaccacaagacaaaagagaacaagcagucacuuaaggaacgaagaaauaccagggacgagacugauacaugggcauauauugccgcugaaggagaccaagaggugcuggauaguguuugucaggcggacgagaacuccgauggccgccagcaaaucuugagccuaggcauggaccugcagcucgaauggaugaaacuggaggauuuccagaagcaucuugacgggaaagaugaaaauuuugcagccaccgacgcuauucccucuaacgugcugcgggaugccgucaagaauggagacuacaucacggugaaaguagcauugaacucaaaugaggaauauaaccucgaucaggaggacaguagcgguaugacccugguuauguuagccgcugccggcgggcaagacgaucugcuaagacuccugauaacaaagggagcaaaggugaauggcaggcagaaaaacgguacuaccgcgcuuauucacgcugccgagaagaauuucuugacaacugucgcaauccugcucgaagccggggcuuucgugaacguccagcaguccaauggcgagaccgcccugaugaaagcaugcaagcgcggaaacucugacauugugcgacuuguuaucgaauguggcgcugauugcaauauccugucgaaacaccaaaacagcgccuugcauuuugcgaagcaguccaacaaugugcucguauacgaccuguuaaagaaccaccuggagacacuaucacgggucgccgaggaaaccauuaaagauuauuucgaggcucgucucgcacugcuugaaccuguguuuccaauagccugucauagauugugcgaggggcccgacuucaguacugauuuuaauuacaagccgccucagaacauccccgaaggaucugguauucuccuguucaucuuucacgcuaauuuccugggcaaagagguuauagccagguuaugugggccaugcagcgugcaggcagucgugcugaacgacaaguuucaacuuccuguauucuuggauucccacuuuguguacucauucagccccguugcgggaccaaauaaacucuuuauucgccugacggaggcccccucugcuaaggucaagcuacugaucggcgccuaucgggugcagcuccaguga

SEQ ID NO: 59162 - RNA, 3552 nt, Artificial Sequence
  derived and/or modified sequence opt3 from MPHOSPH9__Homo_sapiens__NP_073619
auggaggaguucgaccuggugaagacccuccacaaaacaagcuccucugucggcucagaugaaaacagucuucauagccugggguugaauuuaaacacugacagauccucuccccaccugucgacgaauggaguuagcucauuuagugguaagaccaggccuuccgugauccagggcacaguagaagugcuaacuucucucaugcaagagcugcagaacagcgggaaaaccgauuccgaacuuuggaagaauugcgagacacgguggcugcaguuguucaaccucgucgagaaacagugucaagaacagauuguggcccagcaggagcaauuucauaaucagauacagcacauccaggaagagauuaagaaccugguuaagcugcaaaccucaagugcuagccucgcaucuugcgagggaaauuccucaaacaaacaggugagcagugaaucucagaugggcuucuuuuccuuaagcucggagcgcaaugaaucugucauccauuacccagaguccacugaaccggagauucaacaggagaugucaacaagucagcccgacuguaacguggauagcugcuccguaucuagcgguuaugggaccuucuguaucucagaacugaaucuuuacaagaguaaagacccuaaggaguuuauggaacacauagauguuccaaaaggacaguauguggcccccgcggucccugcugaguccuugguggacggcgugaagaacgaaaauuucuacauccaaacgccagaggagugccacgucagccugaaggaagauguuucuauuucacccggcgaguuugaacauaacuuccuaggggagaacaaagugagugaaguauauagcggaaagacuaauuccaacgccaucaccucuugggcacagaaacucaagcagaaucagccuaaacgagcccacguggaggacgguggcucgcguagcaagcaagggaacgagcaguccaaaaagacaccaauugaaaagucagauuuugcugcagccacucauccgagagcuuucuaccugaguaaacccgacgagaccccuaaugccuggaugucugauagcggaacaggccuuaccuauuggaagcuggaagagaaagacaugcaccacuccuugccagagacgcucgaaaagacuuuuaucucacugagcucuacagacgucucccccaaccagaguaauaccagcaacgagaugaaauuaccuucucugaaggauauauacuacaagaaacagagggaaaauaagcaacucccagagcggaaccuuacuuccgcgucaaaucccaaccauccgccugaagugcugacauuggaccccacccuacacaugaaaccaaagcagcagauuagugguauccagccucaugggcugcccaaugcacucgaugaccgcauuagcuucucgccagauuccguucuggagcccucuaugagcucaccuagugacaucgauuccuucucucaagccagcaacgugacgucccagcuuccaggauuuccgaaauaucccucacacaccaaggcuagcccugucgacaguuggaagaaucagacauuccaaaacgagucuagaacuuccagcaccuuuccaucgguguacacaaucacuucaaacgauauuucuguaaauaccguugacgaagagaacacagugauggucgccagugcauccgugagccagucucagcugcccggcaccgcuaauagcgucccugaauguauauccuugacuucacucgaggauccagugauccugaguaaaauuaggcagaacuuaaaggaaaaacaugcccggcacaucgcggaccugcgcgccuauuacgagagcgagauaaauucucuaaagcaaaaacucgaagcaaaggagauuuccggcguugaagacuggaagaucacgaaccagauccugguggaucgaugcgggcagcuugacucagcuuugcacgaggccacaaguagaguaaggacccuggaaaauaaaaacaaucuccuggagauugaggucaacgaucuucgggaacguuucagcgcugccuccucugcaucgaagauccugcaggagcgcauugaagagaugagaacuagcucaaaagagaaggacaauaccauaaucagguugaaaucccggcuccaagaucuggaagaggccuuugaaaacgcuuauaaguuaagugacgauaaagaggcgcagcugaagcaggaaaauaagauguuccaggaccuacucggagaguacgagucucuggguaaagaacaucgacgcgugaaggaugcacuuaacacaaccgagaauaaauugcuggacgccuauacucaaauuagcgaucucaagagaaugaucuccaaacuggaagcucagguuaaacagguggagcacgaaaacauguuaucacugaggcauaacucucggauccacguccgccccagcagagccaauacacuugcaacgagugacguguccaggcguaagugguugauuccgggcgccgaguacagcauauuuaccgggcaaccucucgauacucaggacucuaacguagacaaucagcuggaggaaacauguucacuaggacaccgguccccacuggagaaagauaguagccccggcucgucuuccaccagccuccugaucaagaaacagcgagaaacaucagacacuccuauuaugagagcucuuaaggaguuggaugaagguaaaaucuucaagaacugggggacccaaacggagaaggaggacaccaguaauauuaaccccaggcagacagaaacuucugugaaugccucccgcagcccagagaaaugcgcacagcagcggcaaaagagacugaacucagcgagucagaggagcuccucuuuaccucccagcaaucgcaaauccucaaccccaacaaagcgagaaaucaugcucacuccgguuaccgucgcuuacucuccuaaacggagucccaaggagaaccugucgccaggcuuuagccaucuucuguccaagaaugagucuucacccauacguuucgauaucuugcucgacgaucuggacacggugccugugagcacacuacagagaaccaacccaaggaaacagcugcaauuucucccccuggaugacuccgaagagaagacuuauagugaaaaagccacagauaaucacgucaaccauucuagcuguccugagccgguuccaaauggagugaagaaagugucaguacgcaccgcaugggaaaagaacaaauccgucaguuacgagcagugcaagcccgugagcguuacuccucagggcaacgacuucgaguauaccgccaagauucggacacuugcugaaacggagagauuuuucgaugaauugaccaaagagaaggaccagaucgaagccgcacugucuaggaugccaucccccgggggacgaauuacuuuacaaacacgccucaaucaggaggcucuggaggaccggcuugaaagaaucaacagggagcuggguucagugcguaugacccuaaagaaguuccacguccuccgcacaagcgccaaucuguga

SEQ ID NO: 59163 - RNA, 864 nt, Artificial Sequence
  derived and/or modified sequence opt3 from MPI__Homo_sapiens__NP_001276084
auggccgcucccagaguguucccucugagcugcgcaguccagcaauacgccuggggcaagaugggguccaacucugagguugcgaggcuccuugcuucaagugacccacuggcccagaucgcagaagauaaaccguaugccgaguuguggaugggaacccacccccggggugacgcuaagauuuuagauaaucgcauaagccagaaaacacugucccaguggaucgcagaaaaccaagacucucuaggcucgaaggugaaagauacuuuuaaugggaaccucccuuuccuguuuaagguacuuucaguggagacgccacugagcauucaggcccaucccaauaaggaauuggcugagaaacuccacuuacaggccccucagcauuacccagacgcgaaccacaagcccgagauggcaaucgcccugaccccuuuccaaggacucuguggcuuucgaccagucgaagagauugugacauuccugaaaaagguuccggaauuucaguuccugaucggugaugaggcugccacucaucuuaaacagaccaugagucacgacucccaggcaguggcuucuagcuugcaauccugcuuuucacaccugaugaagagugagaagaaagucgugguagaacagcuaaaucuccugguuaagcguauaagccagcaagccgcggccgggaacaauauggaggauaucuucggagaacuucuguugcagcuccaucagcaguaucccggcgacauuggcuguuuugcaaucuacuuccugaacuuacugacacucaaaccuggggaggcuauguuucuugaagccaaugugccacacgcuuaucugaagggaggucccugguugugccauuga

SEQ ID NO: 59164 - RNA, 540 nt, Artificial Sequence
  derived and/or modified sequence opt3 from MPLKIP__Homo_sapiens__NP_619646
augcagagacaaaacuucaggcccccuaccccaccguaccccggcccugggggagguggcugggggagcggauccucuuuucggggcacaccaggugggggaggcccccgcccuccaucaccccgagacggcuaugggaguccucaccauacuccaccguacggaccccguagcagaccuuaugguuccucucacucgccaaggcauggcgggucauuccccggaggccgguuugguagcccuaguccagggggauaccccggcuccuauucucgcagcccggccggcucccagcagcaguucggguacucaccuggacaacagcagacgcacccccaggguaguccaagaaccagcacaccuuuuggcucugggagggugcgggagaagcgcauguccaaugaacuggagaacuauuucaaacccucaaugcucgaagauccaugggcuggacuugagcccgucagcguuguggacaucagucaacaguacucuaauacucagaccuuuacaggcaagaaaggucgauacuucugcuga

SEQ ID NO: 59165 - RNA, 2238 nt, Artificial Sequence
  derived and/or modified sequence opt3 from MPO__Homo_sapiens__NP_000241
augggcgugcccuucuuuagcucccugagaugcauggucgaccucgggccuuguugggccggaggucuuaccgcugagaugaagcuguuguuagcacuggccggccuacucgcgauccuggcuacaccacagccgucugaaggggccgcacccgccguucuuggagagguggauacuucacugguauugaguagcauggaagaggcuaaacaacucguggacaaggcauacaaagaaaggcgggaguccauuaagcagcgccugcgaucuggcucggccucaccuauggagcugcucagcuauuucaaacagccagucgcugccacgcguaccgcggugagagcagccgauuacuuacacguugcucuggaccuuuuggaaaggaagcugcggagucuauggcgcagacccuuuaacgugacagauguccucacuccugcccagcugaaugugcuuuccaagucuagcgguugcgcauaucaagacguagggguuaccuguccagagcaggauaaauacaggacaauaaccggaaugugcaacaaucggcgcucccccacucugggcgcuucaaaccgagccuucgugagaugguugccugcggaauaugaggacggcuuuagucucccauacggguggacaccgggagucaagaggaaugguuuccccguggcccuggcacgggcugugagcaacgagaucguccguuuuccuaccgaucaguuaacgccagaccaggaacgcucucugauguucaugcaauggggccagcuccuugaucaugaccuggauuuuacucccgagccugccgcuagagccuccuucguuaccggggugaauugugaaacaucaugcguacagcagccacccuguuuuccguugaaaauuccucccaacgacccaaggaucaagaaucaagcagacugcauuccuuucuuucggagcugucccgccugcccaggaaguaacaucacuauacgaaaucagaucaacgcucuaaccucuuucguggaugcguccauggucuauggcagcgaggaaccccuggcacgcaaucucagaaacaugucgaaucagcugggucuucuggccgugaaccaaagguuccaggacaacgggcgggcuuugcucccuuuugauaaucugcacgacgauccauguuuacugacaaaccgcucugccaggauuccgugcuuccuagcaggagacaccagauccucagagaugcccgagcucacgaguaugcauacucugcuuuugcgugaacacaaucggcuggccacagagcucaaaagccugaacccucgaugggauggcgaaagacuuuaccaggaggcuaggaagaucguuggcgccauggugcagauuaucaccuaccgcgacuaucugccauugguccucgggcccacugcaaugcggaaguaccugccuacauauagauccuacaaugauucuguggacccaaggauagcgaacguauuuaccaaugcuuuccgcuauggacauacguuaauucaacccuuuauguuccgacuggauaaccgguaccagccgauggaaccuaauccacguguuccccuaagcagaguguuuuucgccucauggagggucgugcucgaggguggcaucgacccuauucugcgcgggcuuauggcaacccccgccaaauugaaccggcagaaucagaucgcugucgacgagaucagagaaaggcuguuugagcaagugaugcgaauuggacucgaucugccagccuuaaacaugcagcgcagucgggaccacggccugccugguuauaaugcauggagaagguucugcgggcuuccccagccagaaacaguuggccaguugggaacugugcuccguaaccugaagcuagcucgcaaacugauggagcaauacggcaccccgaauaacauagauaucuggaugggagggguauccgaaccucucaagcggaaagguagagucggcccccugcuugccuguauuaucgggacacaguuuaggaaguugcgagacggagaucgguucuggugggagaacgagggcguguuuagcaugcagcagcgccaagcgcuggcccagauaucuuuaccaagaauuaucugcgacaauacugguaucaccacaguuaguaaaaacaauauuuucaugucaaacagcuaccccagggauuucgugaauuguuccacccucccugcucugaaccuugcaucuuggcgggaagccucguga

SEQ ID NO: 59166 - RNA, 1341 nt, Artificial Sequence
  derived and/or modified sequence opt3 from MPP1__Homo_sapiens__NP_001159933
augacccugaaggccagcgagggcgaauccgggggaucuaugcacacagcucucucagaccuuuaccuggagcauuuguuacagaaaagaaguaggcccgaagcagugagccacccucugaacacugucacggaggauauguauaccaaugguuccccagccccgggcucucccgcgcaaguuaaggggcaggaagugcggaaaguacgccuaauccaguucgagaaggugacagaggaaccuaugggaauuacucucaaacugaacgagaagcagucgugcaccgucgcucgaauacuucauggcgguaugauccaccgucaagggucacugcaugugggagacgaaauuuuggagaucaauggcacaaacguuaccaaucacagcguggaucagcuccagaaggccaugaaagagacuaagggcaugauuagucugaaagucaucccaaaccagcaauccagacugcccgcacuccaggaagccggguuaaaguuugcuacaggagacauaauccagauuaucaauaaagaugacucuaacugguggcaggguaggguggagggcagcuccaaggaaucagcagggcugauuccuaguccagagcuucaagaauggcggguagccagcauggcucagucugcccccuccgaggcgccuucauguagcccauucggaaagaaaaagaaauacaaggauaaauauuuggcaaagcacaguucuaucuuugaccagcuggauguuguguccuacgaggaagucgugcgccuaccggccuucaaaagaaagacccucgugcugauaggcgcuagcggugucgggaggucgcauauuaagaaugcccuucugucucaaaaccccgagaaauuuguuuauccugugccauacacgacucggcccccucgcaaguccgaagaggacggaaaagaauaucacuucaucucaaccgaggagaugacacgaaauauuagugcaaacgaauuuuuggaguucggcagcuaccagggcaauauguuugggacuaaguucgaaaccguacaucagauccacaaacagaacaagaucgcuauucucgauauagagccacaaacacugaagaucgugagaaccgccgaauuaucccccuuuauugucuucaucgcgccgacggaccagggaacucagacagaggcccugcagcaacuccagaaagauucugaggcaauaaggagccaguacgcucacuauuuugaccuuucacuggugaauaacgguguugacgaaaccuugaagaaacuacaggaggccuucgaucaggcuugcaguuccccucaaugggugcccgucagcuggguguacuga

SEQ ID NO: 59167 - RNA, 1794 nt, Artificial Sequence
  derived and/or modified sequence opt3 from MPP2__Homo_sapiens__NP_001265299
augagcugggcucccccuccacaggugggccaaaaccugagaucccagaccguccucaggauccuuaaugggauggaggaccugauguggguugccauggaggagcggcgcuuccgagcauuggccucuuuuacaaugccgguggcggcuacuaacucagaaacggccaugcagcagguauuagauaaucugggaagucuacccagcgcaaccggugccgcugagcucgaccugauuuuccuucguggcauaauggaauccccuaucgugagaucucuggcaaaggcccacgagagguuggaggaaacaaagcucgaggcuguccgggauaacaaucuggaacuggugcaagagauucuccgcgacuuagcccagcuggcggagcagucgucaacugcagccgaacuugcucauaucuugcaggagccacacuuucaaagccugcuagaaacccaugauaguguugccuccaagacauacgagacacccccuccaucucccgggcucgacccuacuuucagcaaccagccagugccgcccgaugcagucagaauggugggaauuaggaaaacagcuggcgaacaccuggguguaaccuuucggguugaagggggagagcuugugaucgcccgcauacugcauggcggcauggucgcgcagcagggguugcuccacgugggagacaucauuaaggaagugaauggucaaccugucggcuccgauccacgagcccugcaggaguuacugagaaacgcaucagggaguguuauccucaaaauucuucccagcuaucaggaaccucaucugccaaggcaaguguucguaaagugccacuuugacuacgaucccgcucgggacucuuugaucccguguaaggaggccggacuacguuucaaugcuggcgaucugcuccagauagugaaccaggacgacgccaauugguggcaggcaugccacgucgaagguggguccgccggacugauuccuucacaacuucuggaggagaaacgcaaggcuuuugugaaaagagauuuggaacucacgcccaacagcggcacucuguguggcaguuuaucugggaagaaaaagaagaggaugauguaucugaccaccaaaaaugcggaguucgaccggcaugaacuacucaucuacgaggaaguugcacgaaugccaccuuuucgcagaaagacucuggugcuuauuggagcccagggugucggcaggcgguccuugaaaaacaagcugaucaugugggaucccgaccgcuaugggaccacagugccauacaccagcagaaggcccaaagauucggagcgugagggacagggcuauucuuucguaucccggggugaaauggaggcugacguucgagccgggagauaccucgaacacggcgaguacgagggaaaucuguauggcacgaggaucgauucaauucgcgggguggucgcagccggaaaggugugcguccuugacgugaacccucaggcuguuaaagugcugcggacugccgaauuuguaccauacgucguguucauagaggcaccggauuucgaaacauugagagcgaugaacagggcugcccucgagagugguaucagcaccaagcaacugacugaagcagacuuacgccgaacaguugaggaguccucucggauucagcguggcuaugggcacuacuuugaucugugucuagugaauagcaaccucgaaagaaccuucagggagcugcagacggccauggaaaaacuucgcaccgagccccagugggucccugugucauggguauauuga

SEQ ID NO: 59168 - RNA, 1758 nt, Artificial Sequence
  derived and/or modified sequence opt3 from MPP3__Homo_sapiens__NP_001923
augcccgugcugagcgaggacuccggccuccacgaaacccuugcccuguugacaucucaguuaagaccugauucaaaccauaaggaggaaaugggguuccugagggacgucuuuagugagaaaagccuauccuaccucaugaagauccacgaaaaacugcgguauuacgagcgccaaucuccaacuccgguucuucauucggcuguggcacuggccgaggauguaauggaagaguugcaggcggcuucagugcacagcgacgaacgagagcuccugcagcugcucaguacgccccauuuacgugccguccugauggugcacgauaccguugcacagaagaauuucgacccugugcuuccacccuugccugauaacauugacgaggauuuugacgaagaguccgucaaaauagugagacugguaaagaauaaggaaccacuaggagccacaaucaggcgggaugagcacucuggugcuguuguggucgcacgcauuaugagaggcggggccgcugacaggagcggacucgugcaugugggcgaugaacugcgggaggucaacgguaucgccguucuucacaaacgccccgacgagauuucccaaauccuggcgcagucacaggggaguauaacuuugaagaucauuccugcaacccaggaagaggaccgacucaaagaaagcaagguguucaugagagcccuguuucauuauaauccaagggaggaucgggcuaucccgugccaagaagccggauuacccuuccagcgucgccagguacuggagguggucucucaggacgauccuacaugguggcaagcaaaaagagugggcgacaccaaccucagggcuggccuuauuccauccaagggguuucaggagcggcgacugucauaccgcagagccgcgggaacuuugcccagcccucagagucuaaggaagccacccuaugaucaaccgugugacaaagaaacaugcgauugugaggguuaccugaagggccacuauguugccgggcuccggcgcucuuucagacugggaugcagggaacgucuuggcgguucccaggaggggaaaaugagcucgggagcagaaucuccugagcuguugaccuacgaggaaguggcucgguaccagcaccagcccggcgagcgaccaagacucgucgugcugaucggcuccuuaggggccaggcugcaugaacuaaagcaaaaaguaguugcugagaauccucagcacuuuggaguggccgucccccauacgacucgcccacggaagucacacgagaaagaagguguggaguaucauuucgucaguaagcaggcauuugaagccgaccuccaccacaacaaguuccuggagcauggcgaauacaaagagaaucuuuaugggaccagcuuggaggcuauacaggcggugauggcaaagaacaaaguuugucugguggauguagaacccgaggcccucaagcaacugagaacauccgaauuuaaaccuuacauuaucuucgucaagccagcuauucaggagaagaggaaaacuccgcccaugucuccugccugcgaagacaccgcagccccauucgaugagcagcagcaagagauggcugccagcgcagcguuuaucgaccgccacuauggacaucuuguggacgcuguucuggugaaggaagauuugcagggcgccuacucacagcucaaagucgugcuggagaaguuaaguaaagacacacacuggguacccguguccuggguucgauga

SEQ ID NO: 59169 - RNA, 1926 nt, Artificial Sequence
  derived and/or modified sequence opt3 from MPP5__Homo_sapiens__NP_001243479
auggccguggacugccccggcgaucuggggaccagaaugaugccuaucaggcggagcgcucagcucgagcgcauucgacaacagcaggaagacaugcguagaaggcgggaggaagagggaaagaaacaggaacuugaucugaacuccucuaugcgcuugaagaaauuagcacaaauaccaccgaagacagguaucgacaaucccauguucgauacugaggagggcauuguccuggaaucaccucacuacgccguuaaaauccuagagauugaagaccucuuuaguagccugaagcauauccagcacacgcuuguggauucccagucucaggaggacauaucgcuguugcuccaacugguacagaacaaggauuuccagaaugcguuuaaaauccauaacgcuauuaccgugcacaugaauaaggccucaccacccuucccucugaucagcaacgcacaggaccucgcccaagagguccagacaguguuaaaaccaguucaucacaaggaagggcaggagcugacugcucuuuugaauacaccccacauucaagcacugcuacucgcccaugauaaaguggcugaacaggagaugcagcuggaaccuaucaccgacgagagagucuaugagaguauaggacaguacggcggugaaaccgugaagauuguaaggaucgagaaggcccgggauauuccacuuggggcgacuguucgcaacgaaauggacuccgugaucaucucucgaauugucaaaggaggcgcagccgaaaagagcggccuguugcacgaaggggacgaggugcucgagauaaauggaaucgaaauuagagguaaagaugugaacgaggucuuugaccuguuauccgauaugcauggcacacugaccuucguucucaucccgucacaacagauaaagcccccuccagcuaaagaaacggugauucacguaaaggcccacuuugacuaugaucccagugacgauccuuacgugccauguagggagcuugggcugagcuuccagaaaggagacaucuugcaugucaucucucaggaagaucccaauugguggcaagcauaucgggagggcgacgaggauaaccagccgcuagcuggucuggugccugggaaguccuuucagcagcaacgugaagccaugaagcagacuauugaggaagacaaagagcccgagaagucaggaaaacucuggugcgcgaagaaaaauaagaagaaacgcaagaaaguucuguacaacgccaauaagaacgacgauuaugacaacgaagagauccuuaccuacgaagagaugagccuguaccaccagccagcaaauagaaaaaggccuauuauauugaucggcccccagaacuguggccaaaaugaacuccggcagcgacugaugaacaaggagaaggaucgcuucgcuagugccgugccacauacaacuagaucuaggcgggaccaggaggucgcugggcgcgauuaucacuuuguguccagacaagccuucgaagcagacauugccgcuggaaaauuuaucgagcauggugaguucgagaagaauuuauacggcaccagcaucgauucgguaaggcagguuauuaacucugggaaaauaugccugcuaucccuccguacacagucacugaagacccuucggaauagugacuugaaacccuauaucauuuucaucgcgccuccaagccaggaacgacugagagcacuccuggccaaggagggaaagaacccgaaacccgaggaacuuagggagauuaucgaaaagacgcgcgagauggaacaaaauaacggccacuacuuugauacugcuauagucaauuccgaccuggauaaagccuaucaggaguugcuccggcugaucaacaaguuagacacagagccucagugggugccaucuaccuggcugagauga

SEQ ID NO: 59170 - RNA, 1500 nt, Artificial Sequence
  derived and/or modified sequence opt3 from MPP7__Homo_sapiens__XP_005252425
augcccgcccugagcaccggcuccgggucugacacaggacucuacgagcuucuggcugcauugccugcccaguuacaaccacacguggauucacaggaagaccugacuuuccuaugggauauguuuggugagaagagucuccauagccuggucaaaauccacgaaaaacuucauuauuacgagaaacaguccccgguucccauucugcacggcgcggcugccuuggcagacgaucucgccgaggaacugcagaacaagccucucaauucugagauaagagaacuguuaaaacugcuuucgaagccaaacgugaaggcuuugcugucaguacaugacacgguggcacaaaagaauuaugaucccguccuaccuccaaugcccgaggacaucgaugacgaagaggauagcgugaagauuaucaggcucguuaaaaaccgggagccucugggggccaccauuaagaaagacgaacagacaggagcuaucauaguggcccgcaucaugcgaggcggugcggcagaucguagugggcuuauucacgucggagacgagcugagagaagugaauggcaucccaguagaggacaagaggccggaagagauuauccagauauuggcccagucccaaggcgcuauuacuuucaagaucauucccgggucuaaagaggaaaccccuagcaaggagggaaaaauguuuaucaaggcccucuucgauuacaacccaaaugaagacaaagcaauccccugcaaggaggcuggucuguccuuuaaaaagggcgauauuuuacagauaaugucacaggacgaugccacaugguggcaggcgaagcacgaagccgacgcaaacccucgggcugggcugaucccaaguaaacauuuccaagagcgcagacucgcccuuaggcggcccgagauucugguucagccguugaaggugagcaaucgcaaaucuuccggauuucgaaagucauucagacuaagcaggaaagauaagaagaccaacaaaaguauguaugaauguaagaaaucugaccaguacgauacugcugacgucccuacauaugaggaagugacccccuaccggcgucaaacgaaugagaaguaccgccuggugguccucguuggcccaguggguguagggcugaacgaacuuaaaagaaagcuguugaucuccgauacucagcacuauggagugaccgucccucauacaacuagggcccggcgaagccaggagucggacggcguggaguacauauuuauuucuaagcaccucuucgaaaccgacguucagaauaacaaauuuaucgaguauggcgaauacaagaauaacuauuacgggacauccaucgauucagugcgcaguguccuggccaaaaacaaggugugcuuacuggacguacaaccccacggaccaugguuccuacucccccugauggcaguuccuuggggugcuaaaccaccgaaugcgagaaugaccuguggcagcccccuugauuuguga

SEQ ID NO: 59171 - RNA, 1002 nt, Artificial Sequence
  derived and/or modified sequence opt3 from MPPE1__Homo_sapiens__NP_001229833
auggccaugaucgagcugggcuucgggagacagaacuuucacccccucaagaggaaaagcucccuucuguugaaguuaauugcuguggucuucgcaguucugcuauuuugcgaguuccucauauacuaucuggccaucuuucaauguaauuggccugaagugaaaaccacagcgucugacggagaacagacuacgcgggagccaguacuuaaggcuauguuccuggccgauacccauuugcucggugaauuucugggccacuggcuggacaaacuccgccgagaguggcagauggagcgugcauuccagacagccuuauggcugcuucaaccggaaguggucuuuauuuugggggauaucuucgacgagggaaaguggucaacucccgaggcuugggcagaugacguggaaagauuucagaagauguucaggcauccuagucacguucagcugaaaguggucgccggcaaccaugauauugguuuucacuacgagaugaauaccuauaagguggaacgguucgagaaaguauucagcuccgaacgccuauuuucuuggaaggggaucaacuucguuauggucaauucgguggcucucaacggagacggcugcggcauauguucagagacagaagccgagcugaucgaggugagccacagacuuaauugcaguagggaacuguugugguggcuccagccacggcugguguuauccgggcauacccacucugcgugugagguccaucacggaggucgcguucccgaacugagcgugccuuccuuuucauggcgaaacagaaauaacccaaguuucauuaugggcagcaucacucccacagauuacacccucucuaaaugcuaucuuccuagggaggacguagugcugauuaucuacuguggggucgugggauuuuugguugugcuaacgcugacucacuucggccuccuggcauccccauuucuuucaggucugaauuugcucgggaagcggaagacccguuga

SEQ ID NO: 59172 - RNA, 834 nt, Artificial Sequence
  derived and/or modified sequence opt3 from MPPED2__Homo_sapiens__NP_001138871
auggcccacggcauccccagccaggggaaggugacuauuacagucgacgaguacuccucuaacccuacucaggcuuucacgcauuauaauauaaaccaaucaagauuucagccaccgcacguucauaugguggaucccaucccuuacgacaccccaaaacccgcaggacacacaagguucguaugcauuagugauacucauagccggaccgacgguauccagaugccuuauggcgauauucugcuccacacaggggacuuuaccgaacuuggacugccauccgaggugaagaaauucaaugauugguugggcaacuuacccuacgaauauaagaucgucauagccgguaaucacgagcugacuuuugacaaagaguucauggcggaucuagugaagcaagacuacuaucgcuuuccuucuguuucgaagcucaaaccagaagauuucgacaacgugcagucacugcuuacaaauagcaucuaccugcaggauagugaggucaccgugaagggguuucgaauuuacggagcuccguggacgcccugguucaacggcuggggcuuuaauuugccucgugggcagucccuccuggacaaauggaaccugaucccagaaggaauugacauccucaugacucauggucccccuuuaggcuucagagauuggguaccaaaggagcugcaaaggguuggguguguggaacuuuugaauaccguccagcggcgcgugagacccaaacugcacguguuuggaggcauacaugaggucaacccgguuucuauuagcaaggcccuaaggacaaagaucugcucccucccuucaaaaaccaguuga

SEQ ID NO: 59173 - RNA, 3117 nt, Artificial Sequence
  derived and/or modified sequence opt3 from MPRIP__Homo_sapiens__NP_055949
augagcgccgcuaaggagaaccccugcagaaaauuccaggcaaauaucuuuaacaaguccaaaugucaaaauugcuucaagccuagggaaucucaccuacucaacgacgaggaucuuacccaggccaaaccaauuuacggcggguggcuguuguuagcgccggacggaacagauuuugacaaucccgugcaucggucacgcaaguggcagcgacguuucuuuauacuguaugaacacggucuacucagauacgcucuggaugagaugccuacuacgcuuccacagggcaccaucaacaugaaucaauguacagacgucguugauggggaaggaaggacuggccagaaguucagucugugcauuuugacccccgagaaagagcauuuuauccgggccgaaacaaaggagauugugagcgguuggcucgaaaugcugaugguauauccucgcaccaacaaacagaaucagaagaaaaagagaaagguggagccacccacuccucaagagccagggccggcaaaagucgccgugacauccucuucgucaagcaguuccucuagcuccucaauccccagugcugaaaagguuccuaccacgaaaagcacucuguggcaggaggaaaugaggaccaaggaccagccagauggaucuucccucucacccgcacagagcccuagucaaucucagccacccgccgcuuccagcuuacgggagccgggccuggaaucgaaagaggaggaaucugccauguccucagaccgcauggauuguggccgaaaggugagagucgagaguggguacuucagccuugaaaagacaaagcaggacuugaaggcggaggaacaacagcugccucccccacuauccccucccucuccaagcacucccaaccacaggcggucacaggugauagagaaauuugaggcacucgauaucgaaaaggccgagcauauggaaaccaaugcuguaggaccuaguccauccagcgacacacgucagggucgcucugagaaaagagccuucccgaggaagcgggacuuuaccaacgaagcacccccugcuccacugcccgaugccucagcgaguccucuuagcccacaccgacgcgccaaaucccuggacagaaggucuacggagcccucgguuacuccggauuugcucaauuucaagaagggcuggcugacaaaacaauaugaggacgggcaguggaagaaacacugguuuguguuagcagaucagagccugcgguacuaucgcgacuccgucgcugaagaggccgcugaucucgacggagaaauugaucuuucagccugcuacgacgugaccgaguacccugugcagagaaacuauggcuuccaaauccauacuaaggagggugaguucacacugagugcaaugaccucugggauuaggcguaauuggauccagacgauaaugaaacacguccauccaaccacagcccccgauguuacuagcuccuugccugaagaaaagaacaagucaagcuguucuuuugagaccugcccccggccaacagaaaaacaggaggcugagcuaggagaaccugaccccgagcagaagcgauccagagcgagggaacgccggagagagggcaggaguaaaacuuucgacugggcagaauuucgcccaauucaacaggcccuggcucaggagcgagugggcgggguaggaccggccgauacccacgagccucuccggcccgaagcagagccaggugaacuggagcgugaaagagccaggcgccgggaggagagaaggaagcgauucggcaugcuugacgcuacagaugggcccggaaccgaagacgccgcacugcgcauggagguggaucggagcccuggcuugccaaugucugaccucaaaacucacaacguccauguggaaaucgagcagagauggcaccaaguugagacgacaccccugagggaagagaaacaggugccuauugcgccgguccauuuauccucagaagaugguggggaccgucugaguacccacgagcuaacuagccuccuggaaaaggagcuugagcagucgcaaaaagaggcuuccgauuugcuggaacagaaucgccuccugcaggaccagcuucggguggcccugggcagagaacaaucugcaagggagggauacguauugcaggccaccugugaacgaggcuuugcugccauggaggagacacaucagaagaaaaucgaagaucuccagcggcaacaccagcgcgagcuggaaaaguuaagagaggaaaaagacaggcugcuagcagaggagaccgcugccacuaucagcgcgauugaagccaugaagaacgcucaccgggaggaaauggagcgagagcucgaaaaaucacagagaagucagauauccucuguuaauagcgauguggaggcacugcgcaggcaauaucuugaagaguugcaguccguccagcgugaacuggaggugcucucagagcaauacagccagaagugccuggaaaacgcccauuuagcucaggcccuggaggcagaacggcaggcgcuuagacaaugucagagggagaaucaggaauugaacgcccacaaucaggagcucaacaaucgccuggcugccgagaucacacgacuaagaacgcugcucaccggggacggagguggcgaagcaacugggaguccacuggcucaaggaaaggacgccuaugagcuugaagucuugcugcgggugaaagagucugaaauucaguacuuaaagcaggagaucuccagccucaaagaugagcugcagacagcacuuagggacaagaaauaugccucggauaaguacaaggacauauacaccgaacugucaauugcuaaagcgaaggccgauugcgacaucucucgcuugaaagagcaacucaaggcagcuacagaagcccugggcgagaaaagucccgauuccgccacuguuagcgguuaugacaucaugaagucuaagagcaacccugauuuccugaaaaaggaccguuccugcgugaccagacagcugcggaauauuaggucaaaaagucucaaggaggggcugacgguacaggaacgccuuaaauuguuugagagccgagaucugaagaaggacuga

SEQ ID NO: 59174 - RNA, 894 nt, Artificial Sequence
  derived and/or modified sequence opt3 from MPST__Homo_sapiens__NP_001123989
auggccagcccccagcugugcagagcucucguguccgcacaaugggucgccgaggcgcuuagggcuccucgggccggccagccacugcaguuguuagacgcaucuugguaccugccgaagcuagggcgcgaugcccgacgugaguucgaggaaagacacauccccggagcugcauuuuucgacauugaucaguguucagacaggaccaguccuuaugaucauaugcucccaggugccgagcacuuugcugaauacgccggccggcuggggguuggagcggcaacacaugugguaauauaugacgccagcgaucaaggccuuuacuccgcuccccgcgugugguggauguucagagccuuuggucaccaugcagucucucuguuggacgggggacucaggcacuggcugcggcagaaccugccucucucgucaggcaaaagccagccagcucccgccgaguuccgcgcgcaguuagauccugccuuuaucaagacuuaugaggacauuaaagaaaaucuggagagucgaagauuccaagugguugauuccagggcaacgggccgguuucgugggaccgaaccagagccgcgcgacggaaucgagcccggucacauuccuggcacagugaacaucccauucacugauuuucuuucucaggaaggguuggaaaagagccccgaagagauaagacaucuguuccaggagaaaaaggucgaccuauccaagccucucguggcuaccugcggaucaggcguaacagccugucacguugcucugggugccuaccuuugcgggaaaccagacgugcccaucuaugauggaaguugggucgaaugguacaugagggcacggccggaggacgugauuagcgaaggccgaggcaagacccauuga

SEQ ID NO: 59175 - RNA, 531 nt, Artificial Sequence
  derived and/or modified sequence opt3 from MPV17__Homo_sapiens__XP_005264383
auggcccuguggagagcuuaccagagggcacucgccgcgcaccccuggaaggugcaaguccuuaccgcuggcagccugaugggguugggagacaucauuucccagcaguuaguugagcggcgcggucugcaggaacaucaacgaggccguacacuaacuauggugucucucgggugcggauucguaggcccuguggucggugggugguauaaagugcuggauagauuuauaccaggaacgaccaagguugacgcccuuaaaaagaugcuguuggaucagggcggcuucgcaccguguuuucucgggugcuuccugccccuggugggagcccucaacgguuuaucagcucaggacaauugggcaaaacugcagagggauuacccugacgcccuuaucacaaacuauuacuuguggccagcuguccaacuggccaauuuuuaucuagugccccuccacuaccggcuggcgguaguucaguguguggcagucauuuggaacaguuaucuuagcuggaaggcccaucgccuguga

SEQ ID NO: 59176 - RNA, 621 nt, Artificial Sequence
  derived and/or modified sequence opt3 from MPV17L2__Homo_sapiens__NP_116072
auggccagaggcggguggaggcggcugcgccgacuccuuagcgcuggacagcuguuguuccaaggucgugcauuacuggugaccaacacacuaggcugcggggcccucauggcggcuggagacggcgucagacaguccugggaaaucagggcccggcccggucagguuuuugauccucgcagaucugcaucaauguucgccgugggguguaguaugggaccauuucugcacuacugguaucuuagccuggacagguuguucccggcuuccggccuccggggcuuucccaauguacugaagaaagugcuggucgaucagcucguggcaucuccuuuacuggggguuugguacuuccuuggauuggguugccuggaaggccaaacugugggggagucgugucaggaacuacgcgagaaguuuugggaguucuauaaagccgacuggugcgucuggccagcugcccaguuugugaacuuccucuuuguacccccucaguuccgaguuacguacauuaauggacugacccuuggcugggauacauaucugucauacuugaaguauagaagcccagugccccucacuccuccagguugugucgcgcuggacaccagggcagauuga

SEQ ID NO: 59177 - RNA, 747 nt, Artificial Sequence
  derived and/or modified sequence opt3 from MPZ__Homo_sapiens__NP_000521
auggcccccggcgcuccuagcuccucuccaucaccgauccuggcagugcuccuuuucaguagccuggucuugucccccgcccaggcgauuguuguguacaccgacagagagguacacggggcugugggaucuagggucacauuacauugcucguuuuggucaagcgaaugggugagugaugacauauccuucacuuggcgguaucaaccugaggguggccgcgaugccaucucuauuuuucacuacgcaaaggggcagccauauaucgacgaaguuggaacguucaaagagcguauucagugggugggcgauccccgauggaaggacgguagcaucgucauacauaaccuggauuacuccgacaaugggaccuuuacaugugaugugaaaaacccuccagacaucguaggaaagacuucacagguuacccuauauguguucgaaaaaguccccacaagauacggcguggugcucggcgccgucauugggggaguucugggugugguacuucuguugcuccugcuguuuuauguggucagguacugcuggcuccggcgccaagcugcauuacagagaaggcugagugccauggagaagggcaaacuucacaagccugggaaggaugcuagcaaacggggacgccagaccccaguguuguacgccaugcuggaccauucucgauccacuaaggcgguuucagagaaaaaggcaaagggccuaggugaaagcagaaaagauaagaaauga

SEQ ID NO: 59178 - RNA, 360 nt, Artificial Sequence
  derived and/or modified sequence opt3 from MPZL1__Homo_sapiens__NP_001139663
auggccgcuagcgcaggcgccggggcggugaucgcugcccccgacuccagaagguggcuguggucuguccucgcagccgcucuuggacuguugaccgccgguguuucagcauuagagguguacacaccuaaggaaauuuucguagcuaacggcacucaggggaaacugacgugcaaguuuaaaaguaccagcacaacuggaggccuaaccuccgugucuuggucguuccaaccagagggugccgauacaaccgucucagggccggugauauaugcgcagcucgaccacagcggaggccaucacagugauaagaucaauaaauccgaaucuguuguguacgcagacauucggaagaacuga

SEQ ID NO: 59179 - RNA, 648 nt, Artificial Sequence
  derived and/or modified sequence opt3 from MPZL2__Homo_sapiens__NP_658911
auguacggcaagagcuccaccagagccgugcugcuccuucuggggauccaguugacagcuuuauggcccauugcagccgucgagauauauacuucuaggguucuggaagcggugaacggaacggacgcucggcuaaaaugcaccuucucaaguuuugccccuguaggugaugcacucacagugacuuggaauuuccgcccacuggacggcgggccggagcaauuugucuucuacuaucacaucgaucccuuucagccuaugagcggacgauucaaggaccguguguccugggauggcaacccagaaagauacgacgccucuauucuucuguggaaauugcaguuugaugacaaugguaccuauacaugucagguuaagaaucccccugauguggacggggucaucggagagauuaggcucucggugguacauaccguucgguucucagaaauccacuuucuggcucuggcaauaggcagcgccugcgcucucaugaucauuaucgugauugucgugguguuauuccaacauuaccgcaaaaagagaugggccgagagggcgcacaaggucguugagaucaaaaguaaggaagaggaacggcugaaccaggagaaaaagguguccguauaucuugaggauacugacuga

SEQ ID NO: 59180 - RNA, 672 nt, Artificial Sequence
  derived and/or modified sequence opt3 from MPZL3__Homo_sapiens__NP_001273081
augcagcaaagaggcgccgcugggagcaggggaugcgcacuguucccccuccuuggugugcuguuuuuccaggacgcccacguccggggcuacguuggggagaagaucaaauugaaguguaccuuuaaauccacaucugaugugacugacaaguuaacgauugauuggaccuaucgcccuccaucaaguagccauacaguauccauauuccacuaccagucuuuucaguauccgacuaccgcgggaacauuccgagaccguaucucgugggugggcaacgucuacaaaggugaugcuucaauuagcaucaguaaucccaccauuaaggacaacgggacuuuuuccugcgccgugaagaauccuccagauguucaucacaacauccccaugacagaacugaccgugacggagagaggauucggcacuaugcuaucuagcgucgcacuccuguccauacuuguguuuguaccuucagccguuguggucgcucuguugcucgugaggaugggccggaaagcagccgggcugaagaaacgcaguagaagcggauauaagaaaucuuccaucgaagugucagacgauaccgaccaagaggaagaggaggcuuguauggccaggcugugcguccggugugcggaaugccucgauagcgacuacgaggaaacauauuga

SEQ ID NO: 59181 - RNA, 891 nt, Artificial Sequence
  derived and/or modified sequence opt3 from MR1__Homo_sapiens__NP_001181928
augggcgagcugauggccuuccuccuuccccugaucauuguguugauggucaagcacagcgacuccagaacccauucuuuaagguacuuucggcuggggguuucagauccuauacacggagugccagaguucaucaguguagguuauguggacagccauccgauuacaacuuacgauuccgucacgcgccagaaagaaccccgagcuccuuggauggcagaaaaccuagccccagaccacugggagcguuauacccaacuccugagaggcuggcagcagauguuuaagguggaacuuaaaaggcugcagcggcauuacaaucacucugauaacguugcgcacacaaucaagcaggcuugggaggccaaucaacaugaguugcucuaucagaaaaacuggcuggaagaggaaugcauugcauggcugaagcgcuuccucgaguacgggaaggacacuuuacagagaaccgagcccccucuggugagggucaaucggaaagaaacauuuccaggagugaccgcccuuuucuguaaggcucacggcuuuuaucccccugagaucuacaugacuuggaugaaaaacggugaagagauaguacaagaaaucgauuacggggacauuuugccaucgggagauggcacauaucaggcaugggccucaaucgagcuggacccgcagagcaguaaucuauacuccugccauguugagcacuguggcgugcacaugguccuccaggugccccaagaaucugagaccauuccucuggugaugaaggcugucagcggguccaucguucuugugauaguacuggccggagugggugucuugguguggcgccgaagaccaagggaacagaacggcgcgauuuaucuccccacgccugaucgguga

SEQ ID NO: 59182 - RNA, 618 nt, Artificial Sequence
  derived and/or modified sequence opt3 from MRAP2__Homo_sapiens__XP_011533703
augagcgcccagagacugaucuccaacaggaccucucaacagucagcuaguaauagcgacuacacaugggaguaugaauacuaugagauuggccccguguccuucgaagggcucaaggcacacaaauacucuauagucaucggauuuuggguuggucuugccguguucguaauuuuuauguucuuugugcugacuuuguuaacgaagaccggcgcgccucaucaggauaacgcugagucgucagaaaaacgguuccgcaugaauagcuuugucagugacuucgggcgaccacuggagccggauaagguguuuucccgucagggaaacgaggaaucuagaagccuauuccacugcuauaucaaugagguugaaaggcucgaccgggccaaagcaugucaucaaacaacugcccuggauuccgacgugcagcuucaggaggcuauucgcucaaguggccagcccgaggaggaacugaacagauugaugaaguuugauaucccuaauuucgucaacaccgaccaaaauuacuuuggugaagaugaccuccugauaagcgagccacccaucgugcuggaaacaaagccucucucucagaccucccacaaagauuuagacuga

SEQ ID NO: 59183 - RNA, 519 nt, Artificial Sequence
  derived and/or modified sequence opt3 from MRAP__Homo_sapiens__NP_848932
auggccaacggcaccaaugcuagcgcacccuacuauuccuacgaguauuaccuggacuaucucgaucuuaucccuguggacgaaaagaaacugaaggcccacaaacauucuauugucauagcguucuggguuucauuggcugccuuugugguauuacuguuccuaauccuccuguacaugaguuggagcgcauccccacagaugagaaacucuccgaagcaccaucaaacaugccccuggucgcacgggcuuaaucugcauuuguguauucagaaaugccucccuugucacagggagccacuggccacuucacaggcucaggcaagcaguguggaacccggaucccggacggguccugaucaaccacugcgccaggagucuagcuccacccuccccuuaggcggguuucagacacacccuacucugcuuugggaauugacccugaacggaggcccgcuaguccgaucaaagccaagugagcccccuccaggugaccguacaagccagcuccaaucuuga

SEQ ID NO: 59184 - RNA, 627 nt, Artificial Sequence
  derived and/or modified sequence opt3 from MRAS__Homo_sapiens__NP_001239019
auggccaccagcgcugugcccuccgacaaccugccuacauacaagcucgucguugugggcgaugggggaguagguaaaucugcacuuacuauccaguucuuucaaaagauuuucgugccagacuaugauccgacgauagaggacucauaccugaaacacaccgaaaucgauaaucagugggccauuuuggacgucuuagauacagcgggccaggaggaauuuagugcuaugagagagcaguauaugaggacuggggacggauuccugaucguguacagcguuaccgauaaggccuccuuugaacauguggaccgguuccaccaacuaauucuccgcgucaaagaucgagagucuuuucccaugauccugguggcaaacaagguagaccuuaugcaucugcguaagauaacaagagagcagggcaaagaaauggccaccaagcacaauaucccuuauauugagacuucggcuaaagauccacccuugaacguugacaaggcauuccaugaccucgugagggucauccggcagcagauuccugaaaaaucacaaaagaagaaaaagaaaacaaaguggcgcggugauagagccaccgggacgcacaaacugcagugcgugauccuguga

SEQ ID NO: 59185 - RNA, 4371 nt, Artificial Sequence
  derived and/or modified sequence opt3 from MRC1__Homo_sapiens__NP_002429
augagacugccccuccuucugguguucgccagcgucaucccuggcgcuguuuuguuacuggacaccaggcaguuucuaauuuacaacgaggaucacaagcggugcguggacgcaguauccccaucugccgugcaaacagcggcuuguaaucaggaugccgaaucacagaaauuccgcugggucagugagagccagauaauguccguggcauuuaagcucugccuggggguuccgucuaaaacugacuggguggccaucacgcuuuaugcuugugauucgaagucagaguuccaaaaaugggagugcaagaacgacacccuguugggaauuaagggugaagaucucuuuuucaauuacggcaaccgacaggagaaaaauaucaugcuguauaaggggagcggacuguggagucguuggaaaauuuacggcacaacugacaaccucuguuccagagguuaugaggcaauguacaccuuacuggggaaugccaacggagcuacaugcgccuuucccuucaaguuugaaaauaaaugguaugcggauuguaccucugcaggcaggagcgacggcuggcuuuggugcgggacuacaaccgauuacgacacggauaaguuguucggauacuguccucugaaguuugaggguuccgaaucacuauggaacaaagacccacucaccagugucagcuaucagaucaauucuaaguccgcccugacuuggcaucaggcucggaaaucaugccaacagcagaacgccgagcuucugagcauaacagagauccacgaacagacuuacuugaccggccucacaaguucucugaccuccggguuauggauuggacugaauagccucucguucaacucuggcuggcaaugguccgaccgcucacccuuuagauaucuuaauuggcugccugguaguccaagcgcagagcccgggaaguccugugugucuuugaacccugggaaaaacgcuaagugggaaaaucuagagugcguacagaaacugggcuacaucugcaagaagggcaacacgacucucaauagcuucguuauuccaucagaaagugaugugccgacacauugucccucccagugguggccuuaugccgggcacugcuacaaaauccauagggacgagaagaaaauacaacgggaugcgcugaccacuugucgcaaggagggaggugaccuuacaagcauucacaccaucgaagaacuggauuucauuaucucucaguugggcuaugaaccaaacgacgagcucuggaucgggcugaaugauauuaaaauacagauguacuuugaauggucagacggaacgcccgucaccuucacaaagugguuacgaggcgagccuagucacgagaacaauagacaggaagauugcguggugaugaaggguaaagacggguacugggccgauaggggcugugaguggccacugggauauaucugcaagaugaaaagccggucccaaggccccgaaauugucgagguugaaaaggggugucguaaaggauggaagaagcaucacuuuuacugcuauaugaucggucauacucuaucuaccuucgcagaggcuaaccagacauguaauaacgagaaugccuaccucacuaccauagaagaccgcuaugagcaggcuuuucugacaucguucgugggccuuagaccggaaaaauacuuuuggaccggguugagcgacauucagacuaagggaacguuccaauggacaaucgaggaggaaguaagguuuacccacuggaacuccgauaugccuggccggaaacccgguugcguggccaugcgaacugggaucgcaggcggacugugggacguccucaagugugaugagaaagccaaguucgugugcaagcacugggcugaaggcguuacccauccaccuaaacccacaaccacuccagagcccaagugcccugaagacuggggagcgucaagucgcacaucucuguguuuuaaacuuuaugcaaagggaaaacacgagaagaaaacgugguucgagagcagagauuuuugcagggcccuggguggcgacuuggcuuccauuaauaacaaggaagaacagcagaccaucuggcggcucauuacugccucagggagcuaccauaagcuguucugguuaggacugacauacggcucuccauccgaagguuucaccuggagugaugggagcccggugucuuaugagaauugggcauacggcgaacccaacaacuaucagaaugucgaguacuguggagagcuaaaaggcgacccuacaauguccuggaacgauauaaauugcgaacaccucaacaauuggaucugucaaauucagaaggggcagacuccaaaacccgagccuaccccagcuccccaggacaacccgccugugacggaagauggauggguaaucuauaaggacuaccaauauuacuuuucaaaagagaaggaaaccauggauaaugcccgcgccuucugcaagagaaacuuuggcgaccugguuaguauccagagcgagucggagaaaaaguuccuuuggaaauacgugaauaggaacgacgcacaguccgcguauuuuauugguuugcugauaucucucgauaagaaauucgcuuggauggacgggagcaaggucgauuacgugucaugggccacaggagaaccaaauuuugcaaacgaggacgaaaauugugucacuauguauaguaacuccggcuucuggaaugauaucaacugcgguuaccccaacgccuuuauuugucaacgucauaauucuagcaucaacgcuaccacagugaugccuacuaugcccuccguuccaucaggcugcaaggagggguggaauuucuauagcaacaaauguuuuaagauuuucggauuuauggaggaggagcggaaaaauuggcaggaagcccgaaaggcaugcaucggcuucgggggaaaccuggugaguauacagaaugagaaagaacaggcuuucuuaaccuaccacaugaaggacucuacguuuuccgccuggacaggccugaacgauguaaauagcgagcacaccuuccuuuggacugacgguagagggguccauuauacaaacuggggaaagggcuacccugguggcaggcgcucgucauugucuuacgaggaugcggacugcgugguuaucauugggggagccaguaaugaagcuggcaaauggauggaugacaccugugauuccaagcggggguauaucugccaaacuagaagcgaccccucucucaccaacccaccggcaacaauucagacggacggauuugugaaauacggcaagagcuccuauucacugaugaggcagaaauuccaguggcacgaggccgaaaccuacuguaagcuacauaauagucugaucgcuagcauacucgauccuuauucuaacgccuuugcauggcugcaaauggagacuuccaaugaacgcgucuggauugcgcuuaacucaaacuugacagacaaucaguacaccuggacagauaaauggcgagugcgguauacuaacugggccgcugacgagcccaagcugaagagugccugcguauacuuagaucucgacgguuacuggaaaaccgcacacuguaaugagagcuucuauuuucugugcaagcguuccgaugaaaucccagcuacggagcccccucagcuuccagggagaugucccgaaucugaccacacagccuggauuccuuuccauggacacugcuacuauaucgagucgagcuacaccaggaacuggggccaggcaucacuggaauguuugcgcauggguuccagucucgugucuauagagagcgccgcugaguccucauuucugucuuaucggguugaaccgcuaaaaagcaagacuaauuucuggaucggccuguuuagaaacgucgaggggaccuggcucuggauuaauaacaguccaguguccuucgugaauuggaacacaggagaucccagcggcgaaaggaaugacugcgucgcgcugcaugccucuucaggguucugguccaacauccacuguaguagcuacaaaggauauauuugcaagcgaccuaagaucauagaugcaaaaccaacucaugagcuuuugaccacaaaggcugacacgcgcaaaauggaccccucgaagccuucuuccaauguugccggcguggugauuaucguaauccuguuaauucucaccggugccgggcuggcugcauacuuuuucuacaaaaagcggagaguccaccuuccgcaagagggagccuuugaaaacacucuguauuucaauagccagucaagucccggcacaucugauaugaaggaccuagugggcaacaucgagcagaaugaacacuccguuauuuga

SEQ ID NO: 59186 - RNA, 4440 nt, Artificial Sequence
  derived and/or modified sequence opt3 from MRC2__Homo_sapiens__NP_006030
augggccccgggagaccugccccagcuccguggcccaggcaucugcuccggugcgugcuucuguugggauguuuacaccugggucgcccuggcgcaccaggggacgccgcgcuacccgagccuaacgucuuccucaucuuuagccacggacugcagggcugccuugaagcucaaggugggcagguucgagugaccccagccuguaauacaucccugcccgcacagcguuggaaguggguaucuagaaacagguuguucaaucucggaacuaugcagugccugggcacgggcuggccugggaccaacacaacugccucacugggaauguacgagugugaucgggaagcucucaauuuacgcuggcauugcagaacccugggugaccaacuuaguuugcugcuaggcgcaaggacaagcaacauuuccaaaccagggacccucgagcggggagaucagacucgcucuggccaguggcgaauauaugguucggaagaggaccugugugcccuuccguaccacgagguguauacaauccagggcaauucacauggaaagcccugcaccauuccuuuuaaauacgauaaccaaugguuccacggcuguacgagcacuggcagagaagacgggcaccuguggugcgcuaccacacaggauuauggaaaggacgagaggugggguuuuuguccaaucaaaaguaaugauugcgaaacuuucugggacaaggaucaguugaccgacuccugcuaccaguuuaacuuccaaucuacacucagcuggcgggaggccugggcguccugugagcagcagggcgcagaucuguuaucaauuaccgaaauccaugagcaaacguauauaaaugggcugcucacuggauacaguagcacacuuuggaucggccugaacgacuuggacaccucugguggguggcagugguccgauaauucaccccuaaaguaccugaacugggaaagcgaccagccugauaauccaagugaggaaaacugcggcgucauucguacugagucuuccggaggcuggcagaaccgcgacuguagcaucgcccuccccuaugugugcaaaaagaaaccgaaugcuacagccgagccuacgcccccagauagaugggcaaacguuaagguggaaugugagccuucguggcaacccuuucaggggcacugcuacaggcugcaggcugaaaaacggucuuggcaggaguccaagaaggccugucuucgaggagguggcgaccuggucucaauucauaguauggcggaauuggaguucaucaccaaacaaauaaagcaggagguggaggaacucuggauugggcugaaugauuuaaaacugcagaugaacuuugaauggagcgacggaucccuaguaucuuucacccacuggcacccauuugagcccaauaacuuccgcgauagccucgaagacugcguuacaaucuggggcccugaggguagauggaaugauucaccauguaaccagagucugccguccauuugcaagaaagccgggcaacuuagccagggcgcagcugaggaagaccauggauguaggaagggcuggacuuggcacucucccucaugcuauugguugggggaggaccaggugaccuacagugaagcccggcgccugugcacagaucauggaagccagcucgucacuaucaccaauagauucgagcaagcauuuguguccucucugaucuauaacugggagggugaauacuucuggacagcccuucaggacuuaaauucgaccggcagcuuuuucugguuguccggggaugaggugauguauacucacuggaacagggaccagccuggauacucacguggcgguugugucgcacucgccacggggagugcuaugggccugugggaaguuaaaaauugcacaucuuuucgggcgcgauacauuuguagacaaagccugggaaccccagugacucccgagcugccuggcccagaucccaccccgucccuaacagggucaugcccucagggaugggcaagcgacaccaagcucagguauuguuacaagguauucucuuccgaacgccugcaggauaaaaagaguugggugcaggcccaaggcgcuugccaggagcuuggugcccaguugcugagccucgcaucuuaugaggaggaacauuuugucgccaacaugcugaauaaaauauucggggaauccgagccagaaauccacgagcagcacugguuuuggauuggauuaaaccggagagaccccaggggcggucaaucauggcgcuggagugauggcgugggguucagcuaccauaacuuugaccgaucgcggcacgaugacgaugacauccguggaugugcuguucuggaccuugccuccuugcaguggguggcaaugcagugcgauacucagcucgacuggauauguaagauuccuagaggcacagaugucagggagcccgacgauucuccacaagggcgccgggaauggcugagauuccaggaggcggaauauaaauuuuucgagcaucacagcacgugggcucaggcccaaaggaucugcaccugguuccaggcagaacuaacuucagugcacagucaggccgagcuggacuuucucucccauaaucugcagaaguucucucgagcucaagagcagcacugguggaucggacuucauacaagcgaauccgauggccgcuuucgguggaccgacgguucaauuaucaacuucauuagcugggccccugggaagcccagaccaguaggaaaagauaagaaauguguuuacaugacagcaaguagggaggacuggggcgaucagcguugcuugacugcucugccguauauaugcaagcgcucuaaugugaccaaagaaacgcagccucccgacuuaccaaccacagcccucgguggcugucccuccgauuggauccaauuucugaacaagugcuuccagguccaggggcaggagccucaaagccgggugaaguggucggaggcgcaguuuucaugugaacagcaggaggcccaacuugucacuauuaccaauccacuggaacaggcuuucaucacagcaucuuugcccaacgugacuuuugaccucuggaucggacugcacgccagucagagagacuuccaauggguugagcaggaaccucuaauguacgcuaauugggccccgggcgagccauccgggcccagcccugcaccaucuggaaacaaacccaccagcugcgcggugguacugcauuccccuucagcccacuuuacggggaggugggaugaccgaaguuguacagaggaaacccacgguuucauuugccagaaggggacugauccgagccucucucccuccccagcugcccugccucccgcaccaggaacagagcuuucauacuugaauggcaccuuucggcuguuacagaaaccucuccgcuggcaugacgcucugcuucugugugaaaguagaaacgccagccuagcauauguccccgauccauacacucaagccuuccucacccaggcugcgaggggucugcggacaccguuguggauaggccuggccggggaggaaggaucccgaagauauucuugggugucggaggagccuuuaaauuacguuggcuggcaggacggggaaccccagcaaccaggaggcugcacguauguggaugucgacggugcauggcgcaccacuagcugugauacaaagcuccagggggcugugugcggaguaucauccgggcccccuccacccaggcguaucaguuaccacggcucuuguccucagggccuggccgacagcgccuggauuccguuccgggagcauugcuauuccuuucacauggaacuucuguugggacauaaagaggcuagacagaggugccaacgcgcugguggcgccgugcucucaauccuggaugaaauggagaacguuuucgucugggagcaccuacagucuuacgaagggcagagccgaggagcguggcugggcaugaauuuuaacccaaagggugggacccuuguguggcaagacaauacagcugugaacuacaguaacuggggacccccuggccucggccccuccaugcugagccacaauucuuguuauuggauucagucaaacuccggguuguggagaccaggagccugcacuaauaucaccaugggugucguuuguaagcugccucgggcagagcagaguagcuucucgcccucugccuuaccagaaaacccugcugcacucguggugguacugauggccguccuucuguugcucgcgcugcuaacggcugcccugauacuuuacaggcgccgucaguccaucgagagaggcgcauuugagggggcccgguauagcaggucaaguucuuccccgacagaagcuaccgagaaaaauauucucgugagcgacauggaaaugaacgagcaacaggaauga

SEQ ID NO: 59187 - RNA, 2043 nt, Artificial Sequence
  derived and/or modified sequence opt3 from MRE11A__Homo_sapiens__NP_005581
augagcaccgccgacgcucuggaugacgagaacacauucaagauccucguggcaacugauauucaccuuggcuuuauggaaaaagacgccgucagagggaaugauacguucguuacccuggacgagauauugagguuagcgcaggaaaacgagguggauuuuauccugcuaggaggugaccucuuccaugaaaauaagcccucccggaaaacacugcacacuugccuugagcuguugcgcaaguacuguaugggcgaucgaccuguacaauuugagauucucucugaccagucagugaacuucggguuuaguaaauucccaugggucaauuaucaggauggaaaccugaauaucagcauuccgguguuuuccauccauggcaaccacgacgaucccaccggugcugacgcccugugcgcacucgacauauuaucuugugccggguucguuaaucauuuuggacguucgaugucaguggaaaagaucgauauuagcccuguccugcuucagaagggcaguacaaaaaucgcuuuguacggccugggguccauuccagacgagagacuauauaggauguucgugaacaagaaaguaaccaugcuccggcccaaggaagaugaaaauucuugguuuaaccuguucguuauccaccaaaaucgcagcaaacacggauccacuaacuucauaccugagcaguuucuugacgauuucauugaccuggugaucuggggucaugaacacgagugcaagauugcaccaacaaagaaugaacagcaguuguuuuacaucucacaacccggcaguagcgucgugaccucucucuccccuggggaggccgugaaaaagcaugucggacuguuaagaaucaaaggcaggaagaugaacaugcacaaaauuccacugcacacgguucggcaguucuuuauggaagauauagugcucgcuaaccauccggacaucuucaaucccgauaacccuaagguaacucaggccauucagucauuuugucuugagaaaaucgaggaaaugcuggagaaugcggaacgcgagcgauuggguaacagccaccaaccagaaaagccccuagugagacugagggucgacuauagugggggauucgagccuuuuucugugcuccgguucucccagaaguuuguugaucguguggcaaauccaaaagacauaauucauuucuuucgccacagagagcagaaggagaaaaccggcgaggaaaucaacuucggcaagcugaucacaaaacccagcgaggggacuacccuuagggucgaagaccuggugaagcaauacuuccagacagccgagaagaauguacaguugucgcuccugaccgagcggggaaugggugaagcuguucaggaguuuguggauaaagaagagaaggacgccauugaggaauuagucaaauaucaacuggagaagacgcagcgauuccuaaaagaacgccauaucgaugcacucgaggacaagauugaugaagaggugagaagguuucgggagacucgccagaagaacacaaaugaagaggacgaugaagucagagaggcuaugaccagggcccgugcgcugcggucucaguccgaagagucagccagugcauucagcgcugacgaucuuauguccauagacuuggccgagcaaauggcuaacgauucugacgauagcaucucagccgcaacuaauaaaggccgagggagaggaaggggccgccggggugggagaggccagaacagugccuccaggggaggcagccagcgcgggcgagcuuuuaagucuacacggcagcaaccgucacguaaugugaccacgaaaaacuacagugaaguuauugagguggacgaaagcgacguagaggaagauaucuucccuaccacauccaagacugaccagagauggucuucgaccagcuccucaaaaaucaugagucagucucaggucagcaagggaguggauuuugaguccucagaggacgaugacgaugaccccuucaugaauacaagcucucugaggcgcaaccggagauga

SEQ ID NO: 59188 - RNA, 645 nt, Artificial Sequence
  derived and/or modified sequence opt3 from MREG__Homo_sapiens__NP_060470
augggccugagagacuggcucaggaccgugugcuguugcugugggugcgagugucuugaagaacgggcccugcccgaaaaggagccuuuggucagcgauaacaauccauacuccucuuucggagcuacauuaguucgcgacgaugagaaaaaccuguggucaaugccgcacgacgugagucauacugaggcagaugacgaucgaacgcuauauaaucucaucguaauucguaaccagcaagccaaggacagcgaggaauggcagaaacugaauuacgauauacacacccuuagacaggugaggcgggagguccgcaacagauggaagugcauccuggaagacuuggguuuucagaaagaggcggauucccuccugucugugacaaagcugucgacuauuucagacagcaagaauaccaggaaagcucgggagaugcucuuaaagcuggccgaagagacaaacaucuuccccaccaguugggaacuuuccgagcgcuauuuguuuguuguggaucgacugauugcacuagacgccgcugaagaguucuuuaaacucgcaagaaggacuuacccuaagaaaccaggcguccccugucuggccgacgggcaaaaggagcuucauuaucugccuuucccaucucccuga

SEQ ID NO: 59189 - RNA, 384 nt, Artificial Sequence
  derived and/or modified sequence opt3 from MRFAP1__Homo_sapiens__NP_150638
augagaccccuggacaucguggagcucgccgaaccugaggaagucgagguucuugaaccagaggaggauuucgaacaguuucuguugccggugauuaacgagaugagggaagacauagcuagcuuaacccgggagcacggacgcgcauaccugcgaaaucguuccaagcuaugggagauggauaacaugcucauccaaauuaaaacacagguagaagccucugaggaaucagcgcugaaucaucuucagaaccccggggacgcugccgagggcagagcagccaagaggugcgaaaaagcugaggagaaggcaaaagaaaucgccaagauggcugagaugcugguggaauugguccggcgcauugagaagagugaaagcuccuga

SEQ ID NO: 59190 - RNA, 615 nt, Artificial Sequence
  derived and/or modified sequence opt3 from MRGBP__Homo_sapiens__NP_060740
augggcgaggccgaaguugggggagguggcgcugcaggggacaagggacccggcgaggccgcgaccagcccugcugaagagacagucguuugguccccagaaguggagguaugccuguuccacgccaugcucggucauaaaccggugggggucaacagacacuuucauaugaucuguauuagggauaaguucucucagaauauaggacggcaagugcccucaaaaguuaucugggaccaccuuaguacuauguacgauaugcaggcacugcaugagagcgaaauuuugccuuuuccaaaccccgagcgcaauuucguguuaccugaagagaucauucaggagguccgagaaggcaaggugaugaucgaggaagagaugaaagaagagaugaaggaggacguagauccacacaacggcgccgacgauguguuuuccucuucggggucacugggaaaggcuagcgaaaagaguuccaaggacaaagagaaaaauucuagcgaucuagguugcaaagaaggcgcagacaagcguaagagauccagggugacggauaaaguccucaccgccaacucaaaucccaguagcccuucugcugccaagcggcgcagaacauga

SEQ ID NO: 59191 - RNA, 1032 nt, Artificial Sequence
  derived and/or modified sequence opt3 from MRGPRF__Homo_sapiens__NP_659452
auggccggcaacugcagcugggaggcucaccccgggaauagaaacaagauguguccuggacuguccgaagcaccagagcucuacucuagggguuuccuuaccaucgaacagauugccaugcugccgcccccugcggugaugaauuauauauuuuuguuacugugccuauguggccucgucgggaacggacugguucuuugguucuuuggcuucucaaucaaacggaauccauuuaguauuuacuuccugcauuuggcuagcgccgacguggguuaucucuuuuccaaggcaguauucucuauccugaacacagggggauuucugggcacuuucgccgauuacauucgcucggugugccgaguccucggcuuauguauguuucugacgggggugucacuuuugcccgcuguuagcgcagagcguugcgccagugugaucuucccugcuugguauuggagaaggcggccaaaacgccuguccgccgucgugugugcgcuacucuggguacugucucuucugguuaccugcuugcacaauuacuuuuguguguuccucggaagaggugcacccggcgccgcuugcaggcauauggacauauuccuggggaucuuacuguuucuccuuuguugcccucugauggucuugccaugccuagcccugauucuccacguggaaugucgggcacgccgaagacaaaggagcgcuaagcugaaccaugugauccuugccauggucuccguuuuccuggugucaaguauuuauuugggaaucgauugguuucucuucuggguauuucagauaccggcgcccuucccugaguacgugacagaccugugcauuuguaucaauagcucugccaaaccaauugucuacuuuuuagcaggccgggauaagucccagcgucugugggagccccuacgcgugguuuuccagagagcucucagggacggugccgaacugggggaggcuggaggcucaacuccuaacaccgugacaauggaaaugcaaugcccacccggcaaugccagcuga

SEQ ID NO: 59192 - RNA, 969 nt, Artificial Sequence
  derived and/or modified sequence opt3 from MRGPRX1__Homo_sapiens__NP_671732
auggaccccaccaucagcacacuggauacugagcucacgccuauuaacggcaccgaagagacacuuugcuauaagcagacucuguccuugaccguguuaacauguauagucucucugguugggcuaaccggaaaugccgugguacucuggcugcuugguugcagaaugaggcggaacgcuuucucaaucuauauucugaauuuggcagccgcggacuuucucuuccugaguggccgccugaucuacagccucuuauccuuuauuucuaucccacacacuauaucgaaaauccuguauccggugaugauguucucauacuuugcugggcuuagcuucuugagugccgucuccacagaacgaugucugucugugcuauggcccauuugguaucguugccauagaccuacccaccucagcgcaguuguguguguccugcuuugggcccuguccuugcucaggucaauccuggaguggauguuaugcggauuucuguucaguggcgcugauagcgcauggugucaaacgucugacuuuauuacuguggccuggcucaucuuccuuugcguaguucugugugguuccucauuggugcuacugauacggauucucugcgggagccgcaagaucccacugaccagacuuuacgucacaauucuguugacugugcucguguuucuguuauguggacugcccuucggcauccaguuuuuccuauuccucuggauccaugucgauagggaaguucuguuuugccacgugcaucuuguaaguauuuucuugucugcucugaacuccagcgccaauccuauaaucuacuuuuucgugggcucguuucggcagcgccagaaccgacaaaaucucaaacugguccuucagagagcgcugcaggacgcaucugagguggaugaagggggaggucaguugccagaggagauucucgaacuguccggcucaagguuagagcaauga

SEQ ID NO: 59193 - RNA, 969 nt, Artificial Sequence
  derived and/or modified sequence opt3 from MRGPRX3__Homo_sapiens__NP_473372
auggacagcaccauccccgugcugggcacagagcucacuccuauuaacgggagagaagagacgccaugcuacaagcagacccuuuccuucacaggacugacuuguauagucucuuugguugccuuaaccgguaaugcugugguacuguggcuacucggcugcaggaugcggcgcaacgcagugucaaucuauauucugaaucuugucgccgcggauuuucuguucuugagugggcacaucauuuguagcccgcuccgacugaucaacauacgucaucccaucuccaagauucugucuccugugaugacauuuccauacuucaucggacucucgauguuaucagcuauuagcaccgaaagaugccugaguauccuuuggcccauaugguaucacuguaggcggccucgcuacuuguccucuguuaugugcgugcugcuaugggcccucagccugcuuagauccauucuggaguggauguuuugugacuucuuguuuucaggcgcaaauagugucuggugcgaaacuagcgauuucaucacaauugccuggcucguguuucuguguguaguuuuaugcgguucuucccuggugcuccuugucaggauccugugugggucacggaagaugccauugacccgccuauaugugacgauccugcucacugugcuggucuuccuucugugcggauugcccuuuggcauucaaugggcucucuucagccgaauacaucuggacuggaaaguuuuauuuugccacgugcaucugguaaguaucuuccuaucugcacucaacuccagcgccaauccuauuaucuacuucuuugugggcucguucagacagaggcagaaccggcagaaucugaaacuugucuugcaacgugcucugcaggauaccccagagguggacgaagggggagguuggcucccgcaggagacacuggagcuuucuggcucccgccuggaacaguga

SEQ ID NO: 59194 - RNA, 969 nt, Artificial Sequence
  derived and/or modified sequence opt3 from MRGPRX4__Homo_sapiens__NP_473373
auggaccccaccgugccugucuucggcacaaagcugacuccaaucaacgggagagaggaaacgccgugcuacaaucagacccucagcuuuacaguucuuacuuguauuauaucccuggugggauugaccgguaacgccguaguguuauggcugcuaggcuauaggaugcggcgcaaugcugucucuaucuacauucucaaccuggcagccgcggauuuccuuuuucugucauuccaaaucauucgauugccccuccgucugaucaauauaagucaccugaucagaaaaauucucgugagcguuaugacauuuccuuauuucaccggguuauccaugcugucugcuaucucgacugagaggugccuuucaguguuguggccaauuugguaccggugucgcagacccacacaucugagcgccgucgugugcguacuacucuggggacugagucuucuguuuuccauguuggaauggagguucugugacuuucucuucucuggcgcagauagcuccuggugcgagaccucagacuuuaucccuguugccuggcugauauucuuaugugugguccugugcgugaguagccucgugcuucugguccggauuuugugugguucucgcaagaugccacuaacgcgacuguauguuacuauccuccugaccgugcuuguauuucuguugugcgggcuccccuucggaauuuugggcgcuuuaaucuacagaaugcaccugaaccuagaagugcucuauugucaugucuaccuggugugcaugucccuuucaagccugaauaguucugcaaacccuaucauuuacuucuuuguuggcuccuucaggcagcggcagaaucgucagaaccugaaacucgugcugcaacgcgcccuucaggauaagccagaggucgacaaaggggagggacagcugccggaagagagcuuggaacucucggguucuagacugggccccuga

SEQ ID NO: 59195 - RNA, 1110 nt, Artificial Sequence
  derived and/or modified sequence opt3 from MRI1__Homo_sapiens__NP_001026897
augacccuggaggccaucagauacagcaggggcucccuccagauucuugaccaacuguuguuacccaagcagucucgguaugaagcuguggggucaguccaccaggcaugggaggccauacgcgcgaugaaaguucgaggagcuccugccaucgcacugguggguugccuaagucucgccguagaacugcaggcuggcgcagggggaccaggccuugccgcucugguggccuucguccgugauaaguugagcuuucucgugacagcgagaccgacugcaguuaacauggccagggcugcccgggaccuggcagauguggcugcccgcgaggcggaaagagagggugccacggaggaagcagucagggagcgggugauuuguugcaccgaagacaugcuggagaaagaucuccgcgacaaucgauccaucggggauuuaggagcuagacaucugcuugagaggguagcccccucuggcggcaagguuacaguguugacucacuguaacaccggggcucuggccacagcaggauacgguaccgcccuaggcgucauucggucgcuccauucacuggggcgucuugaacacgcuuucugcacugagacacgcccuuauaaucaaggagcgagacugaccgcauuugaauugguguacgagcagaucccagccacgcucauaacugacagcaugguggcugccgcaauggcccauaggggcgucagugcuguugugguaggugccgaucggguggucgcaaacggggacaccgcgaauaaagugggaacauaucagcuggcuaucguugccaagcaccacggcauucccuucuacguggcagccccuuccucuagcugugauuuacgacuggaaacuggcaaggagaucauuaucgaggaacgcccagggcaggagcucaccgacgucaacggagugagaauagcugcccccgguauuggcguauggaauccugcauuugauguuacaccacaugaccuuaucaccgggggaauuaucacggaacugggcguguucgcuccggaggaauugaggacugcccuaacaaccacuaucuccucacgggacgguacacuggaugggccccaaauguga

SEQ ID NO: 59196 - RNA, 1062 nt, Artificial Sequence
  derived and/or modified sequence opt3 from MRM1__Homo_sapiens__NP_079140
auggcccugcucagcaccgugagaggcgcuacaugggggaggcuugucacucggcacuucucccaugcagcccgccacggagagcgacccgguggcgaggaacugucucguuuguuacuggacgaucuaguuccuacgucaagacucgaacugcuuuuugggaugaccccaugccuguuggcgcuccaggcugccaggcggaguguggcacgccugcugcuccaagccggaaaggcuggcuuacaggguaaaagagcagagcugcuuaggauggccgaagcucgggacaucccgguauugcgcccccgaagacagaagcuggauacaauguguagguaccaggugcaucaaggggucugcauggaggugagcccucuacggccacgucccuggcgcgaggccggagaagcguccccuggcgacgauccacagcagcucuggcugguucuugacggcauucaggaucccagaaacuucggggcagugcugaggucugcccacuuuuugggagucgacaaagugauaacuucgcggcgaaauucauguccucucaccccaguaguuagcaagaguuccgcuggugccauggaggugauggaugucuucucuacagacgaucugaccggcuuuuuacaaacuaaagcacagcagggguggcugguggcuggaacagugggcugcccgagcaccgaagacccccaguccucagagaucccuauuaugaguugucucgaguuccuuugggaacgcccaacgcuguugguccuagguaacgaggggagcggacugucucaagaaguucaggccuccugccagcuccugcuuacuauccugcccagaaggcaauugccuccaggccucgagucacugaaugugagcguagcggccggcauuuuacugcauaguaucuguucucagcggaagggguuucccaccgaaggagagcgcagacagcuacuccaggauccgcaagagccuuccgcaaggagcgaaggucugucgauggcucagcaccccggccuuucuuccgggccagagaaggaacgucagaacgagggauga

SEQ ID NO: 59197 - RNA, 4758 nt, Artificial Sequence
  derived and/or modified sequence opt3 from MROH2B__Homo_sapiens__NP_775760
augacccugagcacagaggaauccaucgagauguucggcgacauuaaccucacucuugggaugcugaauaaggaagauauagugaacaaagaggacaucuacucucacuugacgucagucauucagaauaccgauaucuuagacgaugccauuguucaaagacugaucuauuacgcuaguaaggacaugagggauaacaauaugcuacgggaaauacgcaugcucgcaggagaggugcugguaagccuugccgcgcaugacuuuaacuccgugauguaugagguccagucuaauuuccgaauccuggaauugcccgaugaguuugugguucucgcucuggccgaacuggcaacaucguacgugucacagagcauuccuuucaugaugaugacucucuuaaccaugcagacaaugcugcgucuugccgaggacgagagaaugaaagguaccuuuugcaucgcuuuggaaaaguucaguaaagcaauuuauaaguacgucaaccacuggagggauuuuccauauccgcggcuggacgccaaucgccuauccgauaagaucuucaugcucuuuugguacauaauggagaaaugggcuccccuggccucuccuaugcaaacucuuagcauugugaaggcgcauggcccaacaguaucccuguugcuccacagagaagacuucaggggguacgcacugggacagguucccugguuacugaaccaguauaaagacaaggagaucgauuuucaugugacccagucacucaaacaaauucuuacggccgcuguccuguacgacaucggcuugccucggagucuacgccgaagcaucuucauuaaucugcuccagcagauauguagagccccagaacccccugugaaggagaacgagaugaaggcaucuuccugcuuucugauccuugcucacucaaauccaggugaacugauggaguucuucgaugaacaggugaggagcaacaaugaggccauucgggucgggaucuugacucuccugcguuuagcgguuaacgccgacgaaccgcgccugagagaucacauaauuaguaucgagaggaccgugaaaaucguaaugggagaccuaucuacaaaggugcggaacuccguccuccugcuuauucaaacuaugugugagaaaagcuauaucgaagcacgagagggcuggcccuugauugauuacguguuuucgcaguucgcuacccugaaucgcaaccucgaaaagccuguuaaaacaaauuuucaugagaacgaaaaggaggaggaaucugugagagagaccucccuggaaguccuuaaaacgcuggacccauuggugauaggcaugccccagguacucuggccuaggauccugacuuucguugugccagccgaguauacagaggcuuuagaaccccuguuuucaauuauccggauccuaauuauggccgaggaaaagaagcaacacagugcaaaagagagcaccgcccucgucguguccacuggggcugucaagcugccgucuccucagcagcuuuuggcgcgccugcucgugauaagcaugcccgcaucacugggagaauuaagaggugccggcgcuaucgggcugcuuaaaauuuugccagagaucauucauccuaagcucguugaucuguggaaaacaaggcuacccgagcugcuccagccacuggaaggaaagaauaucaguaccgugcuuugggagacgauguugcugcaauuacucaaggaaucccuguggaaaauaagcgacguagccuggaccauccagcuuacacaggauuucaagcagcaaaugggcucuuacucaaacaauaguacugagaaaaaguuucuguggaaagcauuggguaccacacucgccugcugucaggacagcgacuucgucaacucccagauuaaggaauuucugacugcucccaaucagcuaggggaucaacgucagggaaucaccucuauucugggcuauugcgccgagaaccaccucgacaucgugcugaagguucuuaaaacauuccagaaucaggagaaguuuuucaugaaccgguguaaaucguuguuuagcggcaagaaaucccugaccaagacugaugugauggucauauacggggcaguggcguuacacgcuccuaagaaacaacuccugucacgacuuaaucaggacauuaucagucagguacugucucuacauggacaaugcagccaggugcucgguauguccguuaugaacaaggauauggaccugcagaugucauucacgagaagcauuacagaaaucggcauagccguccaggaugcagaggaccaaggguuccaguuuucuuacaaagaaauguugaucggauauaugcuggauuucauuagggacgagccauuagauucccucgccaguccgauccgcuggaaggcucugauugccauccgguaccuuagcaaacugaagccccaguugucucuccaggaccaccugaauauacuagaagagaacauuagaaggcugcuuccucucccaccccuggagaacuugaaauccgaaggccaaaccgauaaggacaaggagcauauccaguuucuguaugaacgcucaauggacgcauuagguaaacuccugaagacuaugaugugggauaaugugaacgcugaggacugucaggagauguucaaucuucugcagaugugguuggugagucaaaaagaaugggagcgagaacgggccuuucagaucaccgcgaagguccucacaaacgauauugaggccccugaaaauuucaaaaucgggagccugcuaggccugcuugcuccacacucgugcgacacccuccccacuauucgucaggcagccgcuuccucuacaauaggacuguuuuacaucaagggcauucauuuggagguugagagauuacaagggcugcaggaaggacucgagagcgaugacguacaggugcagaucaagauuucaaguaaaaucgccaagauaguguccaaauucaucccgaacgaagagauucugauguuucuugaagagaugcuggaugguuuggagucucuaaauccuacguguaccaaggcaugcggcaucuggaugauuacuguccugaaacaacagggggcggcccucgaagaccagcugcuugagaucuuaggaacaauauaucaccacaugccagugcugaggcagaaggaagagagcuuccaauuuauucucgaagcuaucucccagaucgccucauuccauauggauaccguuguggucaacuugcugcagaagccccucccuuuugaccgcgauacaaaaacucuguggaaggcacuugcugagaaacccgccagcaguggcaagcuguugcaggcacuaauugacaaacuggagaccgaacucgaggaugacauagcccggguggaagcuaucucuguugcgugcgccauguacgaggugauuuccauggguacgagcguaaccggguuauauccagagcuguucacacuucugcucaaguuggucucguguacucugggccaaaagaugcuuaccugcccuuggucacacagaaggcaugugaugcagcagggagaacagcaacagauccccgacccaugucgacugucuacagcaacucuuaaaugccuacaggcucaagccaugcgcgagggccuggccaaggaaagugaugagggggacaauuuguggaccuuacuguccagcccgucuacgcaccacauuggaguguguagccucgcucgguccauggcagucuggcagcaugguguuauccuggauauaauggaacagcuucugucaagucucacaucuagcuccgagaacuacagaaucaccggcgccgcguucuuuucagaguugaugaaagaaccuauucuguggaagcacgggaaucuaaggaacgugcugauccucauggaccagagugcuugggauagcaaugccacucuucgucaaauggcaauucgcggacugggcaacacagccuccggugcuccccauaaaguaaagaaacacaagcaguuaauguuggagucuaucauacgggggcuguaccaucucgcaagaaccgaaguggucugcgagucgcugaaggcccuuaaaaagauucuggaacucuugacugacagggaugugagcuucuauuuuaaagagaucguucugcagacccgaacauucuuugaggacgaacaggaugacgugcgguuaacggcgaucuuccuauuugaggaucuggcuccacucaccggccgcagauggaagauuuucuuugccgaagagaucaaaaagucacuuauauccuuccuguugcaccugugggaccccaauccuaagauuggagucgcauguagggacgugcucaugguuugcaucccauuucugggccuucaagaacucuacggggugcuggaucgguugcuggaccaggauuuaccccgagccagagacuucuaucgccaguucugugucaaacuagcuaagaaaaaccaggagauucuguggauccuccacacucauaguuuuacauucuuuaccucuacaugggagguaauaaggagcgccgcagugaagcucacugaugcuguugugcugaacuugaccucccaauacgucgaacugcucgaccgugagcagcugacgacacggcuucaggccuuaagacaagauccuugcauuucagugcagagggcggccgaagcagcucugcagacccucuugcgccgauguaaagagacuucuaucccgcuguga

SEQ ID NO: 59198 - RNA, 633 nt, Artificial Sequence
  derived and/or modified sequence opt3 from MRO__Homo_sapiens__NP_001120647
auggccuggggcagcaaggggauccagggaugggagaaccuggcugaauccucucaccucgcaaccacaagagagucaagucccccugaaagcgguacuggcuccgggucuucgaggggaucacggcuucaagagccacaggugagcuggaaacugcgcuuccagaagcgagaaccguugaaaaaugucuuuuucauuuuagccgagcgugcgagagaccccagugcuaagaaaaggcauauggccaugcggaaccugggcacgauggcauacgaggccccugauaagguucgcaaguauaaaaagauagugcuagaccuccugguauacggucuuuaugauccagugaaucuggaagucauccacgaguccaugaaaaccuugacagugguucucgggaagauucagggaaaaggccugggcagcuuuuucaucgacauuacucugcaaaccagaacacucuuagaugacgcuugcaagaccacuuuucaggcauguucucccuaccugaaacuuaaggaagaguauuccuuccagucagaggaagaucagaggaacacaaaguuguaccaacagcugagucauuaucacccugagauccuacaguuuuucuacgccaauaaaauacucuga

SEQ ID NO: 59199 - RNA, 786 nt, Artificial Sequence
  derived and/or modified sequence opt3 from MRPL10__Homo_sapiens__NP_660298
auggccgcugcaguggccggcaugcugagagggggacuccuuccccaggcggguaggcugccuaccuugcaaacaguccgguacggcagcaaggcuguuacucgccaccgacgugugaugcauuuccagagacagaaauuaauggccguaacggaguauaucccaccgaagcccgcaauucacccuuccugccugccaucucccccuucaccaccccaggaagagauagggcuaaucaggcuccugcggcgcgaaauugccgcuguguuucaagacaacagaaugaucgcagucugucagaauguggcccuuagugcugaggauaaacuguugaugaggcaucagcuccggaagcacaaaauucugaugaagguuuucccuaaccaggugcugaagccauuucucgaagacagcaaauaccaaaauuuacugccgcuuuucgucggacauaacauguugcugguguccgaggagcccaagguaaaagaaaugguucgcauccuacgaaccgugccuuuucucccacugcuuggcgguugcauagaugacacaauccugucuagacagggguucauuaauuauucgaaguugcccucacucccucugguccagggagaguuagugggcggccugacuugucucaccgcccagacacacagccuucugcaacaccagccauugcagcuaaccacucugcucgaucaauacaucagggaacagcgggagaaagacagugugauguccgcgaacgggaagcccgauccggacacagucccugauucuuga

SEQ ID NO: 59200 - RNA, 579 nt, Artificial Sequence
  derived and/or modified sequence opt3 from MRPL11__Homo_sapiens__NP_057134
augagcaagcugggcagagccgcuagggggcuccggaaacccgaggugggaggugucauccgcgcaauuguucgagccggccuugcgaugccugggccaccgcugggacccguguugggccagcgugguguauccauaaaccaauucugcaaggaauuuaaugagagaaccaaagacaucaaggaagggauuccuuuaccaacaaaaauccuggugaagcccgauaggacuuucgagauuaagaucggacagccuacggucucuuacuuucuaaaagcugccgcaggcauagaaaagggcgcccggcagaccgggaaagagguggcuggacucguuacacugaagcacguguaugagaucgcacgcauuaaagcccaggacgaggcuuucgcccuucaagaugucccacugucaagugugguaagaagcaucauugguuccgcgaggucuuugggcauccggguugugaaggaccucucgucagaagaacuggcagccuuucagaaggagcgcgcuauauuccuggccgcacagaaagaggcugaucucgccgcgcaggaagaggccgcaaagaaauga

SEQ ID NO: 59201 - RNA, 537 nt, Artificial Sequence
  derived and/or modified sequence opt3 from MRPL13__Homo_sapiens__NP_054797
augagcuccuucucuagagcuccccagcaaugggccaccuuugcaaggaucugguaccugcucgacggcaagaugcagccuccagggaaacuugccgcgauggcuucaauucggcugcagggauugcacaagccgguguaucaugccuuaagugauugcggugaccacgucguuauaaugaacacacgccauaucgcauucagcggcaauaaaugggagcagaagguguacuccucucacacuggguaucccggaggcuuucgacaaguaacggccgcucagcugcaucuacgugauccuguggcaauugucaaacucgccaucuacgguaugcugccaaagaaccuucacagaaggaccaugauggaacggcugcacuuguuccccgacgaguauauuccugaagauauccucaagaaucugguggaggaacugccacagccccgcaaaauaccuaagagacucgacgaguacacacaggaggaaaucgaugcuuuuccaagguuauggacuccgcccgaggacuaucggcuguga

SEQ ID NO: 59202 - RNA, 891 nt, Artificial Sequence
  derived and/or modified sequence opt3 from MRPL15__Homo_sapiens__NP_054894
auggccggcccccugcaagggggaggugcuagagcacucgaccuucugaggggcuugccucgggugagcuuagccaaccugaagccaaauccgggguccaaaaagcccgagcgccgaccucguggaagaaggcggggccgcaaaugcgguagagggcacaagggagaaaggcagcggggcacccgcccacgacuaggcuucgaagggggacagacacccuuuuacaucaggauuccuaaauaugguuucaacgaaggccauucuuuuagacggcaguacaagccacucucacugaaucgucuucaguaucugauagauuuggggcgcgucgaccccagucaaccuaucgaucucacucagcugguuaacggaagaggcgugacgauucagccacugaagagggacuacgguguacagcucguggaggaaggggcggauaccuucacagcuaaagucaauaucgaggugcaauuagccagcgagcuggcaauugccgcuaucgaaaagaacggaggcguugugacuaccgcauuuuaugacccgcggucccuugauauagucuguaaacccgugccuuucuuuuugcgaggccagccaauccccaagcgcaugcugccuccagaggagcuaguacccuacuauacagacgccaaaaauagaggguaccucgcugauccggccaaguucccugaggcgaggcuggagcuugcacggaaguacggauauauucugcccgacaucaccaaagaugaauuguuuaagaugcucugcacucgcaaagacccaagacagauuuucuuuggucuggccccuggcuggguugugaacauggcugauaagaaaaucuuaaagcccacagacgagaaucugcucaaauacuauaccucuuga

SEQ ID NO: 59203 - RNA, 528 nt, Artificial Sequence
  derived and/or modified sequence opt3 from MRPL17__Homo_sapiens__NP_071344
augagacugagcguggccgcugcaaucucccacggcagggucuuccggcgcauggggcucggacccgagucucguauucaucuucugcgaaacuuguuaaccggucugguuagacacgaaaggauagaggccccuugggcgcggguggacgaaaugcgcggcuacgcugagaagcuaaucgauuaugggaaacucggagacacaaaugaaagagccaugaggauggcagauuuuuggcugacugagaaggaccuuauuccaaaacuguuccagguauuggccccgcgguacaaggaucaaacgggcgguuauacccgcaugcuccagauccccaaccgaucacuggacagagcuaaaauggcagugauugaguacaaggggaauugccugccuccacuccccuuaccuaggcgggauagucaucugacacuuuugaaccagcugcuacagggacuccgucaagaccugcgccagagccaggaagccuccaaucacucuucgcauacugcucagaccccaggcaucuga

SEQ ID NO: 59204 - RNA, 879 nt, Artificial Sequence
  derived and/or modified sequence opt3 from MRPL19__Homo_sapiens__NP_055578
auggccgcuugcaucgcagccggccacugggcggcuauggggcugggaaggagcuuccaggccgcaagaacccuccuucccccuccagccuccauugcuugucgggugcaugcagguccgguccgccaacagucuacaggccccucagagccuggggccuuucagccacccccuaagccaguuauaguggacaaacaccgacccguagaaccugagcguagauuccugaguccagaauuuaucccgaggcggggacgcacugaucccuugaaguuccagauugagagaaaagacauguuagaaaggcggaaggugcugcauaucccugaguuuuacgucggcagcauucuacgcgugacgaccgcugauccauaugccuccgguaaaaucucucaauuccucgggauaugcauccagcgaucgggaagaggccugggcgcgacauuuauucuuaggaacguuaucgaggggcagggaguggaaauuuguuucgagcuguacaauccccggguccaggaaauccaagugguaaaguuggagaagcgucucgacgauucacugcuguaucuccgcgacgcauuaccugaguacagcacuuuugauguuaacaugaaaccagugguccaggaacccaaucagaaggugccggugaacgagcugaaagucaagaugaaaccuaagcccuggaguaagagaugggaaaggccaaauuucaacauaaaagguauucgguuugaccuuugcuugaccgagcagcaaaugaaggaagcccagaaauggaaucagccuuggcuggaguucgauaugaugcgagaguaugacacauccaagaucgaagcugccauuuggaaagagaucgaagcaucuaagcgcagcuga

SEQ ID NO: 59205 - RNA, 978 nt, Artificial Sequence
  derived and/or modified sequence opt3 from MRPL1__Homo_sapiens__NP_064621
auggccgcugcagugagaugcaugggcagggcccugauccaccaucagcggcacagccucuccaagauggucuaccaaaccucucuuuguucaugcaguguuaacauucgcgugcccaaucgacauuucgcggcugccacaaaaagcgcaaagaaaacuaagaaaggggccaaggagaagacgccugacgagaaaaaggaugaaauagagaaaaucaaggcuuauccauacauggaaggagaaccggaggacgauguauaucugaaacguuuguaccccagacagauuuaugagguggaaaaggcaguccacuuacugaagaaauuucagauccuagacuucaccuccccuaagcagucuguguaccucgaucugacacuugacauggcccuggguaaaaagaaaaacguugagccauuuacuucgguguugucacuccccuauccuuucgcuagcgaaauuaauaaggucgccguguuuaccgagaacgcgagugagguaaaaaucgcagaagagaauggcgccgcuuucgccgggggaacaucccugauacaaaagaucugggaugacgaaauuguugcagauuuuuacguggcugucccagagaucaugcccgaacugaacaggcuccggaagaaauuaaauaagaaauacccuaagcugucucgcaacagcauuggcagagacaucccaaaaaugcuugaguuguucaagaauggucaugagauaaagguggaugaagagagggaaaacuuucugcagaccaaaauugccacucuagacauguccucagaucagaucgcggccaaucuccaggcagugauuaacgaggucugucggcaccgcccgcugaaucuugggcccuucguugugcgagcuuuucugagaaguagcacaucugaaggauugcuccugaagaucgacccuuuacugccaaaagagguaaagaacgaggaauccgagaaagaagacgccuga

SEQ ID NO: 59206 - RNA, 462 nt, Artificial Sequence
  derived and/or modified sequence opt3 from MRPL23__Homo_sapiens__NP_066957
auggccagaaacguggucuacccccuguauaggcucggcgggccucagcuucggguuuuccgcaccaacuuuuucauccaacuggugcgaccaggaguagcucagccggaggacacagugcaguuucguauucccauggaaaugacuagagucgauuugaggaauuacuuagaggguauauauaaugugccuguugcagccgugcggacgcgcguccagcacggcagcaacaagagaagggaccaucggaaugugcgcaucaaaaagccagauuacaaaguagcguauguucaacuggcucacgggcagaccuucacauuucccgaccuauucccugaaaaggaugaguccccagaaggaucugccgcagacgaucucuacucaaugcuggaggaggaacgacagcagagacaaaguagcgaccccaggcggggcggugugccuuccugguuugggcuuuga

SEQ ID NO: 59207 - RNA, 771 nt, Artificial Sequence
  derived and/or modified sequence opt3 from MRPL28__Homo_sapiens__XP_011520653
augccccugcacaaguacccuguguggcucuggaaaagacuucagcugagggagggcaucugcagccgguugccagggcauuauuuacgcucccuggaagaggaacgaaccccgacacccguccacuaccguccucauggagccaaguucaaaauuaacccaaagaauggucaaagagagaggguugaagacgugcccauaccuaucuauuuuccacccgagucucagcggggccuauggggaggggagggcuggauucucggucagaucuacgcuaacaaugauaaacugucaaagcgccuuaagaaaguauggaagccucagcuguucgaaagagaguuuuauagugaaauuuuggacaaaaaguucacugugacggucaccaugaggacacucgaucugaucgacgaggcauacgggcuggauuuuuauauacucaaaacuccaaaggaggacuuauguagcaaguucggaauggaucugaaacggggcaugcuuuugcgccuggcccgacaagacccgcagcuacaccccgaagauccugagagaagggcggcuaucuacgacaaguacaaagaauuugccauuccagaggaagaggcagagugggugggccucacccuggaagaggccaucgaaaagcagcggcuucuggaggaaaaagaucccguuccuuuguucaagauuuauguggcugagcucauccagcaacugcagcagcaggcauuauccgagccagccgucgugcaaaaacgugcuucugggcaguga

SEQ ID NO: 59208 - RNA, 198 nt, Artificial Sequence
  derived and/or modified sequence opt3 from MRPL33__Homo_sapiens__NP_004882
auguuccugagcgccguguuuuucgcuaaguccaaaucuaagaacauccucgucagaaugguuucagaggcaggcaccggguuuugcuucaauacaaaaaggaaccggcuucgcgaaaagcugacuuuguuacacuacgaccccgugguaaaacagcgagugcuguuugucgagaagaagaaaauucguagucuauga

SEQ ID NO: 59209 - RNA, 312 nt, Artificial Sequence
  derived and/or modified sequence opt3 from MRPL36__Homo_sapiens__NP_115868
auggccaaccuguucaucagaaagauggugaauccccuccuuuaccugagcaggcacaccgucaaaccucgggcuuuguccacauuuuuauucggcucuauucgcggggcagccccaguugcgguggagccgggagcugccguacgaucacugcuaagucccggucuccugccucaucuucugccagcauugggcuuuaagaacaaaacugugcucaagaaacguugcaaggacuguuaucuggucaagagaagggggcggugguacguguauugcaaaacgcacccccgccauaagcagagacaaauguga

SEQ ID NO: 59210 - RNA, 1047 nt, Artificial Sequence
  derived and/or modified sequence opt3 from MRPL3__Homo_sapiens__NP_009139
augcccggcuggagacugcucacccaggugggggcccaaguccuuggaaggcugggugacggcuugggggcugcauuaggaccuggcaaccggacacacaucuggcuguucguucgcggucuacauggaaagagcgggacuuggugggaugagcaccucuccgaagagaaugugccauuuauuaaacagcugguaucugacgaagauaaggcccagcuugcgucaaaacugugcccguugaaggacgagcccuggccuauacauccaugggaacccggcaguuuccgagugggccucaucgcucugaaacuggggaugaugccucucuggacgaaggauggacagaagcacgucgugaccuuacugcaaguucaggacugucaugugcuuaaauacacaagcaaggagaacugcaaugguaaaauggccacuuuguccgucggcgggaagaccgugucucguuuuagaaaagcaacaucgauucuggaguucuauagggaacuaggacucccacccaagcagaccguaaagaucuuuaacauuacugauaaugccgcuaucaaaccuggcacaccacuguacgcagcccacuuccggccgggucaguauguugacgugaccgcuaagacgauagggaaaggauuucaaggcgucaugaagcgcuggggcuucaaagggcagcccgccacucacggacagaccaagacacauagaaggccuggugcgguggcaacuggcgauaucgggcggguguggccaggaaccaaaaugcccggcaagauggguaacauuuaccgcacagaguaugggcuuaaggucuggcgaaucaauaccaaacacaacauuaucuacguuaauggcucagugccuggacauaagaacugucugguaaaagugaaggacagcaaauugccagccuauaaggaucucggcaagaaucugcccuuuccgacguacuucccugacggggaugaagaggaguuacccgaagaccuguacgacgagaacgucugccagccaggagcuccuaguauaacuuuugccuga

SEQ ID NO: 59211 - RNA, 621 nt, Artificial Sequence
  derived and/or modified sequence opt3 from MRPL40__Homo_sapiens__NP_003767
augaccgccagcgugcugagauccaucucucucgcucuuaggcccacaucaggccuguuggggacuuggcagacgcaauuacgggagacccaccagcgcgcaagucugcucagcuucugggaacuaauuccuaugcgauccgagccacugcguaagaaaaagaaagucgacccgaagaaagaucaggaagccaaggagagacuuaagaggaaaauacggaagcuggaaaaagcgacacaggaguugauccccauugaggacuuuaucacuccucucaaguuccuggauaaagcucgcgaaagaccacaaguugagcugaccuuugaagagacagagaggcgggcccucuuacugaagaaguggucucuuuacaaacagcaggaacgcaagauggagcgagacaccauuagagcaauguuggaagcccagcaagaggcucuggaagaacuacagcucgagucgcccaaacugcaugcagaagccaucaagagggauccuaaccuuuucccauuugagaaagaaggaccccacuauacuccuccaauaccgaauuaccagcccccugagggucgguauaacgacaucacaaagguguacacccagguagaguucaaacguuga

SEQ ID NO: 59212 - RNA, 414 nt, Artificial Sequence
  derived and/or modified sequence opt3 from MRPL41__Homo_sapiens__NP_115866
augggcgugcuggccgcugcagccagaugccucgucaggggagcggaccggaugagcaaguggaccuccaaacgcgggccccgaucuuuccgugguagaaagggcaggggagcuaaagggaucggcuuucuuacaucagguuggcgguucguucagauuaaggagauggugccugaauuuguagugccagaucugacuggguucaaauugaagccguacgucaguuauuuagcccccgagagcgaagagacgccucugaccgcagcccaacuauuuuccgaagcuguggcaccagccauagagaaggacuucaaagauggaacauuugaccccgauaaccucgagaaguacggcuucgaaccuacucaggagggcaaacuguuucagcuuuauccacgcaauuuccugagauga

SEQ ID NO: 59213 - RNA, 999 nt, Artificial Sequence
  derived and/or modified sequence opt3 from MRPL44__Homo_sapiens__NP_075066
auggccagcggccuggugagacuccuucagcaagggcacaggugccuguuggcucccgucgcaccuaaguuaguuccaccggugcggggagugaaaaaggguuuccgcgccgcguuucgauuccagaaagagcuggaacgucagagacuacucaggugucccccuccacccguacggcgcuccgagaagccuaacugggacuaccaugcugaaauccaggccuuuggccacagacugcaagagaauuucucucuugaucuguugaaaaccgcauuugucaacucaugcuauauuaagagugaagaggccaagaggcagcagcucgggauagagaaagaagcugugcugcugaaucucaagagcaaccaggaguuauccgaacaaggaacaucuuucucgcagacuugucugacgcaguuucuugaggacgaguacccagauaugcccaccgaaggcaucaaaaauuugguugacuuccugacaggugaggaaguggucugccauguggcacggaaccuagccguagagcagcucacucugucagaagaguuuccuguuccaccggcugugcuucaacagaccuucuuugccgucauuggggcgcuguugcagagcaguggacccgagcgcacagcacucuucauccgagauuuucugauuacccaaaugacuggcaaggaauuauucgagauguggaaaaucauaaauccuaugggccugcucguggaggaacuuaagaagagaaacguguccgccccagaaucuaggcugacacggcagagcgggggaaccacggcuuugccccuauauuucgucggucuguacugugacaaaaagcucaucgccgagggcccuggggagacuguucugguggcagaagaggaagcugcccguguagcgcuucgcaaacuguauggauuuaccgagaauagaaggccauggaacuacuccaagcccaaagaaacauugcgggccgagaagucaauuacugcaaguuga

SEQ ID NO: 59214 - RNA, 501 nt, Artificial Sequence
  derived and/or modified sequence opt3 from MRPL49__Homo_sapiens__NP_004918
auggccgcuaccauguucagagcaacacugaggggcuggcggacuggggugcagcgcggaugcggucuccgacuucugagccaaacgcaggggcccccugacuacccacguuuugucgaguccguugaugaauaucaguucguggagagauuguuaccggccaccaggauccccgacccuccaaagcacgaacauuaccccacaccuucuggcuggcagccaccccgggauccuccaccgaaccugcccuauuuuguacgcagaucaaggaugcacaauauuccuguguacaaagacauaacucauggaaaccggcaaaugaccgucauccgcaagguggagggcgauauuugggcgcuacagaaagacguugaagauuuccucaguccacugcuugguaagacacccgugacccaggucaaugaggugacugggacacugcgaaucaaaggauauuuugaccaggaguugaaggcuuggcuccuggaaaagggcuucuga

SEQ ID NO: 59215 - RNA, 372 nt, Artificial Sequence
  derived and/or modified sequence opt3 from MRPL52__Homo_sapiens__NP_848026
auggccgcucugggcaccgugcuguucacaggggucagaaggcuucacugcagcguugcagccugggcgggaggucaguggcggcugcaacagggcuuggcugccaaccccuccggguacggaccuuuaacugagcugccagacuggucuuaugcagauggccgcccggcucccccuaugaagggucagcuacgacguaaagcugaaagagagacguuugcaaggcgggugguacuccugucacaggaaauggacgccgggcuucaagccuggcagcugcgccagcagaaguugcaagaggaacagagaaaacaggagaaugcccucaagccaaaaggagcgagucucaagagcccccugccuucccaguga

SEQ ID NO: 59216 - RNA, 702 nt, Artificial Sequence
  derived and/or modified sequence opt3 from MRPL9__Homo_sapiens__NP_001287662
auggccgcucccguggucaccgcaccuggcagagcccugcucagggcgggggcuggacggcuucugcgcgguggcguucaggaguuguuacgaccacgucacgaagggaacgccccggaccuggcaugcaauuucagccuaucccaaaacagaggaacagugaucguagagaggugguggaaggugccccucgccggcgaaggucggaaaccucgccugcauagaaggcaccgggucuacaaacuuguggaggauacuaaacaucgcccaaaggaaaaucuggaguugauucucacgcagucuguugagaacguggggguccgaggagaccuggugucaguaaagaagagucugggcagaaauaggcucuuaccccagggccuggcuguuuaugcaagcccugaaaacaagaaacuuuuugaggaagagaaguugcugcggcaggaggggaaacuagaaaagauacaaaccaaagccggagaggcucucgguguggucguggccccacacacacugaaacuucccgaggaaccuaucacucguuggggcgaauacuggugugaggugaccgucaaugggcuggauacaguucgcgugccaauguccguagugaacuucgagaagccgaagaccaagagauauaaauacugguuggcgcagcaggcagccaaggcuauggcccccacuucuccucagauuuga

SEQ ID NO: 59217 - RNA, 585 nt, Artificial Sequence
  derived and/or modified sequence opt3 from MRPS11__Homo_sapiens__NP_073750
augcaggccgugagaaacgcuggcagcagguuccugcgguccuggaccuggccccaaacagcagggcgcgucguugcccgaacuccugcgggaacgaucugcaccggugcucgucagcuccaggacgccgcagccaagcagaaaguggagcaaaaugcugcaccaucucacacaaaguuuucaauuuacccgcccauaccuggcgaagagaguagccuuagaugggccgggaaaaaguucgaagagaucccaauugcucauaucaaagccucccacaacaauacucagauucagguagugucugcgucgaacgaaccccuggcauuugccucauguggaaccgagggcuucaggaaugcuaagaaggguacagggaucgccgcacagaccgcuggaauagccgcggccgcacgggcuaaacaaaagggcgucauccauauucgcgugguugugaaaggcuuggggccuggaagauuaagcgccaugcacggucugaucaugggcgggcuagaggucauuaguaucacugauaacacaccaauaccccauaauggaugcaggccucggaaggcucgcaaacucuga

SEQ ID NO: 59218 - RNA, 417 nt, Artificial Sequence
  derived and/or modified sequence opt3 from MRPS12__Homo_sapiens__NP_203527
augagcugguccggccugcuccacgggcuuaacaccucucugacaugcggacccgccuuggugccuagauuaugggcuacuuguucaauggcaacgcugaaucagaugcauaggcuagguccaccgaagcggcccccucgcaaacucggcccaaccgaggggcgaccccaacugaagggagucguucuuugcacauucacucguaaaccuaagaaaccaaacagugccaauagaaaguguugcagggugcggcugagcaccggccgcgaagcgguauguuuuauccccggugaggggcacacauugcaggaacaucagauugugcucgucgagggaggcagaacccaggaccugccuggcgugaagcugacuguugugagggggaaauacgauugcggacacguccaaaagaaauga

SEQ ID NO: 59219 - RNA, 414 nt, Artificial Sequence
  derived and/or modified sequence opt3 from MRPS16__Homo_sapiens__NP_057149
auggugcaccugaccacacuccuuugcaaggccuacagaggcgggcaucugacuaucagguuggcuuuaggagguuguacgaaccggcccuucuaucgcauugucgcagcccacaauaaaugcccucgagacggccguuuuguugagcagcuggggagcuacgauccacuaccgaacucccauggagaaaagcucguggcgcugaaucuugacagaauaaggcacuggaucggcuguggugcucaucugucuaaacccauggagaaguugcucgggcuggccggauucuuuccucugcacccaaugaugauuaccaacgcagaacggcuccgcagaaaaagggcccgggagguauuacuggcuucacaaaagacagaugcagaagccacugacaccgaggcuacagagaccuga

SEQ ID NO: 59220 - RNA, 777 nt, Artificial Sequence
  derived and/or modified sequence opt3 from MRPS18B__Homo_sapiens__NP_054765
auggccgcuagcgugcugaacaccguccucagaaggcuucccaugcuguccuuguuccggggcucucaccgcguucaggugccuuuacaaacacugugcacuaaggcaccaucagaggaagacagucuaagcuccguaccgaucucucccuacaaagaugagccuuggaaguaucucgaaucggaggaauaccaggagcgauaugggucacguccagugugggccgacuacagaaggaaucauaaaggaggugugcccccucagcggacgcgcaagaccuguauuagaaggaacaaagucguuggcaauccaugccccauaugucgggaucacaagcugcauguggacuuucgcaacgucaaacuucuggagcaguucgugugcgcgcacacagggaucaucuuuuaugcuccuuacacuggaguauguguuaagcaacauaagcgauugacccaggccauucagaaagcaagagaucacggccuccugauuuaucacaucccacagguggaaccgagggaccuggauuucagcacaagucauggugccgucuccgcuacucccccugcaccaacccucgugucuggggaccccugguacccuugguacaauuggaagcaaccacccgagcgggaauuaagccgucugcgcagacuuuaucagggacacuugcaggaggaguccggcccgccucccgaaucaaugccaaaaaugccucccaggacaccagccgaggcuaguagcaccggccagacggggccccaaucugcccuguga

SEQ ID NO: 59221 - RNA, 1083 nt, Artificial Sequence
  derived and/or modified sequence opt3 from MRPS22__Homo_sapiens__NP_064576
auggcuccccugggcaccacagugcuccuuuggagccuguugagauccucuccuggggucgagaggguuugcuuccgggcccgcauccagccauggcacggagguuuacugcaaccgcuacccuguucauuugaaaugggccucccucgacguagauucaguagcgaggcagccgaauccgggucuccagagacuaagaaacccacguuuauggacgaagaggugcagucgauucugaccaagaugacaggacuuaaccugcagaaaacuuucaagccugcgauacaggaguugaaaccacccaccuacaagcucaugacacaagcucagcuggaagaggccaccaggcaggcaguagaagccgcuaaggugcggcugaaaaugccuccaguccucgaggagcgcgugccgaucaaugauguuuuagcagaagacaagauucuggagggcacugaaacaaccaaauauguguuuacggauaucucauacagcauuccccauagagagagguucaucgucgugcgggaaccuagugguacucuucgcaaggccuccugggaggagcgagacagaaugauacagguauauuuuccaaaagaagggaggaagaucuugacccccauuaucuucaaggaggaaaaccugcggacaauguacucucaagaucgucacguugacgugcuaaaucucugcuuugcucaguucgagccugauagcacugaauauauuaaaguccaucacaagaccuacgaggacaucgauaaacgcggaaaguaugaccugcuuagauccacaagguacuuuggcggcauggugugguacuucgugaacaauaaaaagauagaugggcuguugauugaccagauccagcgggaucucauugacgacgccaccaaccugguccaauuauaucauguucugcacccagauggacagucagcgcagggugcaaaagaccaagccgcugagggcaucaaucucaucaagguguuugccaagacggaagcacagaaaggggcuuacauugagcuuacucugcagacauaucaggaagccuugagucgacacagcgcggccucuuga

SEQ ID NO: 59222 - RNA, 573 nt, Artificial Sequence
  derived and/or modified sequence opt3 from MRPS23__Homo_sapiens__NP_057154
auggccggcagcagacucgagaccgugggguccaucuucucuaggacacgggaccucguccgcgcuggaguucuuaaggaaaaaccccugugguuugauguguacgacgcauucccuccauugcgagagccgguauuucagcgucccagagugagguaugguaaggccaaagcgccuauucaagauauaugguaccacgaagaccggauccgcgcuaaguucuauucagucuacggcagugggcagagagccuuugauuuauucaacccaaauuuuaaaagcacuugccagagguucguggagaaguauacggaacugcagaagcuaggagagaccgacgaggaaaaacucuuuguugagacaggcaaggcacugcuugccgaaggugugauucugcggcgcgucggggaggcucgaacucaacauggaggcucccacgugucuagaaaaucggagcauuugucaguaaggccccagaccgcacucgaagagaacgaaacacagaaggagguuccucaggaucaacaccuggaagccccagcugaccagagcaaaggccugcugcccccuuga

SEQ ID NO: 59223 - RNA, 564 nt, Artificial Sequence
  derived and/or modified sequence opt3 from MRPS28__Homo_sapiens__NP_054737
auggccgcucugugcagaaccagggcaguggccgcggagagccacuuccuccgggucuuucuuuucuuucgccccuuccgaggaguugggacagaauccggaucugagucagguaguagcaacgcuaaggaaccuaaaacucgugccggcggguuugcauccgcccuggagagacauucugaauuguuacagaagguggagccacugcaaaaaggaucgccgaagaauguagagucauucgcuagcaugcuaaggcacaguccccucacgcagaugggcccugcaaaagacaagcuggugaucggucggauuuuucauauagucgaaaacgaucuuuacaucgacuucgggggaaaguuucacugugugugccgcagaccagagguugauggcgaaaaauaucagaagggcaccagggugcggcugcgcuugcucgaccuggagcugacaucccgauuccucggggccacuaccgauacaaccgucuuagaggcuaaugccgugcugcuuggcauucaggaaucuaaagacagcagauccaaggaggaacaucacgagaaauga

SEQ ID NO: 59224 - RNA, 1320 nt, Artificial Sequence
  derived and/or modified sequence opt3 from MRPS30__Homo_sapiens__NP_057724
auggccgcugcaagaugcuggaggccccugcuccggggcccucgccuuagccugcacaccgccgcgaacgcugccgcaacagccacugagacgaccugucaggacguggcugcaacaccagucgcccgauacccgcccaucguugcuuccaugacugccgauucuaaggcggcacguuugagaaggauugaacgguggcaagccaccgugcaugcugccgagucaguagacgaaaaauuacgcauacugacaaagaugcaguucaugaaauauaugguguacccucagaccuuugcacuaaaugcugauagaugguaucaguacuucacuaagacagucuuucucagugggcugccacccccuccagccgagcccgaaccugagccagagccggaacccgagccugcgcuugaccuggccgcauugagggcuguggccugcgauugucuccugcaagaacacuucuaucugcggcgccgaagaaggguucaucgguacgaggagagcgaagugaucucccucccauuuuuagaccagcuggucucuacccuugugggauugcugucgccccacaacccugcucuagccgcagccgcucucgauuaucguugcccaguacauuucuacuggguucgcggugaggaaauuauccccagaggccacaggcgggggcgaauugacgaucugcgcuaccagaucgacgauaaaccgaauaaccagauaagaaucucaaagcaacuugcggaguuugugccucuggacuauagcguccccauugaaaucccaacgauuaaguguaaaccugauaaguugccccucuucaaaaggcaguacgagaaucacaucuuugugggaaguaagacugcagacccaugcuguuauggccauacccaguuccaccuguuacccgacaaacugcggcgcgagagacuccuuaggcagaacugcgccgaucaaauagaaguggucuuucgugcuaaugccauugcaucccuguucgccuggacaggugcucaggccauguaccagggguuuuggucugaggcagacguuacucggccuuucgugagccaagcgguaaucaccgauggaaaguauuucuccuuuuucuguuaccaguugaacacacuagcucugaccacgcaggccgaccagaauaacccacgaaagaauauuugcuggggcacucaaucaaaaccgcucuaugaaacaaucgaggauaacgacgugaagggcuuuaaugaugacguccugcuucagaucgugcauuuccuguugaacagacccaaagaagagaagagucagcuccuggagaauuga

SEQ ID NO: 59225 - RNA, 1188 nt, Artificial Sequence
  derived and/or modified sequence opt3 from MRPS31__Homo_sapiens__NP_005821
auguuccccagagugagcaccuuucugccucucaggccacuuucccggcacccgcugucuucaggcagucccgagacaagcgccgcugcaaucauguuguuaacuguccgccaugggacgguucgauaccguuccucugcccugcuagcgagaaccaagaacaauauucagagguauuucggaacaaacucggugauaugcagcaaaaaggacaaacaaucaguacggacugaagagaccaguaaggaaacauccgagucucaggauagcgaaaaagagaauaccaagaaggaccuccuggguaucauuaaaggcaugaagguggagcuuuccacugucaacgugcgcacaaccaaaccuccaaagagaaggccccugaaaucauuggaagcuacgcucgggcggcugcgccgagccacugaguacgcaccuaagaagagaaucgaaccacugagucccgagcucguugccgcugcaagcgccguggcugauucuuuaccuuuugacaaacagaccacaaaguccgagcugcuuucacaguugcaacagcacgaagaggaaagcagggcccagcgggaugcgaaacguccaaagauuaguuucucuaauaucauauccgacaugaaagucgcacgcagcgccacugcuagagugaggucgcggccggagcugcgaauccaguuugaugaaggauaugacaacuaccccggccaagagaagaccgaugaccucaaaaagcgcaagaauauuuucacagguaaaagacuaaacaucuuugauaugauggccguaaccaaggaggcaccugaaacggacacuucuccaucccugugggauguugaguucgcuaaacagcuugccacagugaaugaacagccccugcagaacggguuugaggaauugauucaauggaccaaggagggaaaacucugggaguucccuaucaauaacgaagcgggcuuugacgacgauggcucagaguuccaugaacacauauuucuggagaagcauuuagaaaguuucccaaagcaggggcccauuaggcacuucauggagcuggucacuuguggacucagcaaaaauccguaucuuuccgugaagcagaaaguggagcacaucgaaugguuucggaacuacuucaaugagaagaaagacauucugaaggaaucuaacauccaauuuaacuga

SEQ ID NO: 59226 - RNA, 321 nt, Artificial Sequence
  derived and/or modified sequence opt3 from MRPS33__Homo_sapiens__NP_444263
augagcucccugucugaguacgccuucagaaugucaaggcucagugcucggcuuuuuggcgaagugacccgccccacaaacagcaaguccaugaaagucguuaagcuguucucugaguugccuuuagccaaaaagaaagaaacuuaugacugguacccaaaucaccauacguaugcagagcugaugcagacccuacgauuucucgggcuguaccgugaugaacaccaagacuucauggaugagcagaagagacuuaagaaacugaggggaaaggagaaaccgaagaaaggugaaggcaagcgggcggcuaagcgcaaauga

SEQ ID NO: 59227 - RNA, 378 nt, Artificial Sequence
  derived and/or modified sequence opt3 from MRPS6__Homo_sapiens__NP_115865
augcccagauacgagcuggcccucauccuuaaggcuaugcagaggccugaaacagcagccacacugaaacggacuauugaggcguugauggaccgcggcgcuauagugcgagauuuagaaaaccugggggagcgugcccuaccauauagaaucagcgcacacucccaacagcauaauaggggagguuacuuccucgucgacuuuuaugccccgacggcugcaguugaaucuaugguggagcaccugucacgggauauugacguaauccgcggcaacauugugaagcauccccuuacccaggagcugaaagaaugcgaggggaucgucccugugccauuggccgaaaagcucuacaguaccaaaaagagaaagaaauga

SEQ ID NO: 59228 - RNA, 729 nt, Artificial Sequence
  derived and/or modified sequence opt3 from MRPS7__Homo_sapiens__NP_057055
auggccgcucccgcagugaaggucgccagaggcuggagcgggcuggcgcucggaguuaggcgggcugugcuucagcugccugguuugacccaaguacgcuggucccgauacucuccagaguucaaagacccguuaaucgauaaggaauauuaccguaaacccguggaggaacugacagaggaagagaaguaugucagagagcuaaagaagacucagcucauuaaggccgcuccugccggcaaaacgucaaguguguuugaagacccaguuauaagcaaguucaccaacaugaugaugaucgggggaaauaaagugcuggcuaggucccuuaugauucagacacuggaggcagucaagcggaaacaguuugaaaaguaccacgccgcuucugccgaggagcaagcgacuaucgaacgcaaccccuauaccauuuuccaucaggcauugaagaauugcgagccuaugaucggccucgugccaauacugaaaggugggagauuuuaccagguacccguuccucugccagauaggcggcgccgauuccucgccaugaaguggaugaucacagaauguagagacaaaaagcaccagaggaccuuaaugccggagaaacugucgcauaaacuuuuggaagcauuucacaaccaaggacccgugauuaaacggaagcaugaucugcacaagauggccgaggcaaaucgugcucuagcccacuaucgcuggugguga

SEQ ID NO: 59229 - RNA, 1191 nt, Artificial Sequence
  derived and/or modified sequence opt3 from MRPS9__Homo_sapiens__NP_872578
auggccgcucccugcgugagcuacggcggggcagucuccuauagacugcuccuuuggggaagggguucucuggcccggaagcagggcuuguggaaaaccgcggcuccugaguuacaaacaaacguucgcucacagauccugcgacuacgucacacugccuucgugauuccaaagaaaaauguaccgacgaguaagagagaaaccuacacagaggacuuuaucaaaaagcagauagaagaguucaacauugggaagaggcaucucgcaaauaugaugggagaagaucccgagacuuuuacccaggaggacaucgaucgggccauugcuuaucuguucccuagcggccuuuuugaaaaacgcgcaagaccagugaugaagcaccccgagcaaaucuucccuaggcagcgggccauacaguggggugaagacgggcgcccauuucauuaccuguucuauacaggaaaacaguccuacuauucuuugaugcacgaugucuacggcaugcuccugaaccuggagaagcaucaaucgcaccuccaggcuaaaucauuacugcccgagaagaccgugacucgagacguuaucggcagcagauggcuuauuaaggaagaguuggaagagaugcugguggaaaaacuaagugaucucgacuacaugcaguuuaucaggcugcuugagaagcuguugacaucccaguguggggccgcggaggaagaguucguccaacgguuucgucgcucugugacccucgaaagcaaaaagcagcugauugagccuguacaguaugaugaacaaggaauggcauucuccaaaucagaggguaagagaaaaacggccaaggcugaggccaucguuuacaagcacggcagugggaggauaaaagugaauggaauugacuaucaguuauacuuuccaaucacucaggaucgggaacagcugauguucccguuccauuuugucgaccgacucggcaagcacgaugugaccugcacagugagcggugggggacgcucugcacaagcuggcgccauuagacuugcgauggccaaagcacuguguuccuucgucacugaggacgaaguugaguggaugaggcaggcuggcuugcuaaccacagacccccgggugcgcgaaagaaagaaaccugggcaggagggagccaggcguaaguuuaccuggaagaaacgguga

SEQ ID NO: 59230 - RNA, 633 nt, Artificial Sequence
  derived and/or modified sequence opt3 from MRRF__Homo_sapiens__NP_001166983
auggcccugggccucaagugcuucagaauggugcaccccaccuuuaggaacuaccuugcugcaagcauccggccugucuccgagguuacacugaaaacugugcaugaacgccagcacgggcaucgacaauauauggccuacucugcgguaccagugcgucacuucgcuacgaagaaagccaagggaucauuggacaaaauugcagucgugaccgccgaugguaaguuagcucugaaucagauaagucagaucagcaugaaguccccgcagcuaauucucguuaacauggcaucuuuucccgaguguacagccgcugccaucaaagcgauuagagaaucgggcaugaaucugaacccugagguggaagggacucuuaucagggucccaauaccccaagugacccgggagcaucgcgagaugcugguaaaguuggcaaaacagaauacaaacaaggccaaagacucacucagaaagguuaggaccaauagcaugaacaagcugaaaaagaguaaagauacuguguccgaagacacaauccggcugauugagaagcagaucucucagauggcugaugacaccgucgccgaacucgaucgccacuuagcagugaaaacgaaggagcugcuuggauga

SEQ ID NO: 59231 - RNA, 1341 nt, Artificial Sequence
  derived and/or modified sequence opt3 from MRS2__Homo_sapiens__NP_001273193
auggagugccugagaagccuccccugucuucugccuagggccaugcgguugccacgccgaaccuuaugcgcucuggcacuagacgugacauccgucggcccgcccguugccgcgugugggcguagagcuaaccucaucggaaggucucgggccgcacagcugugcgguccugaucgccuuagaguggccggcgaaguacacagguuccggacuucagacgugagucaagcuacgcuggcaagcgucgccccaguguuuaccguuacaaaguucgauaaacaggggaaugugacuuccuuugagcgcaagaaaaccgaauuguaccaggagcucggacugcaggcucgagaccugagauuccaacaugucaugucuauuacagugaggaacaaucggauaaucaugcguauggaaaaguauucgcucuuacuggagucaguagccagcauucuucagaacaguguuuccuuuauggagcgccagaccgaacagugguuguucagagagcugcccucucaacuaagcggcgaaggucagcucgugacuuacccucugccauuugaguucagggcgaucgaggcacuucugcaguauuggauuaauacauugcaggggaaacucuccauccugcaacccuuaauacuggaaacccucgaugcccuugucgacccuaagcacucaaguguggaucggagcaagcugcauaucuugcuacagaacggaaaaucucuguccgagcucgaaacggacauuaagaucuuuaaagagucaauucuggaaauccuugaugaggaggaacuguuggaggaacucugugugagcaaguggagugacccacaggucuucgagaaaucuuccgcuggcauagaucacgccgaagagauggagcuguuacuggaaaauuacuaucgacuagcagacgaucucagcaacgcugcccgcgagcugagaguucuuauugacgacucgcaaucuaucauuuuuaucaauuuggauucccauaggaacgugaugaugcggcugaaucuccagcugacuaugggcaccuucucacuuagucuguuuggguugaugggaguagcguucgguaugaaccucgaaagcucccuggaggaagaccaccgcaucuucugguuaauuacaggcauaauguuuauggggucuggacugaucuggagaaggcuacucagcuuccugggccgucagcuugaggccccguugcccccuaugauggcaucacugccaaagaagacucuccuggcugaucggaguauggagcugaaaaauuccuuacgacuugacgguuuggggagcggaagaucuauucucaccaacagguga

SEQ ID NO: 59232 - RNA, 2715 nt, Artificial Sequence
  derived and/or modified sequence opt3 from MRVI1__Homo_sapiens__NP_001092049
augggcauggaccugaccugccccuucgggaucagcccugccuguggagcucaggcauccuggucuauuuuuggugccgaugcggcugaggugccaggcacaagagggcacucacaacaggaagccgcaaugccgcauauacccgaggacgaagaaccuccaggagaaccccaggccgcucagaguccugcaggccaagguccacccgccgcuggggucagcugcuccccuacuccaacgaucguucucaccggagaugccacaucuccggagggcgagacugacaagaaccuugcgaauagggugcacucgccccauaaacggcugucacaccgccauuugaagguaagcaccgcaaguuuaacauccguggauccugccggccacauuaucgaccuggucaacgaucagcuaccagacauuucuaucagcgaagaggauaaaaagaaaaaucucgcucugcuugaagaggccaagcugguguccgagcgauucuugacccguagagggaggaagucacggaguagccccggagacucuccuuccgcaguuucaccaaaccucagccccagugcuucuccgacuuccagccgcucuaauucgcugacagugccuacgcccccaggucuggaugucuguuccggcccucccucaccacuccccggggccccuccacagcagaaaggagacgaagcggaugugaguagcccgcaccccggcgagccuaacguaccaaaggguuuagccgacagaaaacaaaaugaccagaggaagguuucccaggggcggcuggcaccccgcccuccacccguggaaaaaucuaaggagauagcuaucgaacagaaggagaacuuugauccgcuucaauacccugagaccacuccaaaaggauuggcccccgucaccaauagcucaggcaagauggcucugaacaguccucagcccggcccaguggaauccgagcuagggaaacagcuccugaagacaggaugggaagguagcccucuuccccgaucuccaacucaagacgccgcaggcguggggccgccugccucacagggaagaggccccgcuggugagccaauggggcccgaagcgggcaguaaagcagagcugccuccaaccgucagcaggcccccuuugcuccggggacuguccugggauucuggcccggaggaaccagggccccguuuacagaagguucuggccaaacucccucuugcugaggaagagaagcgcuucgccggaaaggccgguggcaaacuggcaaaggcuccaggguugaaagacuuucagauucaagugcagcccguaagaaugcagaagcuaacaaaacugagggaggagcauauccucaugcggaaucagaaccuggugggacuuaagcugccugauuugucggaggccgcagaacaagagaagggccucccgagcgaacugucccccgcgauugaggaggaagagucaaaaagugguuuagacgucaugccaaauaucucugaugugcugcuacgaaagcuccgcguucacagaagccugccuggguccgcucccccacuuaccgaaaaagagguggaaaacgucuucgugcaguugucacuggccuuuaggaaugacagcuauacgcucgagucucggauaaaccaggcagagcgcgaaagaaaccugacugaggaaaauacagagaaggaacuugagaacuucaaagccuccauuaccaguagcgcuucucuguggcaucacugcgagcacagggaaacuuaccagaaguugcucgaggauaucgccguacugcaucguuuagcagcucggcuguccucacgagccgaaguugugggcgcggucagacaagagaagaggaugaguaaagccacagaagugaugaugcaguaugucgagaaucuaaagcgcaccuacgagaaagaccacgcugaacucauggaguuuaagaaacuggcaaaccagaauagcucgcgguccuguggaccuucugaagauggcgugcccagaacggccaggagcaugucacuuaccuuggggaagaacaugccacgccgacggguuaguguggcuguagucccgaaguucaaugcccugaaccucccuggacagacacccuccucuagcuccauuccaucacugcccgcauuaagcgagaguccuaaugguaaaggcucucugccagugacuuccgcgcuucccgccuugcucgagaacgggaagaccaauggagacccugacugcgaagcuagcgccccggcacugacacuaucgugucuggaggaacucucacaagagacuaaagcucguauggaagaggaggccuauucuaagggcuuucaggaaggucugaaaaagaccaaagagcuucaggauuugaaggaagaggaagaggagcaaaagagugaauccccagaggaacccgaggaaguugaggagacagaagaggaagagaaagggccuagaagcucuaagcuggaggaauuagugcauuuccuccaggucauguaccccaaacugugccagcacuggcaagugaucuggaugauggcagccguaaugcuugugcugaccguugucuugggccucuauaacagcuacaauuccugugcugagcaggcggacggaccacugggcaggucaacuugcagugccgcacagcgcgauagcugguggucuuccgggcuacagcaugaacagccuacggagcaauga

SEQ ID NO: 59233 - RNA, 666 nt, Artificial Sequence
  derived and/or modified sequence opt3 from MS4A12__Homo_sapiens__NP_001157942
augaugagcuccaagcccaccucucacgccgaggugaacgaaacaaucccuaauccauacccgcccucaaguuucauggcuccuggcuuucagcaaccacuggggagcauuaaccucgagaaucaggcacagggagcccagagagcgcaacccuaugguauaacuuccccuggcaucuucgcuucuucgcagccagggcagggaaacauucagaugaucaaucccucagucggcacggccguuaugaacuuuaaagaagaggcaaaggcccuugguuucauuaucagcgggagucuguccgugucugcuagcaaagaauuguccaggugcuuaguaaagggaucacugggcaugaauauagugaguagcauccuagcauuuauuggcgucauccuccugcuuguggacauguguauuaacgggguugccggacaagauuacugggcugugcugucugguaaaggcaucuccgccaccuugaugauauucucacuccuggaguuuuucgucgcgugcgcaacagcccauuuugcuaaucaggccaacacuaccacaaauaugagcgugcugguaauuccuaacauguaugagaguaauccaguuaccccggcaucuuccagcgcucccccucgguguaacaauuacucggccaacgcgccaaaguga

SEQ ID NO: 59234 - RNA, 894 nt, Artificial Sequence
  derived and/or modified sequence opt3 from MS4A1__Homo_sapiens__NP_068769
augaccacacccagaaacagcgugaauggcacuuucccugccgagccaaugaaggggccgaucgcuaugcaguccggacccaaaccucuguuuaggcggaugucuucacucgucgguccaacgcaaaguuucuuuaugcgcgaaagcaagacccuuggcgcaguucagauuaugaacgggcuguuccacauagccuugggaggcuuacugaugauccccgcggguauuuacgcuccuaucugcgugacaguaugguauccacuauggggaggaauuauguacaucauauccggcucucuccuggccgcaacugagaaaaauucgcgaaagugucuugugaaaggcaagaugaucaugaacucacugagcuuguuugccgcuauuagugggaugauccucuccauuauggacauccugaauauaaagauuucucauuuccugaaaauggaaagccucaacuuuauccgugcacacacccccuauauuaauaucuacaacugcgagccugccaauccauccgaaaagaacucaccgaguacacaguauuguuacagcauccagucuuuauuccuggggauucuuuccgucauguugauauuugcuuucuuucaagagcuggugaucgccgguauuguugagaaugaauggaaaagaaccugcucaaggcccaagagcaacaucgugcuacucagugcggaggagaaaaaggaacagacuauagagauuaaggaagaggucgugggccugacagaaaccucuucccagccuaaaaaugaggaagauaucgagaucauuccaauccaggaggaagaggaagaggaaacggagacuaacuuccccgagccuccacaagaccaggaaagcucgcccauugagaaugauucuuccccguga

SEQ ID NO: 59235 - RNA, 600 nt, Artificial Sequence
  derived and/or modified sequence opt3 from MS4A2__Homo_sapiens__NP_001243845
auggacaccgagagcaacagaagggccaaucuggcucucccccaggaaccuuccucugugccagcauucgagguccuugaaaucucaccgcaagagguuaguagcggccggcuguugaaguccgccucuucgcccccuuuacacacauggcugacugugcucaaaaaggaacaggaguuucuaggguucucaauuagcggaaugcugaguauaaucuccgagcgccgaaacgcgacguaccuuguacgugguucucugggcgcuaauaccgccagcuccauugcagggggaacaggcaucacuauuuugaucauaaaccucaaaaagucacuggccuauauccauauucacaguugccagaaauuuuucgaaaccaaguguuuuauggcuagcuucucuacagagaucguggucaugaugcuguuucucaccauuuuaggucugggguccgcagugucacuuacuaucugcggagccggcgaagaguugaagggcaauaaaguuccagaggauagaguguacgaggaacugaacauauauagcgcuacauacagugaacuagaggaccccggggaaaugucuccuccaauugaucucuga

SEQ ID NO: 59236 - RNA, 276 nt, Artificial Sequence
  derived and/or modified sequence opt3 from MS4A3__Homo_sapiens__NP_001026836
augaacaucgccagcgcuaccauugcacuggugggcacagccuuccucucccuuaauauagcggucaacauccagucucugagaucaugccacaguagcuccgagucucccgacuuguguaauuacauggggucgauuucaaacggaaugguuagcuuacugcuaauccucacucugcuugaacugugcgugacgauuaguaccaucgcuaugugguguaaugccaacugcuguaauuccagggaggaaauaucuagcccuccaaacuccguauga

SEQ ID NO: 59237 - RNA, 561 nt, Artificial Sequence
  derived and/or modified sequence opt3 from MS4A4A__Homo_sapiens__NP_001230195
augcaccagaccuacagcagacauugcaggcccgaggaauccacauucucugccgcuaugacuacgaugcaaggcauggagcaggcaaugccuggggccggaccaggugugccgcagcugggcaacauggcggucauccacucacaucucuggaaggggcuucaggaaaaauuucugaagggagagcccaaaguuuugggcgugguacaaauuuuaaccgcucugaugagucuaagcauggguauaacaaugauguguauggccuccaauacuuaugggucuaacccuaucucgguguacauuggauauaccaucuggggcucagucauguucauuaucagcggcagucucuccauagcagccgggauccggacaaccaagggacugggucuugacggcauggugcuguugcucucuguucuggaauuuugcauugcugugagccuguccgcauucggguguaaaguccucugcuguacuccaggaggcgugguauuaauccugcccucacacagucauauggccgagacagcuagcccuaccccacuuaaugagguuuga

SEQ ID NO: 59238 - RNA, 762 nt, Artificial Sequence
  derived and/or modified sequence opt3 from MS4A6A__Homo_sapiens__NP_001234928
auggugcugcucaaacuucuggaggucuacagaaagggcagcgccgggaccuuccacaaguccacaaucuuuggaaacacuauuaugacgucucagcccguuccuaaugaaaccauaaucguguugccaucaaacguaauuaauuucagucaagcugagaaaccggaacccacaaaccagggucaggacagcuuaaagaaacaucugcacgcagagaucaaggugauuggcacuauccagauacuaugcgggaugaugguccucucccugggaaucauucuugccucugcgucguuuucaccuaauuucacccaagugacaagcacccuguugaacagugcuuauccauuuaucggccccuucuuuuucauuaucuccgguucucucagcauagccacugaaaagaggcugacaaaacugcucguucauuccucauuaguggggaguauucugagcgcacuuucugccuuggucggauuuaucauucuguccgugaagcaggcuacccuaaauccugcaucacuccagugugagcuggauaaaaacaauaucccaacgcggagcuacguaaguuauuucuaccacgacucucuuuauacuaccgauugcuacacagccaaggcuucccuggccggcacuuugagccucaugcugaucuguaccuuacuggaguuuugccucgcgguucuuacagcagugcugcgcuggaaacaggccuauucggacuuccccggcgucucuguguuggcuggguuuaccuga

SEQ ID NO: 59239 - RNA, 753 nt, Artificial Sequence
  derived and/or modified sequence opt3 from MS4A8__Homo_sapiens__NP_113645
augaacagcaugaccuccgccgugcccgucgcuaauucuguucuggugguagcaccucacaacggcuacccagugacaccggggaucaugucacaugucccccucuauccuaauagucagccacaagugcaccuuguucccggaaacccuccaagccugguguccaaugucaacggucagcccgugcagaaggccuugaaagagggcaagacuuuaggggcgauucagauaaucauuggacuggcucauaucggccuagguucuauuauggccacgguacucguuggggaauaccugucgaucucauucuauggaggcuuuccuuucuggggcgggcuuugguuuauaaucagcggaagucuguccguggcagccgagaaucaaccauacucuuauugcuugcucagcgguucccugggccugaacauugucucagcuaucuguagugcagugggggugauucucuucaucaccgacuuaagcauaccgcaccccuacgccuauccugauuacuacccauaugcuuggggagucaaucccggcauggccauuucugguguucugcuuguguuuugcuugcuggaguucgggaucgcgugugcauccucacauuuuggaugccagcuaguauguugccagagcaguaacgugucugucauuuacccuaauaucuaugccgcuaacccagugaucacacccgaaccgguuacuuccccucccagcuacucgucugaaauucaggccaauaaauga

SEQ ID NO: 59240 - RNA, 1365 nt, Artificial Sequence
  derived and/or modified sequence opt3 from MSANTD3-TMEFF1__Homo_sapiens__NP_001185741
augcagaacaaugagaucauuaagcccgccaaauacuucagcgaacuggagaaguccauacuccuugcucugguggaaaaauauaaguacgucuuggagugcaaaaagucugacgcaagaaccaucgccuuaaagcaaaggacauggcaggcgcuggcucacgaauauaacucacagccuaguguuagccuacgggauuuuaaacagcucaagaaauguugggagaauauuaaggcccgcacuaaaaagaucauggcacaugagcgacgugaaaaggugaaaagauccguaucuccacugcuuucgacgcacgugcugggcaaggagaaaauugccucaauguugccggaacaacucuacuuccugcagagucccccugaggaggaaccagaguaucaucccgacgcuagcgcacaggaacugaacgucagggaguccgaugugcggguuugcgacgaaucuagcuguaaguacgggggagugugcaaagaggauggugacggccucaagugugccugccaguuucaaugucacaccaauuauaucccugucugcggguccaacggagauacauaccagaaugaguguuucuuacgcagagcugccugcaaacaucagaaggaaauaacugugaucgcgaggggcccauguuacucagacaacgguagugggagcggagagggcgaagaggaaggcucuggggcagagguacaccggaagcacuccaaaugcggacccugcaaguauaaagccgagugugaugaagacgcugagaauguugguugcguguguaacauugauugcucaggcuacagcuuuaauccugucugugccagugacgggucuuccuauaacaauccaugcuucgugcgcgaagcaagcuguaucaagcaggagcaaauugauauccgacaucugggacacugcaccgacacagacgauaccucgcuuuugggcaaaaaggacgauggucugcaguacagaccggacgugaaggaugcuucugaccagagggaagaugucuauauagggaaccauaugcccuguccugagaaucuaaacggauacugcauucacggcaaaugugaguuuaucuauuccacucaaaaggccucaugccggugcgaaaguggcuacacagggcagcacugugagaaaaccgacuucagcauucucuacguugugccaucccgucagaagcugacgcauguacuuaucgcggccaucauuggagcagugcagauagcuaucauugucgccaucgugaugugcauaacucgcaaaugucccaagaacaauagagguaggcggcaaaagcagaaccugggccacuuuaccucugauacaagcucacgaaugguuuga

SEQ ID NO: 59241 - RNA, 621 nt, Artificial Sequence
  derived and/or modified sequence opt3 from MSC__Homo_sapiens__NP_005089
augagcaccggcuccgugucugaccccgaggaaauggagcugagagggcuccagagggaauacccugucccagccucaaagcggccgccccuucgcggaguugagcgaaguuaugcuagcccuuccgauaacucuucggcagaagaggaggacccagauggugaagaggaacguugcgcccugggcacagcggggucagcugagggauguaaaagaaagaggccccggguggccggcggugggggagcaggcggcagcgccgggggagguggcaaaaagccuuugccagcuaaagggagugcagccgagugcaagcaaucccagcgcaaugcugccaacgcgagagaaagggcacggaugcgcguauuaucuaaggccuucagccgacugaaaacuucccuacccugggugccuccagacacgaagcucucaaaacuggauacccuuagacuggcuaguagcuacaucgcccacuugaggcagcuccugcaggaggaccgguaugaaaauggauacguccauccggugaaccugacauggcccuuuguugugucuggccguccugauuccgacacuaaggaggucucagcagcuaaucgccucugugguaccacagccuga

SEQ ID NO: 59242 - RNA, 582 nt, Artificial Sequence
  derived and/or modified sequence opt3 from MSGN1__Homo_sapiens__NP_001099039
auggacaaccugagagagaccuuccucagccuugaagauggccugggguccucugacucacccggauuguuaaguagcugggauuggaaggacagggccgguccuuuugagcugaaucaggcuuccccaucucaaucgcuaucaccggcacccagccucgaaaguuacuccucuagcccuugcccagccguggcgggccugcccugugagcacgggggagcuuccucaggcgguagugaagggugcagcgucggaggcgccucuggccuuguugagguggauuauaacaugcuggcauuccagccuacacauuugcaagggggagguggcccaaaagcccagaaggggacuaaaguacggauguccgugcagcgccgacguaaggcuucagagagagaaaaacucaggaugcggacgcuggcagacgcccugcacacccuccgcaauuacuuacccccugucuauagccagagaggacagccacugacaaagauccagacucuuaaguacaccauuaaauauauaggcgaguugacagaucugcuaaacaggggucgggaaccgcgcgcucaaagugccuga

SEQ ID NO: 59243 - RNA, 2805 nt, Artificial Sequence
  derived and/or modified sequence opt3 from MSH2__Homo_sapiens__NP_000242
auggccgugcagcccaaggagacccugcaacucgaaagcgcugcagaggucggcuucguuagauuuuuccaggggaugccugaaaaaccaacaacuacggugaggcuuuuugaccggggagauuucuacaccgcccacggugaggacgcgcuguuggcugcccgcgaaguauuuaagacacagggcgugaucaaauauauggggccggcaggagccaagaacuuacaguccgucgugcugucuaaaaugaauuucgagucauuuguuaaggaucuacuccuggugcgacaauaccgugucgagguguauaagaacagagcuggcaauaaagcaaguaaggaaaacgacugguaccuugccuauaaagcuagccccgguaaucugucccaguucgaggauauuuuguuugggaacaaugacaugucugccucgauaggaguaguuggcgugaagaugucagcggucgauggccagaggcaggucggggugggauacgucgacagcauccaacggaaacucggucugugcgaguucccugauaacgaccaguuuaguaaucuggaagcacucuuaauucagaucggcccaaaggaguguguucugcccgggggagaaacugccggcgauauggguaagcuacgccagauuauccaaagagggggaauauugaucaccgagaggaaaaaggcugacuucuccacaaaagauauuuaucaggaccugaaccggcuacucaagggcaaaaagggcgaacagaugaacucugccgugcugccugagauggaaaaucaaguagcagugagcucccuuucagcugucaucaaauuucuggaguugcucagugacgauagcaauuucgggcaguucgagcugaccacuuuugacuucucucaguacaugaaguuagauauugccgcggugcgcgcccugaaccucuuucagggauccguugaagacacaaccgguucacaaagccuugcagcucuguugaauaagugcaaaacgccacagggccagcgacuugugaaccaguggaucaagcaaccccugauggauaaaaacagaauagaggaaaggcucaaucuggucgaggccuucguggaagacgcugagcuucggcagacucugcaggaggauuugcuccgucgcuuuccugaccugaacagauuagccaagaaauuccagaggcaagcagccaaucugcaggauuguuaccggcuauaucaggggauuaaccagcucccaaauguaauccaagcucuggaaaagcaugagggaaagcaccagaaacuuuugcuggcgguuuuugugaccccgcucacagaccugcgaagugauuucucuaaguuucaggaaaugauugagacuacccuugacauggaccaagucgaaaaccaugaguuccuggugaaacccuccuuugauccuaauuugagcgagcuccgcgaaaucaugaacgaccuggagaagaaaaugcagucgacauuaaucucugcagccagagaucugggccuagacccagguaagcagauuaagcucgauuccucagcucaguucggguacuauuuuagggugaccugcaaagaagagaaggugcugcggaauaacaaaaauuucaguacgguugacauacaaaagaacggcgugaaauucacuaauagcaaacuuacauccuugaacgaggaauacaccaagaauaagacugaguaugaagaggcccaggaugcaaucguaaaggaaauugucaacaucucuagcggauacguggagcccaugcagacacugaacgacguucucgcccagcuggaugcuguggucucauuugcccacgugaguaauggcgcaccuguaccauaugugcgccccgcgauauuagagaaagggcaaggaagaauuauccugaaggcuuccaggcaugccuguguugaaguccaggacgagaucgcauucauuccgaacgauguguacuuugaaaaagacaagcagauguuccacaucauuaccgguccuaauaugggcgggaaaagcacguacauacgucagaccggagugaucguccuuauggcccaaauuggcugcuuuguucccugugagucugcugaagugucaaucguggauugcaucuuggcccggguaggugcaggggacagucagcucaagggcgucagcacauucauggcugagaugcuggagacugccuccauucuacgaucugcgaccaaggacucgcugauaaucauugaugaacucggaagaggcacaagcacuuaugacggguuuggacuggccugggcuaucuccgaguacauugcaaccaaaaucggugccuucuguauguuugcuacacacuuccaugaacuuaccgccuuggcaaaccagauaccaacugugaauaaccugcacguuacggcguuaacaaccgaggaaacucucaccaugcuguaucaagugaagaaaggcgucugcgaucagucauuugggauccauguggccgagcuugcuaauuucccuaagcacguuauugagugugccaaacagaaggcacuggaauuggaggaauuucaguacaucggagagagucaaggcuaugacauuauggagcccgcugccaagaaaugcuaccucgaaagggagcagggugaaaagaucauacaggaguuccugucuaaagugaagcagaugccauucacagaaaugagcgaggagaacauuaccaucaaacuaaagcaacugaaggcagaaguaauugccaaaaauaacuccuuugucaaugagaucauaucacgcaucaaggugacuacauga

SEQ ID NO: 59244 - RNA, 3414 nt, Artificial Sequence
  derived and/or modified sequence opt3 from MSH3__Homo_sapiens__NP_002430
augagcagaaggaagcccgccuccggcgggcuggcugcaucuucaagugccccugcgcggcaggcugugcucagccgcuucuuucaauccaccggaucucuuaaaucgacaucaagcaguacuggugccgcagaccaggucgauccaggcgccgcugcagccgcugccgcggcagccgcugccgcaccgcccgcuccuccagcccccgcguucccuccacagcugcccccucacaucgccacggagauugaccgacguaagaaaagaccauuggaaaacgaugggccgguuaagaaaaaggugaagaaaguacagcaaaaggagggaggcuccgacuuagguaugucugggaauagcgaacccaaaaagugccugaggacccggaacguguccaaaucacuagagaagcucaaggaauuuuguugcgauagugcacugccucagagccgcguccagacagagucucuucaggagagauucgcugugcugccaaaauguacugacuuugaugacauauccuugcuccaugccaagaaugcuguuucaagcgaagauaguaaaaggcaaaucaaccagaaggacaccacacuguucgaucugucucaguuuggauccagcaauaccucgcacgagaaccuccagaaaacugccucuaaguccgcaaauaaacggucaaagaguauuuacacacccuuagaacugcaauauaucgagaugaagcagcagcauaaagacgccgugcuuugcgucgaguguggcuacaaguaucgcuucuuuggcgaagaugcugagauugcggcacgagaauugaacaucuacugccaccuggaccauaauuucaugaccgccagcauaccuacgcacagacuauuugugcacguaaggcggcucguugcuaaaggguauaaggugggagucgugaaacaaacugagaccgccgcacugaaggccaucggugacaaccguuccucucuuuucagccgcaagcugacagcuuuguacacuaaaucaacccucauuggcgaagaugugaauccacugaucaaguuagacgaugccgucaacguugacgagauuaugacagauaccaguacguccuaucugcucuguaucagcgagaauaaagaaaacgugagagacaagaaaaaggggaauauauuuauuggaaucguaggcgugcagcccgcaacuggugaggucguguucgauucuuuccaggacucagcgaguaggagcgaacuugagacacggauguccucucugcagccgguugaauugcuacugccuucggcucucagcgagcaaaccgaggcccugauucaucgagcaacuuccgugucaguccaggaugaccgcaucagaguggaaaggauggauaacaucuacuuugaguacagucacgccuuccaggcuguaacagaauuuuaugccaaggacaccguugacauuaaagggucucagauaaucagcggaauugugaaccuugagaagcccgucaucugcucccuggcagcuauaauuaaauacuugaaggaguucaaucucgagaaaaugcugucaaagccagagaacuuuaagcaauuaagcucuaaaauggaguucaugacgaucaauggcaccacacugcggaaccuagaaauccuccagaaucagacugauaugaagaccaaaggcucccugcuuuggguguuggaccauacaaagacuucuuuugggcgcagaaaacugaagaaaugggucacccagccucuccugaaacuuagggaaauuaacgcccgucuggaugcggugagcgagguuuugcacucugaguccucaguguucggacaaaucgaaaaucaccuccggaagcugcccgacauugagcgagguuuauguaguauauaucauaagaagugcagcacacaggaauuuuuccugaucguaaaaacccuauaccaccucaagucggaguuucaggccauuaucccagcugucaacucccauauccagucugaucugcuuagaacugugauuuuggaaauacccgagcugcucagcccuguugagcacuaucugaaaaucuuaaaugaacaagcagccaaggugggcgacaagacggagcuguucaaagaucuuucagacuuuccauugauuaagaaaaggaaggaugaaauccagggggucauugacgagauccgcaugcaucuccaggaaauacggaaaauccugaagaacccgagugcucaauacgugacaguauccggacaggaguucaugauugagaucaagaauagugccgugagcuguauucccaccgauuggguuaaagucggcuccacuaaggcagugucaagauuccacagcccuuuuaucguggaaaacuauaggcaccuaaaucagcugcgcgagcagcucguccuggacugcagugcggaauggcuugauuucuuggagaaauuuucugaacauuaccacucccugugcaaggccguucaucacuuagcuaccguggacuguauauucagccucgccaaaguggcaaagcaaggugacuacugccgaccaacaguacaggaggagcggaagauugucaucaaaaacgggcgucaccccgugauugauguucugcuuggcgaacaggaccaguaugugccuaauaacaccgaucugucggaggacucagaaagagucaugaucauaacuggaccaaacaugggcgggaagucuaguuacaucaaacaaguggcuuugauuacaaucauggcccagauuggauccuauguucccgcagaggaggccacgaucgguauaguggauggcauuuuuaccaggaugggggcugcggacaauaucuacaagggacagagcacuuucauggaagaacucacagauaccgccgaaaucauucgcaaagcaacaucucagagccugguaauccuagacgagcugggccgggguacuuccacccaugaugggauugcuauagccuaugccacgcucgaauacuuuaucagagacgucaagucacugacccuuuucgugacacacuauccgccugugugugaguuggagaaaaacuacagucaucaagucggcaauuaccacaugggauuucugguuagcgaagaugagucuaaguuagacccaggcgcugcagaacaggugcccgauuucguaacuuuucucuaucagauuaccagggggaucgccgcgcgauccuacggacugaacguggcuaaacuugccgacgucccuggugagauucugaagaaggcagcccauaaaucaaaggaacuagagggccucaucaauacaaaacgcaagcggcugaaguauuucgcuaaauuguggacuaugcacaacgcacaagaccugcagaaguggaccgaggaauuuaauauggaggaaacgcagacaaguuuacuccacuga

SEQ ID NO: 59245 - RNA, 2469 nt, Artificial Sequence
  derived and/or modified sequence opt3 from MSH5__Homo_sapiens__NP_079535
auggccagccugggcgcuaaccccagaaggaccccucaggggccacggccgggagcagccuccucugguuuccccagcccugcgccagugcccggcccucgcgaggcugaagaggaagaggucgaagaggaggaggaacucgccgaaauccaccuuugcguucuguggaauaguggguacuugggaauugcauauuacgacacaagcgauuccacuauacauuuuaugccagacgcccccgaucacgagucuuuaaagcugcuacaacgagugcucgacgagaucaacccucagucgguagugacgucagcuaaacaggaugaaaauaugacccguuuccugggcaaacuugcaagccaggagcauagagaaccaaagaggccggagauuaucuuucugcccagugucgacuucgguuuggaaauuuccaagcaacggcuccugucugggaacuauagcuuuaucccugaugccaugacagcuacugagaaaauacuguuccucuccucaaucauuccauuugacuguuuacugaccccaccuggagaucuucgcuucacaccaauccccuugcugauuccgagucaggugagagcccuaggcggccuccugaaguuucuugggaggcggcgcaucggaguugagcuggaagacuacaaugugagcgucccuauauuggguuucaagaaauuuaugcucacccaccuggugaacauugaucaggacacuuauucuguauuacagaucuucaaguccgagucacaucccagcguuuacaaaguggcgaguggccugaaggaagggcucucucuuuuuggcauucugaaucgaugccacuguaaauggggagagaaguugcuaagacugugguucacaaggccaacccacgaucucggugaacuguccagccggcuugacgucauccaauucuuucuguugccucagaaccucgacauggcacagaugcugcaucguuuacuggggcacaucaagaaugugccccuaauucucaaacgcaugaagcugucgcauacgaaagugucugauuggcagguccuuuauaagacuguuuacuccgccuugggacugagagacgcuugcaggucacucccacaaaguauacagcuguuccgggauaucgcccaggaguuuagcgacgaucuucaccacauugcaucccugaucggcaaagugguagacuucgagggcucuuuggcugaaaaccgauuuaccgugcuccccaauauagauccugagauugacgaaaagaaacgcagacugaugggguuacccagcuuccugacagaggucgccaggaaggaacuagagaaccucgauucacggaucccgaguuguuccgugaucuacauuccccugaucggauuucuuuugagcauuccucgccugccaucuaugguugaggcgucagacuucgaaauaaauggucucgauuuuauguuccugagugaggaaaaguuacauuauagaagcgccaggacuaaagagcuggacgcacuuuugggcgaccuccacugcgagauccgugaucaagaaacccugcuaauguaccagcugcagugucaggugcucgcucgggccgcuguccugacacgagugcuugacuuggccuccagacuggauguauuacucgcacuggccucugcugcgagggacuauggguacucgcgcccccgguauagcccucaaguucuuggagugaggauucagaacggcagacauccacugauggaguugugcgcacgcaccuuuguccccaauuccacggaaugugguggggauaagggccgagugaaagucaucacuggaccgaacucaaguggcaagucuaucuaccucaaacagguggggcugauuacauucauggcccuaguuggaucauuugugccugcugaggaagccgagauaggugcaguagacgccaucuucacccggauucacuccugcgagucaaucagccugggccucucuacuuucaugauugaucugaaccagcaagucgcuaaggccgugaauaacgcaacagcgcagucccuuguuuugaucgacgaauuugggaagggaaccaauacgguggauggccuggcuuuacucgccgcaguccugcgucauuggcuugccagagguccaaccuguccccacauauucguggcuacaaacuuucugagucuaguacagcuccagcuguugccucaagggccccuggugcaguauuuaacuauggagaccugcgaagacggcaaugaucucguuuucuuuuaccaggucagcgaccugaucaggucuggaaaaccaauuaagccugugaaagaucuucugaagaaaaaccagauggagaauugccaaacauugguggacaaguucaugaagcucgaccuggaagaucccaaccuagaccugaaugucuuuaugucccaggagguucuuccagccgcaacuucaauccucuga

SEQ ID NO: 59246 - RNA, 4083 nt, Artificial Sequence
  derived and/or modified sequence opt3 from MSH6__Homo_sapiens__NP_000170
augagcagacaguccacccuguacucuuucuuucccaagaguccugcccucucagacgcuaacaaagcaagcgccagggcgucccgggagggcgggcgcgcugccgcagccccaggagcuucuccgucgcccgguggcgaugcagccuggucagaagcugggccuggaccacgaccccuugcccguagcgcgaguccuccaaaggcaaagaaucugaacggcgguuugagaagguccguggcccccgcugccccuacaucuugcgacuucagcccaggggauuuagucugggcaaagauggagggauauccgugguggcccugucugguuuacaaucacccuuuugacggcacuuucauccgggaaaaaggcaaguccgugcgcguacaugugcaauuuuucgaugacucaccaacgagagggugggucaguaagaggcuacucaaacccuauaccggaagcaagucuaaagaggcucagaaggguggccacuuuuacuccgccaaaccugaaauucugcgggcgaugcagcgcgccgaugaggcacuuaacaaggacaagauaaaacgacuggaguuggcugugugcgaugaaccaucagagcccgaagaggaggaagagauggaaguugggacaacuuaugugaccgacaagagcgaggaagauaaugagaucgagagugaagaggaaguccagccgaaaacacaaggaucuagaagguccagccggcagauuaagaaacgucgcgugaucucggacucugaguccgauauuggcgguucagacguagaguucaagccugacaccaaagaagaggggaguagcgaugaaaucuccucuggaguuggcgacagcgagucagaaggccucaacagucccgugaaggucgccagaaagaggaaacggauggugacugggaauggaucccugaagcgaaaaagcucucgcaaggagacaccaucagcuaccaaacaggccacgaguauaagcuccgaaacuaagaacacccugagagcauuuucugccccucaaaauucggagagccaggcucauguguccgguggcggggaugacucaaguaggcccacagucugguaccacgagacucucgaaugguuaaaggaggaaaaacggcgcgaugagcauagaaggcguccagaccaccccgauuucgacgcgucuacccuguauguuccugaggauuuucuuaacagcuguacaccaggaaugcggaagugguggcagaucaaaucccagaauuucgacuuggugauuugcuacaagguaggcaaauuuuacgaacuguaucacauggaugcacuaaucggugugucagagcucgggcuggucuucaugaagggcaacugggcccauagcggauucccggaaauugcuuuuggccgauacucugacucccuugugcagaagggguauaaaguugccagaguggagcaaaccgaaacgcccgagaugauggaggcaaggugucgcaagauggcccacaucaguaaauacgaccgggucgugagaagggaaauaugccgcauuaucacuaagggaacacagaccuauagcguacuggagggugauccuucugaaaauuacuccaaauauuugcucucacugaaggagaaggaagaggacaguagcggccauacucgagcuuacgggguuuguuucguggauacaucguuaggaaaauuuuucauuggccaguuuuccgacgaucggcacugcucucguuucagaacccuggucgcccacuacccacccgugcaaguccucuuugagaaggguaaccuuagcaaagaaacgaagaccauccugaaaucaaguuuguccuguucucuacaggaggggcugaucccuggcagccaguucugggacgcauccaagacacucaggacucugcuugaagaggaauauuuucgcgagaaacugucagauggaauuggcgugauguugccacagguucucaaggggaugaccagcgagagugacucuauaggacugacacccggugaaaaguccgaguuagcgcugagcgcucuaggcgggugcguguucuaccucaaaaagugucugaucgaucaagaacuuuugucgauggccaauuuugaggaguauauuccgcuggacucagauacuguaucuaccacacggaguggagcaaucuucaccaaagccuaccagagaaugguccucgacgcugugacucugaacaaccuugaaauauuucugaauggcacgaacgguuccacagaggggaccuugcucgaaaggguugauacuugccauaccccuuucggcaagcgacuguuaaaacaguggcugugcgccccacuauguaaucacuaugcaauuaacgaccgccucgacgcuaucgaggaucugauggugguccccgacaagaucagcgaagugguagagcuuuugaagaaacugccugaucucgagcggcuguuaucuaagauucauaaugugggaagcccccugaaaucccagaaccacccagacucaagagccaucauguacgaagagacaaccuauaguaagaaaaagauuauagauuuccuuagcgcguuggaaggcuuuaagguuaugugcaaaaucauugggaucauggaggaagucgccgacggauucaagucuaaaauccucaagcaagugauuucccugcagacuaaaaauccugagggcagguuucccgaucuaacaguggagcugaaccguugggacacggcuuucgaucaugaaaaggcacgcaagaccggucucauaacuccaaaagccggguuugacucagauuacgaccaggcucuggccgauauccgggagaaugaacagagucuuuuggaguaccuggaaaagcaaagaaacaggauuggaugucgaacaaucgucuauuggggcauuggucggaaucgcuaccaguuagagaucccggagaacuucaccacaagaaaucucccugaagaguaugaacugaaaagcacuaagaaaggcugcaagagguacuggaccaaaacgauagagaagaaacuugcaaaccugaucaaugcggaggaacggcgagacguuuccuugaaagacuguaugagacgccucuuuuauaacuucgauaagaacuacaaagacuggcagucugccguggagugcauugcugugcuggauguacuacugugucucgccaauuauucgcgugggggagacggccccaugugcaggccagucauccugcuucccgaagauaccccuccauuuuuggagcugaaggggagccggcaccccuguauuacaaaaacuuucuuuggagacgauuucaucccuaacgacauauuaauuggcugcgaagaggaggaacaggagaaugguaaggcauacugugugcucguuaccgggccgaacaugggaggcaagucaacacugaugagacaagcuggucuucuggccgugauggcacagaugggcugcuacgucccagccgaagugugcaggcuaacucccaucgaucgcguuuuuacccgacucggggcuuccgacagaauuaugaguggagagucuacguucuucguggaacugagcgagacagcguccaucuugaugcacgccaccgcacauucacugguauuagucgaugagcucggccgggggacugcuacauuugacggaaccgccauagccaaugcuguggugaaagaacuggcagagacuaucaaguguaggacccuuuucucuacacacuaucauagccuggucgaagacuacagucagaacguugccgugcgcuugggccacauggcgugcaugguagagaaugaaugugaggauccuucccaagagacgauuaccuuucucuauaaauucaucaagggugcuugcccaaaaagcuacggguuuaacgccgcacgucuggccaaucuacccgaagaggugauucagaagggacacagaaaggcucgggaauuugagaaaaugaaccagucucugaggcuuuuccgcgaggucugucucgcaucagaacgauccacuguggacgccgaggcgguucauaagcuguugacacugaucaaagaauuauga

SEQ ID NO: 59247 - RNA, 1089 nt, Artificial Sequence
  derived and/or modified sequence opt3 from MSI1__Homo_sapiens__NP_002433
auggagaccgacgcaccccagccuggccuggcuagcccagauuccccgcacgaccccugcaagauguucaucgggggacucucuuggcaaacaacucaggaaggucuuagagaguacuuuggccaguucggggaagugaaagagugucuggucaugagggauccuuugacgaagcggucacgcggauuuggcuucguuaccuuuauggaccaggccgguguggauaaaguauuagcccaaagucgacaugaacuggacagcaagacaauugauccaaaaguggcguucccccguagagcucagccuaagauggucacuaggaccaagaaaauauuuguugggggacuauccgugaacacaaccguggaggacgucaagcaguauuucgagcaguuuggcaaaguggaugacgccaugcucauguucgauaagacuacaaaucggcaccgcggcuuuggguucguaaccuuugaaucugaggacaucguugaaaaagugugcgagauucauuuccacgagaucaacaauaagauggucgaauguaagaaagcacaaccaaaggaggugaugucgcccacgggaucagccagagguaggagccgggugaugccuuacggcauggaugcuuucaugcuggggauuggaaugcuuggcuauccagguuuucaggcaacuaccuacgccagucgcuccuauacagggcuggcuccgggauacacuuaucaguuccccgaauuucgagucgagagaaccccuuugccaucugcccccguucucccugaacugacagcgaucccacugaccgcauacggccccauggccgcugccgcagcugccgcggccgugguaaggggcacggggagccauccguggacuauggcaccucccccaggauccacaccuucacggaccgguggcuuccucgggacuacaagucccggaccaauggcugaguuauacggcgccgcuaaccaggacagcggugugucuuccuauauaucagccgcaagccccgccccuaguaccggguuuggccacucucugggaggcccacuuaucgcuacggcguucaccaauggguaccacuga

SEQ ID NO: 59248 - RNA, 987 nt, Artificial Sequence
  derived and/or modified sequence opt3 from MSI2__Homo_sapiens__NP_620412
auggaggccaacggcagccaggggaccuccggaucugcuaaugacucacaacacgaucccgguaagauguucaucggcgggcugaguuggcagacaagcccugacucccucagagauuacuuuucuaaauucggagaaauuagggagugcauggugaugcgggacccaacuacgaagcgcucgcgaggcuuugguuucgucaccuuugcagauccggccucaguugacaaagugcuugggcagccccaucacgaacuggauagcaagacaauagacccuaaaguagcguucccacguagagcucagcccaagauggugacuaggaccaagaaaaucuuugucggaggcuugagugccaacacagugguugaggaugugaagcaauauuucgaacaguuuggcaaagucgaggacgcaauguuaauguucgauaagaccacuaaucggcaucgcggguuuggauucgugacauuugagaacgaagacguaguugagaaagugugugaaauucacuuccaugagaucaauaacaagauggucgagugcaagaaagcccagccuaaggaagugauguucccacccgguaccagaggcagggcucgggggcugccuuacacgauggaugcauuuaugcuaggaaugggcaugcucgguuauccaaauuucguggccacuuacgggcgcggauauccgggcuuugcucccuccuacggcuaucaguucccuggguuuccagccgcggcauacggacccgucgccgcugccgcaguugcugccgcgcgagguucuggcagcaacccugccagaccagggggauuccccggcgcaaauuccccggguccuguggcugaccuguacgggcccgccucacaagacaguggcguaggaaacuauauuagcgcugccucuccacagccuggcuccggguuuggacacgguaucgcaggcccccuuauagccaccgcuuucacaaauggguaccacuga

SEQ ID NO: 59249 - RNA, 1866 nt, Artificial Sequence
  derived and/or modified sequence opt3 from MSLN__Homo_sapiens__XP_005255091
auggcccugcccaccgcuagaccucuccuuggcagcugcgggacaccagcacugggauccuuguuauuccugcuauuuucucucgguugggugcagccgucaaggacucuggccggcgagacggggcaagcggcuccccuugacggaguccuggccaacccuccaaauaucaguagcuugucuccccggcagcuccugggcuucccuugugcagaaguuuccggucugucgaccgagcgcgugcgagaacucgccguagcuuuagcacagaagaacgugaaacugucaacagagcagcuucguugcuuggcccacagacugagcgaaccacccgaggaucuagacgcucucccucuggaucuucuguuguuucucaauccagacgccuucagugggccgcaagcguguacuagguuuuucucccggauuaccaaggcaaacgucgaucuguuaccccgcggagccccugagagacagaggcugcucccagcugcccuugcaugcuggggcgugcggggcucucuguugagcgaagcugacguucgcgcccuagggggacuggcgugugaucuccccggucgauuuguggccgaguccgcagaaguccugcuuccuagacuggugucaugcccaggccccuuggaccaggaucagcaagaggcugccagggcugcccuccaagggggaggcccgccuuacggucccccaaguacauggagcguaucuaccauggacgcacugcggggguuacugccuguucuaggacagcccauaauccguuccauuccacagggcaucguggccgcuuggcgccagagaucaagcagggaucccaguuggcggcagccugagcgaacuauucuccgcccaagauucaggcgggaagucgagaaaacagcguguccgucuggcaagaaagcacgcgaaaucgacgagucccugauauuuuauaagaagugggaacuugaggccugcguggaugcugccuugcuggcaacccagauggacagagugaaugccauccccuucacguacgagcaacucgacguccugaaacauaaacuugaugaacuguauccucagggguacccagagagcguuauucagcacuugggauaucucuuucugaagaugucgcccgaagacaucaggaaguggaacgugacuucuuuagagacccugaaagcucuacucgaaguaaauaagggucaugagauguccccucagguggccacacugauugaucguuucgucaagggccgggggcaacuugacaaagauacuuuggacacccugacagcauuuuacccaggauaucucuguucacugagucccgaggaauuaagcuccgugccgccuucuagcaucugggcgguucgaccacaggaucuggauaccugcgaccccagacagcuugacguguuguacccuaaggcuaggcucgccuuccagaacaugaauggcucagaguacuucgucaaaauacaaaguuuucuggguggggcacccacggaagaucuaaaggcccugucccagcagaacgugagcauggaccucgcuacuuucaugaaacugcgcacagacgccguacuuccauugaccguugcagaggugcagaagcuguuaggcccucacgucgaaggacucaaagcugaggagcggcauagacccgugagggauuggauucugcgccaacgacaggacgaucuugacacucugggcuuggggcuccagggagguaucccaaauggcuaucugguccuagaucugucuaugcaggaagcccucucagggacaccgugucugcuuggaccuggccccguguugaccguucuggcguuacuccuggccaguacgcuugcuuga

SEQ ID NO: 59250 - RNA, 345 nt, Artificial Sequence
  derived and/or modified sequence opt3 from MSMB__Homo_sapiens__NP_002434
augaacgugcugcucggcagcgucguuaucuucgccaccuuugugacacuuugcaaugcuuccuguuacuucauucccaacgaggggguaccuggagacucuacuagaaagugcauggaucugaaagguaauaagcacccaauaaacucagaauggcagacggacaauugugagaccugcacauguuaugaaacugagaucaguugcuguaccuuggugagcacaccggucggcuacgauaaagacaacugccaaaggauuuuuaagaaagaagauuguaaguauaucgugguugagaagaaagaccccaagaaaaccugcuccgugucugaguggauuaucuga

SEQ ID NO: 59251 - RNA, 489 nt, Artificial Sequence
  derived and/or modified sequence opt3 from MSMO1__Homo_sapiens__NP_001017369
augcccagaugguacuuccugcucgccaggugcuuuggcugugcugugaucgaggacaccuggcacuauuuccuucaucggcuguugcaccauaagcgcauuuacaaauauauacacaagguccaucacgaauuucaggcaccuuucgggauggaggccgaauacgcgcacccauuagagacacugauccuaggaacuggcuuuuucauugguaucguucuccugugcgaucaugugauucuucugugggcuuggguaacgauccgauugcucgaaaccauagacgugcacagcggguaugauaucccgcugaacccccugaaucucauuccuuuuuacgccggaucccgucaucacgacuuccaccauaugaacuuuaucggcaauuaugcaucuacauucacuuggugggauagaauuuuugguaccgacucacaauacaacgccuacaaugagaaaaggaagaaauucgagaagaagacagaauga

SEQ ID NO: 59252 - RNA, 420 nt, Artificial Sequence
  derived and/or modified sequence opt3 from MSMP__Homo_sapiens__NP_001037729
auggcccugagaaugcucugggcuggccaggcaaaggggauccuuggagguuggggcauuauaugccuggugaugagcuuguuacugcagcaccccggggucuacuccaaauguuauuuccaggcccaggcgccuugccauuacgagggaaaguauuuuacccuaggcgaaucuuggcucaggaaagacuguuuccacugcacaugucugcauccaguugguguggggugcugugauacuucacagcacccgaucgacuuucccgcuggaugcgagguacggcaagaagccggcacgugucaguucagucuugugcaaaagagcgauccucgccugccaugcaaaggcgggggacccgacccugagugggguuccgcaaacaccccaguccccggcgccccugcuccacauucuucguga

SEQ ID NO: 59253 - RNA, 1734 nt, Artificial Sequence
  derived and/or modified sequence opt3 from MSN__Homo_sapiens__NP_002435
augcccaagaccaucagcgugagagucacaacuauggacgccgagcuggaguucgcuauucagccuaacacgaccggcaaacaacucuuugaucagguugugaagacaauagggcuuagggagguaugguucuuuggacugcaguaccaggacacuaaagguuucuccaccugguugaaguuaaauaaaaaggugacagcacaagauguccggaaggaaucuccacugcuauuuaaauuccgcgccaaguuuuauccggaggacgugucagaagaacucauccaggauauuacccagcgacuguucuuucuucagguuaaagagggcauccugaacgacgauauuuacugucccccugaaacugcgguguugcucgcuaguuaugccguccaaagcaaguacggggacuucaauaaagaggugcacaaguccggauaucuggcaggcgauaagcugcucccacagcguguauuagaacagcauaaacugaacaaggaccagugggaggagagaauccaaguuuggcacgaagaacauagggguaugcuucgggaagaugccguguuggaguaccugaaaauagcucaggaccuagaaauguauggggucaauuacuuuucuaucaagaacaaaaagggaucggagcucuggcugggcguggaugcacuuggccugaauauuuacgagcagaacgaccgcuugacacccaaaaucggguucccuuggucagaaauuagaaauaucagcuuuaacgacaagaaguucgugauaaaaccaauugauaagaaagcccccgacuucgucuuuuaugcuccuaggcuccggaucaauaagcgcauucuggccuuaugcaugggaaaccacgagcuguacaugcgaagaaggaaaccagauaccaucgaaguucaacagaugaaggcgcaggcacgggaggaaaagcaucagaaacaaauggagcgugccaugcucgagaaugaaaagaaaaagcgcgagauggcugaaaaagagaaggaaaagaucgagagagagaaagaggagcuuauggaaaggcugaagcagauugaggagcagacgaaaaaggcccagcaagaauuggaggaacagacucggcgagcacuagagcuggaacaggagcgcaaaagagcucagagugaggccgaaaagcucgcgaaggagaggcaagaagccgaggaagcaaaagaggcucugcuucaggccucccgggaccagaagaaaacccaggagcaacuggcuuuggaaauggccgagcucacagcacgcauaucucagcuggaaauggccagacagaagaaagagagcgaagcuguggaguggcaacagaaggcgcagaugguacaggaggauuuagagaaaacuagggcagaacugaagaccgccauguccacaccgcacguggcugaacccgccgagaacgagcaagacgaacaggaugagaauggugcagaagccucagcugaccuacgugccgaugcaauggcgaaggaccggagugaggaggaacgaaccacggaggcugagaaaaacgaaagaguccagaagcaccucaaagcccugacuagcgaacuugcaaacgccagggaugagucuaagaaaacagcuaaugacaugauccaugccgaaaacaugcgcuugggccgggacaaguauaagacccugagacagauuaggcaagggaauacuaaacagcgcaucgaugaguucgaguccauguga

SEQ ID NO: 59254 - RNA, 1077 nt, Artificial Sequence
  derived and/or modified sequence opt3 from MSR1__Homo_sapiens__NP_002436
auggagcagugggaccacuuccauaaccaacaggaagauaccgacagcugcuccgagucugugaaguuugaugccagaucaaugacagcucugcucccaccuaaucccaaaaacaguccgagccuucaggaaaagcugaaauccuucaaggcagccuugaucgcguuauaccugcuagucuuugcuguucucauuccccugauaggcaucguggccgcacagcuucugaaaugggagacuaagaauuguucuguaucgucaacgaacgccaaugacauuacccaauccuugacagggaagggaaacgauagugaagaggagaugagguuccaggaaguguuuauggagcacauguccaauauggaaaaacggauccagcauauucucgacauggaggcuaaccugauggauacugagcacuuccagaauuuuucuaugaccacagaccaacgcuucaacgauauccugcuccaguuaagcacccuguuuuccucaguccagggucauggcaaugcaauagacgaaaucaguaagagccuuauuucuuugaacacuacacugcuagaucuccagcugaauaucgagaaccuuaaugggaaaauucaagaaaacaccuucaagcagcaggaggaaaucuccaaacuggaggagcgaguguauaacguuucagccgaaauaauggcuaugaaggaggaacaagugcacuuggagcaggaaauuaagggagaggucaaagugcucaauaacaucacgaaugaccugcguuuaaaggauugggagcacagccagacucugagaaacauuacccucauccagggcccuccaggucccccuggggaaaaaggagacaggggcccaacaggcgagagugggccccggggauuuccugguccaaucggcccgcccgggcuuaagggagaccgcggcgccauugguuucccugggucuagaggacugccaggcuacgcgggcaggcccgggaauagcggaccuaaaggucaaaagggcgaaaaagggagcggaaacacuuugcggccaguacagcuaaccgaucauauacgcgcaggccccucguga

SEQ ID NO: 59255 - RNA, 588 nt, Artificial Sequence
  derived and/or modified sequence opt3 from MSRA__Homo_sapiens__NP_001129142
augcugagcgccaccagaagggcuugccagcuccuucuguugcacuccuuauuccccgugccucggaugggcaacucugcaucaaauaucgucaguccacaagaggcccugccggggcgcaaggaacagacacccguugcggcuaaacaucacgugaacggaaaucgaacuguagagccuuuuccagaagguacgcagauggccguguucgagaagaccggccaugcagaagucgugcguguuguguaccagcccgagcacaugagcuuugaggaacuacucaaagucuucugggagaaccaugacccuacacaagggaugagacagggaaaugaucacggcacucaguauagguccgccauuuacccaaccucugcuaagcagauggaagcagcccugucgucaaaagagaacuaucaaaaggugcuuagcgagcacgguuuugggcccauaacaaccgacauccgggaaggacagacuuucuacuaugcugaggauuaccaucagcaguaucugaguaagaauccuaacggcuacuguggcuugggagggacagguguauccugcccaguuggcauuaaaaaguga

SEQ ID NO: 59256 - RNA, 549 nt, Artificial Sequence
  derived and/or modified sequence opt3 from MSRB2__Homo_sapiens__NP_036360
auggccagacugcucuggcuucugaggggcuugaccuuagggacagcuccccggcgcgcagugcgaggacaggccgguggcgggggaccuggcacugguccagggcugggagaggcgggcagccuagcuacgugcgaacucccgcuggccaaguccgaguggcaaaagaaacuuacccccgaacaguucuacgucacacgugagaaaggcacugaaccuccauuuucugggaucuaucugaacaauaaggaggcaggaauguaccacuguguuugcugugacucacccuuguucaguagcgagaaaaaguauugcuccgguaccggcuggccuucuuuuucggaagcccaugggacaucaggaagcgaugagagucacaccggcauucucagaaggcuggacacuucccuggguucugcucggacagaagugguauguaagcagugcgaggcacaucucgggcacguguucccagauggacccggcccuaacggccagcgcuuuuguauaaauagcgucgccuuaaaauucaagccaagaaaacauuga

SEQ ID NO: 59257 - RNA, 558 nt, Artificial Sequence
  derived and/or modified sequence opt3 from MSRB3__Homo_sapiens__NP_001180390
augagcgccuucaaccugcuccaccuugugaccaagucccagcccgucgcucugagagcaugcggcuugccuucugggucauguagggacaaaaagaauugcaaaguuguguuuagucaacaggaguuacggaagcgccugacaccacuacaguaccauguaacucaggaaaaaggaacggagagcgccuucgaaggugaguauacccaccauaaggauccgggcaucuacaaguguguggucugcgggacaccccucuuuaaauccgaaacuaaguucgacucuggaucgggcuggccuucauuucacgaugugauuaacagcgaggcgauaaccuucacagacgauuuuaguuaugguaugcaucgaguugagaccuccuguucucaaugcggggcucaccugggacacaucuucgacgauggcccacgucccacuggcaaaagauacuguauuaauagcgccgcacuuuccuuuaccccugccgacucaagugggacagcugaaggagguagcggcguggcaucuccagcccaggcugauaaggccgagcuguga

SEQ ID NO: 59258 - RNA, 2178 nt, Artificial Sequence
  derived and/or modified sequence opt3 from MST1__Homo_sapiens__NP_066278
augggccuguggugggugaccguccagcccccugccagaaggaugggguggcucccacuucuguuguuacugacacaaugccuaggaguuccgggucagcggagcccccucaacgacuuccaggugcugcgcggcacugagcuucagcaccuguugcaugcuguagugccugggccauggcaagaagaugucgcagacgccgaggaaugugcgggacgaugcggcccccucauggauugucgugcuuuucacuacaauguguccucucaugguugccagcugcugccuuggacgcagcacucaccacauaccagacucaggcggagugggcgcugugacuuauuccagaagaaagauuauguuagaacaugcaucaugaacaauggagugggcuacaggggcacuauggccaccacagucgggggacugcccugucaagcauggagccacaaguuuccuaacgaccacaaauauaccccaacucuucggaaugguuuggaggaaaacuucugccgcaauccggauggcgaccccgggggaccuugguguuacacaaccgauccagccgugcgauuucaguccugcggcauuaagucuuguagagaggcugcaugcguauggugcaacggugaggaauauaggggagccguugaccggacggagucggggcgugaaugucagcgcugggaucugcagcauccccaccaacauccuuucgagccaggcaaauuucuagaccagggccucgaugacaauuacugcagaaaccccgacgggucagagaggccgugguguuauacuaccgauccucagauagaacgggaguucugcgaccugccccgauguggaagcgaagcucaaccacgccaggaggccacaacugugaguugcuuuagagguaagggcgaaggguacaggggaaccgcgaauacaaccacggcaggcgucccuugucagcggugggaugcccagaucccccaccaacaccgcuucacuccagagaaguacgcuugcaaagaccuuagagagaacuuuuguaggaaucccgaugguuccgaagccccuuggugcuucacacugcguccagggaugcgggcagcuuuuuguuaucagauucgaagaugcaccgacgaugugaggccgcaggacugcuaccauggcgccggagagcaguaucgcggcacugugucuaagacacggaaagggguccaaugucagagauggagcgcggaaacgccccacaagccucaguucaccuucaccuccgagccacaugcccaguuggaagagaacuuuugcaggaaucccgauggagacucacacgguccuugguguuacacaauggauccacgcacucccuucgacuauugcgcacuccgacggugugcugacgaucaaccgccuaguauccuggacccacccgaucagguucaguuugagaaaugcggcaagcguguggacagauuagaucagaggcgcagcaagcugcggguagucgggggacauccuggcaacucucccuggaccgugucccucagaaacaggcaaggucagcacuucugugggggcucacuugugaaagaacaguggauucugacagcccgacaaugcuuuagcaguugucacaugccauugacuggauacgagguuuggcuaggcacccuguuccagaauccucagcauggggaacccucucuccagcgcgugccagucgcuaagauggugugcggaccguccgguagccaacugguacuucugaaauuggagcggucgguuacacucaaccagagaguggcccugaucuguuuaccucccgaaugguaugucgugccacccggcaccaagugcgagauagcaggguggggagagacuaaaggcacggguaaugacacaguccugaacguggcccuacucaauguuaucucuaaccaggaaugcaauauuaagcacagggggcgugugcgcgaguccgaaauguguaccgagggccugcuugcuccuguaggagcgugcgagggcgauuacgggggaccauuggcauguuuuacucauaacugcuggguccuggaaggcaucauuauccccaaucgggugugugccagaucaagguggccugcuguuuucacccgagugagugucuuuguggacuggauacacaaaguaaugcggcucgguuga

SEQ ID NO: 59259 - RNA, 4056 nt, Artificial Sequence
  derived and/or modified sequence opt3 from MST1R__Homo_sapiens__NP_001231866
auggagcugcugcccccucuuccacagagcuuccuguuguuacugcuacucccggccaagcccgcugcaggcgaagacuggcaaugcccuagaaccccauacgccgcguccagggauuuugacgugaaauaugucguucccucuuucucagcugggggacuggugcaggccaugguaacauacgagggugaucggaacgaaagugcaguguuugucgccauccgcaaucgacuucacgugcugggcccugaccuuaagagcguucagucccucgcuacugggccagcaggagaucccggcugucagacgugcgccgcuugugguccugggccacauggaccgcccggcgacaccgauacaaaagugcugguccuggacccugcccucccagcguuagugucuugcggcucgucacugcaagggcguuguuuccuucacgauuuggagccccagggaacugcaguacaucuggccgcuccugccugccuauuuagcgcacaccauaacagaccagacgauugucccgacugcguugcuaguccgcucgguaccagggugacagucguggaacagggccaggccuccuauuucuacguggcgucuagccuggaugccgcagucgcugccuccuuuucaccucggaguguuagcauucgcagacuuaaggcugacgccucuggguucgcacccggauuuguggcccuguccguauugccaaaacaccucgugucauauagcauagaguacguccacaguuuccauaccggcgcuuuuguguauuuccugacuguucaaccugcgucugugacagacgaucccuccgcauuacacaccaggcuggcccggcucagcgcuacggagccagaacuuggugacuaccgcgagcuggucuuggauugucgauuugcccccaagagaaggcggcguggggcaccugaaggaggccagccauacccggugcuacgcguagcccauucggcucccguuggcgcccagcuggcaacugagcucucuaucgcggaggggcaggaagugcuguucggagucuucgugaccgguaaggacggcgggccuggagucggcccaaauuccgugguuugcgcuuuucccauugaucuucuggacacauugaucgaugaggguguggaaagauguugcgagucaccuguacacccagggcucaggcggggccuggacuucuuucaaagucccagcuucugcccgaacccuccaggauuagaagcccugucccccaauacuucuugucgacacuuuccucuacucgucagcucaaguuucucccgcguggaucuguuuaacggccuuuuggggcccguucaggugaccgcacuguaugucacaagacucgacaaugugaccguagcccauaugggaacgauggaugguaggauucuccagguggagcuuguucggagccugaacuacuugcucuaugucucuaauuucucacugggcgacagugggcaaccagugcagcgcgacgugagcagauuaggagaucaucugcuauuugcuuccggcgaccaggucuuccagguuccuauccaaggucccgggugcaggcacuuucucacuuguggccguugccugcgggccuggcacuucaugggauguggcuggugcgggaacauguguggacagcagaaagagugcccagguucuuggcagcaagaucauuguccgccuaaguugacagaauuucacccccacucgggcccauugcgagggagcaccagacugacucucugcggauccaauuucuaccugcaucccucaggcuuagugccugaggguacacaccaggugaccguagggcagaguccauguaggccccugccuaaagacucuagcaaacuucgcccggucccacggaaggauuucguggaagaguuugaaugcgaguuggagccccucggcacgcaggcaguuggaccuaccaacgugucccugacagucacuaauaugccacccggcaagcauuucagaguggacgggaccucaguucuaaggggauuuagcuucauggaaccugugcugauagcuguacaaccgcucuuuggcccccgcgccggugggacaugccugacucuugagggacagucuuuguccgucggcaccagucgagcggugcuggugaacgguacagaauguuuacucgcccgggucagcgagggccagcugcuuugcgcuaccccaccuggggcaacuguugccucugugccccuguccuugcagguaggaggcgcucaagugccagggucauggacguuccaguaucgugaagauccugucgugcucaguaucagccccaauuguggauacauuaacucgcacaucacaauuugcggccagcaccugaccuccgccuggcaucuaguucugucuuuucacgacggucucagagcaguggagucaaggugugagcgccaacugccagaacagcagcuuugccgguugccggaguaugucgugagagauccucagggguggguugcgggaaaccugagcgccaggggcgacggugcugccggcuucacuuuacccggguuucgauuccucccacccccucauccacccagugcaaaucuggugccucuuaagccggaggaacacgcuaucaaauuugaggucuguguagauggagaaugccauauacugggccgcgugguucggccagggcccgacggagugccucaauccacccuacucggcauucuguugccccuguuacuccuggucgccgcacuugccacagcucugguguucucuuacugguggagaaggaagcaguugguacucccaccuaaccugaaugaucuagcgagccuggaccagaccgccggugcaacuccccuuccaauccucuacuccgggucagacuaucguagcggacuggcuuugccugccauugauggccuggacaguacaacgugugugcacggugccucuuuuuccgauagcgaggacgaaucgugcgucccguuacuccgcaaagagucaauccagcugcgggaucuugacucugcucuguuggcagaaguuaaggaugugcucaucccccacgagagaguggucacccauagugacagggugauuggcaaagggcacuucggaguuguauaccauggcgaguauauagaucaagcccagaaccgaauccagugugcgauuaagucccugagccggaucacugaaaugcagcaaguggaggcuuuccuacgcgaagggcugcuuaugagaggacucaaucacccaaacguccuggccuugauaggcauuauguuaccucccgagggucugccacaugugcuccugccuuacaugugccacggggaccuucugcaguuuaucaggucuccccagcggaauccgacaguuaaagauuugaucagcuucggacuacaaguggcacgaggcauggaauaucuggccgagcagaaguuuguccacagagaccucgcugcacgcaacugcaugcuggaugaguccuucaccgugaagguagccgacuuuggccuugcgagggacauuuuagaucgugaauacuauucaguccagcagcaucggcacgcuagacugccagugaaauggauggcccucgagaguuugcaaacauacagguucacuaccaagagcgacguuuggucuuuuggggugcugcucugggaacugcuuacgcgcggagcaccucccuaccgacauaucgauccauucgaccugacccacuuuuuggcccaggguagacggcuaccccagccugaguauuguccggauucccuguaccaggucaugcaacagugcugggaagcugaccccgccgugaggccaacauuccgcguucucgugggcgaggucgagcagauugugucagcauuacugggggaucacuauguacagcuuccugcuacuuacaugaaucugggacccaguaccagccaugaaaugaacgugcguccugagcaaccacaguuuucccccaugccuggcaauguuagacggccaaggccccucucugaaccgccucgcccaacauga

SEQ ID NO: 59260 - RNA, 1128 nt, Artificial Sequence
  derived and/or modified sequence opt3 from MSTN__Homo_sapiens__NP_005250
augcagaagcugcaacucugcguguacaucuaucuuuucaugcugauugucgccggccccguugacuugaacgagaauagcgaacagaaagagaacguggaaaaggagggguuauguaaugcuugcaccuggagacagaacacaaaauccucuaggauagaagcaaucaagauucagauccugucaaaacuacggcucgagacugccccuaauauuaguaaggauguaauccgccaacugcuuccaaaggcgccgccccugcgagaguugauagaccaguacgaugugcagcgugacgauagcuccgacggaucucucgaagaugacgauuaucacgcuacgaccgagacaaucauuacuaugccuaccgaaucggacuuucugaugcaggucgaugguaaaccaaaguguugcuucuuuaaauucucaagcaagauccaauacaacaaagugguuaaggcccagcuguggauuuaucucagacccguggagacaccuaccacugucuuugugcagaucuuaaggcugauaaagccaaugaaagacggcacacgguacaccgggauucgcagucuuaaguuggauaugaaucccggaacgggcaucuggcaguccauugacguaaaaacuguucugcaaaacuggcuaaagcagccugagucuaaucucgguaucgaaaucaaagcacuggacgagaacgggcaugaucuugccgugaccuucccaggaccgggcgaagacggccugaaucccuuuuuggaggucaaggugacagauacuccuaaaagaagcaggcgggacuucgggcucgauugugacgaacacuccaccgagucacgcugcugucgauauccacugacaguggauuuugaggcuuucggaugggacuggauuauagcacccaagagauacaaggccaacuacugcaguggugaaugugaguuugucuucuuacagaaauauccucauacccaccugguucaucaagcuaauccaaggggcagcgccgggcccugcuguacgccgacuaagaugucuccuaucaacaugcucuacuuuaauggaaaagaacagauuaucuauggcaagauacccgcgauggugguagaucggugcgguugcuccuga

SEQ ID NO: 59261 - RNA, 1677 nt, Artificial Sequence
  derived and/or modified sequence opt3 from MSTO1__Homo_sapiens__NP_001243462
auggccggcggggcuagagaggugcugacccuccagcuuggacacuucgcagguuuugucggcgcccauugguggaaccaacaggacgcggcucuggggagggccacagauagcaaggaacccccuggagaguugugcccagacguuuuauaccggacuggccgcacgcugcacggucaggaaaccuauacaccgcgacuaauccucauggaucugaaagggucccuuucuucacugaaggaggaaggaggcuuguaccgugacaaacagcucgaugcagccauugcuuggcaaggcaagcugacuacccauaaagaggagcuguaucccaagaauccuuaccuccaggacuucuuaagugcagaaggggugcugagcuccgauggaguauggagagugaagucuauaccaaacgguaaaggcucgucaccccuuccuacagccaccacuccaaagcccuugaucccuacagaggcuagcauuagggucuggagugacuuucugcgggugcaccuacauccacgcuccaucuguaugauucagaaauauaaucacgauggggaagccggaagacucgaggcguucggccagggugagucuguucugaaggaaccgaaauaccaagaggaacuugaggacaggcugcacuuuuauguggaagagugcgauuacuugcagggguuccagauccucugugaccugcaugauggauuuagcggcgucggcgcaaaggccgcugaguuacugcaggacgaauacuccgggcggggaauaaucaccuggggucuccuucccggcccuuaucaccgcggggaggcccaacgaaacauuuacagacuguugaauacggcauucggccuagugcaucugacugcucacucaagucucguaugcccacugagccuuggagguucucugggguugaggcccgaaccuccaguuuccuuucccuaucuccacuacgacgccacccugccguuccauuguucagcgaucuuagccacagcacuggauacugugaccgucccuuaucggcuaugcagcagucccgugucuauggugcaccucgcugacaugcuguccuuuuguggcaagaaagucguuacagccggagcuauuaucccauucccucuugcccccggccagagcuugccagauucgcugaugcaguuugggggagcaacccccuggacgccucucucugccugcggugagccauccggcacucguuguuucgcucaaucagugguacugcgcgggauagacagagcgugccauacaagucagcuuaccccgggaacucccccuccaagcgcacugcacgccuguacaaccggcgaagagauuuuggcucaguaccuccagcaacagcagcccggugugauguccucuagccaucuguuacugacgccuugcagggucgccccacccuauccgcaccuauucucaaguugcuccccuccaguggagagcauccccguuuuuggggcacucuguucuucaaguagccugcaccagacccuugaagccuuggcucgggaucugacaaagcucgaccugcgacgcugggccuccuucauggaugcaggcguggagcaugacgaugucgcggaauuacugcaagagcuucagucuuuggcucagugcuaccagggaggcgacucgcucguggauuga

SEQ ID NO: 59262 - RNA, 912 nt, Artificial Sequence
  derived and/or modified sequence opt3 from MSX1__Homo_sapiens__NP_002439
auggcccccgcugcagacaugaccagccugccucucggcgugaaggucgaggauuccgccuucgggaaaccagcgggagguggcgcugggcaggccccgucugcagccgcugcaacagccgcugccaugggagcggacgaagagggcgcaaagcccaaaguuucaccuagucuucugccauuuagcguggaagccuugauggcugaucacagaaagcccggugccaaagaguccgcauuagcuccuucugaagggguacaagccgcgggaggcucggcccagccacugggcgugcccccugggucacuaggagcaccagacgcuccgagcagucccaggccucucggucauuucuccgucggcgggcugcuuaagcugccagaggaugccuuggugaaggcugagucucccgaaaaaccugagcggacuccauggaugcagagcccccgcuuuuccccgccucccgcccgacgucucucaccuccagcaugcacgcugagaaagcacaaaaccaacaggaagccccggacaccauucacuaccgcccagcugcucgcuuuagaacgcaaauuuagacaaaagcaguaccugaguaucgcggagagggcagaguucucuagcucccuuucauugacagaaacccagguuaagauuugguuucagaaucggcgcgccaaagcuaagcgacugcaagaggccgaacuagagaaacucaagauggcagccaaacccaugcugccuccagcugccuucggacuuagcuuuccgcugggcggucccgcagcgguggcugccgcagccggggcuaguuuguauggagccucuggcccuuuccagagagcagcucucccagucgcccccgugggccuguacacugcgcauguaggguauuccauguaccacuuaacauga

SEQ ID NO: 59263 - RNA, 804 nt, Artificial Sequence
  derived and/or modified sequence opt3 from MSX2__Homo_sapiens__NP_002440
auggccagccccuccaagggcaacgaccuguucucuccugaugaggaagggccagcuguggucgcaggaccgggucccggcccugggggagccgagggcgcggcugaagagagaaggguuaaagugucaagucucccauuuagcguagaagcccuuauguccgacaagaaacccccuaaggaggcaucuccacugcccgccgagucggcuucagccggugcaaccuugcggccuuuacugcuaagcgggcacggagcucgcgaagcccauaguccaggcccgcucgugaaacccuucgagacagcguccgucaagucugaaaauagcgaggauggcgcagccuggaugcaggagccugggcgauacuccccacccccucgucacaugucaccaacuacgugcacccugagaaagcauaaaacaaacaggaagccccggacuccguuuaccacaagucaacuucuggcuuuggaacgcaaauucagacagaagcaguaucucagcaucgccgagagggcagaauuuucuuccucacugaaucugaccgagacucaggugaaaauuugguuccaaaaccggcgcgcuaaggccaagcgacuccaggaagcggaguuagagaaacugaagauggccgcaaaaccuaugcuucccagcaguuuuucuuugccauucccuauauccagcccccugcaggcugccucgaucuacggagcuucuuauccauuucacagacccguucuaccuauuccaccggugggucucuacgccacacccgucggcuaugggauguaccaucuguccuga

SEQ ID NO: 59264 - RNA, 186 nt, Artificial Sequence
  derived and/or modified sequence opt3 from MT1A__Homo_sapiens__NP_005937
auggaccccaacugcagcugugccaccggcggguccugcacauguacuggaucuugcaaguguaaagagugcaaguguacgucaugcaaaaagaguuguugcagcuguugcccuauguccugcgcuaaaugugcacaggguugcaucuguaagggcgccucugaaaagugcucguguugcgcguga

SEQ ID NO: 59265 - RNA, 186 nt, Artificial Sequence
  derived and/or modified sequence opt3 from MT1B__Homo_sapiens__NP_005938
auggaccccaacugcagcuguaccacaggcggguccugcgccugugcuggaucuugcaaguguaaagagugcaaguguacuucaugcaaaaaguguugcuguaguugcugcccuguggguugugcaaaaugcgcccagggcugugucugcaaggggagcuccgaaaaguguagaugcugugcguga

SEQ ID NO: 59266 - RNA, 186 nt, Artificial Sequence
  derived and/or modified sequence opt3 from MT1E__Homo_sapiens__NP_783316
auggaccccaacugcagcugugccaccggcggguccugcacaugugcuggaucuugcaaguguaaagagugcaaguguacuucaugcaaaaagaguuguugcagcuguugcccuguggguugcgcaaaaugugcccagggcugcgucuguaagggggcguccgaaaagugcucuuguugcgcuuga

SEQ ID NO: 59267 - RNA, 186 nt, Artificial Sequence
  derived and/or modified sequence opt3 from MT1F__Homo_sapiens__NP_005940
auggaccccaacugcagcugugccgcuggcguguccugcaccugugcagggucuugcaaguguaaagagugcaaguguacaucaugcaaaaagaguuguugcagcuguugcccugucggaugcuccaaaugugcccaggguugcguuuguaagggcgcgucugaaaagugcucguguugcgauuga

SEQ ID NO: 59268 - RNA, 189 nt, Artificial Sequence
  derived and/or modified sequence opt3 from MT1G__Homo_sapiens__NP_001288196
auggaccccaacugcagcugugccgcugcaggcguguccugcaccugugccucuucaugcaaguguaaagagugcaaguguacaaguugcaaaaagagcuguugcuccuguugcccugucgggugcgcgaaaugugcucagggaugcaucuguaagggugccucugaaaagugcucguguugcgcauga

SEQ ID NO: 59269 - RNA, 186 nt, Artificial Sequence
  derived and/or modified sequence opt3 from MT1H__Homo_sapiens__NP_005942
auggaccccaacugcagcugugaggccggcggguccugcgcuugugcaggaucuugcaaguguaaaaagugcaaauguaccucaugcaagaaaaguuguugcagcuguugcccucuggguugcgccaagugugcgcagggcugcaucuguaagggggcuuccgaaaaaugcucuuguugcgccuga

SEQ ID NO: 59270 - RNA, 186 nt, Artificial Sequence
  derived and/or modified sequence opt3 from MT1M__Homo_sapiens__NP_789846
auggaccccaacugcagcuguaccacaggcguguccugcgccuguacugggucuugcaaguguaaagagugcaaguguacgucaugcaaaaagaguuguugcagcuguugcccugucggaugcgcuaaaugugcacacgguugcguuuguaagggcacccuggaaaauugcuccuguugcgccuga

SEQ ID NO: 59271 - RNA, 186 nt, Artificial Sequence
  derived and/or modified sequence opt3 from MT1X__Homo_sapiens__NP_005943
auggaccccaacugcagcuguuccccugugggcucuugcgccugugcugggucaugcaaguguaaagagugcaaguguaccaguugcaaaaagagcuguugcuccuguugcccagucggaugcgcaaaaugugcccaggguugcaucuguaagggcacaucugauaagugcucguguugcgcguga

SEQ ID NO: 59272 - RNA, 186 nt, Artificial Sequence
  derived and/or modified sequence opt3 from MT2A__Homo_sapiens__NP_005944
auggaccccaacugcagcugugccgcuggcgauuccugcaccugugcagggucuugcaaguguaaagagugcaaguguacaucaugcaaaaagaguuguugcagcuguugcccugugggaugcgccaaaugugcgcaggguugcaucuguaagggcgcuuccgacaagugcucuuguugcgccuga

SEQ ID NO: 59273 - RNA, 207 nt, Artificial Sequence
  derived and/or modified sequence opt3 from MT3__Homo_sapiens__NP_005945
auggaccccgagaccugcccuuguccaagcggcggguccugcacaugugccgauucuugcaagugugaaggaugcaaauguacuucaugcaagaaaaguuguugcagcuguugcccggcugagugcgaaaagugugcaaaagacugcguguguaaggguggcgaggccgcggaagcugaggccgagaagugcuccuguugccaguga

SEQ ID NO: 59274 - RNA, 189 nt, Artificial Sequence
  derived and/or modified sequence opt3 from MT4__Homo_sapiens__NP_116324
auggaccccagagagugcguguguaugagcggcgggaucugcauguguggagauaacugcaaguguaccacaugcaauuguaaaacuugcaggaaguccuguugcccuuguugcccaccggguugcgccaaaugugcucggggcugcauuuguaaagggggaucugacaagugcucauguugccccuga

SEQ ID NO: 59275 - RNA, 1293 nt, Artificial Sequence
  derived and/or modified sequence opt3 from MTA1__Homo_sapiens__NP_001190187
auggccgcuaacauguacagagugggcgacuaugucuacuucgagaauagcuccucuaaccccuaucugaucaggcggauugaggaacucaauaagaccgcaaacgggaauguugaagccaaagugguaugcuuuuaccgccgacgugauauaucaaguacacuuaucgcgcuggcugacaagcacgccacuuugagcguguguuauaaagcaggaccuggugccgauaacggcgaggaaggggagauugaggaagagauggaaaauccagagauggucgacuuaccggagaagcugaaacaucagcuaagacacagggaacucuuccugucccggcaacuugagucucugcccgcuacgcauauccgcggaaagugcucggugaccuugcucaacgaaacagagucacucaagagcuaccuggaaagagaggacuuuuucuuuuauagucugguuuacgauccucagcagaaaacuuuacuggcagauaagggcgagauuaggguggguaaucgguaccaggccgacaucaccgaucuuuugaaagaaggggaggaagacggacgcgaucaaucccgacuggagacacaggucugggaagcucacaacccacuaaccgacaagcagauagaucaguuccucgugguagccagaucuguuggcacuuuugcgagggcacuggacuguagcuccucagugcggcaacccagucuucauaugagcgccgcugccgcaucucgugacaucacacuguuccacgcuauggauaccuugcacaaaaauauuuaugacaucuccaaggccauuucagcgcucgucccucagggcgggccagugcugugccgcgaugagauggaggaauggagcgccagugaggcaaacuuauuugaagaggcucuggaaaaguacggaaaagacuucacggauauccagcaggacuuucuccccuggaagucucuuacuuccauaauugaguauuacuauauguggaaaaccacagauagauacgugcaacagaagaggcugaaagccgcugaggccgaaagcaaguugaaacaggucuauaucccuaauuacaacaagccaaauccgaaccaaauuucgguuaacaaugugaaggccgguguagugaacggcacuggggcacccggacagucuccuggcgcuggucgggcgugugaguccugcuacaugucaagucuacgaauccugcucgacauccuggaagagauuugguggcuugagaaugcaaacccaguccgcuggagagaagccaggaccaaaccccaguga

SEQ ID NO: 59276 - RNA, 2007 nt, Artificial Sequence
  derived and/or modified sequence opt3 from MTA2__Homo_sapiens__NP_004730
auggccgcuaacauguacagagugggcgacuaugucuacuucgagaauagcuccucuaaccccuaucugguuaggcggaucgaggaacucaauaagaccgcaaacgggaauguggaagccaaaguagugugccuuuuucgccgacgugauauuucaaguagccugaacuccuuggcggacucuaaugcuagagaguucgaagaggagucgaagcagccuggagucucagaacaacagaggcaccaguuaaaacaucgggagcuguuucuaagccgccaguucgaaagucucccagccacacacauaagagguaaguguuccgugacucugcuuaacgagacggauauccugucucaauacuuggagaaagaagacugcuuuuucuauagccucguuuuugauccggugcagaagacccugcuggcagaccagggcgagauuagggucggguguaaguaccaggccgaaauccccgaucggcucguggagggagaauccgacaaucgcaaccaacagaaaauggagaugaagguaugggauccugacaauccauuaacagaucgacagauugaccaguuccugguuguggcuagagcagucggcacuuuugccagggcucuugauugcucaaguagcauccggcaacccucuuugcauauguccgccgcggcagccucacgugacauaacccuguuccacgcuauggacacacuacagcgcaacgguuaugaucucgccaaagcaaugagcacccuggugccucaggguggaccagugcuuuguagagacgagauggaagaguggagugcuucugaagccaugcuguuugaggaagcguuggagaaguacggcaaagauuucaaugacaucaggcaagauuuucuccccuggaagucccuggccagcauuguccaguucuacuauauguggaagacuacagaccgguacauccagcagaaacgauuaaaggcagcugaggccgauucgaaacugaagcaaguuuauauuccuaccuacacgaaaccaaacccgaaucagaucauaucugugggcuccaagcccgggaugaacggagcugguuuccagaaaggccucacuugcgaaucaugucauaccacacagagugcccaaugguaugcaugggggccuccaaacaugcagugccgccuuugugccagcugcuggauuuacuggaagaaguauggaggccugaaaacucccacccaguuggagggugcuacaagagggaccacggaaccucacuccaggggacaccuaucucggccagaggcgcagagccugucacccuacacuacaagugcaaaucgcgccaagcuccuggcuaaaaacagacaaaccuuucuucugcagacuacaaaguugaccaggcucgcccgucggaugugucgagaccuguuacagccgagaagggcagcccgccggccuuacgcucccaucaaugccaacgcaauuaaagcggaaugcuccaucagacugccaaaggcugccaagacgccucuaaaaauccauccccucguaaggcugccacuugcaaccauugugaaggauuuggucgcccaggcuccccugaaaccuaagacaccacgcggcacuaaaaccccgauaaaucgaaaccaacucagccagaaucggggccuugggggaaucauggugaagcgugccuaugagacaauggcaggggcuggcguucccuucucugccaacgggagaccucuggcgucaggaauuaggaguagcucccagccagccgcuaagcgccaaaaacugaaucccgcagacgccccuaacccaguggucuuuguggcuacuaaggauacccgggccuugagaaaagcacucacacaccuggagaugaggcgagcggcccgccggcccaauuuaccgcugaagguaaaaccuacccuaaucgcuguuagaccacccgugccucuccccgccccaucucauccugcaucgacuaacgaacccauaguccuggaggacuga

SEQ ID NO: 59277 - RNA, 1548 nt, Artificial Sequence
  derived and/or modified sequence opt3 from MTA3__Homo_sapiens__NP_065795
auggccgcuaacauguacagagugggcgacuaugucuacuucgagaauagcuccucuaaccccuaucugaucaggcggauugaggaacucaauaagaccgcaucagggaacguugaagccaaagugguaugcuuuuaccgccgacgugauauaaguaauacacuuaucaugcuggcggacaagcacgcuaaagagauugaagaggagagcgaaacuacgguggaggccgauuugaccgacaagcagaaacaucaauuaaagcacagagaacuguuccuauccaggcaguaugagucucucccugcaacacauauccggggaaaguguucggucgcccugcuuaacgagacugaaucagugcugagcuacuuggauaaagaggacaccuuuuucuauagucucguuuacgauccaucccugaagacacugcucgcugacaaaggugaaauucgcgugggcccgagauaccaggcagauauccccgagauguuacuggaaggggagucugacgagagggaacagagcaagcuggaggucaaagugugggauccuaauuccccauugaccgaccggcaaauagaucaguuucugguaguugcccgcgcugugggaacuuucgcccgagcgcuagacugcucaaguagcgucagacagcccucucuccacauguccgcagccgcugccucaagggacaucacacuguuucaugcaauggauacccuuuaucggcacagcuacgaccugaguucugcuauuuccguguuggugccucucggcgguccaguccugugucgugaugaaauggaggaauggagcgccucggaggcgucuuuauucgaggaagcccuggagaaguaugggaaggacuuuaacgauauccgccaggacuuccuccccuggaaaucccuuacgucaauuaucgaauacuauuacauguggaagacuaccgauagauauguucaacagaaaaggcugaaggcagcugaggccgaaaguaaauugaaacagguguacauaccuacauacagcaagccaaauccgaaccagauuuccacuucuaauggaaagcccggcgcuguaaacggcgccguggggaccacauuucaaccucagaauccacuacugggacgggcaugcgagagcuguuaugccacccagucacaccaaugguacaguuggggucccccuaacaugcagugccgacucugugcuaucugcuggcuguauuggaagaaauacggcgggcuuaagaugccaacgcaguccgaggaagagaaacugagccccucuccgacuacagaagacccucgcgucagaucacaugugaguaggcaggcgaugcaaggaaugcccguucggaauaccggcagcccaaaguccgcagugaaaacucgccaggccuucuuuuugcacacaaccuauuucacgaaguucgcuagacaggucuguaagaacacccucaggcugcgucaggccgcacggcgaccuuuuguggccauuaacuacgcugccaucagagcagagugcaaaauguuacuuaauucuuga

SEQ ID NO: 59278 - RNA, 852 nt, Artificial Sequence
  derived and/or modified sequence opt3 from MTAP__Homo_sapiens__NP_002442
auggccagcggcaccacaacuacggcugugaagaucgggauuauaggagguaccggccuggacgaucccgagauccucgaagggagaacagagaaauacgucgacacuccuuucggaaagccauccgaugcacuuauucugggcaaaaucaagaacguugacugcguguuguuagccaggcacggucggcagcauaccauuaugccgucuaaaguaaauuaucaagcgaacaucugggcucugaaggaagagggguguacacacgugauagucaccacugccugcggaucacuacgcgaagagauccagcccggcgauauugugaucauugaccaguuuaucgaucgaacaaccaugcguccucagaguuucuacgacggcagccauuccugugcaagagggguuugccacauaccaauggccgagcccuuuuguccuaagacgagggaagugcucauugagacugcuaaaaagcugggacuucggugccauucuaaagguaccauggucacaaucgaaggcccacgcuucucgucaagagcagagagcuuuauguucaggacuuggggagccgaugugauuaauaugaccacaguacccgagguugugcuggcuaaggaagccgggaucuguuaugcgaguaucgcaauggccaccgacuacgauugcuggaaagagcacgaagaggcugucuccguggaccggguguugaagacgcucaaggaaaacgccaauaaagcaaagucucugcugcucacuacaauuccucaaauaggcagcaccgagugguccgagacuuuacacaaccugaaaaauauggcucaguuuucaguccuuuugccacgccauuga

SEQ ID NO: 59279 - RNA, 2715 nt, Artificial Sequence
  derived and/or modified sequence opt3 from MTBP__Homo_sapiens__NP_071328
auggacagauaccugcuccuugugaucuggggcgaagggaaguuccccagcgccgcuuccagggaagcagagcacggaccugaagucucuucaggugagggcaccgaaaaccagccagauuuuacagccgcgaauguuuaucaucuguugaaacggaguauuagcgcuuccauaaacccggaggacucuacuuuccccgccugcucgguagggggaaucccuggcucaaagaaaugguuuuucgcagugcaagccauuuacgguuuuuaucaguucuguagcagugauuggcaggagauccacuuugacacggaaaaggauaaaauugaggacguguuacagaccaauaucgaagagugccugggggcugucgaguguuucgaagaggaagauuccaacucucgcgagagccuaucccucgcagaccuguacgaagaggccgcugagaaucuucaucaacugucagauaaguugccagcccccggacgagcgaugguggacauaauccuccugcugagugauaaggacccuccaaaacucaaggauuauuuacccacaguuggcgcacugaaacaccuucgugaaugguacagcgccaagauuacuaucgcuggcaaccauugcgagauuaauugucagaaaaucgccgaauauuugucugcaaacguggucucccuggaggaccuaagaaaugugauagacucaaaggaacucuggagggggaagauucagaucugggagcggaaauuuggauucgagauuagcuuuccugaguucugccugaaggguguaacccuuaaaaacuuuaguacaucuaaucugaacaccgauuucuuggcuaagaaaaucaucccauccaaggacaaaaauauucucccgaagguuuuccacuacuacggccccgcccuggaauuugugcagaugauaaaguuaagcgaucugccuucguguuauaugucugacaucgaguucgaacucgggcuuacuaacuccacaaaacaaaauucaguccuguugcuagaacagauuaguagccugugcuccaaggugggagcgcucuuugugcugccauguaccaucucuaacauacuuauucccccuccaaaccagcugagcucacgcaaauggaaggaguacaucgccaaaaagcccaagacgaucagugucccggauguugaggugaaaggcgaaugcuccagcuauuacuugcuccugcaggguaaugggaacagaagguguaaggcaacuuuaauucacucugcuaaucaaaucaacggaucauucgcccugaaucuaauucauggcaaaaugaagaccaaaacagaggaagcuaagcucaguuuuccuuucgaccugcuuagcuugccccacuuuuccggcgagcagauaguacagcgggagaagcaacuggccaacgugcagguccucgcacuggaagagugccuuaaacgccgaaagcuggccaaacagccagaaacugugucuguugcugaguugaagucgcuccugguguuaaccagaaaacauuuccuggauuauuuugacgcggucaucccuaagaugauucuaaggaagauggauaaaaucaagacauucaauauccucaacgacuuuagccccguggaaccaaauuccucaagucugauggagaccaacccccuugaguggccugaacggcacguauugcagaaucuggagacguucgaaaagacuaagcagaaaaugcguacagggucucucccacacagcuccgagcaacuguuaggacauaaggaagguccgcgcgauucaauuacccugcuugacgcaaaagaguugcucaaguacuuuacuagcgacggccugcccauaggggaucuacagccucugccaauccagaagggagagaaaacauucguucucacccccgaacugucuccuggcaaacuucaaguguugccauucgagaaagccuccgucugccacuaucaugguauugaauacugucuggacgauagaaaggcuuuagagagggacgggggcuuuagugaacuccagagccggcugauccgauacgagacgcagaccacaugcacucgcgagucuuuccccgugccgaccguccuuuccccucugccaucacccgugguuaguagcgauccuggaucggugcccgacggcgaaguauugcagaacgagcucagaacagaagucuccaggcugaaacggcgcucuaaggaucuaaauugucuguauccaagaaagaggcucgugaaaagcgagucaagugagucccugcuuucucaaacuaccgggaacagcaaucacuaccaucaccacguuacaucccguaagccucagaccgaacggucauugcccgugacuugcccacuggucccgauuccuagcugugagacgcccaaauuagccacaaagaccaguucuggacagaaauccaugcaugaaagcaagacuucgcgacagaucaaggagucaagaucucaaaaacacaccaggauacucaaggaagugguaacagagacccugaaaaagcauaguaucacugagacacacgaaugcuuuacggcauguucccagcgccuuuucgagauuagcaaauuuuaucugaaggaccuaaagaccucucggggucucuucgaagagaugaaaaagacugccaacaacaaugcugugcagguuaucgauuggguccuggagaaaacaagcaagaaauga

SEQ ID NO: 59280 - RNA, 1170 nt, Artificial Sequence
  derived and/or modified sequence opt3 from MTCH1__Homo_sapiens__NP_001258570
augggcgccagcgaccccgagguggcuccuugggcaagagggggagccgcggguauggcuggcgccggggcaggagccggcgcuagggguggggcagccgcuggagucgaagcccgggcgcgcgauccaccgcccgcacaccgagcccauccucgucacccaagacccgcugcccagccuuccgcaaggcggauggacggcggcucugggggacuggguucaggcgauaacgcuccaaccacagaggcccucuucguugcgcuuggggccggagugacugcacugagucaucccuuguuauacguaaagcugcuaauccaggugggccacgaaccuaugccaccgacgcucgguaccaauguccuggggcgcaaagugcuuuaucugcccagcuuuuucacauacgcuaaguauauuguucagguggacggaaaaauaggcuuguuuagaggccucuccccuaggcugaugucuaacgcccugucgacugucacccgggggucaaugaagaaaguguucccacccgaugagaucgaacagguaagcaauaaggacgauaugaagacaagucucaaaaagguugugaaagagaccuccuacgagaugaugaugcagugcgucucucgcauguuagcucauccucugcacgugauuagcaugcgauguauggugcaauuugucggaagagaagccaaguauuccgguguucuuucaaguaucggcaaaauuuucaaggaggaaggguugcugggauuuuucgugggccuaaucccacaccuccugggugacguaguguuucuuugggggugcaaccuguuggcacauuucauaaaugccuaccucgucgaugacagcgugucugauacucccggcggacugggcaacgaccagaauccggggucccaguuuucacaggcuuuagcgaucaggagcuauacaaaguucguuaugggaauugcagugaguaugcugaccuacccuuuucuccuugucggugaucugauggccgugaacaauuguggcuugcaagcugggcuacccccauacucuccuguauucaaauccuggauccacugcuggaaguaucugagcguucagggacaacucuuccggggcucgucucugcuuuuucgucgcguguccucagguaguuguuucgcccuggaguga

SEQ ID NO: 59281 - RNA, 912 nt, Artificial Sequence
  derived and/or modified sequence opt3 from MTCH2__Homo_sapiens__NP_055157
auggccgacgcugcaagccaggugcugcucggcuccgggcuuaccauccugucucaacccuugauguacgucaagguuuuaauucaggugggauaugagccucugccaccgacaauagguagaaacaucuucggcaggcagguaugccagcuacccgggcucuuuucauacgcccaacacauugcgaguaucgauggacggcgcggccuguucacuggucuuacgccucgacuguguagcgggguguugggaaccgucgugcauggcaaaguucuccagcacuaucaggaauccgacaagggcgaggaacuggggccaggaaaugugcagaaagaggucucuucgucauuugaucaugugauuaaggaaacaacucgugagaugaucgcuagaagcgccgcaacccugauaacacaccccuuccauguaaucacccucaggaguaugguucaauuuauuggucgggaguccaaauacugcggcuuaugugacucuaucauuacuaucuaucgcgaagaggggauacugggauucuuugccggccuugugccuagauugcugggugauauucuaagccucuggcugugcaacucccuugcuuaccuggucaauacauaugcauuggacucaggggugaguaccaugaacgaaaugaaaagcuacucucaggccgugacgggauucuuugcuuccaugcucacuuacccauucguccugguuucaaauuuaauggccgugaacaauuguggccuggcgggcgggugucccccuuauagcccaaucuacaccaguuggauugauugcuggugcaugcuccagaaggagggaaacaugucuagggguaauucccuguuuuuccggaagguaccguuuggcaagacauauuguugcgaccuuaaaauguugaucuga

SEQ ID NO: 59282 - RNA, 4761 nt, Artificial Sequence
  derived and/or modified sequence opt3 from MTCL1__Homo_sapiens__NP_056025
auggaggaaaugagagacagcuaccuggaggaagauguguaucagcuccaagagcuuaggcgggaacuggaccgcgccaacaagaauugccgaaucuugcaguaccguuuaagaaaagcugagcagaagucccugaaagucgcagagaccggccagguugauggggaacuaauuaggucucucgagcaagaccugaagguggccaaagauguaucagugcggcuucaccaugaacugaagacagucgaggagaagcgcgcgaaagcugaagacgagaacgaaacuuugagacagcagaugauagagguggaaaucaguaagcaggcccuccaaaaugagcuggagaggcugaaagaaagcucccucaagcggcgcucuacgcgagagauguauaaagaaaagaagaccuucaaccaggaugacucggcagauuuaagaugucagcugcaguuugccaaagaggaggcuuuccuuaugaggaagaaaauggcaaaguugggacgggagaaagacgagcuggaacaagagcuacagaaguacaaaucacucuauggugauguugacagcccccugccuacaggcgaagccgggggaccaccgaguacucgugaggcugaacuuaagcugcgcuugaagcucguggaggaggaagccaauauucugggcagaaaaaucgucgaguuagaaguggagaacaggggucugaaggcggagauggaagauaugcgggggcagcaagagcgagaaggacccggccgcgaccacgcaccuuccauuccaaccucucccuuuggcgacagccucgaguccucaacagaacuuagaaggcaucugcaguucguagaggaggaagccgaguugcuacggcgcaguaucagcgaaauagaggaucacaauagacagcugacccaugaacucucuaaauuuaaguucgagccuccaagggagcccggguggcugggagaaggugcuuccccuggcgccgggggaggcgcaccacuucaggaggaacugaaaucagcucguuugcaaaucagcgagcucagugguaagguucugaaguuacagcacgaaaaccacgcccugcuaucuaauauucagcggugcgaccucgcggcccaucuggggcuucgagcaccgucccccagagauagcgacgcugagucggaugccggcaaaaaggagucugacggagaagaguccagguugccucagccaaaacgcgaaggccccgucgggggagagucagauagugaggaaauguuugagaagacuagcgguuucggcuccgggaaaccuucugaagcuagcgagccaugucccacagaacugcucaaggcccgggaggacucagaguaccuggugacccuuaagcacgaagcacaaagacuggagaggacgguggaacgcuugaucacugauaccgacaguuuucuccaugaugccggacugcgaggcggugcuccguuaccugggcccggccugcagggagaggaggaacagggcgagggggaccagcaagaaccacagcuacucggaacaauuaacgcgaaaaugaaggcauucaaaaaggagcugcaggccuuucuugaacaggugaaucggaucggugacggcuuguccccucugccccaccucacugagaguucuucauuccugaguaccgucacaagcguuucccgugauucuccaauagggaacuuaggaaaagaacugggccccgaccuucaaucgagauugaaggagcagcucgaguggcagcuggguccugcucgcggggaugaaagggagagccuacggcugagagccgcaagggaacuccaccgacgcgccgacggcgauaccggaucccauggccuugggggacaaacgugcuuuucacuugaguugcgggguccaccggugcugcccgagcagaguguaucuauugaagaguuacagggccagcucgugcaagcugccagacugcaccaggaagagacugaaacauucaccaauaagauccauaaaauggaggaggaacaccuuuaugcacugagguggaaggaguuggaaaugcauagccucgcgcugcagaacacucuacacgagcguacaugguccgacgagaaaaaucugaugcagcaagaacuccgcucacugaagcagaacauuuuccuguuuuacgucaaauugcgguggcuguuaaagcacuggagacaggggaaacagauggaggaagagggagaagaguucaccgaaggcgagcauccugagacgcucagcaggcugggugaacuuggggugcaaggcggacaccaggcugauggcccagaccaugauucugaccgaggguguggauuucccguuggcgagcacuccccucacagucgggugcagaucggugaucauagccugcgccuacaaaccgccgacagagggcagccacacaagcaggucguggaaaaccagcaacucuucucugcauuuaaggcccuguuggaggauuucagggcugagcugcgggaagacgagcgagccagauuacgccuccagcagcaguacgcauccgacaaagcugccugggauguagaaugggcgguucugaagugcaggcuugagcaacuggaagagaaaacagagaauaaguugggagaacucggcucaagugccgagagcaaaggugcucugaagaaggaacgugaggugcaucagaaacuacuggcagacucgcacucccuugucauggaucuccgguggcagauccaucacucugaaaagaacuggaauagagagaaaguggagcuguuggacaggcuggaucgcgaccgacaggaaugggagagacaaaagaaagaauuuuuauggcggauugagcagcuccagaaggaaaacagccccaggcgcggcgggucauuccugugugaucagaaggacggaaauguccguccguuuccucaccaaggcagucuuagaaugccacggcccguggccauguggccuugcgcugaugccgacuccauacccuucgaggauaggccacugucuaaauugaaggagagcgaccgcuguuccgcaucagaaaaccucuaucuggaugcgcuaagccuggacgacgagccugaggaacccccagcccaucgaccggagagagaauuucggaauaggcuuccugaggaagaggaaaaccacaaagggaaucuccagcgcgcuguuagugugucuuccaugagcgaguuccagagacugauggauaucucgcccuuuuugccagagaagggauuacccucaacuucuaguaaagaagacguaaccccuccacugucccccgaugaccucaaguacauugaggaguucaacaagagcugggauuauacaccuaauaggggccauaacggugggggaccggaccugugggccgaucggacugaagucggccgugcaggucacgaagacucuaccgagccauuccccgauagcuccugguaccuuacaaccucagugacuaugacgacagacaccaugacuagcccugagcauugccaaaaacagccacugcgcagccacguuuugaccgaacagucuggccuacgagugcugcacucacccccugcugucagaaggguggauuccaucacagccgcagggggagagggcccguuucccaccagucgggcccgcgggagcccaggagacacuaagggcgguccucccgaaccaaugcucuccagauggccuuguacaucucccaggcauucgcgggacuauguagagggggcucgaagaccacuggauagcccgcuuugcacgucauuaggauucgcguccccucugcacagucucgaaaugucuaaaaauuugagcgacgauaugaaggagguggccuuuuccguucgcaacgcaauaugcucaggccccggugagcugcaggucaaagacauggcuugucaaaccaauggcucuaggacuauggggacacagaccgugcagacaauuagcgugggacuccagacugaagcccugcggggcaguggggucaccuccagcccacauaagugccuuacgcccaaagccggaggcggugcuaccccuguuucuucaccaucccguagucugagaagcaggcaaguggcacccgccaucgagaaggugcaggcgaaguucgaacgcacauguugcucgccuaaauacgggucuccgaaguugcagcggaaaccacuacccaaggcugaucagccuaacaaccgaacuucccccggaauggcccaaaaaggcuauagcgagucagcaugggccagaaguaccacaacuagggagucuccaguacacaccacgaucaaugacggccuguccagccucuuuaacauuaucgaucacucaccugucgugcaggaccccuuccagaagggguuacgcgcuggaagucggagcagauccgcagaaccacguccugagcuggguccgggccaagaaacagggaccaauucuaggggacggagccccuccccaauuggcguugguucagagaugugucgcgaagaagggggagagggcacuccugugaagcaggaucuuucugcgcccccaggcuacacacugaccgaaaacgucgcccgaauacucaauaaaaaguugcuggagcaugcucucaaagaagagagaaggcaggccgcacacgggccucccggacugcauagugacucgcacagccuuggugauacugccgaaccgggcccaauggagaaccagaccgugcuacugacagcuccuuggggguuguga

SEQ ID NO: 59283 - RNA, 324 nt, Artificial Sequence
  derived and/or modified sequence opt3 from MTCP1__Homo_sapiens__NP_001018025
auggccggcgaggacgugggggcucccccugaucaccuguggguccaucaggaaggaaucuacagagacgaguaucaaaggaccuggguugcagugguagaagaggaaacuagcuuccuccgggcccgcgugcagcagauucaggucccacuuggugaugcggcucgaccgucccaccuguugacaucucaauuaccccugauguggcagcuauacccugaggagcguuauauggacaacaauucaagacucuggcagauacagcaucaccugauggugaggggcguucaagaacuucuguugaagcuccugccagaugacuga

SEQ ID NO: 59284 - RNA, 1749 nt, Artificial Sequence
  derived and/or modified sequence opt3 from MTDH__Homo_sapiens__NP_848927
auggccgcuagaagcuggcaggacgagcuggcacagcaggccgaagagggcuccgcgaggcuccgggaaaugcuuucuguggggcugggauucuugcgcaccgaguuaggucuggaucuaggccucgaacccaagcgauacccugggugggucauccugguuggaacaggcgcucuuggucuguugcuccuguuucugcucggguauggaugggccgcagccugcgcuggcgcacguaaaaagagaaggucaccaccgcggaaacgcgaggaggccgcugccgugcccgcggcagccccugacgauuuagcucugcuuaagaacuugagaagugaagaacagaaaaagaagaauaggaaaaagcugagcgaaaaaccaaagcccaacggccggacuguagagguggccgagggggaagcaguccgcacgccucaguccgugaccgcuaaacaaccacccgagauugacaagaagaaugaaaaaucuaagaaaaacaagaaaaagucgaaaucagaugccaaggcgguucagaauagcagucgacacgacggaaaggagguggaugaaggugccugggagacaaaaauaucccauagagagaagaggcagcagcggaaacgugacaagguccuaacugauucuggcagccucgacuccaccaucccugggauugaaaacacaaucaccgugacuacagagcaacugaccacggcaucauucccaguaggaaguaaaaagaauaagggcgauagccaccuuaacguucaggugucuaauuuuaaauccgguaagggggacucaacucugcaggucagcaguggauugaacgaaaaucucaccgugaacggcggcggguggaaugagaaaucugugaagcuguccagccagauuucggcuggagaagagaaauggaacucugucuccccggccucagcugguaagcgcaagacagagcccagugccuggagccaagauacuggcgacgcaaauaccaacgggaaagacuggggaagauccuggucugauaggagcaucuucucaggcauagguaguacagccgaaccuguuucccagagcaccacgucugacuaccagugggaugugucacggaaccaaccauauaucgacgaugaguggaguggguuaaauggccugagcuccgcugaccccaacucugauuggaaugcgccugcagaagaguggggaaacuggguagacgaggagcgagccucgcuccuuaagagccaggagccaauucccgaugaccagaaaguguccgaugacgacaaggaaaaaggcgagggggcucugccgacuggaaagucaaagaaaaagaaaaagaaaaagaaaaagcagggugaagauaauaguacagcccaagacaccgaggaguuggaaaaggagauccgcgaagaucuaccugucaacacuucuaaaacaagacccaagcaggagaaagcauuuagccugaagaccauuuccacgucagacccagccgaagugcucguuaaaaauagccagccuaucaagacccugcccccagcuacaucuacugagcccuccgugauacuuaguaagagcgauucugacaaauccucaagucaggucccuccaauucugcaagagaccgauaagagcaaaucgaacacaaagcaaaauuccgugccgcccucucagacuaaaagcgaaaccucaugggagaguccuaagcagaucaagaaaaagaaaaaggccaggcgggaaacauga

SEQ ID NO: 59285 - RNA, 1200 nt, Artificial Sequence
  derived and/or modified sequence opt3 from MTERF1__Homo_sapiens__XP_006716189
augcagagccugucccucggccaaaccucuaucucaaaggggcuuaacuaccugacaauuauggcccccggaaauuuguggcacaugagaaacaauuucuuauuugguaguaggugcuggaugacucgguucagcgcugagaacauauuuaaauccgugucuuuccgccuguuuggcgucaagugucauaauacggacucggaaccucucaaaaacgaggaucuacugaagaaucuucugaccauggggguugacaucgauauggcacgaaaacgucagccaggaguguuccacagaaugauuacaaacgaacaggacuugaagauguuucuccugucaaagggcgccagcaaagagguaaucgcgaguauuaucuccagguauccgcgggcuauaacucgcacccccgaaaaucugucuaagagaugggaucucuggaggaaaaucgugacaagcgacuuagagauugucaacauccuggagcgguccccugaaucauucuuucgcaguaauaacaaucuuaacuuggagaauaacauuaaguuccuguacagcgugggucuaacccgaaaaugccucuguagacugcuuacuaacgccccaaggacauuuucuaauucccuggauuugaacaagcagaugguugaguuccuccaagcagccgggcugucauuaggacauaaugaccccgcugauuuugugcggaagaucauauucaaaaacccuuucauucugauccagagcaccaagcgugucaaagcaaauauugaauuucuccgcaguacguucaaccuuaauucugaggaacuguuggugcuaaucugcggcccaggcgccgagauccuggaccucuccaacgauuaugcuagaaggagcuacgccaauauuaaggaaaaacuguuuucgcuuggguguacugaggaagagguacagaaguucguucugucuuaucccgacgugauauuuuuggcggagaaaaaguucaacgauaagaucgacugccucauggaagagaauauuuccaucucacagauaauugaaaacccucggguccuggacaguagcaucuccaccuuaaaaucucgaaucaaggagcuggugaaugcaggauguaaccuaagcacacucaauauuacucugcuuucauggaguaaaaagcgcuacgaagccaaauugaagaagcuguccagauuugcuuga

SEQ ID NO: 59286 - RNA, 2262 nt, Artificial Sequence
  derived and/or modified sequence opt3 from MTF1__Homo_sapiens__XP_011539794
augggcgagcacagccccgacaacaauaucauuuacuucgaagccgaggaagaugagcugaccccugacgauaagaugcucagauuuguggacaaaaacgggcuugucccauccucuucaggaacaguuuaugauaggacuacggugcugauagaacaggacccggguaccuuggaggaugaggacgaugacggccaaugcggggaacauuuacccuuccugguaggaggcgaggaagguuuucaccuaaucgaucaugaggcuaugagucagggguacgugcagcacauuaucagcccugaccagauucaucucacaaucaauccaggauccacucccaugccucggaacauagagggcgcaacccugacacuucaaucugaauguccagagaccaagcgcaaagaagucaagcgauaucagugcacuuucgagggcuguccccguacauacucgaccgccgggaaucugagaacgcaccagaaaacucacaggggagaauauaccuuugugugcaaccaggaggguuguggcaaggcguucuugacaucauacagccuccggauccauguucgcgugcacacuaaggagaaaccuuuugaaugcgauguccaagggugugagaaggcuuucaauacccuguauagacugaaagcccaucagaggcuccacacaggaaagaccuuuaacugcgaaagugagggcuguuccaaauacuucacgacuuuaucugaccugcggaagcacauucgcacacauaccggugaaaagccauuucgaugcgaccacgauggguguggaaaagcauucgccgcuagccaucaccuuaagacucaugugagaacacacaccggcgagaggccguuuuucugccccuccaauggcugcgagaaaacguucucaacccaguacaguuugaaaagccacaugaaggggcaugacaacaagggacacucuuauaaugcacugccucagcauaacgguuccgaagauacaaaucacucacuaugucucagcgaccugagucuucugucuacugauuccgaguugcgggaaaacagcucgaccacacaaggccaggaccucucuacuaucuccccagccauuaucuuugagucaauguuccagaauagugaugacaccgcuauacaagaagauccccagcagacagccagccugaccgaguccuuuaacggggacgcggagucuguaagcgauguuccuccaucaacuggaaacagugcauccuuaagccugccccucgugcuucagccgggccugucugaaccuccccaaccauugcuaccugccucagcucccagugccccacccccugcaccaagccuggguccggggucccagcaggcugccuucggcaaucccccugcgcuccugcagccacccgaggucccugugccacacucuacgcaauuugccgcaaaccaucaggaguuccuuccccacccgcaggcuccucagccaauugugcccggacugucggucguugccggcgcuagcgccuccgcagccgcuguggcgucagcaguagccgcuccugcacccccacaaaguacaaccgaaccuuugcccgccauggugcagacucucccacugggggccaauucugucuuaaccaacaauccgacaaucaccauuacuccuacacccaacacggcuauccugcagagcucccuagugaugggagagcagaaucuccaauggauccugaacggugccaccucaagcccacagaaucaggaacaaauucagcaggcaucuaaaguugagaagguguuuuucacuacagcgguccccguggcuuccaguccuggcagcucuguacagcaaauagggcuuuccguuccagugaucauuaucaagcaggaagaggccugccagugucagugcgcaugucgugacucagccaaagaacgcgcuaguagcagaaggaagggaugcucgucucccccuccgccagagcccuccccucaagccccagacggccccagcuugcagcugccugcacagaccuuuucaagugcuccgguccccgguuccucuagcuccacacucccaucaagcugugagcagagucggcaagccgaaacuccuucugauccccagaccgagacgcuguccgcgauggacgugagcgaguuccuuucgcugcagucauuggauaccccaucuaaccucauaccuauugaagcccuguuacaaggggaagaggagaugggccugacaaguuccuuuagcaaauga

SEQ ID NO: 59287 - RNA, 1170 nt, Artificial Sequence
  derived and/or modified sequence opt3 from MTFMT__Homo_sapiens__NP_640335
augagagugcuggucaggcggugcugggggcccccucucgcccacggcgcucgccgaggacguccaagcccgcaguggagagcacuugccaggcuggguugggaggacugucgggauucccgcguuagagaaaagcccccuuggaggguguuguucuuuggcaccgaccaauucgcgcgggaggcuuuacgcgcccugcaugcagcccgagaaaacaaagaggaggaacuaaucgauaagcucgagguagugacaaugccaucucccucaccuaaagggcugccagucaagcaguacgcugugcagagucagcuucccguuuaugaauggccugacgugggaagcggcgaguacgaugucggugugguagcauccuuugggagacuguugaaugaagcccucauucugaaauucccauauggaauacugaacguucacccgucuugccuccccagguggcggggcccugcuccagugauccauacugucuuacacggcgacacggugaccggggugacaauuaugcaaauccgucccaagcgcuuugaugucggaccuauucugaagcaggagacuguuccagugcccccgaaaucgaccgccaaggagcuugaagcgguauugucaagacugggugcaaauaugcuaaucagcgugcucaaaaaccugccugagagucuuuccaauggcaggcagcagcccauggaaggggccacauacgcuccaaagauaucugccggaaccagcuguaucaaaugggaggaacaaacuuccgagcagauuuuccggcuguaucgagcaaucggcaacauuaucccuuugcagacacucuggauggcuaauaccauaaagcuguuagaccuggucgaggugaacucaaguguucucgccgaucccaaacuuacgggucaggcgcugauuccagggagcgugaucuaccauaagcaaucucagauuuugcuagucuauugcaaggacggauggaucggcgugcgcuccguaaugcugaaaaagucacucacugccaccgauuuuuacaauggcuaccugcaccccugguaucagaaaaacagccaagcacagccuagucaguguagauuccagacacuuaggcugccaacuaagaaaaagcaaaagaaaaccguugcuaugcagcagugcaucgaauga

SEQ ID NO: 59288 - RNA, 408 nt, Artificial Sequence
  derived and/or modified sequence opt3 from MTFP1__Homo_sapiens__NP_001003704
augagcgagccccagccuagaggcgccgaaagggaccuguaccgggauaccugggugcgcuaucucggguacgcuaacgaggucggagaagcauuccgaucccuuguuccagccgcggugguauggcugucuuaugguguggcuucaaguuacgucuuggccgacgcaaucgauaagggcaaaaaggccggggaggugggaggcuuuccgcccgguuuacaaccugcucaggcacugccaaauagcggggaagcccagcuacuccugauuauacuuugguaucuggcuugcgccuccgcgucuuguuucaugucgacaucauacagcugccagggaauguggacucccggcaguuugguuuccaaagacccuggcacguggguggggcucucuuggaccgaggcauga

SEQ ID NO: 59289 - RNA, 1005 nt, Artificial Sequence
  derived and/or modified sequence opt3 from MTG1__Homo_sapiens__NP_612393
augagacugacccccagggcccucugcagcgcugcacaggccgcguggcgggagaacuucccucuuuguggccgcgacguggcucgaugguuuccagggcacauggccaagggacugaaaaagaugcaauccucuuugaaauuagucgauugcaucauugaaguucaugacgcacguauaccgcugucagguagaaauccccuauuccaggagacacucggccugaagccucaccuucugguguugaacaaaauggaucucgccgaccugacugaacagcagaagaucaugcaacaucuggagggggaaggacucaagaauguaauuuuuacgaacugugugaaagaugagaaugucaagcagaucauuccaauggugaccgaguuaaucggcaggagucaccgguaccaucgcaaagaaaaccuggaguauugcauaaugguuaucggugugcccaaugucggaaagagcucccuuauuaacucuuugagaaggcagcaucugcggaaagggaaggcuacacgcgugggcggcgaaccugggaucacucgagcaguaaugucgaagauucagguuucagagagaccacuaauguuccuccuggacacccccggagugcuugccccuaggaucgagagcgucgaaacaggucugaaauuggcucucuguggcaccgugcuggaucacuuagugggggaggaaacuauggccgacuaccugcucuauacacuuaauaagcaccaacgguuuggauacguccagcacuauggccuggguagugcgugcgauaacguugagcguguguugaaauccguagcagugaagcuagggaaaacccagaaggucaaagugcugacgggaacuggcaauguuaacauaauucagccaaauuacccggccgcugcccgcgacuuccuccaaaccuuuagaaggggccugcuugggucugugaugcuggauuuggacguccuccggggacaucccccugcagaaacacugccauga

SEQ ID NO: 59290 - RNA, 2808 nt, Artificial Sequence
  derived and/or modified sequence opt3 from MTHFD1__Homo_sapiens__NP_005947
auggcccccgcugagauccugaacggcaaggaaauuagcgcacagauaagagccaggcucaaaaaucaagugacccagcuuaaggagcaggucccuggguucacaccacggcuggcgaucuugcagguuggaaaccgcgacgauuccaauuuauacauuaacgugaaacugaaggcugccgaagagaucgguauuaaagcaacucacaucaagcuaccgcgaacgaccacagaaucugagguaaugaaguauauaacuucacucaaugaggacaguaccgugcauggcuuucugguccaacuuccccuggauagcgaaaacuccaucaauacagaggaagugauuaacgccaucgcuccugagaaagacguugauggguugaccucuauuaaugcaggaaagcucgcccguggcgaccugaacgauugcuucaucccauguacucccaaagguugccuggagcucauaaaggaaacaggggugccuauugcuggaagacacgccgucgugguaggcaggucgaaaaucguuggcgcgccaaugcaugacuuacugcuuuggaauaacgcaaccgugacgacuugucacucaaagaccgcccauuuggaugaggaagucaauaagggggacauucuggugguggcuacaggacagcccgagauggucaaaggugaauggaucaagccuggcgccaucguuauugauugcgggauaaacuacgugccagacgauaaaaagccgaauggacggaaaguagugggcgacgucgcauaugacgaggcuaaggagcgcgccagcuuuaucacucccgugccuggugggguuggaccaaugaccguggcgaugcuaaugcagaguacagucgaauccgccaaaagauuccucgagaaguuuaagcccggcaaauggaugauucaguacaacaaccugaaucuuaagaccccugugccaucugauaucgacauaagcagguccuguaaacccaagccgauuggcaaacuggcacgggaaaucggguugcucucagaggaaguagagcuguauggagagacgaaggcuaagguuuuacugagugcccucgaacgccuuaaacaccgaccugaugguaaguacguggucgugacuggcaucacacccaccccacugggggagggaaaaagcacuacaaccauuggcuugguccaagcucuaggugcccaccuguaucagaacguguucgcaugcguuagacagccuucucaggggcccacguuuggcaucaagggaggcgccgcugggggagguuacucccaagugauuccaauggaagaguucaaucuccaucugaccggcgacauacacgcgaucacagcagccaacaaucuuguagcugccgcaauugaugccaggaucuuucaugaacugacucagaccgacaaggcuuuguucaaccggcucguccccucagugaaugggguucgucgcuuuagcgauauccagauuagaaggcugaaacgguuaggaauagagaagacagacccuacuacccugacagaugaggaaaucaaccgauucgcccgccuagacauugauccagagaccaucacuuggcaaagagugcucgacacgaaugacagguuucugcggaaaauuacaaucggccaggcaccgaccgaaaagggucacacucgcaccgcgcaguucgauauaagugucgcuucugagaucauggccgugcuugcauugacaaccucccuggaggacaugagagaaaggcucgggaaaaugguaguggccagcucgaagaaaggcgagcccguuucugcugaagaucugggagucuccggcgcccuuacugugcugaugaaggacgcaauuaagccuaacuugaugcagacacucgaggggacgccaguguucguccacgcuggacccuuugccaauaucgcgcaugguaacucaaguauuaucgccgaucguauagcucugaaauuaguuggcccugaaggguucguggugaccgaggcaggauuuggcgccgacauugguauggagaaguucuuuaauaucaaaugucgguacagcgggcugugcccacacguagucgugcuaguugcuacugugcgagcccucaagaugcauggcggaggccccacagucaccgcagggcugccgcuuccuaaagcguauauucaagaaaacuuggagcugguggaaaagggauucuccaaucucaaaaagcagaucgagaacgccagaauguuuggcauaccaguugugguagcugucaacgccuucaagacagauacugaaucugagcuggacuuaaucagcaggcugucacgcgagcacggugcauuugaugcugugaaauguacccauugggccgaagggggaaagggcgcacuugccuuggcucaggcggugcagcgggccgcacaagcucccaguuccuuccagcuccuguacgaccuaaaacugccugucgaggauaagauuagaaucauugcccagaaaaucuauggugccgacgauauagaacuccugcccgaggcucagcacaaggcagaaguuuacacgaagcaaggcuuugggaaucuuccaauuugcauggccaaaacccacuugagccugucucauaacccugagcagaagggagugcccacaggcuucaucuuaccaaucagggacauucgcgcgucaguaggggcuggauuucucuauccgcuggugggcacuaugaguaccaugccuggucuucccacacgaccauguuucuacgacaucgaucuggaccccgagacugaacaggucaauggguuguucuga

SEQ ID NO: 59291 - RNA, 2940 nt, Artificial Sequence
  derived and/or modified sequence opt3 from MTHFD1L__Homo_sapiens__NP_001229696
augggcaccagacugccccucgugcuuaggcagcugcggcgcccuccacaaccgcccgggccuccacgacguuugagaguccccugcagggccagcuccggagguggcgggggaggcggugggggacgggagggcuuacugggccagcgcagaccucaggacgggcaggcuaggucuucauguaguccaggaggucggacacccgcagcccgcgauagcaucguucgagaagugauucaaaacuccaaggagguacuaucucuccugcaggagaaaaauccugcguucaagccagugcuugcuauaauccaggccggcgacgauaaccugaugcaggaaauuaaucaaaacuuggcagaagaggccgggcucaauaucacucacauuugccugccgcccgacucgucagaggcugaaaucauagaugagauccugaaaauuaacgaagacacgagaguccauggacucgcauuacagaucagcgagaaucuguuuaguaacaaggugcuuaaugccuugaaaccugagaaggauguugacggcgugaccgauauuaaccuggguaagcuagucaggggagacgcucacgaauguuucguguccccaguagccaaagcgguuaucgagcuccuggaaaagucugugggggucaaucuugauggcaaaaagauacugguggugggcgcacaugggagcuuggaggccgcucuccagugccuguuucagcggaaaggauccaugacaaugucaauucaauggaagacucgucaguuacagaguaagcugcacgaagccgacaucgucguucucgguagccccaaaccugaggagauuccacuuaccuggauccaacccggcacaaccgugcugaacuguucucaugauuucuuguccgggaagguaggaugcggcucaccgcgcauccacuuuggugggcuaauugaagaggacgacgugauacugcucgcagcugcccugagaauccagaauauggucagcaguggcaggcgguggcuucgagaacagcagcaccgcagauggaggcugcauuguuugaaacuccaaccucugucucccgugccauccgauauugagaucagccggggacagacuccuaaggcgguugacguguuagccaaagaaauaggccugcuagcagaugagauugagaucuacgggaagucgaaagcuaagguccgccucucugugcuggaaagacuuaaggaccaggccgauggaaaauauguauugguugcugguaucacacccaccccacugggcgaggggaaguccacggugacuauuggacucguccaggcccugaccgcacaccuuaacgucaauucauucgccugccugaggcaacccagucagggcccuacauuuggugugaaagggggcgcugcgggaggcggguacgcacaggugaucccaauggaagaguucaacuugcaucucacuggagacauucacgccauaaccgcugccaacaaucuguuagcagccgcuaucgauacacguauucugcacgaaaacacccagacggacaaggcccuauauaaucggcucguuccgcuggugaacgguguacgagaguuuagcgagauccaacuugcaagauugaaaaagcugggcaucaauaagacugaucccuccacacucaccgaagaggaagucucuaaauucgcgaggcuggacauugauccuagcacuauaacauggcagcgcguguuagacaccaacgaccgguuucugagaaagaucacgauugggcagggaaauaccgagaaaggccauuacaggcaggcucaauucgauaucgccguugcaucagagauuauggccgugcuugcuuugacagacagucucgccgauaugaaggcacgccugggucgaauggucguggcuuccgacaaaagcgggcagccaguaacugccgaugaccuaggcgugaccggagcgcugacaguucucaugaaggaugccaucaagcccaaccugaugcagacucuugaaggcaccccugucuuugugcacgcugggccauucgcaaauauagcccauggaaacucuucaguguuggcugacaaaaucgcccugaaguuagucggcgaggaagguuucguugugacagaggcaggguuuggagcggauauuggcauggaaaaauucuuuaauaucaagugucgggccaguggucucgugcccaacguagucgugcugguugcuaccgugcgugcccuuaaaaugcacggcgggggaccgagcgucacugcaggcgugccucugaagaaggaguauacggaggaaaauauucaauugguugcugacgggugcuguaaccuccagaaacagauccagauaacacaacuguucggagugccaguagucguggcccuaaauguguuuaagaccgauacuagagcagagauugaccuggucugcgaacucgccaaaagggcuggcgcguucgaugccguucccugcuaccauugguccgugggugggaagggaucuguagaccuggcacgcgcugugcgggaggccgccucgaaaagaagcagguuucaguuccuuuaugacguccaggugccuaucguugauaagauucgaaccaucgcucaggcaguguacggcgccaaagacauagaauugucccccgaggcgcaagcuaagaucgaucgcuacacacagcaggguuuuggcaaccugccaauuuguauggccaagacccacuuaucacucagucaccagccugacaaaaagggggucccccgggauuucauccugccaauuucugacgugagagcaagcaucggagccggcuuuauauauccgcuuguugggacuauguccacaaugccuggacugcccacgaggccaugcuucuacgauauugaccuagauaccgagacugaacaagugaaaggccucuuuuga

SEQ ID NO: 59292 - RNA, 1053 nt, Artificial Sequence
  derived and/or modified sequence opt3 from MTHFD2__Homo_sapiens__NP_006627
auggccgcuaccagccugauguccgcacucgccgcgagacuucugcagcccgcucacucuugcucauugagguuacggccuuuccaucuggccgcagugcgcaacgaggccgucguuaucaguggccgaaagcuagcucaacagauuaaacaggaagugcgucaggagguagaagaguggguggcaagcgggaauaagagaccacaccucuccgucauacuggugggagaaaacccggccucucauucguacguucuuaauaaaacaagggcugccgcgguggucgguaucaacucagagacuauuaugaagcccgcaagcaucagugaggaagaacuguugaaucucauuaacaaacugaauaacgacgauaauguggacggccugcucguacaauuaccucugccagaacacaucgaugagcggcgcauauguaacgccguuucccccgacaaggauguggacggguuucaugucaucaaugugggaagaaugugccuugaucaguauucuauguugccugcuacgccauggggcgugugggagauuaucaagaggaccgguauucccacacuggggaaaaacgucguuguggccggacggagcaagaauguaggcaugccuaucgcaaugcuacuccacacugacggcgcucacgaacgcccagggggagaugccaccgugacaauaucccaucgauacaccccgaaagagcagcugaagaaacacacuauucuugcggacaucgucauuucagccgcagguauccccaaccugaucacagcugauaugauuaaggaaggcgccgcugugauagacguugggaucaauagagugcaugauccugucaccgccaagccaaaauuggugggagacguagacuucgagggcguuaggcagaaggcagguuauauuacgcccgugccugggggagucggcccaaugacuguggccaugcucaugaaaaacaccaucauagcugcgaagaaaguccugcgguuagaggagcgugaggugcugaagaguaaagaacucggcguugcaacaaacuga

SEQ ID NO: 59293 - RNA, 2091 nt, Artificial Sequence
  derived and/or modified sequence opt3 from MTHFR__Homo_sapiens__XP_011539797
auggaccacagaaaggccagggugcugcccgcuggccauuacugcccuagccucgggaucugggcaucccaggucggaucuguucggucaagugugccaccgagcauucgcaaccccgccaugguaaaugaggcgcgagguaacuccucucuuaauccuugucuggaaggcucggcuucaagcgggagugaguccucuaaagauagcucccguugcucaaccccaggauuggaccccgaaagacacgagagguuacgggaaaagaugcgcagaaggcuggagaguggcgauaaaugguucagccuagaguuuuucccuccacggacagccgaaggugcagugaaccucauaucucgcuuugaccgaauggccgcugggggaccccuguauaucgaugucacuuggcauccugcaggcgacccaggcuccgauaaggagacgucaagcaugaugauugccaguaccgcugugaauuacugugggcuugaaacaauccugcacaugacuugcuguagacaaagguuggaggagauuaccggacaucuccacaaagccaagcagcugggucugaagaacaucauggcgcuccggggcgacccgauaggggaucagugggaagaggaagagggaggcuucaauuaugcaguugacuuagugaaacacauccguucugaauuuggugauuacuucgacauuugcgucgccggguaucccaagggacauccugaggcuggcuccuuugaggccgaucugaaacaccuuaaggaaaaagugagcgcaggcgcugacuucaucauuacacaguuguuuuucgaggccgacaccuuuuuccgcuuuguaaaggcguguacugauauggggaucacaugcccaauaguucccggaauuuucccuauccaagguuaccauucgcugagacagcuagugaagcucucuaaacuggaagucccacaggagauuaaggacgugaucgaacccaucaaagauaacgacgccgcaauuaggaauuauggcauagagcuugcugugucccugugucaggaguugcucgccucagggcuggucccgggauuacacuucuacacccugaaccgggaaauggcuacgacugagguucucaagcgacuuggcauguggaccgaagauccucgcagaccccugccaugggccuugagugcacacccuaaaaggcgggaggaagacgugcgccccaucuuuugggccagcagaccaaaguccuacauuuauaggacacaagagugggaugaguuccccaauggucguugggggaacucuagcaguccugcuuuuggcgaacuaaaagacuacuaucuguucuaccucaagucaaaguccccaaaagaggaacugcuuaagauguggggagaggagcugacuagcgaagagucuguauuugaaguguucgucuuguaucucucaggcgagccgaaucggaacgggcauaaagugaccugccugcccuggaaugaugaaccuuuagcggcagagacaagucugcuaaaggaggaacuccugcgaguuaacagacagggaauccuuaccauaaacagccagccaaauauuaacgguaaacccuccucugacccuaucgugggcugggggccaucgggaggcuacgucuuucagaaggccuauuuggaguucuuuacgagcagggaaacugcugaggcccugcuccaagugcugaagaaauacgaacuucgcguaaauuaccaccugguuaacgugaagggugagaauaucacaaacgcacccgaguugcagccgaaugccgucaccugggggauuuucccuggccgggaaaucauucagccaacuguggucgaucccguguccuuuauguucuggaaagacgaggcuuuugcccucuggauagaaagauggggaaagcuguaugaggaagagucaccuaguaggacaaucauucaauacauccaugacaacuauuucuuaguuaaucugguggauaacgacuucccccuagauaauugucucuggcagguagucgaggacacccuggaacuuuugaaccgcccaacgcagaaugcacgagagaccgaagcgccuuga

SEQ ID NO: 59294 - RNA, 612 nt, Artificial Sequence
  derived and/or modified sequence opt3 from MTHFS__Homo_sapiens__NP_006432
auggccgcugcagccgugagcuccgcgaagagaucucugaggggcgagcucaaacagcggcuucgcgcuaugucagccgaggaacgacugcgucaaaguagagucuugagccagaagguuaucgcacacuccgaauaccagaaaucuaagaggauuucgauauucuuaucaaugcaggacgagaucgaaaccgaggagauuaucaaagauauuuuucaacgggggaagaucugcuucauaccccgcuauagauuucagagcaaccauauggacauggugaggaucgaaaguccugaggaaauuucccugcuaccaaagacaucuuggaauaucccgcagcccggagagggugauguacgggaggaagcccucagcacuggcgggcuggaccuuauuuucaugccuggacugggcuuugauaaacacgguaaccgcuuggggcgaggaaagggcuacuaugacgcuuaccucaaaagaugucugcagcaucaagaggugaagccauauacgcuggcacucgccuucaaagaacagaucugcuuacagguccccgugaaugagaacgauaugaagguugacgaagugcuguacgaggauuccucaaccgcuuga

SEQ ID NO: 59295 - RNA, 2184 nt, Artificial Sequence
  derived and/or modified sequence opt3 from MTIF2__Homo_sapiens__NP_001005369
augaaccagaagcugcucaaacuugagaaucuguugagauuccacaccaucuacaggcaauuacauagccugugccagcggcgcgcccuacgacaguggcgucacggcuuuuccucugcuuaucccguguggacagcacagcucugugccuggccuuggccaacugacguccugacgggggcggcucuuucacaauacagacuguugguuaccaagaaagaagagggaccguggaagagucagcucagcuccacaaaaucuaagaaggugguagaaguguggauugguaugacuauagaggaacuggccagggcaauggagaaaaacaccgauuaugucuacgaggcccugcucaauacagacaucgauauugacucguuagaagcugauucacaucuggacgagguguggaucaaggaaguuauuaccaaagcaggcaugaaacuuaaguggagcaaguugaagcaggauaaagugcggaagaacaaagacgccguccgcagaccccaggcugauccugcccugcuaacuccaaggagucccgugguaacaaucauggggcacguugaccauggaaagaccacgcuccuggauaaauuccggaagacucaaguggcggcagucgagaccggcgguauaacacagcacaucggggccuuucuugugucccugccuucuggagagaaaauuacuuucuuggacaccccaggccacgcugccuuuagcgcaaugcgcgcucgaggcgcccaggugacagauaucgucguucucgugguagcggccgacgacggggugaugaagcagaccgucgaauccauucaacaugcaaaggaugcucaggugcccaucauacuggccguuaauaaaugcgacaaggcugaggccgauccugaaaaagugaagaaagaguuacuggcauaugacgucgugugugaagauuacggaggugacguacaggccguuccagugucagcucucacgggcgauaaccuuauggcgcuggcagaggccacugucgcuuuggccgagaugcuagaacugaaggcagacccgaaugggcccguggagggaacagucauugaaaguuucaccgauaagggcagaggucucgugacuacagccaucauucaaagggggacccugcggaaaggaagcguucuuguggcuggcaagugcugggccaaaguacgucugauguuugacgagaacggcaagacgaucgaugaagcauauccuucuaugccagucgggaucaccggauggcgcgacuugcccuccgcgggugaggagauucucgaaguggagucagaaccuagagcuagggagguuguggacuggcggaaauacgaacaggagcaggagaagggccaggaagaucugaagauaaucgaggaaaaacgaaaggagcacaaagaggcccaucaaaaggcacgcgaaaaauacgggcacuuacuguggaagaagagaagcauucuaagguuccucgagcggaaagaacagaucccacugaagcccaaagagaagcgcgaaagagacaguaauguccuuucugugauaauuaaaggagauguagacggcuccguggaggccaucuugaacaucauugauacauaugacgcuagccacgagugugaacuggagcucguucauuuuggugucggggaugugucggccaaugacgugaaccuggcagaaacuuucgauggcgucaucuacggauuuaauguuaacgcuggcaaugugauucagcagucugccgcgaagaaaggggugaagauaaaacuucacaagaucauuuauaggcugguagaggacuugcaagaggaacucuccucacgucugccgugcgccgucgaggaacauccugugggagaggcuaguaucuuagcaaccuucagcguuacagaagguaagaaaaaggugcccgucgccggcugucgggugcagaaagggcagcuggagaagcagaagaaauuuaagcuaacucgaaacggacacguuaucuggaaaggcucccucaccucucugaagcaucacaaagaugacauuagcauagugaagacagguauggauugcgggcuuucauuggacgaagacaacauggaguuccaaguaggcgauagaaucgucuguuacgaggaaaagcagauucaggcuaaaaccaguugggacccaggauucuga

SEQ ID NO: 59296 - RNA, 837 nt, Artificial Sequence
  derived and/or modified sequence opt3 from MTIF3__Homo_sapiens__XP_011533265
auggccgcucuguuccucaagagacuuacccugcagacagugaaaagcgagaacuccugcaucagguguuuuggcaagcacauuuugcagaaaacugcacccgcccaauuaucuccuauagcgucagcuccacggcugaguuuccuaauccaugccaaggcauuuagcacggccgaagacacccagaaugaggggaaaaagacaaagaaaaacaagacugcuuucuccaaugucggacgcaaaauuucucagcgaguuauccaccucuuugaugaaaaggguaacgaccugggcaauaugcaucgugcaaacgugauuagacuuauggaugagagggaccugcgguugguacaacgcaauaccucgacagaaccggccgaguaccagcucaugaccgggcugcagauccugcaggagagacaaaggcuccgggaaauggagaaagcuaaccccaagacuggaccuacauuacgcaaggaacugauacuuucaagcaauaucggccagcacgauuuggacaccaaaacgaagcagauucagcaauggaucaaaaagaaacaucuggugcagauuacuaucaagaaagguaagaacgucgaugugagugagaaugagauggaagagauauuccaccagauucuacaaaccaugccagggaucgccacauuuuccucucgaccccaggcgguucagggaggcaaggcacucaugugcgugcugagagccuucagcaaaaacgaagagaaggcuuauaaagaaacucaggagacccaagagagggacacacuuaauaaggaucacggcaacgacaaagaauccaauguccugcaucaguga

SEQ ID NO: 59297 - RNA, 921 nt, Artificial Sequence
  derived and/or modified sequence opt3 from MTL5__Homo_sapiens__NP_001034745
auggaggaaggcccccugccugggggacucccaagcccggaggacgccauggugaccgaacuucugucccccgaggguccuuucgcuucugaaaacaucggcuugaaggcaccagucaaauacgaggaggaugaauuucacguuuucaaggaggccuauuuagggcccgcggacccuaaagaaccagugcugcaugcuuuuaaucccgcccuaggagcagauugcaagggccagguaaaagccaagcucgcugguggggacucagauggaggcgagcugcuuggcgaguacccugggauuccagaacugagugcauuggaggacguggcccuccugcaagcuccgcagcccccugccuguaacguccacuuccugagcucccucuuaccagcgcauagaucucccgcagugcugccucuuggagccuggguuuuggaaggugcuucgcacccaggcgugaggaugauacccgucgagaucaaggaagccgggggaacaacuacgucaaauaacccggaggaggcaacccugcagaaucuacucgcucaggaaagcugcuguaaauuuccuaguucccaagagcuggaagaugccucuugcuguagccuuaagaaagacuccaaccccauggugauuugccagcugaagggcgguacacagauguuguguaucgauaauucacggacucgcgagcucaaagcgcugcauuuaguaccacaguaucaagaccagaacaauuaccugcagagugauguuccuaagcccaugaccgcccucguggggcgauuccuuccagcaagcacaaagcugaacuugauuacccagcaacuagaaggagcucugcccucugucgugaauggcuccgccuuuccuucaggcagcacucucccagggccgcccaaaaucacacuggcuggauga

SEQ ID NO: 59298 - RNA, 1812 nt, Artificial Sequence
  derived and/or modified sequence opt3 from MTM1__Homo_sapiens__XP_011529475
auggccagcgcuuccaccucuaaguacaacucacacagucuggagaaugaaagcaucaaaagaacauccagggacggcgugaaccgggaucucacugaggcagucccccgccuuccuggggaaacgcugauuaccgacaaggagguuauauauaucugcccauucaauggaccgauuaaaggucgaguguacaucacaaacuaucguuuguacuuaagaucucuggaaacugauucgucacuaauucucgacguaccccugggcgugaucagcaggauagagaagaugggaggggccaccagucggggcgaaaauuccuauggucuugauaucacauguaaagacaugcgcaaccugagauuugcguugaagcaggaagggcauucuaggcgggauauguucgagauucucacccgcuacgcuuuuccucuggcccacagccugccacucuucgcauuuuuaaaugaagagaaguucaacgucgacggauggacuguguauaaucccguugaggaauaccgaagacaaggccugccuaaccaucacuggaggaucacauuuauuaauaaaugcuacgagcuuugugauaccuauccagccuugcuggugguccccuaccgggcuuccgacgaugaccuacgucgcguggcaacguucagaucaaggaaccggaucccuguacucaguuggauacauccagaaaauaagacuguuauugugcgaugcagccagccgcuggucggcaugucugggaaacgcaacaaggaugacgagaaauaucuugacgugaucagagaaaccaauaagcagauuuccaagcugacaaucuacgaugccaggcccucagugaacgcugucgccaacaaagcgacuggagguggcuaugagagcgacgaugcauaccacaaugccgaguuguuuuuccucgacauccacaacauucauguuaugcgggaaagucugaagaaagugaaggauauaguauauccuaauguggaggaaucucacugguuauccagccuggagucgacccauuggcucgaacacaucaaacuuguccugacaggggcuauucagguggccgacaagguuucuuccggaaaaucaaguguguugguccacuguagcgauggcugggaccgcaccgcacaacuaacgucccuggcuaugcucaugcuggauucuuuuuacagaagcaucgaggguuucgagauacuugugcagaaggaauggauuucauuugggcauaaguucgccaguaggaucggacacggcgacaaaaaccauacugaugcggaccguuccccaaucuuccugcaguuuauugacugcguauggcagaugagcaagcaauuccccacagccuuugaguucaaugaacaguuuuugaucauuauacucgaucaccuguacucuugucgguucggcaccuuuuuauucaacugcgagucagcacgagaaagacagaaaguuacugagaggacagugagucuguggagccuaaucaauuccaacaaggagaaauuuaagaauccuuucuauaccaaggaaauuaaccgcguccucuacccaguggcuucuaugcggcaucuggagcuuugggucaauuauuacaucagauggaaccccaggaucaaacagcaacagccgaauccuguggaacagcgcuauauggaguugcuggcccuccgagacgaguacauuaagcggcuggaggagcuucaacuggcuaacucggccaaauugagcgaucccccaacguccccuucaagucccucucagaugaugccacacguucagacccacuuuuga

SEQ ID NO: 59299 - RNA, 1239 nt, Artificial Sequence
  derived and/or modified sequence opt3 from MTMR11__Homo_sapiens__XP_011507401
augugguggggcgggagaggacagagcuucaacaucgcuccccaaaaggaggaaccugagauggguuccgugcaggaaaauaggaugccagagccgcggucucgccagcccucaaguugccuggccagccgaugucucccuggcgaacagauucuugcaugggccccagggguccguaaaggacuggagcccgaguuguccggcaccuuaauaugcacaaacuuuagaguuacuuuccaaccuugugguuggcaguggaaucaggacacgccacugaacucugaauacgauuuugcgcuagugaauaucgggaggcucgaggcuguaucgggacugucacgggugcagcuucugcgccccggcagcuugcacaaguucauuccugaagagauccucauucauggcagagacuuuaggcugcugcgggucggguucgaggccggaggucucgaaccacaagcauuucaggugaccauggccaucguucaggcucgcgcacagaguaaccaagcccagcaguauuccggcauaacauuaucuaaagcugggcaaggaagcggcucccgaaagccgcccaucccucugauggagacugccgaagauugggagaccgaaaggaaaaagcaggcggcaagagguuggcgggugucaacagucaaugagcguuucgacguggccaccagucuuccacgcuacuuuuggguacccaacagaauuuuggauagcgagguuaggcgggcuuucgggcacuuucaucagggacgaggcccucgccugucuuggcaccauccaggcggguccgaccuacucagaugcggagguuucuauacugccucagaucccaauaaggaagacaucagggcaguggagcugaugcuucaggcuggccacagcgaugucgugcugguggacacaauggaugaauugccgagucucgccgacguccaacuggcgcacuuacggcugcgcgcccucugucuuccugauucuuccguugcagaggacaaauggcugagcgcuuuggaagggaccagauggcuagacuacgugagggccugccugcguaaggcuucggauauuucuguacucgugacgucccggguccgaucagugauccugcaggccgcauuuagucccagaagcccaaacacuguuuggcuuccuauaaccuccacagccagggugggaggcucuuggacuagccugcccgacucagcuugggguaauugggggcaguga

SEQ ID NO: 59300 - RNA, 2244 nt, Artificial Sequence
  derived and/or modified sequence opt3 from MTMR12__Homo_sapiens__NP_001035536
augcugggcaaggggguggucggagguggcgggggaaccaaagcccccaagccuagcuucguuuccuacgugagaccagaggaaauccacacaaacgagaaagaaguaacugagaaggaagugacgcuccaucuucugccgggcgagcaguuguuaugcgaggcuucuaccguccugaaauaugugcaagaagacucaugucagcacgguguuuacgggaggcuagugugcacagauuuuaagauugcauuccucggagacgaugagagugcccuggacaaugaugaaacucaguuuaagaacaaagucauaggcgagaaugacaucacccuucauuguguggaucagauuuauggcguauucgacgagaagaaaaagacacuguuugggcaauugaaaaaguaccccgaaaagcucaucauucacugcaaagaucugcggguuuuccaguuuugucugcgcuauaccaaggaggaagaggugaaacgaaucgucagcggaauaauccaucacacucaggcgccuaagcucuuaaaacgucuguuccuuuucuccuacgcuacagccgcacagaacaauaccgugacggacccaaagaaccacacugugauguucgauaccuugaaagacuggugcugggaacuggagagaacaaaggguaauaugaaguauaaagccgucucuguuaacgagggcuacaaggugugugaaaggcuacccgcuuacuuuguagugccuacuccacuccccgaggaaaauguccaacgguuccaggggcauggcauuccuaucuggugcuggucgugucacaacggaucagcacugcuuaaaaugagcgcccugccaaaggagcaggaugacgguauuuugcagauccaaaaaucuuuucucgacgggauauauaagaccauucaucgcccgcccuacgaaaucgugaagacagaggaucuguccucuaauuucuuaagccugcaggagauucagaccgcuuauuccaaauucaagcaacucuuucuuaucgacaacucaacggaauuuugggauacugacaucaaaugguuuagucuguuggagagcaguuccuggcuagauauuauaagaaggugccugaagaaagccaucgaaauuacagaguguauggaagcgcagaauaugaacguucuccugcuugaggagaaugcaucagaccugugcugcuugaucagcagucucgugcagcugaugauggauccucacugucggacccgcauaggauuccagucuuuaauucaaaaggaaugggucaugggcggccacugcuuucuggaccgauguaaccaucuaagacagaacgauaaggaggaagugccaguauuccuccuguuucuugacugcguuuggcaguuggugcaccagcaucccccugccuucgaguuuacugagacauaccugaccguccucuccgauagccuguauaucccaaucuucucgacguuuuucuuuaauucuccccaccaaaaagacaccaacauggggagggaaggacaggacacacaguccaagccgcuuaaucuguugacugugugggauuggucaguccaguucgagccuaaagcucaaacccuccugaagaaccccuuauacguggaaaaaccaaagcuggacaagggucagcggaaaggcaugcguuucaagcaucagcgccagcuaagucucccucugacacaaagcaaauccucucccaagagaggguuuuucagggaggaaacugaucaccuuauuaaaaauuugcugggaaagcggaucagcaaacucauuaacucaagugacgagcugcaggauaauuuucgagaguucuaugacuccuggcacagcaagucuaccgauuaccauggcuuacugcuuccacacauagaaggucccgagaucaagguuugggcccagcgcuacuugagauggauuccugaagcacaaauccucgggggcggacagguggcuacacugucaaaacuacuggagaugauggaagagguacagagucuccaggagaagaucgacgaaaggcaucacagccaacaggccccacaggcggaggccccgugucugcuucggaacuccgcacgcuugucuucgcuguuucccuucgcuuuacuccagagacacagcuccaaaccuguccugccaaccucaggcuggaaggcccuuggggaugaagacgaucuggcuaaaagggaggacgaauuuguggauuugggagacguuuga

SEQ ID NO: 59301 - RNA, 1953 nt, Artificial Sequence
  derived and/or modified sequence opt3 from MTMR14__Homo_sapiens__NP_001070993
auggccggcgcuagagcagccgcggcugccgcaagcgccggguccucugcuucaaguggaaaccagcccccucaagagcugggucucggcgaacuucuggaggaauuuagcaggacccaguaccgggcaaaggacggguccggaacaggcgguucuaaaguggagcgcaucgaaaagcgaugcuuggaguuauuugggcgugauuauuguuucucggucauuccaaauacuaacggagacauaugcggccacuacccgagacauaucguuuuucuggaguaugaaucaagcgagaaagaaaaggauacguucgagaguaccgugcagguauccaaacuacaggaccucauucacaggucuaagauggcccggugucgcggcagauuugugugccccgucauccuguucaaggggaaacauauuuguaggagcgcuacacuugccggauggggugagcuguacggccgguccggguauaauuacuuuuucucaggaggcgcggaugacgcaugggccgauguggaagacguuacugaggaagauugcgcuuugcgcaguggugacacccaccucuuugauaaggugcgaggguaugacaucaaacugcugagauaccucagcgucaaguacauaugugauuuaaugguggagaacaaaaagguaaaguucggaaugaauguuacaucuuccgaaaaaguggacaaggcccaaagguaugcagacuuuacccugcuuucaaucccuuacccaggcugcgaguucuuuaaagaguauaaggaucgggacuacauggcugaaggcuugauuuucaacuggaaacaggauuaugucgacgcgccccugagcaucccugauuuccuaacucauagucucaauauugacuggucucaguaccaguguugggaucuggugcaacagacacagaacuaucuuaagcuguugcucucccuggugaauagcgacgaugacucgggguuacugguccacugcaucucuggaugggaucguaccccacucuuuauaucccuucugcgcuugucacuaugggccgacggucugauucacacgagucucaaacccacugagauccuguaccuuaccguugccuacgacugguuccuguuuggccauauguugguggauagacucagcaagggggaagagauuuucuuuuucuguuuuaacuuccugaagcacaucacauccgaagaguuuucugcauuaaaaacucagaggcgaaagagccugccugcucgggacggaggcuucacccuagaggauaucugcaugcuccgcagaaaagacagggguucaacaaccagucugggguccgauuuuagccuuguaauggaaucuucaccaggcgccacgggaaguuucacuuaugaggcuguggaauuggucccggccggcgcacccacacaagccgcuuggcgcaagagccauuccucuucgccucagagcgugcuguggaaucggccacagcccuccgaggacagacucccuucacaacaggggcuggcggaagcaaggaguucuagcuccucaagcucuaaccacuccgauaauuucuuccguaugggaaguagcccacuugagguucccaaaccgcggucuguggaccacccucugcccgguuccucauugaguaccgauuacggcagcuggcagauggucacugggugcggaucgauucaggagcgagccgugcuccauacagacuccucucugccauucagcuuuccugaugaauuacccaacucaugucugcuagcugcccucagugacagagagaccaggcugcaagaaguacgcuccgcauuccuugccgcuuauucuagcacgguuggcuugcgggccguggcaccaucccccucaggugcgauagggggccugcucgagcaguuugcuagaggagucggccugaggagcaucaguucuaaugccuuauga

SEQ ID NO: 59302 - RNA, 1998 nt, Artificial Sequence
  derived and/or modified sequence opt3 from MTMR1__Homo_sapiens__NP_003819
auggacagacccgccgcugcagccgcggcuggcugcgaagggggagguggcccuaacccagggccggccggaggcaggcggcccccucgcgcagccgguggggcuaccgcaggaagccgacagccauccguggaaacacuggauucucccacuggcucacacgucgagugguguaagcaacucaucgccgcuacgauuaguagccagauauccggcucuguuaccucggaaaaugugucacgugacuacaaagcccuuagagaugggaacaagcuggcgcagauggaggaagcaccuuuguucccaggagagagcaucaaagccauuguaaaggacgugauguauaucugccccuuuaugggugcugucaguggcacauuaacugugaccgauuucaaacuguacuuuaagaauguugagagggacccucauuucauucuagaugugccacucggggucaucucccggguggaaaagauaggagcccagucucacggcgacaacagcugugguaucgagauuguaugcaaagauaugcgcaaucugagacuugcauauaagcaagaggagcaguccaaacuggggaucuuugagaacuugaauaagcaugcuuucccgcucucaaacggacaggcccuguuugcguucaguuacaaagaaaaguuucccauuaauggcuggaagguuuaugacccugugagcgaguacaaaaggcagggccugccaaacgaaucuuggaagaucuccaaaauaaauucaaacuaugaguucugugauacauaccccgccauuaucgucgugccuaccagcgugaaggacgaugaccucaguaaagucgcagcuuuucgggccaaggggcgcguuccaguguuaucuuggauucaccccgaaucccaagcuacuaucacacgaugcagccagccgcugguaggaccuaaugacaaaagauguaaggaggaugagaaguaccuucagaccaucauggacgccaacgcacagucgcauaaauugauuauauucgaugccaggcaaaauucuguggcugacacgaacaagacuaaagguggcggguaugaauccgagucagcguaccccaacgcagaacuggucuuucuagagauccacaauauucacgugaugcgggaaagucuccguaagcugaaagagaucguuuauccaagcauagaugaggcccgcuggcuuuccaacguggacggaacccauuggcuggaauacauuagaauguugcucgcuggcgccgucaggaucgcagauaagaucgagucugguaagacaagcgugguaguucacugcucagacgggugggaucggacugcccagcugaccaguuuagcuaugcugaugcucgacuccuauuaccgaacaauuaaaggcuucgaaacccuuguggagaaggaauggaucagcuucggacaucgcuuugcccugagagucggccacgggaaugauaaccacgcagacgcggacaggucuccuauuuucuugcaguuuguggauugugucuggcaaaugacgcggcaguuccccucagcuuuugaguucaaugagcuauuucugauaacuauccucgaccaucuguauaguugccuuuucggaacauuucuguguaacugcgaacagcagcgcuucaaagaggauguguacaccaagacuauuagcuugugguccuacaucaauucucaacucgacgaauuuucgaacccauucuuuguuaauuaugagaaccacgugcuguaccccguagccagcuuaucccaucuggagcuaugggucaauuauuacgugagauggaacccuaggaugcguccacagaugccgauccaccagaaucucaaagaacugcuugcaguucgggccgaguugcagaagcgaguggaaggucugcaaagagaggucgcuacaagggccgugucaaguucuagcgaacgcggcuccucacccagccauucugcaaccuccguacacacgaguguguga

SEQ ID NO: 59303 - RNA, 1932 nt, Artificial Sequence
  derived and/or modified sequence opt3 from MTMR2__Homo_sapiens__NP_057240
auggaaaagagcuccucuugcgaaucacugggcagucagcccgccgcugcaagaccuccaagcguggacucccucucuucggccucaaccagccacagugagaacuccguccauacaaaaucugcgagcguuguguccucagauaguaucagcacuucugcugacaauuucuccccggaucuuaggguacugcgggaaucaaacaaguuggccgagauggaagaacccccuuuacugccaggggagaauauuaaagacauggcaaaggaugugacguacauaugucccuuuaccggagccguccgcgguacacuaacugugaccaacuaucgacucuacuucaaaagcauggaacgugacccuccauuuguucuggaugcuagucuuggcgugaucaauagagucgagaagauugggggagcaucuuccaggggcgaaaacagcuauggucuggagacagugugcaaggacauccggaauuugcgcuucgcccacaaacccgaggggagaaccaggcggucgauuuuugaaaaccucaugaaguacgcuuucccuguaucuaauaaccugccacuguuugccuucgaguauaaagaaguuuuuccggagaauggauggaagcucuacgaucccuuacuggaauaucgccgacaaggcaucccuaacgaguccuggagaauaacuaaaaucaaugagagguacgaacuuugugacacauacccagcguugcuggugguccccgcaaacauuccugaugaggaacuaaagcggguggccucauuccguagucgcggcagaaucccagugcucagcuggauucaucccgagucccaggcuaccaucacgaggugcucucagccgauggucgggguuagcggaaagcggucaaaagaagacgagaaguaucugcaggccauaauggauaguaaugcacaaucccacaaaauuuuuaucuucgacgcucgaccuagcgugaacgccguagcgaacaaggccaaagguggcggguacgagucugaagacgcauaucagaaugcugagcuuguguuucuggauauucauaacauccacgucaugcgcgaaucauugagaaagcucaaagagaucguguaccccaauauugaagagacucacuggcugaguaacuuagagagcacccauuggcuggaacacauaaagcucauccuugccggagcucugaggauugccgacaagguugaguccggcaaaacaucuguggucgugcauuguucggaugguugggaccggacugcacaguugaccagccuagccaugcugaugcucgauggguauuaccgcacaaucagaggauucgaaguacugguugagaaggaguggcuuuccuucggccacagguuucagcugcgugugggccacggggacaaaaaucaugcugaugcggaccggucaccagucuucuugcaauuuauagauugcguguggcagaugacccgacaguucccuacggcauuugaguucaacgaguauuuucucauuacuauccuggaccacuuauacaguugucuguucggaacauuucuaugcaauucugaacagcaaagagguaaggagaaccuccccaaaaggaccgucagccugugguccuacaucaauucacagcuugaagauuucacuaacccauuguauggcagcuacucuaaucaugugcuguaucccguugccuccaugcgccaccucgagcugugggugggguacuauauucgguggaacccuagaaugaagccacaggagccgauccauaauagguacaaggaacuucuggcuaaacgcgccgaguugcaaaagaaaguagaggagcuccagcgagaaauuaguaaccggagcacaucuuccucagagcgugcaaguagccccgcccagugugucaccccugugcagacgguuguguga

SEQ ID NO: 59304 - RNA, 3597 nt, Artificial Sequence
  derived and/or modified sequence opt3 from MTMR3__Homo_sapiens__NP_066576
auggacgaggaaaccagacacagccuggagugcauccaggccaaccaaauuuuccccaggaagcagcucauacgggaagaugagaaucuucaggugccuuuucuggaauugcauggcgaguccacagaguucgucgggcgcgcugaagacgcaaucauugccuuaucuaacuaccgacugcacaucaaauuuaaggagucucuaguuaaugugccacuccagcugauugaaaguguagagugucgugauaucuuccaacuucaucugacuugcaaagacuguaaggugauaagaugccaguuuagcacguucgagcagugucaggaaugguugaaaaggcucaacaaugcgauccggccgcccgcuaagauugaggaucuguuuuccuucgccuaucacgcauggugcauggaagucuacgccucugagaaggaacaacauggagaccugugucgcccuggugagcacgugaccucgagauuuaaaaacgagguugaaaggaugggcuucgauaugaauaacgcuuggcggaucucaaauauuaacgagaaguauaaacucugcgggagcuacccacaggaauuaaucgugcccgcauggauaacagacaaggagcuggaaagugucuccucuuuucgcagcuggaaacggauuccugccgugaucuauagacaccaguccaauggagcuguaauugccagguguggccagccagagguuucauggugggguuggcggaacgcggaugacgagcaucuugugcaaagugucgcaaaggccugcgcuagcgauucucguuccucagggagcaaguugaguacucgcaauaccucuagagacuuccccaacggaggcgaucuguccgacguggaauuugacagcucgcuaucuaaugccuccggcgcagagucacucgcuauccagccucagaaacugcuuauccuggaugccaggaguuacgcggccgcaguggcuaaccgggccaaagggggagguugugaaugcccagaguauuacccgaacugcgaagucguuuucaugggcauggcuaauauucacagcauacgacgcuccuuccaaucuuugagacuccuguguacacagaugcccgacccugggaacugguuaagcgcccuggagucaaccaaguggcuccaucaccuuagugugcuguugaaguccgcacuacugguagugcacgccgucgaucaggaccagaggccagugcucguucauugcagcgauggaugggaccggacuccccaaaucguggcucuggcgaaacuucuguuggauccuuacuaucgcacaauugagggcuuucagguccucguggaaauggaguggcuggacuucggucacaaguuugcagauagaugugggcauggagaaaauucugacgauuuaaacgagaggugcccaguauuccugcaguggcuagacuguguucaccagcuccaacgucaguuucccugcucauucgaguuuaaugaagccuuccuggugaaacuuguccagcauaccuacaguuguuuguuuggcacguuccugugcaacaaugcuaaggagcggggcgaaaagcacacucaggagcgaaccuguagcguguggucccuccugagagccgggaacaaagcauuuaagaaucuucuguauucuucgcaaagcgaagccgucuuguacccggugugccacguuaggaaccucaugcugugguccgcuguguauuuaccuugucccucaccaacaacuccuguagacgauaguugcgcccccuacccagcacccggaaccucuccugacgauccaccgcugagccgccuacccaaaacacgguccuaugacaaucucaccacggcgugcgauaacacugucccucuggcuucaagaagguguagcgacccaucucuuaaugagaaguggcaggagcaucgccgauccuuggaacugaguagccucgccggucccggcgaggauccucugucugcagacuccuuagggaaaccaacacgggugcccggaggcgccgaacugucaguugcugccgguguggcagaggggcagauggaaaacauccuucaggaggcuaccaaggaggaaaguggcgucgaggaaccggcccaccgugcgggaauagagauucaagaaggcaaggaggauccuuugcucgagaaagaaagcagaaggaagacuccagaggccucggcuaucgggcugcaucaggaccccgaacuaggagaugcagcccugcgcucccaccucgacaugucuuggccucuguucagccaggguaucucagagcaacagaguggccuuuccguguugcugucuagcuuacagguacccccacgaggggaggauucccucgaagugccuguugagcaguuuagaauugaagagaucgcugaaggaagggaggaggccguccugcccauuccaguggacgcaaaagugggcuacgguacaucacaaagcugcagucuucugccgucucaggucccuuucgaaacccgagggcccaauguugacuccagcacggauauguugguggaggacaaggugaaaucgguaucaggcccacagggacaccaucgcucuugucucgucaacaguggcaaggaucggcugccccagaccauggaaccuuccccaagcgagacaucucuaguggaaagaccccaaguugggagcgugguccacaggacuucccugggaucaacccucagucugacacguagcccuugcgcgcuuccguuggccgaguguaaggagggucuggugugcaacggcgcuccagaaacugagaaucgcgccucugaacagcccccuggguuauccacccuccagauguacccaacacccaacggacauugugcaaauggcgaggcuggucggucaaaagacagucugagcagacagcuuuccgccaugucuugcucgagcgcacaucugcacucaaggaaccuacaccacaaguggcuccauucccacagugggcgaccuucugccaccagcuccccggaucaacccucacggucucaucuggacgaugacggcaugagcguuuauacugauacgauacagcagcgcuugagacaaaucgaaaguggacaccagcaggagguggagacacugaaaaagcagguacaagaauuaaaauccaggcucgagagccaguaccugaccucuucacuucauuucaauggcgacuuuggggaugaagucacuuccauuccagacagugagagcaaccuggaucagaauuguuugucgcggugcucuaccgagaucuucuccgaagcuagcugggaacagguggacaagcaagacacagagaugacccgauggcucccugaucaccuggcggcccacuguuaugcaugcgacucagcuuuuuggcuagccaguagaaagcaucacugccgcaacuguggaaauguguucugcucauccuguugcaaccagaaaguccccguuccaagccagcagcuguuugagccuucaaggguguguaagaguugcuacagcucccuucaucccacuucuagcuccaucgaucucgaacuggacaaaccaauugccgcuacaucaaauuga

SEQ ID NO: 59305 - RNA, 3588 nt, Artificial Sequence
  derived and/or modified sequence opt3 from MTMR4__Homo_sapiens__XP_006722231
augggcgaggaagggcccccuagccuggaguacauccaggccaaggaccucuucccaccgaaagaacuugugaaggaggaagagaaccugcaaguccccuuuaccguuuugcagggagaggguguggaguucuuaggcagagcugcagaugcccugauugcgauauccaauuauaggcuacacaucaaauuuaaggacucuguaauuaacgugccucuccggaugaucgauucagucgaaagucgcgacauguuccagcugcauauuagcugcaaagauuccaaggugguucgaugucacuuuucuacauucaagcagugccaagaauggcuuucgcgucugucaagagcuacugccaggccagcaaaacccgaggacuuguuugccuucgcuuaccaugcauggugucucgggcugacggaggaagaucagcacacccaucugugccagccuggagagcacauccggugucgccaggaagccgagcucgcuagaaugggcuuugacuuacaaaauguguggagggucagccacauaaacaguaauuauaagcugugcccauccuacccccagaaacuuuuggugccuguauggaucacagauaaggaacuggagaacguugccucuuuccggagcuggaaacgcauuccaguggucguguaucgacaucuaagaaauggugcggcaaucgccagguguucccagccggagauuucaugguggggguggcggaacgcugacgaugaauaccucgugaccaguaucgccaaggcaugcgcucuggaccccggaacucgugccacaggcggcagccuuucuaccgggaauaacgauacuuccgaggcgugugacgccgacuuugauucaagccugacagcaugcaguggagucgaaucuaccgcugccccucagaaguugcucauacuggacgcucgcuccuauacggccgcaguugccaauagagcuaaagguggcgggugugagugcgaagaguacuacccaaacugcgaggugguauucaugggaauggcgaauauucacgcaaucaggaacagcuuucaauauuuacgggccguguguucgcagaugcccgauccuucuaauuggcuguccgcucucgaaucaacuaaguggcuucagcaucugagugucauguugaaagccgcagugcuaguugccaacaccguggaccgagagggccgcccaguccuggugcacugcagcgaugguugggacagaacaccccaaauuguagcucucgccaagauccugcuugauccguacuauaggacucuggaaggguuccagguuuugguggaguccgacuggcucgauuucggacacaaauuuggcgaccgguguggccaucaggaaaacgucgaggaucagaaugagcaaugcccuguguuccugcagugguuagacucuguccaccagcugcuaaagcaguuucccugucucuucgaauuuaacgaggcauuccuggugaaacuuguucaacauaccuacagcugcuuguaugggacauuucuggcgaauaacccaugugaacgcgagaagagaaauaucuacaagaggaccugcucagugugggcucuccugcgugccggaaacaaaaauuuccacaacuuucuuuauacgccuaguuccgacaugguacugcaucccgucugucacgugcgggcauugcaccucuggacugccguuuaccugccagcuagcucucccugcacauuaggugaggaaaauauggaucuguaccuaucaccuguggcccagagucaggaguucagcggccgaucccucgacagacugccaaagaccaggucuauggaugaccuuuugucggcaugugauacuagcuccccgcugacacgcaccucaagugaccccaaccucaauaaccauugccaggaaguccggguggggcuggagccuuggcacucuaauccagaaggaagcgagacguccuuuguagauucaggcgugggugggccccaacagaccguuggcgaggucggauuaccuccaccccugccgagcucucagaaagacuaucuuuccaacaagccuuucaaaagucauaagagcugcucuccauccuacaaguugcucaauacagcugugcccagagaaaugaaaucaaacaccagugauccugagauuaaggugcuggaagagacuaaaggccccgccccagacccuagcgcgcaggaugaacuagggaggacacuggacggaauaggugagcccccagagcacuguccggaaacugaggccgucucggcucucuccaagguuaucucuaacaaaugcgauggcguguguaauuuuccugaaagcucacaaaacagucccaccgggacaccacagcaggcacaacccgacuccaugcugggagugccuucuaagugcguacuugaccacagcuuguccaccgucuguaauccacccucagccgcuugccagacuccucuggauccgagcacggacuucuuaaaccaggauccaaguggcucuguggccuccauuagccaucaggagcaacucucgucaguucccgaccugacacacggugaagaggauaucgggaagcgcggcaauaaccgaaauggacagcuucuggagaacccucgguucggcaaaaugccauuggaacucgugcguaagcccauaucucagagucagauuuccgaguuuagcuuccuggggucuaauugggacagcuuucaaggaauggucaccuccuucccuucaggugaagcaacuccgagaaggcuacugaguuauggcuguugcagcaaacgccccaacucuaagcagaugcgggcgaccgggccauguuuuggaggccagugggcccagagagagggugugaaauccccuguuugcucaagucauagcaaugggcacuguacaggccccggaggcaagaaccaaauguggcucuccucucauccaaaacaggugucgagcaccaagccuguaccccugaauugcccaucaccggucccuccccuuuacuuggaugacgaugggcugccauuccccacugacgugauccagcacagguuacgacaaaucgaggcuggauauaagcaggaaguggagcagcuccgccggcaggucagagaacugcaaaugaggcuugauauucgucacugcugugccccuccagcagagcccccuauggacuacgaagaugacuuuacaugccugaaagaguccgacggcagugauacggaggacuucgguucugaucauagcgaagacugucuauccgaggcuucaugggaaccgguugauaagaaagagaccgaagugacucgcuggguaccagaccacauggccucucauugcuauaacugugauugcgaguuuuggcucgcaaagcggagacaccauuguaggaauugcgggaacguguucugugccggaugcugucaccugaaauugcccaucccugaccagcagcuguacgaucccgucuuagugugcaacagcugcuacgagcacauucagguuagucgagcucgggaacucaugucccaacagcugaagaagccaauagcgacagccagcucuuga

SEQ ID NO: 59306 - RNA, 1866 nt, Artificial Sequence
  derived and/or modified sequence opt3 from MTMR6__Homo_sapiens__NP_004676
auggagcacaucagaaccacaaagguggaacaggucaaacugcucgacagguucagcacuuccaacaagucucuuacgggcacccuguacuugacagccacucauuuacuguuuauugauucacaccaaaaagagaccuggauacuacaucaccauaucgcuaguguugaaaagcucgcacugacaaccagcgggugcccccuugugauucaguguaaaaauuuccggacuguacacuuuaucgugccucgcgagcgagacugccacgauauuuauaacucccuguugcagcucucuaagcaggccaaguacgaagaccuguaugcguucucguacaauccaaaacaaaacgauucagagcgucugcagggauggcagcucaucgacuuagcugaggaauauaagagaaugggugucccgaauagccauuggcagcugagugaugccaacagggacuacaaaauaugugagacauauccccgggaacuuuacgugccucgcaucgcauccaagccaauuaucguuggcucuagcaaauuuagauccaaggggagguuccccguguugucauacuaucaccaagauaaggaggccgcuauuugccgguguagucagccucugagcggauuuucugcacgcugccuagaggacgaacaucuccugcaggccaucuccaaagcuaauccagucaaccgauacauguaugugauggauaccagacccaaacuuaaugccauggcgaacagggcagccggcaaggguuacgagaaugaagacaacuauucaaauauacgguuccaguuuguagggauugagaacauccacguuaugcguagcagucugcaaaaguugcucgaagugaauggaacgaaaggccugucugucaacgauuucuacuccggcuuagagagcucgggguggcugcgccacauuaaggcugugauggacgccgcaaucuuucucgcuaaagccaucacuguggagaacgcgucuguccuuguucauuguuccgacggaugggauagaaccucacaggugugcagucuggguagcuugcuacuggacuccuauuacaggacaauuaagggcuucaugguacucauagaaaaggauuggaucucuuuugggcacaaauucagcgagcgguguggacagcuggacggcgauccuaaggaagugucaccagucuucacucaauuucuugagugcguguggcaucugaccgaacaguucccgcaggccuuugaguucagugaggcauuuuugcuccagauucacgaacauauccacuccugucaauucgguaauuuucuggggaacugccagaaagagcgagaagaguuaaagcugaaagaaaagacauacagccuauggcccuuccuccuggaggaccagaagaaauaucuuaauccuuuguacucuucagagagucaccgcuuuaccguucuggaaccaaacacggugagcuucaauuuuaaguucuggagaaacauguaucaucaguuugauaggacucuccacccccggcaauccgucuucaauauaauuaugaacaugaaugagcagaacaaacagcuggaaaaggacaucaaagaucuugagucuaagaucaagcagcgcaaaaauaagcaaacagacggcauucugaccaaagaguugcuccauucggugcacccugaaagcccaaaccugaagacuuccuuaugcuucaaagagcagacacugcuacccguaaaugaugcucucagaaccaucgaaggaucaaguccggccgacaacagguacucugaguaugcugaagaguuuagcaaguccgagccugccguugugucacuggaauacggcgucgcacguaugacguguuga

SEQ ID NO: 59307 - RNA, 1983 nt, Artificial Sequence
  derived and/or modified sequence opt3 from MTMR7__Homo_sapiens__NP_004677
auggagcacaucagaacccccaagguggaaaacgucaggcugguugaccgggugagcccuaaaaaggccgcucucggcacacuuuaccugacugcaacgcauguaauuuucguggagaauagcccagauccgcgcaaagaaaccuggauauugcacucucagaucucaacaauugagaagcaagccacuaccgcgacagggugccccuuacugauccgauguaaaaacuuucagauuauccagcuaauaaucccucaggaacgugacugccaugaugucuauauuagucucaucagacuggcuaggccagugaaguacgaggagcuuuauuguuucagcuuuaaucccaugcuggacaaggaggagcgggaacaaggauggguuuugauugaucucuccgaggaguacacccgcaugggucugccuaaccacuauuggcagcugucugacgugaauagagauuacagggucugcgacucguauccaacugaacucuacgugcccaaaucagccacagcacauaucauaguaggcagcaguaaguuccggucccgccgaagauuuccuguuuuaucuuacuauuacaaagauaaccacgccagcauuuguagguccucacagccacugaguggguucagcgcucggugccuugaggacgaacagauguugcaagcaauccguaaggccaauccgggaucugauuuuguguaugucguggacacccgccccaaacugaacgcuauggccaauagagcggcaggcaaggguuacgagaacgaagauaauuauuccaacauuaaguuccaguuuaucgggaucgagaauauucacgugaugaggaacucacuacagaaaaugcucgaggucugugaacuuaagagcccuaguaugucugacuuccuguggggacuggaaaauuccggcugguugcggcauauaaaagccaucauggacgcuggcauuuuuaucgccaaggcaguuagcgaagagggggcuucggugcucguacacugcucugauggaugggaccgaacggcccagguguguuccgucgcgucacuguuacuggauccacauuaccgcacucucaaagguuucauggugcuuauagaaaaggacuggauuaguuuuggccacaaauucaaccacagauaugggaaccuggauggagaccccaaggagaucagcccuguuaucgaucaauucauugagugcguguggcaguugauggaacaguuuccaugugccuucgaguuuaaugaaagguuccuaauccauauucaacaccauauauacuccugccaguuuggcaacuuccugugcaauucucagaaggagcggcgcgaacucaaaauccaggagagaaccuacagccugugggcacaccuuuggaagaacagggcugacuaucugaaucccuuguuucgugccgaucauucacaaacacaggguacucuccaucugccgaccacaccuuguaacuucauguacaaauuuuggagugggauguauaaucgguucgagaagggaaugcagccccgacaguccgucaccgacuacuuaauggcugugaaagaagagacgcaacagcuggaagaggagcuagaagcccucgaggaaagacuggagaagauucagaagguacagcuuaacugcacuaaaguuaagagcaaacaaucugaaccaucaaagcacaguggcuuuagcacauccgauaauucuaucgcaaacaccccucaggacuauucgggcaauaugaaauccuuccccuccaggucaccaagucagggggacgaggauucugccuugauccugacucaggacaaccucaagagcuccgaucccgaccugucagcuaauagcgaucaagagucuggaguggaagaccuuuccugucgcaguccuagcgguggcgagcacgcgccaucugaagauuccgggaaggaccgggauucagacgaggcagucuuucugacagccuga

SEQ ID NO: 59308 - RNA, 2115 nt, Artificial Sequence
  derived and/or modified sequence opt3 from MTMR8__Homo_sapiens__NP_060147
auggaccacaucaccgugcccaaggucgagaacguuaaacugguggauagauacguaagcaagaaaccugccaauggcauucucuaucuuacagcuacucaucugauauacguggaagcauccggggccgcgaggaaggagacguggaucgcuuugcaccauauugccaccgucgaaaaauuaccaaucacaucucugggaugcccgcuaacucuccgguguaagaacuuccgcguggcacacuuuguucuggacucagaucuugugugccaugaggucuauauuagucuguugaagcucagccagcccgcccugccugaagaccuguacgcuuucuccuauaauccaaaaucuucgaaggagaugcgagagucagguuggaaacucaucgaucccauaagcgacuuuggccguauggggaucccuaacagaaauuggaccauuacagaugcaaacaggaauuacgaaaucuguaguaccuauccacccgagauugugguaccuaaguccguuacuuuaggaacaguggucggcucuagcaaauuccgguccaaggaacgcgugccagugcugucauaccuuuacaaggagaacaaugccgcuaucugcagauguagucaaccguugagcgguuuuuauaccaggugcgucgacgaugagcugcuacucgaagccauaucucagacgaaccccgggucccaguucauguacguuguggacacucggccuaaacugaaugcgauggcaaaccgcgccgcuggaaagggcuaugagaaugaagauaacuacgccaauauucgauuuagauucaugggcaucgagaacauucacguaaugaggucaagccuucagaaacuguuggaagugugugagcucaagaccccaacaaugagugaguuucugucuggguuagaauccagcggauggcugcggcacaucaaagcaaucauggacgcugguauuuucauaacuaaggccgucaaaguggagaaggcgucgguucucgugcauugcucugauggcugggaccguaccgcccaagucuguuccguggcaucaauccuucuggaccccuuuuaucgcacauucaagggguugaugauucuaaucgaaaaagaguggauaaguaugggacacaaguuuagccagagaugcggccaucuggauggugacuccaaagaaguaucuccuauuuucacccaguuccucgauuguaucuggcagcugauggagcaauuuccaugcgcuuucgaguuuaacgaaaauuuccuucuggagauccacgaccacguuuuuagcugccaguucgggaacuuuuugggaaauugucagaaggauagggaagaccuccggguguacgagaaaacgcauucagucuggcccuuccuggugcagcgaaagccggauuuucgcaacccuuuauauaagggcuucacuauguacggcguccugaaucccaguacagugccauacaacauucaauuuuggugcgggauguauaauagauucgacaaaggacuacagccuaagcaguccaugcucgaaagccugcuugagaucaaaaagcaaagggccauguuggagaccgauguucacgaacuggagaaaaagcucaaggugcgggacgaacccccagaggagauuuguacuugcucucagcuggguaacauacuuucacagcaucugggcagucccuugacaaauccucucggguuuaugggaaucaacggcgaucugaauaccuuaauggaaaacgguacgcugagccgcgaagggggccuaagagcucagauggaccaaguaaaaucccagggagccgaccuccaccauaauuguugcgagauugucggcucucugagggcaaucaacaucucgggggaugugggaauuagcgaggccauggguauauccggcgacauguguaccuucgaagcuacaggguucucaaaggaucuuggaaucugcggcgcgauggacauuagugaggcaacugguaucucugggaauuugggcauuagcgaggcccguggauuuuccggcgauauggggauccugggagacaccgguauaucaaaagcuagcacaaaggaagccgauuacucuaaacaccaguga

SEQ ID NO: 59309 - RNA, 1650 nt, Artificial Sequence
  derived and/or modified sequence opt3 from MTMR9__Homo_sapiens__NP_056273
auggaguucgccgaacugaucaagacccccagaguggacaacgucguucuccacaggccuuuuuacccagcuguggagggcacacuuugccugacugggcaucacuugauuuuaagcucccggcaggauaauacggaggaacuguggcuacuccauucuaacauagacgcaaucgauaaacgcuucguaggaucacuggguaccauuaucauuaaguguaaagacuuucgaaucauacaacuugauaucccgggcauggaagagugccugaauauugccaguagcaucgaggcguuguccacacucgacucuauuacucugauguaucccuucuuuuaccguccuauguucgaagugaucgaggauggguggcacucguuucugccagaacaggaguucgagcucuauucaagcgcuaccagugaauggagauuauccuacgucaacaaggaguuugccgugugucccucuuauccuccaauaguuacagugcccaaaagcauugacgaugaagcacugaggaaggucgccaccuuccggcauggaggccgcuuuccugugcuuuccuacuaucacaagaaaaaugguaugguaaucaugagaucagggcagccauugacuggaacaaacggcaggcggugcaaggaggacgaaaaacugauuaaugcuacccuacgcgcaggcaagcgaggguacaucaucgauacgagaagucucaacguugcccagcaaacuagggcuaaaggagguggcuucgagcaggaggcccacuacccgcaguggcggcguauucauaagagcauagaacgcuaucacauccugcaggagucucuuauuaagcugguggaagcguguaaugaccaaacccauaacauggauagaugguuguccaaacucgaggcaucaaauuggcugacacacaucaaggaaauauuaacuaccgccugccuggcugcccaguguauugacagggagggggcaagcauccucauccacggaacagagggcaccgacaguacgcuucaggucacuucucuggcucagauuaucuuggaaccccggucccgaacaauucgcgguuuugaggcccuaauagaaagagaguggcugcaagcggggcauccuuuccagcagaggugcgcccaaagcgcauacuguaacaccaaacagaagugggaagcuccaguguuccuccuguuucuugauugcguguggcagauccugcggcaguuccccuguucguuugaguucaaugagaacuuuuugauuauguuguucgaacacgccuaugcuucucaauuuggaacuuuccugggcaauaacgaguccgaacgcugcaaauuaaagcugcagcagaaaacaaugucacuauggaguugggucaaccagccuagcgagcucuccaaguuuaccaauccacuguucgaggccaacaaucuuguuaucuggcccucuguggcaccgcaaagccucccucugugggaaggcaucuuucucagauggaacaggucaaguaaguaccuggacgaggccuaugaagagaugguaaauauuauagaauacaacaaagagcuucaggcuaaggugaauauccugcgucggcaguuggcggagcucgaaacggaggaugggaugcaggaaucccccuga

SEQ ID NO: 59310 - RNA, 1053 nt, Artificial Sequence
  derived and/or modified sequence opt3 from MTNR1A__Homo_sapiens__NP_005949
augcagggcaacgggagcgcccugcccaaugcuucccaaccugugcucagaggagacggugcaaggccaucuuggcuugccucagcgcuggcuugcgucuugaucuucaccauuguuguggauauauuaggcaaccugcuaguaauccucaguguguaccggaauaagaaacugcgcaacgccgggaauauuuuugucgugagccuugcaguugccgaccugguggucgcuaucuauccguaccccuuggugcucauguccauuuucaacaauggauggaaccugggcuaucugcacugucagguaucugguuuucucaugggguuaucgguuaucggaucaauauucaauaucacaggcauugcaaucaaccgauacugcuauauuugucauagccugaaguacgauaaacuuuauaguuccaaaaauucuuugugcuacgugcugcuaaucuggcuccugacucuugccgcuguccugccuaacuugcgugccggcacgcuccaguacgacccaagaauauauagcuguaccuuugcgcaguccgugucaagugcauacacaauugccguggucguuuuccacuuucuggugcccaugaucauuguaaucuucugcuauuuaaggaucuggauucuggugcuccaaguccggcagcgcgugaagccugauagaaagccaaaacuuaagccccaggacuuuaggaauuucguuacuauguuuguggucuucgugcuguuugcuauauguugggccccuuugaacuucaucgggcuagcaguagcuagcgauccagccucuaugguuccgcggauucccgaguggcuguucguggcguccuacuauauggccuacuuuaauucaugccucaacgcaaucauauauggacugcuuaaccagaauuuccgcaaggaauaccgaagaauuaucgucagccuguguaccgcuaggguguuuuucgucgacaguucuaacgauguggccgaccggguuaaauggaagccuuccccauugaugacaaauaacaaugugguaaaagucgauagcguguga

SEQ ID NO: 59311 - RNA, 1089 nt, Artificial Sequence
  derived and/or modified sequence opt3 from MTNR1B__Homo_sapiens__NP_005950
augagcgagaacggcuccuucgccaauugcugugaagcugggggaugggcagugagacccgguuggucuggcgccgggucagcgaggccuagucggaccccacgcccgcccugggucgcuccugcccugagcgcaguucucaucgugacaacugccguagacguggucggaaaccuucuggugauuuuguccguuuuacgaaaucguaagcugagaaacgcuggcaaucuauuucucgugucucuggcacuugccgaucuggucguggcuuucuacccauaucccuugauacucguagccaucuuuuacgacgguugggcgcugggggaggaacacugcaaagcaucggccuucguuaugggacugucagugauuggcagcgucuuuaacaucacggcuauugccaucaauagguauuguuacauaugccauaguauggcauaucaccggaucuaccgcagauggcauaccccucuccacauuuguuuaaucuggcugcuuacagugguggcuuugcugccaaacuucuuugucggcucccuagaguaugaucccaggauuuacucuugcacuuucauccagaccgccagcacacaauacaccgcggccguugugguaauacauuuucuccugccuauugcaguggucuccuucuguuaucuucggaucugggugcugguuuugcaggcucgccgaaaggccaaaccagaaucaagacucugccugaagccgagugacuuaaggagcuuucugacuauguucguggucuuugugauuuucgcuaucuguugggcaccccucaauugcaucgggcuugccguagccauuaacccucaggagauggcuccacagauacccgagggacuguucguuacaucuuacuugcuagcguauuuuaauuccugucugaacgcaaucguguacggucuccugaaucaaaacuuccggcgugaauauaaacgcauucuucuggccuuguggaauccuagacacugcauccaggaugcuucaaagggcagccacgccgaggggcuccagaguccagcacccccgauaauuggaguccagcaucaagccgacgcucuguga

SEQ ID NO: 59312 - RNA, 2199 nt, Artificial Sequence
  derived and/or modified sequence opt3 from MTO1__Homo_sapiens__NP_001116698
auguucuacuuuagaggcugcgggagguggguggccgucagcuucaccaagcagcaauuuccccuggcucggcucuccucugacucagcagccccucgcacaccacacuucgauguuaucgugauuggagguggccaugcggggacugaggcugccacggcagccgcucgauguggaagucguacccuucuguugacacacagaguagacacuauaggccagaugagcugcaacccguccuuuggugggaucggaaaaggccauuuaaugagggaaguggaugcacuggacggccuauguucucggauuugcgaucagucggggguccacuauaaggugcucaaucgcagaaaaggacccgccguuuggggucugagggcucagaucgaccggaaguuguacaaacaaaacaugcagaaggagauucugaauaccccuuugcucacagugcaggaaggcgccgucgaggaucugauccugaccgaaccagagcccgagcauacugggaagugucgcgugucaggaguaguucucguggacggcagcacagucuaugcggaaagugugauauuaaccacggguacuuuccugcgagggaugaucgugauuggacuugagacccacccugcaggcagauugggcgaucagccauccaucgggcuggcccaaacacuagaaaaacucggauuugucguugguaggcugaagacuggcacucccccucggauugcuaaagagucuaucaacuucagcauacuuaauaagcacauuccagacaacccguccauccccuuuucauucacaaaugagaccguguggauuaaaccugaagaucagcugccaugcuacuugacgcauacuaacccccguguagacgagaucgugcucaagaaucugcacuuaaacagucaugucaaggaaacaacccgcgggccuagauauuguccaagcaucgagucuaaagugcugagguuucccaaucggcuccaccagguuuggcuugaaccggagggaauggauuccgaccugauuuacccucagggcuugucaaugacucuacccgccgagcugcaagaaaagaugauaacaugcauccgaggucucgagaaagcaaaggugauucagccaggguauggcguccaguacgacuaccuggauccucgccaaaucacccccagccuugaaacgcaccuggugcagagauuguucuuugcuggacagauaaacggcaccacaggguaugaggaagccgcggcccagacugaguguugcaguguagcaaggcucgaguguucugacaugauuucccaacugcaggcuaucuuacugccacagcccagccuaguugccggaaccgcugguaugcaucacaauacacagggcgugaucgccgggauuaacgcaucgcuccgggucucucgcaaaccuccauucguggucuccagaacugaaggauacaucggcgugcugauugaugaccuuaccacauuggguaccucagagccguauaggauguucaccagucguguugaauuucggcugagccuccgacccgauaaugccgacuccagacugacgcuuaggggguacaaggaugcuggcugcgugucucaacagcgcuaugagcgggcgugcuggaugaaaagcucacuggaagagggaauaaguguauugaaguccaucgaguuccucagcucuaaguggaaaaagcugauuccugaagcaucaaucaguacaagcagauccuuaccagucagggcccuggacgugcuaaaauacgaggaaguugauauggacucucucgcuaaggccgugcccgagccucugaaaaaguauaccaagugucgcgagcuugcagaacgauugaaaaucgaggccacuuacgaaucgguccuguuucaucagcuccaggagauuaagggcgugcaacaggaugaagcucugcaguuaccaaaagaccuggacuaccuuaccauacgggauguaagccuuucccacgaggugcgugagaagcuccauuucucaagaccccagacaaucggggccgcaaguaggauuccgggaguuaccccugcggcuaucauuaaccugcuacgcuuugucaaaacuacacaacggagacagucugccaugaacgaaagcuccaagacggaccaguaucugugcgaugcagacaggcuccaagagcgagaacuguga

SEQ ID NO: 59313 - RNA, 1749 nt, Artificial Sequence
  derived and/or modified sequence opt3 from MTPAP__Homo_sapiens__NP_060579
auggccgugcccggcgucgggcugcucaccagacuuaaccugugcgcuaggcggcgcacacgaguucagcguccuaucgugagauuguuaagcuguccaggaacuguagcaaaggaccugaggcgggaugagcaaccguccgguucuguggaaacgggcuucgaggacaaaauucccaagcgcagauuuucagaaaugcagaaugagaggcgggaacaggcccagcgcaccguccuaauacacugcccugagaaaaucagugagaacaaguuccucaaauaccugagccaauuugggccaauuaauaaccauuucuuuuaugaauccuucggacuuuacgcggugguugaguuuugucagaaggaaucuaucggcucgcugcagaaugguacacacacucccucaaccgcuauggagacagccauuccuuuccgaagcagauuuuucaacuugaagcucaaaaaucagaccagugagaggucccgggugcguucuagcaaccaacugccacgcuccaauaagcagcuguuugaacucuuaugcuaugcagagucaaucgaugaccagcugaacacucuuuugaaagaauuucagcugacagaggaaaauaccaagcuaagauaccucacguguagucugauagaggauauggccgcugcauauuuucccgacugcaucgucaggccuuucgggagcucugugaacacuuucggaaaacuuggcugugaucuggacauguuuuuggaucucgacgagacccggaaucuguccgcccauaagauuucaggcaacuucuuaauggaauuucaaguaaagaauguuccaagcgagcgaaucgcuacacagaaaauucugagugugcucggggaaugccuugaucacuucggaccggguugugucggcgugcagaagauccugaacgcccgcugccccuuggugagauuuucucaucaagcguccggguuccagugugaccuaacuaccaacaauaggauagcacugacaagcucggagcuccuguacauuuauggagcccuugauucucggguccgcgcucugguuuucuccgugagaugcugggccagggcacacucauugaccaguagcaucccuggcgcuuggauuacgaacuucucccucacuaugaugguaaucuuuuuccugcagcgucggucuccacccaucuuaccuacacuggacagccuaaaaacccucgccgacgcggaagauaagugcgugauugaggguaauaacuguacuuuuguccgagaccugucaagaauaaaaccaagucagaauacagagacccuugaauugcugcucaaggaguucuuugaauacuucgggaacuucgccuuugauaaaaauuccaucaacauuaggcaaggacgcgagcagaauaagcccgacagcucuccgcuguacauccagaacccuuucgaaacgucacuuaauauaaguaagaacgugagccagucccaacugcagaaauuuguugauuuggcacgggagucugcuuggauucuccagcaggaggacaccgauagacccucgaucagcuccaauaggccauggggccuggugucauuacugcuaccuagugcccccaaccgcaagucuuucacuaaaaagaaaagcaauaaguuugcuaucgaaacagucaagaaccuccuggagucccuuaaaggcaaccgaaccgaaaauuucacaaagacuucagggaaacggaccauuagcacacaaaccuga

SEQ ID NO: 59314 - RNA, 357 nt, Artificial Sequence
  derived and/or modified sequence opt3 from MTPN__Homo_sapiens__NP_665807
augugcgacaaggaguucaugugggcccugaaaaacggcgaucucgacgaagugaaggauuacgucgcuaaaggggaggacguuaauagaacccuugaaggagguaggaagccccugcacuaugcagccgauuguggccaguuggagaucuuagaauuucugcuacucaaaggggcggacauuaacgcuccugauaagcaucacauaacaccacugcuuagcgccguguacgagggacauguauccugcgugaagcuguugcucucuaaaggcgcagacaagacugucaaagguccggaugggcugacggccuucgaggcuaccgacaaucaagcaaucaaggcccugcuccaguga

SEQ ID NO: 59315 - RNA, 1338 nt, Artificial Sequence
  derived and/or modified sequence opt3 from MTRF1__Homo_sapiens__XP_006719963
augaacagacaccugugcguguggcuuuucaggcaucccagccuuaauggcuaccugcagugucacauccaauugcauucccaccaguuucggcagauucauuuagacacccgccugcaggucuuccgacaaaaccguaauugcauacuacaccuccugucuaagaacuggucaagaagguauugucaccaggauacaaaaaugcuuuggaagcauaaagcccugcagaaguacauggagaauuugaguaaagaauaucagacucucgagcaaugccugcagcacaucccuguuaacgaagagaaucggcgcagccugaacagaaggcaugcugaacucgcaccauuagccgcgauuuaccaggagauccaggagacggaacaagcuauugaggaacuggaguccauguguaagucucuuaauaagcaggacgagaaacaguugcaagaacuggcccuagaggaacggcagaccaucgaucagaagauaaacaugcucuauaaugagcuguuucagucgcuugugccgaaagaaaaguacgacaaaaacgauguaauccuggaggugacagcagggcgcacuaccggaggugacauuugccaacaguucacacgagagaucuuugauauguaucagaauuacucauguuacaagcacuggcaguucgaauugcucaacuauacccccgccgacuacggcgggcugcaccaugcugcagccagaauuagcggagauggcgucuauaagcacuuaaaauacgagggugggauccauagggugcaacggauaccugaaguuggacugaguucccguaugcagcgcauucacacuggcacaaugucugugaucguccucccacagcccgacgagguggauguaaagcucgacccuaaagaucugagaauugacaccuuuagggcuaagggcgccgggggacagcauguuaauaaaacggacagcgcggugcgguugguccacaucccaacuggucuagugguggaaugccaacaggagcgaucccagaucaagaacaaagagauugcauuccgcguccugagagccaggcucuaucagcaaauaaucgaaaaggauaagcggcagcagcaaucagcucgcaaacugcagguuggcaccagagcccagagugagaggauucguacauacaacuuuacucaggaccgggugagcgaucaccgaaucgcauaugaaguaagagacauaaaggaguuccuuugugggggaaaaggccuggaucaauugauucagaggcuccugcagucugcugacgaagaggccaucgcggaguuacuggaugaacaucuaaaguccgccaaauga

SEQ ID NO: 59316 - RNA, 3798 nt, Artificial Sequence
  derived and/or modified sequence opt3 from MTR__Homo_sapiens__NP_000245
augagccccgcccugcaggaccucucccaaccugagggccuuaagaaaacccugagagaugaaaucaacgcuauuuugcagaagaggauaaugguguuagacgggggaauggguacaaugauccagcgggagaaacugaaugaagaacacuuccgcggccaggaauuuaaggaucaugcacgaccacuaaaagggaacaaugacauucucucuaucacucaaccggaugucauuuaccagauccacaaggaguaucugcuugccggagcggacauaaucgagacgaacaccuucucaaguacaagcauugcucaggccgauuacggccuggaacauuuggcauaucguaugaauaugugcuccgccgguguugcuagaaaggcagccgaggaagugacucuccagaccgggaucaaaagguuuguagcuggagcccugggccccacaaacaagacccugucugugucgccuucagucgagcggccagacuaccgcaauauuacuuucgaugagcucguggaagcguaucaagagcaggcaaaaggcuuacuggacgggggaguugauauccuuuugauagaaacaauuuuugacaccgccaacgcuaaggccgcacuguucgcucuacagaaucucuuugaggaaaaauacgcccccagaccuaucuucauuagcgguacgaucguggauaagaguggcaggacucuguccgggcagaccggagagggcuuugucaucucugugagccacggugagccacuuuguauugggcugaacugcgcguugggagccgcagaaaugcggcccuucauagagaucauuggcaaguguacaacugcuuauguacucugcuacccuaaugccggccugccaaacaccuuuggggacuacgacgaaacaccguccaugauggcuaaacauuuaaaggauuucgccauggacggacugguuaauaucguggguggcuguugcgggucaacccccgaucacauacgcgagauugcagaagccgucaaaaacuguaagccucgagugccacccgcuacggcguuugagggacacaugcuccuuaguggccuggagccuuucagaaucgguccauauacuaauuucgugaacaucggggaaaggugcaacgucgcaggcagccggaaauuugccaaguugauuauggcuggaaauuacgaggaagcccuauguguugcaaaagugcaaguagagaugggcgcccaggugcuggacgucaacauggaugacgggaugcucgauggacccucugcuaugacacguuucugcaaucugaucgccuccgaaccggacauugcaaaggugccucuuuguauagauucaagcaacuuugcgguuaucgaggcuggucugaagugcugccagggcaaauguauugugaauaguaucucuuugaaggagggggaagacgauuuccucgagaaagcccgcaagaucaaaaaguauggagcagccauggucgugauggcuuuugacgaagagggccaagccaccgagacugacacaaagauuagaguaugcaccagggcauaccaucuguuaguuaaaaagcuggguuucaaccccaaugauauaaucuuugacccaaacauucuaacgaucgggaccggcauggaggagcacaaucucuaugcuauuaacuucauccaugccacaaaagugauaaaggaaacucugccuggagcgcggaucuccggcgggcuuagcaauuugucguuuucuuuccgaggaauggaggccauucgcgaagcuaugcacggugucuuucuguaccacgcaaucaaauccggcauggauauggggauugugaacgccggaaaucuccccgucuaugacgauauccauaaggagcugcuucagcugugugaggacuugauauggaacaaggauccagaagcuaccgagaaacuccugagauacgcccagacacagggcacuggugggaagaaagugauucaaaccgacgaauggaggaauggccccguugaggaacgguuagaguacgcacuggugaagggaaucgagaaacacauuaucgaagauacagaggaagcgcgccuaaaccagaagaaguauccuagaccacucaacauaaucgagggcccgcugaugaaugggaugaaaauuguaggagaccuuuucggcgccgguaagauguuuuugccccaggucaucaaaucagcuagggugaugaagaaagccguugggcaucugauuccuuucauggaaaaggagcgugaggaaacccgggugcucaacggaacugucgaggaagaggauccauaccagggcacgaucgugcuggcaacaguaaaaggugacgugcacgauauaggcaagaauauuguuggggucguguuaggaugcaacaauuuccgagugaucgaccugggcgucaugacccccugugacaagauccuuaaagcugccuuggaucauaaggcagacauuaucgggcucaguggacugauuacuccuagccuagaugagaugauauuuguugccaaagaaauggagagacuggcuaucaggauuccacuccugaucggcggugcgaccacauccaagacccacacugccgugaaaauugcaccccgcuauucugcuccggugauccacguacuugacgccagcaagucagucgugguuugcagucaauugcuggaugaaaacuuaaaggacgaguacuucgaagagauaauggaggaauaugaggauauccggcaggaccauuacgaaucccucaaagagagaagguaucugccucuuagccaggcccgcaagucuggguuucagauggauuggcugucagaaccacaccccgugaaaccuacauucauuggaacgcaagucuuugaggacuacgauuugcagaagcucguggacuacaucgauuggaaacccuucuuugacguuuggcagcugcgaggcaaguauccaaaucgggguuucccuaagauuuuuaacgacaaaaccgugggcggggaggcucguaagguauacgaugacgcacauaauaugcuaaacacucugaucagucagaaaaagcucagagccaggggagucgugggcuucuggcccgcgcaaagcauacaggaugacauucaccuguaugcugaagccgcagugccacaggccgcugagccgaucgcaacauuuuacgggcuucgccaacaggccgaaaaagauuccgcgucuaccgagccuuauuacuguuugucggacuucaucgcuccccugcacagcggaauuagagauuauuuaggccucuuugccgucgcaugcuucgguguugaggaacuguccaaggccuacgaggacgauggggacgauuacucaaguauaauggugaaggcucuuggagacagacuggccgaagcauucgcugaggaacuacaugagaggguacgacgcgagcucugggccuauuguggcucugaacagcuggacguggcggauuugcggagacugagguacaaagguauccguccagcccccggcuauccuagccagccagaccacacagagaaguuaacuauguggcgccucgcagauauugaacaauccaccgggauccggcugacggagucacuugcuauggcccccgcuagcgcagucucuggacuguacuuuuccaauuugaaaaguaaguauuucgccgugggcaaaauuagcaaggaccagguugaagauuacgcccuccggaaaaacaucucuguggcugaggucgagaaguggcuggggccuauacuaggauaugacaccgauuga

SEQ ID NO: 59317 - RNA, 75 nt, Artificial Sequence
  derived and/or modified sequence opt3 from MTRNR2L7__Homo_sapiens__NP_001177418
auggccaccggcggguucggaugccugcuccuucugaucagagagauugacuugagcgugaagaggcagauauga

SEQ ID NO: 59318 - RNA, 2097 nt, Artificial Sequence
  derived and/or modified sequence opt3 from MTRR__Homo_sapiens__NP_002445
augagaagguuccugcuccuuuacgccacccagcaaggccaggcuaaggcaaucgccgaggaaauuugcgagcaggcggugguccacggguuuagcgcugaccugcauuguauauccgaaucugauaaauaugacuugaagacagagacugcccccuuaguugugguagugucaacgaccggaacaggugauccuccagacacugcacggaaauucgucaaggaaauccagaaccaaacccugccgguggacuuuuucgcccaccuacgcuacggccuccuggggcuuggagauagugaguauacauacuuuugcaauggcgguaaaauuaucgauaagcgacugcaggaguugggggcucgucauuucuaugacaccggacacgcagaugacuguguuggccucgaacugguggucgagcccuggauugccggccuguggccugcucucagaaagcauuuuaggagcucccgggggcaggaagagaucucuggagccuuaccaguggcgucgcccgcaucaagccgcacugaucugguaaaaagugagcuuuugcacauagaaucccagguugagcugcuaagauucgacgauucugguaggaaggacagcgaagugcucaaacaaaacgccgucaauuccaaccagucaaauguggugaucgaggacuuugaaaguagccugacacggucugucccuccacuuucccaggcuucacugaacauucccggcuugccuccagaguaccuccagguucaucugcaagagagcuuagggcaggaagagagucaggugucuguaaccuccgccgauccgguguuccaaguccccaucagcaaggcagugcagcugacgacuaaugacgcuauuaaaaccacacuccuuguugaacuggauaucucgaacacugacuuuucuuaucagccuggagaugccuucuccgugauaugcccaaauucagacagugagguccagagcuugcuacaacgccugcagcucgaagauaagcgagagcacugugugcugcuuaagauuaaagcggacaccaagaaaaagggcgccacacugccccagcacaucccugcagguugcuccuugcaguuuauuuucaccuggugucucgagaucagagcuauccccaaaaaggccuuccugagggcuuuaguagauuacacgucugacagcgccgaaaaacggcgucugcaagagcuaugcucaaagcagggggcagccgauuacagucgcuuuguuagagacgcuugugcgugccuccuggaccuuuugcuggcauucccauccugucagccgccucucagccugcuucuggaacauuugcccaagcuccagccaaggccuuauucuugcgccucaaguagccuguuucaccccggaaaauuacacuucguguuuaacauugucgaguuccuguccacugcuacaaccgaagugcuacggaagggcgucugcacuggcuggcucgcccugcuuguggcaucuguuuugcaaccaaauauacaugccucgcacgaggauagcgggaaagcucuggcccccaagaucuccauuucaccucgaacaaccaacaguuuucaucucccagacgauccgucuauccccauaauuauggugggaccugguacgggcaucgcaccauucaucggguuucugcagcaccgcgagaaauuacaggaacagcaucccgacggaaauuucggcgcgauguggcuguuuuucgguuguagacacaaggauagggacuaccuuuuucggaaggaguugcgccacuuccucaaacaugggauucugacccaccuaaaggucagcuucuccagagaugcuccuguaggcgaagaggaggccccagcaaaauaugugcaagacaacauccagcugcauggacagcaaguugccaggauucuccugcaggaaaauggccacauauacgugugcggggaugcuaagaacauggccaaagacguccacgaugcacuugugcagaucauuucaaaggagguaggaguggaaaaguuggaggcuaugaaaacacuggccacuuuaaaggaagagaaacguuaucuccaggacaucuggagcuga

SEQ ID NO: 59319 - RNA, 2193 nt, Artificial Sequence
  derived and/or modified sequence opt3 from MTSS1__Homo_sapiens__NP_001269903
auggaggccgugaucgaaaaggagugcagcgcucugggcgggcuguuccagaccauuauauccgacaugaaaggaucuuaccccgucugggaagauuuuaucaacaaggcagguaaacuucaaucacagcugagaacaacuguuguggccgcggcugccuucuuggacgcauuucagaagguagccgauauggcuacgaauaccaggggcgggacacgggagauuggaagugcauuaacucgcauguguaugcgacaccguagcaucgaagccaaacugagacaguucuccucugcucuaauugacugccucaucaacccucugcaagagcagauggaggaauggaagaagguggccaaucagcuugauaaagaccaugcgaaggaguauaaaaaggcaaggcaggaaaucaaaaagaagucgucagauacccugaaauugcaaaagaaagccaagaaaggccggggugacauacagccacagcucgauagcgcucugcaggacgucaacgauaaguaccugcucuuagaggagacagaaaaacaagccgugcgcaaggcacugauugaggaaagagggagguuuuguaccuucaucaguaugcuucggccgguuauugaggaagagaucuccauguugggagagauaacucaccuccagacaauuucugaagaccuaaagagccucaccauggauccccauaaacugccuuccucaagugaacaggugauccuugaccugaagggcagcgacuauucuugguccuaccaaacgccacccucaagcccuaguacuaccaugucucgcaaauccagcgucugcucgucucucaauuccgugaacucaagugauagccgauccucuggcagccacucacauaguccauccagccacuauagauacaggucuucaaaucucgcucagcaggcccccguacggcugaguagcguuuccucucacgacucgggguuuauuagccaggaugcguuccaauccaagucaccuaguccaaugccgcccgaagccccuaaccaaaauucuagcuccucagcaagcucugaggcuuccgaaacaugucagagugugagcgaguguucuuccccaacuucagucaguagcggaucgaccaugggugccuggguguccacagagaaagacugggcuaagcccggcccuuaugaucagccauuagugaacacccugcagcgucgcaaggagaaaagagagcccgacccgaaugggggaggcccuacgacugccucuggucccccagcagccgcugaagaggcgcagaggccucggagcaugacagucucagcagccacccgacccggggaagagauggaggcuugcgaagaguuggcccuugcacugagucgcggauugcagcuagauacucagagauccucuagggacagccugcaaugcuccucaggcuacagcacacagaccacgaccccauguugcagugaagauacaauccccucucagguuuccgacuacgauuauuuuagcgugucgggcgaccaggaggccgaccaacaggaguucgauaagucaucuacuaucccucggaacagugacauuucccagagcuaccgcagaauguuucaagcuaaaaggccagccucuaccgcagggcucccgacaacucugggacccgcgaugguaaccccugguguggcuacaauacgucggaccccaagcacuaagcccuccguccgaagaggcacgaucggggccggaccuauuccaaucaaaacacccgugauaccgguuaagaccccuacugugccagaucuucccggcguccugccugcacccccagacgguccugaagagaggggcgaacauucacccgagaguccaagcgugggggaaggaccgcagggcguaaccucuaugccuuccucaauguggagugggcaggccagcguuaaucccccauugcccggaccuaagccauccauucccgaggagcaccgccaggcuaucccugaaucugaggccgaagaucaagagcgggaaccgccaucggcaacagugagccccggucagaucccugagucagacccagcugaucucucccccagagacaccccucagggcgaggauaugcugaacgccauuaggcgcggggucaaauuaaagaaaacuacaacgaaugaccgaagugcgccgcgguucucuuga

SEQ ID NO: 59320 - RNA, 2685 nt, Artificial Sequence
  derived and/or modified sequence opt3 from MTTP__Homo_sapiens__NP_000244
augauccugcucgccgugcuuuuccugugcuuuauuagcuccuacucugcuucagucaagggccacaccacaggguugaguuuaaacaaugacagacuguauaaacuaacuuacagcacggagguucuccuggauaggggaaaggguaaacuucaggacuccgugggcuaucggauaucuucgaacguagauguggcacuguuguggcgcaaucccgacggggaugacgaucaacucauccagauuaccaugaaggacgucaacguggaaaauguuaaccagcagcgaggagagaaaucaaucuucaagggcaagagcccuaguaaaauuauggguaaggaaaaucuggaggcccugcaacguccaacacucuuacaucugauccacgggaaagugaaggaauuuuacuccuaucagaacgaggcggucgcuauagagaauaucaaaagaggacuugccucuuuguuccagacucagcugagcuccggcaccacaaacgaaguggauauuucaggcaauuguaagguaaccuaccaagcacaucaggacaagguuaucaaaauuaaggcccuagauaguugcaaaaucgcuaggagcggguuuacuacaccgaaccaggugcucggagucucuuccaaggcaaccucagugacgacuuauaaaauagaggacagcuucgugauugccguccuggcugaagagacccacaauuuuggucuuaacuuccugcagacaaucaagggcaaaauuguuaguaagcaaaaguuggagcucaaaacuaccgaagccgggccccggcugaugucuggaaagcaggcggcagccaucaucaaagcuguggauuccaaguacacagccauuccuauaguaggccagguguuucaaagccauuguaaagguugcccaucguuaucugagcuguggcgcuccaccagaaaguaccuccagcccgacaaucuuucaaaggcagaagcugucaggaacuuccuggccuuuauccagcacuugcggacggcgaaaaaggaggaaauucuacagauccugaaaauggagaacaaggaggugcucccucaacugguugacgccgugacuucugcacagacaagcgauucccuugaagcuauacuggacuucuuggauuuuaaaucugacagcucaauuauccuccaggagcgcuuccuguaugccuguggguucgcuagucacccaaaugaagaguuacugcgagcccuaaucuccaaguuuaagggaagcauuggcaguucagauaucagagaaaccgucaugauuauaacuggcacacucgugaggaaacugugccagaacgagggguguaaacuuaaagcaguaguugaggccaagaaauugauccugggaggucucgaaaaggcugagaagaaagaagacacccggauguaccugcuugcgcugaagaaugcauugcuccccgagggcauuccuagucuguuaaaauaugccgaagcuggggagggaccaaucagccaucuggccacgaccgcacuacaacguuacgaucucccguucaucacagacgaggugaagaaaacucugaaccgcauuuaucaccagaauagaaagguccaugaaaagaccgugaggacagccgcugccgcaauaauccuuaacaauaaccccuccuacauggaugucaagaauauuuugcugucuaucggcgagcucccucaggaaaugaacaaguauaugcuggcgauugugcaggacaucuuacgguuugagaugccagcuucgaaaauaguucgacgcgugcugaaggagaugguagcccacaauuacgauagauucagcagguccgguucaaguucugcauacacuggguauaucgaacggagcccccgcuccgccucaaccuacagccuugacauuuuguauucuggcuccggaauccucagaaggaguaaccugaauauuuuucaauacaucggcaaagcugggcuacacggaagccaggucgugauagaggcccagggucuggaagcacucauugcugccacaccugacgagggcgaagagaaccuggauucuuaugcggggauguccgccauccuuuucgacguucaguugcguccagugaccuuuuucaauggauacucagaucugaugaguaagauguuaagcgcuucgggcgaccccauuuccgucgugaaaggucucauccugcuuauagaucauucucaagagcugcaguugcagagcgggcucaaggcaaacaucgaaguacaaggcggacuggccauugacaucucaggcgcuauggaguuuagucuaugguaucgggaauccaagacucgagugaaaaacagaguuacggucgugauuacaaccgauaucacuguggacucuagcuucgucaaggccgggcuggagaccuccacagaaaccgaggcaggacucgaguuuauaucaacuguucaguucagccaguacccguuucuggugugcaugcagauggauaaagacgaagcgccuuucaggcaauucgagaagaaauacgaacgccuuaguacaggucggggcuaugugucucagaagagaaaggaguccguauuggccgggugugaauuuccccugcaccaggagaauagcgagaugugcaaagucguguucgcuccacagccugauucgacgucaucuggaugguuuuga

SEQ ID NO: 59321 - RNA, 396 nt, Artificial Sequence
  derived and/or modified sequence opt3 from MTURN__Homo_sapiens__NP_690006
auggacuuccagcaacuggccgauguggcugagaaguggugcagcaacacccccuuugaacucaucgcaacagaggaaacugagagaaggauggacuucuacgccgauccuggcgucuccuuuuauguucuuuguccagacaaugggugcggagauaacuuccacguguggucugaaucagaggacugucugccguuuuugcaguuagcgcaggauuacauuaguagcugcgguaaaaagacgcugcaugagguacuagaaaaaguguucaaguccuuucggccccuccugggccuuccugacgcugaugacgaugccuucgaggaauauucugcagacgucgaggaggaggaaccagaagccgaucacccccagaugggggugucgcaacaguga

SEQ ID NO: 59322 - RNA, 1554 nt, Artificial Sequence
  derived and/or modified sequence opt3 from MTUS1__Homo_sapiens__NP_001001931
augaccgugcccggcggguucagaagcugcacagagacugacaucuccucuaagauuuuuauaaacucaacgcugaccccuccagccggaagugaaaggcacuacgaugcuacacuccuuacucuguuggucguugguagcuauuccuuauguaucauuccgcugcuagcaaccuucacaggcaaaaagaccgggaaugccgcggugaucaaauacgaggaaaagcccccuaaaccagcuuuucagaacggaucuucgggcucauucuaucucaagccccugguaagccgggcccaugugcaccuuaugaagacuccuccaaaaggucccagucgcaagaaucuguuuacagcauugaacgccgucgagaaaucccgacaaaagaauccucguucucucugcauucagccacagaccgcuccggacgcacugcccccugaaaagacgcuggagcucacucaguacaagaccaagugugagaaccaaagcggguucaucuuacagcugaaacagcuuuuggccugcggaaauacaaaguuugaagcucugacugugguuauacagcaucuacucuccgagagagaagaggcccugaaacaacacaagacccuuucacaggagcuggugaacuugaggggcgaacucgucacagcgaguaccacgugugagaaacuggaaaaggcacggaaugaguuacagacuguguaugaagccuucguacagcaacaucaggcugagaaaacagagcgcgaaaacagacugaaggaguuuuacaccagggaauaugagaagcuccgggauacuuacaucgaagaggccgagaaauacaagaugcagcuucaagaacaguucgacaaucugaacgcagcucacgagacaagcaaauuggaaauugaggccucucacuccgaaaagcuagagcugcucaaaaaggcguaugaggccucacugagcgaaaucaagaaaggccaugagauugaaaagaaaagucuugaggaucuguugucugagaagcaggaaucccucgagaaacagaucaaugaccugaaaagcgaaaacgaugcauuaaaugagaagcugaaaucggaagaacaaaagcgccgagcuagagagaaagccaaccuaaagaacccacagauaauguaccucgaacaggagcuggaaucucuuaaagcuguuuuggagauuaagaaugaaaagcugcaccagcaagacaucaaacucaugaagauggagaaacugguggauaacaauaccgcccuugucgacaagcugaaaagguuucagcaggagaacgaagaguugaaggcacggauggauaaacauauggccauuucccgucagcucucaacggaacaagcugugcugcaggagaguuuagaaaaggagagcaaggugaauaaacgccuguccauggagaacgaggagcuacucuggaagcugcacaauggggaccuuugcucucccaaaagaagcccuaccucaagugcgaucccauugcagucccccaggaacagcggaucuuucccgucaccuaguaucagcccccgguga

SEQ ID NO: 59323 - RNA, 4140 nt, Artificial Sequence
  derived and/or modified sequence opt3 from MTUS2__Homo_sapiens__NP_001028774
auggccagcucccccaccaagggccugacaaugucugugccugucgcucccaaaaagucaugcuacacucagcucagagacaacaggaaugcagcccggaacaauaacgagaguauccuuagccugggggauacgaaugcgaaccaaauuauguuggaaguuuccucuucgcacgacgagucaaaaaccugugauuuaggagacgaaauagguaauacaaacagcagugagccggaaaaucgcacucauuuccacaaggaguuucaucagcugcagggcuucgggaaaggaucccaggcuggcucugccagccuaaaggauuuucgacucuccucaaccauccaacgugagcugaacgaggaacauacaguggaaagagguaccgacagucuucagacuacaaggagcauucaggggcccucucuguccucauggcggaauguaaugagcgaggcaaguuuggaugugcucgccaagcgcgacgcugagaucccuagacaugucccaaaagauaagcuggcaaaaacccuggacaacgaggagcucaggcggcacucuuuagaacgcgccuccagcucgguggcugccguuggaucucugacgccccagcacccucaaccacuuuccuuggauucacgagaggcgagaggccagauucccggcgggggagaagguccucagaagacucugccagaccaugcagugccggccgcuuuccccgccaccgauaguacaagcgagggcaaauccgucaggcacccuaagccaucuacuagcgagucaaagcagaguacccccuccgaaacacaaaccgugggggcacauguacuacagguuugcagcgagcacacgucucacucagcucauccugaaccagcccucaaucugacucuugcgaguaaagagauccccagcaagcuggaagcccaguugggacaaggcaaaggugaggcaaagcucgaccugaaauaugugccgccucggcgugucgagcaggaagggaaggcugcccaggagggauacuuaggcugucacaaagaagagaaccuguccgcucucgaaggccgcgaccccugcggggaggcccauccagaggcaacagaugcccuuggacaucugcucaauucugaccuacaccaccugggugugggcagagggaacugugaagagaagaggggagugaacccuggcgaacaggauucgcuccacaccacucccaagcaagguagcgcuucccuugggggcgcggacaaucagccaacaggaaaaauaucacccugcgcaggcgagaaacugggggagcggaccaguucuagcuuuuccccuggagauucacaugucgccuucaucccaaacaaucugacggacagcaaaccguuggauguuauugaagaagaacgacgcuuggguucuggcaacaaggacuccgugaugguacugguguuuaaucccagugucggggagaacaagaccgaagugccugagccauuagauccccagagcggaagaucugaggcuagggaauccaaggagguuacaacuucaguggccgaaaaucggaaccugcuagagaaugcagacaagaucgaaaguaccagcgcccgcgcugauucgguccucaacauuccugccccacugcaccccgagacaacugugaauaugaccuaucagccgacaaccccuuccucuagcuuccaagacguaucaguuuuuggcauggacgcagguaguccacuuguggucccaccucccacugauuccgcgagauugcugaacacgucuccaaaagugccugacaagaauacaugucccagcgggaucccaaaaccggucuucacccacuccaaggauacuccuucaagccaggagggcauggaaaacuaccagguggagaaaaccgaagagaggacagaaaccaagcccauaauuaugccaaagcccaaacacguucguccuaagaucauuacuuauauccggcgaaauccacaggcucucggacaaguggacgccagucugguacccgucggccuuccuuacgcaccgccaacaugcacgaugccccugccucacgaggagaaagccgcugggggagauuugaagccaucugccaaccucuaugaaaaauuuaagcccgaccugcagaagccuagaguguucuccagcgguuuaaugguuucgggcaucaaaccgcccgggcauccauuuucacagaugucugagaaguuccugcaggaagugaccgaucacccuggaaaagaggaguucuguagucccccauacgcacauuacgaagucccucccacuuuuuauagguccgcuaugcuacucaagccacaacugggccuuggugccaugagccgcuugccgucugcgaaaagccggauucugauagccucccagagaucaagugcuagcgcaauccacccucccgggccaauuacaaccgccacaucucucuacuccucagaccccagugcugaucugaagaaagccagcuccucuaacgcagcgaagucgaauuuaccuaagagcggccugaggccacccggauauucacgccuuccugccgcuaaauuggccgcauucggcuuugugcgauccaguucuguaagcuccgugucaucuacucagagcggggacagugcucaaccggagcagggacggccagccacccguuccacguucggcaacgaggaacagcccguucucaaggcaagccugccuucuaaagauacccccaagggugccgggagagucgcuccuccagcgucauccagugugacagcccccaggcgcagccuacugccagcaccuaaaucgacuucuaccccggcuggaacaaagaaggacgcccagaaagaucaagacacuaauaagcccgccguguccagcccaaaacgggucgcugcaucaaccacgaagcuccauaguccuggcuaccccaaacagagaacagccgcggcuaggaacgguuuuccaccuaagcccgacccgcaggcccgagaagcagagcgccagcugguucuucgguugaaggagagaugcgaacaacagaccaggcagcugggcguggcccagggggaguuaaaacgugcuaucuguggauucgaugcacucgccguggcgacucaacacuuuuuccgcaagaaugaaucugcucugguaaaagagaaggaacuuuccauagagcuggccaacauucgggacgaggucgcauuucacacagccaaaugcgaaaaguugcagaaggagaaagaggaacucgaaagaagguucgaggaugaggugaagcgacugggcuggcagcaacaggcugaacuacaggagcuggaggaacggcuccagcugcaauuugaggccgaaauggcacgccuucaggaggaacauggggaccaguugcugagcaucagaugccagcaccaagagcagguugaagauuuaaccgcuucacaugacgccgcgcuccuggagauggagaauaaccacacuguggccaucaccauucuucaggaugaccaugaucacaaaguccaggaacugaugaguacacacgagcuagaaaagaaagagcucgaagagaauuucgagaagcugagguugagccugcaagaccagguggauacguuaaccuuucagucccagucucuccgggaccgagcaagacgcuucgaagaggcucugaggaaaaacacugaggaacaacuugaaaucgcccuggcuccauaucagcauuuggaggaggauaugaaaagccucaagcagguucuggaaaugaagaaucaacagauucacgagcaggaaaagaaaauacuagagcuggagaaacuugcagaaaagaacaucauucucgaggaaaagauccaggugcugcaacagcagaaugaggacuugaaggcccguaucgaccagaacacaguagucacccggcaacuguccgaagagaaugccaacuuacaggaguacguggaaaaagagacacaggaaaagaaaagacucucaaggacuaacgaggaacugcuuuggaagcugcagaccggagauccuacgucucccauuaaauugaguccaacaucgcccguguaucgcggcagcuccucugguccuucaagcccggcucgagucuccaccacucccagauga

SEQ ID NO: 59324 - RNA, 1401 nt, Artificial Sequence
  derived and/or modified sequence opt3 from MTX1__Homo_sapiens__NP_002446
augcugcucggcgggcccccuagaagcccaagguccggaaccucuccgaagggucccuggucaaguacaggccacgugcaguucgggaaaagcccucaaacuuggccacggcgcacgcgaccccguuccccugagccagccgcucccucuggagucagaggcucgaccuggacaaggcggcgcgacucaccuagaagggcagguccaacugcccuuagccgguacguugggcaucuguggaugggacgccgaccgcccaguccugaagcgagaggcccagugcccagguccucugcugccagccgggcacgucgcuccuuggccucaccuggcaucaguccagggcccuuaaccgcuacaauuggaggugcaguagccggcgggggaccgagacagggcagggcugaggcccacaaggaaguguuuccuggucagcgggucgggaaaauggcggcacccauggagcuguucugcuggagcggaggcuggggccuaccaucuguggaucucgacucccuggccguucuuaccuaugcucgauuuacuggggccccucugaaggugcauaaaauaucaaaccccuggcagagcccaaguggaacauugcccgcacuccgcaccucucacggugaagucaucuccgugccucauaagauuaucacgcaccugagaaaggagaaauacaaugcugauuaugaccugagcgccaggcaaggcgcggauacucucgccuucaugucguuacuggaggaaaaacuuuugccaguacugguucacaccuuuuggauugacacaaagaacuacguggaggucacucggaagugguaugcagaagcuaugccguucccccuaaacuuuuuccucccugggcgcaugcagagacaguacauggagaggcugcagcuucugaccggagagcaucguccagaagaugaggaagaguuggaaaaagagcucuaucgggaggcccgagaaugucugacauuacugucucaaagacucggcucccagaaguuuuucuuuggugacgcucccgccucacuugaugcauucguguuuaguuaccuggccuugcuacugcaggcuaagcucccuagcgggaaacuucaggugcaccugaggggccugcauaauuugugcgcguacuguacccacauccucucccuguauuucccaugggacggagcagaggucccuccgcaacgccagacgccugccggcccagaaacugaggaggaacccuaccggagaaggaaucagauauuaucuguucuggcugggcuagccgcaauggugggauaugcccuccugagcgguaucguaucaauucaacgcgcuacacccgcccgagcacccggcacccggacucuugggauggcggaggaagaugaggaagaguga

SEQ ID NO: 59325 - RNA, 792 nt, Artificial Sequence
  derived and/or modified sequence opt3 from MTX2__Homo_sapiens__NP_006545
augagccugguggccgaggcuuucgucucccagaucgcagccgcggaacccuggccugagaacgcuacccucuaccaacagcuuaagggcgaacagauucuguugucugacaaugccgcaucauuagccguucaggcuuuucugcaaaugugcaaccuaccaauaaaagugguauguagagcaaaugccgaguauaugaguccgagcgggaaggugcccuucauccacgucggaaaccaggugguuuccgaacucgguccuauugugcaguuugucaaagcuaagggccauucucugucggaugggcuugaggaggugcagaaagccgaaaugaaggcguacauggagcugguaaauaacauguugcucacagcagaacuguaucugcaauggugcgacgaggccacuguuggagagaucacgcacgcuagguacggcucaccauaucccuggccucucaaucauauuuuagccuaccagaagcagugggaagugaaacggaagaugaaagcaaucgguugggggaagaaaacccuggaucagguccuugaggacguggaucaauguugccaggcuuugagccagcgccugggaacacaaccauauuucuuuaacaagcagcccacugaacuagacgcccucguguucggccaccuguacaccauacuuacaacccagcugacuaaugaugaguugagugaaaaggucaaaaacuacuccaaucuccuggcguuuugucgacguaucgagcagcauuauuucgaggacagaggcaaggggagguuaucuuga

SEQ ID NO: 59326 - RNA, 16008 nt, Artificial Sequence
  derived and/or modified sequence opt3 from MUC12__Homo_sapiens__NP_001157934
augcuggugaucuggauucucacccuugcccugagauugugcgcuagcgucacuacuguuacgcccggcuccaccgugaacacuucuauagggggaaauacuaccucagccaguacaccuagcuccucugacccauucaccacuuuuucggauuacgguguaucagugacauucaucaccggcagcacggccacuaagcacuuuuuagacaguuccaccaacucugggcauagcgaggaauccacagucucacacaguggaccgggcgcgacugguaccacacuguuccccagccauucugcuaccuccguguuuguuggggagccuaaaacgucaccaauuacuagcgccaguauggaaacaaccgcacuacccggaucuacuacaaccgccggccucuccgaaaaaucaacgaccuucuauucgucuccuagguccccagaucggacacugucacccgcucgcacuaccaguagcggcguguccgaaaaaucuacaacuagccacucacgaccugggccaacccauacaaucgcauuuccggacaguaccacuaugcccggagucucccaggagagcacggccucucacucaauuccugguaguacagauaccacucuuagcccaggcaccacaacccccuccucucuggggccugagucgacuacauuccacagcuccccaggauacacgaagaccacucguuugcccgacaauacaaccacaucaggccuccuggaagcuaguacuccggugcauucuagcaccgguuccccucacacgacccugucacccaguucuuccacaacucaugagggggaaccaaccacauuucaaaguuggccuagcucuaaagauacuucccccgccccaucaggaaccacgagugcguucguaaagcucagcacaaccuaucacucgucccccucuagcacuccuacaacccacuuuucagcaaguuccacuaccuuaggccauucugaggagagcacaccaguucacuccucaccgguggccacggcuaccacucccccuccagccagaagcgcaacaaguggccaugucgaagagucuaccgcuuaccacaggucccccgggagcacacagacuaugcauuucccugaaucgucaaccacgucuggacacagugaggaauccgccacauuucacgguagcaccacucauaccaagucuagcacaccauccacuaccgcggcccuggcacacacaucauaucauaguagccuuggcucuacggagaccacucacuuccgggacuccucaacaaucagugggcgcagcgaggaauccaaggcuucucacucgagccccgaugccauggcuaccacuguguugccggccggaucaacaccuuccgugcuggucggcgacaguaccccaucucccauaagcuccgguucaauggagacgacugcacuaccugggucuaccacaaagcccggccucagcgaaaagagcaccacuuucuacuccagcccaagaucuccugauacaacccaucugcccgccucaaugacauccaguggaguuagcgaggagucgacuaccucucacuccaggccaggcagcacgcauacaaccgcuuuuccggggucaacuaccaugccuggacuuagucaggagucuacagcgucccacagcucacccgguccaacugacaccacgcugagucccggcagcacaaccgcauccucuuuggggccugaguauacuacauuccauagccggccaggauccaccgaaacuacacuccugcccgauaacaccacggccucaggcuuacuggaggcuucuaugccugugcacaguucgacucgcagcccgcacaccacacucuccccagccgguucuaccacacgacagggggaaucaacuaccuuucauagcuggcccuccaguaaggacacgagaccugcaccacccacaacuaccucugccuucguagagccuagcacaaccucacacggcuccccgaguagcauccccacuacccauauuucugcuagguccacaacgucaggacuuguggaagagagcacuaccuaccacucgucuccaggcaguacacaaaccaugcauuuuccugaguccgacacuacaagcgggcggggagaagagucaaccacgucccacucuagcacuacacacaccaucaguuccgcccccagcaccacuucugcacuggucgaggaacccacaucauaccauaguuccccugguagcaccgcgacaacucacuuccccgauucuucgacgaccucaggccguagcgaggaauccacagcuagucauucuagccaggacgccacugggaccauuguguugccagcacgcuccacaaccucaguucuacugggagagaguacuacgucuccgaucagcuccggcucaauggaaaccacagcccucccugguagcacuaccacacccgggcugucugagagauccaccacuuuucacaguagcccaaggucgcccgcuacaacgcuuuccccugccucuaccacuucaagcggcgugagugaagaguccacaaccucucggagccgaccaggaucaacccacacaacugcauuccccgauuccacgaccacaccuggccugagucgccauagcacuaccucucacucauccccggggagcacagacaccacuuugcucccagcuucuacgacaaccaguggacccucgcaggaguccacuaccagccauucaucuagcggcuccacagauacugcccugaguccugguucaaccacagcguuaucuuuugggcaggaaagcacgaccuuccacuccaaucccggaaguacucauacaacccuguuuccagacagcacuacauccucuggcauagucgaggccucaaccagagugcacagcucgacggguuccccuaggaccacacuaagucccgcuucuagcacuucaccaggccuccaaggggaauccaccgcauuccagacacacccugccucuacucauaccacaccgagucccccaagcaccgcuacugccccuguagaggaauccacgacauaucaccggucacccggaagcaccccaacuacccauuuuccugcaucuaguacaacguccggccacagcgagaaaucaaccauuuuccacucuucccccgaugcgucggggacuacaccgagcagugcccauucuaccacuuccggacgcggcgagagcacaaccucaagaaucaguccagguuccacagaaauuacuacccugccugggagcacgaccacacccggacuuucugaggcuucaacuaccuucuacagcuccccaaggucucccacaacuaccuugaguccugccucgaugacgagccugggcguuggugaagaguccacaaccucacguucucagccgggcagcacucacaguacagugucccccgcaucaaccacuaccccagggcucucugaagagagcacaacggucuauuccaguagccggggaucuaccgagacuacaguguuuccucauucaaccacuacauccguccacggcgaagaacccaccacguuccauagccgaccugcuaguacacacaccacucuguuuaccgaagacucuacaacuuccgggcuuaccgaggagucgacagccuucccaggaagccccgcaucaacgcagacuggccugccugccaccuugacaaccgcugaucucggugaagaguccacuacauuuccaucuaguagcgggucaaccggaacgaagcugucccccgcgagaagcacuaccucuggcuuagugggugaaaguacaccguccaggcugagcccuucaucuaccgagacuacaacccuaccaggcucgcccacaacuccuagccucuccgaaaagaguaccacguucuacacaucuccacgcucacccgacgccacccugagcccggcaacuaccacauccagugggguuucugaggagagcuccacuucacacagccaaccuggaucuacgcauaccacagcuuuucccgauuccaccacuacaagugaccuuucacaggaaccaaccacuagccacucgucccagggcucuacagaggccaccuugaguccugggagcacgacugccucaucccugggacaacagucuaccacauuccauagcagucccggcgacaccgaaacuacacuccugccagaugacaccaucacguccgguuuaguggaggcuagcacacccacucacucuucaaccgggucccugcacacaacccuuacuccugcaagcaguacgucugccggauugcaggaagagucaaccacauuucaguccuggccaagcucgucugauacuaccccgagucccccuggcacaaccgcggcuccaguagaggucuccacuacauaucauagccggcccucaucuaccccuacgacucacuucagcgccuccaguacaacccucggcagaucagaagagagcacuaccgugcauuccucuccaggggcaacaggaaccgcccuguuucccacgaggagugcuacaagcguucuagugggugaaccuacuaccuccccgaucucaucuggcucgacagagacuaccgcacugccagggagcacaaccacugccggacucuccgagaaaagcacgaccuucuacucuagcccccgcucaccugacacaacucugucccccgcgagcaccacaucuaguggcgucuccgaggagucaaccacuagccacucucgaccagguucgacacauacgaccgcuuuuccuggguccacuacaaugcccggagugagucaagaaagcaccgccucacacucuuccccaggcagcaccgauacuacacuuaguccgggcucaacgaccgcauccagcuuggggccugagucuacaacuuuccacaguagccccggauccaccgaaacaacucuguuaccagacaacaccacggccucuggucuccuggaggcuucaacacccguacauagcuccaccggcucgccucacacuacccuuucuccagccgggaguacaacucggcagggagagagcaccacauuccagucauggcccuccucuaaggauacgaugccugcaccgccaaccacuacaagcgcuuuuguggaacuguccaccacaagccauggcucacccagcucuacaccuaccacgcacuucuccgccaguagcaccacauugggucguucagaggaaucuacuaccguucauuccucgccagucgcgacagccacuacccccagcccugcaagaaguacaacguccgggcucguggaggaaucuaccgcuuaucacucaagccccggauccacucagacaaugcacuuuccagagucuagcaccgccaguggcaggucagaggaaucccgcacuagccauucuaguaccacacacacgauuuccagcccgccuucaaccacuucggcucugguggaggaacccacaucuuaccauagcuccccaggcaguaccgcaacuacacacuucccugacucaucuaccacuagcgggcgguccgaggaaaguacagccagccacucuucccaagaugccaccggaacgauaguccuacccgcuagaucaaccacaagcguucugcucggugagucgacuaccuccccaaucucuaguggcucaauggagacaacugcgcugccugggagcaccacgacacccggacuuuccgaaaaaucuaccacuuuucauagcaguccgaggucaccagcaacaaccuuguccccugccagcacuaccucuuccggcgugagugaggaaagcacaacgucacacucucgacccgguuccacccauacuacagcuuucccagacagcaccacuacacccgggcugucgcgccacaguaccacgucucauucauccccuggaagcacagauaccacuuuacucccggccucuaccacaacuagcggcccaucccaggagaguaccacaucacacagcucccccggcucuacggacacugcacugaguccugggucaaccacagcccuuagcuuuggacaggaauccaccacuuuccacucuucgcccgguagcacacauaccacgcuguuuccagauuccacuaccaguucaggcauuguggaggcuucuacacggguacacagcuccaccgggaguccuagaacuacacuaucucccgcgagcucaaccuccccaggacuccagggcgagagcacggccuuccaaacacauccugcaucuacucacaccacaccgucacccccaaguaccgcuacugccccugucgaagaguccaccacauaccacaggagccccgguucgacuccaacgacccauuuuccugcaucuuccacaacuagcgggcacucagaaaagaguaccaucuuccauucuucccccgacgccagcggaacaaccccgucaagugcucacuccacuacgagcggccguggcgagucuacaaccucgcgcauaagcccaggguccacugagauuaccacacugccuggaucaaccacuacacccgguuugucugaagccaguaccacguucuauagcuccccacggucucccacaacuacccugagcccugcgagcaugacaaguuuaggcgugggggaggaauccaccacuucuagaagccagcccggauccacgcauucaaccguuaguccagcaagcacaacuaccccuggccucucugaggaauccacaaccguguacucgagcucaccggguaguacugagacaaccgucuuucccaggacgccaacuacauccgugcgaggggaggaaccuaccacuuuccacucucggcccgccagcacccacacaacccuguuuacggaggacucaacaacuuccggccuuaccgaagagucuacagcuuucccaggaagcccugccaguacucagaccggccugcccgcuacauugaccacugcagaucucggggaagaguccacgaccuuuccgaguucuucaggaaguacagguacuacccuguccccugcccgcagcacaaccucuggccuaguuggggagucgacuccaucaagacugagccccuccaguacggaaacaaccacucuuccuggaucuccaacaacccccagccucuccgagaaaucaacuaccuucuauacaaguccuaggagcccagacgcuacgcugucucccgccaccacaacuuccagcggcgugucagaagagucuuccaccagucauagccagccggguucgacacacacuaccgcauuuccugauuccacgacaacccccggguugucucggcauucaacuaccagccacaguuccccaggcucuacagacacuacccuguuacccgcgagcacaacgaccucaggaccuagucaagaauccacuacaagccauucuuccccaggcucaaccgauacugcccucagccccgggaguacaaccgcucugucuuucggacaggagucgacgaccuuucacuccagcccugguucaacacacacuacccuuuucccagacucuacaacaaguagcggcaucguagaggccuccacccgaguccauucaagcacaggguccccgagaacgacccugucucccgcaaguagcacuuccccuggauugcagggcgaaucuacaaccuuucaaacucacccagcuucaacccauacaacgcccucgccuccaagcacugccaccgcacccguggaggaaaguacaaccuaccaccgcuccccggguucuacuccuacaacccacuucccagccagcucaacgacuuccgggcauagugagaagucuacaaucuuucacagcucccccgaugcuucaggcaccaccccuagcucugcgcauaguacaacuuccggaaggggcgagagcaccacaucgcguauuucucccgggucaacugaaaucaccacgcucccaggauccacaaccacuccgggccugagcgaggccaguacaaccuucuauucuuccccucggagccccacuaccacacuaucaccagcaaguaugacgucccugggugugggggaagagagcaccacuucuagaucacagcccggaagcacacacuccaccgucaguccugcuucuacuacaaccccaggccuuucggaagagagcacgacaguuuacuccucaucucccgguaguacugagaccaccguguucccuaggagcacaacuaccuccguacgcggcgaggaaccaacgacauuucauucacgaccggccucuacucacaccacacucuucaccgaagacagcacuacauccgggcugaccgaggaaaguacggccuuucccggaagcccugcaucuacucagaccggcuugccagcuacauuaaccacugccgaucugggggaggaguccacaaccuuccccucaagcaguggaucgacgggcacuacacucucuccugcgagauccaccacaagcggucuggugggggaaucaaccccaagucggcuuucccccucuagcacugagaccacaacucugccuggaucaccgacgacccccuccuugagcgaaaaaucuacaacuuuuuauaccaguccaagguccccugacgcuacacuaagccccgccaccacuacgucaucuggcgucucggaggaaaguagcacaucccacucucagccagguucaacccauacuaccgcauucccugauagcacaaccacuuccggccugagucaagagcccacagccucucacagcucccaggggucaacggaggcuacccucagcccaggaaguacaacugcaucuucccugggccagcagucgaccacauuucauagcucaccgggggacaccgaaacuacgcuuuuaccugaugacaccauuacauccggacugguggaggccucuacucccacccacaguagcacaggcucccuccacacuaccuugacaccagcgucaucuaccagcgcuggucugcaagaagagaguacgacuuuccaguccuggcccaguucuucagacacaaccccuuccccacccgggacuaccgccgcaccuguugaggugaguacaacguaccauagccgcccgucuucgacccccacuacacacuuuuccgccucaagcaccacacucggacguagugaagagucuacuaccguccauuccagcccaggcgcuacaggcaccgcccuguucccuacuagaucagcaacgucugugcuuguuggggaacccaccacaagcccaauauccaguggaucaacugagaccacagcucugccugguagcacgaccacugccggcuuguccgaaaagucuacaaccuuuuacaguagcccccgguccccagauacuacacuaucgccggcgucuaccacuucaagcgggguguccgaggagaguaccacaucucacagcaggccuggaucaacgcauaccacagccuuccccggcuccacuaccaugccaggugucagccaggaaaguacagcaucucacuccucaccugggagcacugacaccacgcugucucccggaucgacaaccgcuuccagucucggcccagagagcacuaccuuucacucaggcccugggucuacagaaacuaccuuacugcccgauaauacaacggccuccggacuucuggaggcaagcaccccgguacauaguuccacugguagcccacacacaacccucucucccgcuggcucaacuacacgccagggggaaaguaccacguuccaauccuggccuaacagcaaggacaccacuccagcacccccuacaaccacaucugccuucguggaguugucaacuaccucgcauggaagcccguccaguacgcccacaacccacuuuucugcgagcuccacuacacugggccgaucagaggaaucuaccacuguucacagcaguccaguggcuaccgcaacaacgccuucccccgccagaucaacuaccagcggucucgucgaggaaucuacaaccuaucauuccaguccagggagcacucagacaaugcacuucccugagucggauaccacgucaggacggggcgaagagucuacuacaucccauagcaguaccacccacacaaucuccucugcucccagcacuaccucagcccugguggaggaaccaacauccuaccauaguagcccuggcucuacugcaaccacgcacuuucccgacucauccacaaccagcgggaggucugaggaaaguacugccucgcacuccagccaggaugcuacaggaaccauuguacuuccggcgcgcucaacuacgucugugcuacugggugagagcaccacauccccuaucaguucaggcucuauggagacuaccgccuugccagggagcacaaccacucccggauuauccgagaaaaguacaaccuuccauagcucuccuagauccccagcaacgacucugucacccgcuagcacaaccucguccggcgucucugaggaaaguaccacaagccacucaaggccggguuccacucauaccacggccuuuccugacucuacaacuacccccgggcucagccggcacaguacaaccucccauucaagcccaggaucuacugauacaacccugcuucccgcaaguacgacuaccuccggcagcucacaagagucuacaaccucccacagcucgaguggcucuacugacacagcccugucaccuggguccaccacggcucucagcuucggacaggaaaguacuacauuucacucuagcccagguuccacccauacaacuuuguuccccgauucaaccaccagcuccggcaucguugaggccucuacacgugugcacaguucaacugggagcccucgcacgacccuguccccagcgucuucgacaagcccgggacuacagggcgagaguacugcauuucagacccaucccgccuccacacacaccacuccuucaccacccucuacggcuacagccccuguggaagagagcaccacuuaucaccgauccccagguaguacccccacaacccauuucccggcaagcucuacuacaucagggcacuccgaaaagagcacgauuuuucauucuaguccugacgcuuccggaaccacuccaucaagcgcccacucgacaaccucuggcagaggcgaguccacaaccagcaggauaagucccgggucaacugaaaucacgacccugccuggauccacaacuacccccggucucucugaggcuagcacaacuuucuacaguucaccacgguccccuaccacaacgcuuagccccgccucuaugaccucgcugggcgucggggaggaaagcacuacaucccgcagucaaccaggaucuacccauucaacugugagcccggcauccaccacaacgcccggcuuaucugaggaaaguaccacuguuuauagcucauccccugguagcacagagaccacaguauuuccaagaucuacuaccacguccgugaggcgggaggaacccacaaccuuccacagucgaccugcgucaacucacaccacauuguucacugaggacagcaccacaucugggcugacggaagaguccaccgccuuuccaggaucgcccgcuagcacucagacaggccucccugccacccugacuacagcagaucuuggcgaagagaguaccacguucccgucauccucugggagcacuggaaccaaacugaguccagcuagauccacaaccucaggucucgucggcgagagcacucccucucgcuuguccccuagcucuacagaaaccacaacucugccagggagucccaccacgccuucauuauccgaaaagagcacaaccuuuuacacuucgcccaggucuccagacgccacccuaaguccggcaacaacuaccagcuccggagugucagaagagucuagcacaucccauagucagccuggcucaacgcacaccacugccuuccccgauagcacaaccacuucuggucugucccaggaaccaacaaccagccauaguucacaaggguccacggaggcgacccucucuccuggcucgacuacagcuagcucccuuggacagcagucuaccacauuucacaguagccccggcgacacugagaccacgcuguugccagaugacacaauuacuucagggcugguugaagccuccaccccgacacacucuagcaccggaagucuccauacuacccugacuccugcaucauccacgagcacuggucuucaggaggaaucuaccacauuccaauccuggcccucgagcagugauaccacuccaucacccccuucuacaaccgccgugccagucgagguguccacgacuuaucacagccggcccaguucaacaccuaccacccauuuuucugcuuccagcacaacucucggccguagcgaagaguccaccacaguacacucuucaccgggggccacuggaacggcacuguucccaaccagaagugcuacaagcgucuuggugggcgagcccaccacuuccccuaucucuucggguucaacagaaaccacugcccugcccgggagcacgaccacagcgggcuuaagugagaaauccacuaccuuuuacucuagcccaagguccccugacacaacccuaucacccgcuaguacuacaagcucuggaguuuccgaagagucaaccacgagccauagucgcccaggcucuaugcacacuacagccuucccuuccagcaccaccaugccgggggugucgcaggaaucuacagcaucccacucaagucccggaagcacugauacgacccuguccccagguucuacaacugccagcucacucggcccugagaguaccacauuucauuccagccccgggucuaccgagacuacacuucugccagacaauaccacggcuucaggauugcuggaagcaaguacuccuguccacagcuccaccggcucuccccauacaacucucucgccggccgguagcaccacacggcagggcgaguccaccacguuccagucauggccaaacaguaaggauacuacacccgcgccuccaaccacuacaucugccuuuguggaacugagcaccacgucccacgggucacccagcucuaccccuacaacucauuucuccgcuaguagcaccacacuuggacgaucugaggaguccacuaccguucacucaagucccguggcaacagccaccacuccaagcccugcuagaucgacgacauccggcuuagucgaagagucuaccacuuaccacagcucaccggggaguacccaaacaaugcauuuccccgaauccaauaccacuucuggaaggggcgaggaaagcacaacgucccacucaagcaccacucauacaauuaguucugccccauccaccacaagcgcacugguggaggagccuacuucguaucacucaucucccgguaguaccgcuacgacccacuuuccagacuccagcacaacuucugggcgcagcgaagaguccaccgccucacauaguagccaggaugcgacaggaacuaucguacucccugcccggucuaccacguccguguugcugggcgaaucaacaaccagucccauaagcuccgguucuauggagacuacagcacuaccgggcucgaccacuaccccagggcugagcgaaaagucaacaacguuccacuccaguccuucuagcacccccacuacacauuuuuccgcuucaucuaccacacucggaagaagcgaggagaguacuaccguucacuccagcccagucgccacggcaacaaccccuucucccgcccguucaacuaccuccggccuuguggaagagaguacagcuuaccauagcucgccggggucuacucagaccaugcacuucccugaauccagcacagccucaggaaggagugaggaaucucggacgucccacagcucaaccacucauacaaucaguagcccaccauccaccacuucugcgcugguggaggagcccacaagcuaucacuccucaccuggcucuauugcuaccacgcauuuuccagaaaguucgacuaccagcggucgcuccgaggaaucuacagcaucacacagcucccccgacaccaacgggaucacuccuuugccagcccacuucacaaccaguggacgaauugcugagucuacaacuuuuuacaucagccccggcucaauggagaccacgcuggccuccacagcaaccacuccgggucucagugccaaaagcaccauacuguauucuuccucaagaagcccugaccaaacauuaucgccagcuucuaugacaaguuccagcauuucaggcgaacccaccucccuuuacucucaggcggagagcacgcauacaaccgccuucccugcaaguacuacaaccuccgggcugagccaggaaucuacuacauuucacucaaagccaggaaguaccgagacgacucucucccccggcagcaucaccacaucuucguucgcccaggaauuuaccacaccucauucacaaccagggagcgcucuauccacugucagucccgcaucuaccacgguaccgggacugagcgaggaguccacaacuuucuauucaaguccuggcucuaccgaaacaaccgccuuuagccacuccaauacuaugucaauucauagccagcagucuaccccauuccccgauuccccugguuucacacacacgguguugcccgcuacucugaccacaaccgacaucgggcaggagaguacugccuuucacagcucguccgaugcgacaggaaccacgccacucccggcaaggucuacugccucagaccuuguuggcgaacccacaaccuucuacauaagcccuaguccaaccuacacuacacuguuucccgcuuccucuagcaccucaggcuugacagaggaauccacuacguuccauaccaguccuagcuuuacaucuacuaucgugucaaccgagucccuggagacacucgccccaggguuaugucaagaaggacagauuuggaacgguaaacagugcgucuguccccagggcuaugugggguaccaaugccugagcccucuugagucuuucccaguugaaaccccggagaagcugaaugcaacucuaggaaugacggugaaagucaccuaucggaacuuuacagaaaagaugaacgaugcuaguucgcaggaguaccagaauuucuccacucucuuuaagaaccgcauggacgugguacugaaaggcgauaauuugccccaauauagaggugugaacaucaggcgacugcucaaugggagcauuguugucaagaacgacgugauccuugaggccgauuacacccuggaauaugaggaauuauucgagaaucuggcggagauagugaaagccaagauuaugaacgaaacacggaccacuuugcucgacccugauucaugucguaaagcuauccugugcuacucugaggaagacacauuugucgauagcuccguuacgccaggauucgacuuucaggagcaguguacccagaaggcagccgaaggcuacacucaauucuauuacguggacguacuagauggcaaacuugcuugcgugaauaaauguacaaaggggaccaaaagucagaugaacugcaaucugggaaccugucagcuccagagaucagguccccgcugccugugcccuaacacaaauacucacugguauuggggcgagacgugugaguucaacaucgcaaagucuuuggucuacgggauugugggagccguuauggcugugcugcuccuugcccugaucauuuuaauaauccuguuuagcuugucccaaaggaaacggcauagagaacaguaugacgucccacaggaguggcgcaaggaaggcacccccgguauuuuccagaaaacagcaaucugggaggaucaaaaucucagggaaagucgauuugggcuggagaacgccuacaacaauuuccggccgacucuagagaccguagacagcggaacagaacuucacauucagagaccugagaugguggcguccaccguuuga

SEQ ID NO: 59327 - RNA, 1539 nt, Artificial Sequence
  derived and/or modified sequence opt3 from MUC13__Homo_sapiens__NP_149038
augaaggccaucauucaccugacccuccuugcucuguugagcgugaacacagcaacuaaucagggcaacuccgccgacgcggucacgaccacagagacugcuaccucugggcccacaguugccgcagccgauaccacugaaacaaauuucccugagaccgcuucaacgacugcaaacaccccaaguuuuccgacagccacuagccccgcuccuccaauaaucuccacccauucuucgucaacaauucccaccccugccccacccaucauuagcacgcacaguuccucuacuaucccuauaccaacagcggcagacagcgaauccaccacuaaugugaacucauuagccacaagugauaucauuaccgcuagcucuccgaaugacggacugaucacgaugguacccuccgagacccaaucaaacaaugaaaugagcccuacaacugaggauaaccagaguucugguccacccaccggcacagcccuacucgagacuuccacccugaauagcacagggccuucgaacccaugccaggacgaucccugugcagacaauucucuuugcgugaaacugcauaacaccuccuucuguuugugccucgaaggauacuauuacaauucaaguacuuguaagaaaggcaaggucuuuccggguaaaauuagcgugacgguuuccgagacauucgauccugaagagaagcacucuauggcuuaucaggaccugcauagcgagaucaccucacuguuuaaggauguguucgggaccagugucuacggacaaacugugauacucacaguauccaccagcuuaucucccagaucagaaaugagggccgacgauaaauuuguuaacgugacuauugucacaauccuggcggagacgaccagugacaacgaaaagacugugacagagaaaauuaauaaggccauccggagcuccucuucgaacuuccuuaauuaugacuugacccugcgcugcgauuacuauggcuguaaccagacagcagacgauugccuaaauggccucgcuugugacugcaaaagcgaucugcagcgaccaaacccucagucccccuuuuguguggccucaagucuuaagugcccagacgcuugcaaugcccaacacaagcagugucugaucaaaaagucugggggagcacccgaaugcgccugugucccugguuaccaggaggaugcuaacggcaauugccagaaaugugcguucggguacagcggauuggacugcaaggauaaauuucaacucauucugacuauaguuggcaccaucgcagguauugugaucuuauccaugauaauugcccugaucguaacggcucguucaaacaauaagaccaaacacaucgaggaagagaaccucauugacgaagauuuccagaaucuuaagcugagaagcacaggguuuacuaacuugggagccgagggcucuguguucccaaaggucaggaucaccgcaucccgggacagucagaugcaaaauccguauagccgccauucuuccaugcccagaccugacuacuga

SEQ ID NO: 59328 - RNA, 1086 nt, Artificial Sequence
  derived and/or modified sequence opt3 from MUC15__Homo_sapiens__NP_001128563
augggcaucauucagagcauacuggccaccuccagagacugcuacucuuucaagaaaaagcccaucccuaaaaagccaacaaugcucgcucuugcaaaaauucuguugaucucaacuuuauuuuauagucugcuaagcgggucccacggaaaggagaaccaagauauuaauacgacccagaacaucgccgaaguguucaagacaauggagaauaaaccgauaucucucgaaucggaggcgaaccuuaauucagacaaggaaaacaucacuaccagcaaucuuaaagcuagucauucucccccucugaacuugccaaauaacucccacgguauuacagauuuuagcuccaauucaagugccgagcauagccucggcucucugaagcccaccuccacuaucucaacaagcccuccacugauucacaguuucgucucuaaaguucccuggaacgcaccuaucgccgacgaggaucucuuaccaauauccgcucauccgaaugcaacccccgcccugagcucggaaaacuuuacguggucucuugugaaugacacuguaaagaccccugauaacuccucaauuacagugaguaucuugagcuccgagccaacuucucccagcgucaccccucugauuguggaaccaucaggguggcuaacaaccaacagugacuccuucacgggauuuacucccuaccaggagaagacaacccuccagccgacucugaaauucacaaauaacagcaagcuguuuccuaauaccucugauccccaaaaagagaacaggaauacgggcaucguuuucggugcuauccugggggccauuuugggagugucacuccugaccuuagucggcuaucugcucuguggcaagcggaaaacagacaguuuuagccaccgccgacuuuacgaugaccguaacgaaccagugcugagauuggauaaugcgccugagcccuaugacguauccuucgggaacucuucguacuauaauccaacucuaaacgacagcgcaaugcccgaauccgaggaaaaugccagggauggaauaccuauggacgauaucccaccgcugcggaccucaguuuga

SEQ ID NO: 59329 - RNA, 13482 nt, Artificial Sequence
  derived and/or modified sequence opt3 from MUC17__Homo_sapiens__NP_001035194
augccccgaccuggaaccauggcccugugccuccuuacucugguguuguccuuacugcccccgcaggcugcagccgaacaagaccuauccgucaacagggcgguuugggaugggggagguuguaucucucagggcgacgugcucaaucggcagugccagcaacugucacagcacguacgcacugggagugcugccaacacggcaaccggaacuacuagcaccaauguggucgaaccccgaauguaccuuuccuguucuacuaacccugagaugaccucgauugaaucaagcgugacaagugauacuccaggcguuuccucuacccguaugacgcccacugagagcagaaccacuuccgaaucaacaagugacagcaccacucuguucccuucuuccaccgaggauacgucaagcccaacuacucccgaggguaccgacgugccuaugaguacuccaucugaagaguccaucagcucgaccauggccuuugucucuaccgcuccguugcccuccuucgaagcauauacgucacucaccuacaagguggauaugaguaccccucugacuaccagcacccaggccuccucuagcccaacuacccccgagucaaccaccaucccuaaaaguacuaauuccgaggggagcacgccacugaccucuaugcccgcuucaaccaugaagguagccaguagcgaagcgauuacucucuuaaccacaccgguugagaucuccaccccugugacuauuucugcacaggccucgagcucccccacaacggcugaaggaccaucacugaguaacucugccccuagcggcggcuccacaccccuuacuaggaugccauugucagucaugcugguggugagcucugaggcauccacacuaaguaccacacccgcugccacuaauaucccugucauaaccagcacggaagcgucuuccucaccaaccacagccgaggggacaaguaucccgaccagcacauauacugagggaucgacaccccucacguccacuccugcaucuaccaugccaguugcuacuagcgaaaugucaacacugaguauuacccccguggacacuuccacccuuguaacaacgucuaccgagccuagcucccugccaacuacagccgaagcuaccucaauguugacaagcacucucagugaggguucuacaccccugacgaacaugccgguguccacaaucuuagucgccagcucggaagcaucaaccacuucuaccauuccuguggauaguaaaacauuuguuacuaccgccuccgaggcuagcucuagcccaacaacggcggaggacaccuccaucgcaacuucaacacccagugaaggcagcaccccucugacuucuaugcccguguccacaaccccagucgccucaagugaggcuagcaaucucuccacgacuccuguggauucuaagacccaaguaacaaccucgacugaagccagcucaagucccccaacagcagagguuaacagcaugccgaccucuacaccuagcgaaggguccacuccccuuaccucaaugucugugagcacgaugccagucgccaguuccgaggcuagcacacugucuaccacucccguggacaccucaacaccugucacuaccuccagugaggccagcucgucuuccacgacaccagaaggaaccagcauacccacuucaacaccuagugagggcucuaccccguugacuaauaugccaguguccacacggcuaguugugagcucagaagcaaguaccacgagcacuacccccgcggauuccaacacauucguaaccacaucuagcgaggcuuccucaucuaguacuaccgccgaggguacgucgaugccuacaagcacuuacuccgaacgcgggaccacaauuaccucuaugucagucagcacuacccugguggcauccagugaggccucuacacucagcacgacuccaguugacucaaauacccccgugacaaccuccacugaagcuacaaguagcucuaccacggccgagggaacuuccaugccuacaucaaccuauaccgaaggcagcacuccgcugacaucgaugcccgucaacaccacacuuguggcaucuagugaggcuuccacucugagcacgaccccaguagacacaucaacuccugugaccacauccaccgaggccucuagcagucccacuacggcggauggcgccuccaugccaaccagcacaccuucugaagggucaacucccuugaccaguaugccaguuuccaaaacacuccugaccagcucugaggcuucgacuuuaucaacaacgccgcuggacaccagcacucauaucacaaccuccaccgaagcaaguugcucuccuacaacuacggagggaaccagcaugcccauuuccacaccaucagaagguaguccccuacucacuucuaucccugucagcaucaccccagugacaucccccgaggccucaacccugagcacuacgccuguggauucuaauuccccggucacaaccaguacugagguuagcucguccccaacccccgcugaaggcacaucuaugccuacuucaaccuacagcgaggggagaacaccccuuacgaguaugccaguguccaccacuuugguggccacaucugcaauuagcacccugucaacuacaccuguagacaccuccacgcccgucaccaacaguacagaagcgaggagcucuccaacuaccucagagggaacauccaugccuacuagcaccccgggcgaagguucuacaccccucaccaguaugccagauucgacuacgccugugguuuccagcgaggcccggacacugucagcuacccccguggacacuucuaccccagucacaacgagcaccgaggccacuuccaguccuacaaccgcagaagggacuucaauacccacaucuaccccgagcgagggcacaacuccacuuaccuccacgccugugagucacacccugguugcuaacagcgaagccuccacauugucuacuacccccguggauucaaauacaccacucacuaccagcacggaggcaucguccccaccuccgacagccgagggaaccaguaugcccacuucuacaccaagcgaaggcucaaccccucugacucgcaugcccguauccaccacaauggucgcuucuagugagacgagcaccuuauccacuacuccugcggacaccucaacuccagugacaaccuauagccaggccucuaguuccagcacgacagcagaugggaccucaaugcccacuucuaccuacuccgaaggaucgacaccucugacuagcgugccagucaguaccagacugguugugucuuccgaggcuagcacacucucaacgacucccguagacaccaguaucccggugacaaccuccacugaagccuccucuucaccuacaaccgccgaggguacgagcauuccaacuucucccccuagcgagggcaccacaccacuggcuaguaugcccgucucgaccacucuugugguuagcuccgaagcaaacacauugucaaccacaccgguggauucuaagacucaggucgccaccagcacggaggcgaguuccccucccccaacagcugaagugaccucaaugccuacuucuacccccggggagagaagcacaccacugacuuccaugcccguuaggcauacgccuguggccaguagcgaagcaucuacccucucaacauccccagucgacaccagcacuccgguaacaaccagugccgagacuucuuccucgcccacaaccgcugagggaacgagccugccuacuucaaccacauccgaaggcucuaccuuacugacaaguaucccagugagcacaacccuuguuacgucacccgaggcauccacauugcucacuaccccuguggacacaaaggguccagucgugaccagcaaugaaguaucuaguucccccacuccugccgaggggacgagcaugccgaccucaacauacucugaaggccggacuccacugaccucgauacccgugaacacaacccuagucgcgagcuccgcuauuaguauccugucuacuacaccuguugauaauucaacccccgugacgacuagcacagaggccuguuccaguccaaccacuucugagggaaccagcaugccuaacuccaaucccucagaaggcacaaccccacucacgagcaucccggugucuacaacuccugucguguccagugaggcaucaacccugagcgccacacccguugacacuucgaccccagggacaaccuccgcugaagccacuucuagucccacgaccgcagagggaauuagcaucccuacaucaacuccauccgaggguaaaacaccccuuaagucuauuccuguaagcaacacaccgguggcuaauagugaagccuccaccuugagcacuacaccagucgauucuaacucacccgugguuacguccaccgcggugagcaguucuccuacuccagccgagggcacaucaauagcaaucuccacccccagcgaagggucgaccgcucugacuucuauuccugucaguacaacgaccguggccuccagcgagaucaauucauuaucuacaacucccgcuguaaccagcacaccagucacuaccuauucccaggcaaguucaagcccgacgacagccgacggaaccuccaugcaaacuucuaccuacagugaaggcagcacaccucucacuucccugcccgugucaaccaugcuuguugugucuucggaggccaacacacugagcacgaccccaaucgauuccaaaacucaggucacagcuaguaccgaggcgucuagcucaacuacagcagaagguuccagcaugaccauuucuacgccuagugaggggucccccuugcucaccucaauaccagugagcacaacuccuguugccucucccgaggcuucgacccuguccacaacuccgguggacaguaauagcccagucaucaccucaacagaggugucuuccagcccuacgcccgccgaaggcaccaguaugccaacuucaacauauaccgagggacguacuccccuaaccuccauuacaguacgcacgaccccuguggcaagcucugccaucaguacucugagcacaaccccgguugauaacuccacuccagucacaaccucuacugaggcuagaucaagccccacaaccuccgaaggcacgucgaugccuaauucuacccccagugaggggacaacuccacucaccagcauuccugugucaacaacucccgugcuguccucugaagcgagcacccuuuccgccacgccaaucgacacaaguaccccugucacuacaucaaccgaggcaacuagcucuccgaccacagcugaaggaacguccauacccaccaguacuuugagcgagggcaugacaccacugaccucaacuccuguaucucacacauuaguggccaacuccgaggcaucgacccucagcacgacacccguugauaguaacuccccaguggucaccucuacugccgugucaagcuccccuacccccgcugaagguacaucuaucgccacuagcaccccgagugaggggucaacagcgcugacguccauuccaguuagcacuaccacaguggcaucuagugaaaccaauacucuuuccacaaccccugccgucacgagcacucccgugaccacauacgcucagguaucaucgucuccaaccacugccgacggaagcuccaugcccacaaguaccccuagggagggccggcccccacugacgucaaucccugugucuacaacuaccguugcuagcuccgagauuaacacacuaaguaccacucucgcagauacccgaacaccggucacuacguauagccaagccucuuccucacccaccacagcugacgguacuagcaugccaaccccugccuacucggaaggcuccacaccccugaccucuaugccauugaguacuacgcugguggugucaagcgaggcauccacauuaucuaccacuccugucgauaccagcacacccgcgaccacaaguacagaagggucauccagcccgaccacggccggaggcacaucuauccagacuuccaccccuagugagcgcacaaccccacucgcugggaugcccguuagcacuacgcuggugguaucaucugaaggaaauacccuuuccacaacuccuguggacagcaagacccaggucacaaacucgaccgaggccaguucuucagcaacugcugagggcuccagcaugacaauaucugccccaagcgaagguagcccccuguugaccaguauuccucucucaacgacuccaguggcaagccccgaggccuccacacugucuaccacuccgguugacaguaauucaccugugaucaccagcacagaagucuccucuucgcccauuccaaccgaggggacgagcaugcagacauccacuuauagugauagaaggacaccccuaacaucaaugccuguaucuacuaccgugguugcuagcuccgcgaucaguacacugucuaccacuccaguggacacgagcacccccgucacaaacucaacugaagcccgguccagcccuaccacaucugagggaaccucaaugccaacaaguacgccguccgagggcagcacacccuuuaccucgaugccugugucuacuaugccagucgugacauccgaagcaagcacccuuucagcuacucccguugauaccaguacaccugugacgaccucuacagaggccacuuccagcccaaccacagccgaagguacuucaauacccaccaguacgcucuccgagggcacaaccccgcugacuagcaucccuguaucucauaccuugguggcaaauucggaagucagcacacuguccacuaccccaguugacucaaacacacccuucacgaccucuacugaggcuaguagcccucccccaacagccgaggggaccuccaugccgacuucuacaucaagcgaaggaaauaccccuuuaacgcgcaugcccgugaguaccacaauggucgcguccuuugagacuucuacccucagcacaacuccagcugauaccuccacacccgugacgaccuacucacaagccggcaguagcccuacuacagcagacgauaccucuaugccaacuuccaccuacucggaagggagcacaccccugacgucaguaccugugaguacuaugccaguuguguccucugaggccagcacccacucaacaaccccggucgacacuuccacacccgugaccacgucuacugaggcuagcaguuccccuacaaccgcagaaggaaccagcauuccaacaucucccccuucagagggcacuaccccacuugccaguaugcccgucuccacaacuccugugguuagcucugaagcggguacccugucgacgacaccgguagauaccucaacucccaugacaaccagcacugaggcuuccaguucuccaaccacagccgaagacaucguggucccuauuagcacggcauccgaggggucaaccuugcucacaaguauccccgugagcacaaccccaguugccucuccugaggcuuccacucugagcacaacccccguggauucaaacucuccagucgugacguccacagaaauaaguagcucggccacuuccgcagagggaaccucuaugccgaccucaacauauagcgaaggcaguacuccucuaagauccaugcccguaucuaccaaaccacuggcuagcucagaggccaguacgcuuuccacaacucccguggacaccagcauuccuguuacaaccucuacugaaacauccucaagcccaaccacggcgaaggauacaaguaugcccaucucuaccccuucggaggucuccacaagccucaccucaauccuggugucuacuaugccgguggccaguagcgaggcauccacauugucaaccacgcccgucgacacuaggacauuaguuaccacaagcaccgguacuuccucuaguccaaccacagcugaaggcagcuccaugccuacuucuacgcccggggagcguucaaccccacugacaaauauucucgugucgacuacccugcuugccaacagcgaagcaaguacacuguccaccacuccuguagacacgucuacacccgugaccacuagcgcugaggccucauccaguccaaccacagccgaaggaaccucuaugcggaucagcacuccguccgauggcucaacaccuuugacgagcauucuagucucuacccugcccguggcgaguuccgaggcuagcacaguuucgacuaccgcaguggacacaucuauaccagucaccacuucaacggaggccuccagcaguccuaccacagcugaagugacuucuaugcccaccuccacaccaagcgagacuucaaccccucucacaaguaugcccguaaaucacaccccgguugccuccagcgaagcagggacgcugucuacuacaccaguggauaccucaacucccgucaccacaagcacgaaggccuccaguucuccuaccacugcugagggaaucguggugccaauuucgacagcgagcgagggcuccacccuuuuaacaucaauccccgucucuacuaccccuguugccaguagcgaagcauccacacugucaaccacuccgguggacacgucuauucccguaaccacaagcacugaggguuccaguagcccaaccacagcugaagggacgucuaugccuaucuccacccccucagaggugagcacuccacucacaaguauauuggucucgaccgugccuguugccggaucugaagcauccacucugagcacaacccccguggauacucgaaccccagucacaacgucagccgaggcuaguuccucuccuaccacagccgagggcacuagcaugcccaucucaaccccgggcgaaagaaggacaccucucacuuccaugagcgugucuaccaugccaguagcgaguuccgaggcaagcacgcugucacgcacacccgccgacaccucuacuccuguuaccacaucgacugaagcuaguagcuccccaaccacagccgaggggacgggcauucccaucucuaccccgucagaagguagcacuccucuuacauccauucccgugaguaccacuccagucgcaauccccgaggcuucuacacugagcaccacgccuguggauuccaacucaccaguugugaccagcacugaggucaguucuucccccacuccugccgaaggcaccucgaugccaauaagcacauacucagagggguccacuccguugaccggagugcccguaucuacgacaccugugaccaguagcgcuauuuccacucuaucaacaaccccagucgacacuucuacccccguuacaacgagcacugaagcccauaguuccccuaccacaagcgagggcaccucuaugccaacuucaacacccuccgaagguaguaccccgcugacguauaugccugugagcacuaugcucgucgugucuucggaggauuccacauuaucagcaaccccaguagacaccagcacacccgugacuaccaguacagaggcgacuucuuccaccacggccgaagggacaagcaucccuaccucaacucccucugagggaaugacaccacugaccagcguuccuguguccaauacucccgucgcuaguucagaagccagcauccuuuccacgaccccaguggauucuaacacaccgcugacuaccaguacagaggcaagcuccucgcccccuaccgcugagggcacuucuaugccaacaucaacccccagcgaaggcuccacgccucucacaaguaugccaguuucuacaaccaccgucgccagcucagagacauccacuuugagcaccacgcccgcagacacaaguacuccugugaccacauacucucaggccuccucaagcccgccaauugcggacgggaccucuaugcccacuucgacauauuccgaaggaaguaccccucugacgaacaugagcuucucaacuaccccagugguaucuuccgaggcuagcacacucaguaccacucccgucgauacauccaccccugugacgacuagcacagaagccucucugucacccaccacagcagaggguacaaguauaccaaccuccagcccgucugagggcaccacaccucuugccucaaugcccguuucgacuacgccaguggucagcuccgaagugaauacccuaaguacaacuccuguugacucuaacacccuggugacaaccagcacugaggcuuccucaucucccacgaucgccgaagggacuuccuugccaaccaguacuaccuccgagggaucaacaccguuaagcauuaugccucugucuaccacucccguagcauccagugaagcuagcacacucucgacgaccccagucgauacuucaacacccgugaccacaucuuccccuaccaauagcaguccaacuacggccgaggugaccuccaugcccacaucuacugcgggcgaggguagcaccccucugacaaacaugccgguuucaacuaccccagucgcuuccagugaagccagcacacuuucuacgacccccguggacucaaauacuuuuguaacauccagcucucaggcaaguucguccccugccacccuacaggugacuaccaugcggaugagcacacccucagaggggucuagcucccucacgaccauguugcugaguucaacuuacgucacaucuagcgaggcuuccaccccaaguacaccuagcguggauagaucuacucccguuaccacguccacacaaucaaacagcaccccaacuccuccggaggugaucacccuacccaugucgacaccauccgaagucucuacuccucugaccauuaugcccgugaguacaacgagcguuaccaucucagaggcaggaacugccuccacacucccaguggacaccucuacuccuguaauaacaagcacccaggucaguuccucacccgugacgccggagggcacuaccaugccaaucuggacacccagcgaaggcucuaccccucuuacuacaaugccaguuaguaccacaagggugacuuccagcgaggggucaacccugucuacgcccuccgucgugacaagcaccccuguaacuaccucgacagaagcgauuaguucuucagccacuuuagauuccaccacaaugagcgugaguaugcccauggagaucucuacguugggaaccacuauucuggucagcacaaccccaguuacucgcuucccugaguccucaacaccgagcauccccuccguguauaccucuaugaguaugacgaccgcuucagaagguagcuccucuccaacuacacucgagggcaccacaacuaugccuaugucgaccacgagcgaacgaaguacacugcuuacuaccgugcugauaucccccauuucagucaugucuccaagcgaggcauccacacucaguaccccucccggggacacuagcaccccguugcugacaucuacgaaagccggaucauuuuccaucccagcugaagugacuaccauccggauuagcaucacaucugagcguaguaccccuuuaacuacacuacugguuuccaccacgcuccccacuucauucccaggcgccagcauagcaucgacaccuccccuugauaccucuaccacauuuacuccguccaccgacacagcuagcacuccuacgauucccguagccaccacaaucagugugucagucauuaccgaggguuccacuccagggacaaccaucuucauacccucuacuccugugacgagcaguaccgcggauguuuucccagccacaacuggagcagugucaacccccgucauuacauccaccgaacugaauacuccuagcacaucuucgagcuccaccacgacaaguuuuucuacaaccaaggaguucaccacaccagcuaugacuacggccgcacccuugaccuacgugacaaugucaacugccccgagcaccccuagaacaaccuccaggggcugcacuacaucugcuaguacccugagcgccacgucaacuccacacaccuccacaagcguaacuacccgccccgugacaccuucuuccgaaaguucacggccaagcaccaucacgucucauacuauacccccuacauuuccacccgcgcacuccucgaccccgccuacuacaagcgcuaguucaaccacggucaacccagaggcaguuaccacaaugacuaccagaacaaaacccuccacuaggaccacaucuuucccuaccgugacuacgacagccguccccaccaauacuaccauuaagagcaacccaacaaguaccccgacugugccccgaacaacgaccuguuuuggcgacgggugccagaauacugcuucccgcuguaaaaacggagguacaugggauggccucaagugccaguguccuaaucuguacuauggggaacuuugcgaggagguugugucaagcaucgacauuggaccacccgaaaccauaucugcccaaauggagcucacaguaacugugaccuccgucaaauucacggaagaacugaagaaccacagcucucaggaauuucaggaguucaagcagaccuuuacagagcaaaugaauaucguguacaguggcauuccugaauauguuggugucaacaucacuaaauugcggcuggggucaguggugguagagcaugacgucuuacuaagaaccaaguacacaccagaauauaaaacugugcuggauaacgcaaccgagguugugaaggagaaaaucacgaaggucacaacccagcagauuaugauaaaugacaucugcuccgauaugauguguuucaacacuacaggaacccaagugcagaauauuacuguuacccaguacgaccccgaagaggauugcaggaagauggccaaagaauauggcgacuacuuuguggucgaguaccgugaucagaagccuuauuguaucagcccaugcgaaccgggcuucucggugucuaaaaacuguaaucucgggaagugccaaaugagucuuagcggaccccagugucugugcguaacaacggagacccacugguacuccggugagacuuguaaccagggcacacagaaaucauugguguaugggcugguuggagcuggcgucgugcucaugcugauuauccuuguggcguuacugaugcucgucuuucgcucuaagcgggaaguuaagagacaaaaauacagguugagccagcuguauaaguggcaggaggaagacuccgguccugccccagggaccuuccagaauauaggcuucgauaucugccaagacgaugacaguauucaucuagagucaaucuacagcaacuuucagcccucucugcgacacauugauccugaaacaaaaauccggauacagcgcccacaagugaugacuaccuccuucuga

SEQ ID NO: 59330 - RNA, 25155 nt, Artificial Sequence
  derived and/or modified sequence opt3 from MUC19__Homo_sapiens__NP_775871
augaagcugauccucugguaccuuguggucgcacuguggugcuucuuuaaggacguugaagcauuguuauauagacaaaaguccgauggcaagauugcagcauccagaucugggggauucucauacgguaguagcuccucuggcgaccuggaucggaagaaaccccuauuuucgcucgaguucgggucaccuggagagaccgaagacaagagccgccaacgacaggaugcgggcaguccaaaguccgaggacacuccggcugguggguuuuucaacucuagcuccucaaguggagauagcgaccguacuaaacccuuuuucucucugggccuuggcgcaccugggaaggcagaagauaaauccggagacucacaggaugcugguggcagcaagagugaggacacgccacccgggggauuuuucuauggaucuuccagcucgggugauucugacaaaaagaagccucuguuuuccuucgaguuuggggcuaccggagaagacgaggauaaaucaagagaaaggugggacgcaggcaauagucggagcgaggauuccccagccgacucuacuaacacucgcuacggcgcuggguucagcucaaguggagccuccuuggauguggguuucggcugggggauaagcgacgagaagggacucgaaguaucuaaagcggauggcagagagaccagggguucagggagugcaggcggagaaacuaucguguuuggccccgacgccgggagcuccgucggaaccgguucuucgggccugaagcugggggcuggaaaaggcgaugccgcauucgguuuugaggugagcgacuccaauucauucggggauacuggcauuaguucuaagacuguugaaggaaaccagaccagcuccucaggcgggagcgugucuaucgaccucggagacacguccuuucggagugagaaucaguucgucgguggcgggagcuuaaacucuauuuccaaucugugggauucaggacaggagggcuuugguaucaacgaaauagggggcaauggaaugaguggcagcgugucggcugaggccggguucaaaggauuuggcuccgacucuagcucaaguggugauuccucugcgcgcaacggguucgaaaauagcuccggaaucucagaggacagcggcguaauucuugguaguucugaucagcacgaaguugaguugucccgaacuggcgggaacagaaagaggagcucggacccugaugaggccggaaaucugucaccaggcucugacgugagugauuccgggggaaacaccuggagcucugacagcggcuccggugggggaggcgucacuucaaguagcgaauauucuacuuccgguccgcuaaauacccccgagaagggcucacauaucccugaagcaacuccaaaauacagugagaccaacgcuauuaucggggaaauaagcacgugguccaagggagccuauaaaucuuuuaacggccggauuuucuuuuucgagucgagcugucccuacacuuucugccgucacuguaucgagucagggggagauuuuaauauugaaaucaagcgcaacaaugacuccgagaucgagaagauuacagugcucauagauaacaaugacgugaguaucuucggcgacaccauucuggucaacggugagucuguucagaucccuuacaauaacaaacuuauacauauuaagaaauauggggagcacaaugugcugaacagcagaaggggaaucuugacucucaugugggauaagaauaacaaacuguccuuaacacugcauaagcaauacccaaccugcggccucugugguaauuuuaacucaacgcccggccaggacaucaaugaacacauugcuaacucuaaaaucccgggggauugcccuaacgccguaggaaagagcuaugaggugugugaagacggcauucagcacugcaauaagauaaucgggaccuacuucgagaaauguggaaaggucgcagcccuuaguaacgauuauaaaaugauuugcaucgacgaauacugucagacacgggauaagacuucuaccugcgacacauauagcgagcugagccgauugugcgcuucagauggccccgguacuuuugaguccuggcgcagugacagcgaugugguuugugggacccaaagaugcccagaacagcauaucuacaaagaguguggaccuucgaaucccgcgacaugcucuaacguggcaccauuccaggacuccgaaugugucagcggcugcaccugucccgagggcuaccuacuggaugacauuggggaaaagggaaagugcgugcucaaagccgaguguccuugcgagucaagugguacuguauaucaaccaggcgaaguuagggaggggccguguggaucucagugcacgugccaggacgcuaagugguccuguacagaagcccugugccccggccgguguaaaguggaggguagcucacuuaccacuuuugauggggucaaguacaauuucccuggaaacugccacuuucuggcagugcauaaugaagacuggaguauaagcgucgaguugcgcccaugucccuccggccagaccggcacaugccucaacucugugacccuguuacugaauagcuccguuccuguggauaaauauguauucaacucagacgggacugucacaaaugauaagaucagaaaccaaggauacuauuacucugacaaaauucagaucuuuaaugccaguucgagcuaucuacagguggagacguacuuccacguuaagcuccagauucaaaucgugccagucaugcagcuguacguguccaugcccccgaaccaguuuaccgauacuguaggucuuuguggcucuuauaauaacaaggcugaagacgauuucaugucaagccagaacauauuggagaaaacaucccaagccuucgcaaauaguugggaaaugaugucuugcccuaaggggaacccaagcucauguaucuccauugagaaagagaaguuugcggaaaggcacugcggaauccugcucgacaguagcggcccccuggcuucuugucauccuauugugaaucccaaaccauaccacgaggaaugcaagaaguauaccugcacaugugagaacucccaggauugccuuuguacuauccuggguaauuacguuaaagccugcgcagaaaaggagaccuauauagucggguggcguacgggauugugugagcauucaugcccuagcggccucguguucaaauacaacgugaaggccuguaauucgucuugccggagucuguccgaacgagacagaagcugugacgucgaggauguucccguggacggcugcaccuguccagaugcuauguaucagaacaaugaagggaacugcguguuaaaaucacagugcgacuguuacauuaaugaugagguaaugcaaccgggaaagcugauccacauugacgauaacaagugcgucuguagggacgguauccuacucugccagauaccuaucgaucugacacuucagaauuguuccggcggggccgaauacguggacugcucugaucccaaagcacaacgccggacuaacagaaccuguagcacaaggaauauuccaguuuuugacgagaacuugcccugcaagcgcggauguuucugcccugagggcauggugcgaaacaguaaagguaucugugucuuuccaaaugauugccccugcuccuucgggggacgggaauaugacgagggcagcgugacuucuguuggcuguaacgaaugcaccuguauuaaggggucauggaguugcacgcagaaugagugucagacaaucugccauauauacggagaaggucacgugcguaccuuugacggcaaauccuauagcuucgaugggcugugucaguacucuuuucucgaggacuauugcggacacgagaacggcacuuucaggauucugacagaaucgguaccuuguugcgaggaugguuuaaccuguucaaggaagaucaucgucgcuuuucaagaccagaauauugugcugcaggaugggaaggugacugccgucaaaagcaccgaauccaagaaaugcgagcuuaacgcgaaugccuacaguauccauacaguuggauuguaucucauucugaaguuccagaacggcauaaucgugauuugggacaaaaauacgcgccuaucuguaauccuggauccgaacuggaauggcaaggugugcgggcucuguggaaacaauaacggugaccugaaagaugacuucaccacucgguacagcuccgucgcuucaggcgcacuugaguuugggaauaguuggaagacaucucaagaaugcagcgauaccguggcccagacauucccaugugacuccaaccccuacugcaaggcuugggccguuagaaaaugugagauuuugagggauucaacuuuucgagacugccacaauaagguggacccuagcgcauaucaugaugcguguaucgaagaggccugcgcuugugacauggaaggaaaauaccugggcuucugcaccgccgucgcaauguaugcugaggccuguucugcaguggguguuugcguguccuggcgcaagccaaacuuaugucccgucuacugcgauuauuacaacgccccuggggagugccgguggcacuaugaaccguguggcacgguaacagcuaaaaccugcaaggaccagcucgugggacagaaguuuaguagccugcuugagggcuguuacgcgaaaugccccgauucggccccauaccuggacgaaaauacuaugaaguguguuuccuugucugagugcucauguuucuauaacgaugugauaccugcagggggagucaucgaagacaauugcgguagaaccuguuacugcauugcuggccaacucgaguguagcgagacagcccccacuaacaguaccuuugccguguccacaacgaccgcuacuacaauccugucuaccggggcagccauuacucuaguaacaggaggcccaagcaccgcggcuucaaucccugccauaacgacuuccaguagcgaaaccacagguaccacucuggggccccucacagagccauucaccacaggcauuacugaaaccucugugccgaucaucucaacguccggaaaugcaggcaugacaggggucguuagcccuaccgugacuggagccucugguauggcuggcaccacagggggaguggaugcagccacuaccggcgcggcuagugagaacacgucggaaagggccgguacaccccgugucuccggggagaccccagcagugggcggaggcagcacucccggggaggccggaccuggcgcuacaguuucagguucuaccgggguaagcgccggauccauuacugcaaguccaggcgcuucagccacaucuagcgaauccaguaaaagcgguaccacgggccccuccguagggggcaagacuggcgcgaccucuucagaggccacaagcucggaagggauguccggagucaccggccagagucuggguucuacagcagggagcgacucagagauaacugcuaaaaccuccuuuacgggaucuaguccuccgggcaaacuuacacgcccaagccccgguuccccuggccacuucucagggggaacuaccgaguggggcaauguggccacaaccggggcugcaggagaaaacacuagcggcgccuuggguucuaccgaggggaguguugaagccacaacguccgcuggaagcggcaauacugcgggcaccucagggacaggagauaccggucccggcaacacugcagugucugggacaccagucguguccccuggagccacccccggcgcuccagguucgagcacgccuggggaggccgacaucggaaauacaaguuuuggcaagucuggcacaccgaccguauccgcagccagcaccacuucaagucccgucuccaaacauacagacgcugcgagcgccaccgcagugacaauuucugggucaaagccaggaacuccugguacgcccggcggggcuaccagcggaggcaaaaucacauccgguuggucuaguucggggacuagcaccggagccuccaacacaccaggcgcaaccggcucaucuacugggcagacggauaccagcggaccuagugccaagguuacagguaauuauggccaauccucagaaauucccgggacuaucaaaucuagcuccgacgugaguggaaccaugggccagagcgauacaaccucugguccgucagucgcugugacucggacauccgagcagagcagugggguuacgguggccucugagccauccgucggagugucgggcaccacuggcccucuggcggaaauaagcgggacaaccagacccuuaguaucaggacucaggaccacagguuccucugcagagggcagugggacuacgggaccaagcucacgagaauccgugaccacacggccccuggccgagggcagcgguacuucugggcagaguguuaccggaucccgcgcuacaggccuuagcgccaccgaacugggcacuacggucucauucacagggggacuagguaccucuagaucgagcgcuagggagacucggaccacaggcccuuccgcagacgggaguggaacuaccggcccgucuguggugcgaucagguacaacgagacucagcgucgggguaacccgcgccacugaguccagucccggagugacaggcaccacuacaccaucugcugaagagagcaggaccacgggcccuuccguucuggugaccgggacaacuggacaaucaggucagggcagcgggaccacaggaaagucuuuuaucgaauccggccccagugucguggguucagggacuaccggcccuacaagcgccggauugggcaccacugcaccaucgacgcgucgguccucuacaaccaagcccaguguugggagaacuggaaccacaggucagagcggcgcggagucagggacgaccgaaccuuccgccaggguggcuggagucacuggcacaucugccgaggugagcggucgcauugagccaagugcaaccgaauccagcacuucucgaccccugggggagacaaccggcacaacuaucccgucaauggaaggauccgaggcuaccggcccuagcguaauugggagugagacgaccagauuaucugugaucggaucagguacaacuggcaccuccagcgggggaucgggcgccacacggucuagugguggcgggaugggaacuaccggccaguccacggcaaggagcgaaacaaccgggccacucuucggacugacuggcacauucggucaaucagccaccguuacugggaccucuagcaacuccgcuggagucacaacgcccgagaaaaguccuggcguggcgaugaccacuggucuucugguggaaggcucagccacaacccagccacgcauauuggagagcgaaacuacagaguccucugcaggggucauuguuaccaguggacagagcgcucgugugacgggcgccacagggcccuccgccggagagaccggcacuaccgaaccgucaacagaggguucuguagcagcugugcucuuugucaucgggucggaaacuaccagaccucuggauaucggaagcggcacaacggguacucuauccggcgggaguucuaccacacggagcucagacggaaccacuggcacaaccaggaaguccacggcccgcagcgagacuaccgggcugucuggacuuacaggcaccaguggucagcucgcgggggugacuggaacauccucaaaaagcgcuggcguuaccgugacaucugaaaagucggccggcgucgcaguaauuacuggguccuucguggagcgacccguuaccacgggaccaccucuguuggagagugaaacaaccagacccagcgguggcgugacugucaccucagggcaaucugcccgggugacagagacugucggagcuuccgcaggcgugacggguaccacagggccaagcaccgaaggaaguggcgccacuggccccucaguugugggguccggaacaaccaggccucuggcgggugagagcggcacuacagaaucuagugcugggguaaccggaacgcgcccaagcuccucuagagagucagccacuaccggcccgagcgaugaggguuccgggacaaccggauuaucggcaggcgugacugucacaucuggccagaguguuaggaaaaccgggacgacaggagcccccgcuggugugacugaaaccacacggccuagcgucgugaagucaggcaccacugggccauccguaaucggaacgcguaccacaggcacuucuagcgguggguccggagccacccgcaguucaggcggcgagacagaaaccacugggcagagcgcagugaagucuggaacaaccgaguccuuuacgcgacucacuagaacaaguggucagagcgcuggcaugaccgggacuucagcccaaucugcgggaguugcccugaccucccccuucguggagggccuugucacaaccgguucgagcacgguggggcuggaaacaacuaggccuagugcagucggauccggcaaaaccggcccacccgugguuaaggcucagacaacugggccuucugccggaguaaccgugacaucaggucagagcgcacggaugaccggcgcuuccgggccgucugucggagugacuggcacgaccgguccagccagcaaaggguugggcacaauacgccccaguguugugggacucgagacuaccgaacugucagccgagggcuccgggacaaccggaccucccauugucggugaaacuacagugccaagcgcgggcguaacggugaccucuggguacagugacagaguuacuggagcuacagagccucuagcaggcgucaccgguaccaucaagcccuccguggccgggagcgugacuacaggcccaucagucacgggaguugagaccacagcuaaaacuaccucgggcgggcugucuacaacuauuagcuccgugggagguaccggcacgacagggcaaaguccggaaaggucaggaaccacuggcccuuuuaccggucuuacagggacuucugcccagagcgcaggcguaaccaugacauccauccagagugccggagugcucgucacgaccggccugaauguggauggguugggaacuacagguaaggcuuuaauaggcagcgggaccacuggacugucugcggaggccacaggcaccauuggucccuccacggaaggccucgagaaaaccgggccaucaaucacaggaagcggcacuacccggccccugguuacagaaucguggacugcagggaccuccucuggaggccacaguacaacgucaccuagcgugcgagguaccgagacuacagggcaguccgcugccgagucugucaccacuggaccagugaccggcuauacagaaacgagcggucccagugcaggcguaaccguuacuccuagacaaucaccgacagugacccagacuacaggguccagcgccgcugucucuggaaccacugugcagucccuuacagugaguggcaccacgcgcccaagcucagggcagaccgagaucacaggaucuuccgucaaggaaagcggcacuaccgagucgagugccguuaggucugguacaacugggcccaccgcgggagugacgggcacaaacgguccuucauccgcaggcguaaccgggauuacuggaagcucuccaggcgugacagggaccacuggaagcucccccggcgucaccgguacaacggggaguucagcccggagcggaaccuccaucccuucugugggcaagacuggcacaacccguacaaguguugaagagucaagaacaaccaggcccagcgcugggauuacgggaacaaacggucuguccgccgaggugaccggcacuaccgggccauuggcaggagucacaggcacuaccgguccgucugcuggggugacacgcacgacuggacuaucggccggcgaaaccggcacaaccgggcugagcccuggaguaacucggacaacccgauccagugcuggucucacgggcaaaacugggcugucagccggaguuaccggcaagacaggucuuucugcagaggugaccgggacuacaagauuaagcgcgggagucaccggcacgacaggccccuccccaggggugacuggaaccacagguaccccugccggcguuacugggaccacagaacugagugcuggagugacuggcaaaacgggucucucuagcgaggucaccgagacaacuggguugucauacggagugaagaggaccauaggccuguccgccggcagcacagggaccucuggacaaucagcugguguggcaggcacuacgacacucagugccgaagugaccgggacuacccgccccuccgcaggagucacaggcaccacuggucugagcgccgagguuacagaaaucaccgggauuucggcgguggucacgggaacaacuggcccaucugcuggcgugaccgagacaaccggguccagcgccggaguagcagguacuacgcggcuuucagccggcgugaccgggaucacaggacugagugcuggcguuacugguaccacaggguugucuaccgaagugacuggcacaaccggaccuuccgccggcgcaacggggacuacaggacuaagcgucggugugaccggcaucacugggcugucagacguugucaccgagacaaccggaaguuccgcuagaagcggcacggguauucccucugugggggagacacguacuaccucgacaagcguggaagaguccaggacuacccggccgucagccggcauaaugggaacaaauggccucccagcggaaguaaccgggacuacggagccuuuagcuggagguaccggcacaacugggauccuggccggagucaccggcacaaccggucuuucugcaggggaaacuggcaaaauuggaaguagcgccggcgugacggggaagacaggauccucugcucgcguuaccggcaagacuggucccucagcagaggugacagggaaaaccggacugagcgccggcgucacugguaccacaggccucaguccaggggugacgggaaccuccggcuugucugcggagguuacagggacuaccggacccagcgccgaagcuacaggccugccugguguguccgcagggguaacuggaaccacgggcucacucgccgguggcacagggaccaucggacugagugcuggcgucacugggaccacaggaagcucugccggcgugacugguaccacagggcuuuccgcaggagugacgggcauugcuggucuaucggccggcguuaccgggaucacuggaccgagcgcgggcgucacagggaccacuacagugucagccggaguaaccggcacgaccggucugagugcagaggcuacagaaauaacuggguuguccgccggagugaccggcacaacuggcuuaucugcaggggucaccgagacaauccgacugagcgccggagugacggguaccauuagaucauccgcuggcguuacugggaucacaggacucucugccggcgugaccgguacuaccgggccaagcgcgggagucacaggcaguacgggccugcuugcuggggugacugaaaccacaggacaguccgcaaagguuaccgguacuacaggccagagcguggggguaaccggaacgacuaggucuucaggcggugucacagggauuaccggacugagugccggcgugaccggcacaaacgggcucuccgcuguuacuggaaugaccgguuugagcgccgaggugacaggcacuaccgggcugucugucggagugacgggcaucgcaggucuaucggccgggguaacaggaauaaccggccccucagcuggcauuacugggacaaccacuaucagcgcgggagugaccgguacauccggccugagugccgaggcaacggggauuaccggacucucugccggcgucacugguaaaacagggcuuagcgcuggaguuaccgaaacuaucggccuguccgcagaggccacaggcaccauagggucaaguccuggagugacggguacaacuggcagcucuaccggggugaccggaaucacaggcuuauccgcuggugucacugggaccacgggcuugagcacagaagugacuggaaccacaggccccucagccgggguuacccggacuacaggacugucugcggguguaaccggcauuacggggcucuccgcaaucgugacugagaccacaggaaguagcgcccgcucgggcaccuccauuccaucugucggugagacugggacaaccagaacgucaguggaagagagcaggacuacacgaccuagugcuggcaucaccggaacaaauggccuguccgccgaaguuaccgggacuauaggaccccuugcugguggaaccgggacaacuggacugucugcaggcgugacggguaccgucgggagcucagccgugguaacaggcacuaccggacucagugcgggcgugacagggaccacuggaccauccgccgaggaaacgggcgcuacagguccuagcgcagaggucaccgagacuaccgggccgucugccggaguuacaggcaccggucgguuguccgcugaagugacuggcacaacggggcccucagcagaggucaccggacugccaggcgaaagcgccgaggugacagggacuauuggaaguccugcuggcguuaccgguacaacccaguuaucugccgugguaacugggaucacgggacuaucggcagaagugaccggcacaacuggucuguccgccggcgucaccgggaucacaggacucagcgcggaggugacucguaccacaggccuuucagcugggguuaccggaacgauuggccugucugccggugucacugggacaaccagacccagugcaggagugacuggcaccacaggccaaagcgccgaggugacggggaccacugaaccauccgcuggauugacagagaccacagguucaagcacuggcguaaccggggccacaggaccucuggcaggcgucaccgguacuacggggaucuccaccgaagugacaggaacuaccggccccucugcucgcguuacaggcacgaccgugcucagugccggggucacuggaauaacaggucugagcgcgauugugaccgagacuacaggcuccucugcaaggucagggaccucgacuccgagcguuggagaaaccggcacaacgcggaccaguguggaggaguccagagccacacgcccaucugcugguaucacugggaccaacggacagagcgccgaagucacauggauuacuggcccucuugcuggcgugaccgggacgacaggaaucucagccgguguaaccggcacuaccgggcucuccgccggagugacaggcacuauagguaguucugcgguugucaccgggaucaauggacugagcgccggcgugacaggcacgaccgggcccuccgcugaggaaacuggagcaacagguccaucagccgaggugaccggcacuacagggcccagcgcugaggaaaccggagccacgggcccuucugcagaggucaccgguacuacagggcccaguggaggcguuaccggcacaaacggguuguccgccgaagugacuggaaccacggguccaagcgcugagguaacaggccugccuggggugucggcgggagucaccggcacuauugguucuccggccgcagugacagggaccaucaggcccucagcuguugugacuggaauuaccggcuuauccgccgaagucacaggcacgacugggcuaagcgcauggguaaccggaaucgccggucugagugcuggcgugacagagaccauugggucuuccgcgggaguuacuggcacaaauggucucagcgccgaggcaaccgggacgacuggcccaucagcuggagugacaggcaccaccgggcuuagugccggagucacagguacugccggccuguccgcucgagugaccgaaagcacaggguugucugcaggagugacuggcaccacgggucugucagccggggucacaggcaccacuggaccuagcgcuggcaucacagggaccaacggacucuccgcggagguuacugguacgaccggcccccuggccggggugacaggaacuauaggccuuagugccgguguaaccggcauugccggguuaucugcuggagugacagaaucgaccggccugagcgcaggggucacuggaacaauccgguccucagccguugugaccggcaucaauggucucucugcuggggugacgggaacuacaggcccaagugccgaggaaaccggugcaaccggcccuagcgcggaggucacagggacuaccggacccuccggcgggguaacgggaacaucaggcauuucugccgaggugacugguaccacagggccgagcgcugaaguuaccggauugccuggcguguccgccggugucacuggcacaauagggaguccagcagcugugaccggaacgacuagacccagcgccguugugaccggcaucucugggcuguccgcggaggucacaggaaccacuggccuaucagccgguguaacagaaaccauugggagcagugcuggagugacgggcacuaacggccugucggcagaggccacagaaaccacagggccuucugcuggagucacugguaccaccggccucuccgcaggggugacaggaacuacgggcccaagcgccgguaucgccgggaccaauggacuuucagcuggcguuacaggcacuaccgggcugagugcaagggugacagaguccaccggauugucugccggugucacuggcacgauugggagcucagcggugguaacagagaccacucgccuguccagcggagugaccggcacaaucggucccucugcugaagagaccggggccacuggacucagugcagaaguuacaggcacgaccggcucccuggccgaggugacugggacaaccggauuaagcgcuggugucacaggcaccauagggucaucugccgugguuacuggaacgaccggccuuucggcagguaucacagggacuaacggacugagugcugaggucaccggcacagccggcccucucgcgggggugacuggaaccacaggucuaagcgcaggcguaacggggaccacuggacuguccgccggcgugacagaaaccacuggucagucugcuggggucaccgagucaacaggauugagcccaggcgugacgggcaccauuggguccagugccguugugacuggaaucaagggucugucugcuggcgucacagggaccacaggacccagcgcagaagagacuggcgccaccgguccguccgcggaagugacggggacaaccggcccuucaggaggcguaacugggaccagcguucucaguguggaggucacaggaacuaccggucccucugccgaggugacaggccuuccagggguguccgcuggacugacgggcaccauugguucgcccgcagccguucgugggacuacauggccuagcgcugucgugaccggcaucucaggauuguccggcgaaguaacugggacaaccggacugucugccggugugacgggcauagggggacucagugcaggcgucacugguaccauugggagcuccgccggcgugacaggaaccaaugcuuuaucagcggaggccacuggcacaaccgggccaucugcaggaguuacagguacuaccggccugagcgcuggggugacgggaacaaccggccuuagugccggugucacuggcaccauccgguccagcgcagugguaacagaaacuaccgggcugucugccggaguuacaggcacgaccgggcccucagcuggaaucgcgggcacuaacggucuauccgccgaggugacagggaccacuggacucagugcaggcaugacagguaccacgggccugagcgcuagagucaccgaaucuacuggguugucggccggagugacaggcaccauuggguccucagccguugugacagagacuaccaggcugagcgcuggagucacgggcacaauagguccuagugcagaggaaacuggggccaccggacucucugcggaggugacacgcaccacuggcucccuugcugguguaaccggcacaacggggccaagcgccguggucacuggaaaaaccgaacugucagcagagguuacaggcaccacugaauuaucugccgaggugacagagaagaccgggccgagcgcugaagugacgggaaagacuggccuguccgccggugucauggagacaaccgggcccagugccgaagugaccggaacaacuggcucaagcgcuggcguuaccgggacaacuggaccuuccgccgguguaacgggcaccacagggccaucugcggaggcaaccggauugcccggcgugagugccggugucacugggacaaucggaagcccugcuggcgugaccggcacugcccgacucuccgcaguugugacggggauuucgggacugucugcugaggucaccgguacaacuggccuaucaaccggggugacaggaaucgccggccauagcgcggccguaaccgguauuacucggccauccgcaggggucacaggaaccacgacugugagugcuggcguuacaggcaccaucgggcuuucugccgaagcuaccggaauaacacugcccagcgccggugugacugagacgaccggccucucagccggggucacagaaacuaucggacuguccgccggcgugaccgguacaauugggagcagugcuggaguuaccgagaucacuggcuugucugcaggcgugacagggaccacgggaccguccgccgguguaacuggcucaaccgugcugagcgcgggggucacagcuacuaccggacaaucugugggcguuacagguaccacggggccuucggccggagucacuggcacaaccggccucuccgcaggggugacuggaauugccggucuuagugcuggcgugacagggaucaccggaccaagcgccggcguaacggguaccacaacugucucagcaggggugaccggcacaacuggacugucugcugaagccaccgagauuacaggcuuauccgcggggguuaccggaacuacgggucugagcgcaggcgugacagggauagccggauugagugcuggcgucaccgagacuaucgguuccagcgccggggugaccggcacaaauggacucucugcagaagcuaccggcaaaacugggcccucagccggaguuacagguacgaccggccugagugcgggggugacuggaacaaccggccuauccgccgguguaacagagacuauugggcuuagcgcuggcgucaccggaacgaucggaucuucagcaggggugaagggaaccacaggccagucggccgaagugacuggugcuaccgggcagagcguuggagucacaggcacuaccagauccagugguggcgugacggggaucacaggacugucugccggccucagggggaccacuguaagcuccgcaaaagccggaacaucaauuccucugaccggcaagacugguaccacacgcacgucuguggaggaaagcaccacuacagggcccagugcuggaauaaccggcacaaacgguuuguccgcggagaugacuggcaccaacgaguuaucagccggggucacgggaacaaucggcagcucugcagggguuaccggaacuaccggccuguccguggaagcuacagugacuaccggucucagugccggggucacaggaacgaccgugccacuugcaggcguuacuuggacaccggguccuagcgccggcgugaccgggauugcugcgcugucggccggaguaacuggcaaaucagggcuaucugcaggagucacaggcaagaccggucuguccgcuggggugacgggaacuaccggccccagcgccgaggccacaggcaagaccgggcucagugcaggaguuacugguaucacaggcccauucgcugaagugaccgggacaacuggauuguccgccggcgucauugguaccacggggucuagcgcggaggugacaggaaucaccggccugucagcuggcguaacugggaaaaccagauccagugccggagugacagguacuaccggccuuagcgcaaagucugggacgucaauacccuccgccggaaaaacaggcaccacuaagacaagcgucgaagagucucggaccacuaggccuagugcugguaucacagcaaccacggggguuccagccgcuacuucgcccggagccgagggcgaauccauugcgagcaccucaguggcaacaggcgccaucccucguucuaccauugcuccagggagcacaacuaccggaacgacaggugugacuaccggcacaacccuggccccgcgauccuuuaauaucgggacaaguggaggcauaucagguaaaacccucaagcccgggucuuaugucagcgaggcaacaacggcuacuggaaccccuggcgccggcccauccgggggaacaaccauuaguagccccgaaguuucuacuaucuccgaggugucaaacacagguauuaccggcguagggagcgagacgucgaucgaaacuggaauauccaauacagcgaccaccggcguggccccugguacuacauuagcaccagggucuaguagcaccgaggcuacaacuucaaucggaggcuccgccucuacgcgcggcgggauugcuaccgaagcaacaggaagcacuagagguguccggaccacaggcagugaggcccccgaagggaccuccggagaguucucaggcacuacgaucagcucugguggguuucacaccgaggccacaacucugaccggcggaaggggcaguauugggacagaaucccgcgcugagagcaccacuucauugccucagucugcaaaaacaagaggagguauccugacggaagccaccuccagcacuggccggauaagggcgacagggucggaggcuccgggaggcaccagucgaaaguucucugguaccacaauuucauccgggggcagccauacugaagccacgacccucgcaggaggccgugauaguacagagucugaguuuagaacugccaccaucggggugguucccgcuacaaccguggcaccaggaagcuccaagacugaagccacgacauuccuuggugucucaggcaccacuagcguggggcgcgcgaccggagcuacaacuuccaucgccggcucugacaccagucaagcagagcacccuggugggacaucaggcgaauuucccggaacgaccauuacuagcggcgauucccacacagaggccaccgcucugacugggucucggggaucgaucggcacagaaagcaccguagagacgaccacauacauaggugagagugggacuaccaggggaggccuagccacagcaacuaccggugcuuucuccggcaaaacacuggaaccagggaacgacaauaccgaggccacuggaucaacgggcgggauuagagcgacacgcaccgaagccccuggaggcacuucuggugaguuccccgggaccacauuuacgagcggaggcucccauaccgaggcuacuacauucaccgguggcaaggggaguacuggaacagaaagccgggcagccaccacaagggcugccccaggcacuacccucguuccggggucuucaaacacgggagcaaccgcguccccuggcgguagcgccacaacucgagggagaaucaccacagcuacuaccggagcauuuucuggcaaaacguuggagagugaaaaugacaacacagaggccaccuccucaacucggggcgugaggacaacccgcagcgaagcucccgggggaacuucgggugaguucccaggcacccguauuacaucugggggauccuacacggccaccacuagagcagcccccggcacaacccuggcuccugguagcaguaauacuggggcgacagccucacuuggaggcuccgcaaugacccgaggcaggaucacgacagcuaccacuggggccuuuucuggaaagacccuggagccagguaacaauaacacagaagccacuagcaguacccggggcguccgcacaacgagaucagaggcacccggggaagcuacuaccuuaacaggagauagguccagcaccggcucugagucgcggacugccacaaccgguguggcgccugggacgacugucgcuccgggaagcuccaaaaccgaagccacaaccuuccucggcgugaguggcacuacaaauauagggcgcgcaaccggagccacaacuucuaucguugguucagacaccagccaggcugagagacccggcgggacgacagugguauccccaggagcaucuaguaccagccagucaucccgaccuggcacuagcgugacccccgauucuuccgccagugagucagaaacagucacuacgaaggaguuuagcgguaccacagcuauuucuaggaccucccacacugggacaccagccgcaucgggaggccaggcgaccggcagccugacugccacaaccgggguggcuccuggaacgacuguugcccccgguaguucaaacaccgaagcaacaaccuccgucggcgagcgggaaacuacaaaggcugagaucauuaccggggacacgggagaguugucuggcacaacuaucauuagcgaaaauaguaccacagccgguaucaccgcggccacugggaaacaagcaggaaccuccgagguggcuccaucaacaacgguggccccgggcagcuucucuacugcagcuaccacauccccuggcgccagcgggaccacuggaguuacaaccacgacuaagacaaccacuucucuggguggcagugggaccacaggagccgaaauaaaaucagcuaccacgggcgcacccgguucccguacagggacugccggagucccaagcgcgaccacagugucgccuggcucuaguaacagcgaggcuacuaccuccguaggcgagucagggaagacaggagccgaaaccaucacugaggcaacgaccucuacagaagguacuggcaccagcgggacaggauuuaaaaccggcacuuccgagguggcccccgcuacaacggucgcaccagguaguuucucaaccgccgcgacuacaagcccuggggcuucuggcaugaccggagugaccacuacaacgaagaccacaacuucccucggcgggagcggaaccacaggugccaagauuaaacuuguuggcacuaccacgacagcacccgaaagucgcaccgccggggugccgucaggaacuagagucaccccaggcuccucuaacucggaggcuacaacuagcguagaggaauccaggaucacccgggccgaggugauuacagaagcaacgaccuuuucuggugggaguggcgcuacuagagccggacugccccgcggcacaaccggggaguucagcggaacuaauuuuauaucagguuccucuaacacagaagcgaccacgagcaccgagggcacagggacaaguggaaccggcuucaagaucgccgguauuacaucagcaccuggcaaacaggcugggacuuccggaguuagccuagccaccacaguggcuccaggcucuuucuccacggccaccacuucgagcggggcaaguggaaucacacgagcgggccccaccucagagacuaccacaucucuggguggguccggaacgaccggcgccgaaauuaagagcgcugcagucccuagugguacuacaguggccccgggcucaucuaauuccgaggcuaccacuagcgugggggaaaacggaaaaacaaggggcgagaucauaaccgauacuacagaagggaccagcggaaagguucucgagcccggcuccgcccauacggaggcaaccacauuuccaggugggucuggaacuacccgggccggcccucccgguggcacaacuggggaauugucaagaaugaccaucauuccaggaaguagcaauacggaggcuacaaccuccacuaagggcacagggaccucuggaacuggcuucaaaaccgguacaucgugggucgcgccugggacgaccgugucacccggcagcuuuaguacugccacaaucuccccaggcgcaucucguaccacuggcgcugccccugccgcagaaacaaccacgagccuggaagggggagguacaaccggcgcugagauuaaguccggggccacuucaggaguacccggcaguaaaaccgguacagcgggggugccgagcgcaacuaccaucgccccuggaucuuccaacucagaagcuacaacgagcuuaggcgagaguggcaagacucgcgucgaaaccauaacagggaccacugagggaaaaacacuugccgcugguucugcacacaccgaagccacgacuuucuccggcgggagcggaucgaccagggcuggcccacuggguggggccucuggaacauccggcggcuauguucccgggcgggagaccgagccuacuacaucaauugaagagaccggaacgaguagaacaaucuuuaagacuguggguaucaccagcgcaccaggccgacaggcggggacauccguggucgcccccucuaccacuguagcuccgggcagcuucucaaccgccgcaacaacaaguccuggcgcuuccgguaugacgggggugaggaccacaagcaaaacuaccacaucucucggaggcaccggcacuacgcgcacagaaauuaagucaggggccaccacuggagcgcccgguauaaagaccgacaucaugggcgagaguagccggacaaccauucuguccgggucuucgaauacugaagccacaaacagcaucgaggagacgggaaccuccggcacagguuuuaaaacugcagggauuaccgcugccccaggaaagcaggcaggcacaucaggcguugcucccgggaccacuguggccccuggaaguuucucuacggccgcuaccacaagcccaggugcauccggcgucacugggaccggacccacagccgaaaccacuacauuuuugggcgguucaagcaccacgggggcggagaucaaaucuggcgcuacuacaggagccccuggcuccaagaccgggacugcaaaagugcugaguggaaccacaguugccagcgguucuuccaauucagaagcuacgaccuucaguggcauaacagaggcagugacugucccaagcaagaacgggucgaugaccacagcccucggaucccaacuuucuagcucacagacuguaaucccgggcaguuccgguaccauuucucauacaaccguggcgcccgggagcuccgugacuggcacgaccacaggagcuucagaugaccaggucacuggcagcaagaccgggacaaccggaguugcccugaguacuacgguggcaccugguucuuccagcacagaagccaccacuucgacaggcguccacagaaccacugugguagggcagaaaaccggagcuacaacgaggggcucagccaagcaagguacccgcucuacaaucgaggcaacuaccaguuuucgugggacaggcacuaccggauccggcaugaauacggggacaaccggagugguuagcgguaacacuauuucuccaagcuccuucaauaccgaggcuacaucaggcacaagugaacggcccaacccugggagcgagaucggaaccacaggcauagugucugguacgaccgucgccccaggcuccucaaauacugaagcgacaaccagucuagggaacggaggcacuacagaggccgggagcaaaauugugaccacgggaaucaccacaggcacuaccauuguucccgguuccuuuaacacaaaggcaacuaccucuacagaugugggggucgcuacgggaguaggcauggccaccgguaucacuaauaucauuucgggcagaagccagccgacagggucaaaaaccggauacacugugaccggcuccgggacaacggcucugccuggaggcuuccgaacugguaacaccccagggaguacaggagucaccucuagccaggagggcacuacagugguuuccucagguauaaccggcauccccgaaacgucuauuagcgggccuaguaaggaggccuccgacaagacuacagcacccggaccaccuaccaccgugacagcgagcacuggcgucaaagaaaccucugagacaggggugcaaacuggaucaaccuuaguaacggccggcguucccacaaggccacaggugucccagccggaaaccacugucguggcuacacgcgagguggagaccgaaaauaagacugagugccucgcaagucugcccccugccccaguuugccacggucccuugggggaagagaaaagcccuggagauaucuggaccgcuaacugucaucggggcacaugcacggacgccaagaccauugacuguaaaccagaagagugccccucgccuccgacuuguaagacaggcgagaaacuugucaaauuccagucuaaugauaccugcugugaaaucggguauugcgagccaagaacuugucuguuuaacaauacagacuacgaaauaggagcauccuucgaugaccccagcaacccuugcgugucauauaguuguaaggauaccgguuuugccgcuguagugcaagacugcccaaaacagacguggugcgcggaggccaauaggaucuacgauucuaagaaauguugcuauacauguaagaacaauugccgcuccagccucgucaacgugacuguuauuuacucaggcuguaagaaaagagugcagauggcaaagugcaccggggaaugugagaaaaccgccaaguacaauuaugacauccuguugcuggagcacaguugccuauguugccgggaagagaacuacgaacuccgagauauuguccuugacugucccgauggaagcacaauaccuuaucaguacaaacauaucacuaccugcuccugccuggacauuugucaauuauauacgacauucauguacucuuga

SEQ ID NO: 59331 - RNA, 795 nt, Artificial Sequence
  derived and/or modified sequence opt3 from MUC1__Homo_sapiens__NP_001018016
augacccccggcacacagagcccuuucuuucugcuccuucuguugacuguguuaacggccaccacagcuccaaagccggcaacugucguuaccggguccggacacgccucuucaacacccgguggcgagaaagaaaccagugcgacucaaagaagcuccgugccuucuucgacagagaagaacgcuuucaauucaagccuggaagacccaaguaccgauuacuaucaggagcuacagagggacaucuccgaaauguuucuccagauuuacaaacaagggggauuccugggccuuucuaacauaaaguuucggcccgguagcguagugguccagcugacguuggccuuccgcgaggggacuaucaaugugcaugauguugagacccaguuuaaccaguauaaaacagaagcagccucccgauacaaucucacuauuucagacgugagugucagcgaugugccuuucccauuuucugcucaauccggagcaggcguacccggcugggggaucgcccugcugguucucgugugcgucuuaguggcucuggccauuguguaucuuaucgcguuggcagucugucagugccguagaaagaacuacggacagcuggacauauucccugccagggauaccuaucacccaaugucagaguacccgacauaccauacccacggucgguauguucccccuagcaguacggaccgcucuccauacgaaaagguguccgcuggcaaugggggaagcucgcuaucuuauacuaaccccgccguagcagcuacauccgccaaucucuga

SEQ ID NO: 59332 - RNA, 2130 nt, Artificial Sequence
  derived and/or modified sequence opt3 from MUC20__Homo_sapiens__NP_001269435
augggcugccugugggggcucgcccuuccccuguucuuuuucuguugggaggugggagucagcgguuccucugcuggcccuucaaccagaagggcagacacagccaugacuacggaugacaccgaaguuccagcgaugacauuggcuccggggcacgccgcauuagagacucagacccugagugccgaaacaagcucccgggcuucuacccccgcaggaccuaucccagaggccgaaacucgcggcgcuaagcgaauuucgcccgcccgugagacaagaucauuuaccaaaacgagcccuaacuucauggugcuaauagcgaccaguguagagacuuccgcagccucugguagcccagaaggggcuggaaugacaacugugcaaaccaucacaggcuccgaucccagggaggccauuuuugacacccucugcacggaugacucaagugaagaggcaaagacucugacaauggauauccuuacccuggcucauacuagcacagaggccaaaggcuugucuuccgaaucaagcgcgaguucugacuccccucacccagucauuaccccgagccgggccucggagucuuccgcaucaagugaugggccccauccugugaucacgccaagccgcgcuuccgaaucuagcgccucaagugacggaccccacccuguuauaaccccauccagagcuagcgagucuucagccaguagcgaugguccccauccggugaucacaccuuccagggcaucugaaucgagcgccuccucagacggcccccacccagucauuacuccuagucgggcuucugagagcuccgcgucaagcgaugggccccacccagugaucacccccucucgcgcauccgagaguagcgccucuuccgacggaccucauccaguaauuacaccgucacgagcuagugaaagcucggccuccucugacggcccccacccuguuaucacuccaagcagagcaucagagaguuccgccucuagcgaugguccccauccugugauaaccccauccagggcuucagaaagcagugccucuuccgacgggcuccaccccgucauuacaccgagccgggcaucggagucaucugcgaguuccgauggaccucacccagugaucacccccagccgugcuucugaaagcuccgccucaagugacggcccucaucccgugauuacuccaagcuggucuccuggcuccgaugucacgcugcuggcagaggcccucguuacagugaccaauaucgagguaaucaacuguucaauuacugaaauagagaccacaaccaguagcauccccggggcuuccgacacugauuuaauuccaacagaaggagugaaggccucuucgacgagcgacccgccugcacugcccgauucaaccgaggcuaaaccacacaucacugaagucacagccuccgcggagacccuuaguacagccgguacuaccgagucugcugcacccgacgccacggugggcaccccuuugccaacaaauagcgcuacugaacgcgagguuaccgcccccggggcaacaacucuguccggagcgcuagugaccgucucaagaaacccucucgaagagacgucugcccugagcguggagacaccgaguuacguaaagguuuccggcgcugccccagugagcauagaagcagguucugcugucgggaagaccacuucauucgccggcuccagugcaagcucguauucucccuccgaggccgcucuuaaaaauuuuacaccuagcgaaaccccaacuauggauauugcgaccaagggacccuucccuacaucaagggacccgcugcccagugugccaccuacgaccacuaacucuucccggggcacaaauagcaccuuggccaaaaucacaacuucagcaaagaccacgaugaaacccccaacagcuaccccuacuaccgcccgaacacgccccacuaccgacgucagugccggggagaacggagguuuucuccuguuaagacugagcguggcuuccccagaagaucucacagacccgaggguugcagagcggcuuaugcagcagcugcaucgcgaguugcacgcccaugcgccucacuuccaggugucucuacugagaguaaggcguggcuga

SEQ ID NO: 59333 - RNA, 1701 nt, Artificial Sequence
  derived and/or modified sequence opt3 from MUC21__Homo_sapiens__NP_001010909
augaagaugcagaaaggcaacgugcugcucauguucgggcuucuguugcacuuagaggccgcuaccaauagcaacgaaacauccacuucugcaaauacgggaucaagugucaucagcuccggugccucuaccgcgacaaacucgggcucaagcguuacuucauccggggugucuaccgcuacaauuagcggauccucaguaaccaguaauggcgugagcauagucacuaacucugaguuucauacaaccuccucagguaucagcacggccacuaauagugaguucucuaccguguccagcgggauuucgaucgcaacaaacucugaauccucaacuaccaguagcggagccuccacagcuaccaauucugaaagcucaacgcccaguuccggcgcaagcacugccacaaacucugacucaaguaccacuagcuccggcgcuucuacagccaccaauucggauagcuccacgaccucaagugaggcgucuacagcaacuaacagcgaguccucaaccacaagcucuggggccuccacugcuaccaauagugaaagcucuacaguuuccucaagagccaguaccgcaacuaacagcgagucguccacgacaucuagcggagcuucaaccgccacuaauagugaauccaggaccacaucuaacggugcgggcaccgccacuaacagcgaguccucaacaacgagcaguggggcaucuaccgcuacuaauuccgagagcucgacaccuucaucuggagccggcaccgcuacaaacagugaauccagcacuaccucuagcggugccgggacggcaaccaauuccgagucaaguacagugagcucuggaauuuccacugucaccaacucagaaaguagcacaccauccucuggcgccaauacugcuaccaacucggagagcucaacgacauccaguggcgcgaauaccgcaacuaacucugacagcuccacaaccucaucuggggccagcacugcuaccaauagugaauccagcacaacgucuucaggagccuccaccgcaacuaacagugagagcucgacaaccucuuccggugccagcacagcuacuaauucaggcaguucuaccacguccagcgggacaucaaccgccacuaacagugagagcuccaccgugucuagcggagcauccacagcgacuaccucagaaucuaguacaacgucgagcggcgcuuccaccgccacuaauucugagucaagcacaguauccaguggugcaucuaccgccacuaacagcgaaucauccacaaccaguagcggggcuaauacggccacuaacucuggcuccucaguuaccagcgcaggaucgggcacagcugcccugaccgggaugcacacuacaucucauagugcguccaccgccgugagcgaggcuaagccgggagguagucuaguccccugggaaaucuuucucauaacacugguguccguggucgcagccguuggccuuuucgcugggcuguuuuucugcgugcggaacucuuugagccuccgcaauacuuuuaacaccgccguauaccacccucauggacugaaucacggccuggguccagggcccggcggaaaccacggcgcaccucaucgaccacguuggagucccaauugguucuggagaaggccuguguccagcaucgcgauggagaugucugggcggaacucaggaccauga

SEQ ID NO: 59334 - RNA, 5322 nt, Artificial Sequence
  derived and/or modified sequence opt3 from MUC22__Homo_sapiens__NP_001185744
augagaaggggcaacaucagccccgccuucugguuucuguggcuccuucuguucggguuguuaggaccuuccucugagaauaccacagcuuuuacuaaggguucagacacgaccacagcaaguauuacuggcagcgaaaccacaauggccuccaccauggcgucuacuucggcucugacaaccgggucaaaaauaacgacugauagcaccacaggaagugagacuaccuccgccucuacaauggcaagcaccgccgcuuucacgacuggcuccgaaacaaacaccgcaucaacuacagacagugguaccacgaucgccagcacccggacauuuacuaccgggucugauacaacuaccggauccacagcuggcucagagaccauuguggccagcacuacggucaguggcacaaccacuaccuucacaaucgcgucuaccacuguuccagaaacaacgauggcauccagcaccacuucgacagccgggucugagaagaccauggcuuccucaauuaucagugagacaacuauggccagcaccacgggauccgaaaccgcaacagugucuacuaccgguagcgagacaacuaccacgucaacagcuaguuccgaagccaccaaaguaagcacuacaggcucugagaccacuaccgcgucaacagccgggagugagacgaccacuacaagcaccuccauggcaggaucugaagcuacaacuaccucgacggccgacagcaaggugauaacagcuuccucaaugaguucugagaccacugucgccccggcagccggcagcaauaccacaacugcuuccaccacagguucagaaacgaccacuauccuaauuaaagcgagcgagacaaccacugcaucuacagccggguccgaaaccacgacucccaguccuaccggaagccagacaaccaucgugucuauuuccggcucagagaucacuacaaccaguacagcuggcagcgagaacacuaccguuucguccgccgggucuggaacgacaaccgcaagcauggccgguucagaaacuaccgugaguacagcuggcuccgagacuaccacggucucuauaacagggaccgaaacuacaauggugagcgccaugggauccgagaccacuacaaauucaaccacgagcagugaaacuaccguaacaucuaccgcaggcuccgagacaacuaccguuagcacgguggguucggagacaacuaccgcguacacagcugauucagaaaccacugccgcaucuaccacagggagugagaugacgacugucuuuaccgccggcuccgaaacaauuaccccaagcacugcuggaucugagacaaccacggugagcacugccggcuccgaaacaaccaccgugucaacuacagggagugagaccacaacugcaagcacggcucacucugagaccacagccgcguccacuaugggaucagaaaccacaaaggucaguaccgccgguagcgagacuacgguuuccaccgcuggcucugaaacaacugcagccucgaccgaggacagcgagacaaacaccgcuuucacugaagauucaaagacaacgaccgccuccacuacaggguuugagaccaccgcagcgaguacaacuggaucugaacccacgauggccagcaccaugggcuccgagacaacuauggcuucaaccaucgguccugaaacaaccaaagugucuacugccagcagugagguaacgacaguguucgcagcuggguccgagaccauucgcgccagcacugucggcucugaaaccacaacugugucaaccacaggauccgagacgaccacugcaaguaucaugggcagcgaaacaucgaccgacucuacuacaggguccgagaccacgaccgccagcacagaaggaucagagacuaccacagcuaguacugaggguucugaagcgaccacaguuuccaccacuggcagcgagacgacaaccgugucaaucacugauagugaaaccacaacgaccugcacugaggggagcgaaaugacagccgucuccaccacuguguuugagacaaccacagcaucuacugagggaagcgaaauuaccauagcuuccacgucagacucugagaccacaacugccaguaccgaaggcucggagacaacuaccguaacgacagccgguagcgagaccaagacugcuuauacaaccggguccgaaacuaccacagcaucuaauacgggccucgagaccacuacaguuuucaccaucggaucagauacuacaaccgccagcacggaaggcuccgagacaaccgcggugagugcuacugggucugaaaugaccacagucagcacugagggaucagagaacaccacaguguccacgacuggcagugaaaccacaaccgucagcacuacaggucuggagaccacgacuaccucuacagaaggguccgagaugaccacugugucaacaaccggagccgaaacaacuaccgacagcacggagggcucggguacaaccgcagccucuacugcuggcagugagaccacaacuguuuccacggcagauagcgaaaauaccacagccucaaccgcggacuccgagacuacaucugcuagcaccacugggagugaaacaaccacggccuccacuaccagcucugagacaaccacugcaucaacagaaggaagugagaccacgacaguguccacuaccgacagcgagacaaccaugguaucuacuacgggcucggaacgaaccauuacaucaacugaggggagcgaaaccacaaccgucuccgccacuggaagugagacaaccgugucuacggagggcagcgguacuacaaccguuuccaucacugggucagaaaccacaaaagugaguaccacgggaucugagacaacuaccacaagcacugaaggcuccgagauaaccacagcuucaauuaccgguagcgaaacuacgaccgccucuacagagggcuccgagacuaccacagcaaguaccgaagggagcgagacuacaucggcuuccacgaccggaucugaaacuacaaccgccucaaccacuagcagugagacaacgauggcguccaucaugggcucugaaaccacaauggccagcacuaucgggucagagaccacaaaggucuccacugcaaguagcaaaaugaccacgguguuuacagagaacucugaaaccacuauugcuucaaccacagccuccgagacuaccacaguaagcacggcuggaucugaaaccaucccagcaaguacugccggcucggagacaaccacuacaaccuccacggaagguagcgagaccacaacugccucaaccgaggggucugaaacaacuaccgcuagcacagaguccagugaaacgaccacugcgacaaccauuggaucagagacuaccacagcaucuacggagggcagcgaaaccacuacaaccuccacugaggguagugaaacaaccacugccagcacagagggcuccgaaauaaccacggugucuaccacagggucagagacuaccacagcuagcacugagggaucggaaaccacgacagccuccaccgagggcagugaacuuacuacaguuucuaccacugggagcgagaccaucacagucucagcagaaggauccgagacgaccacugugacaaccaugggcucugagacuacaaccgccaguacggcugguagcgaaacaaccacuguguccaccgcggggucagagacaacuaccgccagcauugaaggaucugagacaacgacugucaguuccaccggcagcgaaacaaccacuguuucaacaaccggcacggagacuaccaucacaucuaccgagggguccgaaacuacaaccgugacgacagcaggaucggagacuaccgcuguguacacaaccgguagcgaaacuaccacaacuaguacggagggcucugagaccacaacuguauccaccacagggagcgaaaccacuacggccucaacagcagaucuggagaccacuaccgucaguacauccggaagcggcaccacuacagccucuaccgcugguucagaaacgacaacuguguauaucaccgggagcaagacaaccacugccuccacggagggaucugaagcgaccacaguuaguacuaccucgagcgagacaaccacugcauccacaaccggcucagagaugacgacuguguucacaaccgucucugaaacuaccacagugagcaccauuggcagugaggccacgacauccucagcugccgggucugaagcuacuaccacaagcacugagggauccgaaaccacaaccgcaaguacugccgguagcgagacgaccacagcuucuacugccggcucagagaccacaaccgcauccacuagcgggagugaaacgaauacagcguguaccacuggaucugagacauccacccccucgagcgccggcucagaaacuaacaccgcuuucauaaucgguuccgagucuacaauugccaguacggcaagcuuggaaccuaccgcuacaucacucacuggguccgagaccacaacuguuagcaucaccgccucuggagcaacggccgcuaguacaaccguguccagcacuaccuuuguacugacaaaggcgacugacgucucaauucaaccaaucaccaauacaccgaugucuggcacgcguaccacuggcacaagacugaccgccucgagcuccgugacuauggcacccgggauggauuucacagcuagugccgccucucauaccgugccuggaauaguccucaacacgucagguuuaggcaccagcacaaugggggcauccaguacuaccucugcucacggaguuaggacaacuaccggcagcacacgggagccaacguccucaaccuuucaggaaacuggucccgugagcauggggacaaauaccguaucuaugucccauacuccuaccaacgugaucaaaccaaguggauaccugcagcccugggccauuauccuuauuucauuggcggcugucguggccgcaguuggccugagcgugggccuaucguucugccuccgcaaccuguuuuucccgcuuagauauugugggaucuacuauccucacggacauucccacucucuggguuuggaccucaaucugggcuuagggaguggaacauuucacagccugggcaacgcccucguccaugguggggagcuugaaaugggacacggcggcacgcauggguucggauacggugugggccacgggcugucacacauacauggagauggcuacgguguuaaucacgggggccauuauggacacggcgggggacauuga

SEQ ID NO: 59335 - RNA, 15540 nt, Artificial Sequence
  derived and/or modified sequence opt3 from MUC2__Homo_sapiens__NP_002448
augggccugccccucgccagacuugcugcggugugccuggccuugucguuagcagggggcuccgagcugcagaccgaagguaggacccggaaccacggccauaaugucuguucuacuugggggaacuuccacuacaagacguuugacggagauguuuuccgcuuuccuggcccaugcgacuauaauuucgcuucagacugucgagguaguuacaaagaguuugccgugcaucucaagcgugggccgggacaagcagaagcccccgcuggcguugaguccauccuccugaccauuaaagacgacaccauauaucuuacuagacaccuggcaguguugaacggcgccgucguguccaccccucauuacucuccagggcuccugaucgaaaagucggacgcuuauacaaaaguuuacucaagggccggacugacccucauguggaaucgggaggaugcguuaaugcuggagcuugacacuaaguuccgcaaccacacaugcgguuuguguggcgauuauaaugggcugcagagcuacagugaauuucuauccgacggaguacucuucucuccccuggaguuuggcaacaugcagaagauuaaucagccugaugucgugugcgaagacccagaggaggaaguggcacccgccagcuguuccgagcacagagcugaaugcgagaggcuucugaccgccgaagcauucgcugauugucaagacuugguuccucucgagccauaccugcgggccugccagcaggaccgcugucgaugcccggguggggauacgugcguguguucaacugucgcggaguuuaguagacagugcagccaugccggaggcaggcccggcaacuggcggaccgcaacauuauguccuaaaacuugcccagggaaucugguguaucucgaaucuggaucccccuguauggauaccugcucacaccuugaggugagcagucugugugaggaacaucguauggaugguugcuucuguccugaaggcacagucuacgacgauaucggggacucuggaugcguuccagugucccaaugucacugccgcuugcacggccaucuauauacccccggucaggagauuacgaacgauugcgagcaguguguaugcaaugcugggagauggguguguaaggaccugccgugcccuggcacuugugcccucgaaggaggcagccacaucacaaccuuugaugggaaaacuuacacauuccauggagacugcuauuacguccuggcuaagggugaucacaacgacucguaugcccuucugggcgaguuggcacccugugggucuaccgacaaacagacgugccucaagaccgugguucuguuagccgauaagaaaaagaauguggucguguucaaauccgacggaucaguacugcuaaacgaacuccaaguuaaccugccacaugugacagcuaguuuuagcgucuucaggccuuccucuuaccacauaauggugagcauggcgaucggcguccggcuucaggugcaguuggcacccguuaugcaacuguuugugacucucgaucaggccucacagggucagguacaagggcuguguggcaauuucaacggacuugagggcgacgauuuuaagaccgcuagugggcuggucgaagccacaggagcagguuucgccaauacuuggaaagcucaguccacaugccacgacaaguuggauuggcucgacgauccauguagccugaacauugagucugccaauuacgcagagcauuggugcucauuacugaaaaagaccgaaacccccuuuggccgaugccacagugcgguggacccugcugaguauuacaagcgcuguaaauaugauacuugcaacugucagaauaacgaagacugccuaugugccgcacucagcuccuacgccagagcuugcacggccaaggggguuaugcuguggggauggagggagcauguguguaauaaagaugucggcucuugcccaaacagccagguguuccuuuauaauuugacaaccugucaacagacuugccggagccuguccgaggcagacucacacugucucgaagguuuugcuccgguagacgggugcggcugccccgaucacaccuuccuggacgagaagggacgcugugugccuuuagccaaaugcaguuguuaccauagaggccuguaucuugaagcgggggauguugucgugaggcaggaggaacguugcgugugucgggacggacgauugcacugcagacagaucaggcucauuggccaaucuuguacagccccaaagauccauauggauugcagcaaccugaccgcucuagcaacuuccaagccccgcgcccugucaugucagacacucgcugccgguuacuaccacacggagugcgucagcggguguguuugcccugacggacugauggaugacggccgggguggcugcgugguggagaaagaauguccaugcguacauaauaacgaucuuuauucuuccggggcaaagauaaaagucgacuguaauaccugcacuuguaagagaggaaggugggugugcacacaggcgguuugucacggaaccugcaguauuuacgggagcggacacuauaucacauuugauggcaaauacuaugacuucgauggucauuguucuuacguggccguccaggacuauugcgggcaaaacuccucauugggaaguuuuagcauuaucacugagaacgugcccuguggcaccacggguguuaccugcucgaaggcuaucaagauuuucaugggccgcacagaacugaaauuagaggacaagcaccgagugguaauacagcgggaugaagggcaucacgucgccuacacuacccgugaggugggacaguaccucguggucgaguccucuacaggcaucauuguuaucugggacaaaagaacuaccguguucauaaagcuggcaccgagcuauaaagggacgguaugcggacuuuguggcaauuuugaucauaggucaaacaaugacuucacaacccgcgaucacaugguggucaguuccgaacuggacuuugguaacucuuggaaggaggcuccuacuugcccagaugugagcacaaaucccgaaccuuguuccuugaacccccaccggagaucaugggccgagaagcaaugcagcauucucaaaaguucuguuuucuccaucugucauagcaagguggacccaaaaccuuuuuacgaagcaugcguccacgauucguguucaugcgacaccgggggagauugugagugcuucuguucugccguggcuaguuaugcgcaggagugcacuaaggaaggcgccuguguauuuuggaggacccccgaccugugcccaaucuucugcgacuacuauaauccgccucaugagugugaauggcacuacgagcccugcgguaaccgauccuuugagacaugucgcacgauuaauggcauccacagcaacauuucugugagcuaucuagaagggugcuacccacggugucccaaagauagaccuauauacgaggaagaccugaagaaaugcgucaccgcagauaaguguggaugcuauguagaggacacucauuacccacccggcgcuuccgugccuacagaagagaccuguaagucaugcguuuguacaaauaguagccagguggucugcaggccggaggaagggaaaauccucaaccagacucaagauggagccuucugcuauugggagauuuguggcccaaaugguaccguggaaaagcacuuuaacaucugcucuaucacgacacgucccuccacccugacuaccuucacaacuauuacccuuccuacaacgccaaccacuuuuacaaccacuacaaccacgacuacccccacaucaaguaccguauugagcacuacaccuaaacuguguugcuuaugguccgacuggauaaaugaggaucauccgucuucggggagcgacgauggagaccgcgaaaccuucgauggcguguguggcgcccccgaggacaucgagugccggucagucaaggauccacaccucucccuggaacagcuugggcagaaaguucagugugacgugagugugggauucauuugcaagaacgaggaccaauuugguaacggcccuuucgggcuguguuacgauuauaagaucagagucaauugcuguuggcccauggacaaaugcauuacaacuccaucuccucccaccacgacaccaagcccgccucccaccuccacuaccacacuaccacccacuaccacgccuucaccacccacaaccacuacaaccacuccuccgccaacaaccacgcccucuccucccaucacuaccacaaccacaccaccucccacuaccacgccaagcccuccgauaaguacaacuaccacacccccaccuaccacuacccccuccccaccuacaacgacucccagcccgccaaccacaaccccuucucccccaacuacaaccacgacuacacccccuccgaccaccacucccucaccaccuacaaccacacccaucacuccuccagcuuccacgaccacacuacccccuacuaccacaccaagucccccgaccacuacgaccacaacuccuccacccaccacaaccccuagcccacccacuacaacgccgauuaccccucccacuucgacaaccacccugccaccuacaacuacgcccucuccacccccuaccacaacuaccacaccaccgcccaccacuacgccuuccccacccacaaccacuaccccuagcccacccacaaucacuaccacaacgccuccgccaaccacuacacccucaccucccaccacuacaaccacgaccccaccucccacaacuaccccaaguccgccuacaacuacccccauuacaccacccaccucuacuacgacauugccuccaaccacuacccccuccccuccgccaacaacgaccacuacacccccuccaaccacuacacccagcccucccaccacaacuaccccaucaccgccuaucacgaccacaacuacacccccaccuacaacuacccccaguagcccaauaacgacaaccccuagcccacccacuacaaccaugacuacccccucuccuacaacgacccccagcuccccaauuacuacaaccacuacacccucaucuaccacgacaccuaguccgccacccaccacuaugaccacaccuucgcccacuaccacaccaagcccucccacgacuaccaugacaacccugccaccuacuacaaccuccucuccguuaacgacuacaccccucccaccuucaaucacacccccaaccuuuagcccuuucuccacuacaacccccacaacuccgugcgugccacuguguaacuggaccggauggcuugauaguggcaagccuaauuuucauaaacccgguggggacacggaacugauuggagauguuugcggcccaggcugggcagccaacaucucuuguagggcgacaauguaccccgacguaccuauagggcaguugggacagaccguggucugcgaugugagcguuggucucaucuguaagaaugaggaccagaaacccggcggggugauuccaauggcuuucugccugaacuaugaaaucaauguccaauguugcgagugugugacucagccuaccacaaugacuacgaccacaaccgagaacccgacucccccaacaaccacuccuauuacaaccacgacuaccguaacacccaccccaacuccuacaggaacccagacgcccacaacuaccccgaucacaaccacuacgaccgucacaccuacuccaacccccacaggcacccaaacuccuacaaccacgccaauaacuacaaccacuaccgugacacccaccccuacgccaacagguacucagacccccacaacuaccccgauuacaaccacuacgaccguuacaccuacucccaccccaacagggacccagacucccacaacgaccccuaucacuacaaccaccacugugacaccaacgcccaccccuacaggaacucagaccccaacaacuaccccgaucacgacaaccacuaccgucacacccacuccuaccccaacaggcacgcaaacccccacuacaaccccuauuacuacaaccacgaccgugacaccaacucccaccccgacaggcacucagaccccuacaacgaccccaaucacuacaaccacuaccguuacacccacgccuacccccacugggacacagaccccaacuacaaccccgauuacuacaaccacgaccgugacaccuacucccaccccaacaggaacucagacccccacgacaaccccuauaacuacaaccacuaccgucacaccaacgcccaccccuacugguacacaaaccccaacuacaaccccgaucacgacaaccacuaccgugacacccacuccuaccccaacaggcacgcagacucccaccacaaccccuauuacuacaaccacgacuguaaccccaacacccaccccuacugggacacagaccccgacgacaacucccaucaccacaaccacuaccgugacaccaacuccuacgcccaccggaacacagacuccaaccacaaccccuauuacuacgacaaccacuguuacccccacaccaaccccgacuggcacacaaaccccuacgacaacucccaucaccacaaccacuacggucaccccaacacccacuccuaccgguacacagaccccaacuacaacccccauaacgacuacaaccacugugaccccuacaccgacccccacggggacacagacuccaaccacaacuccuaucaccacaaccacuacggugacccccacaccaacuccuaccggaacacagacccccacuacgacaccaauuaccacuacaaccacugucaccccgacaccuacgcccaccggcacacaaacuccaaccacaacuccuaucaccacgacaaccacuguaacccccacaccaacuccuaccggcacacagacgcccaccacuacaccgauuaccacuacaaccacggugaccccaacacccacuccuaccgggacacagacuccaaccacaacgcccaucaccacuacaaccacuguuaccccuacaccgacgcccacuggaacccaaacaccaaccacuacaccuauaaccacgacuacaaccgugacccccacaccaacuccuaccgguacacagacucccaccacgacaccaauuaccacuacaaccacugucaccccuacacccacgccgaccggcacucagacaccuaccacuacaccaaucaccacgacaacuaccgugacccccacaccuacuccaaccgggacgcagacacccacuaccacaccgaucaccacuacaaccacgguuacuccuacccccacaccaaccggaacucaaacacccaccacgacuccuauuacaaccacaaccacugugaccccaacacccacuccuacgggcacccagacaccaacuaccacaccgauaaccacuacgacaaccgucacucccaccccuacaccaaccgguacucagacacccacgaccacaccuaucacuaccacaaccacugugacgccaacccccacaccgacugggacccagacaccuacuaccacaccaauuaccacgacuacaaccguaacucccaccccuacacccacgggaacccaaacuccaacaaccacaccuaucacuaccacaaccacugugacgcccaccccaacaccgacuggcacccagacacccacgaccacuccuauuacaaccacuacaaccguuacuccaacccccacaccuacgggcacccagacaccaacuaccacacccaucacuaccacgacaaccgucacuccuaccccgacaccaacugggacccagacacccacgaccacuccuauaacaaccacuacaaccgugacgccaacccccacuccuacaggaacccaaacacccacuaccacgccaaucacaaccacuacaaccgugacuccgaccccuacacccacggguacucagaccccaacaaccacuccuauuacaaccacgacuacagucacccccaccccaacaccgacuggcacccagacaccuacuaccacgcccaucacaaccacuacaaccguuacuccaacgcccaccccuacagggacucaaaccccaacaaccacucccauuacaaccacgacuacagugaccccuaccccgacaccaacuggaacccagacgcccacaacuaccccuaucacaaccacuacaaccguaacgcccacuccaaccccuacaggcacccagacucccacaaccacgccaauaacuacaaccacaacugugaccccuaccccgacacccacugguacgcagaccccaacaacuaccccuauuacaaccacuacgacagucacccccacuccaaccccuacagggacccaaacucccacaacgaccccgaucacuacaaccacaaccgugacuccaacgcccaccccuacaggcacucagaccccaacaacuacccccaucacaacgaccacuacaguuaccccuacucccaccccaacaggaacgcagaccccuacuacaaccccgauuacaacuaccacgacagugacccccacuccaaccccuacaggcacucagacccccacaacgaccccaaucacuacaaccacuacagucaccccuacgcccacuccgaccgggacacaaaccccaacuacaaccccuauaacaacuaccacgacaguaacccccacuccaaccccuacaggaacucagacccccacaacgaccccgauuacuacaaccacuacagugaccccuacgcccaccccaacugguacacagacccccacaacuaccccuaucacgacaacuaccacaguuaccccaacucccaccccuacaggcacgcagacuccaaccacaacccccauuacuacaaccacgacugugacaccgaccccuaccccaacagggacucaaacccccacaacuacgccuaucaccacaaccacuacagucaccccaacucccacgccuaccggaacacagacuccaaccacaacccccauaacuacaaccacgacugugacaccgaccccuaccccaacaggcacucagacgcccaccacaacuccuauuaccacaaccacuacagucacccccacgccaacuccgaccgguacacagacucccaccacaaccccuaucacgacuacaaccacugugacaccaacccccacgccuaccgggacacaaacuccaaccacaacucccaucaccacaaccacuacgguuacaccuaccccaacuccgaccggcacacagacccccacuacaacgccuauuaccacuacaaccacagugacuccaacccccacgccuaccggaacacagacuccaaccacaacucccaucaccacgacaaccacuguaacaccgaccccuacucccaccggcacacaaacgccaaccacuacaccuauuaccacaacuaccacggugacacccaccccaacuccuaccgggacacagacucccaccacaacgccgauaaccacuacaaccacugucacaccaacccccacgccuacuggaacccagacaccaaccacuacacccaucaccacaacuaccacgguuacaccuaccccaacucccaccgguacacagacuccuaccacgacaccgauuaccacuacaaccacugugacacccaccccaacgccuacuggcacccaaacacccaccacaacuccaaucaccacgacaacuaccgucacaccuacccccacuccgaccgggacacagacgccaacuaccacaccuaucaccacuacaaccacggugacucccacaccaaccccuaccggaacucagacacccaccacaacuccaauuacgaccacaacuaccguaacaccgacccccacuccuacgggcacccagacaccaacuaccacacccauaaccacuacaacgaccgugacuccuacacccaccccaaccgguacacaaacuccuacgaccacaccgaucacuaccacaaccacuguuacgcccacaccaaccccuacugggacccagacacccacuaccacaccaauuacgaccacuacaaccgugacuccuacacccaccccaacgggcacccagacaccuacuaccacaccgaucacuaccacaaccacugucacgcccacaccaaccccuacuggaacccagacacccacgaccacuccaauuacaaccacuacaaccgugacaccuacucccaccccgacgggcacccaaacacccacuaccacaccaaucacuaccacgacaaccgucacuccuacacccaccccuacugggacccagacaccaacgaccacucccauaacaaccacuacaaccgugacgccuacaccaaccccgacuggaacccagacacccacuaccacaccuaucacgacuaccacaaccguuacuccaacacccaccccuacgggcacucaaaccccaacaaccacucccauuacaaccacaacuaccguaacgccgacaccuaccccaacugguacccagacacccacuacgaccccuaucacaaccacuacaaccgugacucccacaccaaccccgacggggacucagacccccacaaccacuccuauuacaaccacgacaacugucaccccaacacccaccccuacuggaacccagacaccaacgacuacccccaucacaaccacuacaaccgugacgccuacuccaacacccaccggcacucaaaccccgacaaccacgccuauaacaacuaccacaacuguuaccccaacacccaccccuacugguacgcagaccccaacaacuacccccauuacaaccacuacaacggugaccccuacuccgacacccaccggcacccagacuccaacaacgaccccuaucacaacuaccacaacugucacccccacgccaacaccuaccgggacucagacccccacaacuaccccaauuacaacgaccacuacagugaccccgacucccacaccuaccggaacgcaaaccccaacaacuacccccaucacaacuaccacaacgguaaccccuacuccaacacccaccggcacucagaccccuacaacgaccccgauaacuacaaccacuacagugaccccaacucccacaccuaccgggacgcagacccccacaacuaccccaaucacaacuaccacgacaguuaccccuacucccacaccaaccggaacucagaccccgacaacgaccccuauuacuacaaccacuacagucacccccacgccaacaccuaccggcacucaaacccccacaacuaccccaaucacaacgacuaccacagugaccccuacucccacaccgaccgguacgcagacuccaaccacaacccccauuacuacaaccacgacagugacuccuaccccaacacccaccgggacucagaccccuacaacuacgcccaucaccacaacuaccacagucaccccaacuccuacgccgacaggaacccaaacucccaccacaaccccaauaacuacaacgaccacaguuacuccuacccccacaccaaccggcacucagacgccuaccacaacucccauuaccacaaccacuacagugaccccgacgccaacuccuacagguacccagacucccaccacaacgccaaucaccacaacuaccacaguaacuccuacccccacaccgaccggcacucagacgccaaccacaacucccaucaccacaaccacuacggugacaccuacccccacuccaacagggacccaaacuccuaccacaacgcccauuaccacaacuaccacagucacuccaaccccuacgccgacaggaacccagacucccaccacaacuccuaucaccacaacgaccacugugacaccaacccccacuccuacaggcacccagacgccaaccacaacucccauaaccacaacuaccacaguuacgccgaccccuacuccaacagggacccagacucccaccacaacgccuauuacuaccacaaccacugugacacccaccccaacgccuacuggaacacaaacccccaccacaacuccaaucaccacaacuaccacggucacaccgacccccacuccuacaggcacccagacuccaaccacaacgcccauuaccacuacaaccacugugacaccuaccccaacgcccacagguacucagaccccuaccacaacuccgaucaccacgacaacuaccguaacaccaacccccacuccuacagggacccagacgccaacuaccacacccauaaccacuacaaccacgguuacuccuacaccaacccccacaggaacccaaacuccgaccacaacuccuaucacgaccacaacuaccgugacacccaccccaacuccuacgggcacacagacccccacuaccacaccaauuaccacuacaacgaccgucacacccacuccuaccccgacaggcacccagacuccaacgaccacacccaucacuaccacaacuaccgugacaccuacgccaacccccacugggacacagaccggaccuccaacucacaccucaacagcccccauugcagaacuaacgaccuccaauccgccucccgagaguagcacuccacaaacaucucgauccaccucaagcccucugacagaaucgacuacccuucucucuacacugcccccagccaucgagaugaccaguacugcuccucccuccacgccgaccgcaccaacaacuaccagcgguggccacacauugucaccucccccauccaccacuacgucuccucccgggacaccaacccggggaacuacaaccggcagcaguuccgccccgacucccagcaccgugcagacaacgaccacaucugcguggacuccuaccccaacaccccugucaacuccuaguauuauccgcaccacggguuuaagacccuacccauccagcguccucauaugcuguguucugaacgauacauacuaugcuccuggggaggaaguguacaauggaaccuauggcgacacuugcuacuuuguaaacugcucucuuucguguacccuggaguucuauaauuggucaugcccgagcacacccuccccaacuccuacccccaguaagucuacaccaacgccuagcaagcccuccucaaccccgaguaaaccaacuccuggcacaaagcccccagaauguccugauuuugauccgcccaggcaggagaacgaaaccuggugguugugcgauuguuucauggccacuugcaaauacaauaacacaguggagauugucaagguggagugugaacccccuccgaugccaaccugcucuaacgggcuccaaccaguucggguggaggacccugacggauguugcuggcauugggaaugugauugcuauugcacggguuggggcgacccccacuacgucaccuuugaugggcuguacuauagcuaccagggaaauuguacuuaugugcuaguagaggaaaucuccccaucaguugacaacuucggcguguacaucgauaauuaucauugcgacccuaacgauaaagucagcuguccccgaacacugauugugagacacgagacccaggagguucuuauaaagacagugcacaugaugccgaugcagguccaagugcagguaaaucgccaggcaguggcccucccauacaagaaauauggucuggaagucuaccagucugggaucaacuacguuguggacauuccugaguugggagucuuaguguccuauaauggccugaguuucagcguaaggcuccccuaccaucguuuuggcaacaauacuaaggggcaaugcggaaccuguacgaacacaaccucggaugacugcauccugccuuccggugaaauugugucuaauugugaggcugccgcagaucaguggcuuguuaacgacccaucaaaaccccacugcccucauagcaguuccacuacaaagcggccagcugugaccguccccggcgggggaaaaacuaccccgcacaaggacuguacaccuucuccacugugccaguugaucaaagauagccuauucgcccagugucaugcgcuggugcccccucaacacuauuacgacgccugcguuuuugauucaugcuucaugcccggcuccagucucgaaugugcaagccugcaggcuuaugccgcucuuugcgcacagcaaaauauauguuuagacuggagaaaccacacgcauggugccugccuggucgaguguccaucucacagggaguaccaggccugcgggccggcugaggaacccacuuguaagucauccagcucucagcagaauaacaccgugcucguggaaggaugcuuuuguccugagggcacaaugaauuaugcgccaggcuucgauguaugcgucaagaccugugggugcgugggacccgacaacguuccucgcgaguuuggugaacauuucgaguuugauugcaaaaacugugugugcuuggaaggcgggaguggaaucauuugucaaccaaagcgaugcucgcagaaacccgucacucacuguguggaggacggcacauaccuggcaaccgaaguuaauccugccgauacgugcuguaacaucacugugugcaaguguaauacaucccucugcaaagagaagccaagcguauguccccuggguuucgaggucaagucaaaaauggugccggggagaugcugcccuuuuuacuggugugaaucuaagggagugugcguucacggcaacgcugaguaucagccaggcagccccgucuacuccaguaaaugucaggacugcguguguaccgauaagguagacaauaacacccuucugaaugugauugccugcacacaugucccuuguaacacuucaugcucuccaggguucgaauugauggaggcacccggagaauguugcaaaaagugugagcaaacccacugcaucauaaagcggccggauaaucagcaugugauucuaaaaccuggugacuuuaagagcgaccccaaaaacaauugcacauucuucuccuguguuaagauccacaaccagcugaucaguagcguguccaauauuacuugcccaaacuuugaugccucuauauguaucccuggcucaauuaccuucaugcccaaugggugcuguaaaacgugcacaccaaggaacgagacccgcguccccuguagcacugugccuguuacaaccgaagugucguaugcuggaugcacuaagacgguacucaugaaccauuguuccggcaguugcgguaccuuugucauguacucugcgaaggcccaggcauuagaccacagcuguucaugcugcaaagaggaaaagacaucccaacgugaggugguucugucuuguccaaaugggggaagucuuacucacaccuauacacauaucgaaagcugccagugucaggauaccgugugcggccugccgacuggcacauccagacgggcuaggcgcucaccccgacaccucgggagcggauga

SEQ ID NO: 59336 - RNA, 9972 nt, Artificial Sequence
  derived and/or modified sequence opt3 from MUC3A__Homo_sapiens__NP_005951
augcagcugcucggccuucugggguuguuauggaugcugaaggccagccccugggcuaccggaacacuauccacugcaacgucuaucucacaagugccuuucccaagagccgaggcggcuagugccguccucagcaacuccccgcacucuagggaccuggcagguuggccccuuggcguuccucagcuggccucgccagcucccgggcaucgggaaaaugcaccuaugaccuugacaacuucaccacacgauacccucauuagcgagacacugcugaacagucccguguccucuaauaccagcacuacaccuaccuccaaauuugccuucaagguagaaacgacuccaccgaccgugcucgucuacucagcuacaacugagugcguguaucccaccaguuuuauaaucacaauuagccauccuaccucuaucuguguuacgacuacacagguggccuucaccuccucauacacuagcacaccagucacccagaaacccgugacgaccguaacaaguacuuauucuaugaccacaacugaaaagggaaccuccgcgaugacaagcucgccuucuaccacuacggcacgcgagacaccaauuguuaccgugacucccuccucagucagugccaccgacacaaccuuucacacuacaaucagcuccacgacccgaacuacagagcguaccccguuaccuacaggcucuauacauacuaccacgagccccaccccaguguucacaacucugaaaaccgcugugacaucaacuaguccuaucaccuccagcauuacgucuacaaacaccgucacuucaaugacaaccacugccagucaacccaccgcaacaaauacgcuuagcuccccaaccagaacuaucuugucuucgacacccguucugagcaccgaaacaauuacuuccgguaucaccaacacgacaccucuaucaacccucgugacuacccugccaacaacuauaaguaggucuaccccgacaagcgagacgaccuacacuacaucccccaccucaacuguaacagauagcaccacgaagauugcuuauucuacuuccaugaccgggacacuuaguaccgaaacuagccugccuccaacaucuuccucauugcccaccacagagacugccaccacgccuaugacaaaucucgugaccacuaccacagagaucaguagccacucgacuccauccuuuucuagcucaaccauuuacaguacggucuccacaucuaccacugcgaucagcucccugcccccgacaucaggaaccauggugacuagcacaaccaugacgccuaguucuuuauccacugacaucccauucaccacacccaccacaauuacucaccauagcguuggcucgaccggcuuucugacgacagccacugaucucaccucaacauucaccgugucuaguuccagcgcaaugucuacuagcgucauaccuuccucacccaguauccagaacaccgaaacaagcucucuuguguccaugacgucagcuacuaccccaaauguacggccuacauuuguuaguacccugagcacucccacauccucuuugcuaaccacguucccagccacuuauucguuuagcucauccaugagugcuucuagcgccgggacaacccacaccgaguccauuucaucuccgccugcaagcacuaguacacugcauaccacagccgaauccacucucgcucccacgaccacaacuagcuucaccacaucuaccacuauggagccacccucaacgaccgcggcaacaacuggaaccggucagacaaccuucacuuccaguacagccacguuuccugaaaccacuacaccaacccccaccacagacaugagcacugagucgcugacgaccgcuaugacaucuccuccgaucacuuccagcgugaccucaacaaacaccgucacuaguaugacgacaaccacuucuccacccaccacaacuaauuccuucaccagccuuacaucaaugccucugaguagcacgccagugcccuccaccgaggucgugacuucuggcacaauaaacaccauuccuccgagcaucuugguuacuacacuccccaccccaaaugccuccucaaugacgaccucugaaacaacuuacccuaacagucccaccgggccaggaacaaauucgacuaccgagaucacauacccuaccacuaugacggaaacaagcuccaccgcaacuucucugcccccaaccucaccguuagugagcacagccaagacggcuaaaaccccuacuacaaaccugguaaccacuacaaccaagacaacuucccacaguaccacgucuuuuaccagcucaacagucuauuccacugccaguaccuacacaacugcaauuaccagcgugcccacgacacuaggcaccaugguuacuucuacauccaugaucucaagcaccgugucgacugguauuccaaccucucagcccacaacgauaaccccuaguuccgucgggaucagcggaucacucccaaugaugacugaucugacauccguguauaccguaucuaacaugagcgcgcgccccacuacagugauuccuaguuccccgaccguucaaaauacggagaucagcaucucugucucaaugacaagugcuaccacuccauccggcggccccaccuucacaagcacugaaaacaccccuacaagaucucuuuugacgucguuucccaugacucacucauucagcuccaguaugucugagagcuccgccgggaccacacauaccgagucaauuaguucuccaaggggaacuacaagcacccugcacacgacuguggaauccaccccuucacccacaaccacuacaagcuuuaccacaucuacuaugauggagccaccuuccaguaccgugagcacgacaggucggggccagaccacuuucccgucguccaccgcaacauuucccgaaacuacgacccucacaccaaccacugacauaucuacagucucacugaccacugccaugacaagcccucccccaguuaguuccucuaucaccccuacgaauacuaugaccagcaugcgcacaaccacuuacuggcccacagcuaccaacacgcuuucaccgcugacauccaguauuuugagcucuacuccagugccuucaaccgagaugaucacaucccauaccacuaauacgaccccccucagcacacuggugacuaccuuacugacaaccauuacucgaucuacaccaaccagugaaacgacuuaucccacaucgccuaccuccaucguaagcgauucaacuaccgagauaacauacucuaccagcaucacggggacacuauccacugccaccacacucccgcccacuaguucaucucugccaaccacagagaccgcaacuaugacgccuaccacaacucuuauuaccacaacccccaacacuacaagcuuguccacgccuaguuucaccagcuccacuaucuauucuacagucucaaccagcaccacugcuauuucguccgccaguccaacaucuggaacgauggugaccagcacaacuaugacccccucaucccugucuacagacacuccuaguaccacgccaacaaccaucacuuaccccagcguuggcuccaccgguuuucucacaacugcgaccgaucugacaucaacguucaccgugagcucuaguuccgccaugagcacuucagucauaccgucuuccccuucgauucagaauacagaaaccagcaguuuagugucuaugacuuccgcuacaaccccaagccugagacccacgaucaccucaacagacaguacucuuaccuccagcuugcucacaacuuuuccuucuaccuacucauucagcuccucuaugagugcaucgagcgccgggacaacgcacaccgagacuauuuccucacugccagcuucuacaaacaccauccauacuaccgccgaaagcgcacuagcgcccacaacgaccacuaguuucacaaccuccccgacuauggagccucccucaacaaccguugccacuacaggcaccggacagacgaccuuuccaucuagcacagcuacuuuccuggagaccacaacucucaccccuacgacagauuuuuccaccgaaagucugacuacagccaugaccagcacucccccaauaaccucuucaaucacacccacggacaccaugacuuccaugaggacaaccacuagcuggccuacagcaaccaauacgcuuaguccauugacaucuuccauucugucgagcaccccggugcccucaacugagguaaccacaucccacacuaccaacacaaauccugucucuacguuagugacuacccucccaaucacaauuacccggaguacucugacaagcgaaaccgcuuaucccucauccccuacgagcacugugaccgagucuacaaccgaaaucacuuacccaacaaccaugacggagacaaguuccacugccaccagccuucccccuacaucaucucuggucucgaccgcagagacugccaaaaccccgacaacuaacuugguuacgaccacaacuaagaccacaagccacuccaccacuaguuucacgucuucaacaauauauagcaccgcuuccacuccaaccacagcgauuaccagugugcccacuacacucggcaccaugguaacgucuacaagcaugaucccuuccacugugucaaccgggauccccacaagccaaccaaccacuauuacgccuucuuccgucggaaucagugguucacugcccaugaugaccgaccuaacaagcguguacacuguuucguccaugucugcccguccaaccagugugauuccgagcucaccuacaguccagaauaccgaaacuuccauauuugugucuaugaugagcgcaacaacccccaguggcgggccaacguucacuuccacagagaacacccccacucgcagccugcucaccucuuuuccuguuacacauucauucuccagcaguaugucugcuucauccgugggaaccacgcacacacagagcaucucgucuccacccgccauuacuaguacccugcauacaacugccgaauccaccccuagcccgacaaccacuaugucauuuacgaccuucacaaaaauggagacuccaucuagcaccgucgcuacaaccggcacuggucaaacgacauuuaccuccaguacugcaacaucacccaagaccacuacccuuacaccuacgagcgauaucuccaccgggucuuucaagacagccguaaguagcacuccacccauuaccuccucaaucacaucuacuuauaccgugacgucgaugacaaccacuaccccuuugggccccacagcgacuaauacccugccaagcuuuacauccaguguuucuagcucaacgccggugccuuccaccgaagcuauaacuagcggaacaaccaacacuacacccuuaucuacccucgucacgaccuucaguaacuccgacacaucaagcacuccaaccucugagacaacuuacccuaccucgcugacauccgcccuuacggauaguaccacuagaacaaccuauagcacuaauaugaccggcacacugucaacggugacuucucuaaggcccaccuccagcagucuccugacaaccguaacugcaacagugccaaccacgaacuuggucacuacaaccaccaaaaucacaucacacuccacuccuagcuucaccucuaguauugccacaacugagacccccagccacuccacgccgcgguuuacaucuucaaucaccacuacagaaaccccaagccauuccacuccucgauucaccucgucuauuacaaauacgaagaccacuagucacagcucacccuccuuuacaucuagcaucaccacuacagagaccacgucccauaacacaccaagucugacuucaagcauaaccaccacaaaaacuaccucucacuccacgcccaguuacacaagcuuaauuacuaccacaaccacuacaucacauucuaccccuuccuucacgucgagcaucacuaccacagaaaccacuagucacaauacaccgucccucaccucuucaaucacgacuacagagaccacaagccacuccaccccaucuuuuacuagcaguauuaccacagaaacuacgucacauuccacccccagcuucacaucucugauaacuaucaccgagauuacaagucacuccacccuuagcuacacuacgucaaucacaaccacugagaccccuucgcauucuacacugagcuuuaccuccaguauuacuacaacggaaaccacaucacacucuacucccagcuucaccuccaguaucacaaccagcgagaugccaucucauuccacuccuucauuuacgagcucgauaaccacaacugaaaacgcuacccacuccacacccaauuucacuucuaguaucaccacaaccgagacgacuucacacagcacaccauccuuuaccucuuugauuacuaccacagagacgaccagccaucgcugggggacuacagaaaccacaaguuauucaacuccuuccuucaccagcucuaacacaaucaccgagacuacgucccacaguaccccgagcuacauuacaucaaucacuaccacagaaacgcccucuuccagcaccccaucguucaguucuucaauaacuacaaccgagacuacaucccauagcaccccuggauuuacuucuagcauuaccacaacggaaaccacaucccacaguacucccucauucaccagcuccaucacaacuaccgagacgacaucucacgacaccccaaguuuuacuucaagcaucaccacauccgagacuccuucucauucgacccccagcuccacaagucucauuacgaccacuaagacaaccucacacucuacuccgagcuucacauccaguaucaccacgaccgaaacuacaucucauagcgcacacucauuuaccuccagcauaacaacuaccgagacgacaucucauaauaccagaucauucacuaguuccauuacaaccacugaaaccaacagccacucgacaacgucuuuuacuuccagcaucaccacaaccgagacuacaucacacaguaccccaucuuucuccagcucaauuacgacuacagaaaccccucugcauaguacccccggucuaacauccuggguuacuaccacaaaaacuaccagccacaucacgccaggccugacaucuucgauaaccacuacagagaccacuagccauuccacgcccggguuuaccucaucuauuacaacuaccgagacaaccagugaaagcacuccuucccuuucuucaagcacaaucuauaguaccguguccacgucuacuacagccaucaccagccacuucaccacauccgagacugcggugacccccacgccagucacaccuucaagucucagcacugauauuccgaccacaucucugaggaccuugacucccuccucggugggaacaagcaccucacugacgacuaccacagacuuuccaaguaucccuaccgauauuuccacuuuacccacacggacccacauaaucucuagcucaccauccauucagucuacggaaacuagcagucucguuggcacaaccuccccuacaaugagcacuguacgcaugacccugagaaucaccgagaauacacccaucucuucauucaguacuuccauuguggucauaccggaaacgccuacccagacaccacccgugcuuacuagcgcuaccgguacacagaccucuccugccccaacuacgguuacauuugggucgaccgacucaagcacuuccacccugcauacauugacccccaguacugcacucucuacaaucgugagcacgucccaagucccuauuccaucaacccacaguagcacucugcagacaacccccucuacaccgucccuacagaccagccugacuucaacgucugaguucaccacagaguccuucacuaggggcaguaccagcacaaacgccauccuuacuucguuuuccaccauuaucuggucuucaacaccuacgauaaucaugagcaguucccccucuagcgcuucaauuaccccaguguucaguacuacaauccauuccguacccagcucuccuuacauuuuuuccaccgaaaaugucggaucagccagcaucacuggcuucccaagucucucuucguccgcaaccacaagcacgucaucuaccaguagcucccugacuacagcuuugaccgagauaacacccuuuucauauauuagcuuaccuuccacuaccccaugcccggggacgaucacaauuaccaucgugcccgccucuccuacugauccauguguugaaauggaccccaguaccgaggcgacaagcccuccaacuaccccccugacaguguucccguuuacgaccgagauggucacuugcccuacauccauaucuauccagaccacucucacaaccuacauggauacgucaucgaugaugccagaaagcgagaguuccauuucucccaacgccagcucauccacuggaaccggcacagugccuaccaauacuguuuucacaaguacccgucugcccacaucugaaacuuggcuuagcaacuccucagugaucccacugccguugccuggugucagcaccauuccccuaacgaugaagccaucuaguucccugcccacaauccuccggaccagcucgaaaucuacucacccuucaccacccaccacacgaacuuccgagaccccuguggcaacaacgcaaaccccaacuacacugaccagcagaaggacuacacgcauaaccagucagaugacgacccagucuacucuuacaaccacagcugggacuugugacaacggaggcaccugggaacagggucaaugcgccuguuuaccgggcuuuuccggggaccggugccagcugcagacgagaugucagaauggaggccaaugggaugggcucaagugccagugucccagcacauucuauggaucaaguugcgaguuugcuguagagcagguggacuuggauguugucgaaacugaggugggcauggaaguguccgucgaccaacaguucagcccugaucugaacgacaauaccucucaggcauacagggauuuuaacaagacauucuggaaucagaugcaaaaaauuuucgccgacaugcaggguuuuaccuucaaggggguagagauccucucacugcgcaacggaagcaucgugguugauuaccuugugcuguuggaaaugccauuuuccccccagcuagagagugaguaugaacaggucaaaacuacccugaaggagggccuccaaaaugccucucaggacgugaacucgugccaggauagccagacauuauguuucaaaccugacuccauuaagguuaauaacaauucaaagacggaacugacuccagcugcgaucugccgacgggcagcccccaccgguuacgaggaauuuuauuucccucuuguggaggcuacacgucugagaugugucaccaaaugcacuucuggcguggauaacgccauagacugucaucaagggcagugcguacucgagacaaguggaccgaccuguaggugcuacagcacggacacucacugguuuuccggcccccgcugugaaguggcaguucacuggcgggccuuggucgggggacugacagcuggcgcggcccuccuggugcuucuacuguuggcauuaggugugagagcugucaggucagggugguggggaggccagcgacgcggucggucuugggaucaagacagaaagugguucgagaccugggaugaagagguugugggcaccuuuagcaauuggggguucgaggacgauggaacagacaaagauacuaacuuuuauguagcccuggaaaauguggacaccacaaugaagguccauauuaaaaggccagagaugacuuccaguagcguguga

SEQ ID NO: 59337 - RNA, 3531 nt, Artificial Sequence
  derived and/or modified sequence opt3 from MUC4__Homo_sapiens__NP_004523
augaagggcgccagauggaggcgggugcccugggucagccuguccugccucugucuuugccuguugccucacguugugccagggaugaccacaccgucuuuaaaaacugacggaggucgccgaacggcuaccucacccccuccaacaaccagucagacuaucauuagcacaauacccuccaccgcaaugcauacucguucuacagccgcgccuaucccaauucugcccgagagaggcguaucgcuauucccuuacggggcuggagccggcgaucucgaauuugugaggcggaccgucgacuucacgucaccacuguuuaagccggcaacugguuucccccuugggagcagucugcgcgauuccuuguauuuuaccgacaacggacaaaucauuuucccugagucugauuaccagaucuuuagcuauccaaauccccucccuacaggcuucacuggcagagacccaguggcccugguugcucccuuuugggaugacgcagauuucuccaccgggaggggaacaaccuuuuaccaggaauaugagacguucuacggugaacacucacugcucgugcagcaagccgagaguuggauacggaaaaugacuaacaauggcggguauaaggcucgcugggccuuaaaagucacaugggugaacgcgcaugcauacccggcccaguggacccugggaagcaauacuuaccaggcuauccuuucuacagacggcucccgaucauaugccuuguuucuguaccagagcggugggaugcaaugggauguagcacagagaaguggaaacccuguucuaaugggcuucucuuccggcgacggguauuucgagaauagcccccucaugucgcagccagugugggaaagguaccggccugaucguuuucugaacucuaauuccggacuucagggucugcaauucuaucgcuugcacagagaggaaaggcccaacuaccggcucgagugucugcagugguuaaagucacagccacgauggcccaguuggggcuggaaucaagucagcugcccuuguuccuggcagcaggggcgcagagaccugagguuucagccagugucuauuggacgguggggccucgguagccgccaacuuugcucauucaccaguuggagagggggcguguguugcuccuauggaccguggggcgaguuuagggaaggguggcauguccagcgucccuggcagcuggcucaggaguuggaaccucaaagcugguguugccgguggaacgacaagccauaccuaugugcccuguaccagcagcgaagaccccacguuggaugcgcgacguauaggccuccacagcccgccuggauguucggugauccgcacaucaccacacucgacggcgugucuuacacuuuuaaugggcugggagauuuccuucugguaggcgcacaagacgguaacucaaguuucuugcuccaggggcgcaccgcucagacaggcagcgcccaggcuacuaauuuuauugccuuugcagcccaauaucgguccucuucgcugggaccugugaccguccagugguuacuggagccacaugaugcuaucagagugcuacucgacaaccagacaguuaccuuccaacccgaucacgaagacggcgggggacaggagacuuuuaacgcgacgggugugcugcuuagcaggaauggcuccgaggucucagcaaguuucgaugggugggccacagugucuguaauagcuuugagcaacauucugcaugccuccgcaucacucccucccgaauaccagaaucgcaccgagggacugcuuggcguuuggaacaauaacccagaagacgauuuccgaaugccuaaugguagcacuauucccccagggucuccggaggaaaugcuguuucacuucggcaugaccuggcagauuaacggaacaggcuugcucgggaaacggaaugaccaacugccuuccaacuuuacccccguguucuauagucaguuacagaagaauagcucuugggccgagcaccugaucuccaacugcgacggagauucaaguuguaucuacgacacucuagcucuccguaaugccagcauuggccugcauacaagagaggucucgaaaaacuaugaacaggcaaaugcgacgcuuaaccaauacccacccuccauaaacggugggagggugaucgaggcuuacaagggacagaccacuuugauucaguauacaucuaaugccgaagaugcaaacuuuacccugcgcgacagcugcacagaucucgagcuguucgaaaauggcacuuuacuguggaccccuaaaucacuugagccauuuacguuggagauccucgcccggagugcuaagauaggucuggccuccgcacuacagcccagaaccgucgugugucacugcaacgcugaaucucaaugucuguacaaucagacaagcaggguuggcaacuccucacucgagguggccgggugcaagugugacggaggcacuuucgggcgauauugcgaaggaagcgaggaugcgugugaggaaccuugcuuuccgaguguacauugugucccaggcaaagguugcgaggccugucccccuaaucugaccggggacggacgccacugcgcugcacuugggucuuccuucuugugccagaaccaaagcuguccagugaauuacugcuauaaccagggucauuguuacauuucgcagacacugggcugccagcccauguguacuugcccuccggccuuuaccgauucacgguguuucuuagcugggaauaacuuuucucccacgguuaaucucgaacugccacuuagagugauccaacuguugcucagugaggaagagaacgccuccauggcagaggucaaugcgagcguggccuauaggcugggaacacuagacaugcgugcuuuccugcgcaacucucagguagaacggaucgauagcgccgcuccugcauccggcucacccauucagcacuggauggugaucagugaguuccaguacagaccaagggggccuguuauugacuuucucaacaaucaacugcuugccgcagucguggaagccuucuuguaccacgugccccgacggagcgaggaaccacgcaacgaugucguuuuucagccgauaucuggagaggacgugagagacgugaccgcucugaauguauccacuuuaaaggcguauuucaggugcgauggcuacaaagguuaugaccucgucuacucaccucagaguggguuuacaugugugagccccugcucccggggauauugcgaucauggcggucagugucaacaucugccaucuggcccccgaugcucguguguuagcuucucaaucuacaccgccuggggcgagcacugcgaacaccuuuccaugaagcuggacgcauuuuucggaaucuuuuucggcgcucuagggggacuccuguugcugggcguggguacuuuugucguguuaagauucuggggguguaguggagcccgcuucucuuauuuucucaacagcgccgaggcucugccuuga

SEQ ID NO: 59338 - RNA, 16965 nt, Artificial Sequence
  derived and/or modified sequence opt3 from MUC5AC__Homo_sapiens__NP_001291288
augagcgugggcagaaggaagcuggcccuccuuugggcucuggcauuggccuuagcgugcacccggcacacugggcaugcucaggacggguccucugaaucaaguuacaaacaccaucccgcccugagcccuaucgcacgcgguccauccggcgucccgcuacgaggggccacuguuuuccccucucuccguacgauuccugugguaagagcuucgaacccagcacacaauggaaggguguguucaaccuggggcagcuuucauuauaagacuuucgauggugacgucuuucgguuccccgggcugugcaacuacguguuuagugaacacuguggagccgcuuaugaggauuucaauauacaacuucgcagaucccaggaaucugccgcgccuacucugagcaggguuuugaugaaaguggacggcgucgugauccagcucaccaagggcuccguacugguuaacgggcacccagugcugcuccccuuuucacagaguggagucuuaauucaacaguccucuuccuacacuaaaguggaggcacggcugggucuuguguugauguggaaucaugaugacucacugcuacucgaacuggauaccaaguaugccaacaagacuugcggccuuuguggggacuucaauggaaugccugucguuagcgagcuguugagucacaacacuaaacucaccccaauggaguuuggcaaucugcagaagauggaugacccgacggaucagugccaagaccccgugccugaaccaccccgcaacuguucuacugguuucgggaucugcgaggaauuacugcauggacagcucuuuuccggcuguguagcucuuguggaugucggcagcuaccuggaggccugccgacaggacuuguguuucugcgaggacaccgaucuacugucgugcgugugucacacucucgcagaauauucuagacagugcacucacgcugggggacugccucaagacuggagggguccagauuuuuguccccagaaaugcccgaauaacaugcaguaccaugagugucgguccccuugcgccgacaccuguucaaaucaagaacacagucgugcgugcgaggaucauuguguugccggcugcuucugucccgaagggacugugcuugacgauauuggacagaccggcugcgucccagugagcaagugcgcauguguauacaacggugcugccuaugcuccuggggccacguacuccacugacugcacuaauuguaccugcucuggcggacgcuggagcugucaggagguucccugcccaggcacuuguucagugcugggcggggcacacuucaguacuuuugaugguaaacaguauaccguccauggcgacugcuccuacguguugacgaagcccugugauagcucugccuucaccguccucgcugagcugagaaggugcggguuaacugacucagaaacuugucugaagagugugacccuaagccucgacggagcgcaaacuguugugguaaucaaagcauccggcgaggucuuucugaaccagauauauacucagcuuccuaucucugccgcuaacgugaccauuuuccggccaucgaccuuuuucaucauugcccagaccagcuugggucugcaacucaaucugcagcuuguuccgacuaugcagcuguuuaugcaguuggcacccaagcuccgagggcaaacgugcggccugugcggaaacuucaauuccauccaggccgaugacuuucgcacuuuaucaggcguggucgaagcuaccgccgcagcguucuuuaacacuuucaaaacccaggcugccuguccuaauauaagaaacaguuuugaggauccaugcucucugagcguggaaaaugagaaguacgcacagcacugguguucccaacuaacugacgccgaugggcccuucggaaggugccacgcugccguaaaaccugguaccuauuacucaaacuguauguucgacacuugcaauugugagcggagcgaagauugccucugugcagcucugucuuccuacgugcaugccugcgcggccaagggcguucagcuugggggauggcgcgacggcgucuguaccaaaccaaugacgaccugccccaagaguaugacuuaucacuaccaugugagcacuugccagccgaccuguagaucuuuguccgagggugauauuaccugcucagugggguuuaucccugucgacggcuguauuugcccaaagggaacuuuccuggaugacaccggcaaauguguucaagcuaguaacugccccuguuaucacagggggagcaugaucccuaauggagaaucggugcacgauuccggcgcaaucugcacguguacccaugguaagcucucuugcauugggggacaggcccccgcuccagugugugccgcaccuaugguauuuuucgacugccguaacgcgacacccggcgacacuggugccggcugccagaaaagcugucacacccuggauaugacaugcuacucaccacagugugucccggggugcguguguccugacggauuaguugcugauggcgaaggcgggugcauaacugccgaagacugucccugcgugcauaaugaggcaaguuaucgggcugggcaaaccauccgagucgguuguaacacgugcacaugugauuccagaauguggaggugcaccgacgauccaugccuggccacuugugcaguguacggggacggacacuaucuuacauuugauggccagucuuacagcuucaauggugacugcgaguacaccuugguucagaaccauuguggcgggaaggauuccacucaggacucauuucgcgugguaaccgaaaacguccccugcggaacaacgggcaccacuuguagcaaagccauuaagaucuuccucgggggauuugagcugaagcuaagucacggcaaaguggaagugauagguacagaugagucucaagaggucccuuauaccauucggcagauggggaucuaccugguuguggacacagacaucggacucguacugcuuugggauaagaaaacuuccauuuucaucaauuugagcccagaauuuaagggcagagugugcggucuguguggcaacuucgacgauauugcugucaaugacuuugcgaccaggucgcgcucagugguuggggauguguuagaguucggaaacucuuggaaacucagucccuccugcccugacgcccuggcaccgaaggauccauguacggcuaaucccuuccgaaagagcugggcccagaaacagugcucuauacuucacggcccuacauuugccgcuugucaugcacacgucgaaccagcccgguauuacgaggcgugcgugaacgacgcuugugccugcgauagcgggggagacugcgaauguuucugcaccgcaguugccgcuuaugcacaagccugucaugaggugggccugugcgucuccuggcguacucccucaaucuguccuuuguuuugcgauuacuauaauccggagggucagugugaauggcacuaccagcccugcgggguaccaugucucagaaccugcaggaacccucgcggagacugucugcgggacgugagaggccuagagggcugcuaccccaagugcccaccugaagcgcccauuuucgaugaggacaaaaugcaauguguugcuacaugcccaacuccgccucugcccccaaggugucaugugcacgggaagaguuaucgacccggagccgucgugccuagcgauaaaaauugccagucuugucucugcaccgaacgcgguguagaguguacauacaaggcagaggccugcguguguacguauaacggccagcgguuucacccaggggacgucaucuaccauaccacugauggaacaggcgguugcaucuccgcuagauguggggccaauggaaccauugaaaggcguguuuaucccugcucaccuacuacaccggugccacccaccacguucaguuuuagcacuccuccccugguggucuccucuacccacacaccaucgaacggcccuagcucagcacauaccggacccccauccagugcuuggccuacuacagccgggaccucuccgcgcacacggcuucccacugcgagcgccuccuugccaccugugugcggagagaagugucuguggucacccuggauggacguuucuagaccagguaggggcaccgauagcggggacuucgauacguuagaaaaucuccgagcacacggauaccggguaugcgagaguccucgcuccguggaauguagagcugaggacgcccccggcgucccgcugagggcucuuggucagcgggugcaaugcagcccagauguugggcugacaugucgaaacagagagcaggcaucuggacuaugcuauaauuaccagauacgcgugcaguguugcaccccucuccccuguucaacuuccaguagcccagcccaaaccacacccccuacuaccucgaaaacgacagaaaccagggccucuggcuccagcgcuccgucaaguacucccggcacagucucucuguccaccgcgcguacuacaccagcaccugggaccgccacgagcgugaagaaaacuuuuucaacccccaguccuccacccguaccugcuacaagcaccuccucuaugagcacaacugccccaggaaccuccgucgugucaucuaagcccacgccgacagagccuaguacuucgagcugcuugcaggaacuguguaccuggacagaguggaucgacgguuccuacccagcacccggcauuaacgggggagauuucgacaccuuucagaacuuacgggacgagggcuauacuuucugcgaaucuccuagaucaguucagugcagggccgagagcuucccaaauacaccccucgcugaucugggucaagacgugaucuguucccacacagaagggcuuauuugccugaacaaaaaucaguugccgccuaucuguuacaacuaugagauacgcauccagugcugugaaacggucaaugugugccgagauauuacuagacuccccaagaccguugcgacaacccggccaacuccucaucccacaggagcccagacccaaacgacuuuuacaacccacaugccaagugcaucuaccgagcagcccacugcuacaagcaggggcggcccuaccgccacaucagugacucaggggacgcauaccacacuggucacucgcaacugucacccacguugcaccuggacaaaaugguucgacguggauuuuccgucccccggaccucaugguggcgacaaggagaccuacaauaacaucauuagaaguggggaaaagaucugucggaggccagaggaaauaacucgccuacaaugccgagcaaaaagccaccccgagguaucuauugaacaccugggacaggugguucaguguuccagagaggagggccuugucugccggaaucaggaucaacaggguccuuucaagaugugccucaacuaugaagugagggugcuguguugcgagacgccacgcgggugucauaugaccucaacacccggaagcacuucgucuaguccugcccagaccacaccguccaccacuagcaaaacaacggaaacccaggcuucaggcuccucugccccaagcaguacucccggcacagucuccuugagcaccgcgagaaccacuccugcccccgggacugccacgucuguaaagaaaaccuuuucaacaccaaguccucccccagugccggcuacuuccaccagcucuaugucgacaaccgccccuggaacuucaguugugagcuccaagcccacgccaacagagcccaguaccucuagcugccugcaagaauuauguacuuggaccgaguggaucgacgguuccuacccugcuccaggcauuaaugggggagauuucgacacauuucagaaccucagggaugagggcuauacuuucugcgaaucaccccggaguguccagugucgugcagagucuuuuccuaauaccccgcuggccgaccuuggucaggaugugaucugcagccacacagaagggcugauauguuugaacaagaaucaacucccacccaucugcuacaacuacgagauucgcauccaguguugcgagacgguuaacgugugccgagacauuaccagaccuccaaaaacugucgcuacaaccaggcccacuccucaucccacaggcgcccagacccaaacgaccuucacaacucacaugccauccgcaucaaccgaacagccgacagcgacuagccggggaggcccuaccgccacaucugugacccaggggacucacacgacacccguaacccgcaauugucauccaagaugcacuuggaccacaugguuugacguggauuucccuucccccggaccacacgguggcgacaaggagacguauaacaauaucauaaggaguggggagaaaauuugucggcgaccugaggaaaucaccagacugcagugccgcgcuaagagccaucccgagguuucgaucgagcaccuaggacaagucgugcaguguuccagggaagagggccuggugugccggaaccaggaucagcaagguccguuuaaaaugugucuuaauuacgaaguccguguucucugcugugagacuccaaaggggugcccugugacaucuacccccguaacugccccaucaacacccagcggcagagcaaccaguccuacacaguccacuucuagcuggcagaagucaaggaccacgacccuggugacaacuuccaccacaaguacuccgcagaccagcacgacauaugcucauaccacuucuacaaccucagccccaacugcacgcaccacauccgcccccacgacccggacuacaagcgcuucuccugcgaguaccacuucgggacccggcaacacaccauccccuguccccaccacgagcacaauuucagccccaaccacuucuaucaccagcgcaccuacaacuuccaccacaagugcuccgacgucaucuacuaccagcgggcccggaacaaccccauccccugugcccacuacaaguauuaccagcgccccaacgacuuccaccacaucugccccuaccacuucaacaaccagcgcacgaacaucguccacuaccagugcuacgacaaccucuagaauaagcggucccgaaacuaccccgucaccaguuccuacaacuuccacgaccucugccacaaccacaaguacaaccagcgcgcccacuacauccaccacgucagcuccaacuagcucuaccacaaguagcccccaaaccagcacuacaucagccccuaccacgucuacaacuuccggccccgggaccacaccaucgccugugccgaccacuagcacgaccagugcacccacaacuaggaccacaucugccccaaaauccagcaccacuucagcugcaacaaccaguacgacuuccggaccugagacaacaccccgcccagucccuacuaccagcacaaccucuucacccacgacaagcacuaccuccgccccgacaacuucuaccacaagugcgucgaccacuagcacgaccuccggcgcugguacaacuccuucaccaguacccaccacaucuaccacuagcgccccuacaacgaguaccacuuccgcaccaaucucaucuacaaccagcgccaccacuacauccacgaccagugggcccggcacaacuccuagcccagugcccaccacaucuacuaccucagcuccgacgacauccaccacuagcggaccuggcaccacacccagugccguuccaacuaccucuauuacauccgcacccacgaccucgacuaauagcgcuccuaucucauccacaaccucugccacuacaaccagucggauuagcgggccagagacgacccccucaccugugccaacagcguccacuaccagcgccucuacaacaaguaccacauccggaccgggcacgacccccagcccugucccaacuacaucaaccaucucugugcccacuaccucgacaacgagcgcauccaccacaaguacaaccucugcuucaacuacaagcaccacuuccgguccugggacaaccccaagucccgucccgacgaccucuacaacuagcgccccuaccacauccacuaccucagcaccaacgacaagcaccauaucugcucccacuacauccaccacaagugccaccacaacgucaaccacuagcgccccuacacccagacguaccucggcgccaacuacauccaccaucucugcuaguacgacaagcaccacuucagcaaccacaacuuccaccacaucugccacgacuaccagcacaauuagugcuccgaccacuuccacaaccuugagcccuacgacuucuaccacaucaaccacuaucacauccaccacgagcgcccccauuaguucuacaacuucaaccccacagacauccaccacuagcgcacccaccacaucgacuacgucuggaccuggcaccacaaguuccccagugcccacuaccagcacaaccucagccccuacuacgucuacaaccagcgcuccaacuaccaggacaaccuccguuccgacaaguucaacaaccagcacggcgacaacuuccaccacaucuggucccggcaccacuccuaguccagugcccacgaccagcacaacuuccgccccuaccacacggaccacuucagcaccaacaaccucuacgacuucggcucccacaaccagcacuaccuccgccccuacaaguucuaccacgagcgcaacaacuaccucaacaaucuccguaccgacuaccagcacaaccucugugcccgggacuacgccaaguccuguccccaccacauccacuauaucaguuccaaccacaagcaccacuucugccucgacgacauccaccacaaguggaccuggcacaacccccagcccagugccgacuaccucaacaacgucugcuccuaccacauccacuaccagcgcccccacaacaaguaccauuucagcgccaacgacauccacccccagcgcaccuacuaccucuacaacuuuagccccaaccacaaguacgaccagcgcucccacuacauccaccacuucuacaccuaccucaagcacgaccuccucgccgcagacaucuacuaccagugccagcacaacuucaaucaccuccgggcccggaacaacgccaucuccuguccccaccacuagcacaaccuccgcaccaacuaccaguacaacgucagcugccacuaccagcacaaucucugcuccuaccacuuccacaaccagugcccccacgacuagcacaaccucagcaucuaccgcguccaagacaucgggccuggguacuaccccaagcccgauuccuacaacaaguaccacgucucccccaacaaccagcacuacaucagccagcaccgcuuccaaaacuucugggccuggaaccacacccagcccagugccuacgaccaguacuauauucgcaccccgcacaucaaccacuuccgcaagcacaaccucuacgacaccgggcccagguacuacccccaguccuguaccaaccacauccacugcuagcgugucaaagaccucgacgucucacguuagcaucuccaaaacaacucacagucagcccgugacccgagacugucaucucagaugcacauggaccaagugguucgauauugacuuuccuucaccgggcccccacgggggagauaaggaaacuuacaacaauaucauuaggucuggcgagaaaaucugccggcgcccagaagagauaacaagacugcaauguagggccgaaagccauccugaggucuccaucgagcaccuuggacaggugguccagugcagucgagaagagggacuggugugucggaaccaagaccagcagggccccuucaagaugugcuugaauuaugaaguucguguacuauguugcgagaccccaaaagguuguccugugacgagcacucccgucaccgcaccaucuacaccuuccgggagagccaccucacccacucagagcacaucguccuggcaaaagucucgcaccacgacucuggugacaaccaguacaaccucaacuccgcagaccagcacaacuuccgcgccuacgaccucuacaacuagcgcuccaaccacaaguaccacuucagcccccacgacauccaccacuagcaccccucagacaucuauuuccagugcaccaaccagcucaacuacaucugcccccacguccagcaccaucucggcuaggacaacaaguauuaucucugccccgaccacaucaaccacuuccagcccuacgaccucuacaacuagcgcaaccacaacuuccaccacaagugcucccaccucaagcacgacuuccacaccacagaccucuaaaacaagugccgcgaccucaagcacaacguccggaucuggcaccacucccucgccuguuacaaccacaagcacugcuuccgugaguaagaccucaacaucucacgucagcguguccaaaaccacucauagucaaccaguaacgcgggauugccaccccagauguaccuggacaaagugguuugacguggauuucccuucuccaggcccgcaugggggagacaaggagacuuacaacaauauaauucgcagcggugagaaaaucugcaggcgacccgaggaaaucacccggcuccaguguagagccaagucacacccugagguuuccauugaacaucugggccaggucgugcagugcagcagggaggaggggcuugugugccgcaaccaagaccagcagggaccauuuaaaauguguuuaaauuaugaaguccguguucugugcugugagacacccaagggcugcccugugacgucuaccucaguaacugcaccaaguacacccuccggucgggccaccagcccgacucaaucgacaucuuccuggcagaaaagcagaaccacuacccucgugacaucaaguaucacgucuaccacacagacuuccaccacaagcgcuccuacuaccucaacgacaccagcaaguauacccuccaccacuagcgccccuaccacaucuacuaccucggcgcccacaacgagcaccacuuccgccccaacaaccucaacuacaucuaccccucagacgaccacaaguagcgcucccacauccucuaccacaucagcaccaacuaccagcacgauuagugccccgacaaccuccacuaucucugcucccacaaccagcacuaccuccgccccuacagcaucaacgacaagugcuccaaccagcacaucuuccgcccccaccacuaacacaaccucggcgccuacgacuagcacaaccucagccccaauuaccaguacaaucuccgcacccacuaccucuacaacuagcaccccucaaacgucaacaauauccucuccgaccacuagcacaaccaguacuccacagacguccaccacaagcucucccacuaccucaacaaccagugcuccuacuacauccaccacgagcgccccaacuacaucuaccaccucgacaccccagacuucaauuagcuccgcaccuaccaguucuacgacaagcgcccccacugcuuccaccaucucagccccaacaaccaguacuacuagcuuccacaccacgucuacuaccuccccgccuacaagcucaaccucuuccacuccccagacaaguaagaccagcgcggcuacgucguccacuacaucugggucaggaaccacaccaagcccuguccccacuaccaguaccgcauccgugucuaagacaagcacuucacacguuaguguguccaaaacgacccauagccaaccagucacaagggauugucacccgcgcugcacuuggaccaagugguuugacguggauuucccuucucccggcccacauggcggggacaaagaaacauacaauaacaucauucgauccggagagaagaucugucggagacccgaagagauuaccagguugcagugccgcgccgagucacacccugaaguaagcauagagcaucugggucagguugugcaguguaguagagaagagggccucgucugccggaaccaagaucagcaggggccauuuaaaaugugucugaauuacgaagugagggugcuuugcugcgagacucccaagggauguccugucacgucuacaccgguuaccgcuccaucgacucccuccggccgugccaccagcccuacacaaucaaccucuaguuggcagaagucccgaacuacaacgcuggugaccacuuccacaaccucaacaccccagaccagcacuacguccgcaccaaccacaucuacuaucccugccaguacccccagcacaacuuccgcuccaaccacaucuacgaccucagcgccuacuacaucgaccacuagcgccccgacccaccgcacaacgaguggucccaccacuuccacaaccuuggcaccaacaacuucuaccacgagcgccccuacaaccucaacuaacuccgcucccaccacaaguacuauuucugcaagcaccacauccacgaucucagccccaaccacuagcacaaucucuaguccuaccuccagcacuacaucgacaccccagacgucuaaaacuucagcugccaccuccagcacaaccagugggucuggaacuacaccguccccaguacccaccacaagcacuaccucagcgaguacgacauccaccacuagcgcaccuaccacaucuacuaccucaggcccaggcacaacgcccagcccugugcccuccaccaguacuacaucugccgcuaccacuucgacaaccagcgccccaacgaccagaacuacauccgcaccuaccucaucuaugacaagugggccgggaacuacccccagcccagucccuacgacauccacuaccucagcucccacaaccucuacuaccagcgguccaggcacaacgccuucccccgugccgacuaccaguacaaccagcgccccaauuacuucuacaaccuccgggccuggaucaacgcccagcccaguuccuacuacaaguaccaccucggcgcccacaacuucuaccacauccgccagcacugcuucaacgaccaguggcccggguacaaccccuucccccgugccaacuacaucuaccacuagcgcacccacgacccggacaacuucagccuccaccgcuagcacaaccucugggccuggaaguacuccaucccccgucccuacaaccagcacgacuucagcaccaacaaccaggaccacacccgccucuacugcuucgacgaccaguggcccgggcacaacuccuagcccagugcccaccacauccaccacuucugccucaacaaccagcacgauaucccuaccuacuaccaguacaacuucugcaccaaucaccagcaugacauccgggcccggaaccacgccuucaccaguacccacuacaagcaccacaagugccccgacaaccucuacgaccuccgcgucgacagcuagcacuaccucagguccuggcacaacuccaucccccguuccuaccacaucuaccacaagugcccccacgacaagcaccacuuccgcaucaaccgccucuacaaccagcgggccaggaacaagucuguccccggugcccacaacgagcaccacuucugcuccuacaaccucaacaacuuccggcccagguaccacgcccaguccugucccaaccacaagcacuaccucugcccccacaacuucgaccacguccgggccuggaacaaccccaucaccggugcccacuacaagcaccacuccuguuaguaagaccucuacaucccaccucagcgugucaaaaacgacccauucucaaccagucacuagcgacugccaccccuuaugugcauggacaaagugguucgauguggacuuuccuuccccaggcccccauggcggggauaaagagaccuauaauaacauuauccgcaguggagaaaagauuugcagacggccggaggaaaucacaaggcugcagugucgagcugagucacacccugagguaaauauagaacaccuuggucaggugguccagugcagccgugaggaaggccugguuuguagaaaccaagaccagcaggggcccuucaagaugugccucaauuacgaggugcgcgucuuguguugcgaaacuccacggggauguccugugaccuccguaacgcccuauggcacaucuccaaccaacgcccuguacccuagucucagcacuuccauggugucggcgucuguugcaucaaccagcguggccuccaguucugucgcuagcucauccguggccuauagcacacagacuugcuuuugcaauguugcugauaggcuguaccccgcagguaguaccaucuauagacaucgcgaccuugccgggcacuguuacuacgcgcuaugcucucaagauugucaggucgugcggggaguggacuccgacugcccgucaacaacgcugccacccgccccugcuaccagcccaucuauuucgacuuccgagcccguaacagaguugggcuguccuaacgcagucccacccaggaaaaagggcgaaaccugggccacuccuaauugcagugaggcuacaugugaagggaacaaugugaucagcuuacgaccgagaaccugcccccggguugagaaaccaacgugugccaacggauauccugcagugaaggucgccgaucaggacgguugcugucaucacuaccagugccaaugcguguguucaggcuggggagauccccauuauauuacuuucgacggaaccuacuauacauuccuggauaauugcaccuacguucucgugcagcagaucguaccagucuauggccacuuuagggugcugguggacaacuacuucuguggugcugaagaugggcuuucuugcccucgcuccauaauucuggaguaccaccaagaccguguuguccucacuagaaaacccgugcauggcguaaugacaaacgagaucauuuuuaauaacaagguggucagcccgggauuccgaaagaauggcaucgugguuaguaggauaggggugaaaauguaugcgaccaucccagaauugggaguccaggugauguuuuccggucugauuuucagcguugaggugccuuuuucuaaguucgccaacaauacagaaggccagugugggacuugcaccaacgaucggaaagacgagugucgcacgcccagaggaacaguagucgcaucaugcagugaaauguccggccuauggaaugugagcaucccagaucagccugcuugucacaggccccauccaaccccgacuaccguuggucccacaacuguggggucuaccacggucggcccuacaaccgugggaucaacuacaguaggcccaaccacucccccugcccccugccugccaucgccuauuugucaacucauccuuagcaagguguuugagccgugccacacagucauacccccacuguuauucuacgaggggugcguuuuugaccggugucacaugaccgacuuggauguggugugcuccagucuggaacucuaugcagcccugugugcuucucaugacauuugcaucgauuggcgcggaagaacgggucacauguguccuuucacuugccccgcggacaaagucuaccagccauguggcccuagcaaccccuccuauugcuacgggaaugauucagccucucuuggagcacugccagaggcuggcccuaucaccgaagguuguuuuugcccggagggcaugacacucuucagcaccagugcccagguguguguucccacagggugcccacgauguuugggaccucauggcgagcccguaaagguggggcacacugucggaauggacugccaggaaugcaccugugaggccgcuacguggacacugacuugcaggccaaaauuauguccucuacccccggcaugcccccugccaggcuucgugccuguucccgccgcuccucaagcgggucaguguugcccacaguauuccugugccugcaacaccucacggugucccgcaccuguggggugcccagaaggagcccgugcuauuccgacauaccaggagggcgcauguugccccguccaaaauugcagcuggaccguguguucuaucaacgguacucucuaccagccuggcgccguaguguccaguagccuuugcgaaaccugucgcugcgagcugccagggggacccccuucggaugcuuuugucguuucaugugagacacagauaugcaauacgcauuguccagugggcuucgaauaucaagagcagucugggcagugcuguggaacuugcguccagguggccuguguuaccaacacauccaagagccccgcacacuuguuuuacccgggcgaaaccuggagugacgcggguaaucacugcgugacucaucaaugcgagaagcaccaggaugggcugguaguggucacaaccaaaaaggccuguccuccacucuccugcucucuggacgaagcuagaaugagcaaagauggauguugcagguucugucccccucccccaccgcccuaucagaaccagucaacgugcgccguguaccaucggucccuuauuauccaacagcagggcuguaguagcucugagccuguuagacucgcauauugccgcgguaacuguggcgacucauccagcauguacucucuggaggggaauacugucgaacaccgaugccaguguugccaagaguugaggacaagucugcggaacgugaccuuacauugcaccgauggaucguccagagcuuuuagcuauacugaaguggaggaauguggcugcauggggcgucgcuguccagcccccggagacacacagcacucagaggaggcggaaccugagccaucucaggaagccgagagcggcuccugggagagggguguacccgucaguccuaugcacuga

SEQ ID NO: 59339 - RNA, 17289 nt, Artificial Sequence
  derived and/or modified sequence opt3 from MUC5B__Homo_sapiens__NP_002449
augggcgcccccagcgcuugcagaacccuggugcucgcucuugccgcgaugcuggucguuccucaggcugagacccaggggccaguggaaccguccugggagaacgccgggcacacuauggacgguggcgcccccacgucuucaccuaccaggcggguaaguuucgugccacccgucaccguguuuccuagcuuguccccauuaaaucccgcccauaacgggcgcguuugcucuacuuggggcgauuuccacuacaagaccuuugacggcgauguguuccgauuuccuggucugugcaauuaugucuucucggaacauugccgugcugccuacgaggacuuuaacgugcaguugagaagggggcucguagggucacggccaguugugacccgcgucgugaucaaagcccagggccuggugcuugaagcuagcaauggcaguguccugauuaacgggcagagagaggaguugccguauuccaggaccggacuccugguugaacaaucuggugauuacaucaaggugagcauccggcugguacucacuuucuuauggaauggcgaggacuccgcccugcuugaauuggaucccaaauaugcgaaccagacaugcgggcuguguggagacuuuaauggccuaccugcuuucaacgaguuuuacgcccacaaugcucgccucaccccacugcaguucgguaaccuucagaagcuggaugggcccacggagcaaugcccugacccauugccccucccggccggaaauuguacugaugaagagggcauuugccaucgaacccuguuaggcccugcauuugcugaaugucacgcccugguggacucaacagcguaucucgccgcaugcgcucaggaucuuuguagaugccccacuugcccaugugccaccuucgucgaguacaguaggcagugcgcucacgccgggggacagccucggaacuggcguugucccgaacugugcccacgcacaugucccuugaauaugcaacaucaggagugcgguagcccuuguaccgacacgugcucuaacccacagagagcacaacuaugugaggaccacugcguggauggcuguuucugcccgcccgggacuguucuggacgauaucacacauuccggaugccucccucugggccaguguccaugcacccacggugggaggacuuacucacccggcacuagcuuuaacaccacguguaguucuugcaccuguuccggaggccuuuggcagugccaggaccugccuuguccagggacaugcagcgugcaaggaggugcccacauuucgacuuaugaugaaaaauuguacgaccuccauggcgauuguucuuauguccuguccaagaagugcgcugacucaaguuucaccguguuagcggagcugcggaaaugugggcuaacagauaaugaaaacugccucaaggcaguaacucugagccuugacggaggcgauaccgccauccgaguucaggcugacggugggguguuucuaaauuccauauacacacagcugccccucucugccgcaaacaucacccuguucacuccgagcucauuuuucauugucgugcagacgggccuuggacugcaauugcucguccagcuggugccuuuaaugcagguuuuugugcgccuggacccagcccaccagggccaaaugugcgggcuauguggaaauuucaaccagaaucaggcugaugacuuuacagcccucagugguguagucgaggcaaccggcgcggcuuucgccaacacuuggaaagcacaggccgcuugcgccaaugcaagaaacuccuuugaagaucccuguagccugucuguggagaaugagaacuaugcuaggcauuggugcucacggcuuaccgacccuaauagugccuucagccgcugucacuccaucauuaaccccaagccauuucauucuaauugcauguucgauacauguaacugcgaaagaucggaggacuguuugugcgcggcccugagcuccuacguucacgcuugugcagccaaaggggugcaacucucagauuggagggacggagucugcaccaaguauaugcagaacugcccuaagagucagcguuacgcuuacgugguagaugccugucaacccacuugccggggccugucugaagcagacgugacauguagcguuuccuucgucccaguggaugguugcacguguccggcggggaccuuuuuaaaugacgccggcgcuugcgugccugcccaggagugucccugcuaugcacacggaacuguccuggcuccaggcgaaguugugcaugaugagggggccguguguucaugcacaggaggcaaacuuagcuguuugggugcaucucuccagaaguccaccgggugcgccgcucccaugguauaccuggacugcaguaacagcucugcgggaacaccuggcgccgagugucuacgauccugccacacucuggacgucgguuguuucucaacccauugcgugaguggcuguguuugcccacccgggcucgugagcgauggaucgggcggguguaucgcagaagaggacugcccuuguguccacaaugaagcuacguauaaaccgggagagaccauaagaguggauugcaacacauguacuugcaggaaucgccggugggagugcucccacagacugugucuuggaaccugcguugccuacggugacgggcauuuuauuacauucgauggagacagguauucuuuugaaggcagcugugaguacaucuuggcccaggauuauugcggugacaacacuacccacggcacguuccgcauugugacagaaaauaucccaugugggaccacuggaacaaccugcucaaaggcuaucaaacuguuuguagagaguuacgaauuaauucuccaagagggcacuuucaaggcagucgcccgagggcccggaggcgauccuccauacaaaauacgguauauggguaucuuucuggugauugagacccaugggauggcgguguccugggaccguaagacaucugucuucaucagacuucaccaggauuacaagggaaggguuuguggccugugcgguaacuuugacgauaaugcuauaaacgacuucgccacgcgcagccgguccgugguaggcgacgcauuggaauuuggaaauucauggaaacucagccccaguuguccugaugcccuggcuccgaaggaccccugcaccgcaaacccauucagaaaaucuugggcccagaagcaguguuccauucuacauggaccuacuuucgcggcuugcaggagccaaguggauucgacaaaauauuacgaggccugugucaaugacgcaugcgccugcgauucaggcggggacugugaaugcuuuuguaccgcuguggccgcauaugcucaggccugccacgaugcgggacuguguguuucuuggcgaacacccgacacuugcccacucuucugugauuuuuacaacccucacggcgguugcgaguggcauuaucagcccuguggggccccaugccugaagaccugucgcaauccgaguggacacugccuuguggacuugccuggccuggaaggcugcuaccccaaguguccacccucccagccuuucuuuaacgaggaucaaaugaaaugcgucgcacagugugggugcuacgacaaggacggaaacuauuacgaugugggugcucggguuccaacggccgagaauugucagagcugcaacuguacacccucuggcauccaaugcgcucauagcuuagaagcauguaccugcacuuaugaggacagaaccuacuccuaucaggaugugaucuacaauacaacugacgggcucggagccugucugauugccaucugcggcucaaacgguaccauuauaaggaaagcugucgcgugcccugggacaccggcaacgaccccauucacuuuuacaaccgccuggguaccccacaguacuacaagcccugcacuucccgugucuaccguuugugugcgugaagucugccgcugguccucaugguauaauggacaucggccagagccuggccugggcgggggagauuucgaaacguuugagaaccuaagacagagggguuaccaggugugucccguacucgccgacaucgagugccgagcagcccaacugccagauaugccuuuggaggaacugggccaacagguggacugugaucggaugcgcggguuaaugugcgcuaauagucagcaaagcccgccccucugucacgacuacgaacugagaguccuuugcugugaguauguuccaugcggaccuucccccgcgccaggcacuucuccucagcccucgcugagcgccucaaccgagccggcagugccaacaccuacccagacuacagcuaccgaaaagacaacuuugugggugacccccuccauuaggaguacggccgcacucacaucucagaccgguagcuccucagggccagucacugugacccccucugccccuggaacaacuaccugucaaccgcggugccaguggacggagugguucgaugaagacuaccccaaaagcgagcagcugggcggcgauguugaaaguuaugacaagauccgagcugccgggggacaccuaugccagcaaccaaaggacaucgagugucaggcggaguccuuuccuaacuggacacuggcacagguaggucaaaaagugcauugcgauguccacuucggccuuguguguagaaauugggaacaggaggggguuuucaagaugugcuacaacuaucgcauuagggugcucuguugcagcgacgaucauugucguggacgggccaccacucccccuccaacaaccgaacuggagacugcuacaaccacgacuacccaggccuuguuuucuacaccccagccuaccucauccccaggccugacaagagcucccccggcaaguacuaccgccgucccuacguuaagcgaaggucucacaucgccaagguacacuucuacccuggggacagcuaccacuggaggccccaccacuccugccggcuccacggagccaacugugcccgggguagcaaccagcacacuuccgacccgcucagcgcugccuggaacuacagguaguuugggcaccuggcgacccucucaaccaccuacgcucgcccccacuacaauggcuaccuccagagcccggccaaccgggacugcaagcacagcuucaaaagagccccugaccacaagucuagccccuacucugacgagcgaacuuuccaccucucaggcagagacaagcacuccaaggaccgaaacaaccauguccccgcucacuaauacgaccacaucacagggaacuacccgcugccagcccaagugugaguggacagaaugguucgacgucgauuuuccuaccucuggcguggccgguggggacauggagacuuucgagaacauacgugcugcgggaggcaaaaugugcugggccccaaagaguaucgaauguagagcagagaauuaucccgaaguuucgauugaucaagugggccagguccugacaugcagcuuggagacgggguuaaccugcaagaacgaggaccagacuggacgguuuaauauguguuucaacuacaacgugaggguucugugcugugaugacuacucccacugcccuucuacaccagcuaccucaagcaccgccacacccuccaguacuccugguacgaccuggauccucacaaaaccgacuaccacagccaccacuacggcaucuacaggcagcaccgcuacuccaaccucaacacugcgcacugcacccccucccaaggugcuuaccacaacggcgaccacuccaacagucaccuccaguaaagcuacuccuaguucuucccccgggacagccaccgcacugccagccuugcgaucaacggcuaccacaccgacugcaaccagcgugacaccuauucccucgucuagucuaggaacuaccuggacaagacugucccagaccacuacgccaacagccaccaugagcacugcgacccccucauccacaccugaaacggcucacaccucuacuguacucacagccaccgcaacuacaaccggcgccacagguagcguggcuacuccaaguuccacccccgggacggcccauaccacaaagguuccuacuaccacaacuaccggcuuuacggcaacaccgaguucuucaccaggaaccgcucugacucccccugucuggaucaguacaaccacuaccccaacaacgcggggcuccaccgugacucccagcucuauaccugggacaacccacacugccacagugcuuaccacgacaaccacuaccgucgcgacaggaucgauggccacucccucaagcuccacccaaacaagugguacgccaccgucuuuaacuaccacagcaaccacuaucacagcuaccggcagcacgacuaauccuuccucaacccccgggacaaccccaauuccucccguacugacuacaaccgccacaacuccagcagcuaccaguaacacggugacaccuucuagcgcccucggaaccacucauacacccccgguuccaaauacaauggccacuacgcacggcagguccuugccucccucaagcccacauaccgugcgcacagcguggaccucugcuacuuccgguauccuggggacaacccacauuacugagcccaguacagucaccagccacacgcucgcagccacuaccggcacaacccagcauucgacuccugcucuguccucuccgcacccaucaagcagaacaaccgaaagucccccuucccccggaacgacaacuccaggccauaccacagccaccucuaggacuacggcaaccgccacaccuagcaaaacucggaccucaacacuucugcccuccaguccaaccagcgcuccuaucacuacagugguuaccauggggugugagccgcagugcgcguggucugaaugguuggauuauucauaccccaugccaggaccuuccgguggcgacuucgauacguauagcaacauacgugccgcagggggagcugugugugagcaaccccuaggccuggagugccgcgcccaggcacagccaggugucccucuccgagaauuaggacaggugguagaguguucucuggacuuuggccuugugugcagaaauagggaacaaguuggaaaguucaaaauguguuuuaacuacgagauucgggucuucugcugcaauuauggccacugucccaguacuccggccacaucguccaccgcuaugccaagcucaacuccugggaccacauggauccugaccgaacucacgacaacugccaccacaacugagucuaccggaagcacagcgacccccuccaguacuccaggcacgaccuggauuuugacagagcccucaacuaccgcaacagugaccgugccuacugguucuacagccacggcuagcuccacccaggccacugcagggacaccccacgucaguaccaccgcuacuacaccaacgguuaccagcuccaaggccacaccuuuuucuucaccgggaacugcuaccgcccugcccgcacuccgcagcacagcgacuaccccaacggccacaucguucaccgcuaucccuuccaguucucugggcacuaccuggacaagacuuagccagacuaccacacccacggccaccaugucaacugcaacaccauccucuaccccugaaacugugcauacaaguaccguacuaacgaccacagcuacuaccacaggugccacuggcagcguggcaacccccuccucaacaccggggacggcccacaccacuaagguccugacaaccacuaccacaggauucacggcgaccccuagcucuaguccaggcacugcuaggacauugcccguguggauauccaccacuacaaccccuacuacacgggggagcaccguuacgccaucaucuauccccggaaccacacauacuccuaccguguuaacaacuaccacgacaaccgucgccacuggcuccauggcaacaccaucgagcaguacccagacuucugguacacccccgucccugacaacgaccgccacuacaauuaccgcuacugggagcacaaccaacccuucaaguacgcccggaacaaccccaauacccccuguacucacuaccacagccacuaccccagcagcuacauccagcacggugacucccucuucagcccugggcaccacacacaccccuccaguuccgaauacuacagcgaccacgcauggucgaagccuuucccccucuaguccucacacugugagaaccgcuuggacaucggccaccagcggcacucuggggacaacccacauuacggagccauccacaggaacuucacauacccccgcagccacaaccggcacuacccaacacucuacuccugcucucagcaguccacaucccuccucacgcacaacggaaucuccgccuagcccagggaccacaacucccggacacaccagggcaacaucccggaccacugccacggcgacaccuaguaaaacccguacuagcaccuugcugcccucuucaccaacauccgccccgaucaccacugucgugacaaugggcugcgagccucagugugcuuggagcgaauggcuagacuacaguuaucccaugccaggucccucugggggagauuuugacaccuacuccaacauaagagcagccggcggcgcugucugcgagcagccucuggggcucgaguguagggcccaggcacaaccaggagugccccuucgcgaacugggucagguuguggagugcucguuagauuucggcuugguaugucggaaucgagaacagguggggaaguuuaaaaugugcuucaacuacgagauuagagucuuuuguugcaauuauggacacuguccuagcacgccagcuacaucauccacugccaccccgucuaguacacccggcaccacuuggauccugacggagcagaccacagcggccacuaccacagcaaccacugguagcacagcuaucccuucauccaccccagggacggcacccccuccaaagguucucacuagcacagcaaccacucccaccgccacaucuaguaaagcuaccuccagcucaucuccuaggacggccacaacucugccggugcuuaccucgacagcgacuaagagcaccgcuacauccuucacccccauuccaaguuuuacucugggaacgaccggcacacucccugaacaaacuaccacacccauggcaaccaugucuacuauccauccaucaagcacgccugagacaacccacacuuccacagucuugaccacuaaggccaccacaacgcgcgcuaccaguucuaugagcacacccuccucaacuccaggcaccacauggauucugacugaauuaaccacggccgcaacaaccacugccgcuaccgggccgacagcgacuccuagcucuacccccggaacaacguggauacuaaccgagccauccacuacagccaccgugacuguacccacagguaguaccgcaacggccucaagcacccgggcuacagcaggcacucugaaagugcucaccucgacagccacuaccccuacaguuaucuccucuagagcuacgccaaguagcucacccgggaccgccacugcgcuuccugcacugcguuccacagccaccacuccgaccgcuacaucugugacggccauucccagcaguuccuugggaacugcauggaccaggcugagccagacaaccacuccaacagcuaccaugucuacggccacuccuucauccacacccgaaaccguccauaccagcacagugcucacuaccacaacuaccacgacacgggcgaccggcagugucgccacuccaucuucaacaccugguaccgcucacacuaccaaggugcccacaacgaccacuacaggguucaccgcaacuccauccagcucgccgggaacagcccugaccccucccguuuggaucucuacgacaacuaccccaaccacacgcggcaguacuguaaccccuuccagcauucccggcacgacacauacugcuaccgugcuuacaaccacuacaaccacggucgcaacugggucaauggccaccccaucuagcuccacacagaccaguggaacuccucccucacucacaaccacggcuacuacaaucaccgccacagguagcaccacuaacccguccucuaccccaggcacaacucccauaccuccagugcugacgaccacagcaacuacccccgccgcgacaaguagcaccguuacuccuuccucagcuuuggggacgacacacaccccgcccgugccaaauacuaccgccacaacccacggacgaucucugccucccucgagcccacauacugucagaacagcauggacguccgccaccaguggcaucuuagguacaacucacauuaccgagccuucuacagugaccagccauacucccgcugccacgaccucaacaacucaacacuccaccccagcacuaagcucuccucaucccaguuccaggacaacugagucaccgccuagcccagggaccacaacccccggacacacgcggggcacuucucgcacaaccgcuacugccaccccuucgaaaacaagaacguccacccugcucccaaguagccccacuucagcgccgaucacaaccguagugacaacuggcugcgaaccucagugcgcauggucugaguggcuugacuacuccuaucccaugccagggcccagcggaggugauuuugacaccuacaguaacauuagggccgcuggcggggccguuugugaacagccucugggauuggagugccgagcucaggcacaaccaggcgucccccugcgggaacucggucaggugguggaguguucacuggauuucgggcuugucugccguaauagagagcagguuggaaaguuuaaaauguguuucaacuaugaaauccgcguguuuugcuguaacuacggccacugcccuuccacaccagccaccagcucuacugcgacgccgaguagcacccccggcacaacuuggauauuaaccaagcugacaacgaccgccacuacaaccgaguccacugggucuacagcuaccccuucaagcacuccaggaaccacauggauucucacggaacccuccaccacagcaacuguaaccgugccuacagguucgacugccaccgcuucuaguacgcaggccacagcaggcaccccacaugucagcacuaccgccacaacucccaccgugacaucauccaaggcuacgccguucucuagcccugggaccgcgacugccuugccagcacugagguccacagcuaccacucccacagccaccaguuucacggcaaucccuucaagcucucuaggaaccacuuggacacggcugucccaaaccacaacucccaccgccacgaugaguacagcuaccccaagcucaacuccugagacagcgcacaccucuacuguucucaccacaacggccacuaccacaagagcaaccggcuccguggcuacucccucgagcacaccagguaccgcccauacgacuaaagucccgacaaccaccacaacuggguuuaccgugacacccaguuccucuccuggaacugcccgcaccccacccguauggaucucaacgacaaccacuccuacaaccagcggcuccacuguuacgccaucuagcgugcccggcaccacacacacuccuaccguccuuacaaccacuacaaccacgguggcuacugggaguauggcaacaccgucauccagcacccagaccucuggaacaccacccagucugauuacuaccgccacgacaauaacugcuaccgguuccacaaccaauccuagcucaacuccaggcacaacccccaucccucccguguugacgacuaccgcgacaaccccagccgcaacuucgucuacagucaccccgagcuccgcccuggggacgacucacacaccucccguuccaaacaccacagcuacuacccauggaaggagucucucaccuucuagcccccacaccgugcgaacagcauggacuuccgccacgaguggcacccuggguacaacucauauuaccgaaccaagcacagggaccucucacacuccggcugccacgacaggcaccacucagcauuccaccccugcauuaucaagcccccacccaucgucccggacaaccgagucucccccuaguccaggaacuacaacgcccggccacaccacugcgacaucaagaaccacagccaccgcuacuccuagcaagacgaggaccuccacacuucugccgucuagcccaacaagcgcccccaucaccacaguagugacuaccgggugugagccucagugcgcauggucagaauggcucgacuauuccuaccccaugccaggaccuagcgguggcgauuucgacacauacucuaauauucgcgcugccgggggagcggucugugagcaaccccuaggccuggaaugccgugcccaggcucagccaggugugccuuugggggagcugggccaaguuguggagugcucccucgauuuuggacuugucugucggaacagagaacaggugggcaaauucaagaugugcuuuaauuaugagaucaggguauucuguugcaacuacgggcauuguccgaguacgcccgcaaccagcucaacugccaugccaucuuccacaccuggaaccacuuggauacugaccgaauugacaacgaccgcuacuacaaccgcaagcacagguucgacugccacccccaguucuacgccaggcacagccccucccccgaaaguucugaccucaccagcuacuacccccacagcaacuuccagcaaggccaccucuagcuccaguccucgcacagcgacgacccucccaguguuaacuucaacagcuaccaagagcacugccacauccgucacccccaucccuucuaguacgcuggggacuaccggaacacuucccgagcagaccacuacaccaguggcaaccaugucaacaauucacccuagcuccacuccggaaaccacgcauacaucuaccguucugacuaccaaagccacaacuacccgagcuacaucgagcacguccacccccaguucaacuccaggcacaaccuggauccuaacugagcucacaaccgccgcaacgaccacugcugccacagguccuaccgcgacacccucuagcacuccaggcaccacguggauucugacagaguugacuaccacagcaaccacuaccgccuccacagggaguacggcuacuccuucuagcacccccggaacaaccuggauccugacugaaccgucaacaaccgccacggugacugucccaacaggcuccaccgcuaccgcaagcucuacacaggccacugcggggaccccucacgugucaacaacugccacgacccccacaguaaccaguuccaaggcuacuccaagcucgucuccuggaacagcaaccgcccuccccgcacuucgguccacugccacgaccccgacagcaacuagcuuuaccgccauaccuucaaguucucugggcacaaccuggacuagauuaucccaaacaaccacgcccacugcuacaaugagcaccgcgaccccaucaaguacacccgagacugugcacacguccaccguccugacagccacugcaaccacaaccggugcuacugggagcguugccacaccuucuucgaccccaggaacggcacauacuaccaaagugcccacaacuaccacaaccggcuucacggccacuccuagcuccucaccagguacagcuuugacacccccggucuggauuucuacuacaaccacgccuaccacaacuaccccaacaacaagcggcagcaccgugacacccuccucuaucccugggaccacucacacggcgaggguacucacaaccacuaccacaaccguggccacuggaucaauggcaacaccaagcaguuccacgcagaccucuggcacucccccuagccugacaaccacagcuacuaccaucacggccaccggguccacaacuaauccaucaaguacccccggaacaacuccgauuaccccuguucuaacgagcacagccaccacuccagcugcaacaucuuccaaggccaccucgagcucaaguccccgcacugcgaccacacuuccugugcugacguccaccgcuacuaaaucuacagccaccagcuuuacacccaucccaucauccacucucuggaccacguggacagucccggcacagaccacuacccccaugucuacaaugagcacuauacauaccaguuccacaccugaaacgacccacacuagcacagugcugaccacuacagccaccaugacgagagcuacuaacucuaccgcaacaccaucaaguaccuugggcacuacacggauucugaccgagcucacaacuaccgccacgacaaccgcugccacugguuccaccgcgacacuuagcucuacucccgggaccacguggauccugacagaaccuucgaccauugcaacuguuauggucccaacaggaucaaccgccacugcuagcuccacauuaggcaccgcccauacgcccaagguggugacuaccauggcaacaaugccuaccgcuacagccaguacuguaccaucuagcuccaccgucgguacgacaaggacuccggcggugcugcccucaaguuugccuaccuucagcguuucuacaguguccagcucaguccucaccacucugcguccaaccggcuuucccucuucccacuucaguacaccuugcuuuugucgagccuucgggcaguucuuuagcccaggagaggugaucuauaauaaaacggaccgcgcaggcugccacuucuacgcuguuuguaaccaacauugcgacauagauagauuucagggggccugucccacuucgccgccucccguguccucugcuccacuaucaagcccuagucccgcaccaggaugcgacaaugccauuccucuucggcagguaaacgagaccuggacacuggaaaauugcaccgucgccaggugugugggcgauaaccgcgugguucuccuggaccccaagccggucgcuaaugugacuugcguaaacaagcacuugccaaucaaaguguccgaucccucucagccuugugacuuccauuaugagugcgaauguaucugcagcauguggggugggucacacuacaguacauuugauggaaccuccuauacguucagaggcaacuguacuuacgucuuaaugcgggagauucaugcaagguuuggcaaucugagccucuaccuugacaaccacuauugcacagccucugcgaccgcugccgcagcccgauguccacgugcucuguccauccacuacaagucaauggauauugugcuaaccguuacuauggugcaugggaaagaagagggacugauacucuucgaccaaauccccgucagcagugguuuuucuaagaauggcguguugguuucggugcuggggacaaccacaaugagaguagauauuccugcccuuggagucuccgugacuuucaacggccagguuuuucaggcacgccugccauauagccucuuccacaauaacacggagggucaaugcgggaccuguacaaauaaccagcgggacgauugcuuacagagggacggaacuaccgcugccucaugcaaagacauggcgaagacauggcuggugcccgauucuagaaaggacggcuguugggcaccuaccggcacuccgcccacggccaguccagcugccccugucagcuccacccccacaccaacuccuugucccccgcagccauugugugaucugaugcucucacaaguguuugcagaaugccauaaucuuguaccucccgggccauucuucaacgcuuguaucagcgaccacugccgcggacggcuggaggugccuugucagucccuagaagccuacgcggagcugugcagggcccgaggugucuguucugauuggagaggcgcuaccgggggacucugcgacuugacaugucccccaaccaaaguuuauaagccgugcggccccauccagccugcaacuugcaauagucggaaccagagcccacaacuggaggguauggccgaaggguguuuuugccccgaggaucagauucuuuucaaugcucacaugggaauaugugugcaggccugcccuugugugggccccgacggcuuuccaaaauucccuggggaaaggugggucuccaacugccagucuugugugugcgaugagggaucaguuucgguacaauguaagccgcugcccugcgacgcacagggucagccaccucccuguaaucgcccaggcuuugugacagucacgcguccuagagccgaaaaccccugcugcccagagaccguguguguuugcaacacuacaaccuguccucagagcuuaccggugugucccccagggcaagagaguaucuguacccaggaagagggagauugcuguccuacauuccgaugcaggccccagcucuguuccuacaauggcacuuuuuauggugucggggcuacguucccaggagcgcugccuugccauauguguaccugcuugucuggcgacacacaagaccccacugugcagugucaggaagaugccugcaacaauaccacaugcccgcagggcuuugaguacaaacggguagcagggcaauguugcggagaaugugugcagaccgcuugccugacucccgacggucagccaguccagcucaacgagacguggguuaauagccacguggauaacuguacagucuaccuuugcgaggccgaaggcggggugcaucugcuaaccccucaacccgcaucauguccugacguuuccaguugccgcggaucucugagaaagacuggcuguugcuauagcugugaggaagauuccugccaggugaggauuaauaccacaauccucuggcaccaggguugcgagacugaaguaaacauuaccuucugugaggggucaugcccaggagccagcaaguacucugcugaggcgcaggccaugcaacaucaguguacaugcugucaggaacggcgcgugcacgaggaaacgguccccuugcacugcccuaauggcagugcaauccugcauaccuauacucacguggacgaguguggcugcacaccauuuuguguuccggcucccauggccccuccacauaccagaggguuccccgcccaagaggcaacugcugucuga

SEQ ID NO: 59340 - RNA, 7320 nt, Artificial Sequence
  derived and/or modified sequence opt3 from MUC6__Homo_sapiens__NP_005952
auggugcagagauggcugcuccuuagcugcuguggcgcccuguuguccgcuggguuagcaaacaccucuuacacaucacccggacugcaaaggcuaaaggacaguccucagacugccccagauaaaggucagugcagcacguggggcgcggggcacuucuccaccuuugaccaucacgucuaugauuucucuggaacauguaauuacaucuuugcugccacuugcaaggacgcauucccgaccuuuucgguucagcuccggcgcggccccgaugguucaauuagccgaauaaucguggagcugggggccaguguagugacagucuccgaagcuauuaucucugugaaagacauuggaguuaucagccuuccuuauaccuccaacggccugcaaauaacuccauucggccagucagugcguuuggucgcaaagcagcucgagcuggaacuggaggugguaugggggcccgauagucaucucaugguuuuaguggaaagaaaauacaugggacagauguguggucugugcggcaauuuugacgggaaggucacaaacgaguucgugagcgaggaaggaaaguuucuugagccucacaaauucgccgcuuugcaaaagcuggaugacccaggcgaaaucuguaccuuucaggauauucccucuacgcaugugaggcaggcccagcacgcgcggaucugcacucaacuacucacccuggucgcaccugaguguuccguuucaaaagagccauucgugcuuagcugccaggccgacguagcugccgcaccgcagcccgguccucaaaauaguucuugugcuacacuguccgaauauagccgccagugcucgaugguggggcagccagucagaagguggcggucucccggauugugcuccgugggccaguguccugccaaccaaguuuaccaggagugcggcucagcgugugugaagacuugcaguaauccacagcacagcuguuccucuagcugcaccuuuggguguuucugccccgaaggaacaguccucaacgaucugucaaauaaccauaccugugugccgguaacgcagugcccuuguguuuuacacggugccauguaugcacccggcgaggugacuauugcugccugccaaacaugccgcuguacccuggggcgaugggucugcacugaaagaccauguccuggacauugcagucucgagggcgguuccuucgugacaaccuuugacgcuaggcccuaccgguuccacgggacguguaccuacauccuucugcagagcccacaguugcccgaggacggcgcccuaauggcagucuaugauaaaucuggagugucacacagugaaacaagccugguugccgugguauaccucucccgucaggacaagauagucauuucucaagaugaggugguuacuaauaacggcgaagcuaaguggcugccuuauaaaacccgcaauaucacaguguuuagacagacuucgacccaucuucagauggcgacaagcuucgggcuggaguuggucgugcagcucaggccaauuuuucaagcauacguaaccgugggaccgcaguuccggggucagacucgaggccugugcgggaacuuuaauggagacacgacagaugacuucaccacuuccaugggcaucgccgaagguaccgcuucauuauuuguugauaguuggcgcgccgggaacugucccgcagcccuggagagagagacagacccuugcucuaugagccaacuaaacaaggucugugcugaaacccacugcuccaugcuccugaggacuggcacaguguucgagcggugucaugccacggugaauccagcacccuuuuauaaacgcugcgucuaccaggcgugcaacuaugaagagaccuucccucacaucugugcugcccuuggagauuacguucaugcaugcucauugagaggcgugcugcucuggggguggaggagcucuguggacaauuguacuauuccaugcacaggaaacaccacauuuuccuacaauagucaggccugugaacguacuugccugagccuuucugaucgggcuaccgagugucaccacuccgccguacccgucgacgguugcaacuguccggacggcacguaucugaaucagaagggggagugcgugcgaaaagcacaauguccuugcauauuggaaggauacaaguucauccucgcugagcagucaaccguuauuaacggcaucacaugccauuguauaaaugguagacugaguugcccacagaggccccagauguucuuagccagcugucaagcgccuaaaacuuuuaagucgugcucccagucuagcgaaaacaaguucggggccgcuugugcacccaccugccagaugcuggccacaggcguggcuugugucccaacuaaaugcgagccuggaugugugugcgccgagggccuauaugaaaaugcagaugggcaguguguucccccagaggaaugcccgugcgaguuuucaggagugaguuacccuggcggugcggaacuccacaccgacugucgcacgugcuccuguucucgggggagaugggccugccaacagggaacacauugucccagcaccugcacucuguauggcgagggucacguaauuacauucgauggccagagguuugucuucgacgggaacugugaguacauccuugcuaccgaugugugcggagugaaugacucccaaccaacuuuuaagaucuugaccgaaaacgucauuuguggcaauucagggguuacaugcagccgcgccaucaaaauuuuccugggaggccucagugugguacuggcagaucgaaacuauacggugaccggugaggaaccccacguccaguuaggggugacuccuggagcucugucucuuguuguggacauauccaucccaggccgguacaacuugacacucauuuggaaucgucauaugaccauccugaucagaauugccagggcaagccaggauccccuauguggucugugcggcaacuuuaaugggaacaugaaggacgauuucgagacacgcucgcgguacgucgccucaucugaacucgagcuggugaauaguuggaaagaguccccucuuugcggagacguuagcuuugugacugauccguguucuuugaacgcuuucagaaggagcugggcggaacgaaagugcuccgucauaaauucacagaccuuugccacgugucacaguaagguauaucaucugccauacuaugaggcaugcgugcgcgacgcuuguggcugcgacagcgggggagauugugaaugcuuaugugacgccguugccgcuuacgcacaagccugccucgauaaaggcgugugugucgacuggcggacacccgcguucugcccuaucuauugugguuucuacaacacccacacucaggaugggcauggagaguaucaguacacccaggaagcuaauugcacauggcacuaccaaccaugccugugucccucucagccucaguccgugccgggcucaaacauugaggguugcuauaauuguagucaggacgaguacuuugaucacgaagagggcguaugcgugcccuguaugccaccuacuaccccccaaccaccuacaacgccccagcuuccaaccacugggagcagaccgacacaggucuggccuaugaccggaacuuccacaaccaucggccuguugucuucgacggggcccagcccaucauccaaccauacucccgccaguccuacccagacaccacuccugcccgcaacccuaacuucuagcaagccuacagccuccucaggagaaccgccaaggcccaccacagcuguuacuccucaagcaaccucuggccugcccccaacggccacacuccguagcaccgcgacuaaaccuaccgugacacaggcuacuacccgcgccacggcaaguacagccucccccgcuaccacuagcacagcccagucuaccacucggacaaccaugacgcugccaacuccugcaaccucagguacauccccgacccuucccaagaguacaaaucaagaguugccagggacuaccgcuacgcagacaacuggaccuagacccaccccagccagcacaaccggcccuacuaccccccagccgggccagccaacaaggccuacggcgacugagaccacacaaacccgaacuacaaccgaauauacgacuccccagacaccacacaccacccauucgcccccuacugccgggucuccggugcccuccacaggaccagucaccgcaacaagcuuccacgcuacuacgaccuacccuacacccucacauccugagacuacccugccaacacacgugcccccuuuuaguaccucuuuaguuacuccauccacgcacaccguaauuacacccacucaugcccagauggcuaccagcgcaucaaaccacagugccccgacagguaccaucccuccacccacuacacucaaagccacgggcagcacccauacugcuccuccaauaacacccaccaccuccgggacaucucaggcgcacagcuccuucucaacuaauaagacgccgaccucucugcacagucauacaucgagcacucaccauccugaagugacccccacauccaccacuacgaucacaccaaacccuaccucuacucggacccgcacacccgucgcacacacuaacucagccaccagcuccagaccacccccuccauuuacaacgcauaguccgcccaccggaucuagcccuuucucauccacuggcccaaugacagcuaccaguuuuaagacuacaaccacguaucccaccccuagccacccacaaacaacucuucccacccacgugccuccguucucuacaucccugguuacuccaucaacccauacagugauuacccccacucacgcccagauggcaacgagcgccucgauccauucuaugccuacagguaccauucccccaccuacuacccuaaaagcuacagggaguacgcacaccgcgcccacuaugacacucaccacuuccggaacaagccaggcccugucauccuugaauaccgcaaagacaucuacuagccugcacagucauaccuccagcacgcaccaugcugaggccaccucuacaucaacuaccaacaucacaccaaauccgacuaguaccggcacgccucccaugacagucaccacuuccggcacaagccagucuaggucgucauuuagcaccgcaaaaacuuccaccaguuuacacucucauacaagcuccacgcaccacccagaagugaccucaacuaguacaaccucuauaacucccaaccauacaagcaccgggacgcggacaccuguagcccacaccacuuccgcuaccucaagccgacucccaacacccuucacuacccauucuccuccgacaggaacgacuccaauuuccaguaccggucccgucacagccaccagcuuucaaacuacaaccacguacccuacuccaucgcacccccacaccacacugccuacccaugugcccuccuucucuacuucacuuguuacaccaagcacccacacagugaucauuccgacucauacccagauggcgacgagugcauccauccacucuaugccuacaggcaccauacccccaccuacuaccaucaaggccacagggagcacucauacggcucccccaaugaccccuacaaccucaggaacuucccagagucccagcucuuucucaacagccaaaaccuccacuagccugccguaucacacaucuaguacccaccauccagaggucacgccuacuucgaccacaaauauuacccccaagcacacuuccacaggcaccagaacgccaguggcucauacaacuagcgcaucaucuagccgcuugcccaccccuuuuacaacccacuccccgccaacugguaguucacccuucucuagcacggggccuaugaccgccacauccuuucaaacuaccacaaccuaccccacuccaagucauccucagacaacccuccccacgcacguuccaccuuucagcacuucccuggugacaccgucuacccacacugucaucauuaccacacauacccagauggcuacgucagccagcauccacucgacacccacuggaaccgugccaccucccacaacucuaaaggcaaccggcuccacacauaccgcgccaccuaugacuguaacgaccaguggcacaucucagacucacagcucauuuuccaccgccacagcuucuaguagcuucauauccucaagcucuuggcugccccaaaacaguuccagcaggccgccaucaucuccuauuaccacucagcuuccccaccucuccucggccacaacgccagugagcaccacuaaucagcugaguucuuccuuuagccccucaccuagugcacccuccacaguuagcucuuacgucccaucaagccauuccucuccucagaccaguucgccgagcguggggaccuccucaucuuucgugagcgcucccguccacaguacuacauuguccucaggaucucauagcucccugaguacgcacccaaccacagccagcguaucugcaucaccuuuauuucccuccagcccagccgcuaguacuaccauccgugcgacacucccucauacuaucucuucccccuucacccugucggcccuucugccgauuagcacggugacaguuucaccuaccccauccucucacuuggcaaguagcacuaucgcuuuucccucaaccccucggacaacugccuccacccacacagccccagcauucagcucucaaaguacgaccuccagaagcacuucacucacaaccagggugcccacuucugguuuugucucgcugacaagcggcgugaccgggauuccuacguccccaguuaccaaccuaacaacucgccaucccggaccgacccugaguccuacaacucgauuccuuaccucuucacucacagcucacggcagcacgcccgccuccgcgccagugaguucucuggguacccccacuccuacaagcccaggggucugcuccgugagagagcagcaggaagagauaaccuucaaaggauguauggcuaauguaacugugacccggugcgaaggcgccuguaucucagcagccagcuuuaacauuaucacacagcaaguugacgcuaggugcucuuguugccgccccuugcauuccuaugagcagcaguuagaacugccuugcccagauccgaguacgcccggccguagacucguccugacccuucagguguucucacacugugugugcagcucggucgcauguggggacuga

SEQ ID NO: 59341 - RNA, 1134 nt, Artificial Sequence
  derived and/or modified sequence opt3 from MUC7__Homo_sapiens__NP_001138479
augaagacccugccccucuucgugugcaucugugcccuuagcgcuugcuuuuccuucucugagggcagagaaagggaccacgagcugcggcaucgccgacaccaucaccagucaccuaaaagucauuuugaauugccacacuacccgggguuacuggcacaccaaaagcccuucauucguaaaagcuauaagugucuacauaaaagaugcaggccuaagcucccacccuccccuaacaauccacccaaguuuccuaacccacaccagccgcccaaacauccugauaaaaauucuucggucguuaacccaacacugguggccacuacgcagauacccucaguaaccuucccuagcgcgaguacaaagaucacuacccuuccaaaugugacauuucugccccagaacgcuaccacuauuuccucucgggagaaugucaacacaagcuccucaguggccaccuuggcaccgguuaauaguccugcuccccaagacacgacugccgcaccaccuacccccagcgccacaacuccagcucccccuucuuccucagccccaccggaaaccacagcggcacccccuaccccaagcgccacgacucaggcucccccuaguucuuccgccccacccgagacaaccgcagcuccgccuacuccacccgccacaaccccugcgcccccaagcucgucugccccucccgagacgaccgcagcuccaccgacaccuuccgccacuacccccgcuccacucucaaguagcgcacccccugaaacaacugccgugccacccaccccuuccgccacaacccuggauccgucuagcgcuucagcgccacccgagacuacggcagccccuccaacacccagugcuaccacuccugccccgcccuccagcccagcaccucaggaaaccacagccgcucccaucaccacuccaaacucuucaccuacaacgcuggcccccgacaccagugagacuagcgcagcgccaacacaccagaccacaacuuccgucaccacgcaaaccacaacuaccaagcagccgacaucugcuccuggacagaauaaaauuucgcgcuuccucuuauacaugaagaaccugcuuaauagaaucauagaugacaugguggagcaguga

SEQ ID NO: 59342 - RNA, 273 nt, Artificial Sequence
  derived and/or modified sequence opt3 from MUCL1__Homo_sapiens__XP_011536170
augaaguuccuggccgugcucguccuucugggcguuagcaucuuuuugguguccgcucagaaccccaccacagcagccccugcggacacuuacccagcuacggggccggccgaugacgaggcacccgaugccgaaaccacagcugcagccacuaccgcuacaaccgccgcgccuacuacagcaaccacggccgcuucuacuaccgccagaaaagacauuccaguauuacccaagugggugggagaucugccuaaugguagggucugcccauga

SEQ ID NO: 59343 - RNA, 2136 nt, Artificial Sequence
  derived and/or modified sequence opt3 from MUM1__Homo_sapiens__NP_116242
augauggccgacgcuaaguacgugcugugcagaugggagaaaaggcucuggcccgcaaagguccuugcccggaccgcgacaagcacuaaaaacaagcgccgaaaagaauauuuccuggcuguucagaucuuguccuuagaggaaaagauuaaggugaaaucuacggagguagaaauacuggagaagucacaaaucgaggccauugcaaguagccuagccucccagaaugaagugccugcugcaccacucgaggaacuggccuaccguagaucucuuagggucgcucuggauguguugucggagggcucaaucuggagccaggagaguuccgccgggaccggacgggcggaccgcucucucagagguaaaccgauggaacacguuagcucccccugugauucaaacaguagcucucugccuaggggcgacgugcugggguccucacggccacaucgccgaagacccugcguccagcaaagccucaguucuuccuuuacaugugagaaggauccugaaugcaaaguggaccacaagaagggauuaaggaaaagcgagaauccacggggcccccugguacuuccugccggugggggagcacaggaugaaucgggcucucguauucaucacaagaacuggacuuuggcuuccaaacgcggcgggaauagcgcccagaaggcaagucugugucuaaacggaagcucccucucugaggacgauaccgagagagacauggguagcaaaggcgggucaugggcugccccaagucugccguccggaguuagggaagaugaccccugcgcgaaugccgagggccaugauccuggucuuccacuggggagcuugacagcacccccugcuccagaacccucugccuguucagagccgggagaaugcccugcuaagaaacggccccgacucgacggcagucagcgcccuccagccgugcaacuggagcccauggcagccggcgcugcgccaagccccgggccuggaccagguccgagagaguccgucacccccaggucuacugcacgguuaggcccuccacccucgcacgccagcgcugacgccacacgcugucugccuugcccagauucccagaagcucgaaaaggagugucagucaagugaagagucuauggggagcaacuccaugagaucaauccuugaagaggacgaggaagaugaggaacccccgagggugcuguuguaucacgagccucguagcuucgaggugggaaugcuagucuggcauaaacacaagaaauacccauuuuggcccgcaguugugaagucuguacggcagcgagacaaaaaggccuccgugcuguauauagaaggccauaugaauccuaagaugaaagguuucaccgucagucucaagagccugaaacacuuugauugcaaggagaaacaaacgcuucugaaccaggcuagagaagacuucaaucaggauaucggguggugcgugucuuugauuacugacuacaggguucgccucggcuguggauccuuugccggcucauuccuggaguauuacgcagcggauaucaguuaccccgugcggaagucaauucaacaggacgucuuagggaccaagcugccacagcuaucgaaaggauccccugaagaacccgugguagguugcccacucggccagagacaaccguguaggaagaugcugccugaucgcucucgagcugcccgggaccgugcaaaccagaaacuuguugaguauaucgugaaggccaaaggggcugaaagccacuugagagccauacugaagucaaggaagcccagucgcuggcuccagacauuucuguccucuagccaguacgucacuugcguggagaccuaucuugaagacgagggacaacuggauuuggucgugaaauaccuccagggcguuuaucaggaagugggugcaaagguacugcagcggacaaauggggacagaauuagguucaucuuagauguccugcuaccagaggcuauuaucugugccaucuccgcgguggacgagguugauuacaaaaccgccgaagagaaguauauuaaaggccccucacucagcuaccgagaaaaggagauauuugacaaccaacugcuugaggagcgcaaucggagaaggcguuga

SEQ ID NO: 59344 - RNA, 1095 nt, Artificial Sequence
  derived and/or modified sequence opt3 from MURC__Homo_sapiens__NP_001018126
auggagcacaacggcagcgccuccaaugcugacaagauccaucagaacagacugucuucagugaccgaagaugaggaccaagaugcagcccucacaauugucacuguucuugacaaaguggcgaguauaguagauagcgugcaggcuucccagaagaggaucgaggaacggcaccgcgaaauggagaaugccauuaaaucuguccagaucgaccuguugaaguuaucgcaaucacauagcaacacggggcacauuaucaauaaacuguucgagaagacccgaaaggugagugcacauauaaaagauguuaaggcccguguggaaaaacagcagauccacgucaagaaaguggagguaaagcaggaagagauuaugaagaaaaacaaguuuagaguugugaucuuccaagagaaauuuaggugccccacaucccuaucugucgugaaggaccggaaucucacugaaaaccaggaggaagaugacgaugacauuuucgauccuccaguggaccugagcuccgacgaggaauacuaugucgaggagucacgcagugcuagacuuaggaaaagcggaaaggaacacaucgauaauauuaaaaaggcauuuucuaaggagaacaugcagaaaacccggcagaaucuggacaagaaaguuaaccgcauacgaacaagaaucgugaccccggaaaggcgggagcguuugcgccaauccggugaaagacucaggcagucaggcgagcggcugcgacagagcggggagcgcuucaagaaaaguauuucuaaugccgcucccuccaaggaagccuuuaagaugagaagccugaggaaaggaaaggaucggacuguagcggagggcgaagagugugcacgcgaaauggguguggacaucaucgccagaucggagucucucgggccuauuuccgaguuauacucagaugaacugagugagccagaacaugaggcugccaggcccgucuauccuccacacgagggacgugaaauacccacaccugagccacuuaaagugaccuucaagagccaaguuaaaguggaagacgaugaguccuugcugcuagaccucaagcauucuagcuga

SEQ ID NO: 59345 - RNA, 1656 nt, Artificial Sequence
  derived and/or modified sequence opt3 from MUS81__Homo_sapiens__XP_011543572
auggccgcucccgugagacugggcaggaagcggccucucccagcaugcccgaacccccuuuucguccgcuggcugaccgaguggcgagacgaagccacacguagcagaaggcggacucgcuuuguuuuccagaaagcguugagauccuuaaggcgguacccucugccacuacgcucugggaaggaggcuaaaauccuccaacacuuuggagauggucugugucgaaugcuugacgaaagacugcagaggcaucggacgucaggcggggaucacgcccccgacaguccuagcggagaaaauuccccagcaccccagggccguuuggccgaggugcaggauucuucgaugccuguaccagcucaaccgaaggccggugggucaggaagcuauuggcccgcacgccauaguggcgcuagagugauucuccugguccuguacagggagcaccucaacccuaauggccaucacuucuuaaccaaagaggaacugcuucagcggugcgcccagaaguccccacgaguggcgcccgggucugcacgcccuuggccagccuugagaagccugcuacacaggaaccucguucugcggacacaucagcccgcucgcuauucccuuacuccggagggacuggaauuggcccaaaagcucgcagagucagagggucugaguuuacugaaugugggcauagggccuaaagaacccccaggagaggaaaccgcugucccuggcgccgcgagcgccgagcucgcaucugaagcuggugugcagcagcagccccuugagcugagaccaggggaguacaggguauugcuauguguugacaucggagaaacacguggcggcgggcaccggcccgagcugcuccgagaacugcaaagacuucaugugacccacacugucaggaagcugcacgugggagauuuugugugggucgcccaggagacaaacccucgcgacccagcuaauccgggugaauugguucucgaucauauuguggagcggaaaagacuggacgauuuaugcuccucaaucauugacggcagguuccgcgagcagaaguuucgacugaaacggugugggcuagaacguagaguauaucucguggaggaacacggaagcguccauaaccugagucuucccgagucuaccuugcugcaagccgugacgaauacucagguuaucgauggcuucuuugugaagaggaccgcagacauaaaggaauccgccgcuuaccucgcgcugcuuacacgcggucugcagcgguuguaucaggggcacacucucagaagcaggccuuggggcaccccaggaaaccccgagucgggcgcaaugacaucuccuaauccacugugcuccuuacugaccuucucagacuuuaacgccggggcuaucaaaaauaaggcccaaaguguccgagagguguucgcacgccagcuaaugcagguacggggaguuagcggugaaaaagccgcugcccucguggauagauacuccacgcccgcaucucugcuugcggcuuacgacgccugugcaacuccgaaggagcaggaaacauugcugagcaccauuaaaugcggcaggcuccaacguaaccuggggccugccuuaucacgcacucugagucagcuuuauuguuccuacggaccauugacauga

SEQ ID NO: 59346 - RNA, 2352 nt, Artificial Sequence
  derived and/or modified sequence opt3 from MUSK__Homo_sapiens__NP_001159752
augagagagcuggugaacaucccccucguccacauucuuacccugguugccuucagcggcacagaaaaguugccuaaagcuccagugauaacuacgccguuagagaccguagacgcacugguggaagaggucgccacauuuaugugcgcgguggaauccuacccccagccugagaucucuuggacuaggaauaagauucuaaucaaacucuucgauacccgguauucaauucgcgagaacgggcaacugcuuacaauccugaguguugaagacagcgaugacggaauauacuguugcaccgcuaauaacggugugggcggggccgucgaguccuguggagcacuucaggugaagaugaaaccaaagaucacucgacccccuauuaauguaaagaucauugaaggccucaaagccguucugccaugcacaaccauggguaaccccaagccuucugugucguggaucaaaggggauucaccacugcgugagaauagcagaauagcuguccucgagaguggauccuuaaggauucauaacgugcagaaggaagacgcaggccaguaucgguguguggccaaaaauucucugggcacggcuuacagcaaggucguuaaguuggagguggaagaggaauccgagccggagcaagauacuaaaguauuugcccgcaucuugagagcgcccgaaucacacaacgugaccuucgggaguuuugucacacugcauugcacugcaaccgguauuccugugccaacaaucaccuggaucgagaauggaaacgccguuagcucuggcuccauucaggaaucagugaaggacagggucauagauagccggcuacaacucuucaucacgaaacccgggcuguauacuuguauugcuacaaauaagcacggagagaaauuuaguaccgccaaggcagcugccacuaucucuauagcggaauggcgcgaguacugccuugccgugaaagagcuguucugugcaaaggaaugguugguaauggaggaaaagacacaucgaggccucuauagauccgagaugcaccuguuaagcguuccugaaugcucgaaacugccaucuaugcacugggaccccaccgcuugugccaggcucccgcaucuugcuuuuccucccaugacguccucaaagccaaguguggauauuccuaaccugcccagcuccucuagcucaaguuucuccgucagcccaaccuacucuaugacagugaucaucucaauuaugaguagcuuugccaucuucgucuugcuaacuauuaccacacuguacugcugccggcgucgcaaacaguggaagaauaaaaagagagaguccgcagccgugacucucaccacacugcccucugagcuucuguuggacaggcuccacccuaacccaauguaucagcggaugccgcuguuacugaaccccaagcuacucucgcuggaauacccucgaaauaacauagaguauguucgcgauaucggugaaggggcuuuuggaagaguguuccaggcgagggcaccaggccuuuugcccuacgagccuuucaccaugguagccgucaaaaugcugaaggaggaagcuagcgccgacaugcaggcagacuuucagcgggaggccgcucucauggccgaauuugauaauccaaacauugugaaacugcuuggcguuugugcaguggggaagcccaugugccuguuguuugaguauauggcguacggagaccucaaugaguuccugcgcuccaugucaccgcauacugucuguaguuuaucucacagcgaucuguccaugagagcucaagugucaagcccugguccacccccucuaucuugcgccgaacagcucuguaucgcaaggcagguagccgcuggcauggccuaucuguccgagcguaaauuugugcaccgggaccuugcaacgcgaaacugcuugguuggggaaaauauggucgugaagaucgcugauuucggacugaguagaaacauuuacagcgccgacuacuauaaggcgaaugagaacgaugccauacccaucagguggaugccaccugaaucuauuuucuacaaucgcuauacaaccgaguccgacgugugggcuuacggcgucguucucugggaaaucuucucauauggucugcaacccuacuaugggauggcacaugaggaggugauuuacuacgugcgggauggcaacaucuuaaguuguccagaaaauugcccgguagagcuguauaaccuuaugagauuguguuggagcaaacucccugccgacaggcccucguuuacuuccauacaccgcauccuggaacgaaugugcgagcgggcugaaggaaccgucucuguguga

SEQ ID NO: 59347 - RNA, 2253 nt, Artificial Sequence
  derived and/or modified sequence opt3 from MUT__Homo_sapiens__NP_000246
augcugagagccaagaaccaacucuuccuucugagcccccacuacuugaggcaagugaaagaguccucuggcucacgguuaauccagcagcgccugcuacaucagcaacagccucuccacccagaaugggcugcacuggccaagaaacagcuuaaggggaaaaauccggaggaccugauuuggcauacccccgaaggaauaaguaucaagccuuuguauagcaagcgagauacaauggaccucccagaggaacugcccggugucaaaccuuuuacucguggcccauaccccacgauguauaccuucagaccuuggacaauuaggcaguacgcgggguuuuccacuguugaggagucuaacaaguucuauaaagauaauaucaaggcuggacaacagggccugucgguggccuuugaccucgcaacccaccgggguuacgauucagacaacccacgcguaagaggggaugugggaauggccggcgucgcuauugacacaguggaagauaccaaaaucuuauucgacggcauaccgcuggagaagaugagcguuaguaugacuaugaauggggcagugauccccguccuugccaacuuuauugugacaggagaggaacaggguguaccuaaggagaaauugaccggcacgauccagaaugauauucugaaggaauuuaugguuaggaacacuuauaucuuuccacccgagccuuccaugaaaauaauugcugacaucuucgaauacaccgccaagcauaugccaaaauuuaauucuauuagcaucuccggguaccacaugcaagaggcgggagcagaugccauccuagaacucgcuuauacacuggccgacggccuugaguacucacggacuggucugcaggcaggguugaccauugacgaguucgcuccccgccucaguuucuucuggggaauaggcaugaacuucuauauggaaaucgccaagaugcgagcgggcagaaggcugugggcccacuuaauugagaaaauguuucagccgaagaauagcaagucucugcuccuucgggcacauugccaaacauccggguggucacugaccgaacaggauccuuacaacaauaucgugcguacggcuauagaggccauggcugccgucuucggagguacucagagcuugcacacaaacaguuuugacgaagcacuaggccugcccaccgugaaaucugcccgcauugcuagaaauacucagaucaucauucaagaggaguccgggaucccaaagguggcggauccuuggggaggcagcuauaugauggaaugucucacaaacgacgucuacgaugcagcccugaaacuuauuaacgagauagaagagaugggugggauggcuaaggccguugcagaaggcauccccaaacugaggauugaggagugcgccgcucggcgacaggcccgcaucgacucgggaucugaagugaucguaggcgugaauaaguaucaguuggagaaggaagaugcagucgaggugcucgcgauugacaacaccuccguuagaaauaggcagauagagaaacugaagaaaaucaagucaagucgggaucaggcuuuagccgaacgcugucuggcagcccuaacggagugcgcugccagcggggacggaaacauucucgcacuggcuguggaugccuccagagcgagguguaccgucggugaaaucacagacgcccuuaaaaagguguucggcgagcauaaggcuaaugaccguaugguaucuggggcauaccggcaggaauuuggagagagcaaagagauuacuucagccaucaagcgaguucacaaauucauggaaagagagggcaggcgcccacgguugcugguggcuaagaugggucaggaugggcacgacagaggcgccaaagucauagcaaccggauuugcggaucucggcuucgacguggauaucgggccccuguuucagacaccuagggaagucgcccaacaggcuguggacgccgauguucaugcagugggaauuaguacucuugcugccggucacaagacccugguaccagaguugaucaaggaacucaacucccugggccgcccggacauuuuagucaugugcgggggagugauacccccucaggauuacgaguuccuguuugagguuggcgugagcaaugucuucgguccagggacacgaauccccaaagcagccgugcagguacuagacgauauugaaaagugucucgagaaaaagcaacagucuguguga

SEQ ID NO: 59348 - RNA, 1611 nt, Artificial Sequence
  derived and/or modified sequence opt3 from MUTYH__Homo_sapiens__NP_001280119
augacaccccuggugagcagacucuccaggcuuugggccaucaugcggaagccucgcgcugcagucggcucugggcaccgaaaacaggccgcgucacaagagggacgucagaagcaugcuaaaaacaauagucaggccaagccaagcgcaugcgacgccggucuggcuagacagccggaagagguuguguugcaagcauccguaucuucguaccacuuauucagggauguggccgaagucaccgcuuuucggggcucacugcuaagcugguaugaccaggagaaacgcgaucuccccuggagaaggcgggccgaagacgagauggaucuggaccgccgagcguacgcaguguggguuagugaggugaugcuucagcagacucaagucgccacggugauuaacuauuacaccggguggaugcagaaguggccuacacugcaggauuuggcuuccgccucucucgaagagguaaaucagcugugggcaggacugggcuauuacagcagagguaggcggcuccaagaaggggcucguaagguuguggaggaguuaggaggccauaugccacgcacugccgaaacccugcagcagcuuuugcccggcgucgggagauauacagcgggagccauagcauccaucgcuuucggucaagccaccggcgugguggacgggaacgucgcuaggguucugugucgggugcgagccauuggagcagauccuucaaguacucuaguaagccagcagcucuggggccuggcccagcaacuuguggacccagcucgccccggugauuuuaaucaggcggcaauggagcugggggccacagucugcaccccucagagaccauuguguucucagugcccgguggaaucccucuguagggcucggcaacgcguugagcaggaacagcuguuagccucaggaagccugaguggcucucccgacguggaggagugcgcaccuaacacgggccagugucaccucugccuuccacccuccgaaccuugggaucaaacucugggggucgugaauuucccaagaaaagccagcaggaagcccccgcgugaggaaucgucugcuaccuguguauuggagcagccuggagcccuaggugcacagauccugcucguucagcggcccaacuccggccugcuugcggggcugugggaauuuccaucagugacaugggagccuagugagcaauugcagcgaaaagcucuccugcaggaauuacaaagaugggccggaccccugccagcaacucaucuaaggcaccucggcgaggucgugcacaccuucagccauauuaagcugacauaccaggucuacggucuugccuuggaagggcagacccccgugacgacuguuccuccaggcgcucgcuggcugacacaggaggaauuucacaccgccgcaguguccacugcuaugaaaaagguauuccgggucuaucaaggacagcagccgggcacaugcauggggucuaagagaagccaggugucaagucccuguuccaggaaaaagccucgcaugggacaacagguucucgacaacuuuuuccgaagccauaucucuaccgacgcccacucacugaauagugcggcccaguga

SEQ ID NO: 59349 - RNA, 666 nt, Artificial Sequence
  derived and/or modified sequence opt3 from MVB12B__Homo_sapiens__NP_001011703
augagaagcugcuucugugugaggcggucccgcgaucccccuccaccgcagcccccuccacccccuccacaacgaggcaccgaccagucuacaaugcccgaggucaaggaccugucagaagcccucccugagacaaguauggauccaaucacggggguuggagugguagcuagccguaacagagcaccgaccgguuacgacguggucgcccagacagcggauggcguggacgcugaucuuuggaaagacgggcuguuuaaguccaaaguuacuagguauuugugcuucacccggucuuuuucgaaggaaaauucacacuuaggaaacgugcuggucgauaugaaacuaauugacauaaaggauacacuccccgugggcuucaucccuauucaggagaccguagacacucaagaaguugccuuucgcaagaaaagacuguguaucaaguucauuccaagggauagcacagaggcagccaucugcgacauacggaucaugggucgcaccaaacaggcucccccucaguacacguuuauuggggagcuuaauaguaugggaaucugguaucgaaugggcagagugccaaggaaccaugacuccucucagcccacuaccccgagccaauccucagcagccaguacuccugcucccaaucugccacgguga

SEQ ID NO: 59350 - RNA, 1203 nt, Artificial Sequence
  derived and/or modified sequence opt3 from MVD__Homo_sapiens__NP_002452
auggccagcgagaagccccuggcugcagugaccugcacagccccugucaacaucgcgguuauuaaauacuggggcaagagagacgaagaacucgugcuuccaauaaauuccucucugucaguaacuuugcaccaggaucaauuaaaaacgaccacaacugcugugaucaguaaggacuucaccgaagauaggauuuggcugaacgggcgggaggaagacgucggacagccgcgccuacaggccugucuccgagagauccguugccuggcaagaaaaaggcggaauagccgcgauggugacccccuuccuuccucucugucguguaaggugcauguugccucagugaacaauuuuccaacagcugcaggcuuggccagcagugcugccggguaugcgugccucgcauacacccuggccagagucuauggaguggaguccgaucugucugaaguagcuaggcggggcagcgguuccgccugucgcucacucuacgggggauucguugaguggcagaugggcgaacaagcagacggcaaggauaguauugcucgacagguggcccccgagagccacuggccugaguuaagaguccugauccuuguggugucugcggagaaaaaguugacuggguccacagucggaaugagggccucaguugagaccagcccacugcuacgguuucgugcagaaagugugguacccgcucgcauggccgagauggcuagaugcauaagggaacgggacuucccuucuuuugcccagcucacgaugaaagauuccaaccaguuccaugcaacuugucuggacaccuuuccaccgaucagcuaucuuaaugccauuucguggcgaaucauucaccuggugcaucgcuucaacgcucaccacggugauacaaaggucgcguacacuuuugacgcaggccccaaugccgugaucuucaccuuggacgauacaguugcugaguuuguggccgcagucuggcauggguucccuccaggaucuaacggcgacaccuuucucaaaggucugcaagugagacccgccccuuuauccgcugagcugcaggccgcacucgcgauggaaccaacgcccgggggaguaaaguauauaauuguuacucaggugggcccgggcccucagauccuugaugaccccugcgcucaccuguuggggccagauggacuaccuaagcccgccgcauga

SEQ ID NO: 59351 - RNA, 1035 nt, Artificial Sequence
  derived and/or modified sequence opt3 from MVK__Homo_sapiens__NP_001288111
augcugagcgaggugcuccuugucuccgcccccggcaagguuauccugcacggggaacaugcugugguacacggaaaaguggcauuggccgucucuuuaaaccugagaaccuuccuaaggcuccagccucauucaaaugguaagguggaccugagucuuccaaacauuggcauaaaacgggcgugggauguugcucgccugcagagcuuggacacauccuuucucgagcaaggggaugugacuacgccgaccucugaacaggucgagaagcugaaagaaguggccggacugcccgacgauugcgcaguaacagagcgacucgccguuuuagcuuuccuguaccuuuauuugucgaucugucguaagcagagauggacuaaggaggaccuggaacuaauuaauaaaugggcauuucaaggcgagaggaugauccacgguaacccuucagggguggauaaugccgucagcaccuggggaggcgcucuccgguaccaucagggcaagauuaguucccugaaacgcucuccagcccuucagauccuguugacaaacaccaaggugcccagaaauacuagggcgcucguggcagggguccggaaccgccuguuaaaauucccugaaauaguugccccacugcucacaagcaucgacgcuauuucccuugagugcgagcgagugcugggagaaaugggugaggcccccgcaccugaacaguauuugguacuagaggaacugaucgauaugaaucaacaccaccucaacgcucugggcguggggcaugccucacuugaccagcugugucaggucaccagagcgaggggauugcacaguaagcucacgggcgccggugggggaggcugcggcauuacucuguuaaagccagggcuggagcagccggagguggaagcaaccaaacaagcucuaacaagcuguggauuugauugccucgagacuucuaucggugcccccggcguuuccauacauucagcuaccagccuggacagucgggugcagcaggcccuugauggguuguga

SEQ ID NO: 59352 - RNA, 2502 nt, Artificial Sequence
  derived and/or modified sequence opt3 from MVP__Homo_sapiens__NP_001280133
auggccaccgaggaauuuaucauuagaauacccccuuaccacuauauccaugugcuggaccagaacagcaaugucuccaggguugaggugggcccaaagacauacauucggcaagauaacgaacgcguacucuuugcuccgaugcgaauggugacugugcccccucgucacuauugcacgguggcaaauccaguuucuagagacgcccaggggcuugugcuguucgaugucaccggacaggugagguugcggcaugcggacuuagagauccgccuggcucaggaucccuuuccucuauacccaggugaaguacucgagaaagacauuacaccccugcaaguugugcuuccuaacacugcccugcacuugaaggcacuccuggauuucgaggacaaagauggcgacaaggucguggccggggaugaauggcuguuugagggaccaggcaccuauaucccgagaaaagaaguggaggucguugagauaauccaggcuacaauuaucaggcagaaucaggcacuccgguuacgcgcccgaaaggaauguugggacagagaugguaaggagagggugaccggggaagaguggcugguaacuacagugggagcuuaccuucccgccgucuucgaagagguguuggaccugguugacgcggugauucuaaccgagaaaacggcacuccaucugcgggcccgucgcaacuuuagagauuucaggggcgucucacggcgaacuggcgaagaguggcuugugaccguacaagacacagaagcucacguuccugaugugcacgaggaaguccuggggguggucccaaucacuaccuugggaccccauaauuauugcgugauacucgacccuguugguccagauggcaagaaccagcuggggcagaaacgcgugguaaagggagagaaaaguuucuucuuacagcccggcgagcaacuggaacaggguauucaggacgucuacgugcucagcgagcaacaggggcuucuguugagagcccuacagccgcuggaagagggagaagaugaggagaagguuucccaccaggcaggcgaccauuggcucaucaggggcccucuggaauacgugcccucugcuaaggucgaggugguagaagaacggcaagccauuccacuugaugagaaugaagggaucuaugugcaggacguuaaaacaggaaagguccgcgcggugaucgguucgaccuacaugcugacgcaggaugagguguugugggaaaaagagcucccucccggcgucgaggagcuguuaaacaaggggcaggacccacuggccgacagaggagagaaagauacugcaaagucacuacaaccccucgcuccuaggaauaaaacacguguugugagcuaucgggugccacacaacgccgcuguacaggucuacgacuaucgagaaaagagagccagggugguuuuuggcccggagcuggugagucuuggucccgaggaacaguucaccgucuugucccugucugcagggcgcccuaagcggccacacgccagaagggcucucugucugcuucugggccccgacuuuuucacugaugugauuacaauagaaaccgcggaucaugcacgcuugcagcuccaacuggccuacaauuggcacuucgagguuaacgaccgaaaagauccucaggagacggcuaaguuauuuagcgugccagacuucguaggagaugccugcaaagcaaucgccucccggguccguggcgcuguggccucagugaccuuugacgauuuccauaagaauagugcaagaauuaucaggacagcggucuuuggguucgaaacuagcgaggcuaaaggacccgacgguauggcccugccgcgcccucgggaucaggcaguuuuuccacagaacggccuagugguaucuuccguggacguccaaucaguggaacccguugaccagagaaccagggaugcccuccagcgaagcgugcaacuggcuauagagauuacaacuaacagucaggaagccgcagcuaagcacgaggcccagcgccuugagcaggaagcgcgggggagauuggagaggcaaaagauccuggaccagucugaagccgagaaagcucguaaggagcuccuggaauuagaggcacuguccauggccgucgaaagcaccggaacagcuaaagccgaggcagaaucgcgcgcggaggccgcucggaucgagggcgaagguucugugcuucaggccaauaccauuagagauuuggcaguugcugggccugagaugcaggucaagcuccugcaaucccuaggccugaaaucaacucucaucacggacggaaguacacccauuaaccuguucaauaccgccuuuggccuuuuggggaugggaccagaaggucagccucugggcaggcgagucgcaagcgggcccuccccaggagagggcauaucuccgcagagcgcccaggcuccucaagcgcccggugauaaccauguagugccaguuuuacgguga

SEQ ID NO: 59353 - RNA, 1989 nt, Artificial Sequence
  derived and/or modified sequence opt3 from MX1__Homo_sapiens__XP_005261039
augguggucagcgagguugacaucgccaaggcugaucccgcagccgcgucccacccucugcuccuuaacggcgacgcuaccguggcccagaaaaauccagggucuguagcagaaaacaaucugugcucacaauacgaggaaaaggugagaccguguauugauuugauagacaguuuaagggcccugggagucgagcaggaucuagcucuccccgcaaucgccgugauuggugaccagagcuccggcaaaucuucgguucuggaagcucuuucagggguggcccugccucggggaagcggcaucgucacacgcugcccauuggugcucaagcugaaaaagcugguaaacgaggauaaguggcgagguaaaguuaguuaucaggacuacgagauugaaaucuccgaugcgucugagguggaaaaggagauaaauaaagcacaaaacgccaucgcuggggagggaaugggcauuagccaugaacucaucacuuuagagauuuccucacgugacguccccgaucugacgcuuaucgacuugccuggcauaaccagaguggccguggggaaucagccagcagauauuggauauaagaucaaaacacugauuaagaaguacauccagaggcaggaaacuaucagucuagucguugugcccagcaacguagacauugcuaccacagaggcccucucuauggcgcaagaaguggacccugagggugaucggaccauaggcauccugacuaaaccagaccuugucgauaaggggacagaggacaaagugguugaugugguccgcaaucugguguuccacuugaagaaaggauauaugauuguaaaguguagaggccagcaggaaauccaggaccaacucucccugucagaggccuuacagagggagaaaauauuuuucgaaaaccauccguacuuucgggaucugcucgaagaggguaaggcaaccguucccugccuugcugagaagcugacgagcgaauugauuacucacaucuguaaaagucuaccucugcucgagaaucagaucaaggaaacccaucaacgcauuacagaggaacugcagaaauaugggguggacaucccagaggaugagaacgaaaagauguucuuucuuauugacaaagucaaugccuucaaccaggauauaacugcucugaugcagggagaggaaaccgugggcgaggaggacauccgauuguuuacaagacucaggcacgaguuccacaaguggucuaccauuaucgaaaauaacuuucaagaaggccauaagauccugucccggaaaauucagaaguucgagaaccaguaccgugggcgcgaauuacccggauuugucaauuacagaacguucgagacuauagugaaacagcaaaucaaggcccuggaggaaccugcaguugacaugcuacacacagugaccgauaugguaaggcucgccuuuacugacgucagcauuaaaaacuucgaggaguucuuuaaucugcaucggacagcuaagucgaagaucgaagauauucgagcggaacaggagcgcgagggugaaaaacuuaucagauugcacuuccagauggagcagauaguguauugccaagaccagguuuacaggggcgcacugcagaaggugcgggaaaaagagcucgaagaggagaagaaaaagaagucuugggauuuuggggccuuccaguccucaagugcuaccgacagcuccauggaagagaucuuucaacaccugauggccuaucaucaggaagcaucuaaacgcauuagcucacacaucccacuuauuauccaguucuuuaugcugcaaacguacggacagcaguugcagaaggccaugcuccaacuguuacaggauaaagacaccuauaguuggcugcuaaaggagagauccgauacaagcgacaaaaggaaguuccucaaagagcgucuggcucggcuuacucaggcccgaagaagguuggcacaguuucccggcuga

SEQ ID NO: 59354 - RNA, 2148 nt, Artificial Sequence
  derived and/or modified sequence opt3 from MX2__Homo_sapiens__XP_011527874
augagcaaggcccacaaacccuggccuuacagaaggcggucccaguucucuucacgcaaguaucugaaaaaggagaugaacaguuuucaacagcagccaccgcccuucggcaccgugccuccacagaugauguuucccccuaauuggcaaggggcugaaaaagacgcagccuuccucgcgaaggauuuuaacuuccuuacacugaauaaccagccacccccuggaaaucgaagccagccacgugcuauggguccggagaacaauuuguacucccaguaugaacaaaaggucagacccugcaucgacuuaauugauucucugagggcccuaggcguugagcaggaccucgcacugccugccauagcugugaucggggaucagucgucaggaaaaagcaguguacuugaagcacuguccggcguggccuugccacgggguucugggauugucacucgcuguccccucgugcugaagcugaaaaagcagccuugcgaggcuugggccggaagaaucagcuacaggaacacggagcucgaauuacaagacccaggccagguugagaaagaaauucauaaggcgcagaaugugauggcaggcaacgggcggggaaucucccacgagcugauaucacuugagaucaccagucccgaagucccggauuugacaauuaucgaccugccugguauuacucgcguggccguagauaaucaaccccgagacaucggccuacagauaaaggcucucauuaaaaaguauauccagagacagcaaaccauuaaccugguuguggucccauguaauguggauaucgccacaaccgaggcacuuagcauggcucaugaaguggacccugagggggauaggacuaucggcauucugacaaaacccgacuugauggaccggggaaccgaaaagucugucaugaacguugugcguaaucucacguacccacugaaaaaggguuauaugauaguaaaaugccgcgggcagcaggagaucacuaacagauuaucccuggccgaggcgaccaagaaggaaauuacauuuuuccagacucaccccuacuuuagggugcuccuugaggaaggaucagccaccgucccucggcuggcagagcgauugacaaccgaacuaaucaugcauauacaaaaaucccugccacuccuggagggccagauucgcgagagucaccagaaggcuacggaggaacuuagaagguguggcgccgauaucccgucucaggaagcugacaaaauguucuuucugaucgagaagauuaaaauguucaaccaagauaucgaaaaguugguggagggggaggaaguugugcgggagaaugaaacucgccucuacaacaagauuagagaggacuuuaaaaauugggucggaauacuggccacaaacacccagaaggugaaaaauaucauucacgaggaaguagagaaguaugaaaaacaguacagggguaaggaguuacugggcuucguuaacuauaagacuuucgaaaucaucgugcaucaguacauucaacagcuagucgagcccgcacucuccaugcugcagaaagccauggagauaauccaacaggcuuuuauuaauguggcgaagaaacacuucggggaauuuuucaaccuuaaucagacaguccagagcaccaucgaggauauuaaggugaaacauacggcaaaggccgaaaacaugauccaauugcaguuucguauggagcagaugguuuucugccaggaccaaauauauucggugguacugaagaaaguccgggaagagaucuuuaauccucucggaaccccaucucagaacaugaagcugaauagccacuuccccucaaacgagaguagcguguccucuuuuacagaaauuggcauccaccuuaaugcuuacuuccuggagacuagcaaacgauuggccaaccagauuccuuuuaucauacaguauuucaugcucagagaaaacggugauucacugcaaaaggcaaugaugcagauuuuacaggagaaaaauagguacaguuggcugcuacaagaacaguccgagaccgccacaaagcgccggauccucaaagagagaauuuacaggcugacucaggcucgccaugcccuuugucaguuuagcucuaaggaaauccacuga

SEQ ID NO: 59355 - RNA, 636 nt, Artificial Sequence
  derived and/or modified sequence opt3 from MXD1__Homo_sapiens__NP_001189443
auggccgcugcagugagaaugaacauccagaugcugcucgaggccgcggacuaccuugaaaggcgggagcgcgaagcugagcacggcuaugccagcaugcugcccuacaauaacaaggaucgagacgcauugaaacguagaaauaaguccaaaaagaacaauucuucaaguaggcgggcccauuuacgccugugccuagaaaaacucaaggggcuggucccucuuggaccagagagcuccagacacaccacacugucuuugcucacuaaggcuaaacugcauauuaagaaacuggaggauugugacaggaaggcaguucaccaaauagaucagcuccagcgggaacagcgccauuuaaaacgacaacuggagaaacuugguaucgaaagaauuaggauggacucgaucggcucaacggugagcagugagcgguccgauucugaccgugaggaaauugauguagacguggagagcaccgauuauuugacaggggaccuggauugguccucaaguagcgucucugacuccgacgaacgcggaucaaugcagagccuaggcagugaugaggguuacucuuccacuagcaucaagagaauaaagcuccaggacucgcacaaggccugccuggggcuuuga

SEQ ID NO: 59356 - RNA, 582 nt, Artificial Sequence
  derived and/or modified sequence opt3 from MXD3__Homo_sapiens__NP_001136407
auggagccccuggccagcaacauccaggugcuccuucaagcugcagaguuccuggaaagaagggaacgggaggccgaacacggcuacgcguccuugugcccucaucgcucuccagggccgauucaccgacguaagaaaagacccccucaggcuccaggagcccaggacucagguaggaguguccauaaugaguuagagaagcggcgcagagcacagcugaaaaggugucuagaacggcucaagcaacagaugccccugggcgccgauugcgcucgcuauaccacacuuagccuguugagacgagcaaggaugcacauacagaaacucgaggaccaggaacaacgggcccgucagcugaaggagcgccugagauccaagcagcagucucuccaaaggcaguuagagcagcugcgggggcuugcuggagccgcggaacgagagcgcuugagagcagauucgcuggacucaagcggccuaaguuccgaaaggucugauagcgaccaaguucucccuaacgagaauggugggacuccaaaccaucggcccacgggacgcggcaauaacaucuccucacaccacuga

SEQ ID NO: 59357 - RNA, 630 nt, Artificial Sequence
  derived and/or modified sequence opt3 from MXD4__Homo_sapiens__NP_006445
auggagcugaacagccuccuuauccuguuggaagccgcugaguacuuagaaagaagggaccgggaggcagaacacggcuaugccuccgugcugcccuucgauggggacuuugcgcgcgagaagaccaaagcugccggucuaguccgaaaggcaccuaauaaccguucuucacauaaugagcucgaaaaacacagaagggccaagcugcggcuuuaccuggagcaguugaaacaacucguuccacugggaccggauaguacacgccauacuacgcugagccucuuaaagagagcuaaggugcacauuaaaaagcuggaggaacaggacaggcgggcacuuuccauaaaagagcaguugcagcaagaacaucgcuuccugaagcgaagacuagagcagcucucuguacagucgguggaaaggguccggaccgauucaacaggcagcgccgugaguacugacgauuccgagcaggaaguugacaucgaggggauggaguuuggacccggcgaacuggauucuguggguagcuccucagacgcugaugaccacuauagucuucaaagcgggaccggaggcgauucuggcuucgggccucacugccgucgccugggaagaccagccuuguccuga

SEQ ID NO: 59358 - RNA, 549 nt, Artificial Sequence
  derived and/or modified sequence opt3 from MXI1__Homo_sapiens__NP_001008541
augcccagcccuagacugcagcacuccaagccaccgaggcggcucucucgcgcccaaaaacauucaaguggcagcuccaacaccucuacagcuaaucgacgugcacaccuuagacugugcuuggagagguuaaaggugcugaucccccuagggccugacuguacucggcauacgacccucggacugcuuaacaaagccaaggcgcacauuaaaaagcuggaagaggcugaacgcaagucgcagcaucaguuggagaaucucgaaagagagcagagguuccugaaauggcggcuggagcaacuccaggguccacaggaaauggagcgcauacgaauggauucaaucggcagcacaauuaguuccgacagaucugauagcgaaagggaggagaucgaagucgacguugaguccacugaauuuucacacggggagguggauaacauuaguaccacaagcaucucugacauagaugaccacuccucauuacccagcaucggaagugaugaaggcuacucuuccgccagcguaaagcugucguucaccucuuga

SEQ ID NO: 59359 - RNA, 8487 nt, Artificial Sequence
  derived and/or modified sequence opt3 from MXRA5__Homo_sapiens__NP_056234
augcccaagagagcccacuggggagcucugagcgugguccucauccuucugugggggcauccuagaguugcuuuggccugcccacacccgugugcgugcuacgugcccuccgagguucauuguaccuuccggucuuuagcuucagugccugccggaauugcaaaacacgucgaacgcauaaaccuggguuuuaauaguauccaggcccuauccgagacuuccuucgcuggccucacuaagcuggaacuucugaugauucaugggaacgagaucccaucuauucccgacggagcauugcgagaucucucgucacugcaaguguuuaaauucagcuauaauaagcugcguguuaucacgggccagacccuccaggguuuaaguaaccugaugagacuucacauagaccacaauaaaaucgaauuuauucauccucaggccuucaacggguugacaucccugaggcuacuccaccuggagggaaaucuucugcaucaauugcacccaucuacuuuuagcaccuucacauuucucgauuacuuccggcuguccaccauccgccacuuauaucuggcugagaacauggugagaacucuccccgccucaaugcuuaggaauaugccucuguuggaaaaccuauaccugcagggcaauccauggacaugcgacugugagaugcggugguuucucgaaugggaugcgaagagucgcggcauucugaagugcaaaaaggacaaagcauaugaagggggacagcuuugugccaugugcuucagcccgaagaaacuguacaagcaugagauccacaaguugaaagauaugaccugucucaagcccucuauagaauccccucugcgacagaacagaucaaggagcauugaggaggagcaagaacaggaggaggacgguggcagucaguuaauccuggaaaaauuucagcuaccacaauggucuauuucccucaauaugacggaugagcaugggaacauggucaaucuggugugcgacaucaagaaacccauggauguguauaagauccaccuuaaccagacugacccuccagauauugacauaaacgcuaccguugccuuggacuucgaaugucccaugacacgggagaauuacgaaaaacuguggaagcucaucgcauacuauagcgaggugccggucaagcugcaucgugagcuuaugcugucgaaagauccucgcgugucuuaccaguauagacaagacgcugaugaagaggccuuguacuauacuggagugagggcgcagauucucgccgaacccgagugggucaugcagccauccaucgacauacagcugaaccggcgacaaucaaccgcaaagaaaguuuuacugaguuacuauacacaguacagccagaccauuuccacgaaggauacucgccaggcuagaggcaggucuugggugaugaucgaaccuagcggugccguacaacgggaccagacagugcuagaagggggacccugccagcucucaugcaaugucaaagcuagugaguccccaagcaucuucugggugcugcccgauggcucuauucuuaaggccccuauggacgauccagacucaaaguuuaguaucuugagcuccggcuggcugcgcauuaaaucuauggaaccgucggauagcgggcucuaccaguguauagcacaaguuagagacgagauggacaggaugguguaucguguccuggugcagucccccucaacccagccugccgaaaaggauacuguaacaaucggcaagaacccaggugagaguguuaccuuacccugcaaugcucuggcgauuccugaggcacaccuuucuuggaucuugccaaaccggcgaaucauuaaugaccucgccaacacgagccacguguacaugcugcccaauggcacccuauccauaccgaagguccaggugucagauagcggguauuacagaugugucgcugugaaccaacagggagccgaccauuucacaguuggcaucacugugaccaaaaaggguucugggcugccuuccaagaggggccgccggccaggagcaaaagcccucaguagaguaagggaagauauugucgaggacgaaggcgggagcggaaugggugaugaggaaaauacaucucgccgacugcuucaccccaaggaccaggagguguuuuugaaaacuaaggaugacgcuaucaacggcgauaaaaaggccaagaaagggcggcguaagcugaaauuauggaagcauuccgagaaagaaccugagaccaauguugcagaaggaagaaggguguucgagucacgccggagaauuaacauggcgaauaagcaaaucaaccccgaaaggugggcugacauacucgccaaaguccgaggcaagaaccugccaaaggguacagaggugccuccccuuaucaaaaccacaaguccaccgagccugucguuggagguaacgccucccuuuccagcaauuucucccccuagcgccagcccagugcagacaguuaccucagcugaagagaguuccgccgaugucccccuccugggggaagaggaacacgugcuaggcacuaucucuagcgcauccaugggacuggagcacaaucauaacggcgugauucucgucgagccugaaguuaccucaacaccgcuggaggaagugguggacgaccuuagcgagaagaccgaggaaaucacaaguacagagggggauuugaaaggaacggcugccccaacccugauaucugaacccuaugagccuuccccaacuuuacacacacucgacaccguauacgaaaagcccacacaugaggagacugcgaccgaagguuggagcgccgcugaugucggcucgucaccugagccgacgucuagugaauaugagcccccacuggacgcagugucccuugccgaaagcgagccuaugcaguacuucgaucccgaccuggagaccaaaucucagccagaugaagacaagaugaaggaggauacauuugcucaccuaacuccuacccccacaauuuggguuaaugacagcuccacuucacaacucuucgaagauaguaccaucggggagccaggagugccgggccagagccaucugcaggguuugacggacaacauucaccuggucaaaucuuccuuaucaacacaggauacccuccugaucaagaaagggaugaaggaaaugagucaaacucuucagggcggaaauaugcuggagggcgacccuacacacagccgcuccucugagucggaagggcaggagagcaaaucaauaaccuugcccgacuccacucucggaaucaugaguucuaugagcccagugaagaagcccgccgaaaccacaguuggcacgcugcuagauaaagacaccacuacagcaaccacaacuccucggcagaagguggcgccauccucaaccaugucuacgcaucccagcagaaggcguccuaacggucgccggagacugaggccgaauaaauuucgacaccggcauaagcaaacaccacccaccacuuucgccccuagugagaccuuuuccacacagcccacucaggcuccagauauuaaaaucagcucucaaguagagucaucccuugucccuaccgccuggguggacaacacagugaauacgcccaagcagcucgaaauggagaagaacgcagaaccaaccaguaaagggacuccucgcagaaagcacggaaaaaggccgaauaagcaucgguacacacccagcaccgucucgucucgagcuuccggcagcaaaccaucaccuagucccgagaacaagcacagaaauauuguuacuccaucuuccgaaacaauccuguugccucgcaccgugagccugaaaacggagggucccuaugauucauuagacuacaugacuaccacaaggaagauauauaguagcuacccgaagguacaggagacccucccagugacuuauaaaccuacauccgauggcaaggaaauuaaagacgaugucgccaccaacguggacaagcacaaaucugauauccugguuacaggggagagcaucacuaaugcaauucccaccucccguucacuugugucuacgaugggagaguucaaggaggaaaguucgccagucggcuuucccgggacaccuaccuggaacccgagccggacugcccagcccggaagacugcaaaccggcaucccagugacaacuuccggugagaacuugaccgacccuccccuccugaaggagcuagaagacguugauuucacgucugaguuccugucaagccuuacaguguccaccccuuuucaucaggaagaggcugggaguucuacuacacucagcucaauuaaagucgaaguagcguccagucaggccgagaccacuacacuggaccaggaucacuuggagaccacgguggcaauauuacugagcgaaacuaggccacaaaaucauacccccacagcugcccgcaugaaggagccugccucuuccucaccaagcaccauccucaugucgcugggacagacaacuaccacgaaacccgcacuuccgucuccucgaauuagucaggcauccagagacagcaaggaaaacguuuuccugaauuacgugggcaacccagagacagaggccacucccgucaauaacgaagguacccagcacaugucaggcccuaaugaguuguccacaccaucuagcgaucaagacgcguuuaaccuaaguaccaaacuggaacucgagaaacagguguucgggucccggagccugcccaggggaccggauucucagcgccaggacggccguguacacgcuucacaucaacuuacuagagugccugccaagcccaucuuaccaaccgcaacaguccggcugccugaaaugaguacgcaguccgccagcagguauuuuguuacuucucagucgccccgccacuggaccaauaaaccagagauuacaaccuaccccucaggggcucucccugagaacaagcaauucacuacaccacgauugagcuccaccacgaucccgcugccccuccauaugaguaaaccuucuauaccaagcaaguuuacugauagacggacagaccaguucaauggauacuccaaaguguuuggcaacaauaacauccccgaagcaaggaauccuguggguaagccacccucaccucgcauuccgcacuauaguaacgggagacugccauucuuuaccaacaagacccuuucuuucccccagcugggagucacuaggcggccucagauccccacaagcccagccccugugaugcgugagcgcaaaguuauucccggcuccuacaaucgaauccauucacacagcaccuuucacuuggauuucgguccaccggcgccuccccuacugcauacaccacaaacuacgggcucucccuccaccaaccuccagaauauaccuaugguaaguagcacacagucguccauuucuuucaucacuucaagcgugcagaguuccgggucuuuucaccaaagcucauccaaguucuuugcuggaggcccacccgccaguaaauucuggagcuuaggggaaaagccucagauccugaccaaaucuccgcagacagucucagugaccgcagagacugacacgguuuuuccaugcgaagccaccggaaagcccaagccuuucgugacauggacuaaagucuccaccggcgcucuuaugacaccaaacaccaggauucagagguuugaggugcugaagaaugguacucucguaauacggaaaguccaagugcaggaucgcgggcaguauauguguacagccagcaacuugcauggacuggacagaaugguugugcuccugucugucacggugcaacagccccagauccuugcaagucacuaccaggacguuaccguguaucuaggcgauacuauugcuauggagugccuggccaagggcacuccugcgccccaaaucucguggauuuucccagacaggcgggucuggcagaccguguccccgguagaagggcgaaucaccuugcacgagaauagaacauuaagcauaaaagaagccucauuuucugaucgcggaguguacaaguguguugcaagcaacgcugccggugcugacucccuggcaaucaggcuccaugucgccgcccugccucccgugauucaccaggagaaacuugaaaauaucagucugccaccuggccucucaauucauauccacugcacugcuaaggcggcacccuugccaucugugcgguggguccugggggauggaacgcagauacguccuagccaauuccuacauggcaaccuguuuguauuccccaaugguacccucuauauuagaaaccuugccccgaaggacuccgggagguacgaguguguggcugccaaucugguuggaagugcacgccggacagugcaguuaaacguccagcgagccgcugcgaaugccagaaucacuggcaccagcccaaggcgcacagaugugcgguacggcgggaccuugaaacuggacugcuccgcaucuggagauccuuggcccagaauccucuggcgucugccaucaaagaggaugauugacgcucuuuucagcuuugauucgcggaucaaaguuuucgccaacgguacucugguggucaaguccgugacggacaaagaugcaggcgacuaucucuguguagcccgcaauaaggugggggacgauuacguugucuugaagguggacguggucaugaaacccgcuaagauagagcacaaagaagagaacgaucacaagguauuuuacggaggcgaccugaaaguggauugcguagccacagguuuaccuaacccggaaauuaguuggucucuaccagacgggagccugguaaauucauucaugcaguccgaugacucuggaggccgaaccaagagauacgucguguuuaacaauggcacucucuauuucaacgagguugggaugagggaggaaggagauuauaccugcuuugcggagaaucaaguggguaaggacgaaaugcggguccgcguaaaagugguuacagcacccgccacuaucagaaacaagaccuaucuugcugugcaggucccuuacggcgauguggucacaguggccugugaggcuaaaggggaacccaugccaaagguuacguggcugaguccuaccaauaaagugauucccacuagcuccgagaaguaccagaucuaucaggacggaacauugcugauacaaaaggcacagaggucagacagcggcaacuauaccugccucguacgaaauucugccggugaggaucggaaaacuguguggauucaugucaacguucagccaccuaagaucaaugggaacccgaaucccaucacaaccgugcgugaaauugcugccggaggcaguagaaaacugaucgacuguaaggcagagggcauuccaacgccucgcguccuuugggcguuccccgaaggggugguacucccagccccuuacuacggaaacaggauaaccgugcacgguaauggcucccuggauauccggagcuugagaaaaucagacucuguucaacuggugugcauggcucgcaacgaagggggagaagccagguuaauucuacagcugacaguccucgagcccauggagaagccgaucuuucaugauccaaucuccgagaaaauuacugcaauggcuggccacaccauaucgcuuaacuguagcgccgcagguacaccuacucccagucuggugugggucuugccaaaugggaccgaccugcagucuggacagcaacuccagcgauucuaucacaaggccgauggcaugcugcauaucuccggccuuagcucaguggacgcuggggcguaccggugcguugccagaaacgcagcuggacacacagagagguuaguaagucugaaggugggucucaaacccgaagccaauaagcaguaucauaacuuggucuccauuaucaauggcgagacccugaaacuaccuuguacucccccaggggccggacagggccgcuuuagcuggacgcugccuaacgguaugcaccucgaagggccgcaaacacuuggccgugugucucuguuggauaauggaacccugacuguucgggaggcaucaguguucgacagaggcaccuacgucugcaggauggagacagaauacgggcccagcgugacguccauuccaguaaucgugauagcuuauccuccccgcaucaccucugagccaacuccuguuauuuacacacgacccggaaacaccgucaagcucaauuguauggccauggguaucccgaaagcggauauuacuugggaacugccugacaagagucauuuaaaggcuggcgugcaggcccggcuuuaugggaacagauuucugcacccacagggaucgcucacaauccagcacgcaacccaaagggaugccggcuucuacaaaugcauggcuaagaauauacuagguagcgacuccaaaacaacuuauauucauguguucuga

SEQ ID NO: 59360 - RNA, 969 nt, Artificial Sequence
  derived and/or modified sequence opt3 from MYADM__Homo_sapiens__NP_001277119
augcccgugaccgucacaagaacuacgaucaccacaacuaccacaagcuccucuggccuggggucaccuaugauuguuggaaguccaagggcccucacccagccgcuuggucuguugcgguuacugcagcuagugagcacuugcguagcuuucucccucguggcaucugucggcgccuggacagggucgaugggaaacuggucaauguuuaccugguguuucugcuuuagcgugacgcugauaauccuuauuguugagcuguguggcuugcaagcgcgcuucccccucaguuggcgaaauuuuccuaucacuuucgcuugcuacgccgcacuguuuugucuguccgccucuauuaucuauccaaccacauacgugcaguuccucagccacggucguuccagagaccaugcuauagcagccaccuuuuucucaugcaucgcuugugucgccuaugcgacugaaguggcauggacaagggcccggcccggggagauuaccggauacauggcuacgguaccuggcuuacugaagguucuugaaacuuuuguggccugcaucauuuucgcauuuaucagugauccaaacuuguaucagcaccaacccgcucuggaguggugugucgccguguacgcgauaugcuucauucuagccgcaaucgcuauucuccugaaucuuggcgaauguacaaacgugcugccuaucccauucccgagcuuuuugucugggcucgcccuguuauccguccugcucuaugcuaccgcccuuguucuguggcccuuguaccaguucgacgagaaauacggaggucagccucgcagaucaagggaugugagcugcagucggucucaugcauauuacguaugcgccugggaccgccgacuagcuguggcgauccugacugcaauuaaucuccuggccuaugucgcugaucuugugcacuccgcccaucugguuuuugugaaggucuga

SEQ ID NO: 59361 - RNA, 3999 nt, Artificial Sequence
  derived and/or modified sequence opt3 from MYBBP1A__Homo_sapiens__NP_001099008
auggagagcagagaccccgcccagccuauguccccaggcgaagcuacccaaucuggggcaaggccggccgaucgguacggacugcucaagcacucacgcgaguuccuugacuuuuucugggauaucgcgaaacccgaacaggagacacgacuggcugccacugaaaaguuguuagaguaucugcgugguagaccuaaaggcagugagaugaaguacgcacuaaaaaggcucauuacggggcugggagugggccgggaaaccgcccgcccaugcuauagccuugcucuggcacaguugcuccaguccuuugaggaccugccccuguguucuauacuccaacagauccaggaaaaguacgauuuacaucaggucaagaaagccaugcugagaccugcucuuuucgccaacuuguuugguguucuggcgcuauuccaaucggggaggcucgugaaggaccaggaggcacugaugaaaucaguaaagcugcugcaggccuuggcucaguaucaaaaucaccuccaggagcagccacggaaagcccugguggauauuuuaagcgaagucaguaaggcaacacugcaagagauccuccccgaagugcuuaaggcugaccugaacauuaucuuguccucuccugagcagcuagaacuguuucuccuggcccagcagaaaguuccaagcaaacuuaaaaagcuggugggauccgucaauuuguucucagaugagaacgugccgcgccucguaaauguucugaaaauggcggccaguagcgugaagaaagaccgaaaguuacccgcaauagcucuggaucuacucagacuggcccuuaaggaggacaaauuuccuagguucuggaaggaagucguggagcaaggcuugcugaaaaugcaguuuuggccagcuucuuaccucugcuuccggcugcuuggcgccgcacugcccuugcucacuaaggaacagcugcauuuagugaugcagggggaugucauccgucacuauggagagcauguuuguaccgccaaacugccuaagcaauuuaaguucgcuccagaaauggacgacuacguggguacauuccuagagggcugccaggaugaccccgagcgccagcucgcgguacugguggcauuuuccucagucaccaaccaggggcuuccggugacuccuacauucuggagaguugugagguuuuugucucccccagcccugcaaggauacgucgcuuggcuccgggccauguuccugcagccugauuuagacagucugguggauuuuucuaccaauaaccagaaaaaggcacaggacuccagccuucacaugcccgaacgagccguauuccgcuugagaaaauggauuaucuuuaggcucguuucgauuguggauucucugcaccuagagauggaagaggcucugacggaacaagucgcccgguucugucucuuucauuccuucuuugugacuaagaaaccaaccucacagauccccgagacaaagcacccuuucaguuuuccacuggagaaucaggcacgcgaagcggucagcuccgcuuucuucucucuuuugcaaacucugagcacccaguuuaagcaggccccgggccagacacaaggugggcagcccuggaccuaucauuuagugcaguucgcagaccuccugcuuaaccacucacacaauguuacgacugugacaccuuuuaccgcccagcaaagacaggcuugggauaggaugcugcagacuuugaaagagcucgaagcccauagugcagaggcucgugccgcggccuuccagcaccuucuacugcucguaggaauacaucugcuuaaguccccagcugagagcugcgacuugcugggcgauauucaaacauguauccggaaaucuuuaggcgaaaagccccgaagaucaaggaccaaaacgauugacccucaggagccacccugggucgaagugcucguugagauccugcuugcacugcuagcccagccgagucaccucaugcgccaaguggcucggagcgucuuugggcauaucugcucccaccugaccccuagagccuugcagcugauuuuagacgugcucaacccagaaacaucugaggaugagaaugacaggguagugguuacugaugacucggaugaacgccgacugaagggagcagaggacaagagcgaagagggugaagauaaccgguccucagagagugaggaagagucugaaggcgaggaaagcgaggaggaggaacgugacggggaugucgaccagggauucagagaacagcuuaugaccgugcugcaagcgggcaaagccuuggguggggaggauuccgagaaugaagaggaacucggcgacgaggcuaugauggcccuggaucagucacuagcaagccuguuugcugaacagaaacuuaggauacaggcccgccgggacgagaaaaacaagcuccaaaaagagaaggcacugagaagggacuuccagauccgaguguuggaucuggucgaaguuuuagugacaaaacagcccgagaacgcccucgugcuggaacuucuggagccuuugcucucuauuauccgccggucccugagaaguagcagcuccaagcaggaacaagaccuacugcacaagacugcuaggauauuuacccaucaccuuugucgugcgcgccgguacugccaugaucucggagagagagccggcgcacugcacgcucagguagagagguugguccagcaggccgggcgacaacccgacucaccaacagccuuauaucacuucaaugcuagucuguaccuccugcgggugcuuaaaggaaacaccgcagaagguuguguucaugagacucaggaaaagcagaaagccggcacggauccuagccacaugcccacagggccacaagcggcuucgugccuggacuugaaucuagugacccgcgucuauuccacugcccugucuagcuuucucaccaagagaaacucaccgcugacagugccuauguuccuuaguuuauuuuccaggcaucccguucugugccagucucucuugccaauucuggugcagcacaucaccggacccguacggccucgacaucaggcaugucuccugcuucaaaagacucugagcaugagagagguccgcuccugcuucgaagauccagaguggaagcaguugaugggccaggugcuagccaaggugacagagaaucugaggguccucggugaagcucagacgaaagcacaacaccagcaggccuuaucaagccuggagcuucugaacguucucuuccguaccuguaagcacgaaaaauugacucuggaccucacagugcugcuugggguacuacagggccaacagcagagucugcaacagggagcgcauucuaccggcuccagccgguugcacgauuuauacuggcaggcuaugaagacacugggggugcagagacccaaacucgagaagaaggacgccaaagagaucccuucggcaacucaaucaccgauuucuaagaaaaggaagaaaaagggauuucugccagaaaccaagaaacgcaagaaacgaaagagugaggaugguacgcccgccgaagacggcaccccugcugccacagggggaucccagccacccagcaugggcagaaagaagcggaauaggacuaaagcaaaggucccugcucaggccaacgguaccccgacaacuaagucucccgcgccaggggccccuacccgcagccccuccacgccagcaaaaucaccuaaacuucagaagaagaaucaaaaacccagucaggugaacggcgcuccaggaagcccgacagagccugccggccagaagcagcaucaaaaggcucugcccaaaaaggggguucucggaaaaucuccauuguccgcacuggcccguaagaaagccagacuaucacuggugauccggagucccagccuccuucaguccggcgcuaagaagaaagcgcagacccugagguucacuauuucuucgagcaagaaauga

SEQ ID NO: 59362 - RNA, 1914 nt, Artificial Sequence
  derived and/or modified sequence opt3 from MYB__Homo_sapiens__NP_001123644
auggccagaaggccccggcacagcaucuacuccucugacgaggaugacgaagauuucgagaugugcgaccaugauuaugacggccugcucccuaagucagggaaacgccaccuuggaaagacccgauggacacgugaagaggaugaaaaacugaagaaauugguggagcagaacgguacugacgauuggaaggucauugcuaauuacuuaccaaacagaacggacguucaaugucagcauagguggcagaaggugcugaauccggagcuaauaaaaggccccuggaccaaggaagaggaucagcggguaaucgaacucgugcaaaaauaugggccuaagcgcuggagugucauugcaaaacaccugaagggaagaaucggcaagcagugcagggagcgguggcauaaccaccuuaauccagaggugaaaaagacaagcuggacugaagaggaagaccgcauuaucuaccaggcccacaaacgacuggguaacagaugggcggagauagcuaaguugcuccccgggaggaccgauaaugccaucaaaaaccauuggaauaguacaaugcggcguaagguugaacaggagggauaucugcaagagucuucgaaagcaucacagccugccguggcuaccagcuuucagaagaacagucaccugaugggcuucgcacaggccccacccacugcucaacucccugccacaggccagccaaccgucaauaacgacuacuccuauuaccauauuucugaagcgcagaaugugagcucccacguaccguaccccguugcauuacacgugaacaucgucaaugugccucaaccagccgcugccgcaauucagcgccauuauaacgacgaggaucccgaaaaggagaaaagaaucaaggaacuggagcuuuugcugaugucaacggagaacgaacuaaaagggcagcagacucaaaaucacaccuguaguuacccuggauggcauagcacaacuauagcugaccacaccaggccacauggugauucugcccccguguccugccucggcgagcaccacucaacaccgagccugccugcggaccccgggagucuuccagaagagucugccuccccugcacgguguaugauuguccaucagggaaccauccuggauaacguuaagaauuugcucgaauuugcugagacgcugcaguucauugacagcuuuuuaaacacuucgucuaaucacgagaacuccgaucuggaaaugcccucacucacaaguaccccacuuaucggccauaaacugacugugacaacccccuuccaccgagaccagacgguaaagacccaaaaggagaauacaguguuucgcacuccugccaucaaaagaagcauuuuggaauccucuccaaggaccccgacacccuucaagcacgcucuagccgcacaggagauaaaauaugguccucugaagaugcucccacagacucccagccaucuggucgaggaucuucaggacgugaucaaacaagaaucagaugagagugggauuguugccgaauuucaggagaacggaccuccacuguugaagaagaucaaacaggaaguggagucccccaccgacaagagcggcaauuucuuuugcucucaccauugggagggcgacucacucaacacacagcuguucacccaaacuuccccggucgcugaugcgccuaauauauuaacgagcuccgugcugauggcaccagccucugaagacgaggauaacguacuaaaggcuuuuacaguucccaaaaaucggucgcucgccagcccucugcagcccuguuccucaaccugggaaccagcaaguugcgggaaaauggaggaacagaugacuucuagcucccaagcccgcaaguacgugaacgcuuucucagccagaacccuugucauguga

SEQ ID NO: 59363 - RNA, 2259 nt, Artificial Sequence
  derived and/or modified sequence opt3 from MYBL1__Homo_sapiens__NP_001073885
auggccaagagaagcagguccgaggacgaagaugacgaucugcaguacgcugaccacgauuaugaggugccccaacagaaaggccucaagaaacuuuggaaccgggucaaguggacccgcgacgaagaugacaaacugaagaaguugguugagcagcaugggacagaugacuggacuuuaaucgcaucucaucugcagaaucgaucagauuuccaaugccagcaccguuggcagaaagugcuaaacccugaacucauuaagggaccauggacgaaagaggaggaccagagaguaauagaacuggugcaaaaguacgguccgaaaagguggagucuuaucgccaagcaccugaagggccggauugggaaacagugucgcgagagauggcauaaucacuugaaccccgaagucaagaaaagcuccuggaccgaggaggaagauaggaucauuuaugaggcgcacaagcggcucggaaaucgcugggcugaaaucgccaaacugcugccuggccgaacagacaacucuauaaagaaucauuggaacucgacuaugagaaggaaaguggagcaggaagguuaccuccaggacgggaucaagucagagcggagcaguuccaaguuacaacacaaaccaugcgcagccauggaucauaugcagacccagaaucaauuuuauauucccguucagaucccuggauaccaguaugugucuccagagggcaacuguauugaacacguccagcccacaagcgcuuucauccaacagccuuuuauagacgaggauccagacaaggagaaaaagauuaaagaacuggaaaugcuuuugauguccgcagagaaugaggugcgucgcaagagaaucccgucacagcccggcaguuucagcucuugguccgggucauuucugauggaugacaacaugagcaauacccuaaacagucucgaugaacacacuucugaguucuacuccauggacgaaaaucagccuguaagcgcccaacagaacucgccaacaaaguuucuggcuguugaggccaacgcggugcuuucuucccugcagaccauucccgaguucgcagaaacguuggagcucaucgaaucagauccugucgccuggagugacgugacuagcuuugauaucuccgacgcugccgcaucuccaauuaaaagcacccccgugaagcugaugaggauacagcauaaugagggagcuauggaaugccaauucaacgucucauuaguucuggaggguaaaaagaauacauguaacggcgggaauagugaggccgugccgcucacuuccccuaacaucgcgaaauuuagcaccccacccgccauucuucggaagaagcgaaaaaugcgcguaggacacucuccuggcucagaacugagagacgguaguuugaaugaugggggaaacauggcacuaaagcauacaccccugaaaacccucccauucagccccucccaguuuuucaauacgugcccuggcaacgagcagcugaauaucgaaaacccaucuuucacuucgacaccgauauguggccagaaggcucuuauuaccacuccccugcacaaagagacaaccccuaaggaccaaaaggaaaaugugggguuuaggacgccaaccauccggcgcagcaucuugggaacaacucccagaaccccuacaccauucaaaaacgcccucgcugcccaggagaagaaauacgguccccugaagauugucucccagccguuagcauuucuggaggaagauaucagggaggugcuaaaagaagagacuggcaccgaccucuuccugaaggaagaggaugagccugccuauaaaucaugcaagcaagaaaauacagcuagugggaagaaaguucguaagucucuuguguuggacaacugggagaaagaagagagcggaacccagcugcucacugaagauauuuccgacaugcagucagagaaccgguuuacgacaagccugcuuaugauaccacuguuggagauccaugauaaucgauguaaccucauucccgaaaagcaggacaucaauucuaccaacaaaacuuacacccugacaaagaagaaaccuaaucccaacaccuccaaggucgugaaauuagagaagaaucugcaaaguaacugcgaaugggagacuguaguuuauggcaaaacagaggaucagcuaaucaugacggaacaggcgagaagguaccucagcaccuauacugcaacaucuuccaccucacgcgcccugauucuuuga

SEQ ID NO: 59364 - RNA, 2031 nt, Artificial Sequence
  derived and/or modified sequence opt3 from MYBL2__Homo_sapiens__NP_001265539
augagcagaaggacccggugcgaggaccuggaugaacuccacuaccaggacacagauuccgacgugcccgagcaacgcgauucuaaguguaaagucaaguggacucaugaagagaaccgaacggaccagcagugccaguaucguuggcuuagaguucugaauccugauuuggugaaaggcccauggaccaaggaagaggaccaaaaaguaaucgaguuagugaagaaguacgggacaaaacaguggacucugauugccaagcaccuaaaaggaaggcucgguaagcagugucgggaacgcuggcauaaccaccugaauccggaggucaaaaagucaugcuggaccgaagaggaggauagaauaaucugugaagcucauaaggugcuuggcaacaggugggcagagauugccaaaaugcugcccgggcggacagacaaugcgguuaagaaccacuggaauaguaccaucaaacgcaagguggauacuggaggcuucuugagcgaauccaaagacugcaagccuccagucuaucuccugcuggagcucgaagauaaagacgguuuacagucugcucaacccacagaggggcagggaucgcugcuuaccaacuggccuucagugccacccacgauuaaggaggaagagaauagcgaagaggaauuggccgcagccacuaccaguaaggagcaggagccuaucggcacagaccuggaugcuguacgaacuccagaaccgcuagaggaauuucccaaaagagaggaccaggaaggcuccccuccagagaccucucuccccuacaaguggguuguggaggcagccaaccugcuuauaccugcugucgggagcucccugucagaagccuuggaucucaucgagagugacccagaugcguggugugaccugagcaaauucgauuuacccgaggagccgucugcagaggacuccauuaauaacucacuggugcaacuccaggccagccaccagcaacaggugcuuccucccaggcagccaagugcucuggucccuucuguuacagaauaucgguuggauggacauaccaucuccgaccuaagccguucgucucgcggugagcugauucccaucuccccaucaacggaagugggcgggaguggaauaggcacucccccuagcguacucaagagacagaggaaacggcgaguggcccuguccccagucacagaaaauucuaccagccuuucauuucuggauaguugcaacuccuugacucccaagagcacaccggugaagacccucccuuucucuccaucacaauuucugaauuucuggaacaaacaggacacguuagaacuggagagucccagccuaaccuccacaccuguuuguucucagaagguggucgugacuaccccacuccaccgcgacaaaacaccccugcaucagaagcacgcagcuuuuguaacuccggaucaaaaauacucgauggacaacaccccucacacaccaacccccuucaagaaugcccuugagaaguaugguccuuugaaaccccugccacagacuccucaucucgaagaggaucugaaggaaguucuuagaagcgaggcggggauugaacugaucauugaggacgauaucaggcccgagaaacagaagcggaaaccaggauugcgcagauccccgaucaagaaggugaggaaaucacucgcccuggacauugucgaugaagacgugaaguuaaugaugaguacgcugccuaaaucucuaagccuccccacaaccgcaccauccaacucaagcucucugacucuuuccggcauaaaggaggauaauaguuugcugaaccagggcuuucuccaagcuaaacccgaaaaggccgcugucgcccagaaaccucguagccacuucaccacaccagcacccaugucuuccgccuggaagaccguggcuugcgggggaacucgggaccagcuguuuaugcaggagaaggcgcgacaauuacuggguagacuuaaaccuucacauacaaguaggacguugauccucagcuga

SEQ ID NO: 59365 - RNA, 3522 nt, Artificial Sequence
  derived and/or modified sequence opt3 from MYBPC1__Homo_sapiens__NP_001241647
augcccgagccuaccaagaaagaagagaacgaagugccagccccggcucccccuccagaggaacccagcaaggagaaagaggcaggcacaacuccugccaaggacuggacgcuggucgaaaccccacccggggaggaacaggcgaaacaaaaugcuaacucccagcucucuauccuuuucauugagaagccucagggagguacaguuaaggugggcgaggauauaacuuuuaucgccaaaguaaaggcagaagaccuguugagaaaaccaaccauuaagugguucaaagggaaguggauggauuuagccucaaaggcuggaaaacaucugcagcuaaaggagacauuugaaaggcacagucggguguacaccuucgagaugcaaaucauuaaagcaaaggacaauuuugccggcaacuaucgcugcgaagucacuuacaaagauaaguucgacagcuguuccuuugaucucgaggugcacgagucuacagguaccacgccgaauaucgacauacgaucggcuuucaaacguucaggggaaggacaggaggaugccggcgaacuggacuuuagcggccuucugaagagaagggagguuaagcagcaggaagaggagccccaaguggaugucugggaauugcucaaaaacgcgaagccuagugaguaugaaaagaucgcauuccaguacgggauuacugaccugcggggaaugcugaagcgccucaaaagaaugaggcgggaggaaaagaaguccgccgcuuuugccaaaaucuuagauccagcauaucagguggacaaggguggccgcguacgauucguuguggagcuggcugaccccaaacuugaggucaagugguacaaaaaugggcaggaaauuagaccuucuaccaaguauaucuuugagcauaagggaugccaaaggauauuguucauuaacaauugucagaugacagaugacagcgaauacuacgugacugccggcgaugagaaaugcuccaccgagcuguucgugcgggaaccacccaucauggucacaaagcagcuagaggacaccacggcguauuguggugaacguguugagcucgaaugcgaggugucagaggaugacgccaacguaaaaugguuuaagaauggggaagagauuaucccgggaccuaaaagucgcuacagaaucaggguggaaggcaagaagcacauucugauaaucgagggcgcaacuaaagcugaugccgcugaauauagcgucaugacaaccgggggacaaucuuccgccaaacuuucaguggaccugaaacccuugaagauucucacuccacugacagaucagaccguuaacuuagguaaagagaucugucugaagugcgagauaagcgaaaauauuccuggcaaauggacgaagaacgggcuccccgugcaggagagugaccggcuuaaggucgugcauaaaggacgaauccacaagcugguaaucgcaaaugccuugaccgaagaugagggcgacuacguuuucgcuccagacgcguauaacgugacacuacccgcaaaaguccacgugauugauccuccaaagaucauucuggacggucucgaugccgacaacacugucaccgugauagcugggaauaaacugcgccuugaaaucccgauuucuggcgagcccccuccaaaggccaugugguccagaggagauaaggcaaucauggagggcagcgggaggauccggacagaaucguaccccgacucuuccacucugguuauugauauagccgagcgcgacgauucaggaguguaucauaucaacuugaaaaaugaagcuggugaggcccacgcaaguauuaagguaaaagucguggacuuuccugauccacccguugcgccgaccgugacagaggucggcgacgauugguguaucaugaacugggaaccuccagcuuacgacgggggaagccccauucucggcuacuucaucgagagaaagaaaaagcaguccucuagguggaugcgucugaauuuugacuuaugcaaggaaaccacuuucgagccuaaaaagaugauagaagguguggccuaugagguacggaucuuugcagugaacgccauugggaucagcaaacccucaaugccaagucgaccuuucguuccccuggcugucacguccccaccgacacuacucaccguggauagcgugacugacaccacagucaccaugagauggaggccucccgaucauauuggcgccgcaggacuggacggcuacguucuugaguauuguuuugaagggucuacuucagcuaagcaaagugaugagaauggagaagccgcguacgacuugccagccgaggauuggaucguggcuaacaaagaccugauagauaagacaaaguucacgauuaccggucuccccacugacgcaaaaaucuuugugcgcguaaaggccgucaaugcugccggcgcaagcgaaccuaaauauuacucccagccaauucuggugaaggagaucauagagcccccuaaaauccggauuccgagacaccuuaagcagacauauaucaggcgcguuggggaagcggugaaccuggucauuccauuccagggaaaaccccgaccugaguugaccuggaagaaggauggcgccgaaaucgacaaaaaucaaauaaacauucguaauucugagacagauacuaucaucuuuauucggaaggcugaaagaucgcacagcgguaaauacgaccuccaggugaagguugacaaauucguggagaccgccuccaucgauauucagauaaucgacaggccagggcccccucagauuguaaagaucgaggaugucuggggcgaaaacguggcacugacguggaccccgcccaaggacgauggaaaugcugccauuacaggcuacacuauccaaaaagcagacaagaaaucaauggagugguucaccgugauagaacauuaucaccgcacaagugccacuaucaccgaguuagucauugggaacgaguacuauuuucggguuuucucugaaaacaugugcggacugagcgaggaugcuacgaugacaaaggaauccgcggugaucgccagagacggcaaaauuuacaagaauccaguauaugaggauuuugacuucucagaagcaccuauguuuacccagccccuagugaacacuuacgcuaucgccgguuauaaugccacacucaacugcagcgucagggggaauccaaagccuaaaauaaccuggaugaagaacaaaguggcuauuguugaugacccccgauaccgcauguucucuaaucagggaguguguacucuggagauccggaagccauccccguacgacggcgguaccuauugcuguaaagcagucaacgaucuuggcacaguggagaucgaaugcaaguuggagguuaaggugauuuaccagggggucaauacgccuggacaacccguauuucuggaaggccagcagcaaguggggaguccaagcgccgacucuuccuguaaagcguaucuccagaccuga

SEQ ID NO: 59366 - RNA, 3426 nt, Artificial Sequence
  derived and/or modified sequence opt3 from MYBPC2__Homo_sapiens__NP_004524
augcccgaggccaagccugcugcaaagaaggccccaaaaggcaaggacgcgccgaaaggggcucccaaggaagccccuccaaaggaggcacccgccgaagcuccuaaagaggcaccacccgaagaucagagcccuaccgccgaggagccaacaggaguguuccugaagaaaccggacuccgucucuguugaaacugguaaggaugcugugguaguggccaaagucaacggcaaggagcuccccgacaagccuacgaucaaaugguuuaaggggaaauggcuugaacugggaucaaagaguggcgcgagauucagcuuuaaagagucccacaauucugcaucgaacguguacaccguugaguugcauauugguaagguggucuuaggggauaggggauauuaccggcuggaagugaaagccaaggacacaugcgauucauguggcuucaauauagacguagaggcuccacgccaagaugccagcggccagagucuagaauccuuuaagcgaacuucugagaaaaagagcgacaccgcaggggaacucgauuucuccggacugcuuaaaaagcgugagguuguggaggaagagaaaaagaagaaaaagaaagacgaugacgaccuggguauucccccugaaaucugggaguugcucaagggcgcuaaaaagucagaauaugagaagaucgccuuucaguacgggauuacagaucugagaggaaugcugaaaaggcucaagaaagcgaaggucgaggugaaaaagagugccgcauucaccaagaaauuagacccagcuuaucagguggaucggggcaacaagaucaaacugauggucgaaauaagcgaccccgaucuuacuuugaagugguuuaaaaauggucaagagaucaagccgucuuccaaauacguuuucgaaaacguggggaagaagcgcauucugacaaucaauaaaugcacccuagccgacgaugcugccuaugagguagcagugaaggacgaaaaauguuuuacggagcuguucgucaaggagccucccgugcugauuguuacuccacuugaagaucaacagguguuugucggagacagaguggagauggccguagaaguuucagaggagggcgcucaggugauguggaugaaagauggcgucgaacugaccagggaggacagcuucaaggcgcgguaccgcuucaagaaagacgggaagcgacacaucuugauauuuagugaugugguccaggaagacagaggaagguaccaggugauuacaaacgguggccagugcgaggcagaacucaucguugaggagaaacagcuggaaguguuacaagauauugccgaccugacuguaaaggcuucugagcaggccgucuucaaaugugaaguguccgaugagaagguuaccgggaagugguauaaaaauggaguggaaguccggccuagcaagcguaucacaaucucgcaugugggccgcuuucacaaacucguaauugacgaugugagacccgaggacgagggugauuacaccuucguuccagacggguaugcacuuucucuguccgccaaguugaacuuucuagaaauaaaagucgaguacgugcccaagcaggaaccuccaaagauccaucuggauugcucaggcaaaacgagugagaaugcuauuguggucguugccggaaacaagcucaggcuggacgugagcaucacuggcgaaccgcccccuguggcaacauggcuuaaaggggaugagguauucaccacuacagagggacggacccgaauagaaaagcgcgucgacuguuccucuuuugugauugagagcgcgcaaagagaagacgaggguagguauacgaucaaaguuaccaauccagugggcgaggaugucgcuucaaucuuccuccaggugguugacgugcccgauccuccagaagccguacggauuacaagugucggggaggacugggcaaucuuggugugggaacccccgauguacgauggaggcaagccugugacugguuaucucgucgagcgcaaaaagaaggggucccagagauggaugaaacugaacuuugaaguuuucaccgagacaacuuacgagagcaccaagaugauugaaggcauauuauacgagaugaggguguuugccguaaaugcuaucggagugucucagccaucaaugaacacaaaacccuucaugccuauugcccccaccagugaaccacugcaccuaaucgucgaggacgugacugauacgacaaccacucucaaguggcguccucccaaccggaucggcgcagggggaauugacgguuaucugguugaauacugccuugagggcagcgaggaaugggugccagcuaauaccgagccggucgaacgauguggguuuacagugaaaaacuugccuaccggagccagaauacuguucaggguugugggcgucaauaucgcgggucgcuccgagcccgccacucucgcucaaccaguaacaauucgggaaaucgcagagcccccuaagauuagacugccaaggcaccuucgccagacguauauccgaaaggugggggagcagcugaacuugguugugcccuuccagggcaaaccucggccgcaagucguguggaccaagggaggcgccccacucgauacuucucguguacaugugagaacaucggacuuugauaccgucuucuuuguuaggcaggcugcccgcagcgacuccggggaauacgagcugucagugcagauagaaaauaugaaagauacagcaacuauccggauuagaguggucgagaaggcgggacccccuaucaacgugaugguuaaagagguauggggcaccaaugccuuaguggaauggcaggcuccaaaggacgacgguaacagugagauuaugggguauuucguccaaaaggccgauaaaaagacgauggaaugguuuaauguguacgagaggaaccgacacaccucuugcacaguuagcgaccugaucgugggaaaugaauauuacuuccgcgucuacacugagaacauauguggccuauccgauucacccggugugagcaaaaauaccgcacggauucucaagacaggcaucacuuuuaaaccuuucgaguauaaggaacaugacuuuagaauggcuccgaaguuccugacgccccuuauugauaggguagucguggccggguacucugcagccuugaacugcgcuguucguggacacccaaaaccuaagguggucuggaugaaaaauaagauggagauccgcgaagaccccaaauuucugauaaccaacuaucagggcgugcucacacugaacauccggagaccauccccuuucgaugcggggaccuacacuugcagggccguuaaugaguuaggagaagcacuggcugaguguaaacuugaggugcgagucccccaguga

SEQ ID NO: 59367 - RNA, 3825 nt, Artificial Sequence
  derived and/or modified sequence opt3 from MYBPC3__Homo_sapiens__NP_000247
augcccgagccuggcaagaaaccagugagcgccuucuccaagaaaccgagaucugucgaaguugcugcagggucacccgccguguuugaggcggaaaccgagagggcuggaguaaaggugcgguggcagcgcgguggcagugacaucagcgccuccaacaaauacgggcuggcaacagaaggaacucgacacacgcucaccguccgugaggugggcccugccgaucaagguucuuaugcuguuauugcagggucgucaaaggugaaguucgaccuuaaagucauagaggccgaaaaggcugagccaaugcuggcccccgcgccugcaccagccgaagcuacaggagcccccggcgaggcuccugcuccagccgcggaguugggcgaaagcgccccgagucccaaaggguccucuagcgcagcuuuaaauggaccuacuccaggugcccccgaugacccuaucggccuguuugugaugagaccacaggauggggagguaaccguuggaggcuccauuacauucucagcuaggguggccggugcaagucuacucaagcccccggucgugaaaugguuuaaggggaaguggguggaccugagcucuaaagucggacagcaucuucagcugcacgauuccuacgaccgggccucaaagguuuauuuguucgaacuccauaucaccgaugcucaaccugcguuuacuggcagcuaccgcugcgaggugaguacaaaagacaaguucgauuguucuaacuuuaaucugaccguacacgaagcaaugggcacgggggaccuggaucucuuauccgccuucagaaggacuagccuggcuggagguggccggcgcauuucggacucucaugaggacaccgggauccuugauuuuuccucauugcugaaaaagcgagacaguuucagaacacccagggauagcaaacuagaggccccagcagaagaggacgugugggaaauacuccggcaggccccucccuccgaguaugaacguaucgcuuuucaguacggagucacugaucugcgcggcaugcuuaagagacugaaggguaugaggcgggacgagaaaaagucuaccgccuuccagaaaaaguuggagccagcauaucaagugagcaaagggcacaagauucgacucacaguugaacuggcggaucacgacgcugaggugaaguggcugaaaaacggccaggaaauccagaugucaggaaguaaguacauuuucgaguccaucggcgccaaacgcaccuuaacgauaagccagugcucucucgcagaugacgccgcuuaccaaugugucguagggggagaaaagugcucaacugagcuuuuugugaaagagcccccuguucugauuacaagaccauuggaagaucagcuagugauggucggucagaggguggaguucgaaugugaggucagugaggaaggcgcccaagugaaguggcugaaggacgggguugagcucacccgggaagagacuuuuaaauaucgcuucaagaaagacggacagagacaucaccugaucauuaaugaagcaaugcuugaggaugcuggccauuacgcccugugcacaagcggugggcaggcguuggccgagcucaucgugcaggaaaagaaacuggagguauaucaauccaucgcugacuuaauggucggcgcaaaggaucaggccguguuuaagugugaaguuucugacgagaacgugaggggagucuggcugaaaaauggcaaggagcuagugccggauucgcguauuaaaguaagccacauagggcgggugcacaagcucaccaucgacgauguuacgcccgcugacgaagccgauuacuccuucgucccugagggauuugcaugcaaccugucagcgaaacuucauuucauggaagugaagauugacuuugugccacgacaggagcccccuaaaauccacuuggauuguccagguagaauacccgacaccauugucguuguggccggcaauaagcugaggcucgaugugccgaucaguggggacccugcuccaacaguaaucuggcagaaggccauuacucaaggaaacaaagcacccgcucgcccugcccccgacgcaccagaagauaccggcgacucugaugagugggucuucgacaagaaacugcuuugcgaaacagagggucgggugagaguugagacuaccaaggauaggagcaucuuuacaguggaaggggccgagaaagaagacgagggcgucuauaccgugacuguuaagaauccugugggagaggaucagguaaaccugacggucaaggugauugacgugcccgaugcuccagcggccccgaaaauauccaaugucggcgaagacucauguacaguucagugggagccucccgcauacgaugggggacagccaaucuugggcuauauucucgaacgcaagaaaaagaaaagcuaccgauggaugcggcugaacuucgacuuaauccaagagcugucucaugaagcucguagaaugaucgagggugugguauacgagaugaggguguaugccgucaaugccauugggaugucccgccccaguccugcuagccagccauuuaugcccauaggaccuccgucugaaccaacccaccuagcaguggaggauguuuccgacacuaccgugucacucaaguggcggcccccugaaagagucggcgccgguggccuggacggguacaguguggaguauugcccagaaggaugcagcgaguggguugcggcacuucagggcuugacagagcauaccucgauccuggugaaggaucuccccacuggggccaggcuguuauuccgaguccgcgcacacaacauggccggaccuggcgcuccgguaacaacgaccgaacccgugacuguucaggagauucugcaacggccaagacuucaguugccuaggcaccuccgucagacaauccagaaaaaggugggugaacccgucaaccugcuaauuccauuccaagggaaaccucgcccccaggugaccuggacaaaggagggacagccacuggcaggcgaagagguauccaucagaaauucuccgacugacaccauacucuuuauccgggccgcgaggcgagugcauagcgguacguaccaagucaccguucggauugagaacauggaagauaaagcuacacuggugcuucagguggucgacaagccuucacccccacaggauuugcgcgugacugacgccuggggccugaauguugcauuagaguggaagcccccucaggauguagggaacaccgaacucuggggauauacagugcaaaaagccgacaagaaaacuauggagugguucaccguccuggagcacuacagaaggacgcauugugugguuccagaacuuaucauuggcaauggguauuacuuucggguguucagucagaacauggucggauuuuccgaucgagcugccacaaccaaggagcccguguucaucccuagaccgggcauaacuuacgaaccacccaauuauaaagcacuggacuuuucugaggcuccuagcuucacacagcccuugguaaaccgcuccgucauugccgguuacaccgcgaugcucugcugugccgugagggggucaccaaagccuaaaaucagcugguuuaagaauggacuggaucuaggcgaagacgcacguuuccggauguuuaguaagcaggguguucugacucucgagauuagaaaacccugcccauucgacggcgggaucuauguguguagggcuaccaaccugcaaggagaggcccgcugcgaaugucgacuugaggucagagugccucaguga

SEQ ID NO: 59368 - RNA, 1434 nt, Artificial Sequence
  derived and/or modified sequence opt3 from MYBPH__Homo_sapiens__NP_004988
augauggagaagaacaccagcgaaggccccgccugcuccccugaggaaacagcuucugagucagcaaaagugccaacugccgaaccgcccggggaggucgcgguuagugagagcacgagagaagaacaggugccuaagccacaagcucccgccccucaggcaccaaccgccuccacagcuacuaaacccgcaccuccaucugaggacguaccgucggcuccccugcuccuuacccuggaugacgugucaagcaguuccgucacagugucuugggagccuccagagagguugggacgguuaggucugcagggcuacguucuagaacucugucgcgagggggccagcgaaugggugcccgucuccgcccgaccuaugauggugacccagcaaacuguacguaaucuggcgcuuggagauaaguuccuguugagaguuucagcagugaguagcgccggcgcugguccacccgccaugcucgaccagccgauccacauuagggagaacauagaagcaccuaaaauccgggucccccgccaucugagacagacauauauuaggcaagugggggagaccgugaaucugcagaucccauuucagggaaagccuaagccccaggcuacguggacucacaacggccaugcccucgauucucagcgggucuccaugcgcaccggcgaccaagauucaauuuuauucauccgaagcgcgcagagaagugacucugggagguacgagcugacaguucggguggaagaucuugaggccaaagcaguaauagacaucuuggugauugaaaagccaggacccccuuccagcauccgucugcuagaugucugggguugcaaugcugcccuccaguggacuccaccgcaagacaccggcaacacagagcugcuuggguauauggugcagaaagcugauaagaaaaccggacagugguuuacgguucuggaacgcuaccaccccacuacauguaccauuucggacuugaucauaggcaauucuuauuccuucagaguguuuucagagaaccucugcggucugaguacuagcgccacagucaccaaggaguuagcacauauucagaaggccgacaucgcugcgaaaccuaagggguucauugaaagggauuuuuccgaggcaccaucuuucacgcaaccccuggccgaccacaccagcacaccuggauacucaacucagcucuuuuguagugugcgggcuuccccaaaacccaagaucaucuggaugaaaaauaagauggaaauucagggcaacccgaaauaucgagcccuuagcgagcagggcguaugcacccuggaaauacgcaagccuucuccauucgauucagggguuuacacauguaaggcaaucaauguguugggagaggccagugucgacugcagacuagaggugaaagcuagcgccgcacacuga

SEQ ID NO: 59369 - RNA, 14037 nt, Artificial Sequence
  derived and/or modified sequence opt3 from MYCBP2__Homo_sapiens__NP_055872
augaugaugugcgccgcuaccgccagccccgccgcggcuuccucuggccuagggggagacgguuucuacccugccgcaacuuuuucaaguagcccagccccgggcgcucucuucaugcccgugccugauggguccgucgcagccgcuggacuuggccuggguuugccagccgcggacucuagagggcacuaucaguuacuguuaucgggaagggcacucgccgaucgguaccgccgaaucuauacugcugcccugaacgaccgugaucagggcggcgggucagcaggacaucccgcuagcagaaauaagaaaauucuuaacaagaaaaagcugaaaaggaagcagaagaguaaauccaagguuaaaacgcggucuaagagcgaaaauuuggaaaacaccgugauaaucccugacauuaaacuccacuccaauccaucagccuuuaacaucuacuguaauguacgccauugcgugcuggaguggcagaagaaggaaauuagucuggcggccgcaagcaaaaacucuguccaguccggugagucagauagcgacgaagaggaggaaaguaaggagcccccuaucaaacucccaaagauuaucgaagugggcuuaugugagguuuucgagcugauuaaagaaacaagauuuucucacccgucccuuugcuugaggagccugcaggcucugcucaaugugcugcaggggcagcagcccgagggacuucagucggaaccuccagagguccuggaaucuuuguuccagcuccuguuagagaucacugugcgguccaccggcaugaacgauucaacaggucagagucugaccgcccucagcugugcuugccuauuuucccugguagccucuuggggagaaacugggcgcacauugcaggcaauuagcgccauccuuaccaauaacggcucacaugcuugucaaacgauacagguucccacuauucugaauagucuccagcgauccgugcaagcgguccuggugggcaagauccagauucaggacugguucagcaacgggaucaaaaaggcagcccuuaugcacaaguggccucugaaagaaaucucuguggaugaggacgaucagugcuugcuccaaaaugacggauuuuuccuguauuuacuguguaaggacggucuguacaaaauuggcucaggguauaguggaaccgucagaggccacauauacaacagcacauccaggauccggaaccguaaggagaagaagucuuggcucgguuacgcucagggguaucugcuuuaccgcgauguuaauaaccauucgaugacugccauuagaaucagcccagagaccuuggaacaggacggcacagugaugcugcccgauugccacaccgagggacagaauauacucuuuacggacggcgaguauauuaaccaaaucgcagccuccagggaugacggguucguagugcggaucuuugcuacuucaacagaaccgguccugcagcaggagcuucagcugaaguuggcccgaaaaugucuccaugcaugcggaauuagucuguucgauuuagaaaaggaccugcacaucauuucuaccgguuucgaugaggaaagcgcgauacuaggcgcugggcgcgaguuugcccucaugaaaacugcaaauggaaagaucuacuauacaggcaaauaccaaucccuggguauuaagcaagggggcccuucagccggaaaguggguggagcuucccaucaccaaaagcccaaagaucguucacuucucugugggccaugacgggucccacgcuuugcuggucgccgaagauggaaguauauuuuucacggguagcgcaucuaaaggcgaggacggggaauccaccaagucaagaaggcagaguaaaccuuauaagcccaagaaaauaaucaagauggagggaaaaauugugguauacacagcuugcaacaauggcagcucguccguuaucucuaaggacggugagcucuacauguuugggaaagaugccauuuauagcgacucaaguucccuggugacugauuuaaagggccauuucgucacccagguggcgaugggaaaagcccacacauguguccugaugaagaacggcgaaguguggacuuuugggguuaauaacaagggacaaugcggccgggacaccggugcuaugaaucaagggggaaaaggcuucgguguggagaacauggcaacagccauggaugaagaccuugaggaagaguuggaugagaaggacgaaaaaucuaugauguguccacccggcaugcauaaguggaaacucgagcagugcaugguauguaccgucugcggggauuguacuggauacggcgcuagcugcguguccucagggcgcccugacagaguuccaggaggcaucugugguugcgggagcggagaaaguggcugugccgugugcgguugcuguaaggcaugcgcgagggagcuggauggccaagaagcccgucagcgggggauacuagacgcugucaaggagaugaucccgcuggaucuccugcuugccgugcccguaccuggagugaauauugaggaacacuugcagcugcgacaggaggaaaaacggcaaaggguuauccgccggcacagauuagaggaaggcagggggccacucgucuuugcaggacccauuuucaugaaccaucgcgagcaggcucuggcccgacuucggucucacccugcacagcugaagcauaaacgugacaagcacaaagacggcuccggugagagaggggaaaaggaugccagcaagaucacgacauauccacccggaucggugagguuugacugugaguugcgcgcugugcaggucucaugcggcuuccaccauucuguugugcucauggaaaauggugauguguacaccuuuggcuaugggcaacacggacagcugggccauggggacguaaacagucggggauguccgacucuaguccaggcgcugccuggcccauccacccaggugacagccgguagcaaccacaccgcaguucuccugauggaugggcaaguguucacuuucggaucuuuuagcaaaggccagcuuggcagacccauauuggacgucccuuacuggaaugcuaagcccgccccaaugccuaacauuggguccaaauauggaaggaaggccacauggaucggugcuucaggcgaucagacguuccugcgaauugacgaggcauuaaucaauagucaugugcucgccaccagcgagauauuugcgucuaaacacaucauugggcugguucccgcuuccaucucagaaccaccgccuuucaagugccuucugauuaacaagguggauggaaguuguaaaacuuuuaaugacagcgagcaagaagaucuacagggcuucgguguaugccucgaccccgucuacgaugugaucuggcgcuuucggccaaacacaagagagcugugguguuacaaugccguggucgcagacgccagguugcccuccgcugcagacaugcagucucguugcucgauacugagcccugaauuagcccucccaaccgggucacgcgcgcugacaacucggucccacgcugcccuucauauucugggauguuuggauacccucgcagccaugcaggaccugaagaugggcguugcuaguacggaggaggaaacccaagccgugaugaaaguauauucuaaggaggauuacagcguggucaacagauucgaaucccacggcgggggaugggguuauucagcacauucuguggaggcuaucagguuuagcgccgacacagauauccuacugggcgggcuuggacucuucggcggucgaggggaauacacugcgaaaauuaagcuguuugaguugggacccgacggcggcgaucacgagaccgacggggaucuguuagccgaaacagacguucucgcauaugauugcgcugcccgggagaaauacgcuaugauguucgacgaaccugugcugcuucaggcaggauggugguaugucgccugggcccgcgugagugguccguccagcgacugcggcucucaugggcaggcuucaaucacuaccgaugacggaguuguguuucaguucaaguccaguaagaaaagcaauaacggcacggaugucaaugcgggucaaauuccacagcuguuguacagacuccccacaucggacgggucugcauccaagggaaaacagcagaccagcgagccuguacacauacugaagaggucauucgcccggacugugaguguugaauguuuugagucucuacuguccauccuucacuggagcuggacaacccucgugcugggcgucgaggaauugcgaggcuuaaaaggguuccaauuuacugcuacccugcucgaucuggagagacuucgcuucgugggaacaugcugucugagguugcuacguguauacacgugcgaaauuuauccagugucagccaccgguaaggcagucguugaggagacaaguaagcuggccgaauguaucggcaaaacacggacccuccugagaaagauucuuagcgaggggguggaccauugcauggugaaauuagauaacgacccccagggauaccugucccagccucucucuuugcuggaagcuguccuccaggagugucacaauacauuuacugcgugcuuccauagcuuuuauccgacccccgcccugcaaugggcaugucuuugcgaucuguugaacugucuagaccaggauauccaggaagcuaauuucaagacguccucaucuaggcugcucgccgcagugaugagugccuuaugccacacaucgguuaaacugaccagcauauuuccaaucgcuuacgacggcgagguacuucugcgcuccauugugaagcaagucucuacugagaacgauucaacccucgugcaccgauucccuuugcugguugcccauauggaaaagcucagccaguccgaggaaaacaucagugguaugacaucuuuuagagaggugcuggagaaaaugcuugucauugugguacuacccguccggaauagccugaggcgcgagaacgaguuguucucaucccacuuagugaguaauacuugcgggcugcucgcgagcaucguuucugaacugaccgcauccgcccuuggaucagagguggacggccugaacagccuccauucggucaaggcuucugccaaucguuucacaaaaacgagucagggcagauccuggaacaccgggaauggaagcccagacgcuauauguuuuucaguggauaagccugguauuguuguggucggcuucuccguguaugggggaggcgguauccacgaauacgaguuggaaguacugguggacgauucugagcaugcaggggacagcacucacagucaccgguggacaucccuagagcugguuaaaggcaccuauacuacagaugacagccccucugauaucgccgaaauuaggcucgacaaggucgugccacuuaaggagaacgugaaauacgcuguccgccugcgaaauuacggaucaagaaccgccaacggcgaugggggaaugacgacuguacagugcccggacggugugaccuuuacauucaguaccuguuccuuaagcucuaauggcacuaaccaaacacgggggcagauaccucagaucuuguauuacaggucggaauuugauggagaccugcagucacaacuccugagcaaggcaaaugaggaggauaaaaacugcucccgcgcgcuuaguguugugucuaccgucgugagagccagcaaggaccugcuccauagggcuuuggccguugacgcagaugacauucccgaacuguuauccucaaguucucuauucagcaugcugcucccacuuaucauugcuuauaucggccccguggccgcagccauaccuaaagucgcuguggagguauuuggucuggugcagcaguugcugccauccguugcgauccucaaucagaaguacgcacccccugcauucaacccgaaccaaucaacagauagcacuaccgggaaucagccagaacagggccugucugcuuguacgacauccagucacuaugccgucauugagagcgaacaucccuacaagccugccugcgugaugcacuauaaagugaccuuucccgaguguguccgguggaugacuaucgaguucgacccacaaugcggaaccgcacagucggaagauguucuucgucuccugauuccugugcgcacaguacagaacuccggcuacgggcccaaguugacuucugugcacgagaaucugaacucauggaucgaacugaaaaaguuuagcggaaguuccgguuggccaaccaugguccuagugcugccuggcaaugaggcucucuucucucuugaaacggccagcgacuacguuaaagaugacaaggcgucauuuuauggguucaaauguuucgcuauaggauacgaguuuuccccgggccccgaugagggugugauucagcuggaaaaggaguuggccaaccuagggggcgucugcgcagccgcucucaugaagaaagaccuggcacuuccaaucggaaaugaauuagaggaagaucuggagauccucgaggaagccgcguugcaaguauguaagacacauaguggcauucuggggaaaggacuagcucugagccacucuccuaccauccucgaggcccuugaaggcaaccugcccuugcagauacagucaaaugagcaguccuuccuggacgacuuuauugcaugcgugccagguagcucugggggacgacucgccagauggcugcaaccugauaguuaugcugacccccagaagacuucguuaauccuuaacaaagaugacauuaggugcggcuggccgacaaccaucacuguucagacaaaggaucaguacggugacgugguccaugugccaaauaugaaggucgaggugaaagccguuccugugucccaaaagaaaaugagccugcagcaggaucaggcaaagaaaccccaacggauaccaggcucacccgcuguaaccgccgcgucuagcaacacggacaugacuuaugggggacucgccuccccuaagcuagaugugaguuacgaaccgaugauugucaaggaggcacgcuauaucgcuaucaccaugaugaaaguuuacgaaaauuacucauucgaggaacugagauuugccucucccacaccaaagaggccuagcgagaacauguugauucgggugaauaacgacggcaccuauugugcaaauuggacacccggggcuaucggacuguacacucuccacgucaccauugauggcauagagaucgacgccggucuugaagugaaaguaaaggauccuccaaaagggaugauucccccuggaacgcagcuggugaagccaaaguccgagccccagccgaacaaaguucgaaaguucguggccaaagacagugcgggcuugagaauccgcagccauccuucccugcaaucugaacagaucgguauugucaaggugaacggcacaauaacuuuuaucgacgagauucacaaugaugacggggucuggcucagguuaaacgaugaaaccaucaaaaaguaugugccaaauaugaacggauacacagaggcuuggugccugucauucaaucagcaccuuggcaaaagccugcuaguucccguagacgagucgaagaccaacacugaugacuuuuucaaggauauuaauuccuguugcccucaggaagcaaccaugcaagagcaggacaugccauuucucagagggggacccggcauguauaaaguggucaagacagguccgagugggcauaacauccguucuuguccuaaucugagaggaauacccaucggcauguuggugcugggcaacaaaguuaaggccgugggggaagucacgaauagcgagggaacuugggugcagcucgaucagaacucaaugguagaguucugcgaguccgacgagggugaggcuuggucucuugccagggaucgcggcgggaaucaauaccugcggcacgaggacgaacaggcauuacuggaccagaacagucagaccccaccucccagcccauuuuccgugcaagccuucaauaaaggagcuucauguagcgcgcagggcuucgauuaugguuuggggaacucuaagggagaccgaggcaacauuaguacauccagcaagcccgccucaaccucuggcaaauccgagcucucgagcaagcauaguagaucucugaaaccugaugggaggaugucccgcacuacagcagaccagaagaaaccacggggaaccgagagccuaucagcuagugaaucccuuauccuaaagagcgaugccgcaaagcucagaucugacucacacagccguucccugucuccgaaucacaacacguugcaaacucugaaaagugaugguaggaugcccucgagcucccgggccgagucaccuggcccagggucucgccucagcagucccaagccuaaaacacuuccagcuaaucgauccucacccucuggagccagcuccccuagaaguagcucuccgcaugacaagaaccugccacagaaaucaaccgcgcccguuaagaccaaguuagauccucccagggaacgguccaaaagcgacaguuacacucuggauccagacacauugcgcaagaaaaagaugccucucaccgagccccugagaggcaggucuacauccccaaaaccgaagucggucccuaaagauagcacugacucacccgguuccgaaaaucgagcaccaucuccccacguggugcaggagaaccuacauagugaggucguugaagugugcacgagcucaacccuuaagacaaauucccugacugacagcaccugugaugacucuagugaguuuaaguccguagaugaagggagcaacaaagugcacuucucaauuggaaaggccccucucaaagacgagcaggaaaugcgggcuucuccaaagaucucgcguaaaugcgccaauagacauacacgccccaagaaggagaaaagcuccuuucuguucaagggcgauggcaguaaaccuuuggagccggcaaagcaagcuaugucuccaucagucgccgaaugugcuagggccguguuugcgagcuucuuauggcacgaggggauaguucacgacgcaauggccugcuccaguuuucugaaauuccaucccgaacucucuaaggagcacgcuccuauucggagcucccuuaacucacagcagccaaccgaagagaaggagacuaaacugaagaauagacauagccuagaaaucucuuccgcccugaacauguuuaauauugcaccccacggaccugauaucaguaaaauggguucaauaaacaagaauaaagugcucagcauguugaaggagcccccacugcaugaaaagugcgaggacggcaaaacggagaccacauucgaaaugucgaugcacaacacuaugaaguccaaaucuccgcuuccucugacccuccagcacuuagucgcuuuuugggaggauaucagucuggccacaauuaaggcagccagccaaaacaugaucuuccccucaccaggguccugugcgguguugaaaaagaaggaaugcgagaaagaaaauaagaaaucuaagaaagagaagaaaaagaaggagaaagcugaaguacgcccuaggggaaaccuguuuggcgagauggcccagcucgcaguuggugggcccgaaaaggacaccauuugugagcuuugcggagaaagccauccauacccugugacuuaucacaugcgacaggcccaucccggcuguggccgguacgcugggggacaggguuauaauaguaucggccacuucugcgggggaugggccggcaacuguggugaugggggaauaggcggcuccacaugguaccuggucugcgacagauguagggagaaauaucuacgcgagaagcaagcagcugcccgugaaaaagugaagcagagccggagaaagccgaugcaagugaaaacgccaagggcgcugccuaccauggaggcucaccaagucauuaaggccaaugcacucuucuugcugucucuuucauccgccgcugaacccagcauccugugcuaccauccagcaaaacccuuucagagucaguuaccuucuguuaaggaggggaucucagaagaucucccggugaaaaugccaugucuguauuugcagacucuggcccgccaccaucacgagaacuucguaggauaccaagacgacaaucucuuucaggaugagaugcgauaccuucgguccacaagcgugcccgcgccuuauauuucggucacccccgacgccucuccaaacguguucgaagaaccugaaaguaauaugaaguccaugcccccaagccuggagaccucaccuaucacagauacugaccuagcuaagagaacgguuuuucagaggucuuacagcguggucgcauccgaguaugauaaacagcauaguauacugccggcccgcgugaaggcuauucccagacggaggguaaacucaggugacaccgaaguuggcagcucccucuugcgucacccaucuccugagcugagucgauuaaucagcgcccacuccucacuuucuaaaggggaacgcaauuuccaauggcccgugcuggcauuugucauucagcaucacgaucucgagggacuggaaaucgcuaugaagcaggccuugagaaaaucggcgugccggguguucgccauggaggcauuuaacuggcugcucuguaauguuauacagacaacuagccuucaugacauccuguggcacuucguggcuucccuaaccccagccccugucgagcccgaagaggaagaggaugaagagaacaagacaaguaaggaaaauucugaacaagagaaagacaccagggugugcgaacacccgcugagcgauauuguaaucgcaggcgaggccgcucauccauuaccucacacuuuucaucgccuccugcagacgauuucagacuugaugaugucccuucccagcgguucuagucugcagcagauggcccucagaugcuggucccugaaguucaaacaaucagaccaccaguuuuugcaucagagcaacguguuccaccacaucaacaauauucugucuaagucggaugacggggauuccgaagagaguuucagcaucucaauacaaucuggauuugaggcgaugucccaggaacuauguauugucaugugccucaaagaccuuacaagcaucguugauaucaagaccaguucacggccagcuaugauuggcucccugacugacggcagcaccgagacauucugggaaucuggggaugaggacaaaaacaagacuaagaauauaaccaucaacugugugaaaggaauuaaugcaagguacgucagugugcauguagauaacagccgagacuuagguaauaaggugacauccaugacguuucugaccggcaaagccguugaggaucucugccguaucaaacagguggaccuggauucuagacacauugggugggucacuucagaauugcccggaggcgacaaccauaucauaaaaaucgagcuuaaggguccugaaaauacacugcgcgugcggcagguuaagguccucggguggaaagacggcgagagcaccaagauugcuggacaaaucuccgccucgguggcacagcagaggaacugugaagccgagacucugagaguguuccgccuaauuacaucucagguauuuggcaaauugaucaguggggaugcugagcccaccccagaacaagaggaaaaggcgcugcucagcucaccugagggagaagagaaagucuauaaugccacguccgacgcagaucuuaaggagcacaugguggguauaauuuucucucggagcaagcugaccaacuuacagaaacagguuugcgcccauaucgugcaggcuaucaggauggaagcaacacgagucagagaggaaugggagcacgccauuuccaguaaggaaaaugcuaacucacaaccgaaugacgaggaugccagcucugacgcguacuguuuugagcugcucuccauggugcuggcauugaguggcagcaacguugggcggcaguaucuugcccagcaacugacucuccugcaggaucuauucucauuacugcacaccgcuucucccagggugcagcgccagguaacauccuugcuccguagaguccugccagaagugacuccuucgcgacuugccagcauaaucggagugaaaagucugcccccagcagacauuuccgauaucauucauucuaccgagaagggcgacuggaacaaacucgguauccuggauauguuuuuggggugcauagcuaaggcccuuacaguucaacugaaggcgaaaggcaccacuaucacgggaacagccggcaccacugucgggaagggagugaccacaguaacgcuaccuaugauuuucaauucaagcuaccucaggcggggugaaucccacugguggaugaaaggcucuacccccacucagaucagcgagauuaucauuaagcugauaaaagacauggcugcagggcauuuaagugaggccuggucacgcgugacaaagaacgcuaucgcagaaaccauuaucgcccugacuaaaauggaggaagaguuuagauccccggucagguguaucgcuacaacccgguuguggcucgcccuggcaagccuuugcgugcuggaucaggaccacguugaccgccucucuaguggaagauggaugggcaaggauggucagcaaaagcagaugccuaugugugacaaucacgaugacggcgaaacagccgcgauuauauugugcaacgugugcgggaaucuguguacugauugcgaccgauuccuucaucugcacaggcggaccaaaacgcaucagcgucaggucuuuaaggaggaggaagaggcuaucaaaguggauuuacacgaaggauguggccgcaccaagcuauucuggcucauggcccuggcagacuccaaaacaaugaaggccaugguugaguucagagaacauacugggaagccaaccacaagcucaucggaggcuugcagguuuuguggaucucggagcggcacugagcuguccgccguggguaguguaugcucagaugcagacugucaagaauacgcuaaaauugccugcucuaagacccaccccugugggcacccuugcggaggcgucaaaaacgaggaacauuguuugccaugccuccacgguugcgauaagagcgcgacgucccugaaacaggacgcagacgauauguguaugaucugcuucacagaggcccuuagugcugcccccgcuauucagcuggacuguagccauaucuuucacuuacagugcuguagacgcgugcucgaaaaucgauggcugggcccuaggauaaccuucggguuuaucucuugcccaauuuguaagaacaagaucaaucacauuguuuugaaagaucuucuggaccccaucaaggagcuauaugaggaugugcggagaaaagcacucaugcgucuggaauacgagggacugcauaaguccgaagccauaacuacaccgggcguccgcuucuauaacgacccugcgggguacgccaugaauagguaugcuuacuaugugugcuacaaaugucggaaggcauacuuuggaggcgaggccagaugcgaugcugaggccggucgaggggacgauuaugaccccagggaauugauuuguggagcaugcucagauguaagccgcgcccaaaugugcccaaagcacggcaccgacuuccucgaguacaaaugucgguauugcuguucgguggcugucuuuuucugcuuugguacuacccauuucuguaacgcgugccacgaugacuuucagagaaugacauccauccccaaggaagaacugccucauuguccagccggccccaaagggaagcagcuugaaggaacggagugcccucugcacguugugcacccaccgaccggcgaggaguucgcauuaggguguggagugugcaggaaugcucauacuuucuga

SEQ ID NO: 59370 - RNA, 2955 nt, Artificial Sequence
  derived and/or modified sequence opt3 from MYCBPAP__Homo_sapiens__NP_115509
augagagcccccgcuaggggcaccgggugcuguggacggagcgguggccgcuggcuggcaggggccgcgcagccucgaugccucugggcuggaggcgccggucaacguuucauggugccagggggaacaaugaagucccuuaaaaaggacucuagacugaggaucacuccgacgcgguuguuagaggcaucagaaaacgucaaagagaagaaacgcgccaagggccccgaacagccuaccccaacaauucaggaggaacccgagccuguuaguaaugugcugcagggcgaugacauacuagcucucgcaaucaagaaagaggaucugaaggaacaacacauuccaagacuuacugagaaagaagacaagaggguaaucacccagaaauuuauuauccggaagcugaagcccauggauccucgccgaaaagugugucauuuggucgccagaccagcuaacccggacgaggccacaaagccccucgauuacagcgggccuggagacuccuucgaugguucugaccagauacugccacaccauauccugggcucgcuccaggauuuuaaaaggauugcguuagcacgggggaauacccaacuggccgagcguauccccacuucaccuugccuuaugacauugauuagcgcugaaggagagaguaagcagaaagccccaaaggaagagaaacggcccccgugggcaccucccccacagcacaacuuccugaagaauuggcagagaaacaccgcucuaaggaagaaacaacaggaagcccucuccgagcaucugaagaaaccugugucugagcuucugaugcacacgggcgaaacuuaucggcgaauccaggaggaacgcgaguugauagacuguacccuccccacaagaagggaucgcaagagcugggaaaauuccgguuuuuggucacgccuggaguacuuaggggacgagaugacuggacugguuaugaccaaaacaaagacccaaagaggccucauggaaccaauuacgcacaucaggaagccccauaguauucguguggagacuggccuuccugcgcagcgggacgccagcuaucgauacacaugggauagaucucuguucuugaucuauaggcgcaaagaacuacagcggaucauggaggaacuggacuuuucccagcaagauauugacgggcucgaggucgugggaaaggguuggccauucucagcaguaaccguugaggauuacacuguguuugaaagaagccagggcaguucuuccgaggacacagcuuaucuggggacccuugccagcucgucugaugucuccaugccgauacugggacccucacucuuguucugcggcaaaccugcuuguuggaucagggguaguaacccacaggacaagcgccagguggggauugccgcacaccugacguuugaaaccuuagagggcgagaaaacaagcuccgaacugacuguggucaauaacggaaccguugccaucugguacgauuggcgacggcaacaucagcccgacacauuccaggaucuaaagaagaaucguaugcagagauuuuacuucgacaacagggagggcgugauacucccuggggaaauuaaaacuuucaccuuuuucuuuaagucucugacagcuggaguauuccgcgaguuuugggaguuccggacccacccaacucuuuuggguggcgcgauccugcaagugaaucuccacgcagucagccugacgcaggacguguuugaagaugagagaaaaguucuugaaucaaagcugacagcccaugaggcugugaccgucgugagggaaguauugcaggagcuccugauggggguuuuaacucccgaacgaaccccgaguccuguggacgccuaucugacagaggaggaucuauuccgccaccggaacccaccccuccauuacgaacaccaggucgugcaaucccugcaucagcuuuggagacaguauaugaccuugccugcaaaagccgaggaagcuaggcccggagacaaggagcacgucagcccaaucgccacugaaaaggcaucugugaaugcggagcugcucccucguuuucgcucacccauuagugagacacaaguuccacggccggaaaacgaggcucugagagaaagcggcucccagaaagccaggguggguacgaagucuccucagcgaaaaucgaucauggaggagauuuuaguagaagagagccccgaugucgacuccaccaagucaccaugggaacccgaugggcugccucuuuuggaguggaaccucugccuggaagacuuccggaaagcagugaugguucuaccagaugagaaucaccgcgaggacgcccugaugagacucaacaaggcugcccuggaacuuugucagaaacccaggccuuugcaaaguaaucuguuacaucagaugugccuccagcuguggcgggaugugauagacucucuugucggccacagcauguggcugcgauccguguugggacucccggagaaggaaacuaucuaccugaacguaccagaggaacaggaucaaaagucacccccuauuauggaggugaaaguuccagucggcaaggcagggaaagaggaaagaaagggagcugcccaggagaaaaagcagcuagguaucaaggacaaagaagacaagaaaggcgcgaagcugcucgggaaagaggaucgccccaauagcaagaagcauaaagccaaggacgauaaaaaggugaucaaaucugcuucccaggacagguuuagucuggaagauccuacaccggacauuauacuuagcucucaagagcccaucgauccauuggugaugggaaaguauacccagucccugcacucagagguccguggcuuacucgacacacugguuacugaucuuauggugcuggcagacgaacuaaguccuauuaagaacguggaggaagcccuccggcuguguagauga

SEQ ID NO: 59371 - RNA, 1365 nt, Artificial Sequence
  derived and/or modified sequence opt3 from MYC__Homo_sapiens__NP_002458
auggacuucuuuaggguggucgagaaccagcaacccccugccaccaugccacugaauguuagcuucacaaacaggaauuacgaucucgacuaugauuccgugcagccguacuuuuauugcgacgaagaggaaaacuucuaccagcagcaacagcagucugagcuucagcccccugcuccaucagaagauaucuggaagaaauuugagcuguugcccacuccuccauuaagucccagccggcgcuccggccuguguucuccuucguauguagcagugacgccauucucacuacgaggggacaaugauggagguggcgggagcuuuaguaccgccgaccaacucgagauggucacagaacugcuuggaggcgauauggugaaccaguccuucauuugcgacccggaugacgagacuuuuauaaagaauaucauuauccaggauuguauguggucugguuucagcgcggcugccaaacugguuuccgaaaaguuggcaucauaccaggccgcucguaaagacagugggagccccaacccugcaagaggacacucugugugcuccaccucaagccucuaucugcaagaccugagugccgcugccucugaguguauugauccauccgucguguuucccuacccucucaaugacagcucgucuccaaaguccugcgcgucacaggauaguagcgcauucucccccucuagcgacucauuacugaguuccacagagagcucuccgcagggcucaccugaaccccuuguauugcaugaggaaaccccaccuacuacaaguagcgauuccgaggaggaacaagaggacgaagaggaaaucgauguugugucugucgagaagaggcaggcccccggcaaacggucggaaagcggguccccaucagcuggaggucacaguaagcccccucauucuccacuggugcuaaaacgcugucacgugagcacccaucagcacaacuacgccgcaccgcccuccacgagaaaggacuauccugcugccaaaagggucaagcucgauucaguucgggugcugcgccagauaagcaauaaccgaaagugcacuucuccaagauccagugacaccgaggagaauguaaaaaggcggacacacaacgugcuugaacgucaacgcagaaaugagcugaagaggagcuuuuucgcguugcgggaucagauccccgaacucgagaacaacgaaaaagccccuaaggucgugauucugaaaaaggcaacugcuuacaucuuaucuguucaggccgaggagcagaaacugauuuccgaagaggaccuccuucgaaagcgcagagaacaacugaagcauaaauuggagcagcuaagaaauucaugugcuuga

SEQ ID NO: 59372 - RNA, 1395 nt, Artificial Sequence
  derived and/or modified sequence opt3 from MYCN__Homo_sapiens__NP_005369
augcccagcugcuccaccucuacaaugccuggcaugaucuguaagaacccagaccuggaguucgauucacuccagccgugcuuuuaccccgacgaagaugacuucuauuuugggggaccugauaguacuccacccggugaggacauuuggaaaaaguucgaacuucugccuacgccacccuugagcccuuccagaggcuuugccgagcacucuucggaaccaccgucaugggugaccgagauguuacuggagaaugaacuaugggggagccccgcugaggaagaugcauucggacucggcggucuagggggacuuacaccuaacccagucauacugcaagacuguauguggaguggcuuuuccgccagggagaaauuggagcgggcgguuucugaaaagcuccagcauggccgcgggcccccuacugcuggaagcaccgcccaguccccaggugcaggcgccgcuucacccgcagggcgaggacacggcggugccgcuggggccggacgugcgggcgcagcccugccggcugagcuggcccauccugcagcugaaugcguggaucccgccguaguguucccauuuccugucaauaaaagagagcccgcgccagugcccgccgccccugcuagugccccagcugccggcccggcaguugccagcggggcuggaaucgcggcacccgccggugcuccuggcguggccccacccaggccugggggacggcagacaucuggcggugaccacaaggcacucuccaccucaggggaagauacuuuaagcgacagugaugacgaggacgaugaggaagaggacgaagaggaagagauugaugucgugacaguagagaagcgcagaucuuccagcaacaccaaagccguuacgacuuucaccaucacagugaggccaaagaaugcugcccugggccccggacgggcacaaucgucugaacuuauuuugaaacgcugucugccgauccaucagcagcacaacuacgcggcuccuuccccauaugucgagucagaagacgcacccccucagaagaaaauaaagagugaggcaagcccccgaccacuaaaguccgugaucccucccaaagccaagucucucagcccaagaaauucagauagugaagacuccgagaggcggcguaaccacaauauucuggagcgccaaagaaggaacgaucuucggagcucuuuucugacuuugcgagaccaugugccggaacucgucaaaaaugagaaggcugccaaaguugugauccugaagaaagcaaccgaauacguacacucauuacaggcugaggagcaucagcugcuccuugaaaaggagaagcugcaggcccgccaacagcaguugcugaaaaagauugaacacgcgagaacaugcuga

SEQ ID NO: 59373 - RNA, 708 nt, Artificial Sequence
  derived and/or modified sequence opt3 from MYCT1__Homo_sapiens__NP_079383
augagaacccagguguacgagggccugugcaagaacuauuucagccucgccguccuucaaagggaccggaucaaacuguuguuuuucgauauuuuaguuuuucuguccguguuccuacucuuucugcuuuuccugguagacauaauggcuaauaacacaacuucuuuggggucacccuggccugaaaauuuuugggaggaucucaucaugaguuucacggugagcauggcaauuggacugguccuggguggcuuuaucugggccguguucauuugucucucccgccgacguagagcgucugcuccaaucucgcaguggucaagcaguaggcggucccgcucuagcuacacccacggguuaaacagaacaggauuuuauaggcauuccggcugcgaacggcgcucaaaucugagucuugccagcuugacuuuccagcgacaggcaucucuggagcaagccaacuccuuuccgagaaagagcucauucagggcuaguaccuuccaccccuuucuacaguguccuccacuccccguugaaacagagucucagcuggugacccuuccuuccagcaauauaucgccaacuaucucuacaucccauucacugagucggcccgacuacuggagcuccaacucuuugcgugucggucucagcaccccuccaccgcccgcauaugagucaauuaucaaagccuucccugauaguuga

SEQ ID NO: 59374 - RNA, 480 nt, Artificial Sequence
  derived and/or modified sequence opt3 from MYD88__Homo_sapiens__NP_001166037
augagacccgacagggccgaggcuccuggcccaccggcaauggccgcugggggacccggugcgggcagcgccgcaccuguguccucuaccucaagucugccacucgccgcucuuaacaugcggguccgccgacgucugagcuuguucuuaaauguuagaacacagguggcagccgauuggacugcucuggccgaagagauggacuuugaauaccuagagaucaggcaacucgaaacgcaggcggaucccaccgggcggcugcuugacgcauggcagggacgcccuggcgccuccguagguagacuguuggagcuccugacaaagcuggggagggaugacgugcucuuagagcugggaccaucuauuggcgcugccggcuggugguggcuuucguugaugauaacuugccgggcacgcaacgucaccucacgacccaaucugcacagcgcuagucuacaggugccuaucagauccgauuga

SEQ ID NO: 59375 - RNA, 522 nt, Artificial Sequence
  derived and/or modified sequence opt3 from MYDGF__Homo_sapiens__NP_061980
auggccgcucccagcggcggguggaacggagugggugcaucccugugggccgcgcuccuucugggcgcugucgccuugagaccugcagaggccguuucugaaccaaccacaguggcuuucgacguaaggcccgggggagugguccacucauuuagucauaaugugggcccgggugauaaguacacuugcauguucacguaugcaagccaagggggaaccaacgagcaguggcagauguccuuaggcacaucugaagaccaccagcauuuuacuuguaccaucuggcggccucagggcaaaucguaccuguauuucacacaauuuaaggccgagguucgcggggcugaaauugaguacgccauggcguauucaaaagcagccuucgagcgagaaagcgaugugccacuaaagaccgaggaauuugaggucacuaaaacagcuguggcccaccgucccggagcauucaaggcugagcucaguaagcugguaauaguugccaaagcguccagaaccgaacuuuga

SEQ ID NO: 59376 - RNA, 1731 nt, Artificial Sequence
  derived and/or modified sequence opt3 from MYEF2__Homo_sapiens__NP_001288139
auggccgacgcuaacaaggcagaggugcccggcgccaccgggggagauagcccucaucugcagccagcggaaccgcccggugagccuagaagggaaccacaccccgcugaggccgaaaaacaacagccucagcacuccucuucaaguaauggcgucaagauggagaacgacgagagcgcaaaagaagagaaguccgaucucaaagaaaagucuacagggucgaagaaagccaaucgguuccauccauacucaaaggacaaaaacagcggaacuggcgagaagaaaggucccaaucgcaaccgaguuuuuaucaguaauauuccuuaugauaugaaguggcaggcuauaaaggaccuuaugcgugagaaagugggggaaguaacguacguggagcuguucaaggaugcagaaggaaaauccagaggcugcggcgucguggaguuuaaggacgaagaguucguuaaaaaggccuuggagaccaugaacaaauaugauuuaucugggaggccacugaauaucaaggaagacccggauggagagaacgcucggcgcgcccuacaaagaacagguggcagcuuucccgggggacacgugccugacaugggcuccggucucaugaaucugccacccucaauucuuaacaauccuaacaucccacccgaagucauuaguaaucugcaggcggggagguugggaagcacuaucuucguggcaaaccucgauuuuaagguaggcuggaaaaagcugaaagagguuuucucuauagccggcaccgugaagcgggcugacaucaaagaagacaaggaugggaagucccgcggaauggguacagucaccuuugagcaggccauugaggcagugcaggcuaucucaauguucaacggccaauuucuguucgaccgaccgaugcaugugaaaauggaugacaagagcgucccucacgaagaguacagaagucacgaugggaaaacuccccagcucccaaggggauuaggcgguauugggaugggccugggaccuggcgggcagcccaucucugccucccagcuuaauauaggagguguuaugggcaacuuggggccaggaggcauggguauggacgggcccggcuuuggaggcaugaaucggauugggggagguaucggcuucgggggacuggaagcgaugaacagcaugggcgguuucgggggcgugggacguaugggcgagcuauaucgcggggccaugacaucgucuauggaaagagauuuuggaaggggcgacauugguaucaaucggggguucggagauuccuuuggccgacucgguggcgggaugggaucaaugaacaguguaaccggcgggaugggaaugggccuggaccgcaugagcuccucuuucgauagaauggguccugggaucggagcaauucuugagaggagcauagacauggaccggggcuuucugucagguccaaugggcagugggaugcgcgagagaaucggauccaagggcaaucaaauuuucgugaggaacuugccguuugaucucacguggcagaaacugaaggaaaaguucagccagugugggcaugucauguuugcugagaucaaaauggaaaauggaaagucuaaaggcugcgguacugugcguuucgacucacccgagagugccgagaaggcuugucggauaaugaacgggauuaaaaucagcggacgagaaaucgauguuagauuagacaggaaugccuga

SEQ ID NO: 59377 - RNA, 942 nt, Artificial Sequence
  derived and/or modified sequence opt3 from MYEOV__Homo_sapiens__NP_001280220
auggcccugagaaucugcgugaccuacacacccgcucucccuauuggccuuuguacuaggugcugucugugcuuggagcagagcccauccuggugucacugcuuacgcggggucucuuuccugacguuucaucuacaccaaucaguuccgcucggagaccgggauagucugcuuauguucacccgacaggcaggucauuuuguggaaggcagcaaggccgggcguuccagaggaaggcuguguuugucucaggcgcuccggguagcugugcgcggcgccuucgucucgcugugguuugcagccggugcuggggacagagagaggaacaaaggagauaagggcgcacagacaggcgccgggcugucacaagaagcugaggacguggauguuagccgggcccgccgagugacugacgcgccccagggaacccucugcgguacaggcaauagaaacagugggucccagucugcaagggucgugggaguagcccacuuaggcgaggcuuuccggguugguguggaacaggccauaagcuccuguccugaggaaguccaugggcgucacggacugucaauggagaucaugugggcacgcauggauguggcucuuagaaguccaggcaggggcuugcuggccggggcgggagcccuaugcaugacccucgcagaaagcucuugucccgacuaugagcggggucgacgcgcuugccugacucuucacagacauccuacaccacacugcuccaccuggggccugcccuugaggguggccgggucauggcucacggucguuacuguggaggcucugggaggcuggcggauggguguacgcagaaccgggcaagugggcccuacaaugcauccaccgcccgucagcggagccaguccuuuacugcuccaccaccuucuguugcuacugcucauuaucauucugacuuguuga

SEQ ID NO: 59378 - RNA, 768 nt, Artificial Sequence
  derived and/or modified sequence opt3 from MYF5__Homo_sapiens__NP_005584
auggacgugauggauggcugccaguucagccccuccgaguacuuuuaugacgggucuuguaucccuucaccagaaggagaguucggugaugaauuugucccgagaguugccgcuuucggcgcacacaaggccgagcugcaagggagugacgaagaugagcaugugagggcgcccaccggacaccaucaggcuggccacugccucaugugggccuguaaagcaugcaagcggaaaagcacaacuauggaccgccgaaaggccgcuacgaugcgugagagaaggcggcuuaaaaagguaaaccaggcauuugaaacccugaagcgcuguacaacuaccaauccuaaccagagauugccaaaaguggagauuuuaaggaaugccauacgguacaucgaaucccugcaagagcuacuccgcgagcaggucgaaaacuauuacucucugcccggucagucgugcucagagccuacaagcccaaccaguaauuguuccgaugggaugcccgaaugcaacucuccuguguggagccgaaaguccucaacuuucgacaguauuuauuguccagauguuagcaauguguacgcuacagacaaaaacucucuuuccucacuggauugcuugagcaauaucgucgacagaauuaccaguucugagcagccgggacucccccugcaagaucuggccucccucagcccuguggcgucgacggacucucagccagcaacucccggcgccuccucaaguagguuaaucuaucauguacuguga

SEQ ID NO: 59379 - RNA, 729 nt, Artificial Sequence
  derived and/or modified sequence opt3 from MYF6__Homo_sapiens__NP_002460
augaugauggaccuguucgagaccggcagcuacuuuuucuaucucgauggggaaaacgugacacuucagccccuggaggucgccgaaggauccccuuuguacccagguucugacggcacuuuaucaccgugccaagaucagaugcccccugaggcugggagugacagcuccggagaagaacacguucuggcaccacccggccuacagccuccacauugucccggucagugccucaucugggccuguaagacgugcaaaagaaagucugcgccuaccgauaggcggaaagcugccacacugcgcgagcgacguagacuuaagaaaauuaaugaagcauuugaggcccugaagaggcggacuguggcuaacccaaaucaacgcuugccgaagguagaaauacucagaucggcaaucucauauauugagaggcugcaggaccugcuccaccgguuagaucagcaggagaaaaugcaagaacuggggguggaccccuucagcuaccgcccuaagcaggagaaccuugaaggagccgacuuuuugcgaaccuguaguucccaguggccaucugucagcgaucauuccagaggccuggugaucacagcuaaagagggcggggccucaauugauaguagcgcgucuuccucacuaaggugccucagcaguaucguugacucuauauccagcgaggagcggaagcugcccuguguggaggaagucguggagaaauga

SEQ ID NO: 59380 - RNA, 6024 nt, Artificial Sequence
  derived and/or modified sequence opt3 from MYH10__Homo_sapiens__NP_001242941
auggcccagagaaccggccuggaggaccccgaaagguaccucuucguggaucgggcugucaucuauaacccugcaacacaagccgacuggacugcgaagaaacuuguuuggauuccaagcgagcgccacggguuugaagcugccuccauaaaggaggaacgaggagaugaggugaugguagagcuggcagaaaaugguaaaaaggccauggugaacaaagacgauauccagaagaugaauccgcccaaguucucuaaagucgaggacauggcugaauugacgugcuuaaacgaggcaucagugcugcauaaucuaaaggaucguuacuauaguggccucauuuacaccuauagcgggcuguuuuguguugugaucaacccuuacaaaaaucuuccaauuuauuccgagaacaucauagaaauguacagaggaaagaaaaggcacgagaugcccccucauaucuacgccauuucugaaucggcuuaucggugcaugcugcaggaccgcgaggaucagucaaucuuguguacaggcgaaagcggugccgggaagacugagaauaccaagaaagucauucaauaccucgcgcacguggcaaguucccauaagggaagaaaagaccacaacaucccacaggagucucccaagccuguaaaacaccagggcgaacuggagaggcagcugcuccaagccaauccaauauuagaaagcuucggcaacgcuaagacaguuaaaaaugauaacuccucacgguuugggaaguucauucgcaucaauuuugacgugaccggauauauugucggugccaacaucgagacuuaccugcuugaaaagagucgagcagugagacaggcuaaagaugagaggacauuccauaucuuuuaucaguugcugagcggcgccggggagcaccuaaagucugaccuccugcuugaaggauucaacaauuaccgguuucuguccaacggcuauauuccgauacccggucagcaagacaaagauaauuuccaggagaccauggaagcgaugcauaucaugggguuuucacacgaggaaauuuugagcaugcucaagguggucaguucuguucugcaguucggaaacaucuccuucaaaaaggagcguaauacggaccaagccagcaugccugagaacacuguggcacagaaguuaugccaccugcucggcaugaauguaauggaauuuacccgcgcuauacuuacaccaagaauuaaagugggcagggauuacguccagaaggcccagacuaaagagcaagcugacuucgccguggaagcacuggccaaggcuaccuacgagcgguuguuucgauggcuaguucaucgcaucaacaaagcgcuggauagaacaaagaggcagggggcaucguucaucggaauucucgacaucgccgguuuugagauuuucgaacugaauucuuuugagcagcuuuguauaaacuauaccaaugaaaagcugcagcaauuguucaaccacacgauguuuauccucgagcaggaagaguaccagcgggagggcauugaauggaauuucaucgauuuugggcuggacuuacagcccugcaucgaucugauugagcgcccugcuaacccacccggagugcuagcccuccuggacgaagaguguugguucccgaaagcaacugauaagacauuugucgaaaaacuugugcaagagcagggcucccauucaaaguuccagaaaccuagacaguugaaggacaaggccgacuucugcauaauccacuaugcugguaaaguagauuacaaggccgacgaguggcugaugaaaaauauggauccccucaacgacaacguugcaacccugcuucaucaaaguagcgauagguuuguggcggaacuguggaaggacgagauucagaauauccagcgugcuuccuucuaugauucugucagcggguugcacgaaccaccuguggaccggauugucggccucgaucaagugacuggaaugacagagaccgccuuuggcucagcauacaaaacgaagaaagggauguuccgaaccguuggacagcuguauaaggaaaguuuaacaaagcugauggccacucuaagaaacaccaaucccaacuuugugagguguaucauaccaaaucacgagaaacgcgcugguaagcucgacccccaucugguacuugaucaguugcggugcaacggcguccuggaggggaucagaauuuguaggcagggauucccuaaucgcaucguguuucaagaauuccgacagcgguacgagauucucacaccaaacgccaucccgaaaggcuuuauggacgguaagcaggcaugcgaacguaugauaagagcucuggaguuagaucccaaucuguacaggauugggcaguccaaaaucuucuuucgcgccggcguucuugcgcacuuggaggaagagcgggaccucaagauuacugacaucauaaucuucuuucaagccgugugcagaggauaucuggcuaggaaggcauucgccaaaaagcagcagcagcuaagcgcucugaaaguccuccaacgaaacugugccgcauaccugaagcuucgccauuggcagugguggcggguguucaccaaaguaaagccuuugcugcaggugacaagacaagaagaggaauuacaggcgaaggaugaggagcuccugaaaguuaaggaaaaacagaccaaggucgagggcgaacuugaggaaauggagaggaaacaccagcaacuguuggaggaaaagaauauucucgccgagcagcugcaggcugaaacugagcuauuugccgaagcagaggagaugcgugcucgccuggccgcaaagaaacaggaacucgaggaaauccugcacgaccuugagucucggguggaggaagaggaagagagaaaccaaauuuugcagaaugaaaagaaaaagaugcaggcccauauccaggaucuggaggagcaauuagacgaagaggaaggggcuaggcagaaacuccagcuggagaaggugacggcggaagccaaaauaaagaagauggaggaggaaauucuucugcuagaggaucagaacucaaaauucaucaaggaaaaaaagcucauggaggaccgaaucgcagaaugcaguagccaacuggcugaggaggaagagaaagccaagaauuuggccaagauucggaacaaacaggaagucaugaucuccgaucuggaggagcgcuuaaagaaagaagagaagacaagacaggaacucgagaaagcuaagaggaagcuggacggagaaaccacugaucuucaagaccagauugcagagcugcaggcccagauagaugaguugaaacuccaacuggcgaagaaagaagaggaacuacagggugcucuggcccggggcgacgaugagacccuucacaagaacaaugcacucaaaguugugcgagaacugcaggcccagaucgcugaguugcaagaggacuuugaaucugagaaggcaucgagaaacaaggccgaaaaacagaagcgcgaccugagcgaggaauuagaggcgcucaaaacagagcuggaagauacccuugacacuacagcugcccagcaggagcugaggacgaagcgugaacaagagguggcagaguugaaaaaggcccucgaagaggaaaccaagaaucaugaggcucagauucaggauaugcggcaaagacacgccacugcacuggaagagcuauccgagcagcuggaacaggcuaaaagguucaaggccaaccuugagaaaaauaagcaggggcucgaaacagacaacaaagagcuggcgugugaaguaaaggucuugcaacaggugaaagccgagucagagcauaagcgcaagaaauuagaugcacagguucaggaacugcacgcuaaggugagugagggagaccgacucagagucgaacuggccgagaaagcuucuaagcuucaaaaugaacuggauaacgugagcaccuugcuagaggaggcagaaaaaaagggcaucaaguuugccaaagacgccgcuucccuggagucacagcuccaggauacacaggaacugcuucaagaggagacucggcagaaguuaaaucugagcucuaggauucgccagcucgaagaggaaaaaaacuccuugcaggagcaacaggaagaggaggaagaggcgcguaagaaucuggaaaaacagguucucgcacugcaaagucagcuugccgacaccaagaagaaaguggaugacgaccuggguacgaucgagagcuuggaagaggcuaagaaaaagcuacugaaagaugccgaggcacucucucagagauuagaagagaaggcccuggcuuaugacaagcuugaaaaaaccaagaaccggcugcagcaagagcucgaugacuugacaguagaucuggaccaccagaggcaggucgcguccaaucucgaaaaaaagcagaaaaaguucgaucaacugcuugccgaggagaaaucaauaagugcacgcuacgcugaagagcgagacagagccgaagcagaggcccgggagaaggaaacuaaggcucuaagccuggccagggcguuggaggaagcauuagaggccaaagaagaguuugagcgccagaacaagcagcugagagcugauauggaagaccucaugucguccaaagaugacguggggaagaaugugcaugagcuggaaaaaucuaagagggcccuugagcagcaagucgaagagaugcggacccagcuggaggaacucgaggaugaauugcaggcuacagaggacgcaaagcugcgucuagaaguuaacaugcaagccaugaaagcucaguucgagcgcgaccugcagacucgagaugagcagaacgaagagaagaaaagacuccuuaucaagcaagugagggaacuggaggccgaguuagaagacgagcggaaacagcgcgcauuggcgguagccagcaagaagaaaauggaaauugaucugaaggaccucgaggcucagaucgaagccgcaaauaaagcuagagaugaggugauuaagcagcugaggaaacuucaagcccagaugaaggacuaucagcgggagcuggaagaggcacgagccucaagagaugaaaucuuugcucagaguaaggaguccgaaaaaaagcucaaaucuuuggaggcggagauacugcaauuacaggaagagcuagccagcuccgaacgcgcaaggcggcacgcugagcaggaacgugacgagcuggccgaugagauuaccaacucagccagcggcaagagugcacuccuugacgaaaaaagaaggcuggaggcucgcaucgcccaauuggaagaggagcuggaagaggaacagucuaauauggagcuccugaacgaucgguuccgaaagacgacacuucaggucgacacccucaaugcggaacuggcugccgagagauccgcagcccagaaaagcgauaacgcuaggcaacaguuggagcgccagaauaaggaacugaaggcaaaauuacaggagcuagaaggagccgugaagucgaaauuuaaggcgacuaucucagcucuggaggccaaaauuggccaacucgaagagcagcuugagcaggaagcaaaggagcgggccgcugccaacaagcugguuagacguacagaaaaaaaguugaaagagauauucaugcagguggaagacgagaggcggcaugcagaccaauacaaggagcagauggaaaaagcuaaugcccgcaugaagcagcugaagcgacagcucgaggaagcggaggaggaagccaccagagcaaacgcuucuaggcggaaacugcaacgcgagcuugaugacgccacugaagcaaaugagggguuaaguagagaagucuccacccugaagaacaggcuccgacggggaggcccaaucagcuucucuagcucccguucagguagacgccaguugcaccuggagggggcuagucuagagcugagcgaugacgauacagaaucuaaaacguccgacgugaaugagacccagcccccucaaucagaauga

SEQ ID NO: 59381 - RNA, 5838 nt, Artificial Sequence
  derived and/or modified sequence opt3 from MYH11__Homo_sapiens__NP_001035202
auggcccagaagggccaacugagcgacgaugagaaauuccucuuuguggacaagaacuucaucaauucccccgucgcucaggcagauugggccgcgaaaagacuuguuugggugccuucugaaaagcagggguuugaggcugccucaauuaaagaagagaagggagacgaaguaguggucgagcugguggagaacgguaagaaaguuaccgugggcaaggaugacauacagaaaaugaauccaccgaaguucaguaaagucgaagauauggcagaguugacaugcuuaaacgaagccagcgugcugcacaaucuaagggagcgguacuuuuccgggcucaucuauacuuacucuggacuguucuguguaguugugaaccccuauaagcaucuuccuauuuacucggagaagaucgucgacauguauaaaggcaagaaacgccacgaaaugccaccccauauuuacgcuaucgcagauacggccuaucgaucaaugcugcaagaccgugaggaucagagcauauugugcaccggugaaaguggggcuggaaagacagagaauacuaaaaaggugauccaguaccucgccguggucgcguccucucacaaaggcaagaaggacaccagcauuacacagggcccuuccuuugcauacggggaacuggagaaacaacugcuccaggccaacccaaucuuagaggcuuucggaaaugccaagaccguuaaaaacgauaauucaaguagauuugguaaguucauuaggaucaacuuugacgugacuggcuauauaguaggggcaaauauugaaacauaccugcuugagaaaagccgggcuauccgccaggccagagacgaaaggaccuuccauauuuuuuauuacaugaucgcgggagccaaggagaagaugcggucugauuugcugcuagaaggcuucaacaauuauacguuccucuccaacgguuuugugcccaucccugcagcucaggacgaugagauguuccaagagacugucgaagccauggcuauuaugggguuuucagaggaagagcagcugagcauacuuaaagugguuaguucugugcugcaguugggaaacaucgucuucaagaaagaacgcaauaccgaccaagccuccaugccagauaacacagcagcccagaaggugugucaccucaugggcauuaauguaacugacuuuacccgaagcauccugacaccgagaauaaaaguuggcagggaugugguccagaaggcucagaccaaggagcaagcggacuucgcaguggaggccuuagcuaaagccacguacgaacggcuguuucguuggauucucacucgcgucaacaaggcacuugauaaaacacacagacagggggccucguuccugggaaucuuggacaucgcugguuuugagauuuucgaagugaauucuuuugagcagcuaugcaucaacuauaccaaugagaagcugcagcaacucuucaaccauacuauguuuauucuggaacaggaggaauaccagagggagggcauagaauggaauuucaucgauuucgggcuugaccugcagcccuguauugaguugaucgagcggccuaacaauccacccggaguucucgcccuguuagacgaagagugcugguuuccuaaagcaacagauaaguccuucguggaaaagcuguguaccgagcaaggcucacacccaaaauuucagaagcccaaacagcuaaaggacaaaacggaauucaguaucauucauuacgcggguaagguagauuauaacgcuagcgccuggcucaccaaaaauauggacccgcugaacgauaaugucacaucccuuuugaacgcaucuagcgacaaguuuguggccgaucuguggaaggacguugaucgaauaguggggcucgaccagauggcuaaaaugacugagucaagucugccuuccgccagcaagaccaaaaagggcauguuccgcacagucggacaacuuuacaaagagcagcugggcaaguugaugacuacccucagaaacacaacccccaauuuugugaggugcaucauuccaaaccacgaaaagcggucugggaaacuggaugcauucuuaguacuggagcagcuacgcuguaauggagugcucgaagguaucagaauuugcaggcaaggcuuuccuaaccguaucguuuuccaggaguuucggcagcgauaugaaauacuggcugccaaugcgauccccaagggguucauggacggaaaacaggccuguauucuuaugaucaaggcuuuggagcuggauccaaaccucuacagaauuggccaaucaaaaaucuuuuucaggacugguguccuggcacacuuagaggaagagcgcgaccugaagauaacggacgugauuauggccuuccaggcuaugugccggggguaucuugccagaaaggcauuugcgaaaaggcagcagcaauugacagccaugaaggugauccagcgcaauugcgcugccuaccucaaacugcgaaacuggcagugguggcggcuauucaccaaggucaaaccccugcuccagguuacucgucaagaagaggagaugcaggcaaaggaagaugagcugcagaagaccaaagaaagacaacagaaggcugagaaugaacuuaaagaguuggagcagaagcauagucagcugacagaagagaaaaacuuacuccaagaacagcugcaggccgagaccgaacuuuaugcagaggccgaggaaaugagggugcgccuggcugcgaagaaacaggaguuggaagagauucuccacgaaauggaggcccggcuggaggaagaggaagacagaggccaacagcuacaggcagagaggaagaagauggcucagcaaaugcuggaucucgaggaacagcuggaggaagaggaagccgcccgacagaaacuucaguuggagaaggugacugcugaggcaaaaaucaagaaacuggaagacgagauauuaguaauggaugaccaaaauaacaagcucagcaaggaacgcaaacugcuugaggaacggaucuccgaucugacaacgaaucuagccgaggaggaagagaaggcgaaaaaccucaccaagcugaaaaauaagcaugaaucuaugauuucggaguuggaagucagacugaagaaagaggagaagagcaggcaggaauuagagaaacucaagcguaaacuggaaggagacgcuuccgauuuucacgagcagaucgccgaccuucaagcacagauugccgagcugaagaugcaguuggcuaagaaagaagaggaacuccaggcagcccuggcgcgccuagaugacgagaucgcucaaaagaacaacgcccugaaaaagauacgggaacuugagggccauauuucagaucuccaggaggaccuggacagugaaagagcagccaggaauaaagcugagaagcagaagcgagauuugggggaagagcuggaagccuuaaaaacugagcucgaggacacacuggauucuaccgcaacacagcaagaacuucgggcuaagcgcgagcaggaagugacuguucugaaaaaggccuuggacgaggaaaccagaagccacgaggcgcaggugcaggagaugaggcaaaaacacgcccaggcagucgaagagcucacggaacagcuggagcaauucaagcgggcuaaagccaaccuagauaagaauaagcagacccuggagaaagaaaacgcugaccuugcaggagagcuccgagugcugggucaggccaagcaggaaguugagcauaaaaagaaaaaguuggaagcccaagugcaggaguuacaguccaaguguucagauggcgagagagcucgcgcggaacugaaugacaaaguacacaagcuccagaacgaggucgaaagcgugacagggaugcugaaugaggcagaaggaaaagccaucaagcuugcuaaagauguggccucucuguccagucaauugcaggacacucaggagcuacugcaggaggaaaccaggcaaaagcucaacgucagcacaaagcugcgucagcuugaggaagagcggaauucuuuacaggaucagcuggacgaagagauggaggcaaaacaaaaccucgaaagacauaucuccacuuugaauauucagcugucagacaguaagaaaaagcuccaggauuuugccagcaccguugaggcucuggaagagggcaaaaagagguuccaaaaggagaucgaaaaccuuacgcagcaguacgaggaaaaagcggccgcauacgacaagcuggagaaaacaaagaaucgcuugcagcaagaacuagaugaccuggugguagaucucgacaaccagcgacaguuagugucgaaucuggagaaaaagcagagaaaauuugaucaacuucuggcugaggaaaagaacauuuccucuaaguaugccgacgagcgggauagggcagaagccgaggcucgcgaaaaagagaccaaggcccucagcuuggcgcgugcacuggaggaagcccucgaggcuaaagaagagcuggaaagaacuaacaagaugcuuaaagccgagauggaggaccuagucucaaguaaggaugacguggguaagaauguucacgaacuggagaaauccaagcgggcuuuggaaacacagauggaggagaugaaaacccaguuagaagagcuggaagaugagcuccaggcaacugaagacgccaagcugaggcuugaggugaacaugcaagcucugaaagggcaguucgagcgcgaccuccaggcccgagaugaacaaaaugaggaaaagagacggcaguugcagaggcagcugcacgaguacgaaaccgagcuagaggacgaacgcaagcaaagagcacuggcggccgcugccaaaaagaaacucgagggcgaucuuaaggaccuggaauuacaggcagauucugcuauaaaaggaagggaggaagccaucaagcaguugcggaagcugcaggcacaaaugaaagacuuucagcgugagcucgaggaugcccgcgcuagccgagacgaaauuuucgcgacagccaaggagaacgaaaaaaaggcaaaaucccuggaggcugaucuuaugcagcugcaggaggaccucgccgccgcagaaagagcuaggaagcaagccgauuuggagaaagaagagcuggcggaagaguuagcuucaagccuaaguggccggaaugcccugcaggacgagaagcgcagacucgaagcaaggaucgcccagcuugaggaagagcuggaagaggagcaagggaacauggaagcuaugucugaucggguccgaaaggcaacgcagcaggccgagcaguuguccaaugaacuggcgaccgagagaagcacugcucaaaaaaacgaaucggcccgccagcagcucgagaggcagaauaaggagcugcggucaaaacuucaugaaauggagggagcagugaagucuaaauuuaagaguacaauugccgcucucgaagccaagaucgcacaacuggaggagcagguugaacaggaggcucgugaaaaacaggccgcgaccaaguccuugaaacaaaaggacaaaaagcugaaggagauauuacuacagguggaagacgagagaaaaauggccgagcaguauaaggaacaggcagagaaaggcaacgcuagggucaagcaacugaaacgccagcucgaagaggccgaagaggagagccagcggaucaaugcaaaccgaagaaagcuucaaagggaacuggaugaggcuacagaaucuaaugaggccaugggucgcgaaguaaacgccuugaagagcaaacugcgggggccuccaccgcaggagacuucccaguga

SEQ ID NO: 59382 - RNA, 5817 nt, Artificial Sequence
  derived and/or modified sequence opt3 from MYH13__Homo_sapiens__NP_003793
augagcuccgacgccgagauggcuaucuucggcgaagcagcccccuaccugagaaagccugagaaagaaagaauugaggcgcagaaccggccauuugauucuaagaaggcuugcuucguggccgacaauaaggaaauguaugucaaagggaugauucagacccgcgagaacgauaagguuaucgugaagacacucgacgaucgaaugcuuacucugaauaacgaccagguauuuccgaugaaucccccuaaauucgauaagauugaggacauggccaugaugacgcacuugcacgaaccagccguguuauacaaccugaaagagcguuaugcugcauggaugaucuacaccuauucaggauuauuuugugucacagugaaucccuacaaguggcucccuguuuauaaaccagaaguggucgccgcuuacagagguaagaagaggcaggaggcacccccucacauuuucaguaucagcgauaacgcguaccaguuuaugcugacugaccgggauaaucaguccauacuuaucaccggcgagucuggggcaggaaaaacagugaacaccaagcgcguaauucaguauuucgccacuaucgcuguuacaggcgacaaaaagaaagaaacccagccagguaagaugcaggggacgcuggaggaucaaauuauccaggccaauccguugcucgaagcauuuggaaacgcuaaaacugugagaaaugacaacucgucaagguucggcaaguuuauacggauucauuucggcgccaccgggaagcuggcgagcgccgacaucgagacauaccugcucgagaagagucgcgucacuuuucaguuauccucugagcgaagcuaucacauuuucuaccagaucauguccaauaagaaacccgagcugaucgaucuuuugcugauuucaaccaacccuuucgacuuuccauucgugagucaaggagaagugacagucgcaagcauagaugacucugaggaacugcucgcuaccgauaacgccaucgacauucuggguuuuuccucagaggaaaagguuggcaucuauaaacuuacgggggcugugaugcauuacggaaauaugaaguucaagcagaaacagagagaggagcaagccgaacccgauggcacugagguagcagacaaggccgguuaucugaugggguugaacagcgcugaaaugcucaaaggacugugcuguccuagggugaaggucggcaaugaguacgugacaaaaggccagaacguucaacaggugaccaauagugucggggcguuagcaaaggccguguacgaaaagauguuucuguggaugguaacucggauaaaccaacagcucgauacaaaacagccacgucaguauuucauuggaguucuugacaucgcugguuuugagaucuucgauuuuaauucucuggagcaauugugcauuaacuucaccaaugaaaagcuacagcaguuuuucaaccaccacauguuugugcuggagcaggaagaguacaaaaaggagggcaucgaaugggaguucauugacuucgggauggaccucgccgcauguauagaacugaucgagaaacccaugggaauauuuuccauccuugaagaggagugcauguucccgaaggccacggauaccagcuuuaagaauaaacuguaugaccaacauuugggcaagucgaacaauuuccagaaaccuaagcccgcuaaagguaaggccgaagcacacuuuucucucguccauuacgcggggacaguggauuauaacaucgcuggcuggcuggacaaaaauaaggauccauuaaacgagacugucgugggacuguaccagaaguccucacuaaaacuccugaguuuccuuuuuagcaacuaugccggcgcagaaaccggggacuccggagguucuaagaaaggcgggaagaaaaagggaagcucauuccagacaguuagugccguguuucgcgagaauuugaacaagcugaugacuaaucucagauccacccacccucacuucguaaggugucugauucccaacgaaacaaaaaccccaggcgucauggaucauuaccuugugaugcaccaacugcggugcaaugguguuuuggaggggauacgaaucugucgcaagggcuuucccagcaggauucucuacgcugacuucaaacagagguaucggauccugaacgccucugcaauuccugagggacaguuuaucgauucaaagaaugcuagugaaaaauuacugaacagcauagacguggaucgcgagcaauucagauucggcaauacuaaggucuuuuucaaggccgggcuacucggacugcuugaagagaugagggacgaaaaauuggugacgcugaugacauccacccaggcgguaugccgugguuaccucaugcggguggaguuuaagaaaaugauggagcgaagagauucuaucuucuguauucaguauaacaucaggucguuuaugaauguuaagcauuggccauggaugaaccuguucuuuaaaauuaagccguuacugaaaagcgccgaagcugagaaagaaauggcaacuaugaaggaggacuucgagcgcaccaaagaagaacuugcccgguccgaagcuagaaggaaggaguuggaagagaaaauggucucacuccugcaggagaagaaugaccuacaacuacaggugcagagugaaacagagaaccucauggaugccgaggaacgcugcgaaggccugaucaaaucuaagauacuuuuggaggcaaaggugaaagagcugaccgaacgauuagaggaagaggaagagaugaauagcgagcucgucgcgaagaaacggaaccuggaagacaagugcuccucacuuaaacgugauauugacgaucuggaguugacucucacaaagguugaaaaggagaaacacgccacggagaacaaggugaaaaaucugagcgaagagaugaccgcucuagaagagaacaucucuaagcugacuaaagaaaagaagucccuccaggaggcccaucaacagacacuggacgaucuucagguggaggaagacaaaguaaauggguugauuaagaucaacgcaaaacuggagcagcaaaccgaugacuuagaaggaagucucgagcaggaaaagaaacugagagcugaucuugagagggccaagcgcaagcuggagggcgaccuaaaaaugagccaggaaucuauaauggaucucgagaaugacaagcaacagaucgaagagaaacugaagaaaaaggaauuugaguugucccagcugcaggcaaagauugacgaugagcaaguccacucauuacaguuccagaaaaagaucaaagaacuccaggcccggauugaggaacuggaggaggaaaucgaggcugaacacacacuuagagcgaagauagagaaacaaaggagugaccuggcccgagaauuggaggagauuagcgaacgccucgaggaagcaucgggugcuacuuccgcccagaucgagaugaacaagaaacgggaagccgaguuucagaagaugagaagggaucuggaggaagcuacccuacagcaugaggcaacggccgcgacccugcguaagaaacaagcugacucuguggccgaacuuggggagcagaucgauaaucuccagcgcguuaagcagaaacuggaaaaggagaaaagcgaguugaagauggaaauugacgauauggcaucaaacaucgaggcccugaguaaguccaaaucuaauauugaacggacauguagaacuguggaggaccaauucagcgagauaaaggcuaaagaugaacagcagacccaauuaauccacgaccucaacaugcagaaggcaaggcugcagacacagaauggcgagcuuucccaucgagucgaagagaaagaaucacugauuagccaauugacuaagaguaagcaggcccucacccagcagcuggaggagcuaaaacggcaaauggaagaggaaacgaaggcgaaaaacgcuauggcccacgcacugcagucuucccgccacgauugcgaccuucucagagagcaguacgaagaggagcaggaagccaaggcugagcugcaaagggccuugagcaaagcaaauucggaaguggcucaguggcggacaaaguaugagaccgacgccauccagcgaacugaagaguuagaggaagcgaagaaaaagcuggcccaaagacuccaggaggcagaagagaacacagagaccgcuaauucaaaaugugccucucuggaaaagacuaaacagcgccuucagggagagguugaagaucugaugagggacuuggagcguagucauaccgcuugcgcaacacuagauaagaaacaacggaacuucgacaaggugcuggccgaauggaagcagaaacucgaugagucccaggccgagcuggaagcugcgcagaaggagagcagaucucuuagcacggaauuauuuaaaaugaggaacgcauacgaggaaguagucgaccaacuggagacccuccgccgagagaauaagaacuugcaggaagagauuuccgaucugacugaacagaucgccgagacaggcaaaaaucuccaggaagcugagaagaccaagaaacugguggagcaagaaaagucagaccuucagguggcccuggaggaagucgaggggaguuuggagcacgaagagagcaaaauacuaagaguucagcuggaacucucucaggugaaguccgaguuagaucggaaaguaaucgaaaaggacgaggagauugaacaacugaagaggaacucacagcgcgcagccgaggcucuacaaagugugcuggaugcggaaauccguagcagaaaugacgcccuccgguugaaaaagaaaauggagggagaucugaacgaaauggagauucaacucggccauuccaauaggcagauggcagagacacagaagcaucugcgcacuguccagggucaacuuaaagacucucagcuacaucuggacgaugcuuugcgaucgaacgaagacuuaaaggagcagcuggccaucguggaaagacggaaugggcuccugcuugaggaacuggaggagaugaagguugcacucgaacagaccgagaggacgcgcagauugagcgaacaagagcugcuagaugccucagacagggugcagcugcuccacucccagaacacaagucuuauaaauaccaaaaagaaacuggaggcugauauugcccagugucaagcggaagucgagaacucuauccaggaaagccggaaugcagaggaaaaggccaaaaaggcuaucacugacgccgcuaugauggcagaggagcuuaaaaaggaacaggauaccuccgcccacuuggagcguaugaagaaaaaccuggaacaaacagugaaggaccuccagcaucgccuggaugaggcugaacagcuugcccugaaaggaggcaagaaacagauucaaaagcucgagaaucgaguuagagaguuggaaaacgagcuggacguggaacagaagaggggugcagaggcguuaaaaggcgcccacaaguaugaacggaaagucaaggagaugacuuaccaggcugaggaagaucauaaaaauauacuacgccugcaggaccucguagauaaacuucaagccaaggugaaaucauacaagagacaggcagaggaagcugaggagcaggccaacacccagcugucuaggugccggcgaguucaacacgaauuggaggaagcagccgagagagcugacaucgcggaaagccaggugaacaaacugcgcgccaagaguagggacgucgggucccagaaaauggaggaguga

SEQ ID NO: 59383 - RNA, 6111 nt, Artificial Sequence
  derived and/or modified sequence opt3 from MYH14__Homo_sapiens__NP_001139281
auggccgcugugaccaugagcguccccggaagaaaggcaccuccaaggccggggcccguuccugaggccgcgcagccauuccuguuuacaccccggggaccuuccgcugguggcgggccaggaucuggcacuucaccccagguggaauggacggcccgccgacucguaugggugccuagcgagcuucacgguuucgaagcagccgcucugcgugacgagggggaagaggaggcagaagucgaguuggccgaaagcggaagaagguuacggcugccacgcgaucagauccagagaaugaacccgcccaaauuuuccaaggcugaggacauggccgagcugaccugccucaaugaagcgucugugcugcauaaccuuagggagcgguacuauucgggccugauuuacacauauucaggcuuguucuguguugugauaaauccuuacaaacagcucccaaucuauacugaagcaauugucgagauguaccgcgggaagaaacgacacgaagugcccccucauguauaugccguuaccgagggagcuuacagaagcaugcugcaagauagggaggaccagaguauccugugcacaggugaauccggcgccgggaagaccgagaacacuaagaaagugauucaguaccucgcacacgucgcuucuagcccaaagggacggaaagaacccggcgugccggccuccgugucaacagucaguuauggugaguuagaacgucagcugcuucaagcgaauccuaucuuggaggccuuugggaacgcaaagaccguuaaaaaugauaacagcucucgcuucggaaaguuuauaagaaucaauuucgacguggcuggcuacauuguaggcgccaacaucgagacguaucugcuggaaaaguccagggcuauucggcaggccaaagaugaguguucauuucauaucuucuaccagcuccuugggggcgccggugaacagcugaaggccgaccuguugcucgagcccugcagccacuaucgauuucugacuaauggcccaaguucuuccccugggcaagaacgcgaguuauuccaggagacccuggaaagccucagagugcuuggauuuucgcacgaggaaauaauuucuaugcugaggauggucuccgcuguguugcaguucggcaacaucgcgcuaaaacgggagcgcaauacagaucaagcaacuaugcccgacaacaccgccgcucagaagcuguguagacuccugggucuugggguuacagauuucucaagggcccuguugaccccacguauuaaagugggccgggacuacguccagaaggcacagacgaaagagcaagccgauuuugcucucgaagcccuggcaaaggcgacuuaugagcgauuauucagauggcuggugcuaaggcucaaucgcgcucuggaccggagucccagacagggagccagcuuucuuggcaucuuggacaucgcaggguucgaaauuuuucagcugaacuccuucgagcagcucugcauaaacuacacaaaugaaaagcugcaacagcuuuuuaaccauaccauguucguacuggagcaggaggaauaccagagggagggaaucccuuggacauuuuuggauuucggucucgaccugcaaccauguauugauuuaaucgaacgcccggccaaucccccuggccugcuagcucuccuggacgaggaaugcugguuuccaaaagccacagauaagucuuucguugagaaaguggcacaggagcaagggggacaccccaaguuucagcgaccucggcaucuucgugaccaagcugauuucagcgucuugcacuaugccggcaaaguggacuacaaggcgaacgaauggcugaugaagaauauggauccacucaacgacaaugucgccgcucuguuacaccagucaaccgauagacugacggcagagauauggaaagacgaacaugguggguuccagcaauuuaguuuccuuggcuccuuucccccgagcccuccaggaucugccgagagguguucaagugcuauuagucccccuggcguggaagggaucguuggauuggaacagguguccucucucggugacggacccccagggggacgcccucggagaggcauguucaggaccguaggucagcuguauaaggagucgcuaagccgacugauggccacacucuccaacacuaaucccucauuuguccgcugcaucgugccaaaccacgaaaaacgggcagggaagcuggagccgagacuuguuuuggaucagcugagguguaauggcguguuagaaggcauucguaucugccgccaaggcuucccuaaccggauucucuuucaggaguucagacagagguacgagauacugacccccaaugcgaucccaaaaggguuuauggacggaaagcaggccugcgaaaagaugauucaagcucuugagcuggaucccaacuuguaucgagucggccagaguaaaaucuucuuucgggccggugugcucgcacagcuggaagaggaacgcgaccuaaagguaacagauaucauugugucuuuccaggcugccgcaagaggguaccuggccaggcgggcuuuucaaaaacgacagcagcaacagagcgcgcucagaguuaugcagcgcaauugugccgcauaucugaaacuuaggcauuggcagugguggcguuuguucacuaaagucaagccucuguuacaagugacccggcaggacgaggugcuccaggcuagagcccaggagcugcaaaagguccaggaacuucagcagcaauccgccagggagguuggagaacugcagggccgcguggcucagcuagaggaagaacgagcaagacucgccgagcagcugcgggcggaagcugaguugugcgccgaagcagaggaaacaaggggucgccuggccgcucguaaacaagaguuagagcucgugguaucagaacuggaggcaagagucggcgaagaggaggaauguagccggcagaugcagaccgagaagaaaaggcuucaacagcacauacaggaacuggaggcccauuuggaagcggaggagggggcucgccagaagcuccaacuggaaaaagugacuacggaggccaagaugaaaaaguucgaagaggaucuacugcuucucgaagaccagaacucuaagcuguccaaagagcgaaaguugcuggaggauagauuagcagaauuuaguagccaggccgcugaggaagaggaaaaaguuaagucucucaacaaacugcggcuuaaguacgaggccacaaucgcagacauggaggauaggcugcgcaaggaagagaaaggaagacaggaauuggagaagcucaaaaggcggcuggacggcgaguccucagaacuacaagagcagaugguggaacagcagcaacgugcugaggaacugcgcgcccagcuugggcgaaaggaggaggaacuccaggcggcccuggcaagagcugaggaugaaggaggcgccagggcucaauuguuaaaaagucugcgggaggcacaggccgcccucgcugaagcgcaggaggaccuggagagcgaacgcgucgcaagaaccaaggccgagaagcagaggcgggaccuuggugaagaacuggaggcuuugcgaggggagcuagaggauacucuggacucgaccaaugcccaacaggaacucagauccaaacgcgagcaggaagugacagagcugaagaaaacccuugaggaagagacuaggauucacgaagcagccguucaggaguuacggcaacgucacggacaggcucugggcgaacucgcggagcaguuggagcaggccagaagggguaagggcgcaugggagaagacucgccuggcucucgaggccgaagugucugagcugcgggcagaacuuagcucacugcaaacggcccgacaggagggggagcagagaaggcgccgguuggaacuacagcugcaagagguacagggacgagcuggcgauggggaacgugccagggcggaggcagccgaaaagcuccagcgggcucaagccgaguuagagaacgucaguggagcucugaaugaagcagaguccaagaccauccgccuuucuaaagaacugagcuccacugaggcccagcuccaugacgcucaggaguugcugcaggaagagacacgagccaagcucgcacugggcucaagagugagggcgauggaagccgaggcugccggucuucgggaacaacuagaggaggaagcagcugcccgcgagagagcagggagggaacugcagaccgcccaggcucaguugagcgaguggcgacggcgucaagaagaggaggcgggagccuuagaagcaggcgaggaagcuagacgcagggccgcccgggaggcagaagcucugacacagagacucgccgagaaaacugagaccguggaucgccuggaaaggggucgacggagacuucagcaggagcuggacgaugcgacgauggaccucgaacaacagaggcaguuggucaguacccuggagaagaaacaacgcaaguucgaucagcuacuggcugaggaaaaagccgcaguucuccgugccguggaggaacgggagagagcugaagcagagggcagggagcgcgaagcccgagcgcuuucucugacacgggcuuuagaggaagaacaggaagccagagaggaguuggaaaggcagaaccgcgcacugagagccgagcucgaagcucugcuuuccagcaaggacgauguagggaagucggugcacgagcuggaacgggccugcagggucgcagagcaagcugccaaugaccuccgugcacaggugacugaguuggaagaugagcugaccgccgcagaagacgcuaaauuacgacuagagguuacagugcaggcccugaagacucagcaugagcgcgaccuccaaggaagagaugaagcaggcgaggaacggaggcgccagcuugcuaaacagcugagagacgccgaggucgaacgggaugaggagaggaagcagcgaaccuuggccguggcggcucguaaaaagcuggaaggggagcucgaggaacugaaggcacaaauggccucagcuggacagggcaaagaagaggccguuaagcagcuuagaaaaaugcaagcacagaugaaggagcucuggcgcgaaguggaggaaacgcggacaucuagggaggaaauuuuuagucagaacagagaguccgagaaacgccugaaggguuuggaagccgagguccugcgguuacaggaggagcuagcugcgagcgacagggcccgaagacaagcacagcaggaucgggacgagauggcugaugaaguagccaaugggaaccugucuaaggcagccauccucgaggagaagaggcagcuugagggacgccugggccaauuggaagaggagcuggaagaggaacagagcaauuccgagcuccugaacgaccguuacagaaaacuuuuacuacagguggaaucacucaccacugaguugagugcugagaggagcuucucugccaaagcggaauccggcagacagcaacuggagcggcagauacaggaacuacgcgggagacugggagaggaagaugcgggugcaagggcucggcacaagaugacaaucgccgcacucgagucaaaacuugcucaggccgaggaacaacuggagcaggaaacccgcgagagaauuuugaguggcaagcugguucgaagggcugagaagcggcucaaagaagugguccuacagguggaggaggaacgucgcguagccgaccaauuaagagaucagcuugaaaaggggaaucugagggugaaacagcucaagcggcagcuagaggaggcagaagaggaagcgagcagagcccaagcuggacgccgaaggcugcagcgggaguuggaagacgucacugaguccgccgagucuaugaacagagaaguuaccacacugcguaaucgccucaggcggggcccacuuacguuuaccacuagaacagugcgacagguguucaggcuggaggaaggugucgcaucggacgaggaagcugaggaggcccagcccgggagcggaccuucaccggaaccagagggcuccccucccgcacacccacaauga

SEQ ID NO: 59384 - RNA, 5841 nt, Artificial Sequence
  derived and/or modified sequence opt3 from MYH15__Homo_sapiens__NP_055796
augguggagagcugccugcucaccuuccgagccuuuuucugguggaucgcucuuauuaagauggaccuguccgauuugggcgaagccgccgcguuuuuaaggcggucugaggcugaacugcuacuccugcaggccacagcacuugacgggaaaaagaaauguuggauacccgauggugagaacgccuacaucgaagcugagguaaaggguucagaggacgauggcacuguuauuguggaaacggcagacggggagagucugagcaucaaagaagauaagauucaacagaugaauccuccagaguucgagaugaucgaagacauggccauguugacccaccucaacgaggcuuccguacugcauacacugaagcgccgauauggacaguggaugauauacacuuauucuggccucuuuugcgugaccaucaauccguacaaaugguuacccgucuaucagaaggaagugauggccgcguacaaagguaagcguaggucggaggcaccuccacacauuuucgccguugcuaacaaugccuuucaagauaugcugcauaacagggaaaaucagucaauccuuuucacaggggagagcggagcaggcaaaaccgugaacaguaagcacauuauccaguauuuugcuacuauagccgcgaugauugagucccggaagaaacagggcgccuuggaagaccaaaucaugcaggcaaauacaauucuggaggcuuucgggaacgccaagacccuacgcaaugauaacucuagcagauuuggaaaauucaucaggaugcauuuuggugcucggggcaugcucuccucagucgacaucgauauuuaccugcuugaaaagagucgcgugauauuccagcaggccggggagcgaaauuaccacaucuucuaucaaauucugagcggacagaaagaauugcacgaccuccuguuaguaucugcaaaccccuccgacuuucauuucuguucaugcggcgccguuacgguggagagccuggaugacgcugaggaacuccuugcgacugagcaggcaauggauauccugggauuuuugccugacgaaaaguacggguguuauaaacuaaccggagccauaaugcacuucggcaauaugaaguuuaagcaaaaaccaagagaggaacagcuggaggcugauggcacagagaacgccgacaaggcagccuuccucauggggauuaacaguucugaacuggucaaaugccuuauccaucccaggaucaaggugggaaaugaguacgugacucggggucagaccauugaacaggucacaugugcuguuggcgcccuguccaaaagcauguaugagcguauguuuaagugguugguggcacgcaucaacagagcgcucgaugcuaagcugucgaggcaauucuuuauugggauauuagacaucaccggauucgagauucuggaauacaauucucuagagcagcucugcaucaacuuuacgaaugaaaaacugcagcaguucuuuaacuggcacauguucguacuugagcaagaagaguauaagaaagaguccaucgaaugggugucaauuggcuucgguuuggaucugcaggccuguauagaccucaucgagaagccuauggggauucugaguauccuugaagaggaaugcauguuuccaaaagcaacugaucugacauucaagaccaaguuguuugacaaucacuucggcaaaagcguccaucuccagaagccgaaacccgacaagaaaaaguuugaggcccacuucgagcuggugcauuacgcuggaguugugccuuacaacauuuccggcugguuagaaaagaauaaagaucugcuaaacgagacugucguggccguauuucagaagucuagcaaucggcuccuggcaucacuuuucgaaaacuauaugaguacagacuccgcuaucccauuuggggagaaaaagcgcaaaaagggagccagcuuccaaaccguugcgucuuugcacaaagaaaaucugaacaagcucaugacgaaucugaagucaaccgcaccccauuuugugagauguauaaacccuaacgucaauaaaaucccagguauuuuagaucccuaccuggugcuucagcaguugagaugcaacggcguccucgaggggacaaggaucugccgggagggauucccgaaucgccugcaguaugcugacuuuaagcaaagauacuguauucuaaacccuaggacuuuccccaaaaguaaguucgugagcucccguaaagcagccgaggaacugcucggcucucuggaaaucgaucacacccaguaucgguuugguauaacaaagguuuucuuuaaggcuggguuccuuggccaguuggaggccauucgagacgagagacugucgaaaguguuuacuuuauuccaagcaagggcgcagggaaagcucaugcgcaucaaauuucagaagauucuggaggaacgggaugcccuuauccugauacaguggaauaucagagcuuucauggccgucaaaaacuggccauggaugagguuguuuuucaagauuaagccucucgucaaaagcuccgaagugggcgaggaaguugcagggcugaaggaggagugcgcucaacuacagaaagcccuggaaaagucagaguuucagcgcgaggaacucaaagcaaagcaagugagucugacccaagaaaagaaugaccuuaucuugcagcugcaggccgagcaggagacauuagcuaacgucgaggaacaaugugaauggcucauuaaaucuaagauccagcuggaggcgcgagugaaagaacuuagcgagcggguagaggaagaggaagagauaaauuccgagcugaccgcccguggaagaaagcuagaagaugagugcuucgaacucaaaaaggagauugacgaucuggaaacuauguuggugaaaucagagaaggagaagaggacgacagaacacaaaguuaagaaccugaccgaggaagucgaguucuuaaaugaagacaucagcaaacucaaccgcgcagcuaagguggugcaggaggcccaucaacagacucuggaugaccuucacauggaggaagagaaacugucuuccuugaguaaggccaaucucaagcuggaacagcaggucgacgagcuagaaggugcucuggagcaagagcggaaagcaagaaugaacugugaaagggagcuucauaagcucgaaggcaaucugaaauugaaccgagagagcauggagaaccuggaaucuucccagcgccacuuagccgaggaacuccggaagaaagagcuggaacuuucacagaugaauaguaagguugagaacgagaaggggcugguggcgcaguugcagaaaaccgugaaggaacuccagacacagaucaaagaucugaaggagaaacuagaagcugagagaaccacuagggccaagauggaacgugagcgcgcagaccugacacaggaucuugccgaccucaaugagcggcuggaagagguaggaggcagcucguuggcucaauuagaaauuacgaagaaacaggagaccaaguuucagaaacugcacagagauauggaagaggcaacucuccauuucgagacaaccuccgccucucugaagaaaaggcacgcggacagccuugcugaacuggagggucaggucgaaaacuugcaacaggugaagcagaagcuagagaaagauaagucagaccugcaacucgagguugaugaccugcuuacacgaguggaacagaugacucgggccaaagcaaaugccgagaaguuaugcacccuguacgaggaacgccuccaugaagcuacggccaaauuggauaaggucacccagcuggcaaacgaccucgcugcccagaaaacaaagcuguggagugaguccggggaguuucuuagaaggcuggaagagaaggaagcguugaucaaucaacuaucucgggagaaaagcaacuucacucgacagauugaagaucugagaggccagcucgagaaggagaccaaaucccagucagccuuagcacacgcucugcaaaaggcccagcgcgacugugaccuucugagggaacaguaugaggaggaacaggaagugaaagcugagcuccaucguacauugagcaagguuaaugcagagauggugcaauggcggaugaaguacgaaaacaauguaauacagagaacugaggaucuggaagacgccaaaaaggagcucgccaucaggcugcaggaggcugcggaagcaaugggagucgccaacgcucgcaaugccagucuugagcgagcaagacaccaacuacagcuggaauugggcgaugccuuaucugaccuggggaaagugcgguccgcugcggccaggcucgaucagaagcagcugcaaagcggaaaagcacuugcugacuggaagcagaagcacgaggaaucgcaggcccugcucgaugcaucacagaaagaggugcaagccuugucuaccgagcugcuaaagcugaaaaacacguacgaagagaguauugucggccaggaaacacuccgccgugagaauaagaaccuucaggaagagaucuccaaccugaccaaucagguuagagaggguacuaaaaacuuaacagaaauggagaaggugaagaaauugauugaagaggaaaagaccgagguacaagugacucuggaggaaaccgagggggcucucgaacggaaugagagcaaaauccugcauuuucagcuugagcugcucgaagccaaggcggaguuggaaaggaaacugucugagaaggacgaagagauagagaacuuccgccgaaaacagcagugcacaaucgauagcuuacaauccucacuagacagugaagcaaagagcagaauugaggucacgcggcugaagaaaaagauggaagaggaucucaaugaaauggagcuucagcugucuugugccaacagacagguguccgaggcuaccaaaucauugggacaacugcagauccagauuaaggaccuccagaugcaacuggacgauaguacucagcuuaauagcgaccucaaagaacagguugccguggcugagcgcagaaacucccuguugcagucugaacuggaggauuuaaggucgcuacaagaacagacagagcggggccgucgccugagcgaggaggaacuccuugaagcaaccgagcgaaucaaucuguuuuauacacagaacacuucauugcugucccagaagaagaaacucgaggccgacgucgcuagaaugcaaaaggaagccgaggaagugguucaggagugccagaaugcagaagagaaagcgaagaaagccgcuauagaggccgcaaaccugagugaggaacuuaagaagaaacaagauaccauugcucacuuagaaaggacgcgggagaauauggaacagacaaucaccgaccugcagaagcgccucgccgaggcagagcagauggccuugauggguucuagaaaacaaauccagaagcuggaaagcagggugcgggagcuagaaggcgagcuggaaggggagauucgaagauccgcugaggcgcagcgcggagccaggcggcucgaacguuguauaaaagagcuuacuuaccaggcagaagaggauaagaagaaccugucaagaaugcaaacccagauggacaaauugcagcugaagguccagaauuauaaacaacagguagagguggcugaaacacaggccaaccaauaccucucuaaguauaaaaagcagcagcaugagcugaaugaaguuaaagagagggccgaaguggcagagagccaggucaacaaguuaaagaucaaagcucgcgaguucggcaagaaagugcaagaagaguga

SEQ ID NO: 59385 - RNA, 5820 nt, Artificial Sequence
  derived and/or modified sequence opt3 from MYH1__Homo_sapiens__NP_005954
augagcuccgacucugaaauggccauauucggagaagcugcacccuuucugagaaagucagaaagagaacggauugaggcccagaacaaaccuuucgaugcgaagaccaguguguuugucguugacccaaaagagagcuucgugaaggcuacuguacaaucccgcgaagggggaaaagugacugccaagacggaggcuggugccaccgucacagugaaggaugaccagguuuuuccgaugaaucccccuaaauacgauaagauugaagacauggcuaugaugacucaccuccaugagccagcagugcuuuauaaccugaaagaacgauacgccgcuuggaugaucuauaccuacucuggcuuguucugcgucacagugaaucccuauaagugguuaccuguauacaacgccgagguugugaccgcguaucgugggaaaaagagacaggaggcaccaccccacauauuuucgaucucagauaaugccuaccaguucaugcugacugacagggaaaaccaaagcauucuaaucacaggagagaguggcgcugguaagaccgucaauacgaaacgggugauacaguacuuugccacuaucgcagugaccggggaaaagaaaaaggaggaagucacauccggaaaaaugcagggcacucucgaggaucagauuaucucugcuaacccucugcuugaggccuucggcaaugcgaagaccguucgcaacgacaauagcuccagauuugggaaauucauuaggauccauuuuggaacaaccgguaagcuggccucagcagauauagaaacguauuugcucgagaagagucgggugacuuuccaacugaaagcugaacgcagcuaccacauuuucuaucagaucaugucuaacaagaaaccagaccugauugagaugcucuuaaucacaaccaauccguacgauuaugccuuuguaucccagggcgaaaucacugugcccucaauugacgaccaggaggagcugauggcuacagauagcgccauagaaauccuuggguucaccagugacgagcgagucucuauuuacaaguugacgggagcagugaugcauuauggcaacaugaaauuuaagcaaaagcagagagaagaacaggccgaaccugaugguaccgagguugcugacaaagcggcauaccugcaaaaucuaaacuccgccgaucuccugaaggcucuuuguuacccaagggugaaagucgggaacgaguaugugacaaagggacagacuguacagcagguuuacaaugccgugggcgcacuggccaaagcugucuaugacaagauguucuuguggauggugacccggaucaaccaacagcucgauacaaagcagccccgucaguacuuuauaggcguccuggacauugccggguucgaaaucuuugauuucaauagcuuagagcaacugugcaucaacuuuacuaaugaaaaacuccagcaguucuuuaaccaccacauguucgugcuugagcaggaggaauauaagaaagagggaauugaauggaccuuuaucgacuucgguauggaucuggcagcguguauugaguugauagaaaagccuaugggcaucuucucgauucuagaggaggaaugcauguuuccaaaagcuacagacaccucuuucaagaauaagcuguacgagcaacaucucgggaaauccaacaauuuucagaagcccaaaccggccaagggaaaaccugaagcacacuucucacugauccauuaugccggcacuguugacuacaacaucgcugguuggcuugauaagaauaaagacccccugaacgagacggugguaggguuguaccagaagagugccaugaagacacucgcacuguuauuugucggcgcuaccggagccgaagcggaggccggcgggggcaagaaggguggcaaaaagaaagggagcuccuuccagacugugucugcucuguuucgcgagaaucuaaacaagcucaugaccaaucugagaagcacacacccacacuucguuagguguauuauaccuaacgaaaccaagacucccggagcaauggagcaugaacuuguguugcaccaacugcggugcaacggcguccucgaggguauccgaauuugucgcaaaggguuuccaucaagaauccuguaugccgauuucaagcagagguacaaagugcuuaaugcuagugccauucccgaaggccaguuuaucgacuccaagaaagcaagcgagaagcuguugggaucuauagauaucgaccauacacaauauaaguucggccacacgaaaguauuuuucaaggcggggcuccugggauuacuggaggaaaugcgggaugagaaacuagcccagcucauuacccgcacucaggcuaugugcagagguuuccuggccaggguggaauaccagaagaugguugagcgucgggagucaaucuuuuguauucaauauaacguccgagcauucaugaaugugaaacauuggccuuggaugaaacuuuacuuuaagaucaaaccauugcugaagagugcugaaacagagaaagaaauggccaacaugaaggaggaguucgagaaaaccaaggaggaacucgcaaaaacagaggccaagagaaaggaacuggaggagaagauggugacuuuaaugcaggagaagaaugaccugcagcuucagguccaagcugaggcggauagcuuggccgacgcagaagagaggugcgaucagcucauaaaaaccaagauucagcuggaagcuaaaaucaaggagguuacggaacgcgccgaggacgaggaagagauuaacgccgaacuaaccgcuaagaaacggaagcuggaggaugaguguuccgaacucaaaaaggacaucgacgaucuggagcuuacauuggcaaaaguggaaaaggagaagcacgccacugaaaauaaagugaagaaccugaccgaggagauggcgggcuuagacgaaacaauagcuaaacucacuaaggagaaaaaggcccugcaggaagcacaccaacagacccuugaugaccugcaggccgaggaagauaagguaaauacguugacaaaagcuaagaucaaacucgagcaacaggucgacgaucuggaggggucucuagaacaggagaagaaaauuagaauggaccuggaaagggcaaagcgcaagcucgagggagaucugaaacuugcccaggaaucgaccauggacaucgagaacgauaagcaacaguuggacgagaaacugaagaaaaaggaauuugagaugagcggcuuacaguccaaaauugaagaugagcaggcgcucgguaugcaacugcagaagaagaucaaagagcuucaggcucgaauagaggaacuggaagaggaaauugaggccgagcgggcaucacgugccaaggcugaaaaacagagaagugaccuaucuagggagcucgaagagaucagcgaacgccuggaggaggccgggggcgcaacuuccgcucaaaucgaaaugaauaagaaacgggaggccgaguuccagaagaugagaagggacuuggaggaagcgacacugcagcaugaggccaccgcagcuacuuuacgaaagaaacacgccgauucaguggcugagcucggagaacagauugacaaccugcaacgcguuaagcagaaacuugagaaggagaaaagcgagaugaagauggagaucgaugaccuggcaucuaauauggaaaccguguccaaggccaaaggcaacuuggagaagaugugccgggcccucgaagaucagcugagugagauuaaaacaaaggaagaggagcaacagagacuaauaaaugaccugacggcucagagggcgcgucuucagaccgaaagcggggaguauucucgccaacucgaugaaaaagacacucuggucucccaguugucacggggaaagcaggcauuuacacagcaaaucgaggaacugaagagacaguuagaggaggaaauuaaagccaagagugcucucgcccaugcacugcagagcucgaggcacgauugcgaccuucugcgagagcaguacgaagaggaacaagaggccaaagcugaguugcagcgggcgauguccaaggccaacucugaaguggcacaguggcgcaccaaauacgagacagaugcuauccaaagaacugaagaacucgaggaagccaagaaaaagcuggcacagaggcuacaggacgccgaggaacacguugaggcugugaacgccaagugugcgagccuggagaaaaccaagcagcggcuucaaaaugagguagaggaccucaugauugaugucgaacgaacgaacgcagccugcgcugcccuggacaaaaagcagagaaauuucgauaaaaucuuggcugaguggaagcagaagugugaagagacacaugcagaauuagaggccucacagaaagagagucgcucccugucuaccgaacucuuuaagaucaaaaacgcuuaugaggaaagccuggaccaacuugagacucugaagagggaaaauaaaaacuugcagcaggagaucuccgaucuaaccgagcagauugccgaaggcgguaagcguauccacgagcuggaaaagauuaaaaagcaaguggagcaggagaaaucagaacuccaggcagcgcuggaggaagccgaggcuagccuugaacaugaggaggggaagaucuuacggauacagcuggaacucaaucaagugaaaagugaggucgacagaaagauugccgaaaaggaugaggaaaucgaccagaugaaaaggaaccacauccgcauuguugagucuaugcaguccacauuggaugcagagauacgaagcagaaaugacgcuauccggcugaagaaaaagauggaaggagaucucaacgagauggaaauucaacugaaucaugccaacaggauggcagccgaggcacuucgcaauuaccguaacacucaggcgauccugaaagacacccaguugcaccuagaugacgcccugagaucgcaggaagaccucaaggagcaauuagcaaugguggagcggagggcuaaucugcuucaggccgaaauugaggaacugcgcgccacacucgagcagacggagcgaucaagaaaaaucgcagaacaggaguugcuggaugcuucugaacggguacaacuccugcacacccagaacacaagucuuauaaacacaaagaagaaacuagagaccgacaucucccagauucagggcgaaauggaggauaucauucaagaggccaggaaugcggaagagaaggcuaaaaaggccaucacugacgcagccaugauggcugaagaacugaaaaaggaacaggauacaagcgcacauuuggagcgcaugaagaaaaacuuagagcagaccgugaaggaccugcaacacagacucgaugaagccgagcagcuggcgcuuaaagguggcaagaaacagauacagaagcuggaagcuaggguccgggagcucgaaggggagguggagucugaacaaaagcguaauguugaggccgugaaaggauugcgcaagcaugaacgaaaagucaaggagcugacguaucagacugaggaagacaggaaaaacauucuaaggcugcaggaucucguggacaaacuucaggcaaagguuaaaagcuacaagcggcaagccgaggaagcugaggaacaguccaaugugaaccugucaaaauuccgcagaauccagcacgaguuagaggaagccgaggaaagggcagauaucgcugagagucaggucaauaaguugcggguaaaaagccgagaagugcauaccaagauuaucucugaggaguga

SEQ ID NO: 59386 - RNA, 5826 nt, Artificial Sequence
  derived and/or modified sequence opt3 from MYH2__Homo_sapiens__NP_001093582
augagcuccgacucugagcuggcaguguucggagaagcugcacccuuucucagaaagucagagagagaacggaucgaggcacagaaccgcccuuucgaugcgaagaccagugucuuuguugcugaaccaaaggagagcuucgugaaagggacaauucagucccgagagggagguaagguaacugugaaaacggaaggcggggccacccuuacagucaaggacgaucagguguuuccgaugaaucccccuaaguacgacaaaauugaggauauggcaaugaugacucaucugcacgaaccagccguuuuguauaacuuaaaggagcguuacgcugcauggaugaucuauaccuacucuggacuguucugcgugacagucaaucccuauaaauggcuaccuguguacaagccagagguaguuaccgccuauagaggcaaaaagaggcaggaagcucccccucacauauuuucgaucucagacaacgccuaccaguucaugcucacugaucgggagaaucaaagcauucugaucacaggugaaaguggggcgggaaagaccgugaacacgaaacgcgucauacaguacuuugcaacuaucgccgugaccggcgagaagaaaaaggaagagauuacauccggcaaaauccaggggacucuugaggaccagauuaucucugcuaauccacuguuggaagccuucggaaacgcaaagaccgugagaaaugauaacagcuccagguuugguaaauucauacggauucauuuuggcacaaccgggaagcucgcuucagccgacaucgagacguaucugcuggaaaagagucgcgucguuuuccaacucaaagcggagcgaagcuaccacauuuucuaucagaucacuucuaauaagaaaccggaauuaaucgagaugcugcuuauuacaaccaaccccuacgauuauccuuuugugucccagggagagauaucaguagccagcaucgacgaucaggaagaguugauggcaacugacagugcuauugacauccugggcuucacaaaugaagagaaggugucuauauacaaacuaaccggugccgucaugcauuaugggaaccucaaguuuaagcaaaaacagagagaagaacaggcugagccagauggaacggaaguggccgacaaggcagccuaccugcaaucccuuaauagcgcugaucuguugaaagcgcucuguuaccccaggguuaaggugggcaacgaguaugucaccaaaggccagacaguggaacagguaucgaacgcaguuggggcccuggcuaaggccguguacgagaagauguucuuauggauggucgcacggauuaaucagcaacuggacacuaaacagccucgucaguauuuuaucggagugcucgauaucgccgguuucgagauuuuugacuucaacucucuugaacagcugugcaucaauuuuaccaacgagaaguugcaacaguucuuuaaucaccacauguucguccuagaacaggaggaauacaaaaaggagggcauugaguggacauuuauagauuucgggauggaccuggcugccuguaucgaacucauugagaaaccaaugggaaucuucuccauccuggaagaggaaugcauguuucccaaggcaacugauaccucauucaagaacaaacuuuaugaccagcaucugggcaagagugcgaauuuucaaaaaccgaaggugguuaaagguaaggcugaggcccacuucgcauugauucauuacgccggggugguagauuauaacauaacaggcuggcucgagaaaaauaaggacccucugaacgaaaccgucgugggauuauaccaaaagagcgcuaugaaaacucuggcccagcuauuuuccggcgcacagacggcugagggggaaggagccgguggcggggcgaagaaaggaggcaagaaaaaggguucuagcuuccaaacaguuucagcccucuuucgcgagaaucugaacaaacuuaugaccaauuugagaaguacucacccccacuucgugagguguaucauuccaaacgaaaccaaaacaccuggggcuauggagcaugagcugguccuccaccagcugcggugcaauggcgugcuugaaggaauccgaauuugucgcaagggcuuucccuccagaauccuguacgcagacuucaaacagagguauaagguauugaacgccagcgcuauaccagaggggcaauuuaucgauucuaaaaaggccucagaaaagcuccuggcaaguauugacaucgaucauacccaguacaaauucggacacacuaagguguuuuucaaagcggguuuacugggccuacucgaggagaugcgggacgauaagcuggcccagcuuauuacacgcacgcaggcuagaugcaggggguucuuggcccguguugaauaucaacggauggucgagcgaagagaagcaaucuuuuguauacaguacaacauuaggagcuucaugaaugugaaacauuggcccuggaugaagcuguuuuucaagaucaaaccucuccugaaguccgcugagaccgaaaaagagauggccacuaugaaggaggaauuucagaaaauuaaggacgaguuagcaaaaucugaagccaagcgcaaggagcuggaagagaaaauggugacacuuuugaaggagaaaaacgaucuccagcugcaaguccaggcugaagcggagggacuagccgacgcagaagaacggugcgaucagcugaucaagaccaaaauacagcucgaagcuaagaucaaggagguuacagagagagccgaagacgaggaagagauuaaugccgagcugacugcuaaaaagaggaaacuugaagaugaguguucggaauugaagaaagacaucgaugaccuggaguuaacccucgcaaagguggaaaaggagaaacacgccacggagaacaaggugaaaaaucugaccgaagagauggcgggccuugacgaaacaauugcuaagcugacuaaagagaagaaggccuugcaagaagcacaccagcagacccucgaugaccugcaagccgaggaggauaaaguaaacacacuaacuaaggcuaaaaucaagcuggaacagcaggucgacgaucucgaggguagccuggaacaggagaagaaacuucgcauggacuuggaacgagcaaaacggaaacuggagggggauuuaaagcucgcccaagaguccauaauggacauugaaaaugagaaacagcagcuggaugaaaaacuuaaaaagaaagaguucgagaucucaaaccugcagaguaagaucgaagacgagcaagcgcuaggcauucagcuccagaagaaaaucaaggaacugcaggcucguauugaggaauuggaggaggaaauagaggccgaaagagcaucuagggccaaagcugagaagcaacgcagcgaucugucccgggaauuagaggagaucucagaaagacucgaggaagccggaggcgcaaccagcgcucagauugagaugaauaaaaagagggaagccgaguuucagaagaugcgacgcgaccuggaggaagcgacgcuucagcaugaggccacagcagcuacccugcggaaaaagcacgccgauucuguggcugaauugggggagcaaaucgacaaccuccagagaguuaaacagaagcuggagaaagaaaaguccgagaugaagauggaaauugacgaucuagcaaguaauguggagacugucagcaaagccaagggaaaccuggagaagaugugcaggacacuugaggaccaacucucugagcugaaguccaaagaagaggaacagcagcguuugaucaaugaucugaccgcccagcgcggccgguuacaaacugagucaggugaguucaguagacagcucgacgagaaggaggcucuggugagccagcuuucgagggggaagcaggcguuuacccaacagauagaagaacugaaacgacaguuggaagaggaaaucaaggccaagaacgcccucgcucaugcccugcaguccucucggcacgauugcgaccuacugcgcgagcaauaugaggaggaacaggaaagcaaggcagagcuucagagagcccucucaaaagcuaauacagagguugcgcaauggaggacgaaguacgaaaccgaugccauucagcggacugaggaacuggaggaagccaagaagaaguuggcucagcgauuacaggccgcagaggagcacguggaagccguaaacgcuaaaugugccagucuggagaagacaaaacaaagacuccagaacgaagucgaggaccugaugcuugauguggaacgcaccaaugcggcaugcgccgcucuggacaagaaacagaggaacuucgauaagaucuuggccgaguggaagcagaaaugugaggaaacacaugcugagcuagaagcaucccaaaaggaggcccguucucugggaacugaacucuuuaaaauuaagaaugcuuaugaggagagccuggaccagcuugaaaccuuaaaacgggagaacaagaaucugcagcaggaaaucuccgaccucacggagcaaauagccgagggcgguaagaggauucacgaauuggagaaaaucaagaaacagguggaacaggagaagugcgaacugcaggcagcgcucgaggaggccgaggcuucacuggagcaugaagagggcaaaauccuuaggauucaacuggaauugaaccaggucaagagcgagguugaucgcaagauagccgagaaagacgaagagaucgaucagcuaaagcgaaaucacauuagaaucguggaaaguaugcaaucuacacuggacgcagagauucgguccaggaacgaugcuauccgccucaaaaagaaaauggaaggggacuuaaaugagauggagauacagcugaaccaugccaaucguauggcagccgaagcucuuagaaacuaccggaauacccagggaauccugaaggauacucagauucaccucgacgaugcguugaggagccaagaggaccugaaagaacagcucgccaugguagagcgccgagcaaaccugcuucaggcugagaucgaggaacuaagagccacccuggaacagacagagcggucgaggaagauugccgaacaagaguuguuagaugcaucagagcgcgugcagcugcuccacacucagaauaccucucugaucaacacaaagaagaaacuugaaacggacauaagucagaugcaaggcgagauggaagauauucugcaggaggcuagaaacgccgaagagaaagcgaagaaagcuaucaccgacgccgcaaugauggccgaggaacucaaaaaggagcaggacacuuccgcucauuuggaaaggaugaaaaagaauauggagcaaacagucaaagaucugcagcuacggcuggacgaagcagagcagcucgcccuuaaagggggcaagaagcagauccaaaagcuggaggcgcgugugcgcgaauuagagggcgaaguugagagcgagcagaaacgaaacgcugaagccgugaaggguuugagaaaacacgagaggcgggucaaggaacugaccuaccagacugaggaagaucgcaaaaauauucucagacugcaggaccuuguggauaagcugcaagcaaagguuaaaucuuauaagaggcaggccgaggaggcugaggaacagagcaacacaaaucucgccaaauuccggaaguugcagcaugaacuggaggaagcagaggagcgagcugacaucgccgaaucccaagugaacaaauuaagagucaagucacgcgagguacacaccaaggugauaagugaagaguga

SEQ ID NO: 59387 - RNA, 5823 nt, Artificial Sequence
  derived and/or modified sequence opt3 from MYH3__Homo_sapiens__XP_011522173
augagcuccgacaccgaaauggaaguguucggcaucgccgcucccuuucugagaaagucugagaaagaaaggauugaggcacagaaccaaccuuucgaugccaagacauacugcuuugucguugacucaaaagaagaguaugcgaaggggaaaauaaagaguagccaggauggaaaggugacuguggagacggaagacaaucggacccucguggucaaaccagaggauguguacgcuaugaacccgcccaaguucgaccgcaucgaagauauggccaugcuuacacaccugaaugagccugcaguuuuguauaacuuaaaagaccgauacacuuccuggaugauuuauaccuacucuggucuguuuugugugacagucaauccauauaagugguuacccguguacaacccugaggugguugaaggcuaccgugggaaaaagagacaggaggccccaccccauaucuucucgauuucagauaaugcuuaucaguuuaugcucaccgacagggaaaaccaaagcauccugauaacuggagagaguggcgcagguaagacagugaauaccaaacgggucauccaguacuucgccacgauugcugccacuggggaucuugcgaagaaaaaggacuccaaaaugaagggaacccuggaagaucagaucauuucugcaaacccuuugcucgaggccuuuggcaaugcuaaaacagugcgcaacgacaauagcuccagauucggcaaguuuaucaggauacacuucgggacuaccggaaagcuggccucagcagacauugagacauaucugcucgagaagagucgggugaccuuucaguuaaaggcugagcgcagcuaccauaucuucuaucaaauucugucuaacaaaaagccagaacuuaucgaguugcugcugaucacgacuaauccguacgauuaucccuucauuucccagggugaaauacucgucgccucaaucgacgaugcggaggagcugcuugccacagacagcgcaauugauauccugggcuuuaccccugaagagaaaaguggguuguacaagcucacuggagcuguuaugcacuacggcaacaugaaguucaaacagaagcagcgagaagaacaagccgaaccagacgguacagagguggcugauaaaaccgccuaucugaugggguuaaacucuuccgaccugcucaaggcacuuugcuuucccagaguaaaagugggaaaugaguacgucacgaagggccagaccguggaucagguucaucacgccgugaacgcucugagcaagucggucuaugaaaaauuguuccuguggauggugacaaggauaaaucaacagcuggacacuaagcucccucggcagcacuuuauuggcguacuggauaucgcgggguucgagaucuuugaauacaacucucuugagcagcuguguauuaauuucaccaacgagaaauugcaacaguuuuucaaucaucacauguuuguucucgaacaggaggaauauaagaaagagggaaucgaauggacauucauugacuuugguauggaccuggcagccugcauagaguuaaucgagaagccaaugggcauuuucuccauccuggaagaggaauguauguuccccaaggcuacugauaccucauuuaaaaacaagcuauacgaccagcaucucgggaaaaguaauaacuuccaaaagccgaaaguggucaagggacgugccgaggcacacuuuagccugauccacuaugccggcacaguggauuacuccgucucugguuggcuugagaaaaauaaggacccuuugaacgagaccgugguugggcuguaccaaaagagcucaaaucgccuccuggcucaucuuuaugccacuuucgcaacggcggaugcugacaguggcaaaaagaaaguggccaagaaaaagggauccagcuuucagacaguaucugcacuguucagagagaacuugaauaagcucaugucaaaccugaggaccacucacccccauuuuguccggugcauuauaccaaacgaaaccaaaacaccuggcgccauggagcacaguuuagugcugcaucagcuacgauguaaugggguucucgaaggaauccgcauuugcagaaaggguuuccccaacaggauccuguacggcgauuuuaaacaacgguaucgcgugcuuaaugcuagcgccauuccagaggggcaguucaucgacuccaagaaagcaugugaaaaguugcuggcuucuauagauaucgaccacacccaguacaaguuuggacacacuaaagucuucuuuaaggccggccuccuggguacauuagaggagaugagagaugacaggcuggcgaaacuuauuacgcguacccaggccgugugccggggguucuugaugcgaguagaguuccaaaagauggugcagagaagggagucgaucuuuuguauucaguauaacauccgcagcuucaugaauguuaaacauuggcccuggaugaagcucuuuuucaagauaaaaccucugcuaaaguccgcugaaacugagaaagagauggcaacaaugaaggaagaguuucagaaaaccaaggaugaacuggccaaaucagaggcuaagcggaaggaacucgaggagaaacuggucacacuugugcaggaaaagaacgacuugcagcuacaggugcaagccgagagugaaaauuuacucgacgcagaggaaagaugcgaucagcugauuaaagcgaaguuccagcuugaggccaaaaucaaggaggucacugaaagggcugaggacgaagaggaaauuaacgccgagcugaccgcaaagaaacgcaaguuggaggaugaaugcucugagcucaaaaaggacaucgaugaccuggaacuaacgcuggcuaaaguugagaaggagaagcacgccaccgaaaauaaagugaagaaccucacagaggaacugagcggccuugaugagacuauagcaaaauugacccgagaaaagaaagcccugcaggaggcucaucaacaggcguuagacgaucuccaggccgaggaagacaagguaaauucccugaacaagacaaaaucaaaacuugagcagcaaguagaagaucuggagagcucucuagaacaggagaaaaagcuccgggucgaccuggagcguaauaaaagaaaguuggaaggagaucugaaguuagcacaggaguccauccucgaccuggaaaacgacaaacaacagcuugaugagaggcugaagaaaaaggacuuugaauacugucaguugcagaguaaaguggaggaugagcaaacucucggccugcaguuccagaagaaaauuaaggaacuacaggcucgcaucgaggaacuggaggaggaaauugaggccgaacgggccaccagagcuaagacggagaaacaaaggagcgacuaugcacgagaacuugaggagcucucugaacgccuggaggaagccgggggaguuacauccacccagaucgaguugaauaagaaacgggaagcggaguuucugaaguuaagaagggaucucgaggaagcuacucugcagcacgaggccaugguggcagcccuucguaaaaagcacgcugacucagucgcagaacugggugagcagauagauaacuugcaacgcgugaagcagaaacucgaaaaggagaaaagugaguucaagcuggaaauugacgaucuaagcucguccauggagucuguuagcaaaucaaaggccaaccuggaaaagaucugccggacacuugaggaccagcucagugaggcgagaggcaaaaaugaagagauccagaggucccugucugaauugaccacucaaaagagccgauuacagaccgaggcuggggaacugucccggcagcucgaggagaaagaaucaauugugagccaacugagucgcucuaagcaggccuuuacacagcagacggaggaacuuaaaagacaacuggaggaagagaacaaggcaaagaaugccuuggcucaugcccuacaguccagcaggcacgauugugaccugcuccgggagcaguacgaagaggaacaggagggaaaagcagaacugcaacgagcucuuucgaaggccaacucagagguagcgcaguggagaaccaaauacgagacugacgccauccagcgcacagaagaguuagaagaggcaaagaaaaagcuggcucagaggcuccaagauucugaggaacaggucgaggccgugaaugcuaaaugcgcaaguuuggaaaagaccaagcagcgucugcaaggcgagguggaagaccucauggucgauguugagcgggccaacucccuggccgcugcgcuugacaaaaagcagagaaauuucgauaaagugcuggcagaguggaagacaaaaugugaagagagccaggccgaauuggaggcuucucuaaaggaaagcaggucccugucaacugaacucuucaagcugaaaaacgccuaugaggaagcacuagaccagcuugagaccguaaagcgcgaaaauaaaaaccuggagcaagaaauugccgaucucacggagcagauagcugagaaugguaagacaauccaugaauuggagaaaagucgaaagcagauugaacuggagaaggcggacauccagcucgcccuggaggaagcagaggcugcccuugaacacgaggaagcaaaaauucuaagaauccaacuggaguugacccagguaaagagcgagauagaucggaaaaucgccgaaaaggacgaggaaauugagcaguuaaaaaggaacuaccagcgcacugucgaaaccaugcaaucugcucuggaugccgaggugcguuccagaaaugaggcgauccggcucaagaagaaaauggaaggggaccugaacgagauugaaauccagcuuucacaugcaaauaggcaggccgcugagacacugaagcaccuccgcaguguucagggccaauugaaagauacucagcugcaccuagacgacgcccugcgaggacaggaagaucucaaggagcaacuugcuauaguggagagacgggcaaaccuguuacaggccgaagucgaggaauugagggcuacccuggagcagacagagcgcgccagaaaacucgcagaacaggagcugcuugacagcaacgaaagggugcaacugcuccauacgcagaauaccuccuugauucacacuaagaaaaagcuggagacagauuuaaugcagcuacagucugaaguugaggacgcgucgcgggaugcccguaacgcugaggaaaaggccaaaaaggcaaucaccgacgcugccaugauggcagaggaacugaaaaaggagcaagauacuagcgcccaucucgaacgcaugaaaaagaaucuugagcagacagugaaggaccugcagcaccgauuggaugaggcugaacagcuggcgcucaaaggcgggaagaaacaaauccagaagcuggagaccagaauuagggaacuugaguuugaacucgagggagagcagaaaaagaacacggaaucagucaagggccugcggaaauaugagcgcagaguaaaggaauugacuuaccaauccgaggaggacaggaaaaaugugcugcgguuacaggaucuaguugacaagcuacaggugaaagucaagaguuauaagcgacaggccgaagaggcagaugaacaagcuaacgcccaucucaccaaauucagaaaggcccagcacgagcuugaagaggcagaggaacgcgcugacauagccgagucucaggugaauaaacugagggcgaagacacgggacuuuaccagcucccguaugguagugcacgaaucagaggaauga

SEQ ID NO: 59388 - RNA, 5820 nt, Artificial Sequence
  derived and/or modified sequence opt3 from MYH4__Homo_sapiens__NP_060003
augagcuccgacucugagauggcaaucuucggagaagcugcacccuuucugagaaagucagagaaagaaaggauugaggcccaaaacaagccuuucgaugcgaaaaccaguguguuugucguugacccaaaggaaagcuacgugaaagcuauuguacaaucccgggaagggggaaaggugacagccaagacugaggccggugcaacggucaccgugaaagaagaucaaguuuucucuaugaauccgcccaaguaugacaaaaucgaggauauggcuaugaugacacaccuccaugaaccugcagugcuuuacaaccugaaggagcgcuaugccgcuuggaugauuuacacuuauucgggcuuguuuugcgucaccgugaauccauacaaaugguuacccguauauaacccugagguugugacagccuaccgagggaagaagcgucaggaagcgccaccccacaucuucucaauuagcgacaaugcauaccaguuuaugcugaccgauagagagaaccaaaguaucuuaauaacuggagaauccggcgccgguaaaacagucaauaccaagagggugauccaguauuucgcuacgauugccgugacuggggagaaaaagaaagaagaaccugcaucuggaaagaugcagggcacccucgaggaccagaucauuagcgcuaacccacugcuugaagccuuuggcaaugcgaaaacaguccggaacgauaauuccucacgcuucgggaaguuuaucagaauacauuucggagccacugguaagcuggcaagugcugacauugagaccuacuugcucgaaaagagcaggguuacauuucaacugaaggccgagcggucuuaucacaucuucuaccagauucuguccaacaaaaagccggaacucaucgagauguuacugaucaccacgaaucccuaugauuucgcuuuugugucacagggcgagauuacuguaccuagcauagacgaucaggaagaacuuauggccacagacagugcaguggacaucuugggguucaccgccgaugaaaaagucgcuauuuacaagcugacuggagcggugaugcauuauggcaacaugaaguuuaaacaaaagcagcgcgaggaacaggcagagccagacgguacagagguugccgauaaagcugccuaccuaaccucucucaauuccgcagaccugcuuaagagccuguguuacccccgagugaaagucgggaacgaguucgugacgaagggacaaaccguacagcagguuuauaacgccgugggcgcuuuggccaaggcaaucuacgagaaaauguuucucuggauggucacaagaauaaaucagcaacuggauacuaagcagccuaggcaguauuucauuggcguguuagacaucgcgggguuugaaaucuucgauuuuaacucgcuggagcagcucugcauuaauuucaccaacgagaaacuucaacaguuuuucaaucaccacauguuuguccuggaacaggaggaauacaagaaagagggaaucgaaugggaguucauugacuucgguauggauuuggcugccuguauagagcuaaucgaaaagccaaugggcauauuuucuauccuggaggaagagugcauguuccccaaggcaacagacacuuccuuuaaaaacaagcucuaugaacagcaucuggggaaaucaaauaacuuccaaaagccgaaaccugccaagggaaaacccgaggcucacuuuagucuugugcauuacgccggcaccguugauuauaauaucgcagguuggcuggacaagaacaaggacccauugaaugagacagugguagggcucuaccagaaaagcgcuaugaagacccuggccuucuuauuuuccggcgcgcagacugccgaagcugagggaggcgggggcaaaaaggguggcaaaaagaaggggucuagcuuccagacggucucagcacuguuucgggaaaaccuaaauaaacucaugacaaaccugcguaguacccacccucacuucgugcgcuguauuauacccaaugagacuaagaccccaggagccauggaacaugagcuuguuuugcaccaacugagaugcaacggcgugcucgaggguaucaggauuugucggaaaggguuucccucccgaauccuguacgcugauuucaagcagcgcuauaaaguccuuaacgccagcgcaauuccugaaggccaguuuaucgacucuaagaaggcgucagagaaacuguugggaaguauagaaaucgaucauacacaauacaaguucggccacaccaaaguguucuuuaaggccgggcuccugggaacuuuagaggagaugagagacgaaaaacuggcucagcuaauuacaaggacgcaggccaucugccgggguuuccucaugcgcguagaguuuagaaagaugauggaaaggcgugagagcauuuucuguauccaguauaauauacgggcauuuaugaacgugaagcauuggccauggaugaaacuguacuucaagauuaaaccgcuuuugaaguccgcugaaaccgagaaagagauggccaauaugaaggaagaguuugagaaaacuaaggaggaacuggcaaagacagaggccaaacgaaaggagcucgaagagaaaaugguuacccugaugcaagaaaagaacgauuuacagcugcagguccaggcugaggcggacgcccuugcagaugcugaagagagaugcgaccaauugaucaaaacaaagauucagcucgaggccaagaucaaagaagugacugagagggccgaagaugaggaggaaauaaaugcugagcugaccgcaaagaaacgcaagcuagaagacgaguguucugaacugaaaaaggauaucgacgaucucgagcugacgcuugccaagguggagaaagaaaagcacgcgaccgagaacaaagucaagaauuugacagaagagauggcuggccuggacgaaacuauugccaaauuaaccaaggagaagaaagcacuccaggaggcccaccagcaaacacuggacgaucuucagauggaagaggacaagguuaacacucugaccaaagcuaagacgaaauuggaacagcaaguggaugaccucgaggggucgcuggaacaggagaagaagcuaugcauggaucuggagcgggcaaaaagaaagcucgaaggagaccugaaacuugcccaggagagcacaauggauaccgaaaaugacaagcagcaauugaacgagaaacugaagaaaaaggaguucgaaauguccaauuuacagggcaagaucgaggaugaacaggcgcucgcuauucagcugcagaaaaagaucaaagagcuucaggccaggauagaggaacuggaggaagagauugaagcagagcgcgccucacgagcuaaggccgaaaaacagcggagugaccuaucucgugagcucgaggaaaucagcgagagacuggaagaggccgguggggcuacuuccgcccagaucgaaaugaacaagaagagggaggcggaguuucagaaaaugcgccgggauuuggaagagucaacacugcagcaugaagccaccgcagcugccuuaagaaagaaacacgcugacagcguggcagagcucggcgagcagauugauucucugcagaggguaaagcaaaaacuugaaaaggagaaguccgaacugaaaauggagaucaaugacuuggccaguaacauggaaacugucagcaaggccaaagcuaauuucgagaagaugugccgaacccucgaggaccagcugucugaaauuaaaacaaaggaggaggagcaacaacgccuaauaaacgaacuguccgcgcagaaggcacggcuucauacggagucaggagaguuuaguagacagcucgaugaaaaagacgccauggugagccagcugucgaggggcaagcaggcuuucacccagcagaucgaggaauugaaacgucagcuggaggaagagacuaaggccaaauccacauuagcacacgcccuccaaucugcucgccacgauugugaccugcuucgggagcaguaugaagaggaacaggaggcgaaggccgagcugcagagagggaugagcaaagcaaacucagaaguugcucaauggaggaccaaguacgagacagaugccauucagcgaacugaagaguuggaagaggcaaagaaaaagcucgcccagcggcugcaagacgcugaggaacauguggaggccgucaauaguaaaugcgcgucccuagaaaagaccaaacagcgccugcagaacgagguggaagaucuuaugaucgacguugagagaucuaaugcagccuguauugcucucgauaagaagcagaggaacuucgacaaagugcuggccgaguggaagcaaaaauaugaagagacgcaggcugaauuggaggcaagccagaaggaaucccggucauuaagcacagagcuguuuaaaguaaagaaugccuacgaggaaagucucgaucaccuggagacccuuaagcgagaaaacaaaaaucugcagcaagagaucucugacuugacugagcagauagcugaaggaggcaagcauauccacgagcuagaaaaagucaagaaacagcuggaccaugagaaguccgaacuccagaccagccuggaggaggccgaagcaucgcuugagcacgaagaggguaagauuuuaagaauccaacuggaacucaaccaggugaaaucagagauugaucgcaagaucgcggagaaagacgaagaguuggaucagcugaagaggaaucaccuccguguggucgaaucuaugcagaguacacuggacgccgagauacgguccagaaacgaugcucuuaggauuaaaaagaaaauggaaggggaccugaaugagauggagauccaauugaaccaugccaaucgccaggcagcugaagcccuacgaaaccugagaaauacucagggaauccucaaggauacccaauuacaccuggacgaugcaauucggggccaggacgaucuuaaggagcagcuggccaugguugaaaggcgcgcuaaccucaugcaggcggagguggaggaauugcgugccagccuggagagaacagaacgggguaggaaaauggcagagcaagaacuccuggacgcuucugagcgcguacagcuucuacauacgcagaacaccagccugauaaauacuaagaaaaaguuggagacagauaucucccagauucaaggcgaaauggaggacaucgugcaggaagcccgaaacgccgaggaaaaagcaaagaaggcuauuaccgacgccgcgaugauggcugaggagcugaaaaaggaacaggauacuucagcccaccuagagagaaugaaaaagaauauggaacagacagucaaagaccuccaacugcggcuugaugaggcagaacagcuggcccucaaagggggaaagaaacagauccaaaaguuggaggcuagggugcgcgagcuggaaagugagguugaaagcgagcagaaacauaacguggaggcagucaagggccuaagaaaacacgaaaggcgggugaaggagcugaccuaccagacggaagaggaccguaagaauauacuccgccuucaggaucugguugacaaauuacaaacuaaggugaaagccuauaagcgacaggcggaagaggcugaggaacagucuaacgucaauuuggccaaauucagaaagcugcagcacgagcucgaagaggcaaaggaaagggccgauaucgcugagucccaaguaaacaaacugcgggugaagucacgcgagguucauaccaaagugauuagugaagaguga

SEQ ID NO: 59389 - RNA, 5820 nt, Artificial Sequence
  derived and/or modified sequence opt3 from MYH6__Homo_sapiens__NP_002462
augaccgacgcccagauggcugauuucggcgcagccgcgcaguaccugcgaaagagcgagaaagaaaggcucgaggcucagacucggcccuuugacauccgcacugaaugcuucgugccugaugacaaggaggaauuugucaaagccaagauucuuucccgagaagggggaaaaguuauagcagagacggaaaacgguaagaccgugacagugaaggaggaucaggugcugcagcaaaauccaccgaaauucgacaagaucgaagauauggccauguugacauuuuuacacgagcccgcuguccuguucaacuugaaagagcguuaugcagccuggaugauuuacaccuauucuggccucuuuugugugacaguuaauccuuacaaguggcugccaguguauaacgcugaagucguggccgcguaccgggggaaaaagaggucagaggcacccccucauaucuucaguauuagcgacaaugccuaucaguacaugcuuaccgaucgggaaaaccaguccauccugauaacuggagagucuggcgcugguaagacaguaaauaccaaacgcguuauccaguacuuugccucgauugcagcuaucggggacagaggaaagaaagauaacgccaaugcgaacaagggcacguuggaagaccaaauuauccaggccaauccagcacucgaggcuuucggcaacgccaaaacugugaggaaugauaacucaagccgguuugggaaguucauacgcauucacuuuggagcuaccgguaaacuggccagugcagacaucgagacauaucugcucgaaaagucccgagucauuuuccaguuaaaggccgagagaaauuaccauaucuucuaucagauccugucuaacaaaaagcccgaacuuuuggacaugcugcuggugacuaacaauccuuacgauuaugcuuuugugagccaaggcgaggucuccguugcgucaauugacgauagugaagaacucauggcaaccgacagcgccuucgaugugcugggguuuacaucugaggaaaaagcuggaguauacaaacuuaccggcgccauaaugcacuaugguaacaugaaauucaagcagaagcagagggaggaacaagcagagccagacgggacggaagaugccgacaaauccgcuuaccugaugggacuaaauucagccgaucuccugaagggcuuaugccauccgcgggugaaagucggcaacgaguacgugacuaaggggcagagcguucaacagguguauuacaguaucggagcacuggcgaaagcugucuaugagaagauguuuaauuggauggugacacguauuaacgccacccucgaaacuaagcaaccccgccaguacuucaucgguguacuugacauagcaggcuuugagauuuucgauuuuaauucuuucgaacagcuguguaucaacuuuacaaaugagaaauugcagcaauucuuuaaccaccacauguucguucuagagcaggaagaguauaagaaagaagggaucgaguggaccuucauugacuuuggaauggaccugcaggccugcaucgaucucauugaaaagccuaugggcauaauguccauccuggaggaggaauguauguucccaaaagcuacggacaugaccuuuaaggccaaacuuuacgauaaucaucuggguaaaagcaacaauuuccagaagcccagaaacauuaaagggaagcaagaggcacacuuuucguugauccauuaugcuggcacaguggacuacaauauccucggauggcuggagaagaacaaggauccuuuaaacgagacugucguggcccuguaccagaaaucuucccuaaagcucauggcgacccuguucucaaguuaugccacagcugacacuggcgauagcgggaaguccaaaggagguaagaaaaagggcucuagcuuucagaccgucucagcacuucacagggaaaauuugaacaaacugaugacaaaucuccggaccacucacccacauuucgugcgaugcauuauacccaacgagcgcaaggccccggggguuauggacaauccucuggugaugcaccagcuuagauguaacggaguacuggagggcaucaggauuugccggaaggguuuucccaaucgcaucuuguacggggauuucagacaaagguaucguauucucaacccagucgcuaucccugaaggccaguuuauagacagucggaaaggaacggagaagcuguuauccagccuggauaucgaccauaaucaguacaaauucggccacacaaagguguuuuucaaagccgggcuacucggacugcuugaagagaugcgagaugaaagauugucuaggauuaucacccgcaugcaagcacaggcgcggggucagcugaugagaauugaguucaagaagaucguugagaggcgcgacgcccuccuggugauacaguggaacauucgagcuuuuaugggcgucaaaaauuggcccuggaugaaguuauauuucaaaaucaagccacugcuuaaaucagccgaaacugagaaggaaauggcaaccaugaaggaggaguuugggcggauuaaagaaacauuggagaagagugaagcucguagaaaagagcucgaagagaagauggugagccugcuacaagagaaaaacgaccugcagcuccagguacaggccgaacaagauaaucugaacgacgcagaggaaaggugugaucagcuuaucaagaauaaaauacaguuggaggccaaggugaaggaaaugaacgagcgccuggaggacgaagaggaaaugaacgcugaguuaaccgcgaaaaagcggaaacucgaagaugagugcuccgagcugaagaaagacaucgaugaccuugaacugacuuuggccaagguugagaaggaaaaacaugcaacagagaauaaggucaaaaaccucacggaggaaauggcuggacuggaugagauuaucgccaagcuaaccaaagaaaagaaggcccugcaggaggcucaccaacaggcacucgacgaucuacagguggaagaggacaaaguaaauucucuuagcaagucgaaagucaaguuggagcaacagguugaugaccuggaaggcuccuuagagcaggagaagaaggugagaauggaccucgagagggccaagcgaaaacuggaaggugaucuuaagcugacucaggagucaauuauggaccuagagaacgauaaacuccaacuggaagagaaguugaaaaagaaggaguucgacaucaaucagcagaacaguaaaauagaggaugaacaggugcuggcguuacaacuccagaagaaacugaaggagaaucaggcucgcauugaggaacuugaggaagaacuggaggccgaacggacagcaagagccaaaguagagaaguugaggucugaccucagccgugaacuggaggaaaucuccgagcgccuagaggaagcugggggcgcaaccucaguccagaucgagaugaacaaaaagcgggaagccgaguuucaaaagaugagaagggaucuggaagaggcgacacuucagcacgaggcuacugccgcagcccuccggaaaaagcaugcugacagcguggccgaacugggagagcagauugauaauuugcagagaguuaaacaaaagcuggaaaaagagaagucugaguucaaguuagagcucgacgaugugaccuccaacauggagcagaucauuaaagcaaaggcuaaucuggaaaaagucagucgcacgcuugaggaccaggccaacgaauacagagugaagcuggaggaggcgcaaaggagcuugaaugacuuuaccacacagcgggccaaacuccagacugaaaacggcgagcuggcacgacagcuagaagagaaggaagcucugauaucucaacuuaccagagggaagcucuccuauacacagcagauggaggaucugaaacgccaguuggaggaagagggaaaggccaaaaaugcuuuagcacacgcccugcaaucagccaggcaugacugugaucuccugcgugaacaguacgaggaagagacugaggcuaaggcggaacuucagcggguucugaguaaagcaaacagcgagguggcccaguggagaaccaaguacgaaacggacgcuauccaaaggacagaggaauuggaggaggccaagaaaaagcuagcacagcgccugcaggaugccgaagaggcuguagaagcggucaacgccaaaugcucgucccucgagaagaccaaacaccgacugcaaaaugagauugaagaccuuaugguggauguggagagaucuaacgcagcugccgcagccuuagacaagaaacagcggaauuucgauaagauccuggcugaauggaagcagaaauaugaggaaagccagucagagcucgagaguucccaaaaggaagccaggucuuugagcacugagcuguuuaaacucaagaacgcguacgaagagucccuggaacaccuugagacauucaaacgcgagaauaagaaccugcaggaagagauuucagacuugaccgaacagcuaggcgagggugggaagaauguccaugaacuggagaaaguucguaagcagcucgagguggaaaaauuagagcugcaaagcgcacuugaagaggccgaggcuagucuggaacacgaggaaggaaagauccucagagcccaguuggaguuuaaccagauaaaagcugaaaucgagcggaagcuggcagagaaggaugaagagauggaacaggccaaaaggaaucaucaacgcguaguggacucucuccagacuucccuggaugcugagacccgaagcagaaacgaaguccuucgggugaagaaaaagauggagggcgaccuaaaugagauggaaauucagcugucgcacgccaacaggauggcagcggaggcccagaaacaaguuaagucauugcagucuuuacugaaggacacacagauccaacucgaugacgcugugcgcgccaaugaugaccugaaagaaaacauugcaaucgucgagagaaggaauaaccuucugcaggcugaacucgaggaguugcgggccgugguugaacagacggagcguagucgcaagcuggcagaacaggagcuaauagagaccuccgaacgagugcaacugcuccauagccagaauacuucucuuauuaaccagaaaaagaaaauggagagcgaucugacacaguuacaauccgaagucgaggaagccguacaggagugcagaaacgcugaggaaaaggcgaaaaaggccaucaccgacgcagcuaugauggccgaggaauugaagaaagagcaggauacaucagcccaccuggaaaggaugaagaaaaauauggagcagacuaucaaggaccuccaacaccggcuggaugaggcagaacagauugcucuuaaagguggcaagaagcagcugcaaaaacucgaggcccgcgugagagaauuggagggggaacuggaggcggagcagaagaggaacgcugaaaguguuaaaggaaugagaaagagcgagcgaagaauaaaagaauuaaccuaucagacggaggaggacaagaagaaucuacugcgccuccaggaucuuguggacaaacugcaauugaaggucaaagccuacaagaggcaggcagaagaggccgaagaacaggcuaacacaaaucugucuaaauuccggaaggugcagcaugaacucgaugaggcagaggaacgugccgacaucgcggagucccaaguaaacaagcugagagcuaaaucaagggacauuggcgccaagcagaaaaugcacgaugaagaguga
